United States Patent 11,078,247 (RNA ENCODING A THERAPEUTIC PROTEIN) - sequence listing, part 44

SEQ ID NO: 73549 - RNA, 1449 nt, Artificial Sequence
  derived and/or modified sequence opt5 from PDE7A__Homo_sapiens__NP_001229247
auggaggugugcuaccagcugcccguccucccucuggacagaccgguuccccaacacgugcuuagccggcgcggcgccaucuccuucucuagcuccucugcucuguuuggguguccuaaccccagacagcucagccagcggcgcggagccauuuccuaugauucuagcgaccagaccgcgcuguacaucagaaugcuuggcgaugugcggguccgcuccagagcuggguucgaaagcgagcggcgcggaucucauccuuauauugacuuuagaaucuuccacucccaaagcgaaauugaggugucuguuuccgcccggaauauccgcagacugcucagcuuucagcgguaccugagaucuucccgcuucuuucggggcacagccgugagcaacucccugaauauccucgaugacgauuauaacgggcaggcuaagugcaugcuggaaaaagucggaaauuggaacuucgacauuuuucuuuucgauagacugacgaauggcaacucucucgugagccugaccuuucaucuuuucucccugcacggccucaucgaguacuuucaucuggacaugaugaagcugcgccgguuccucguuaugauucaggaggauuaucacagccaaaaucccuaccacaacgccgugcaugcugccgacgucacacaggcgaugcacuguuaccugaaagaaccuaaacuugccaauucugugaccccgugggauauccugcucucccugauugcugccgcuacacaugaccuugaccaccccggggugaaccagccuuuccugaucaaaaccaaucacuaucucgccacacuguacaagaacaccagcguccuggagaaucaucacuggagaucugcgguuggacuccugcgcgaaagcggccucuuuucccaucugccccucgagucucggcagcaaauggagacgcagauuggggcccugauccuugcuaccgauaucagcagacagaacgaauaucugucccucuuccgcagccaccuggaccggggagaucugugccucgaggacacaagacaucgccaccuggugcuucaaauggcccugaagugugcugauauuugcaacccuugucggaccugggaacucucuaaacagugguccgagaaggugacagaagaguuuuuccaccagggcgacaucgagaaaaaguaccaucugggggucagcccccugugcgauagacacaccgaaucuauugccaauauccagauuggauuuaugacguaucuuguggagccgcuuuucacagaaugggcccgcuuuuccaacacccggcugagccaaacaaugcugggccauguuggccucaauaaggcuuccuggaaggggcugcagagagagcagucuagcuccgaagacaccgaugcggccuucgagcuuaacucucagcugcucccucaagagaaucggcugagcuga

SEQ ID NO: 73550 - RNA, 1353 nt, Artificial Sequence
  derived and/or modified sequence opt5 from PDE7B__Homo_sapiens__NP_061818
augagcugccugaugguggagagauguggcgaaauccucuucgagaaccccgaccagaaugccaagugcgucuguaugcugggggauauucggcuucgcggacaaaccggcguuagagcugaacggcgcggguccuacccuuuuaucgacuucagacugcucaacucuacaacguauagcggagagauuggcaccaaaaagaaagugaagcggcugcuuuccuuucagcgcuacuuccacgccucuagacugcuccgggggaucauuccgcaggcgccccugcaucugcucgaugaagacuaucugggacaggcucgccacaugcuuagcaaagugggcaugugggauuuugacaucuuccuguuugauagacucacaaauggcaacucccuggucacccuucugugccaucucuucaauacacacgggcugauccaucacuuuaagcuggacauggugacccuccaccgguuccugguuauggugcaagaggauuaccauucucagaacccuuaucacaaugccguccaugccgcugacgugacacaggccaugcacuguuaccuuaaggagcccaaacuggcuagcuuucucaccccucuggauauuaugcuuggacugcucgccgcggccgcucacgacguugaucaucccggcgugaaccagccuuuccugaucaagacgaaucaccaucuggccaaccucuaucaaaauauguccguccuggaaaaccaccauuggcgcagcaccauugggaugcuuagagagucucggcugcucgcucaucugccgaaagaaaugacacaggacaucgagcagcagcuuggaucccugauucucgccaccgacaucaaucgccaaaacgaguuucugacaagacugaaggcgcaccuccacaauaaagaucugcggcuugaagacgcccaggauagacacuucaugcugcagauugcucucaagugcgccgacaucuguaaccccugccgcaucugggagaugagcaagcaauggucugaacgggugugugaggaguucuacagacagggcgaacuggagcagaaauuugaacuggagauuuccccucuuugcaaccagcaaaaggauagcauccccucuauucagaucggguucauguccuacauuguggaaccucucuuucgcgagugggcucauuucaccggaaauagcacgcuguccgaaaacaugcugggccaccucgcccacaauaaagcccaguggaagucucugcuuccccggcagcauagaagccgcggcuccagcgggucuggaccggaccacgaucaugcuggccaagggacagaguccgaggaacaggagggagacagcccuuga

SEQ ID NO: 73551 - RNA, 2490 nt, Artificial Sequence
  derived and/or modified sequence opt5 from PDE8A__Homo_sapiens__NP_002596
augggcugcgcccccagcauccacauuuccgagagacugguggcugaagacgccccuucuccggcggcucccccucucagcuccgggggaccccggcugccucagggccaaaagaccgccgcccuuccccgcacaagaggggcuggacugcucgagucugaacugcgggauggcagcgggaaaaaggucgccguugcugacgugcaguucggaccuaugcgcuuucaucaggaucagcuucaagugcugcucgucuucacgaaagaggacaaccaguguaauggcuuuugcagagccugugaaaaggcgggcuucaaaugcaccgugacaaaggaggcccaggcuguucuggccuguuuucuggauaagcaccaugacaucauuaucauugaucaccggaacccgcgccagcucgacgcugaggcccugugcagauccauccggucuagcaaacuuuccgaaaauaccgugaucgucggggugguucgcagaguggaucgggaggaacugagcgucaugcccuucauuucugcgggauuuacacgcagauacguggagaacccuaauaucauggccuguuauaacgagcuccugcaacuugaguucggcgaagugcggucccagcugaagcuccgcgcuugcaauagcgucuuuaccgcccuggaaaacucugaggacgcuauugaaaucacauccgaggauagauucauucaguacgccaaucccgccuuugagaccacgaugggguaucagagcggagaacugaucggcaaagagcucggggaaguuccuauuaacgagaagaaagcugaccugcuugauaccaucaauucuuguauccggauuggaaaggaauggcaaggcaucuacuaugcgaagaaaaagaacggcgacaauauucagcagaacgugaaaaucauucccgugaucgggcaaggaggcaagaucagacauuacgucuccauuauccgcgugugcaaugggaacaacaaagccgagaagauuagcgaguguguucaguccgacacacacaccgauaaucagacaggaaaacacaaggaccggagaaagggcucucuggaugugaaagcugucgccagccgcgccaccgaaguguccagccagcggagacauucuuccauggcucgcauccacagcaugacgauugaggccccgaucacaaagguuaucaacauuaucaaugcggcucaagaaucuagcccuaugcccgugaccgaggcccucgaccggguccuggaaauucuuagaacaaccgagcuguauuccccucaguucggggccaaagaugacgauccccaugcuaacgaccucgugggaggccugaugucugauggccugcgccggcucagcgggaaugaguacguccuguccaccaagaacacacagauggugagcucuaauaucauuacgcccaucucccuugacgauguuccuccgagaauugcccgcgcuauggaaaacgaggaauacugggacuuugacaucuucgagcuggaggccgcgacccacaaucggccccucaucuaucugggacuuaaaauguucgccagauuuggcauuugcgaguuccugcacugcagcgaaucuacacuccgguccuggcugcagaucauugaagcuaacuaccauagcuccaauccuuaucacaacucuacccauagcgccgaugugcugcacgcuacagccuacuuucucuccaaggagcgcaucaaggaaacccuggaccccauugaugaggucgcggcccuuaucgcugccacgauccaugacguggaucacccugggagaacaaauucuuuccuguguaacgcuggaagcgagcucgccauucuguauaaugacaccgccguucuggaaucccaccaugcugcgcuugccuuucaacucaccacaggcgaugacaaaugcaacaucuucaagaacauggagcggaaugauuacagaacccugcgccaggggauuaucgacauggugcuggcuacagaaaugacgaaacacuuugagcaugucaacaaguucgugaauagcauuaacaaaccccucgccacccuggaagagaauggcgagacagauaagaaccaggaagugaucaauaccaugcuucggacaccggagaacagaacccugaucaagcgcaugcucauuaaaugugccgacguuucuaauccuugcagaccccugcaguauuguaucgaaugggcugcccggauuuccgaggaauacuuuagccaaacggaugaggagaagcagcagggacugccugucgugaugcccguguucgaccgcaauaccugcucuaucccuaaaucccagauuagcuuuaucgacuacuucaucacagauauguuugacgcgugggaugcuuucgucgaccuucccgaucucaugcaacaccuggacaacaacuucaaguauuggaaaggccuggaugaaaugaagcucagaaaucugcggccgccucccgaguga

SEQ ID NO: 73552 - RNA, 2367 nt, Artificial Sequence
  derived and/or modified sequence opt5 from PDE8B__Homo_sapiens__NP_001025022
augggcugcgcccccagcauccacgugucccagucuggggucauuuacuguagagacagcgaugaguccucuagcccucggcaaaccacauccguuucucagggaccggcugcgccccugccuggccucuucgugcagacggacgccgcugaugccauucccccuagccgcgccuccgggcccccuagcguggcuagaguccggcgcgccagaaccgaacugggaucuggcuccagcgcugggucugccgcgccggccgcuacaaccucccggggacgcagacggcauugcuguagcucugccgaggcugaaacacagaccugcuauacauccgugaagcaaguuagcuccgccgaggugcgcaucggccccaugagacuuacccaggacccuauccagguccugcucauuuuugcgaaagaagauucucagagcgacggcuucuggugggccugugaucgggcuggguaccgcugcaacaucgccagaacgcccgaguccgcucuggaguguuuucuugacaagcaccaugaaaucauugugaucgaucaccggcaaacccagaauuucgacgccgaggccguuugccgcagcauuagagcuacaaacccuucugaacauaccgugauccuggcggucgugucccgggugagcgaugaccacgaggaggccucuguccucccccugcugcacgcuggauuuaauagacgcuucauggaaaacagcuccauuaucgccuguuauaaugagcucauucagaucgaacauggcgagguucggucucaguuuaaacugagagccugcaacagcguguucacagcucuugaucacugucaugaagccaucgagauuaccuccgacgaccacgugauccaaauucacaagauccaucgcgauagcggggacaauucucagacggagccgcacuccuuucgguacaaaaacagacgcaaggaaagcauugaugucaagucuaucuccagccggggauccgacgcgccuucucugcagaauagacgcuaucccagcauggcucggauccauuccaugacaauugaggccccuaucaccaaagugauuaacaucauuaaugccgcucaagaaaacucucccguuacaguggccgaggcucucgauagaguccuggaaauccuucgcaccaccgagcuguacagcccccagcucggcacaaaggacgaggauccucacacguccgaccuggucgggggacugaugaccgauggccuccggagacugagcggcaaugaauauguuuucaccaaaaacgugcaucagucucacucccaccuugccaugccgaucacaauuaaugacgugcccccuugcaucagccagcugcucgauaacgaggaaucuugggacuuuaacauuuucgagcuggaagcgaucacacauaagcggccccuuguguaccuggggcucaaagucuuuucccgcuucggagugugcgaguuccugaauuguagcgagaccacgcugagagccugguuucaaguuauugaagcuaacuaccacucuagcaaugccuaucauaacuccacacacgcugccgacgugcuccacgcgaccgccuucuuucugggcaaggagcgggucaaggggagccuugaucagcuggacgaaguggcugcccucaucgcugccaccguucaugauguggaccacccuggaagaacaaauucuuuccugugcaacgccggcuccgagcuugcuguccuguacaaugauaccgcggugcucgagagccaucacacagcccuggcuuuucagcugacggugaaagacaccaaguguaacauuuucaaaaauaucgaucgcaaccauuaucggacacucagacaggccaucauugacaugguucuggccaccgaaaugacaaagcacuuugagcacgucaauaaauucgugaacuccaucaauaagcccauggcugccgaaauugaggggucugauugcgaauguaacccggcgggcaaaaauuuuccugagaaccaaauccuuauuaagcgcaugaugaucaagugcgcugacguggccaaccccuguagaccucuggaucucugcaucgagugggccggacggauuagcgaagaguacuucgcucagaccgacgaagagaaacgccagggccugcccgucgugaugccuguuuuugauagaaauacguguuccauccccaagucucagauuagcuucaucgacuauuuuauuaccgacauguucgaugccugggacgcguucgcucaucugccggcccuuaugcaacaccucgccgauaacuacaaacauuggaagacacuggacgaucugaaaugcaagucccuccggcugccuucugacagcuga

SEQ ID NO: 73553 - RNA, 1602 nt, Artificial Sequence
  derived and/or modified sequence opt5 from PDE9A__Homo_sapiens__NP_001001567
augggcagcggguccucuagcuacagacccaaggccaucuaucuggacauugauggacggauccagaaagugauuuucuccaaguacugcaacucuagcgacaucauggaucucuuuuguauugcuaccggccugccucgcaauacaacgaucucccuucugaccacagacgaugccauggucucuaucgacccgaccaugcccgcgaacagcgagagaacaccuuauaaaguucggcccguggcuauuaagcaacucuccgaacgcgaggaacugauccagagcgugcuugcccaggucgccgagcaguucucuagagcuuuuaaaauuaaugaacugaaggccgagguggcuaaccaccucgccguucuggagaagcggguggaacuggaggggcucaaagucguggaaaucgagaagugcaaauccgauauuaagaaaaugcgcgaggaacuggcggccagaagcucucggaccaauuguccuugcaaguacuccuuccuugacaaccauaagaaacugacaccccgcagagauguuccuaccuauccgaaguaccuccugagccccgagacgaucgaagcccuucggaaaccuaccuuugacguguggcugugggagcccaaugaaaugcucucuugucuggagcacauguaucaugaucugggacucguccgcgacuucuccauuaacccugugacacugagacgguggcuguuuugcgugcacgauaauuaccgcaacaaucccuuccauaacuuuagacacuguuucugcgucgcucaaaugauguacagcaugguuuggcuuuguucccuccaggagaaguuuucucagaccgacauccugauccuuaugacagcugccauuugccacgaccuggaucauccgggcuauaauaacaccuaccagaucaaugcgcggacggaacucgccgugagauauaacgacauuagcccucuggagaaccaccauugugcuguggccuuccaaauccuggcugaacccgagugcaauauuuuuagcaacaucccucccgauggguucaaacagauccgccagggaaugauuacacucauccuggccaccgacauggcccggcacgcugaaauuauggauagcuucaaggagaaaauggagaauuuugacuacucuaacgaggaacacaugacacuucugaagaugauccucauuaagugcugugauaucuccaaugaagucagacccauggagguggcggaaccuuggguugacugccugcuugaggaguauuucaugcagagcgaucgcgaaaaaucugagggccugccgguggcccccuuuauggaccgggauaaggucaccaaagcuaccgcccaaaucggcuucauuaaguuugugcucaucccuauguucgaaacaguuacgaaacuguuucccaugguggaggagauuaugcugcagccucucugggaaagcagagaccgcuacgaggaacugaagcggaucgacgaugccaugaaggagcuucagaaaaagaccgacucccugacaucuggggcuaccgaaaaauccagagagcgcucccgggaugucaagaacagcgagggagacugugccuga

SEQ ID NO: 73554 - RNA, 732 nt, Artificial Sequence
  derived and/or modified sequence opt5 from PDF__Homo_sapiens__NP_071736
auggccagacuguggggcgcucucagccuguggccccuuugggccgcggugccuuggggaggggcugccgccgucggcguucgggcuugcuccucuaccgccgcuccggacgggguggagggacccgcccugcgcagaagcuacuggcggcaccuccgcagacuggugcuuggcccucccgaaccucccuucucccaugucugucaggugggggauccuguucugcggggaguggcggccccggucgagcgcgcucaacucggcggccccgaacugcagagacugacacagcggcucgugcagguuaugcgcagacggcgcugcguggggcugucugccccucaacuuggaguccccagacaggugcuggcucucgagcugccugaagcccuuugucgggagugucccccgcgccagagagcgcugcggcagauggagccuuuuccccucagaguguucgucaacccuagccugcgcguucuggacucccggcucgugacguuucccgaaggcugcgagucuguggccggguuccuggcuugcguccccagauuucaagccgugcagaucagcggacuugauccuaauggcgaacagguuguguggcaggcuuccgggugggccgcccgcauuauccaacacgagauggaccaucugcagggaugucucuucauugauaagauggacagccggaccuuuacaaacgucuauuggaugaaagugaaugauuga

SEQ ID NO: 73555 - RNA, 636 nt, Artificial Sequence
  derived and/or modified sequence opt5 from PDGFA__Homo_sapiens__NP_002598
augagaacccuggccugccuccugcuucugggcuguggguaccucgcucacgugcuggccgaggaagcggagaucccccgggaagucauugagcgccuugcuagaagccagauccauuccauucgggaccugcaacgccuccuggaaaucgauucuguuggaagcgaggacucccuggauacaucucucagagcccacggcgugcaugccacgaagcacgugccugagaaacggccgcugcccauucgcagaaagcggagcaucgaagaggcugucccugccgugugcaaaacccgcacaguuaucuaugaaauucccagaucccagguggacccuaccucugcuaacuuccuuaucuggcccccuugugucgaggugaagcggugcacaggguguugcaauaccagcuccguuaaaugucagccgagccgcgugcaucacagaucugucaagguggccaagguggaguacguccggaaaaagcccaaacugaaggaaguucaggugcgccucgaggaacaccuggagugcgcgugugccacaaccucccuuaacccugauuauagagaagaggacacgggacggcccagagagagcggcaaaaagcgcaagcggaaaagacugaagccuaccuga

SEQ ID NO: 73556 - RNA, 726 nt, Artificial Sequence
  derived and/or modified sequence opt5 from PDGFB__Homo_sapiens__NP_002599
augaacagaugcugggcccuguuccucagccuguguugcuaccuucggcugguguccgcugagggcgaccccaucccugaggaacucuaugaaaugcugucugaucacagcauucgcuccuuugacgaucuucagagacugcuccauggggacccgggagaggaagauggcgccgagcuggaccugaauaugacccggucucacagcgggggagagcucgaaucccuggcgcgcggcagacggucucuugggagccugacaaucgcugagcccgccaugauugccgaauguaagacgcgcaccgaggucuucgagaucuccagacggcucauugaucgcacaaacgcuaauuuucugguuuggccucccugcguggaagugcaaagauguagcggaugcuguaacaaucggaacguccagugccgcccuacccaggugcagcuuagacccguucaagugcggaaaaucgagaucguccgcaagaaaccuauuuucaagaaagccacagugacccuggaagaccaucucgcuuguaagugcgagacaguugccgcggccagaccggugacccggucucccggcggcucccaggaacagagagcuaagacgccucagacccgcgucacaauccggaccgugagagugcgccggcccccuaaagggaagcacagaaaauuuaagcauacacacgauaaaaccgcccugaaggagacgcugggagcuuga

SEQ ID NO: 73557 - RNA, 1038 nt, Artificial Sequence
  derived and/or modified sequence opt5 from PDGFC__Homo_sapiens__NP_057289
augagccuguucggccuccugcuucugaccuccgcccucgcugggcagagacaaggaacacaggccgagucuaaccugagcuccaaguuucaguucucuagcaauaaagaacagaacggcgugcaagacccccagcacgagcggaucauuacggucuccaccaaugggucuauccauagcccucgcuuuccgcacacauaccccagaaacaccguucuuguguggcggcugguggcggucgaagagaauguguggauucagcucacauucgaugaacgcuuuggacuggaggacccugaggaugacaucugcaaguaugauuucguugaaguggaggaacccuccgacggcaccauucuggggagaugguguggaagcggcacagucccuggcaaacagaucucuaaggggaaccaaauccggauucgcuuuguguccgaugaguacuuccccagcgagccuggauuuugcauccauuauaauauuguuaugccgcaguucaccgaagcugugucucccuccguccucccucccagcgcccugccucuugaccugcucaacaaugccaucacggcuuuuucuacccuggaggaucuuauuagauaccuggaacccgagcgguggcagcucgaccuggaagaucuguaucgcccgacauggcagcuccugggcaaagccuucguguuugggagaaagucccggguggucgaccuuaaccugcucaccgaggagguucgccuguacagcuguacaccuagaaauuucuccgugucuauccgggaggaacuuaagcgcaccgauacgauuuucuggcccggaugccugcucgugaaaagauguggcgggaacugcgcuuguugccugcacaauuguaacgaaugccaaugugucccuagcaaggugaccaaaaaguaucaugagguucugcagcuccggcccaaaacaggagugagaggccugcacaagucccuuacagacgucgcccuggaacaccaugaggagugcgacugcgugugucgcggcagcaccgggggauga

SEQ ID NO: 73558 - RNA, 1113 nt, Artificial Sequence
  derived and/or modified sequence opt5 from PDGFD__Homo_sapiens__NP_079484
augcacagacugaucuucguguacacccucauuugcgccaacuuuuguagcugccgggacacauccgcuacgccccagucugccagcaucaaggcgcugcgcaaugcuaaccuuagacgggaugaguccaaucaucugaccgaccucuaucgcagagaugaaacaauucaagucaaaggcaacggguacguucagucuccucgguucccgaauagcuauccccgcaaccugcuucugaccuggagacuccacucccaggagaauacacggauccagcugguguuugacaaccaauucggacuggaagaggccgaaaaugauauuugucgcuacgacuuuguggaggucgaggauaucucugaaaccagcacaaucauuagaggccgguggugcgggcauaaggaggugccuccccgcaucaaauccagaaccaaccagauuaagaucacguucaaaagcgacgauuauuuuguugccaagccuggauucaagauuuacuauucucuccuggaagacuuucagcccgcugccgcuuccgagaccaauugggagagcgugacaucuuccaucagcggcgucucuuacaacuccccuagcgugaccgauccgacacuuauugccgacgcgcuggauaaaaagaucgccgaguucgacaccguugaagaccuccugaaauacuuuaaucccgaauccuggcaggaggaucuugaaaacauguaucuggacacgccucgguaccgcgggagaucuuaucacgauagaaagagcaaaguggaccucgaucggcugaaugacgaugcuaagcgcuacuccuguacaccccggaacuauagcgucaacaucagagaggagcugaagcucgccaaugugguguucuuuccucgcugccugcuuguccaacgguguggaggcaacugcggcugugggaccguuaauuggagaucuugcacauguaacuccggaaaaaccgugaagaaauaccaugaagugcugcaguucgagcccggccacauuaagcgccgggggagagcuaaaaccauggcccucgucgacauccagcuggaucaccaugaacgcugcgacugcauuuguagcucucggccgccuagauga

SEQ ID NO: 73559 - RNA, 3345 nt, Artificial Sequence
  derived and/or modified sequence opt5 from PDGFRA__Homo_sapiens__XP_006714102
augcugcccagacucgugcugaacagcugggcccagaugaucugccuuccucaacugccgaaguucccccgggcuaugggcaccucccacccugccuuucucguccuggggugucuucugacaggacucucucugauucugugccagcucagccugcccuccauccuuccuaaugagaacgaaaaaguugugcagcucaauucuagcuucucccugcgcuguuuuggcgagucugaagugagcuggcaguaccccauguccgaggaagagagcucugacgucgagauuagaaacgaagagaauaacuccgggcuguucgugacgguucuugaagugagcucugcguccgcugcccauaccggacuguauacaugcuacuauaaucacacccaaacagaggagaacgaacucgagggccggcauaucuacauuuaugucccugauccggacguggccuuuguuccccuggggaugaccgauuaccuggugaucgucgaagacgaugacagcgcuaucauuccuugucgcacaaccgaucccgagacgccugugacccuccacaauucugaaggagugguccccgccuccuaugacagcagacagggcuucaacggcacauuuaccguugggccguacaucugcgaggcuacagugaagggaaagaaguuccagaccauuccuuuuaauguguacgcccugaaagcgacguccgagcuugaucuggaaauggaggcccucaagacagucuauaagucuggcgaaaccaucgugguuacaugugcuguguucaacaaugaggucguggaccugcaguggaccuaccccggggaaguuaaaggaaagggcauuaccaugcuugaggagaucaaagugccuagcauuaagcuggucuauacacucacggugcccgaagccaccgucaaagauuccggggacuacgagugcgcugcccggcaagcgacacgcgaagugaaggagaugaagaaaguuaccaucagcgugcaugaaaagggauuuaucgagauuaaacccacauucucucagcuggaggccgucaaccugcacgaagugaagcacuuuguuguggaggucagagcuuauccuccgccccggaucuccuggcucaaaaauaaccugacccuuauugaaaaccugacggagaucacaaccgauguggagaagauucaggaaauccgcuacagaagcaaacucaagcugauccgggccaaggaggaagacucuggccauuauaccauuguggcucagaaugaggacgccguuaaaagcuacacauucgaacuucugacccaagucccuuccucuauccucgaucugguggacgaucaccauggcagcacagggggacagacggugcgcuguaccgccgagggcacaccccugccugacauugaguggaugaucugcaaggauauuaaaaaguguaacaaugaaaccuccuggacaauccucgcuaacaaugucagcaacaucauuaccgagauccacucuagagaccgguccacgguggaagggcgcguuaccuucgcgaaaguggaggaaacaauugccgucagaugccuggcuaagaaucuucugggagccgagaaccgggagcucaagcugguggcccccacccugagaagcgaacuuacaguugcugccgcggugcucguccugcuggugaucguuauuaucucucucauugugcuggucgugaucuggaaacagaagccgcgcuacgagauccgguggagagugauugaauccaucagcccugauggccacgaguauauuuacgucgaccccaugcaacuuccuuaugauucccgcugggaauuuccccgggacgggcugguucucggaagagugcugggcucuggcgcuuucgggaaaguggucgagggaaccgccuacggccugagccgcucccagccugugaugaagguugccgugaaaaugcuuaagcccacggcucggucuagcgagaagcaggcccucauguccgaacugaaaaucaugacacaucuggggccgcaccucaauauugucaaccugcuuggagcuugcaccaagagcggcccuaucuauaucauuacagaguacuguuuuuauggggaucuggugaauuaccuccauaaaaacagagacucuuuccugucccaccaucccgaaaagcccaaaaaggagcuggacaucuuuggccuuaauccugccgaugagagcacccgcucuuacguuauucucuccuucgaaaacaauggagacuauauggauaugaagcaggcggacaccacacaauacgugccgaugcuggagcggaaagaagucagcaaguauucugauauccagagaagccuguacgaccgccccgccuccuauaaaaagaaaagcaugcucgauucugaggugaagaaccugcuuuccgacgauaacagcgaaggccugacgcuccuggaccugcuuuccuuuaccuaccagguugcucgggggauggaguuccucgccucuaaaaauugcgugcacagagaucuggcugcccggaacguccugcucgcgcagggaaagauugugaagaucugugacuuuggccuggcccgcgauaucaugcacgacagcaauuauguguccaaagggucuacauuccuuccugucaaguggauggcucccgagagcauuuuugacaaccuguacaccacacucuccgauguuuggucuuacggaauccugcugugggaaauuuucagccuuggcgggaccccuuaucccggcaugaugguggacuccacguuuuacaauaaaaucaagagcggauauagaauggccaaaccugaucaugcuacaucugagguguacgaaauuauggucaagugcuggaacuccgagcccgaaaagcggccgagcuucuaucaccugucugagaucguggagaaucuccugccuggccaauacaaaaaguccuaugaaaagauccaucucgacuuccugaaaagcgaucaccccgccguugccagaaugcgcguggacucugauaacgcuuacauuggggucaccuacaaaaaugaggaagacaaacuuaaggauugggagggaggccuggacgaacagcggcucuccgcggauagcggguauaucauuccucugcccgacaucgauccggugccugaggaggaagaccugggaaaaagaaaccgccacuccagccagaccucugaggaaagcgccauugagacaggcuccucuagcuccaccuuuaucaagagagaggacgaaacaauugaggauaucgacaugauggaugacaucgggauugauucuagcgaccuuguugaagauuccuuccuguga

SEQ ID NO: 73560 - RNA, 3321 nt, Artificial Sequence
  derived and/or modified sequence opt5 from PDGFRB__Homo_sapiens__NP_002600
augagacugcccggcgccaugccugcucucgcccugaagggggagcuucugcuccugagccuucugcuccugcuggaaccgcagaucucccaaggacucguggucacacccccuggccccgagcugguucuuaacgugucuagcaccuucgugcugacgugcuccgggucugcgccugucgugugggaacggaugagccaggagcccccucaggaaauggcuaaagcccaggacggaaccuuuuccucuguucucacacugaccaaucuuacaggccuggauaccggggaguacuucuguacacacaacgacagccgcggacucgagaccgaugaaagaaagcggcuguauauuuuugugccggaccccacggucggcuuccugccuaaugaugccgaggaacucuuuaucuuccugaccgagauuacagagaucaccauucccugccgcgugacagacccucaacuuguugugacccugcaugaaaagaagggcgaugucgcucuccccgugccguacgaccaccagagaggguuuuccggaaucuucgaggaucggagcuauaucuguaaaacgacaauuggcgaccgcgaaguggauucugacgccuacuaugucuacagacugcagguuuccagcaucaacgugucugugaaugcuguccagaccgugguucggcaaggggagaacauuacacuuaugugcaucgugauuggaaaugaagucgugaacuuugaguggaccuauccucgcaaggaguccggcagacugguugaacccgugaccgauuuccuccuggacaugccuuaccauauccggagcauucugcacauccccucugccgagcucgaagacuccgggacauacacguguaaugucaccgagagcgugaacgaucaucaggacgaaaaggcgaucaauauuacagucguggaguccggauauguucgccugcuuggcgaggugggcacccugcaguuugccgaacuccacagaucucggacacugcaggucguguucgaggcuuaucccccuccgaccguucuuugguuuaaagauaaccgcacgcugggggacagcuccgccggagaaaucgcucucagcacaagaaaugugucugagacccgguacgucuccgaacugacccuggugagagugaagguugccgaggcgggccacuacacaaugcgcgccuuccaugaggaugcugaaguccaacucagcuuccagcugcagauuaacgugcccgugcggguccuugagcugucugaaagccacccugacuccggggagcaaaccgugagaugccgcggacggggcaugccccagccuaauaucauuuggucugccuguagagaucucaaacgcugcccccgggagcugccgccuacacugcuugggaacagcuccgaagaggaaagccagcucgagacgaacguuaccuauugggaagaggagcaggaauuugagguggucucuacacugagacugcaacauguggaccgcccccucuccguucgguguacccugagaaaugcugugggacaggauacacaggaagucaucgugguuccucacagccuucccuucaagguggucgugaucucugccauucuggcccucgugguccugaccaucauuucccugaucauucuuaucaugcucuggcagaaaaagccucgcuacgagauccgguggaagguuauugaaagcguguccucugacggccacgaguauaucuacguggaucccaugcaacugccguacgacagcacgugggagcugccuagagaccagcucguccugggccggacccuuggguccggagcuuuuggccaggugguugaagcgacagcccaugggcugucucacagccaggcuaccaugaaaguggccgucaagaugcucaaauccacagcccgcagcucugagaagcaagcucugauguccgaacugaaaauuaugagccaucuuggaccccaccucaacgugguuaaucugcugggcgccugcaccaaagggggccccaucuauauuaucacggaguacuguagauauggagaucucguggacuaccugcaucggaacaaacacacauuccuucagcaccauucugauaagagacgcccuccguccgcggaacuguauagcaaugcucuccccgucggccugccucugcccucucacgugagccuuaccggggaguccgacggaggcuacauggauaugagcaaggacgagucuguugauuaugugccuaugcucgacaugaaaggggaugucaaguacgccgacauugaauccagcaacuacauggcccccuaugauaauuacgugccuuccgcucccgagcggacaugcagagccacccugaucaacgaaucuccggugcugagcuauauggaccucgucggauuuuccuaccagguugcuaauggcauggaguuccuggccucuaaaaacugcgugcaucgcgaucuugcggccagaaaugugcugaucugugaggggaagcucgucaaaauuugcgacuuuggccuggcucgggacaucaugcgcgauagcaacuauauuuccaagggaucuaccuuccugccucuuaaguggauggcccccgaaagcaucuuuaauucccuguacacaacgcucagcgacguguggucuuucggcauucugcucugggagaucuuuacccuugggggaacaccuuaucccgaacugccgaugaacgagcaguucuacaaugcuaucaaaagaggcuaccggauggcccaaccugcgcacgccuccgaugaaauuuaugagaucaugcagaaguguugggaggaaaaauuugagauuagacccccuuucagccagcugguucuccugcuggaacgccuucugggggagggauacaagaaaaaguaucaacagguggacgaagaguuccuccggucugaucaccccgcuauccugcgcucccaggccagacuccccggcuuucaugggcugcggagcccucuugacaccucuuccguccuguacacagcugugcagccgaacgagggcgauaacgacuauauuaucccccucccugaucccaagccugaaguugccgacgagggaccccuggaaggcagcccuucccuggccagcucuacccuuaaugaggugaacacgagcuccacaaucucuugcgauagcccgcuggaaccccaagacgagccugagcccgaaccucagcucgagcugcaggucgaacccgagccggagcucgaacagcugccugauuccgggugucccgcuccccgcgcggaggccgaagacucuuuccuuuga

SEQ ID NO: 73561 - RNA, 1128 nt, Artificial Sequence
  derived and/or modified sequence opt5 from PDGFRL__Homo_sapiens__XP_011542860
augaagguguggcugcuccugggccuucugcucguccacgaggcccuggaagacguuaccgggcagcaucuucccaaaaacaagagaccuaaagagccgggagaaaaucggaucaagcccacaaacaaaaaggugaagccuaaaauucccaagaugaaagaucgcgacagcgcuaauuccgccccuaagacgcaaucuaucaugaugcaagugcuggauaaaggcagauuccagaagcccgcggcuacccucagccugcuggccgggcagacagucgagcuccggugcaagggaucccgcauuggcuggucuuacccugccuaucuggacaccuuuaaagauagcagacuuuccgugaagcagaacgaacgguacgggcagcugacacucguuaauucuaccagcgcugacacaggagaguucuccuguugggugcagcugugcagcggcuauaucugucgcaaagaugaggccaagaccggcucuacguacauuuucuucaccgaaaaaggggagcuuuuugucccgucccccagcuauuucgacgugguuuaccugaacccugauagacaggcugugguccccugccgggugacagugcucucugccaaggucacccugcaccgcgaauuuccugcgaaagagauccccgccaauggaacagacaucguuuaugauaugaagagaggcuucguguaccugcaaccgcauuccgagcaccaggggguggucuacugucgggcugaagccggaggccgcagccagauuucugugaaguaucagcuccuguacguugcugugccuuccgggcccccuagcaccacgauccuugccuccucuaacaaagucaagagcggagacgauauuuccgugcugugcacaguucucggcgagcccgacguggaagucgaguuuaccuggaucuuccccggccaaaaagacgaaagaccugugacaauucaggauaccuggcggcugauccaucgcgggcuuggacacaccacaagaauuagccagucugucaucacgguggaggacuuugagaccaucgaugcgggcuauuacauuuguacagcccaaaaucugcaggggcagaccacaguugcuaccacgguggaauuuuccuga

SEQ ID NO: 73562 - RNA, 1173 nt, Artificial Sequence
  derived and/or modified sequence opt5 from PDHA1__Homo_sapiens__NP_000275
augagaaagaugcuggccgcugugagccggguccucuccggcgccucucagaaacccgcgagccgcguucugguggcuuccagaaacuucgccaaugacgccaccuuugagaucaagaaaugcgaucuucaccggcuggaagaggggccuccggugacaacgguccucacccgcgaagacggacugaaguacuauagaaugaugcaaacagugcggcgcauggagcuuaaagcugaucagcuguacaagcagaagauuaucagaggcuucugucaucucugcgacgggcaggaagccuguugcguuggacuggaggcuggcauuaaccccaccgaucaccugaucacagccuaucgggcgcauggguuuaccuucacacgcggacucucugugagagagauucuggccgaacuuaccggccggaaaggcgggugugcuaagggaaaaggcgggagcaugcacauguacgccaagaauuuuuauggaggcaacgggaucgucggagcucaagugccucugggcgccggcaucgcgcucgccugcaaauacaaugggaaggacgagguuugucugacgcuuuauggagauggcgcugccaaccaggggcagauuuucgaggcuuacaauauggccgcccuguggaagcuccccugcaucuuuauuugugaaaacaaucgcuacggaaugggcaccuccguggagagagcugcggccucuacagacuauuacaaacgcggggauuucaucccuggacugcgggucgacggcauggauauucugugcgugagagaagcuacccgguuugccgccgcuuauuguagaagcggcaaggggcccauccucauggagcugcagacauaccgcuaucauggacacuccaugagcgacccuggcgugucuuaccggaccagagaagagauucaagaaguccgcuccaaaagcgauccgaucaugcuucugaaggaccggaugguuaacucuaaucucgccuccguggaggagcugaaagaaaucgacguggaggucagaaaggaaauugaggaugcggcucaguucgccacggccgaccccgaaccuccccuugaggagcugggguaucacaucuacagcucugauccucccuuugaagugcgcggagcuaaccaguggauuaaauucaaguccguuagcuga

SEQ ID NO: 73563 - RNA, 1080 nt, Artificial Sequence
  derived and/or modified sequence opt5 from PDHB__Homo_sapiens__NP_000916
auggccgcugugagcggccuggucagacggccccuccgcgagguuuccgggcugcuuaagagacgguuccacuggaccgccccugcggcucuccaggugacagugcgcgacgccaucaaccaaggaauggaugaggagcuggaaagagacgagaaagucuuucugcuuggcgaagagguggcccaguacgauggggcuuauaagguuucucggggacuguggaaaaaguacggcgacaaacgcauuaucgauacgccgauuagcgagaugggguucgccggaaucgcugugggcgccgcgauggccggccucagacccauuugcgaauuuaugaccuucaauuuuuccaugcaggcuaucgaccaggucaucaacucugccgcuaagacauauuacaugagcgggggacugcaaccugugcccauuguuuuccggggcccuaauggggccuccgcgggaguggccgcucagcauucucaguguuuugccgcuugguauggccacugccccgggcugaaggucgugagcccuuggaacuccgaggaugccaaaggacucaucaagagcgccauucgcgacaauaacccgguggucguucuggaaaaugagcuuauguacggcgugcccuucgaguuuccucccgaagcucagucuaaagauuuccugaucccuauuggcaaggcgaaaaucgagagacaagggacccauauuacaguggucucccacagccggcccgugggacauugucucgaagccgcugccguucugucuaaggagggcguggaaugcgaggucaucaacaugcgcaccaucagaccgauggacauggagacaauugaagccuccgugaugaagaccaaucaccuuguuacgguggaagggggauggccucaguuuggcgucggggcugaaaucugugcccggauuauggagggacccgcguucaacuuucuggaugcuccugccgugcgcgucaccggcgccgacgugcccaugcccuaugcuaaaauccucgaagauaauagcauuccucagguuaaggacaucaucuucgccauuaaaaagacacugaacaucuga

SEQ ID NO: 73564 - RNA, 1461 nt, Artificial Sequence
  derived and/or modified sequence opt5 from PDHX__Homo_sapiens__NP_001128496
augcagagcggcggggccgagggaucccccggcgcugggagaaccggacggggcccugggucuggaaaggccccgcccgcggaaaucagcuccggcgcuccugacuuccccggcggggauccuauuaaaauccugaugcccucucucagcccuacaauggaggaaggaaacauugugaaguggcugaaaaaggagggcgaagccgucuccgccggggacgcucuuugcgagaucgagacggauaaagccguugugacccuggacgcuucugaugacggcauucucgccaagaucguggucgaagagggcagcaagaauauccgccuggggucccuuauuggacugaucguggaagagggcgaggauuggaaacacguugaaauuccgaaggacgugggacccccucccccugucagcaaacccucugagccgagaccuucccccgaaccucaaaucagcauucccgugaagaaagagcauauccccgggacacuccgguuucgccugucuccugcggccagaaacauucuggaaaagcacucccucgaugcuagccagggaaccgccacaggcccgcgggggaucuucaccaaggaggacgcucugaaacuuguucagcugaagcagacaggaaaaaucaccgagucucgccccacgccugcccccaccgcgacaccuaccgcccccuccccgcuccaagcuacagccggcccuagcuaccccagaccugugauucccccugucuccacccccgggcagccgaaugcugugggaacguuuacagaaaucccugccucuaacauucggcgcgugaucgccaagagacugaccgagagcaaauccacagucccccaugcuuaugcgaccgccgauugugaccuuggcgcuguucugaaggugcggcaggaucucgugaaagacgacauuaaggucagcgugaaugauuucaucaucaaggccgccgcuguuacccugaaacagaugcccgacgugaacgucucuugggauggcgaagggccuaagcaacugccguuuauugacaucuccguggccguugcgacagauaaaggacuccugacgcccauuaucaaggacgcugccgccaaaggcauucaggagaucgcugauagcgugaaggcccuuucuaagaaagcucgcgacgggaagcugcucccugaagaguaccagggaggcagcuucuccaucucuaaucuggggauguuuggcauugaugaguucaccgccgucaucaaucccccucaggcgugcauucuugccgugggaagauuucggcccguccugaaacucacagaagacgaggaaggcaacgcuaagcugcaacagcgccagcugaucaccgugacaaugagcuccgauagcagaguuguggacgacgagcucgccacccgguuccugaaaucuuuuaaggcuaaccuugaaaauccuauuagacuggccuga

SEQ ID NO: 73565 - RNA, 1578 nt, Artificial Sequence
  derived and/or modified sequence opt5 from PDIA2__Homo_sapiens__NP_006840
augagcagacagcugcuccccgugcugcuucugcuccugcuucgggccuccugcccuuggggccaagagcagggggcucgcucuccgagcgaggagcccccugaagaggaaauccccaaggaggacggcauucugguccucuccagacacacccugggacuggcccuccgggagcauccugcgcugcuuguugaguucuacgcucccuggugugggcacugccaggcccuggccccugaauauucuaaagcugccgcugugcucgccgcggaaagcaugguggucacacuggccaagguggauggaccggcucagcgcgagcuugccgaggaauuuggcguuacggaguaccccacccugaaauucuuuagaaacgggaaucggacacauccugaagaguauaccggaccccgcgacgcugaaggcaucgccgaguggcucagacggcgcgugggcccuuccgcgaugagacuggaggaugaagccgcugcccaagcucugauugggggacgggaccucgucgugaucggcuucuuucaggaucugcaggacgaggauguugccacauuccuugcccuggcucaggacgcgcucgauaugaccuuugggcugacagaccgccccagacuuuuccaacaguuuggacugaccaaggauacggugguccucuucaaaaaguuugacgaaggccgggccgauuucccgguggacgaggaacuggggcuggaccucggagaucugucucgcuuucuugugacccacagcaugagacuggucacagaguucaacucccagaccagcgcuaagauuuucgccgcccggauccucaaucaucugcuucuguuuguuaaccagacacucgcugcccacagagagcugcuggcgggcuucggcgaagcugccccucgcuuucgggggcaaguccucuucguggugguggacguugccgcugauaaugagcacgugcugcaguacuuuggacuuaaagccgaagcugcccccacccugagacucgucaaccuggagacgacaaagaaauaugcgccuguggacggcgggcccguuaccgccgcuucuaucacagccuucugucaugcugugcugaauggacaggucaagcccuaccuucucucccaagaaauuccuccggauugggaccagcgccccgugaaaacccuggucggcaagaacuuugaacagguggccuucgaugagaccaagaauguuuuugugaaauucuaugcgccuuggugcacacacuguaaggaaauggcccccgcuugggaggcccuggcugaaaaauaccaggaccaugaggauaucauuaucgccgagcucgacgccacggcuaacgaacuggaugcguuugccguccacggguucccuacccuuaaguacuuucccgcuggaccgggccggaaagugauugaguauaagagcacaagagaccuggaaaccuucucuaaauuccucgacaauggcgggguucugccuacagaggaacccccugaggagcccgccgccccuuuucccgaaccgccugcuaacuccaccaugggaagcaaggaggaacuguga

SEQ ID NO: 73566 - RNA, 1518 nt, Artificial Sequence
  derived and/or modified sequence opt5 from PDIA3__Homo_sapiens__NP_005304
augagacugcggcgccucgcccuguuccccggcguggcccuucugcucgcugcggcuagacuggccgccgcuagcgacguccuugagcugaccgaugacaacuuugaaucccggaucucugauacagggagcgccggacucaugcugguugaguucuuugcuccuuggugcggccacuguaagcgccuggccccggaauacgaggcggccgcuacgagacucaaagggauugugccccuggccaagguggacugcaccgcuaauacaaacaccuguaauaaauauggagucuccggcuacccuacacuuaagaucuuccgggauggggaagaggccggagcguaugacggcccccgcaccgccgauggcauugugucucaucugaaaaagcaggcugggccugccagcguuccccucagaacagaggaagaguuuaagaaauucaucuccgacaaggaugcuucuauugugggauuuuucgacgauagcuuuuccgaagcccacagcgaguuccugaaagccgcuucuaaccuucgggacaauuaccgcuuugcgcauaccaacgucgagucccuggugaaugaauaugaugacaacggcgaggggaucauccucuucagaccuagccaccugacgaauaaguuugaagacaaaaccguugccuacacagagcaaaagaugaccucuggaaagauuaaaaaguucauccaggaaaacauuuucggcaucugcccgcauaugacagaggauaauaaagaccugauucaggggaaggaucuccugaucgcuuauuacgacguggauuacgagaaaaacgccaagggauccaauuauuggcggaaccgcgucaugaugguggccaaaaaguuucuugacgcuggccacaagcugaauuucgccguggcgagcagaaaaaccuuuucucacgaacucuccgauuucggccuggagagcacggcuggggaaauucccgucguugccauccggacagccaagggagagaaauuugugaugcaggaagaguucucccgcgacggcaaggcucuugagagauuucugcaagauuacuucgacgggaaccucaaacgguaucugaagucugaaccuauccccgagagcaacgauggaccugugaaggucgugguugccgaaaauuuugacgagauugugaacaaugaaaacaaagacguccugaucgaguucuacgcucccugguguggccauugcaagaaucucgagccgaaauauaaggaacugggggagaaacuuuccaaggauccuaacauugugaucgccaagauggacgcgaccgccaaugauguucccagcccuuacgaagugagaggauuucccacaauuuauuucucucccgcuaacaaaaagcugaauccuaaaaaguacgagggcggccgcgagcucuccgacuuuaucagcuaccugcagcgggaagccaccaacccgcccgucauccaggaggaaaaaccuaagaagaaaaagaaagcucaggaggaucuuuga

SEQ ID NO: 73567 - RNA, 1938 nt, Artificial Sequence
  derived and/or modified sequence opt5 from PDIA4__Homo_sapiens__NP_004902
augagaccccggaaggccuuccugcuccugcuucugcucggccuggugcagcuucuggcugucgccggggcggagggaccugacgaagauagcuccaaccgcgagaaugcuaucgaagacgaggaagaggaggaagaggaagaugacgaugaggaggaagacgaucucgagguuaaagaagagaacggcgugcuggugcugaaugacgccaacuuugauaauuucgucgccgacaaggauaccgugcuccuggaauuuuacgcuccguggugcgggcacuguaaacaauucgcccccgaguaugagaagauugcuaacauccuuaaagacaaggauccucccauuccuguugccaagaucgacgcgacaucugccagcgugcuggcuuccagauuugacgucucuggauaccccacgauuaaaauccucaagaaaggccaggccguggauuaugaagggagccggacccaggaggaaaucguugcuaaggugcgcgaggucucccagccugacuggacaccgcccccugaagugacccuggugcuuacaaaagagaauuucgaugaggucguuaacgacgccgauauuauccugguggaauuuuacgcgcccuggugcggacauuguaagaagcucgccccugaguaugaaaaagcugccaaggagcugucuaaaagaagcccgcccauuccucuggcuaagguggacgccaccgccgaaacagaucucgcuaaacgguucgacgucuccggcuaccccacccugaagaucuuucgcaaaggcagaccuuaugauuacaaugggccccgggagaaguacggaauuguggacuauaugaucgagcaaagcgggcccccuucuaaggaaauucuuacgcugaaacagguucaggaguuccucaaggauggcgacgacgugaucaucauuggagucuuuaaaggcgaauccgauccggcguaccagcaauaucaggacgccgcuaacaaucugcgcgaggauuacaaguuccaccauaccuuuagcacagagaucgccaaauuccuuaaggugucucaggggcagcugguugugaugcaacccgaaaaguuccaguccaaauaugagccuagaagccacaugauggacguccagggaucuacccaagauuccgccauuaaggacuuugugcucaaauacgcucugccccuggucggccaucggaaggugagcaacgaugccaaacgcuauacaagacggccucucguuguggucuacuacuccguggacuucucuuuugauuaucgcgcggcuacccaguucuggagaagcaagguucuggaaguggccaaggacuuucccgaguacacguucgccaucgcugaugaagaggacuaugccggcgaggucaaagaucuugggcuguccgaaagcggagaggacgugaaugcugccauucucgacgaaucuggcaagaaauuugcgauggagccggaagaguucgauuccgacacacugcgggaguuugugaccgccuucaagaaagggaaacuuaagccuguuaucaagagccagcccgucccuaagaacaauaaaggacccgugaagguggucgugggcaaaacauuugauucuaucguuauggacccuaagaaagaugugcugauugaguucuacgcucccuggugcgggcacuguaagcagcucgagccggucuauaacagccuggccaagaaauacaagggacaaaaaggccuggugaucgcuaagauggacgccaccgcgaacgauguuccuuccgacagauauaaaguggaaggcuuucccaccauuuacuucgcccccucuggggauaagaagaauccugucaaauucgagggaggcgaccgcgaucucgaacaccugagcaaguuuaucgaggagcaugcuacaaaacuuucccggacgaaggaagaacuguga

SEQ ID NO: 73568 - RNA, 1560 nt, Artificial Sequence
  derived and/or modified sequence opt5 from PDIA5__Homo_sapiens__NP_006801
auggccagagcuggccccgccuggcugcuccuggcgaucugggugguccuuccuagcuggcuguccucugcuaagguuagcucccucauugagcggaucucugacccgaaagaucugaagaaacuucugcgcaccagaaacaaugugcucgugcuguacagcaaguccgaagucgccgccgagaaccaucugcggcuccugucuacaguggcucaggccguuaaagggcaaggaacgauuugcuggguggacuguggcgaugcugaaagccgcaaacuuugcaagaaaaugaaggucgaccugucccccaaagauaagaaaguggaacucuuccacuaucaggacggggccuuucacaccgaauacaauagagcgguuacauucaagagcaucguggccuuucugaaggauccuaaaggacccccucuuugggaggaggaccccggcgcuaaggaugucgugcaucuggacucugaaaaagauuuccggcgccuccugaagaaagaggaaaagccucugcucauuauguuuuaugccccgugguguuccaugugcaaaagaaugaugccccacuuccagaaggcugccacccagcugcgggggcaugcggugcuugccggaaugaacgucuacagcucugaguuugagaauaucaaggaagaguauuccguucgcggcuucccuacaaucuguuacuuugaaaaaggcagauuccuguuucaauaugacaacuacgggagcaccgcugaggauauuguggaauggcucaagaauccccagccuccccagccucaggugccggagacacccugggccgacgagggaggcucugucuaccaccugaccgacgaagauuucgaccaauuugugaaagagcacuccagcguucuugugauguuccaugcuccuuggugcgggcacuguaagaaaaugaagcccgaguucgagaaggccgccgaagcucugcauggagaggcggauuccucuggcguccucgccgcuguggacgccacgguuaacaaagcccuggcugagcgguuucacaucagcgaguuccccacccugaaguauuuuaaaaauggggaaaaguacgccgugccuguccuccgcacaaagaagaaguuccuggaauggaugcagaacccggaggcgcccccucccccugaacccaccugggaggagcagcagacauccgugcuucaccuggucggagauaauuuuagagaaacccucaaaaagaaaaagcauacgcuggugauguucuaugcuccguggugcccucacuguaaaaagguuauuccccauuuuacagccaccgccgacgcuuucaaggaugaccggaaaaucgccugcgcugccguggauugugucaaggacaaaaaccaagaucuuugccagcaggaggcggugaagggcuacccuacauuucacuauuaccauuauggcaaauucgccgaaaaguacgacagcgaccgcaccgagcugggguuuaccaauuacauuagagcucuccgggagggagaucacgaaagacugggcaaaaagaaggaggaacuguga

SEQ ID NO: 73569 - RNA, 1479 nt, Artificial Sequence
  derived and/or modified sequence opt5 from PDIA6__Homo_sapiens__NP_001269633
augagacgggaccugcgcgagaagcucgugugggucugcagaccccuggccccuguugaagugccggcuaacaucagcuccgauuuccagcccuguucuccuaccagccccgcccacucccuuucucggaaaagcccuauuauguaccccuccacaacgauggcgaaugcuccuggccuggugucuugcaccuuuuuccucgccgucaacgggcuguauagcuccagcgacgaugugaucgagcuuacaccgucuaauuuuaaccgcgaaguuauucaauccgacagccuguggcucguggaguucuacgcccccugguguggacauugccagagacugaccccugaauggaagaaagcugccacagcucugaaggaugucgugaaaguuggcgccguggacgcggauaagcaccauucucucgggggacaguauggcguccagggguuucccaccaucaagauuuucggauccaauaaaaaccggccugaggacuaccaaggcggccgcacaggggaggccaucguggaugcugcccugagcgcucuuagacagcuggugaaggaccggcucggaggccgcucugggggauauuccagcggcaaacaggggagauccgauucuagcuccaagaaagacgucaucgaacugaccgaugacagcuuugacaagaauguucuugauucugaggacguguggaugguggaguucuacgcccccugguguggacacugcaagaaccuggaaccggagugggcggccgcugccuccgaagucaaagagcagacgaagggcaaagugaagcucgcugccguugaugccaccgugaaucaaguccuggcuagccgguauggcauucgcggguuuccuacaaucaaaauuuuccagaagggagaaucucccguggacuacgauggcgggagaacccggagcgacaucguuucccgcgcgcuggaucucuuuucugacaacgccccuccucccgagcugcuugaaauuaucaaugaggauauugcuaaaagaacaugugaggaacaucagcugugcguggucgccgugcucccccacauccuggacaccggagccgcuggccggaacagcuaccuugagguccugcucaagcuggccgauaaguauaaaaagaaaauguggggguggcuguggacggaagcgggagcucaguccgagcucgaaacagcccugggcaucggcggguucggauacccggccauggcugccauuaaugcuagaaagaugaaauuugcccuucugaagggcagcuucucugagcaagggaucaacgaguuccuccgcgaacuguccuuuggacggggcagcaccgcgcccguugggggcggagccuucccuacaauuguggagagagaacccugggacggccgcgacggggagcuuccuguggaagaugacaucgaucugucugacgucgagcucgaugaccugggaaaggaugagcuguga

SEQ ID NO: 73570 - RNA, 1371 nt, Artificial Sequence
  derived and/or modified sequence opt5 from PDK1__Homo_sapiens__NP_001265478
augagacuggcccggcuccugcgcggcgcugcccuugcggggcccggaccuggccugagagcugccggguucagccgguccuuuucuagcgacuccggaucuagcccggccuccgagcgcggcgugcccgggcaggucgauuucuacgcuagauuuucuccuagcccccucuccaugaagcaauuccuggacuuuggaagcguuaacgccugcgagaaaaccucuuucauguuucuucggcaggagcugccugugcgccucgcuaauaucaugaaggaaauuucccugcugcccgauaaccuccugagaacaccuagcgugcagcuuguccagucuugguauauccaaucccugcaggagcuccuggacuucaaagauaagagcgccgaagacgcgaaagccauuuacgagcggccgcgcagaacguggcuucaggugucuucccuguguugcauggcuuguaagaugaucuuuaccgauacaguuauucggauccgcaauagacacaacgacgugauccccaccauggcccagggcgucauugaguauaaggagagcuucggcguggauccuguuacaucccaaaaugugcaguacuuucucgaccgguucuauaugucucgcaucagcauuagaaugcugcugaaccagcauucccuccuguuugggggaaaaggcaaggggagccccucucaccggaaacauaucggauccauuaauccuaacugcaauguccuugaagugaucaaggauggcuacgaaaacgcuagacgccugugugaccucuauuacauuaauagccccgagcuggagcuugaagaacugaacgccaaaucuccggggcagccuauccaaguggucuacguucccagccaccucuaucauaugguguucgaacuguucaagaaugcgaugcgggccaccauggagcaccacgcuaacagaggaguguacccucccauccagguccaugugacacugggcaaugaagaucucaccguuaagauguccgaccgcggcgggggagugccccugcggaaaauugacagacuuuuuaacuauauguacucuacggccccucgcccgcgggucgagaccagcagagcugugccccuggccggcuucggguauggacucccuaucucccgccuguacgcccaguauuuucaaggcgaucuuaagcuguacagccucgagggguacggaacagacgcuguuauuuauaucaaagcgcugucuaccgauuccauugaacggcugcccguguacaacaaggccgcuuggaaacacuauaauacaaaccaugaggccgacgauuggugcgucccuagcagagaacccaaggacaugaccacguuccgcucugccuga

SEQ ID NO: 73571 - RNA, 1032 nt, Artificial Sequence
  derived and/or modified sequence opt5 from PDK2__Homo_sapiens__NP_001186828
augaaggagaucaaccugcuccccgacagagugcugagcaccccuuccguccagcuuguucaaucuugguacgugcagagccugcucgauauuauggaauuucuggacaaagauccggaggaccaccggacacuuucccaguuuacggaugcccuggugaccauccgcaauagacauaacgacgucgugcccacaauggcucagggcguucucgaauauaaggauaccuacggggacgauccugugucuaaucaaaacauucaguauuuccuggaccgguuuuaccugagccgcaucuccauuagaaugcucaucaaucagcacacacugaucuucgauggaucuaccaaccccgcccauccuaaacacauuggcagcaucgaccccaauugcaacgucuccgaggugguuaaggaugcguaugacauggcuaaacuucugugugacaaguacuauauggccagcccugaucucgaaauucaggagaucaaugccgcuaacucuaagcaaccgauucauaugguguacguccccucccaccuguaccacaugcuuuuugagcuguucaaaaaugccaugcgggcuacaguggaaagccaugagucuucccucauccugccucccauuaaggugauggucgcccugggggaagaggaccucagcaucaaaaugucugaucgcggaggcgggguuccucugagaaagaucgagcggcuuuucuccuauauguacagcaccgcgcccacgccgcagccuggaaccggcggcacaccccuggccggguucggauauggccucccuauuucccgccuguacgcuaaauauuuucagggggaccuucagcuguucucuauggaaggauuuggcaccgaugccgugaucuaccucaaggcucugagcacagacuccguggagagacugcccgucuauaacaagagcgccuggcggcacuaccaaaccauucaggaagcgggggauuggugcgugcccucuacggagccuaaaaauacauccaccuaccgcguuagcuga

SEQ ID NO: 73572 - RNA, 1248 nt, Artificial Sequence
  derived and/or modified sequence opt5 from PDK3__Homo_sapiens__NP_001135858
augagacuguuccgguggcuccugaagcagcccgugccuaaacaaaucgagcgcuacagcagauuuuccccgucuccccuuagcauuaagcaguuccuggacuuuggccgggauaacgccugcgaaaagaccuccuauauguuccuccgcaaggagcugccugucagacuugcuaauacaaugcgggaaguuaaccugcuccccgacaaucugcugaaccgcccuucuguggggcucgugcagagcugguacaugcaguccuuucuggagcuucuggaauaugagaauaaaucucccgaggauccucaaguccucgacaacuuccuucaggugcugaucaagguuagaaaucggcacaacgauguggucccgacgauggcccagggagugauugaauacaaggagaaauuuggcuucgaccccuuuaucagcaccaauauucaguauuuccuggaucgcuuuuacacaaacagaaucuccuuccggaugcucaucaaucaacauacccugcuguuugggggagacacaaacccuguucaccccaagcauauuggcagcaucgauccuaccuguaauguggcggacgucgugaaagaugcuuaugaaacagccaagaugcucugcgagcaguacuaccugguggcccccgagcuugaagucgaggaguucaacgcuaaagccccggacaagccuauucagguuguguaugugcccucucaccuguuccauaugcucuuugaacuguucaaaaauuccaugcgcgcuaccgucgaacuuuacgaggauagaaaagagggguauccugccgugaagacgcugguuacccucggaaaagaagaccugagcaucaagauuucugaccugggcggcggggugccccuccggaaaaucgaucgccuguuuaacuacauguauuccacagcgcccagaccuagccuugagccgacccgggccgcuccccuggccggauucggcuacgggcucccuauuucuagacuguaugcucgcuacuuucagggagaccuuaagcuguacuccauggaaggcgucgggacagaugccgugaucuaucucaaagcgcugagcuccgagucuuucgaacggcugcccguuuuuaacaagagcgccuggagacacuacaagaccacgccugaggcugacgauugguccaaucccagcucugagccgcgcgacgccuccaaauauaaggcuaaacaagauaagaucaaaacaaaccggaccuucuga

SEQ ID NO: 73573 - RNA, 1236 nt, Artificial Sequence
  derived and/or modified sequence opt5 from PDK4__Homo_sapiens__NP_002603
augaaggccgcuagauucgugcugcggagcgccggcucccucaacggggcgggacuggucccccgcgagguugaacacuuuucuagauacagcccuuccccgcuuucuaugaaacagcugcucgacuucggcagcgagaaugcuugcgaacggaccuccuuugccuuccugcgccaagagcuucccgugagacuggccaacauccucaaggaaauugauauccugccuacacagcuggugaauacgucuagcguccagcucgugaaauccugguauauucagagccugauggaccuuguugaguuucaugagaagucucccgaugaccaaaaagcucuguccgauuucguggacacccucaucaagguccggaaccgccaccauaaugugguuccuacaauggcccaggggauuaucgaauacaaggaugcuuguaccguggaccccgucacaaaccagaaucugcaguauuuucuugauagauucuacaugaaccggaucagcacccgcaugcugaugaaucaacacauucucaucuuuucugacucccagacaggaaacccuagccauauuggcucuaucgauccgaauugcgacgugguggccgucguucaggaugcguucgaguguuccagaaugcugugcgaccaguauuaccugagcucccccgaacucaaacugacccaagugaacgggaaguuuccugaccagcccauucacaucguguaugucccuucucaccuucaucacaugcuguucgagcucuuuaaaaaugccaugcgggcuacgguggagcaucaggaaaaccaacccagccugaccccgauugagguuaucgugguccuuggaaaggaagaucugacaaucaaaauuuccgaccgcggcggcggggugccucucagaaucauugaucggcuguucagcuacaccuacucuacagcccccaccccuguuauggacaauucccgcaacgcuccccuggccggauucggcuaugggcuccccaucagcagacuguacgcgaaguauuuucagggagaucuuaaccuguacucucucagcggcuaugggacggacgccauuaucuaccugaaggcucuuuccucugagagcaucgaaaaacugccuguguucaauaaguccgccuuuaaacacuaucagaugagcucugaggcugaugacugguguauuccgucccgggagcccaagaaccucgccaaagaagucgccauguga

SEQ ID NO: 73574 - RNA, 990 nt, Artificial Sequence
  derived and/or modified sequence opt5 from PDLIM1__Homo_sapiens__NP_066272
augaccacccagcaaaucgaccugcagggccccgggccuuggggauucagacucgugggcgggaaggauuuugagcagccgcuggccauuagccgggucacgcccggauccaaagcugcccuugcgaaccugugcaucggcgacguuauuaccgcuaucgauggggaaaauacaucuaacaugacccaccucgaggcccagaaucgcauuaagggauguacagacaaccugacccuuacaguggccagaagcgaacauaaagugugguccccucuggucaccgaggaaggcaagcggcaccccuacaaaaugaaucucgcuucugagccucaagaggugcugcauaucggcagcgcccacaaccgcuccgcuaugcccuucacggccucuccugcgagcuccaccacagccagaguuaucaccaaucaguauaacaauccggcugggcuguacagcucugaaaacauuuccaauuuuaacaaugcccucgagagcaagacagcugccucuggaguggaagcgaacucccggccccuggaucaugcccagccucccagcucucuugucaucgacaaggaguccgagguguauaaaaugcugcaggaaaagcaagagcucaaugaaccucccaaacagagcaccuccuuccugguucuucaggagauucuggaaucugaggagaagggcgauccgaacaaaccuagcggguuucgcuccgugaaggcucccgucacgaagguggccgcuagcaucggaaacgcccagaaacucccuaugugcgacaaguguggcacagggauugugggagucuucguuaaacugagagaucggcaccgccaccccgaaugcuacguguguaccgacugcggcacaaaucugaagcaaaaaggccacuuuuucguggaggaucagaucuauugugaaaagcaugccagagagcgggucacacccccugaaggguacgaggugguuaccguguuuccgaaauga

SEQ ID NO: 73575 - RNA, 1809 nt, Artificial Sequence
  derived and/or modified sequence opt5 from PDLIM2__Homo_sapiens__NP_067643
augagaggcgggcgggcccgccccgcuugggagagcuucaugggacugccuccgagauccucugccaaguggggcgcggggcagagccucgaccggcugugcugugcucccggaucccgcggccuugccggggccccuggaagaaugcgggcucccccugccggccgcucucaacccgcuggcgggccuggagauagccugccgcaucccccuggcgggcucggacccggcggguccgccugggcgagacgggccgaagcugccgcuucucgcgccagaggaggcggccggggaggaccuggcaucaccugggcggaggccgggcccggagcuccgggcgggcugagcccugaauccggacgcagacagcgggagcgcuggagacuucccgccuuuccucccagccgggcuugggcccccucuagaacaggcgaacgccagccuggcgagcgggcccaccugagacucuccgcucgcccggcgcugcccggggccggacugcucagcgcuccucugucugcccggaaccccggccuugugagagggccugcccccuggucccuggcuagcgccggagcgccgccucgcgcugcccucucucccgccggcgcucugcuucugcagccucccgcccggagaguccucugcccucgcuccgaagggggcagccggacggggagagcuggccccuccgggugggccccgccucgcggagcgcggucugccgagagcaccgacagacugaaaggcauggcucugacaguugauguggccgggcccgcucccuggggauuccggauuaccggcgggcgcgacuuucacacaccuaucauggugaccaaggucgccgagagaggcaaagcgaaggaugccgaccuccggccgggagauauuaucguggcuauuaauggcgaauccgccgaggggaugcugcaugcugaggcccaaagcaaaaucagacagucucccuccccucuucgccugcagcucgaccggagccaggccacaucucccggacaaaccaacggcgauagcucccuggaaguucuugcuacgagauuccaggggucugugcgcaccuacacagagagccaguccagccugagaucuuccuauagcucuccuaccucccucagcccccgggcgggauccccuuuuucucccccgccuagcuccucuagccugacaggcgaagccgcuaucucccgcagcuuccagucucuggccuguucccccgggcucccugccgcugacagacugagcuacucuggccggcccggaucccgccaagccggccuugggagagcgggagauagcgcuguccuggugcucccgccuucucccggcccucggagcucccgccccagcauggacucugaagggggaucccugcuucuggaugaggacagcgagguuuuuaagaugcuccaggagaauagagaaggccgggccgcuccccgccaguccucuagcuucagacugcugcaagaggcccucgaagccgaggaaagagggggcaccccugcguuucugccguccucucuuagcccccaguccucucugccugcuagccgggcccucgccacgcccccuaagcugcacacaugcgagaaauguuccaccagcauugcuaaccaggccgugcgcauccaggagggacgguauagacaucccggcugcuacacaugugcugacugcgggcugaaucuuaagaugcgcggacacuucugggucggcgaugaacucuauugugagaaacacgcccggcaaagauacucugcgccugccacccuguccagccgcgcuuga

SEQ ID NO: 73576 - RNA, 951 nt, Artificial Sequence
  derived and/or modified sequence opt5 from PDLIM3__Homo_sapiens__NP_001107579
augccccagaccgugauccugccuggcccggcccccuggggguucagacucagcggaggcauugacuuuaaccaaccucuggucaucacacggauuacgcccggguccaaggcugccgcggcuaaucuuugcccuggagauguuauccuggccauugacggcuucgggaccgagucuaugacacacgccgaugcucaggaccgcaucaaagccgcugcccaucagcucugucugaagaucgauagaggagaaacccaccuuuggagcccccagguguccgaggacggcaaagcgcauccuuuuaagauuaaccuggaaucugagccgcaagaguucaaacccaucggcacagcccacaaucggcgcgcucagccuuuuguggccgcugccaacauugaugacaagagacaggucgugagcgcguccuacaauucucccaucgggcucuauagcaccuccaacauucaggaugcccugcauggacaacugcggggccucaucccuagcucuccccagaaugaaccgacagcuuccguuccucccgagagcgacguguaccgcaugcugcacgauaacagaaaugaaccuacccagccccggcagucuggguccuuccgcguccuucaaggaaugguggacgauggcagcgacgacagacccgccgggacgcggucuguucgcgcuccugugaccaagguccacggaggcuccggcggggcccagagaaugccgcugugcgauaaauguggaagcggcauugugggggccguggucaaggcucgggacaaauaucgccaucccgagugcuuuguuugugcggauugcaaccucaaucugaagcagaaaggauacuucuuuaucgaaggcgagcuuuauugugagacacacgccagagcucggaccaagccucccgaaggguacgacacagugacccuguauccuaaggccuga

SEQ ID NO: 73577 - RNA, 741 nt, Artificial Sequence
  derived and/or modified sequence opt5 from PDLIM4__Homo_sapiens__NP_001124499
augccccacagcgugacccugagaggcccuuccccguggggguuccggcucgucggaggccgcgacuuuucugcuccccugacaaucagcagaguucaugccggguccaaggccgcgcuugcugcccugugcccuggagaucucauucaggccaucaacggcgagucuacggaacugaugacccaccuugaggcucaaaaucggauuaaagggugucaugaccaccugacacucagcgugucccgccccgaaggaagaucuuggccuagcgcccccgaugacuccaaggcucaggcccaucggauccacauugauccugagauccaggacggcagcccgaccacaucucgcagacccuccggcaccgggacaggaccugaagauggccggcccagccuggggucuccuuacggacagcccccgcgcuucccugugccccacaacggcuccagcgaggcgacccugccugcccaaaugucuacgcuccaugucuccccuccgcccagcgcugaccccgccagagggcugccccggucccgcgauugcagaguggaccuuggaucugagguuuaucggaugcugcgcgaaccugcugagcccguggccgcggaaccuaaacagagcggcuccuuuagauaccuccagggcaugcuggaggccggggagggaggcgcucccagcucucggcacgggaccuccagcacaaucccgucugccagcugugcugucaccgccgccuga

SEQ ID NO: 73578 - RNA, 1464 nt, Artificial Sequence
  derived and/or modified sequence opt5 from PDLIM5__Homo_sapiens__NP_001011513
augagcaacuacuccgugucucuggucggccccgccccuuggggguucagacuccagggaggcaaggacuuuaauaugccgcugaccaucagcucccuuaaagaugggggaaaggcugcccaagcgaacguucggauuggcgacguggugcugucuaucgaugggauuaaugcucagggaaugacacaccucgaggcccagaacaaaaucaagggcugcacgggcagccugaauaugacccuucagcgcgccuccgcugcccccaaaccugaacccgucccugugcaaaagcccacaguuaccucuguguguagcgagacaucccaggaacuggcugaggggcagagacggggaagccagggcgacucuaagcaacagaacgggccuccgcgcaaacauauugucgaaagauauaccgaguucuaccacgugcccacacauuccgaugccagcaagaaacggcucaucgaggacaccgaagauuggcgcccuagaacgggaaccacacagucucgguccuuucgcauccuggcgcagauuaccggcacagagcaccugaaggaaagcgaggccgacaauaccaaaaaggcuaacaauucucaagagcccuccccucagcucgccagcuccguugcuucuacgagaagcaugcccgaaucccuggauagcccgacaucugggcggccuggagugaccucccuuacaaccgccgcggccuucaagcccgucggcagcaccggcgugaucaaaucuccuagcuggcagcgccccaaccaaggggugcccuccacaggaagaauuucuaauagcgcuacguauuccggcagcgucgccccugcuaacucugcccuggggcagacccagccguccgaccaggauacacucguucaacgggccgagcauauccccgcuggaaagcgcaccccuaugugcgcgcacuguaaucaggugauuagaggccccuuucugguggcccuugggaaaagcuggcacccugaagaguucaacugcgcucauuguaagaauacaauggccuacaucggauuugucgaagagaaaggcgcccuguauugcgagcucuguuacgaaaaguucuuugcucccgagugcggccggugucagagaaaaauucugggggaagugaucucugcccugaagcagaccuggcacguuuccugcuucgugugugucgcgugcggaaagccgauccgcaacaacguguuucaucucgaggacggcgaaccuuauugcgagacggauuacuacgcucuguucgggacaauuugucacggaugcgaguuucccaucgaagccggcgacauguuccuugaggcccugggguauaccuggcacgacaccuguuucguuugcagcguguguugcgaaucccucgagggccaaacauuuuucucuaaaaaggauaaaccucuguguaagaaacaugcucacagcgucaauuuuuga

SEQ ID NO: 73579 - RNA, 1374 nt, Artificial Sequence
  derived and/or modified sequence opt5 from PDLIM7__Homo_sapiens__NP_005442
auggacagcuucaaggugguccuggagggccccgccccuuggggguuuagacuccagggaggcaaagauuucaacguuccgcuguccaucucucggcuuacccccgggggaaaggcugcccaagcgggcguggcugugggggacuggguccugagcauugauggagaaaaugccggcucccucacacacaucgaggcccagaacaaaauucgcgcuugcggcgaaagacugucucuugggcugagccgggcccagccugugcaguccaagccccaaaaggcuucugccccugcggccgaucccccucgcuacacguuugcuccgagcguuucccucaauaaaaccgccagacccuucggagcuccucccccugccgacagcgcgccccagcagaacggccagccgcugcggccucuggugcccgacgccucuaagcaacgccucauggagaauacagaagauuggagaccucggcccgggaccggacagucccgcagcuuuagaauccuggcucaucuuacaggcaccgaguucaugcaggaccccgaugaggaacaccugaaaaagucuucccaggucccucggacagaggccccggcucccgccagcucuaccccucaagaacccuggccugggcccacggccccguccccuaccagcagacccccuugggcuguggaccccgcguuugccgagcgcuaugcuccugauaaaacauccaccguucucacacggcauucucagcccgccaccccgacgccucugcagagccgcacauccauugugcaagccgcugccggaggcguccccggcgggggaagcaacaauggcaagacccccgugugucaccagugccauaaagugaucagagggcgguaccuugucgcgcugggacacgcuuaucacccugaggaguucguuuguucucagugcggcaaggugcucgaagaagggggauuuuucgaggaaaagggcgccaucuuuuguccgcccugcuacgacgugagauaugccccuuccugugcuaaaugcaagaaaaagauuacaggcgagaucaugcaugcccugaaaaugaccuggcacguccauuguuuuaccugcgcugccuguaagacacccauucgcaaccgggcguucuacauggaggaaggggugccuuauugcgagagagauuacgagaaaauguucggaacgaagugccacggcugugacuucaagaucgacgccggggaucgcuuucuggaagcucucggauucagcuggcacgauaccugcuuuguuugugccauuugccagaucaaucuggaaggcaaaacauucuacucuaagaaagaccggccccuuuguaagagccaugcuuuuucccacguguga

SEQ ID NO: 73580 - RNA, 1689 nt, Artificial Sequence
  derived and/or modified sequence opt5 from PDP1__Homo_sapiens__NP_001155251
augugcgugugucccggcccuagacggaucgggauuccgguccgcagcuccucucugccccucuucagcgacgccaugccugcucccacccagcuguuuuucccucuuaucagaaacugcgagcugucccggauuuacggaacagccuguuauugccaccauaagcaccucuguugcucuagcuccuacaucccccaaucucgccugagauauacgccucauccggcguacgcuaccuuuugucggcccaaagaaaauugguggcaguauacacagggccgcagauacgccagcaccccucagaaguucuaucuuacacccccucaaguuaacuccauucugaaagccaaugaguacagcuuuaaggugcccgaauuugaugggaaaaacgugucuuccauccucggauuugacagcaaucagcugccggcuaacgccccuaucgaggaucggcgcucugcugcgaccugccugcagacaagaggcaugcuccugggggucuucgacggacacgccggcugugccugcucccaggcugugagcgaacggcuuuucuacuauauugccguuucucugcucccccaugagacccugcuugagaucgaaaaugcuguggaguccggccgcgcccugcucccuauucugcaauggcacaagcaccccaacgauuacuucagcaaggaagcguccaaacuguauuuuaauucucucagaacguacuggcaggagcugaucgaccuuaacaccggggagagcacagauauugacgucaaggaagcccugaucaaugcuuucaaacggcucgauaacgacauuucccuggaggcccaggugggagaucccaauagcuuucuuaacuaucugguucuccgcguggcuuucucuggcgccaccgccugugucgcucauguggacgggguggaucugcacgucgcgaauacaggagacuccagagccaugcugggcguucaggaagaggacgggagcuggucugcugugacccucagcaacgaucauaacgcccaaaaugaacgggagcuggagagacuuaagcuggaacacccuaaauccgaggccaagucuguggucaagcaggaccgccuccugggacuucugaugccguuccgggcuuuuggcgaugugaaauucaaguggagcaucgaccuccagaaaagaguuaucgaauccggccccgaucaacugaacgacaaugaguacacgaaguuuauuccucccaacuaucacacaccucccuaccugaccgccgaaccggaggugacauaccaucgccuccggccucaggauaaauuccugguccuugcgaccgacgggcugugggagaccaugcacagacaggaugugguucgcaucgugggagaauaucucacaggcaugcaucaccagcaacccauugcugucgggggauacaaggugacgcugggccagaugcaugggcugcuuaccgagcggagaacaaaaaugagcucugucuuugaagaccagaaugccgccacccaccucauccgccacgcugugggaaacaaugaguucggcacaguugaucaugaacggcuguccaagaugcugagccucccugaggagcuggccagaauguaucgcgacgacauuaccaucaucgugguccaguuuaacucucacgugguuggcgcuuaccaaaaucaggaauga

SEQ ID NO: 73581 - RNA, 1590 nt, Artificial Sequence
  derived and/or modified sequence opt5 from PDP2__Homo_sapiens__NP_065837
augagcuccaccgugucuuacuggauccugaacagcacaagaaauuccauugccacgcuccagggcgggcggcgccuguauucuagauacgucagcaaccggaauaaacuuaaauggcgccuguucuccagaguucccccuacccucaacucuagcccgugcggaggcuuuacacuguguaaggcuuaucggcacaccuccacagaggaagacgauuuccaucuucaacugagccccgagcagaucaaugaagugcuccgcgccggggagaccacacacaaaauucuggaccuggaaucuagagugccuaacuccguccuccgguuugagagcaaucagcuggcggcuaacucucccguggaggaucgcagaggaguugccuccugccuucagaccaauggccugauguucgggaucuuugacggacauggcggccacgccugugcucaagccgugagcgaacgccucuucuacuaugucgcugugucucugaugucccaucagacgcuugagcacauggaaggggccauggagagcaugaagccucugcuccccauucugcacuggcugaaacauccuggagauuccaucuacaaggacguuaccucugugcaccucgaucaucugcgggucuauuggcaggagcuucuggaccuccacauggaaaugggccugagcaucgaggaagcgcuuauguacuccuuucagagacuggauagcgacauuucucucgagauccaagccccgcuggaagaugaggugacacggaaccugucccuccagguggcuuucagcggggccaccgcuugcauggcccacgucgacggcauucaucugcacguugcgaaugccggagauugucgcgcuauccuuggggugcaggaggacaacggaauguggucuugccugccccucacaagagaccauaaugccuggaaccaggcugaacugagccggcuuaagagagagcacccugaauccgaggaucgcaccauuaucauggaagaccggcugcucggcgugcugauucccuguagagccuuuggcgauguccaacugaaauggucuaaggagcuccagcgcagcauccuggagcggggguucaauacggaagcccuuaacaucuaccaguuuacaccuccccauuauuacaccccgccuuaucugacagcugagcccgaagugaccuaccacagacuccgcccucaagacaaauuccugguucuggcguccgauggacuuugggacaugcucagcaacgaggaugugguccggcuggugguuggccaccuggccgaagcugacuggcauaagaccgaucucgcccagagacccgccaaucuggggcuuaugcagucucugcuccugcagcgcaaggcuuccggacugcacgaggccgaccaaaacgcggcuacacggcuuauuagacaugccaucggcaauaacgaguauggggaaauggaggccgaacgccucgcugccaugcugacgcugcccgaggaucucgcucggauguacagagacgacauuaccgugacagucguguauuuuaauagcgagucuaucggagccuacuacaagggcggcuga

SEQ ID NO: 73582 - RNA, 1365 nt, Artificial Sequence
  derived and/or modified sequence opt5 from PDPK1__Homo_sapiens__NP_001248745
auggccagaaccacaagccagcuguacgacgcugugcccauccaauccucugucguucucugcagcuguccuuccccgucuauggugcggacgcagaccgagagcuccacacccccuggcauucccgggggaucucgccagggcccugccauggaugggaccgcggcugaacccagaccuggagccggcagccugcagcacgcccaaccgcccccucagccccggaagaaacgcccugaggacuucaaguuugggaaaauccuuggagaaggcuccuucagcacagugguccuggcuagagagcucgccaccucucgggaauaugcuauuaagauccuggagaaacgccauauuaucaaggagaacaaggugcccuacguuacaagagaacgggaugugaugucccgccuugaccacccguuuuucgucaaacuguauuuuaccuuccaggaugacgagaagcucuacuuuggccugagcuaugccaaaaauggggaacugcucaaguacaucagaaaaauuggaucuuucgaugagacgugcacccgguuuuauacagcggagaucguguccgcccuggaauaccuucauggcaaggggauuauccaccgcgaccugaagccugagaacauucuccugaaugaagauaugcauauccagauuaccgacuucggaacagcuaaaguucuuagccccgagucuaagcaagccagagcuaacuccuuugugggcaccgcccaguacgucagcccugaacugcucacggagaaauccgcguguaagucuagcgaucugugggcccuggggugcaucaucuaucagcucguggcuggacugccucccuuccgggccggcaaugaguaccuuauuuuucagaaaaucauuaagcuggaauaugacuuccccgagaaauucuuuccgaaggcucgcgaucucguggaaaagcugcuuguccuggacgccacaaaaagacucggcugugaggaaauggagggguacggaccccugaaggcccacccuuucuuugaguccguuaccugggaaaaccugcaccaacagacacccccuaaacucaccgcuuaucugcccgcgaugagcgaggacgaugaagacugcuacggcaauuaugauaaccuucugucucaguucggguguaugcaaguguccagcucuagcuccucucauagccucuccgccagcgacaccggacugccgcagcggucuggcuccaauaucgagcaguacauucacgaucuugacagcaacucuuuugaacuggaucuccaguucuccgaggacgagaagagacugcugcucgaaaaacaagcugggggaaauccuugccugacaggccgcaucaucuga

SEQ ID NO: 73583 - RNA, 2640 nt, Artificial Sequence
  derived and/or modified sequence opt5 from PDPR__Homo_sapiens__NP_060460
augauguucuacagacugcucagcaucgugggccggcagcgcgccucccccggguggcaaaacuggucuagcgcuagaaauuccaccucugccgcggaggcucggagcauggcccugccuacacaggcccaggucguuauuugcggaggcgggaucacgggaaccuccguggcuuaucaccuuucuaagaugggcuggaaagacauugugcugcucgaacaggggcgccuggccgcuggaagcacaagauuuugugccggcauccuuuccaccgcgcggcaucugacaauugagcaaaagauggccgauuacagcaacaaacucuauuaccagcuggaacaggagaccggcauccagacaggguauacccgcacgggaucuaucuuccuggcucaaacccaggacagacucauuucccugaagcggaucaaugccggccuuaacgucauugggaucccgagcgaaauuaucucucccaaaaagguggcugagcugcaccaucuccugaauguucacgaucuugugggagccaugcaugucccugaggacgcggugguuuccagcgccgauguggcucuggcccucgcuucugccgccucccagaacggcguccagauuuacgaccgcacaagcgugcugcacgugauggucaagaaagggcaaguuaccggaguggaaacagauaagggccagaucgagugccaguauuuugugaauugugcuggccaaugggcguacgaacuggggcucuccaacgaggagcccgucucuaucccucugcacgccugcgaacauuucuaccuucugaccagaccccucgagacgccucugcagagcuccacaccgaccauuguggacgcugauggacggaucuauauucgcaauuggcagggcgggauccuuagcggaggcuuugagaaaaaccccaagccuauuuucacagaggggaaaaaucagcuggaaauccaaaaccuccaggaggacugggaucacuuugagccccugcugucuucccuccugagacggaugccugaacuugagacccuggaaaucaugaagcucguuaauugucccgagaccuucacaccggacaugcgcugcauuaugggagaaagcccugccgugcagggcuacuuuguccuggccggcaugaacucugcugggcuuagcuucggaggcggggccggaaaguaucuggcggaguggauggugcauggcuaccccuccgagaauguuugggaacucgaucugaaaagauuuggggcucugcagucuagccggacguuccucagacaccgcgugauggaggucaugccucugauguaugaccuuaaggugccccggugggacuuucaaaccggcagacagcugcgcacaagcccccucuacgaucggcuggacgcccagggagccagauggauggaaaaacacggcuucgagcgcccuaaguauuucgucccgcccgauaaagaccugcuugcucucgaacaguccaagaccuuuuacaaaccugauugguucgacaucguggagucugagguuaaguguugcaaggaagccgugugugucauugauauguccagcuuuacaaaauucgagaucaccucuacgggggaccaagcucuggaagugcugcaguaccucuuuuccaacgaucuggacguucccgugggacauauuguccacacaggcaugcuuaacgaagggggaggcuaugagaaugauugcagcaucgcccggcugaacaagagauccuucuuuaugaucucuccuaccgaccaacaggugcauuguugggcguggcucaaaaagcacaugcccaaagacagcaaucugcugcuugaagaugugaccuggaaguacacagcccucaaccugauugggccgcgcgcuguugacguccuguccgagcucucuuaugccccuaugacccccgaucauuucccuagccuguuuugcaaggaaauguccgugggcuacgcuaauggaauccgggugaugagcaugacacacacgggcgagcccggguucaugcuuuauauuccuaucgaauacgcccugcacgucuauaacgaggugaugucuguuggacagaaauacggcauuagaaaugcgggguacuaugcccuccgcucccugcggaucgagaaguuuuucgcuuuuuggggacaggacauuaacaaucugaccacaccccuugaaugcggcagagagagccgggugaaacucgaaaaggggauggauuucaucggccgcgacgcccugcugcagcaaaaacagaacggagucuacaagagacucaccauguucauccuggaugaccaugauucugaccuugaucuguggccgugguggggcgagccuauuuaucggaaugggcaguacgugggaaagacaaccuccagcgcuuauucuuacagccucgaaagacacguuugucugggcuuugugcauaacuucuccgaggacacgggggaggaacaggucgugaccgccgauuuuaucaaucgcggagaguaugaaauugacaucgccggcuaccgguuccaagcuaaagcgaagcuguaccccguugccagccuuuuuacacagaaaagacgcaaggacgauauggagcucucugaccugcacgggaaauga

SEQ ID NO: 73584 - RNA, 402 nt, Artificial Sequence
  derived and/or modified sequence opt5 from PDRG1__Homo_sapiens__NP_110442
augcugagccccgaggccgaaagagugcuccgguaccuggucgagguugaggaacuugcugaagaggugcuggccgacaagcgccagaucguggaucucgacaccaaaagaaaccaaaaucgggagggccugcgcgcgcuucagaaggaucugucccucucugaagacgucauggugugcuucgggaacauguuuauuaaaaugccucacccggagacaaaggaaaugaucgagaaagaucaggaccaucuggauaaggagauugaaaagcugagaaaacagcucaagguuaaagugaaucggcuguucgaggcucaaggaaagcccgaacuuaaaggcuuuaaccugaauccucucaaccaggacgagcugaaggcccuuaaggucauccugaaaggguga

SEQ ID NO: 73585 - RNA, 4014 nt, Artificial Sequence
  derived and/or modified sequence opt5 from PDS5A__Homo_sapiens__NP_001093869
auggacuucaccgcccagcccaagccugcuacagcccugugcggcguggucagcgcggaugggaaaaucgcuuacccgcccggaguuaaggagauuacggacaaaaucaccacagaugaaaugauuaagagacucaaaaugguggugaagaccuuuauggacauggaucaagacuccgaggaugaaaagcagcaguaucugccucuugcccugcaccucgccucugaguucuuucugcggaaccccaauaaagacguccgccuucugguggcuuguugccucgccgauaucuucagaauuuacgcuccugaagcccccuauacaagccaugacaagcugaaagauaucuuucuguucaucacccggcagcucaagggccuggaggacacaaaauccccucaauuuaaccgcuacuucuaucuucuggagaaucucgcguggguuaagucuuacaacauuuguuuugaacuggaggauugcaaugaaaucuucauucagcuuuuuagaacccuguucagcgugaucaacaauucccacaacaagaaaguccagaugcauaugcucgaccugaugucuagcauuaucauggagggggacggagugacgcaggagcugcucgauuccauucugaucaaucuuaucccggcccacaagaaccugaauaaacaaucuuuugaccucgcuaagguucugcuuaaacggaccgugcagacaauugaagccuguaucgcuaacuucuucaaucagguccuggugcucggccgcagcuccgugagcgaucugucugagcaugucuuugaccugauucaggaacucuucgccaucgauccccaccuucuucuguccguuaugccucaacucgaguuuaagcugaaaagcaacgacggggaagagagacuugcgguggugcggcugcucgccaagcuguucggaucuaaggauuccgaccuggcuacccagaaucgcccccucuggcagugcuuucugggcagauucaacgauauucacgucccugugcggcuugagagcguuaaauuugccucccauugucugaugaaccaccccgaccucgcuaaggaucugacagaauaucugaaagugcgcucucaugacccggaggaagccaucagacacgacgucaucgugaccauuaucacggccgcuaagcgggaucuugcgcucguuaaugaccaacugcugggcuucgugcgcgagagaacacucgauaaacgguggagaguccgcaaggaagccaugauggggcuggcucagcuuuacaagaaauacugccugcacggagaggccggcaaggaggccgcugaaaaagugagcuggauuaaggacaaacuccugcauaucuauuaccagaacuccauugaugacaagcugcuugucgagaagaucuuugcccaguaucucgugccucacaaucuggaaaccgaggaacggaugaaaugucuguacuaucucuacgcgagccuggaucccaacgcuguuaaggcccuuaaugagauguggaaaugccaaaacaugcugagaucucaugugcgcgagcuccuggaccugcacaagcagccuacauccgaagccaauuguagcgcuauguucgggaaacuuaugaccaucgccaagaaccuccccgaucccggaaaggcucaggacuuugucaaaaaguucaaucaggugcugggcgaugacgagaaacugcggucucaacucgaacugcuuauuagcccuaccugcuccugcaagcaggccgauaucuguguuagagagauugcgcgcaaacuggccaacccgaagcagcccacaaauccuuuucucgagauggugaaauuccugcuggaacggaucgcucccguccauauugacucugaggccaucagcgcucuugugaagcucaugaacaaguccauugaagggacggccgacgaugaggaagagggagugagcccugacaccgcgaucagaucuggccuggagcugcucaaaguucuguccuucacacaccccaccagcuuucacucugccgaaacauaugagucccuucugcagugccuccgcauggaagaugacaaggucgcugaggccgcuauccaaauuuuccggaauaccggccauaaaaucgaaacggaucugccgcagauuagaagcacacugaucccuauucuucaccagaaggccaaacgcgggacaccccaucaggccaagcaagcugugcacuguauccacgcgaucuuuaccaacaaggaggugcagcuggcccagauuuucgagccucucucccggucucugaaugcugacguccccgaacaacucaucacaccucuggugagccuuggacauauuuccaugcuggcccccgaucaguuugccucuccgaugaaaagcguuguggcuaacuucaucgucaaggaccuccugaugaacgauagauccaccggcgagaaaaaugggaagcuguggagcccugacgaagaggugucucccgaaguucuugccaaagugcaggcgauuaagcugcucguccgguggcugcucggaaugaagaacaaucaguccaaaagcgcuaacucuacacugcgccuucuguccgccaugcucgugagcgagggcgaucugacggagcaaaagagaaucucuaaaagcgacaugucccggcugagacuugccgcugggagcgccaucaugaagcuggcgcaggaacccugcuaccacgagauuaucaccccugaacaguuucagcucugugcucugguuauuaaugaugagugcuaccaagugcgccagaucuucgcccagaaacuccauaaggcccuggucaagcugcugcugccgcucgaguauauggcuauuuuugcccugugugcuaaagaccccgugaaggaacggagagcccacgcgcgccagugccuucugaaaaacaucucuaucagacgggaguacauuaagcaaaauccuauggccacagaaaaacuccugucccuccugcccgaguauguggucccuuacaugauccaucuucuggcucacgaccccgauuucacccgcagccaggacguugaucagcugagagacauuaaggaaugucucugguuuaugcuggaggugcuuaugaccaaaaacgagaauaacucccacgccuucaugaagaagauggcugaaaauaucaaacugacccgggaugcccaaucuccugacgagagcaagacgaacgaaaaacucuauaccgugugcgaugucgcccugugugugauuaauuccaagucugcucucugcaacgcggacagccccaaagauccgguucugccuaugaaguuuuucacacagcccgagaaggacuucugcaaugauaaauccuacaucucugaagagacccgcgugcuucugcugacaggaaagccuaaacccgccggcguccucggcgcugugaacaagccgcugagcgccaccgggagaaaaccuuauguucgguccacgggaacagagaccggcagcaacauuaaugugaacucugaacuuaaucccuccacagggaaccgcagcagagagcagucuuccgaagccgcugagaccggagucagcgaaaaugaggagaacccugugcggaucaucucuguuacccccgugaagaauauugaccccgucaagaacaaagaaaucaauuccgaccaggccacacaaggcaacauuagcuccgaucgcgggaagaaaagaacggugaccgcggcuggcgccgagaauauccagcagaagacagacgaaaaaguggaugagagcggaccuccggcccccucuaagccucggagaggccgccggcccaagagcgagucccaggggaacgcuaccaaaaaugacgaucugaacaagccuauuaauaaaggaagaaagcgcgccgcggucggccaagaaucucccgggggacucgaggcuggcaacgccaaagccccuaagcugcaggaccucgcuaagaaagccgcuccggccgaacggcagaucgaucugcagagauga

SEQ ID NO: 73586 - RNA, 4344 nt, Artificial Sequence
  derived and/or modified sequence opt5 from PDS5B__Homo_sapiens__NP_055847
auggcccacagcaagaccagaacaaacgacggcaaaaucacguaucccccuggggugaaggagauuuccgauaaaaucucuaaggaagagaugguccggcgccugaaaaugguugugaagaccuucauggacauggaucaggacagcgaagaggaaaaggagcucuaccugaaucuugcucugcaucucgccuccgacuuuuuccugaaacacccggauaaggaugugagacuucuggucgcgugcugucucgcugacauuuuucggaucuacgcccccgaggccccuuauacaucucccgauaaacugaaggacauuuucauguuuaucacccgccaacugaaaggacucgaagauacaaagagcccucaguucaacagauacuuuuaucugcuugagaauaucgcuugggugaaguccuacaacauuugcuucgaacuggaggacucuaaugagaucuuuacccagcucuaucggacacuguucagcguuauuaacaauggccauaaccagaaagugcacaugcauauggucgaucuuauguccagcaucauuugugaaggggacaccgugucucaagagcugcucgacacgguucuggugaaucugguccccgcccacaagaaccucaauaaacaggcuuacgaucuggccaaggcgcuucugaaacgcaccgcccaggcuaucgaaccuuacauuacaaacuuuuucaaucaggugcucaugcugggaaagaccuccaucagcgaccuuucugagcacguguuugaucugauccucgaacuguauaacauugacucccaucugcuccugagcguccuuccgcaacuggaguucaaacucaagucuaaugauaacgaggaaagacugcagguugugaaacuucuggccaaaauguucggcgcuaaggacuccgagcucgccagccagaacaaaccccuguggcagugcuaccuggggcgguuuaaugauauccacgugccuauucgccucgaaugugucaaguucgcgucccauugccugaugaaccaccccgaccuugccaaagaucugacagaguaucucaaggugagaucucacgacccugaagaggcuauccggcaugauguuauugugagcaucgucaccgccgcuaagaaagacauccugcuggugaaugaccaccuucucaacuuuguucgcgagagaacgcuggauaagcgguggcgcgugagaaaagaagccaugaugggacuggcccaaauuuacaagaaauaugcucuccaguccgcggccggcaaggacgcugccaagcagaucgccuggauuaaagauaagcugcuucauaucuacuaucaaaauagcauugacgaucggcugcucgucgagagaaucuucgcucaguacauggugccccacaaccuggaaacaaccgagcgcaugaaaugucuguacuaucuuuacgccacacucgaccugaaugcggucaaggcucugaacgaaauguggaaaugccagaaucuccugcggcaucaggugaaggaucuucuggaccucaucaagcaaccgaaaaccgaugccucuguuaaggccauuuuuagcaaagugauggucaucaccagaaaccugccugaccccggcaaggcucaggauuucaugaaaaaguuuacacaggugcuggaggacgaugagaaaauucgcaagcagcuugaaguucucgugagcccuacguguucuugcaagcaagccgagggguguguccgggaaaucaccaaaaagcugggaaaucccaaacagcccacaaacccuuuccuggagaugauuaaguuucuccuggagagaaucgcuccggugcacauugacaccgaaagcaucuccgcccuuaucaaacaggugaauaagucuauugacggcacagcggaugacgaggaugaagggguucccaccgaccaggccauccgcgcuggacuggagcuccugaagguccugagcuucacgcacccuauuuccuuucauagcgccgaaacauucgagucucuucucgcuugccugaaaauggaugacgagaagguggccgaagcggcccugcaaaucuuuaaaaacaccggcuccaagauugaggaagauuucccccacauccggagcgcucuccugccugugcuucaucacaaaucuaagaaggggcccccgagacaggccaaauaugcuauccacugcauucaugccaucuucuccagcaaggagacccaguuugcccagauuuucgaaccucugcacaaaucccucgaccccucuaaucuggagcaucugaucacaccucuugucaccauuggacacaucgcucugcucgcgcccgaucaauuugccgcuccucucaagagccugguggccacauucaucguuaaagaccugcuuaugaacgaucgccugcccggcaagaagacgaccaaacucugggugccggacgaggaagucuccccugagacaauggugaagauucaggccaucaaaaugaugguucgguggcugcugggcaugaagaacaaucauucuaaaagcgggaccuccacacuuagacugcucaccacgauucugcacagcgauggagaccucaccgaacagggcaagaucucuaaacccgacaugucccgccugcggcuugcugccgggagcgcgauugugaagcuggcucaagagcccuguuaccacgaaaucaucacacucgagcaguaucagcugugcgcccuggccauuaacgaugaguguuaccaggucagacaaguguuugcucagaaacuucauaaaggacugucucggcuccgccugccucucgaauauauggccaucugcgcgcugugugcuaaggacccgguuaaagagagacgggcccacgccagacagugccuugugaagaauauuaacguccgccgggaauaccugaaacagcaugcugccguguccgagaagcugcucagccugcuucccgaguacguggucccuuauaccauccaucugcucgcucacgaucccgacuacguuaaggugcaagauauugaacagcugaaagacgugaaggagugucucugguucguccuggaaauccuuauggccaaaaaugagaacaauucucacgcguuuauuagaaagaugguggaaaacaucaaacagacaaaggaugcccagggcccugacgaugcuaagaugaaugagaaacuguauaccguuugcgacguggccaugaacaucauuaugagcaaguccacgacauacagccuggagucucccaaagauccuguccuccccgcucgcuucuuuacccaaccggacaagaauuucuccaacacaaagaauuaucugccucccgaaaugaaguccuuuuucaccccugggaagcccaaaaccacaaacgugcuuggagccguuaauaagccgcuguccucugccggcaaacagagccagacgaaguccucuagaauggagaccgugagcaacgcuuccucuagcuccaacccuagcucucccggccggaucaaagggcgccucgacuccagcgaaauggaucacucugagaaugaagacuacacaauguccagcccucugcccggaaagaagucugauaaaagagacgauuccgaccucguccggagcgagcuggagaagccccgcggcagaaagaagaccccugugacagaacaagaggaaaaacuugggauggaugaccugaccaagcugguucaggagcagaaaccgaagggaucccagcggagccgcaagagaggccauacggcgucugaaagcgaugagcaacaguggcccgaggaaaaacggcucaaggaggacauucuggaaaacgaggaugagcagaacuccccucccaaaaaggggaaacgcggcagaccucccaagccucuuggaggcgggacaccgaaggaggaacccaccaugaaaaccucuaagaaaggaagcaagaaaaaguccggcccucccgccccugaagaggaagaggaggaggaacggcagucugggaauacagaacaaaagagcaaauccaagcagcacagagugucucgccgggcucagcagagagccgagagccccgaauccagcgccaucgagucuacccaauccacaccgcagaaaggacgcggccggccuagcaagacgcccucucccucccagccuaaaaagaaugucagaguggggcgcagcaagcaggcugccaccaaagagaacgacuccucugaagagguggaugucuuucaaggcagcucccccguugacgacauuccucaggaagagacagaagaggaggaagugagcaccgugaauguccggagacgcucugcgaagcgggagagacgguga

SEQ ID NO: 73587 - RNA, 1248 nt, Artificial Sequence
  derived and/or modified sequence opt5 from PDSS1__Homo_sapiens__NP_055132
auggccagcagaugguggcgguggcgcagaggcugcuccuggaagcccgcugcccggucuccugggccgggaagccccggccgcgcggggccucugggacccuccgcugccgccgaggugagagcucagguccaccggcgcaaaggccucgaccugucucaaaucccuuacauuaaccuuguuaagcaucugaccagcgccugucccaaugugugcagaaucucccgguuccaccauacaacgccugauucuaaaacccacagcggggaaaaguauacagacccguuuaaacucggauggcgcgaucugaagggccuuuacgaggacauuagaaaggaacugcucaucuccaccagcgagcugaaagaaaugucugaguauuacuucgauggcaaggggaaggcuuuucggcccauuaucguggcccugauggcgcgcgccuguaacauccaucacaauaacuccagacacguccaggcuagccagcgggccauugcucucaucgccgagaugauucauacagcgucucuggugcacgacgauguuaucgacgaugccuccagccgcagaggaaaacauaccgugaauaaaauuuggggcgaaaagaaggcuguccuugccggggaccugauccucucugcugccuccauugcccuggcucggaucggaaacacaaccgugaucagcauucuuacgcagguuaucgaggaucuggugagaggcgaguuccuccaacugggguccaaagaaaaugagaacgaacgcuuugcgcacuaucuggagaagaccuucaaaaagacagccucucucauugcuaauagcugcaaagccgucuccgugcugggauguccugaccccgugguccacgaaaucgccuaccaguauggcaagaacguuggcauugcuuuucagcuuaucgaugacgugcuggacuucaccagcugcucugaucagauggggaaaccuacauccgccgaccucaagcugggacuugcgaccggccccgugcuguuugcuugucaacaguucccggagaugaaugccaugaucaugcggagauuuagccucccuggggaugucgaccgcgcccggcaguacgugcugcagucugauggaguucaacagacgacauaccuggcucagcaauauugccaugaagccauuagagagaucagcaagcuccgccccuccccugagcgggacgcucugauucagcuuucugaaaucgugcugaccagagauaaauga

SEQ ID NO: 73588 - RNA, 1200 nt, Artificial Sequence
  derived and/or modified sequence opt5 from PDSS2__Homo_sapiens__NP_065114
augaacuucagacagcugcuccugcaccuuccccgguaccugggcgccagcggguccccucgcagacucugguggucuccgagccuggacaccaucuccucugugggaagcuggcggggccgcuccucuaagagccccgcucauuggaaucaagucguuuccgaggccgagaaaauugugggguauccuacauccuuuaugucucuuagaugccugcucuccgaugaacugagcaacaucgcgaugcaagugcggaagcuggucggaacgcagcacccccuccugaccacagcucgcggccuugugcaugacucuuggaauagccugcagcucagagggcugguugugcuucugauuagcaaagccgccggaccuucuuccgucaacaccagcugucagaauuacgauaugguguccggcaucuauucuugccagcggagccucgcugaaauuacagagcugauccacaucgcccugcucguucaucgcggcauugugaaccugaaugaacuucaguccagcgacgggccccugaaggauaugcaguucggaaacaaaaucgcuauucucucuggcgacuuucugcuugccaaugcguguaacgggcuggcccuccugcaaaauaccaaggucguggagcugcucgcuuccgcccugauggaucuugugcagggagucuaccacgagaacagcacaucuaaggaaagcuauaucaccgacgauauuggcaucuccacguggaaagagcagaccuuccugucucacggggcucuccuggccaagagcugccaggcggccauggaacuugcuaaacaugacgccgagguucaaaauauggcuuuucaguacggaaagcacauggccaugucccauaaaauuaacagcgaugugcagccuuucaucaaggagaagacaucugacuccaugaccuuuaaucugaacagcgccccggugguccuccaccaagaguuccugggcagagaucuguggaucaaacagauuggcgaagcucaggaaaaggggcggcucgacuaugcgaaacugcgcgagagaaucaaggccggaaaaggcgugacaucugcuauugaccuuugucgguaccacgggaacaaggcccuggaagcccucgaguccuuucccccuagcgaggcucgcuccgcccuggaaaauaucguuuucgcggugaccagauuuucuuga

SEQ ID NO: 73589 - RNA, 852 nt, Artificial Sequence
  derived and/or modified sequence opt5 from PDX1__Homo_sapiens__NP_000200
augaacggcgaggaacaguacuaugccgcuacccaacuguacaaggaccccugcgccuuccagagagggccugcgccggaguuuagcgcuucucccccugccugucucuauaugggacggcagcccccucccccuccgccccacccuuuccccggcgcccugggggcucuugaacagggauccccucccgauaucagcccguacgaggugccuccccuggccgacgauccugcugucgcccaucuccaccaucaccuccccgcgcaacuugcccugccccauccuccggcuggccccuuuccugaaggggccgagcccggaguucucgaggaaccuaaucgcgugcagcugcccuucccguggaugaaauccacaaaggcucacgccuggaaaggccagugggcgggcggggccuaugcugccgagccugaagagaacaagagaacgcggaccgcuuacacacgcgcccagcugcucgagcuggaaaaagaguuucuuuucaauaaguauauuucuagaccccggcgcguggaacuggccgucaugcucaaccugaccgagagacacaucaagauuugguuucaaaaucggcgcaugaaauggaagaaagaagaggacaagaaaagaggaggcgggacagcugugggaggcgggggaguugcggagccugaacaggauugcgccgugaccagcggcgaggaacuucuggcucugcccccucccccgccucccggcggggccgugcccccugccgcuccggucgccgcgcgggagggacgccugcccccuggccuguccgcuucuccccagccuagcuccguugcccccagacggccucaggaaccccgcuga

SEQ ID NO: 73590 - RNA, 2283 nt, Artificial Sequence
  derived and/or modified sequence opt5 from PDXDC1__Homo_sapiens__NP_001272374
auggacgccagccuggagaagaucgcugaucccacccucgccgaaaugggcaaaaaccugaaggaggcggugaaaaugcuugaagacucccagagaacagaggaagagaaugggaagaaacugauuucuggagauaucccuggcccgcuccaagggcggauucagaacaucggagagcagggccacauggcucugcuugggcauagccugggagccuacauuuccacgcucgacaaggaaaagcugcgcaaacugaccacaagaauccucucugauaccacacuguggcuuugccggaucuuccgcuaugagaauggcugugccuacuuucacgaagaggagagagaaggccuggcuaagauuugccggcucgccauccauagccgcuaugaggacuucgucguugauggguuuaacgugcuguacaauaaaaagcccgugauuuaucuuuccgcugccgcgagaccuggacugggccaguaccucuguaaccaacuggggcugcccuucccuugccucugucggguccccugcaauaccguguuuggaucucagcaccagauggacguugccuuccuggaaaaacuuaucaaggaugacauugagcgcggcagacugccucuccugcuuguggcuaacgccgggacagcugccgucggacauaccgauaagaucggccggcugaaagaacucugugagcaguauggcauuuggcugcacguggaggggguuaaucuggcgacgcucgcccugggauacgugagcuccagcguccuugcugccgcuaagugcgacucuaugaccaugacaccgggccccuggcuggggcucccugccgugcccgccgugacccuguacaaacacgaugacccugcucuuacacuggucgcgggacucaccuccaacaagcccacggacaaacugcgcgcccugccgcucuggcugagccuucaauaucugggccucgauggguuuguugaaagaaucaagcaugcuugucagcugucucagcggcugcaggagucccuuaaaaaggugaauuacaucaagauucucguggaagacgagcugagcucuccugucgugguuuuccgcuuuuuccaagaacugcccggauccgauccuguguuuaaagccguccccgugcccaacaugacaccuagcggcguuggcagagagcggcacuccugcgacgcccucaauagauggcugggggagcagcuuaagcagcuggugccggcuucuggacucaccgucauggaucuggaagccgagggcacaugucugcgcuucagcccccuuaugaccgcggcugugcucgggacccggggagaagacgucgaucaacugguggccugcaucgaguccaaacugccuguucucugcuguacacugcagcuuagagaagaguuuaagcaggagguggaagccacggcuggccugcucuaugucgacgaucccaacuggagcgggauuggcgugguucgcuacgagcaugccaaugacgauaaaucuucccuuaagagcgacccugaaggagagaacauccacgcuggccugcugaagaaacucaacgagcuggaaucugaccugaccuucaagauugggcccgaguauaaaagcaugaaguccugccucuacgugggaauggccucugauaaugucgacgcggccgaacugguggagacaaucgcugccaccgcucgggaaaucgaggagaacagcagacuucuggaaaauaugacagaggugguucgcaaaggcauucaggaagcccaagucgagcuccagaaggcguccgaggaacggcugcuggaggaaggggugcuuagacagaucccgguggucggaagcgugcucaacugguucucuccuguucaggcccugcaaaagggccgcaccuuuaaucugacggcugggucccucgagagcacagaacccauuuauguguacaaagcccagggcgcuggagucacccugccucccaccccuucuggcucccggacaaagcagagacuucccgggcagaaaccguucaagcgcagccugcggggauccgaugcccucucugagaccagcuccgugucucacaucgaagaccuggagaaaguugagagacugagcuccggcccugaacaaauuacacuugaggccagcucuacggaagggcaucccggagcucccuccccucagcacaccgaucagacagaggcguuucagaagggcgugccgcaucccgaggacgaucacagccaagucgaagggccugagucucugcgguga

SEQ ID NO: 73591 - RNA, 939 nt, Artificial Sequence
  derived and/or modified sequence opt5 from PDXK__Homo_sapiens__NP_003672
auggaggaagagugcagagugcugagcauccagucccacgucauucggggcuacguugggaaccgcgccgcuaccuucccccuccaagugcugggauuugaaaucgacgccgucaauucugugcaguucagcaaccauacaggcuaugcgcacuggaagggacaggugcuuaauuccgaugagcugcaggaacucuacgaggggcugagacuuaacaauaugaacaaauaugacuacguucugacgggcuauacccgggauaagucuuuucucgcuaugguggucgacauugugcaagagcugaaacagcagaauccucgccugguuuacgugugugauccgguccucggggacaagugggauggagaaggcagcauguaugugcccgaggaccugcuuccuguguacaaagaaaaggucguuccccuggccgauaucauuacaccuaaccaguucgaggccgagcuccuguccggcagaaagauccauucucaagaagaggcccuucgggugauggacaugcugcacagcauggggcccgauaccguggucaucacauccagcgaccucccuucuccgcagggauccaauuaccugauugugcugggcagccagcgcagacggaaccccgcugggucuguugugauggaacgcaucagaauggauauucggaaagucgacgcuguguuuguuggaaccggcgaccucuucgccgcgaugcugcuugccuggacacauaagcacccuaauaaccugaaaguggcuugcgagaagaccgucuccacgcuccaccaugugcugcagcgcaccauccaaugugccaaagcucaggccggggaaggagucagacccagcccuaugcagcuugagcugcggauggugcaaucuaagcgcgauauugaggaccccgaaaucguugugcaggcgacaguccucuga

SEQ ID NO: 73592 - RNA, 891 nt, Artificial Sequence
  derived and/or modified sequence opt5 from PDXP__Homo_sapiens__NP_064711
auggccagaugcgagcggcugcgcggcgcugcccucagagacgugcuggggcgggcgcagggaguccuuuucgauugugacggcguucuguggaacggggaacgcgcugugcccggagccccugagcuccuggaaagacuugcccgggcuggcaaggccgcucuguuugugagcaauaacucccgcagagcccggccggagcucgcgcugcgcuucgccagacugggguuuggaggccuccgggcugaacaacuguucucuagcgcccuuugcgcugcccgccugcucagacagcggcugcccggcccucccgaugcgccuggggccgucuuugugcuuggaggcgaggggcugcgcgcugagcucagagccgcuggacugcggcuggccggcgaccccuccgccggggauggagcugcgccuagaguucgcgccgugcucgucggcuacgacgaacacuucucuuuugcuaaacugcgggaggccugugcccaucuuagagauccggaaugccugcucguggcuaccgaccgcgaucccuggcacccucugagcgacggcucccggacacccgggacgggaucucuugccgcggcuguugagaccgccagcggcagacaggcccugguggucgggaagccuucccccuauauguucgaguguaucacagaaaauuuuagcauugauccggcucgcacccucauggugggagaccggcuggagacagauauccuguucggccauagaugcgggaugaccacagugcucacccugacgggagucucucgccuugaagaggcccaggcuuaccuggccgcgggccaacacgaccucguuccucauuauuacguggaauccauugccgaccugaccgagggccuugaggauuga

SEQ ID NO: 73593 - RNA, 765 nt, Artificial Sequence
  derived and/or modified sequence opt5 from PDYN__Homo_sapiens__XP_011527552
auggccuggcagggccuggugcucgcugccugccugcuuauguuccccagcaccacagcggacugucuguccagaugcucucucugugcugucaagacgcaagaugggccuaaaccgaucaacccccugauuugcagccuucagugucaggccgcccugcucccuuccgaggaaugggagcggugccagucuuuucugagcuucuuuacccccuccacacugggacucaaugacaaggaagaucugggcucuaaaagcguuggggagggaccuuacuccgaacuugcuaagcugagcggcucuuuccucaaagagcuggagaaguccaaguuucuucccagcaucucuaccaaagaaaacacacuguccaagagccucgaggaaaaacugcgcgggcugucugacggauucagagagggcgccgaguccgaacucaugcgggaugcucaacugaaugacggcgccauggagaccgggacacuuuaucuggcggaagaggauccuaaggaacaggugaaacgcuacggaggcuuucucagaaaguauccgaagcggagcuccgagguggccggggagggagacggcgauucuauggggcacgaagaccuguacaaacgcuauggaggcuuccuuagacggauucgccccaagcugaaaugggauaaccagaagagauacggcggguuucuccggcgccaguucaaagucgugaccagaagccaagaggacccuaaugcuuauuccggagaacuguuugaugccuga

SEQ ID NO: 73594 - RNA, 8520 nt, Artificial Sequence
  derived and/or modified sequence opt5 from PDZD2__Homo_sapiens__NP_835260
augcccaucacacaggacaacgcggugcugcaucugccucugcuuuaccaauggcugcagaauagccuccaggagggcggggauggaccggaacagcggcugugccaagcugccauucagaaacuucaggaguauauccagcugaacuucgcggucgacgaauccacaguucccccugaucacucucccccugagauggaaauuuguacgguguaccucaccaaggagcugggcgacacagagaccguggggcugagcuuuggaaauauccccgucuucggcgauuauggggaaaagcggcgcggaggcaagaagagaaaaacacaccaaggcccugugcucgacguugggugcauuugggugaccgagcugcggaagaacuccccggcuggaaagucuggcaaaguccgccuuagagaugaaauccugagccucaaugggcagcugauggugggaguugacguguccggcgccucuuaccuugccgagcaguguuggaacgggggauuuaucuaucugauuaugcuccggcgcuucaagcacaaagcucacagcacauacaauggcaacuccagcaauucuuccgagcccggcgaaaccccuacgcuggagcugggggauagaaccgccaagaaaggaaagcggacacgcaaguuuggcgucaucagcagacccccugcuaacaaagcccccgaagagucuaagggguccgcgggaugcgaagugagcucugacccguccaccgagcucgagaauggcccugaucccgaacuggggaacggacacguguuccagcuugagaauggcccugacagccugaaagaagucgccggcccccaccucgagcgguccgaaguugaucgcgggacagagcaccgcauucccaagaccgacgcuccucugacgacaucuaacgacaaacggcgcuuuagcaagggaggcaaaaccgauuuccaauccagcgacugucuugccagagaggaaguggggcggaucuggaagauggagcugcucaaggaaucugauggacugggcauucagguguccgggggcagaggaagcaaacgcucuccgcaugcuaucgucgugacacagguuaaggagggcggggccgcgcaccgggacggaagacugagccucggcgaugaacugcuugugauuaaugggcaucugcucgucggacugucccacgaggaggccguggcuauccuucgcucugccaccggcaugguucaacugguggucgcuagcaaagaaaacuccgccgaggaccuccugcggcugaccagcaagucucuccccgaucugacauccagcguggaagacgucucuuccuggacggauaacgaggaccaggaggccgauggggaagaggacgaaggcaccagcuccucugugcagagagcuaugccuggaacagacgagccccaggauguuugcggcgcggaagagagcaaagggaaucuugaguccccuaagcaaggaucuaacaagaucaaacucaagagccgccucuccggcggggugcaccggcuggaaagcgucgaggaauauaaugagcugauggugagaaacggagacccccgcauucggaugcuugaaguuucuagagauggccgcaaacauucccucccgcagcugcuggacuccucuagcgccagccaggaguaccacaucgugaagaaaucuacccggagccucuccacaacccaggucgagagcccuuggagacugauucggcccucugugaucuccauuaucgggcuuuacaaggaaaagggcaaaggacugggcuuuagcaucgcugggggacgcgauuguauuagaggccaaauggggaucuucgugaagacgauuuuuccuaauggauccgccgccgaggacggccggcucaaagaaggggaugagauccuggacguuaacggcauucccaucaagggacugacauuccaggaagcuauccauaccuuuaaacagauuagaucuggccuuuucguccucaccgugcgcacaaagcuggugagcccuucccugacccccugcucuacaccgacgcacaugagccgguccgccucuccuaauuucaacaccagcgggggagcguccgcuggcgggagcgaugagggaucuuccagcucucucggcagaaagacacccggccccaaagaccgcaucgucauggaggugacccugaauaaggaaccuagaguugggcuuggaauuggcgccuguugccuggcccucgagaacuccccgcccgggaucuauauucauagccuggcuccuggaucuguggccaaaauggaauccaaucugagccggggcgaucagauccuugaggucaacuccgugaauguucgccacgcugcccucagcaaggugcacgcgauucugucuaaaugucccccugggcccgucagacuggugaucggacggcauccuaaccccaagguuagcgagcaagaaauggacgaggugaucgcccgcuccacauaccaggaaucuaaagaggcuaauagcuccccgggccucggcaccccucugaagucucccagccuugccaagaaagauucccugauuucugaaagcgagcucucccaguauuuugcucacgacgucccugggccccugagcgacuucaugguggccggaucugaggaugaagaccauccgggcuccgggugcagcacgucugaggaaggaucccugccucccagcaccuccacacacaaggagccuggcaaacccagagcgaacucucuugugacccucgggagccaccgggccuccggacuguuucauaagcaggucacaguugcucgccaagccagccugcccggcucuccucaggcucucagaaacccgcugcuucggcagcgcaaagugggcugcuacgaugccaaugacgccuccgaugaagaggaguucgacagagaaggggauuguaucagccugcccggagcucucccuggccccauucggccucugucugaggacgaucccagacgcgugagcaucuccucuagcaaggggauggacguccacaaccaagaagaacggccuagaaagacccugguguccaaagcgauuucugccccgcuucugggaagcuccguugaucucgaagagagcauccccgagggcaugguggacgcugccucuuaugccgcuaaucugacggauuccgccgaagcgccuaaggggagccccggauccugguggaaaaaggagcucucuggcagcuccucugcuccuaaacuggaauacacaguccgcaccgacacacagagccccaccaacaccggcuccccgagcucuccucagcagaaguccgaggggcuuggaagccggcauagacccguggcccgcguuucuccccacugcaagcgguccgaggccgaagcuaaaccuagcggcucucaaacagugaaucugacggggagagccaacgaccccugugaucucgacagccgcguccaggcgaccuccgugaagguuacaguggcuggauuucagccuggcggggccgucgagaaagaaucucugggaaagcugaccacaggcgaugccugcgugagcaccuccugugagcuugcuagcgcccugucccaucucgacgcuucucaccugacggaaaaucucccgaaagccgcgagcgagcugggccagcaacccaugacagagcuugauuccucuagcgaccugaucuccucuccugggaagaagggagccgcucaccccgauccuagcaaaaccuccguggacaccggccaggucagccggcccgaaaacccgucucagccugccucccccagaguuacaaagugcaaagcucggagcccugugcgccucccccaugaggggucuccuucccccggagaaaaggccgccgcuccgccugauuauagcaaaaccagaucugcguccgagacaagcacgccccacaauacccggcgcguggccgcucugagaggcgccgggcccggagccgaaggcaugaccccugcuggcgccguccugccgggggacccccuuaccucccaggagcaacggcagggagcgccuggcaaccauagcaaggcucuggagaugacagggauucacgcccccgaaucuagccaggagccuucccuccuggaaggagccgauucugugagcuccagagcuccccaagccucucucagcaugcugccuuccaccgacaauacgaaagaggcguguggccauguuucugggcacugcuguccgggaggcagccgcgaaucccccgugaccgacaucgauagcuucauuaaggagcuugacgcuucugccgcccgguccccuagcucucagacaggcgauuccgggagccaggagggauccgcucagggccaucccccugccggggcuggaggcgggucuagcugcagagccgaacccgucccgggcggacaaaccuccagcccucgccgggcgugggccgcuggcgcccccgcuuacccccagugggccucucagccuuccgugcuggacagcaucaaccccgauaagcauuuuacaguuaauaaaaacuuccugucuaauuacagcagaaacuuuuccucuuuccacgaggacagcaccucccucucugggcugggagauagcacagaaccuucccuuagcucuauguauggcgacgccgaggauuccagcuccgacccggagucucugaccgaagcuccccgcgcgagcgcccgggaugggugguccccucccagaucucgcgugagccuccauaaggaggacccuuccgaaagcgaggaggaacagauugagaucuguucuacgagaggaugccccaacccgccuuccagccccgcucaucugccuacacaagccgccaucugccccgcuucugccaaaguccucucccugaaguacagcaccccucgggaaucuguggcgucccccagagagaaagcugccugucuuccgggcagcuauaccucugggccugauagcucccagcccagcucccugcuggaaaugucuagccaggagcacgaaacacaugccgacauuuccaccucucagaaucacagacccagcugcgcugaggagacgacagaagucaccuccgccucuagcgcgauggagaacuccccucucagcaagguggcccggcauuuucacucuccgcccaucauucuguccagcccuaauaugguuaacggccuugaacaugaccugcucgaugacgagacacugaaucaauacgaaaccucuaucaacgcugccgcuucccucagcucuuucuccguggauguccccaagaauggagagagcgugcuggagaaccuucacauuucugaaucccaggaccuggaugaccugcuccagaaaccuaagaugaucgcccgcagacccaucauggcuugguuuaaagagauuaauaagcacaaccagggcacacaucugcggagcaaaaccgaaaaggagcaaccucuuaugcccgccagaagcccggauuccaagauccagaugguuucuagcucccagaaaaagggggugacggucccucacucucccccucaacccaaaaccaaucuggagaacaaggaccucagcaaaaaguccccggcggaaaugcugcucacaaauggacagaaggccaaauguggcccuaagcugaaacgccuuucucugaaggggaaagcuaaggugaacagcgaggcccccgcugccaaugccgugaaggcuggaggcaccgaucaucggaaaccccugauuuccccucagacaagccacaagacccucucuaaagcgguuucccagagacugcacgucgccgaccaugaagaucccgaccgcaacacgacagcugccccucggagcccgcaaugcgugcuugagucuaagcccccucuggccaccuccgggccccucaaaccuagcguguccgauacaucuaucagaaccuucgucagcccccugaccuccccuaagccggugcccgaacagggcauguggucucgguuccacauggcuguucugagcgagccugaccgcggaugucccacaacgccuaaaucccccaagugcagagccgagggccgggcgccgcgcgccgacagcgggccugugucucccgcugccuccagaaacggaaugagcgucgcuggcaaucggcagucugaaccccgccucgccagccauguggcggccgauaccgcucagccuagacccacaggggagaagggaggcaacauuauggccuccgaccggcuugaacgcaccaaucaacugaaaaucguugagauuucugcugaagccgugagcgagacagucuguggcaacaagccugcugaguccgauagaagaggcgggugccuggcccaggggaauugucaggaaaagagcgagaucagacucuaucgccagguggcggagucuuccaccagccacccguccucucugcccagccaugccucccaagcugagcaggaaaugucucggagcuuuuccauggccaaacuugcuucuagcuccagcucucugcagacggccaucagaaaagccgaguacucccaaggaaagagcucucucauguccgacagccgcggaguuccucggaacucuauucccggcgggccuagcggagaggaucaccuguauuucacacccagaccggcgacccgcaccuacuccaugccugcucaguuuagcucccacuucggccgggaaggccaucccccucacucucuggggagaagccgcgacucccaggugcccgucacaucuagcguggugccggaggccaaggcuucccggggaggccucccuucucuugccaaugggcagggaaucuacagcgucaaaccccugcuggauaccuccagaaaccuccccgccacagacgaaggcgauauuaucagcguucaagagacgucuugccuggugaccgacaagauuaaagugacacgccggcauuauuguuacgagcagaauuggccucacgaauccaccagcuuuuucucugucaagcagagaaucaaauccuuugagaaccuugcuaaugccgaucgccccguggccaagagcggggccucuccuuuccuguccguuagcucuaagccgcccaucggaagacgguccagcggcuccauugugagcggcucucucgggcacccuggagacgcugccgcucgccugcugagacggagccucuccucuugcagcgaaaaccaguccgaggccggcacacuucugccccaaauggcgaaaucuccuagcaucaugacccugacgauuuccagacagaaucccccugaaaccagcucuaagggguccgacagcgagcucaaaaagucucugggaccgcuuggcauccccacaccuaccaugacacuggccucccccgucaaacggaacaagagcucugugcgccauacccagccuucccccguuagcagauccaagcuccaggagcugcgggcucugucuaugccggaucucgacaaacuuugcagcgaagauuauuccgccgggccuagcgcugugcuguuuaagacagagcuggaaauuacgccccgcagaucucccggaccucccgccggcggcgucuccuguccugagaaagggggaaaucgggcuugcccgggcgggagcggacccaagaccucugccgcggaaacaccuagcuccgccucugacaccggcgaggcugcccaagaucuccccuuccgcagaagcugguccgugaaccuggaccagcuucuggucagcgcuggggaucagcagcggcuccaaucugugcuguccagcguuggaucuaaauccaccauccugacacucauccaggaggccaaggcccagagcgaaaaugaggaagacguguguuuuauugugcuuaaccgcaaagagggcuccggccugggguucucugucgcgggaggcacggauguugaaccuaagagcaucaccgugcacagaguguuuucccaaggggcugccucucaggagggaacaaugaaccggggcgacuuccugcucagcgucaauggggccucccuggcuggacuugcccauggcaacgugcugaagguucuccaccaggcucagcugcauaaagaugcccugguggucauuaagaaaggcauggaccaaccccgcccgagcgcgagacaggagccucccaccgccaaugggaagggacuccuuucucggaaaacaaucccucuggaacccggcauugggcgcuccguggcuguccacgaugcccugugcguggagguucucaagaccagcgcuggacugggccuuucucuggacgggggaaaguccagcgugacgggcgacggcccucucgucaucaaaagaguguacaaagggggagccgcggaacaggccggcauuaucgaggcuggggaugagauccuggccauuaacggaaaaccccugguuggccucaugcacuucgacgcuuggaauaucaugaagucugugccggaagggcccguccagcuucugauucggaaacauagaaacuccagcuga

SEQ ID NO: 73595 - RNA, 2328 nt, Artificial Sequence
  derived and/or modified sequence opt5 from PDZD4__Homo_sapiens__NP_001290441
augggcugcaacaugugugugguccagaagcccgaggaacaauacaaaguuaugcuccaggugaaugggaaggagcugagcaaacugucccaggaacagacccuucaagcccugagaucuagcaaggagccucucgugauccagguccugcggcgcuccccgagacuucggggagacucuagcugccacgaucugcagcucguggacuccggcacacagacggauauuaccuucgaacauaucauggcucuggggaaacugagacccccuacacccccuaugguuauucucgagcccuaugugcugucugagcuuccuccgaucagccacgaauacuaugaccccgccgaguuuauggaaggaggcccucaagaggcggaucgccuggacgagcucgaauacgaggaagucgagcuguauaaguccagccaucgggauaaacuugggcugaugguguguuaccgcaccgacgaugaagaggaccucggaauuuauguuggcgaggugaaccccaauucuaucgcugccaaagauggcagaauccgggaaggggaccgcauuauccagauuaacggagucgaugugcagaauagagaggaagccguggcuauccugucccaggaggaaaacacaaauauuagccugcucgucgcccggccugagucucaacuggcuaagcgcuggaaagacuccgacagagaugacuuccuugaugacuuuggcagcgagaacgaaggggagcugcgggcccgcaagcucaaaucucccccggcgcagcagccuggaaaugaagaggaaaagggcgcccccgaugcugggccuggacuguccaacagccaagagcuugacuccggcguuggcagaaccgaugagucuacacggaaugaagagagcuccgaacacgaccugcucggggaugagccucccagcucuaccaacacgcccggaucccugagaaaguucggccugcagggggacgcccuccagagccgcgauuuucauuucucuauggacagccugcuugcugagggagccggccucgggggaggcgacgugccgggccugaccgaugaagaguacgaacgguacagagagcugcuugaaaucaaaugccaccuggagaaugggaaccagcucggacugcuguuuccccgcgcguccggcggaaauucugcccucgacgugaaccggaacgagagccuggggcacgaaauggcuaugcuugaggaggaacugagacaucucgaguucaagugucgcaauauucugcgggcccaaaagaugcagcagcugagagaacgcugcaugaaggcuuggcuucucgaggaagagucccuguaugaucuggccgccagcgaaccuaaaaagcacgagcucucugacaucuccgaacugcccgagaaaagcgauaaggacucuacauccgcuuacaacaccggcgagagcugucgguccacaccucuucuggucgaaccccucccggagucuccucugagacgcgcgauggccgggaauagcaaccugaaucggacgcccccuggccccgcuguggccaccccugccaaggcugcgcccccgccuggaucccccgccaaauuuagaucucuuagccgggaucccgaagcuggccgcagacagcaugccgaggagcgggggagacgcaacccuaagacaggacucacccuggaacggguuggcccggaguccagccccuaucugucuagacgccacagagggcaaggacaggaaggcgagcacuaccauuccugcgugcagcucgccccuacacgggggcuggaggaacuuggccacggaccccugagccucgcuggcgggccucgcgucggaggcguggccgcugccgcgaccgaggcccccagaauggaauggaaaguuaaggugcggucugacgggacccgcuaugucgcuaaaagaccugugcgggaucgccugcugaaggccagagcucuuaagauccgggaggaacgcuccggaaugacaacggacgaugacgccgucagcgagaugaaaaugggcagauacuggucuaaggaggaacggaaacagcaucucauuagagcgcgcgagcaacggaagagacgcgaguucaugaugcagagccggcuggaaugucugagagaacagcagaauggggauuccaaacccgagcucaacaucauugcccugagccaccgcaagaccaugaagaaacggaauaagaaaauccuugacaacuggauuacaauccaagaaaugcuggcucauggcgccagaucugcugacggaaagcgcguguauaauccgcuccuguccguuaccacaguguga

SEQ ID NO: 73596 - RNA, 3102 nt, Artificial Sequence
  derived and/or modified sequence opt5 from PDZD7__Homo_sapiens__NP_001182192
auggcccagggcuucgcugugggguuugacccccugggacucggcgaucugagcuccgggucucuuagcucccugucuagcagaggacaccucggcuccgacucugggagcaccgccacacgguaccugcuucgcaagcaacagagacugcucaacggaccuccgcggggcauccgcgcguccagccccaugggcagagucauucugaucaauucuccuauugaggcuaacuccgaugaaagcgacaucauucauucuguucggguggagaaaucccccgccgggcgccugggauucagcgugagaggcgggucugaacacggacucggcaucuuugucuccaagguggaggaagggagcuccgccgagcgggcuggacugugcguuggcgauaaaaucacggaggugaauggccuuucucuggaaagcaccacaaugggguccgccgucaaggugcucaccuccucuucccgccugcauaugaugguuagacggaugggacgcgugccuggcauuaaauucagcaaggagaagacaaccugggucgacguggugaacagacggcuugucguugaaaaaugugggucuacacccagcgauaccuccucugaggacggagugcgcagaaucgugcaccuguauacgaccagcgaugacuuuugccucggcuucaauauuagagggggaaaggaguuuggccugggcaucuacgucuccaaaguggaucaugggggacuggcugaagagaacggcauuaagguuggggaccaggugcucgccgcgaauggagucagauucgaugacaucagccacucucaggccguggaaguucugaaaggccaaacacacauuaugcuuaccaucaaggagacagggcgcuauccugcuuacaaggaaaugguguccgaguauuguuggcuggaccggcucagcaacggcguccugcagcagcuuucuccggccuccgagagcuccucuagcguguccucuugcgcuagcuccgcccccuacagcucuggaucccugccuagcgauagaauggacaucugucucggccaggaggagcccgggucucgcggaccuggcugggggcgggcggauaccgccaugcaaacggaacccgacgcuggaggcagagucgagacauggugcuccgugcgcccgaccguuauucugcgggauacagccaucagaagcgacgggccucaucccggccgccggcuggauucugcucucagcgaauccccuaaaaccgcccugcuucuggcccucagcagaccccggcccccuauuacccgcucucaguccuaucugacacuuugggaggagaagcagcagcggaaaaaggagaaaagcggauccccgggcgaaaagggggcucugcaacggucuaaaacgcucaugaaucuguuuuucaagggaggccgccaggggagacuggcgcgggacggaagacgcgaagccuggacccucgauagcggcucccuggcuaagacauacccccggcuugacaucgagaaagccgggggcgugggaccuguccagaaguuugugaccuggagacugcgcagagaucaagaacggggccgcgcccuccugucugcuagaagcgggucccccucuagccagcugccuaacguugacgaacaggugcaggccugggagucccggcgcccccuuauucaagaccucgcgcagagacugcugacagaugacgaaguccucgcugugacccggcacuguagccgcuacgugcaugagggaggcaucgaagaucugguuagaccgcuucuggccauccucgaccggccugagaaacugcugcuucuccaggauauucgcucugucguggcccccacggaccuggggagauucgauuccauggugaugcuggucgagcucgaggcuuuugaagcccucaagagccgggcugugagaccucccgcccuucgcccugcgcggcaggacacacccccgaaaagacaccugaucaccccuguucccgauucucgcggaggcuucuaucuccugcccgugaauggguucccugaagaggaagacaacggcgagcugcgggagagacuuggagcccucaaggucuccccgagcgcuucugcuccccgccacccucauaagggcauucccccucugcaagaugugcccguugacgccuuuaccccucugcggaucgccugcacacccccgccucagcugcccccuguggcgcccagaccgcugcgcccuaauuggcuucugaccgaaccccucucccgggagcacccuccccagagccagauuagagggcgggcccaaucccgcagcagaucucggagccgcuccagaucucggagcuccagaggacagggcaaaucucccgggcgccggagcccuuccccgguccccaccccugcucccucuaugacgaacggaagauaccauaagccucgcaaagcccggcccccucugccgagaccccuggauggcgaagcugccaaggugggcgccaaacaggggccuagcgaguccggaaccgaaggcacagcuaaggaggcggccaugaagaaucccagcggggagcuuaaaaccguuacacucucuaagaugaaacagucccugggaaucagcaucucuggcgggauugaauccaaggugcaaccuauggucaaaaucgagaagauuuuccccggaggcgcugccuuucugagcggcgcccuccaggcuggguucgaacugguggccguggacggagagaaccuugaacaggucacccaccaacgcgcgguugacacgauccggagagcuuaucgcaacaaggccagagagccgauggagcugguggugcgggucccuggccccagcccccgcccuucucccagcgauuccagcgcccucaccgacgggggacugccugcugaucaucugccggcccaccagccccuugacgcggcuccugugcccgcccacuggcugccugaacccccgacaaauccucagacacccccuacagaugccagacuccugcagcccaccccuucucccgcuccguccccugcccuccaaacgcccgacagcaaacccgcuccuucuccgcggauucccuga

SEQ ID NO: 73597 - RNA, 3465 nt, Artificial Sequence
  derived and/or modified sequence opt5 from PDZD8__Homo_sapiens__NP_776152
augggccugcuccugaugauccuugccagcgcugugcugggguccuuccucacccugcuugcccaguuuuuccugcucuacagacggcaacccgagccuccggcggacgaagcugcccgcgccggagagggcuuuagauauauuaagcccgucccugggcugcugcuccgggaauaccuguauggaggcgggcgcgaugaggaacccucuggagcugccccugagggcggcgcuacacccacggccgcgccugagaccccggcucccccuacaagagaaaccugcuacuuccuuaacgccacaauccuguuucucuuccgggagcugcgcgacaccgcccuuacaagacgguggguuaccaaaaagauuaaaguggaauuugaggagcugcuccagacgaagaccgcugggcgccugcuggaaggacucagccugagagauguguuccuuggcgagacaguccccuuuaucaaaaccauucggcuggugcgcccuguugugcccuccgccacaggggaaccggacggaccugagggcgaagcgcuccccgccgcuuguccugaggagcuggccuucgaagcugaggucgaauauaaugggggauuucaccuugccaucgauguggaccugguuuucggcaagucugccuaccucuuugugaagcugagcagagucgugggccggcugcgccucguguucaccagaguccccuucacgcauugguuuuucuccuuuguugaggauccccugaucgacuucgaagugcggucucaguuugaggggagaccuaugccgcagcuuacaagcauuaucgugaaccaacugaaaaagauuaucaaacgcaagcacacccuccccaauuauaaaauucgguucaagcccuuuuuccccuaccagacacugcagggauuugaggaagaugaggaacauauccacauucagcaaugggcucuuaccgagggcagacugaaggucacccuccuggaaugcucccgccugcucaucuucgggagcuacgaccgggaggcgaacgugcauuguacacuggagcuuucuuccagcguuugggaagagaaacagagaucuuccaucaagacgguggaacugauuaaaggaaaucuccagagcgucggccugacccugcgccuugugcagucuacagauggguaugccggacacguuaucauugagaccguggcuccuaacucccccgccgccaucgcugaccuccaacggggcgauagacugauugccaucggcggggucaagaucacaagcacccuucaggugcucaaacugauuaagcaggcgggagaccgcguccuuguguacuaugagcggccgguuggccaauccaaucagggggcugugcugcaggacaacuuuggacagcucgaagagaauuuccugucuagcuccugccaaagcggcuacgaagaggaagccgccgggcugacggucgauacagagucuagagagcuugacuccgaauuugaggaucucgcuagcgacgugcgcgcccagaacgaguucaaagaugaggcucagucucugagccacuccccuaagcggguucccaccacccugucuaucaagccucucggcgccauuagccccgugcugaauagaaaacuugcggucggaucccauccucugcccccgaagauccagagcaaagacggcaacaagccuccuccccucaaaacaucugaaauuaccgauccugcccaaguguccaagccgacacaggggagcgcuuucaagcccccugugcccccucggccccaggccaaaguuccucugcccucugcugacgccccgaaucaggcggagccugauguccugguggagaagcccgaaaaaguggucccucccccgcuuguggacaaguccgccgagaaacaagcuaagaacguugaugccaucgacgacgcugccgccccuaagcaguuucucgcuaaacaggaaguggcgaaggaugucacgagcgagaccuccugucccacaaaagacucuagcgaugaccgccagaccugggaauccucugagauccuguauagaaauaagcugggaaaauggacacggaccagagccagcugccucuucgauauugaggcuugucaccgcuaccugaacaucgcccuuuggugccgggacccuuuuaagcugggcgggcucauuugucugggacaugugucccugaagcuggaagauguugcccucggcugccuggcuacgagcaacaccgaguaucugucuaaacucagacuggaagcccccucccccaaggcgaucgugacacgcaccgcucuuagaaaucugagcaugcaaaaaggguucaacgacaaguuuuguuacggcgauauuacaauccacuucaaauaccucaaggagggagagucugaccaccaugucgugaccaauguugaaaaagagaaggaaccucaccugguggaggaagucuccgugcugccgaaggaggagcaguuugugggccagauggggcuuacggaaaacaaacauagcuuccaagauacacaguuucagaaucccaccuggugcgacuauugcaagaaaaaggucuggacaaaagccgccucucaguguauguucugcgcuuacguuugucacaagaagugccaagagaaaugucuggccgaaaccagcgugugcggagcgaccgaucggcgcauugacagaacacucaagaaccugcggcucgagggccaggaaacgcugcuugggcugccuccccgcguggacgcugaggccuccaaaagcgucaauaagaccacaggacucaccagacauaucaucaacacaucuucccggcugcugaaucuucgccaggugagcaaaaccagacuguccgagccuggcacggaucucguugaacccucuccuaagcacacaccgaacaccagcgacaaugagggguccgauaccgaaguguguggccccaacucuccuagcaagcggggaaauuccacaggcauuaaacugguccgcaaggaagggggacucgacgauucuguguuuaucgccguuaaagaaauuggcagagaccuguaucgggggcuucccaccgaggagagaauccagaagcuggaguucaugcucgauaaacugcaaaacgaaauugaccaggaacuggagcacaauaacagccuugugcgcgaggaaaaggagacaacggauacccggaagaaaucccugcucagcgcugcccuggcuaagucuggagaaagacuccaggcccugacacuucugaugauccauuaccgcgcgggcaucgaggacauugaaacccuggagucccucagccuggaucagcacucuaaaaagaucuccaaauauacagacgauaccgaggaagaccuugacaacgagauuagccaacugaucgauucucagccuuuuuccagcauuuccgacgaucucuucgggcccagcgaaucugucuga

SEQ ID NO: 73598 - RNA, 1539 nt, Artificial Sequence
  derived and/or modified sequence opt5 from PDZK1__Homo_sapiens__XP_011507918
augaccagcacauucaaccccagagagugcaagcuguccaaacaggaaggccaaaauuacggguuuuuccuccggaucgagaaggacacggaaggacaccuggugcgcgucguugagaaauguucuccugccgaaaaggcuggccuucaggauggggacagagugcugcggauuaacggaguguuugucgauaaagaggagcauaugcaagugguugaccucgugcgcaagagcggcaauuccgucacccugcuugugcuggauggggacucuuaugaaaaggccguuaaaacaagaguggaucucaaggagcugggacagagccagaaagaacagggccuguccgacaacauccucucuccggucaugaauggcggggugcagaccuggacacagccccggcugugcuaccuugugaaggagggaggcagcuauggguucucccugaaaaccguccaaggaaagaagggcguuuacaugacagauauuaccccucaggggguggcgaugcgcgcuggagugcucgccgacgaucaccugaucgaggucaacggcgaaaauguggaggacgccagccaugaagagguuguggaaaaagucaagaaaucuggcuccagagugauguuucuucugguugauaaggagacggacaaacggcacguggagcagaagauucaguucaaacgcgaaaccgcuagccucaagcugcugccccaucaaccuagaaucgucgagaugaagaaagggucuaacggauauggcuuuuaccuccgggccggguccgaacagaagggacagaucauuaaagacaucgauagcggcucucccgcugaggaagccgggcugaagaauaacgaccuuguggucgcggugaauggagaguccguugagacacuggaucacgacagcguggucgaaaugauucgcaaaggcggcgaucaaaccucccuccuggugguugacaaggagacagauaacauguauagacuugcccacuucucuccuuuucuguacuaccagagccaggaacucccgaauggguccgugaaggaggcucccgccccuacccccacgagccuggaagucucuuccccucccgacacaaccgaggagguggaucauaaaccgaagcugugucggcucgcuaaaggagaaaacggcuauggguuccaccugaaugccauccgcggacuuccuggcagcuuuauuaaggaggugcagaaagggggccccgcggaccuggccggacucgaagaugaggacguuaucauugaggucaacggcgugaacgugcuggacgaaccuuacgagaaggucguggauagaauccaaucuagcgggaagaauguuacacuucuggugugcggcaaaaaggcuuaugacuacuuccaggccaaaaagauccccauugucuccucucucgcugauccccuggacaccccuccggauagcaaagaaggaaucgugguugaguccaaccaugacagccacauggccaaggaacggcuguauaccauugccgugaauuguaugcucuga

SEQ ID NO: 73599 - RNA, 2367 nt, Artificial Sequence
  derived and/or modified sequence opt5 from PDZRN3__Homo_sapiens__NP_001290070
augaagauggagcacaaaagaaugauccuccuguucagcaaguuuacccugauucauaaaccccacggcgggcggugguaccuugugaacggacgcgaccuguccagagccacacaugaucaggcugucgaagccuucaagacggcgaaagagccuaucguugugcaagugcuccggcgcaccccgagaacaaagauguuuacacccccuucugaaagccagcuggucgacaccggcacccagacagauauuaccuucgagcacaucauggcucuuacgaagauguccucucccagcccucccgugcuggacccuuaucuccugccggaagaacaucccuccgcccacgaguacuaugauccuaaugacuacauuggggauauccaccaggaaauggaccgggaggaacuggagcucgaggaaguugaucuguaucgcaugaacucucaagacaaacuuggacugaccgugugcuacagaacagaugacgaggaugacaucggcauuuauaucagcgaaauugaccccaauuccaucgccgcuaaggaugggcggauucgcgagggagacagaaucauucagaucaacggcaucgaaguccagaaucgggaggaggccguggcucuccugaccagcgaagagaacaaaaauuuuucucuucugauugcccgcccugaacuccagcuggaugagggcuggauggacgaugacagaaacgauuuccuggacgaucuccauauggacaugcuggaggagcaacaccaucaggcgaugcaguuuacagccuccguucuucagcaaaagaaacacgaugaggacgggggaaccacggacacagcuaccauccugagcaaucagcacgaaaaggauucuggcguggggcggacagacgaguccacccgcaacgaugaaagcucugagcaggaaaauaacggagacgaugccaccgcuuccagcaauccccucgccggccaaagaaagcugacauguucccaggacacgcuugggucuggagaucugccguucagcaacgaguccuuuauuagcgcggacugcaccgaugccgacuaccucggcaucccugucgaugagugugaacgguucagagagcugcuggaacucaaaugccaggugaagucugcuacacccuacggccuguauuacccuuccgggccccuugacgccggaaaaagcgaucccgagucuguggacaaggagcuggaacuccugaaugaggaacuucgcagcauugagcuggaaugucucuccaucguccgggcucauaaaaugcagcaacugaaggagcaguauagagagucuuggaugcugcacaacagcggcuuucgcaacuacaauaccuccaucgacguucggagacaugaacucagcgauauuacagagcugccugaaaaaucugacaaggauuccagcucugccuauaacaccggggaguccugccgcagcacgccgcuuacacuggaaaucucccccgacaauucucuccggagagccgcugagggaauuagcuguccuuccucugagggcgcgguggggaccaccgaagccuacggacccgcuagcaagaaccugcuguccaucacagaggauccugaagugggcacccccacauauagcccgucucuuaaagagcucgacccuaaucagccccuggaauccaaggagcgccgggccagcgauggcucuagauccccuacgcccagccagaaacuggggucugccuaccucccuagcuaccaccauucccccuauaagcacgcucacauuccggcccaugcgcaacacuaccagagcuauaugcagcugauccagcaaaaaucugcugucgaguacgcccagucccagaugagccuuguguccaugugcaaggaccugucuagcccuacccccuccgaaccccgcauggaguggaagguuaaaauccggucugauggaacaagauauauuaccaagcggccugugcgcgacagacuccugcgggaaagagcccugaaaauccgcgaggagcggagcggcaugacaaccgaugacgaugcugucuccgaaaugaagauggggagauacuggucuaaagaggaacgcaagcagcaucuugugaaggccaaagagcaaagacggcgcagagaguucaugaugcagagccggcucgacugucugaaggaacagcaagcugccgacgaucgcaaagagaugaacauucuggaacucucccacaagaaaaugaugaagaagagaaauaaaaagaucuuugacaacuggaugacgauucaggagcugcuuacccacggaacaaaaagcccggauggcacccggguuuauaauucuuuccuguccgugacaaccgucuga

SEQ ID NO: 73600 - RNA, 3111 nt, Artificial Sequence
  derived and/or modified sequence opt5 from PDZRN4__Homo_sapiens__NP_001158067
augggcuucgcccuggagagauuugcugaagccguggaccccgcgcucgagugcaagcugugugggcagguccuugaagaaccucugugcaccccguguggacacguuuucugcgcuagcugucuccugcccugggccgugcggcgcagacggugcccucuucaaugucagccccuggccccuggcgaacucuaccgcgugcugccccugagaucccucauccagaaacugcggguccagugcgauuaucgcgcuagaggguguggacauucugugcggcuucacgagcuggaggcccauguugaacacugcgacuuuggcccugcucgcagacuccggagccgcgggggaugugccuccggccugggcgggggagaggugccggcgagaggcgggugcggacccacaccucgggccggccgcgggggaggcgcuagaggcgggcccccuggaggccggugggggagaggacgcggccccgggccgcggguccuugccuggagacgccgggaaaaggcucugcucgcccaacugugggcgcugcagggagaggugcagcucacggccagacgcuaccaggagaaauucacccaauauauggcucauguucggaacuuugugggcgaucugggcgggggacacagacgcgacggcgaacacaagccuuucacaauuguccuugagcgggaaaaugauacccugggguuuaacaucauuggaggcagacccaaucagaacaaucaggaggggacaucuaccgaaggcaucuacgugagcaaaauucucgagaacggaccugccgaccgcgcugauggccuggagauccaugacaagaucauggaagugaaugggaaggaucuuuccaaagccacacacgaggaagccgucgaggcuuuccggaacgcgaaggaacccauuguuguccaggugcugagacggacgccccucucucgcccugccuauggaauggcuagcgaggugcaacugaugaaugccuccacccagaccgacaucacauuugagcauauuauggcccuggcuaaacucagaccgcccaccccucccgugccugauaucugccccuuccugcuuagcgacucuugucacucccugcacccgauggaacaugaguuuuacgaagauaacgaguauauuagcucucucccugccgacgcggaccggacagaagauuucgaguacgaggaaguugagcugugcagaguguccagccaggaaaaacuuggccugaccgucuguuaccgcacggacgaugaggaggacacagggaucuaugugucugaaguugaucccaauuccauugcugccaaggacggacggaucagagagggcgaucgcauccuccaaauuaacggggaagacgugcagaauagagaggaagccgucgcucugcugagcaacgaugagugcaagcggaucgugcuccuggucgcccgcccugagauucagcuugacgaaggcuggcuggaggaugaaagaaaugaguuucucgaggagcugaaccuggagaugcuugaagaggaacacaacgaggcuaugcagcccaccgccaaugaaguggagcaaccuaagaaacaggaggaagaggaaggaacaaccgacaccgcgacauccucuagcaacaaucaugagaaggacuccggcguugggcggacggaugagagccuccgcaacgacgaaucuuccgagcaggaaaaugccgcugaggaucccaacagcaccucucugaaaagcaagagagaccugggacagucccaagauacacucggcucuguggaacugcaguacaaugagagccuugucuccggggaguauaucgacagcgauuguauuggaaacccggacgaagauugcgagcgguuccgccagcugcucgaacugaaauguaagaucagaaaucacggcgaguacgaccuguauuacucuuccagcaccaucgaaugcaaccagggggagcaagagggcguggaacaugagcuucagcuccugaaugaggaacugcggaacauugaacucgagugucagaauaucaugcaggcccaccgccugcaaaaaguuacagaucaguauggagacauuuggacccuucacgauggcggguucagaaacuacaauacgucuaucgacaugcagcggggaaagcuggacgauauuauggagcauccugaaaaguccgacaaagauagcuccucugcuuacaacacagccgagagcugcagauccacaccccucaccguggaccgcucucccgauagcucccugccucgggucaucaaccugaccaauaagaaaaaccuuagaagcaccauggcggccacacaaucuuccagcggccagucuuccaaggaaagcacgucuaccaaagcuaagacaaccgagcagggguguagcgccgaguccaaggaaaaagugcucgagggaagcaagcugccggaccaggaaaaagcugugucugagcacauccccuaucuguccccuuaccauagcuccucuuaucgcuacgccaauauucccgcccacgcucggcacuaucaaagcuacaugcagcucauccagcagaaguccgcgguugaauaugcccaaucucagcugagccuugucuccaugugcaaagagucucagaagugcagcgagccuaagauggaauggaaagugaagauuagauccgauggcacacgcuacaucaccaaacggcccgugagagaccgcauucugaaggagcgggcucucaaaaucaaggaagagagaagcgggaugacgaccgaugacgauacaaugucugaaaugaagaugggccgguacugguccaaagaggagcgcaagcagcaucuggucagagccaaagaacaacggcgcagacgggaguuuaugaugagaagccgccuggaaugucuuaaggagucuccucaguccggaagcgaaggcaaaaaggagauuaacaucaucgagcucucucacaaaaagaugaugaagaaacggaauaagaaaauucuggacaacuggaugaccauccaggaacugaugacacauggggccaagucccccgauggaaccagagugcacaaugcuuuccucagcguuacgacaguguga

SEQ ID NO: 73601 - RNA, 456 nt, Artificial Sequence
  derived and/or modified sequence opt5 from PEA15__Homo_sapiens__NP_001284505
auggaggacgaaggcaacaagcugugccaggcucccccuuggccggggcaaaccagccccgugauggccgaguacggaacacuccugcaggaucuuacgaauaacaucacccuggaagaccucgagcagcugaaauccgccuguaaggaagauauuccuucugagaaaagcgaggaaaucacaaccggcuccgcgugguucucuuuucuugagagccacaauaagcuggacaaagauaaccucuccuauauugaacauaucuucgagauuucuagacggcccgaccugcugacaauggucguugauuaccgcaccagagugcucaagaucagcgaggaagacgagcuggauacaaaacuuacccggaucccuuccgcuaagaaguauaaagacauuauccgccagcccagcgaagaggaaauuaucaagcuggccccuccgcccaaaaaggccuga

SEQ ID NO: 73602 - RNA, 5241 nt, Artificial Sequence
  derived and/or modified sequence opt5 from PEAK1__Homo_sapiens__NP_079052
augagcgccugcaacaccuucacagagcacguguggaagcccggcgaauguaaaaauugcuuuaagccuaaaucccugcaucagcucccucccgaccccgagaaggcucccaucacgcacgggaacgugaaaaccaaugccaaccauucuaauaaccacagaauccggaauacaggaaacuucagaccucccguugcgaagaagccuaccaucgcugugaaaccgacaaugauuguggccgauggccaaagcaucuguggggaacuguccauucaggagcauugcgaaaauaagcccgucaucaucggauggaacagaaaucgggccgcucuuucucagaaaccucugaacaauaacaaugaggacgaugagggcauuagccacgugcccaagccuuacgggaacaacgacuccgccaaaaagaugucugauaauaacaauggacucaccgaaguucugaaggagaucgcuggccuugacacagcgccccagauucgcggcaacgaaaccaauagcagagagacguuucuggggcggaucaacgauuguuauaaacgcucccucgagagaaagcugccgccuagcugcaugauuggaggcaucaaagaaacccaagggaagcacgugauucugucuggauccacagaggucaucagcaaugaaggcgggcgguucuguuaccccgaguuuucuuccggagaagagagcgaggaagacguccucuucucuaacauggaggaggaacaugaauccugggaugagagcgacgaggaacugcuugccauggagauccgcaugagaggccagccucgguuugccaauuuccgcgcuaacacccugucccccguuagauuuuucguggauaaaaaguggaauacaauuccccuccggaacaaaucucugcagcgcaucugcgccgucgacuaugaugacagcuacgacgaaauucuuaauggcuaugaggaaaacuccguggugagcuacgggcagggaucuauccaauccauggucagcucugauagcaccuccccugacucuagccugacggaggaguccagaagcgaaacagcuucuucccucagccagaagauuuguaauggcgggcugucuccgggaaaccccggcgauuccaaggacaugaaagagaucgaaccuaacuaugagagccccuccucuaauaaccaggauaaggacagcucccaggccucuaaaagcuccaucaagguuccugagacccacaaagcggugcuggcccuccggcuggaagagaaggaugggaagauugcugugcaaacagaaaaagaggaaagcaaggccucuaccgacgucgcuggacaggccgugaccaucaaucuuguucccacagaggagcaggccaaaccguacagaguggucaaccuggaacaaccucucugcaagcccuacacggugguugauguguccgcugcgauggccagcgagcaucuggaaggcccugucaauucucccaaaaccaaguccagcucuagcacaccuaacucccccgugaccuccucuagccuuacaccgggccagauuagcgcucacuuucagaaguccucugccauccgcuaucaggaggucuggaccagcuccacgucuccucggcagaaaauucccaagguggaacugaucacaagcgggaccggacccaauguuccuccgcgcaaaaacugucacaaguccgcccccaccucuccuacagcuaccaauaucagcuccaaaacaauucccgugaaaagcccuaaccucucugagaucaaguucaauuccuacaacaaugccggcaugcccccuuuucccauuaucauucaugacgagccgacguaugcgcgcagcucuaaaaacgcuaucaaggucccuauugugaucaaucccaacgccuacgauaaccuggccaucuauaaauccuuccuggggaccagcggagaacucucuguuaaggagaaaacaaccuccgugauuagccacacauacgaagagaucgaaaccgaguccaaggucccugacaauacgaccagcaaaacaaccgacugccugcagacaaagggcuucucuaacagcaccgagcauaagcggggguccguggcucagaaagugcaggaauuuaauaacugccuuaauagaggccaaucuagcccccagcgcuccuauucuagcucccacucuagcccggccaagauucagcgggcuacgcaggagccuguugccaaaaucgaaggaacacaagagucccagauggucggcuccucuagcaccagagagaaggcgagcacagugcugucucagauuguggccuccauccagcccccucaauccccgcccgaaaccccucaguccgggccgaaggcuuguucugucgaggaacucuacgccauucccccugaugcugacguggccaagagcacccccaaguccacaccuguucgccccaaaagccuguucacgucucagccuuccggagaggcggaagccccgcaaaccacagauagccccaccacaaaggugcagaaagacccuucuauuaagcccgucaccccuagccccuccaaacuugugacgucuccgcagagcgagccucccgcucccuuuccucccccucgguccacaucuagcccguaccaugccggcaaccugcuccagagacacuucaccaauuggaccaagcccacauccccuacccgcagcacagaggcugaaucuguucugcacuccgaggggagccggagagccgccgaugcuaagcccaaacgguggaucuccuuuaagucuuucuuucgcagacggaaaacggacgaagaggaugacaaggaaaaagagagagagaagggaaagcuggugggccucgaugggaccgucauucauaugcugccucccccgccugugcaacgccaccauugguucacagaagcgaaaggcgagagcuccgaaaagcccgccaucguuuuuauguaucggugcgacccugcucagggacagcuuucuguggaucagagcaaagccagaaccgaccaagccgcugucauggagaagggccgcgccgaaaacgcgcugcuccaggauuccgagaaaaagagaagccacucuucccccagccagauuccuaaaaagauccugucucacaugacacaugaggugaccgaagacuucagcccccgggacccgcgcacgguggucgggaagcaggauggaagaggcuguaccagcguuacaaccgcucugucucuuccugagcucgaacgggaggacgggaaagaggauaucagcgaccccauggaucccaauccuugcuccgccacauacucuaaccugggacaaagccgcgccgcuaugauuccgcccaagcagccuagacagcccaaaggcgccguggacgaugcgaucgcuuuugggggcaagaccgaccaagaagccccuaaugccucccagcccacaccuccgccccugccuaaaaagaugauuauccgggcuaacaccgagcccauuagcaaggaucuccagaaauccauggaaucuagccugugugugauggccaauccuacguaugacaucgaucccaacugggacgcuuccucugccggaagcuccaucucuuacgagcuuaagggccuggauauugaaagcuaugacucccucgagcgcccgcugagaaaagagcggccuguccccagcgcggccaauucuaucuccagccugacaacccuuucuauuaaggaccgcuucuccaacagcauggaaucucucuccagcagacgggggcccuccugcagacagggacgcggcauccaaaaaccucagcggcaggcucuguacagagggcuggagaaccgcgaagaggugguuggaaagauucggagccuccacaccgaugcccugaagaaacuugcugugaagugugaagaccuguuuauggccggccagaaagaucaacucagauucggggucgacucuuggagcgauuuccgccugacauccgacaagcccugcugugaggccggcgaugcuguguauuacaccgcgucuuacgccaaagacccucugaauaacuaugcuguuaagaucugcaagagcaaagccaaggagucccagcaguacuaucauucucuugccgugcggcagagccucgcuguccacuuuaauauucaacaggauuguggacauuuccuggccgaagugccgaacagacugcuccccugggaggacccugaugaccccgaaaaagacgaggaugacauggaagagacggaggaagaugcgaagggcgagacagacgggaaaaauccuaagcccugcuccgaagcugccucuagccagaaggagaaccagggaguuauguccaaaaagcaacgcagccacguggucgugaucacccgggaggugccgugccugacagucgccgauuuuguuagagacucucuugcucagcacggcaaauccccugaucuguacgaacggcaagugugucuccugcugcuucaacucugcagcgggcuggagcaucugaagcccuaucacgugacccauugugaccuccgccuggaaaaucuucugcucguccacuaccagccuggaggcacagcccagggcuucgggcccgcggagccuucucccaccuccagcuauccgacgagacugaucguguccaacuuuucucaggcuaaacaaaagagccaucugguugauccugaaauucuucgggaccagucccgccuggcccccgagaucauuaccgccacacaguacaaaaagugcgaugaguuccagaccggaauccucauuuacgaaaugcugcaccuccccaauccuuuugacgagaacccggaacugaaggagagagaauauacacgggcugaucuucccagaaucccuuuccgcagccccuacucucggggccugcaacagcucgccuccugucugcugaauccuaaccccagcgagagaauccuuauuucugacgcuaaagggauccugcagugccuccuguggggaccucgcgaggaccucuuucagaccuucacggccugucccagccuggugcaacggaauacacuucugcagaacuggcucgauauuaagagaacccugcugaugaucaaauuugcggaaaagucccuugaccgcgagggcgggauuucucuggaagauuggcucugcgcccaguaucuggcuuucgccacaaccgacagccucuccuguaucgucaaaauccugcaacaccgguga

SEQ ID NO: 73603 - RNA, 3114 nt, Artificial Sequence
  derived and/or modified sequence opt5 from PEAR1__Homo_sapiens__NP_001073940
augagcccuccccugugcccgcuccugcuucuggccgugggccucagacuggcugggacccuuaaccccuccgacccuaauacauguucuuucugggagagcuuuacgaccacaaccaaggaaucccacucucggcccuucagccugcucccuuccgagcccugcgaacgcccuugggagggaccgcauacauguccccagccuaccgucguuuacagaacaguguaucggcaaguggucaaaaccgaucaccgccagagacugcagugcugucauggcuuuuacgaaucucggggguucugcgugccccugugugcccaggagugcguucacggacgcuguguggcgccuaaccaaugccaguguguccccggcuggagaggggacgauugcagcuccgagugcgcuccgggaauguggggcccucagugugacaagcccugcagcuguggcaauaacucuuccugcgauccuaaaagcgggguguguucuugccccuccggacuccagcccccuaauugucugcaaccgugcacgcccggcuauuacgggccugccugucaguuucggugccagugucauggagcccccugcgacccucagaccggcgcuugcuucugucccgccgaacgcacagggccgagcugcgauguuucuuguucccaaggaaccagcggcuuuuucugcccuuccacacacucuugucagaacggcgggguguuucagacgccccaaggaagcugcuccuguccucccggcuggauggggaccaucugcagccuuccuugucccgagggauuccacggcccgaauugcucucaggaauguagaugccauaacgggggacugugcgaccgguuuacaggccagugucgcugcgcuccuggcuauaccggggauagaugucgggaggagugccccgucggacgcuucggccaggacugugccgaaacaugcgauugugcgcccgacgccagaugcuuuccugcuaauggggccugucucugcgagcacggauucaccggcgaucgguguaccgacagacugugcccggacggguucuacggccuuuccugccaagcucccuguacaugcgaucgcgaacauagccugucuugucacccuaugaacggagagugcagcugucuccccggcugggccgggcugcacugcaaugaauccuguccucaggacacgcauggacccggcugccaggagcacugucugugccuccaugggggagugugucaggcgaccucuggccugugccaaugcgccccuggguauacaggcccccacugugcuagccuuugcccgccugauaccuacggagugaacuguuccgcccggugcagcugugagaaugcuauugccugcucucccaucgacggcgaaugugucugcaaggagggguggcagagaggaaacuguuccguuccuugucccccgggcacauggggguuuagcugcaaugccucuugccagugcgcucaugaagcgguguguuccccucagaccggagccugcacguguacacccggcuggcacggggcucacugccaacugccuugucccaaaggccaguucggagagggcugcgccagccgcugugauugcgaccauuccgaugggugugaccccgugcacggacggugccagugucaggccggcuggaugggggcuagaugccaucucucuuguccugaaggacuguggggcgucaacugcagcaauaccugcaccuguaagaacgggggcacaugccuuccggagaacggaaauugugugugcgcccccggcuuucgcgggccuuccugucaacggucuugccagcccggaagauacggcaagcgcuguguuccuugcaaaugugcgaaccacagcuucugccaccccuccaaugggaccuguuauugccuggcuggauggacaggcccugauugcagccagccgugucccccuggccauuggggagagaacugcgcccaaacgugucagugccaccauggaggcaccugucacccccaggacgggucuugcauuuguccucucggauggacaggccaucacugccuggaaggguguccccugggaaccuuuggcgccaauugcucccagccgugucaaugcggcccuggggagaagugccaccccgaaacaggagcuugugugugucccccuggccauagcggggcccccugccggaucgggauucaggagccuuucaccgucaugccgacgacccccguggcuuacaacucucucggcgccguuaucgggaucgcggugcugggaucccuugucguggcccuggucgcucucuuuauuggcuauagacacuggcagaaaggcaaggaacaucaccaucuggccguggcuuacagcucugggcgccuugauggaagcgaguauguuaugccugacgugcccccuuccuacagccacuauuacucuaaucccuccuaccacacacugagccagugcuccccgaacccucccccucccaauaaagucccuggcccccucuucgccucucugcaaaacccggagcggccugggggagcgcagggccaugacaaucacaccacacugcccgccgauuggaagcauagacgggaacccccuccggggccccucgaccgcggaagcuccagacuggaucggucuuauagcuacuccuauucuaacggcccuggccccuuuuacaauaaggggcuuaucagcgaggaggaacugggagcuuccguggccagccucucuuccgagaacccuuaugcuaccauuagagaccugcccagccugccuggcgggccgcgcgaaucuuccuacauggagaugaaaggacccccuagcggcucucccccucggcagcccccgcaguucugggauucccaaagacgcagacagccucagccccaacgggacagcgggacguaugaacagcccuccccucuuauccacgaucgcgacagcguuggaucucagcccccucucccgcccggccugccucccggccacuacgauagcccuaagaacucccauauucccgggcacuacgaccugccgccugugagacaucccccuucucccccucuccggcgccaggauagauga

SEQ ID NO: 73604 - RNA, 564 nt, Artificial Sequence
  derived and/or modified sequence opt5 from PEBP1__Homo_sapiens__NP_002558
augcccguggaccugagcaagugguccggcccucucucucugcaggaggucgaugaacaaccgcagcacccccuucauguuaccuacgccggggcugccguggacgagcugggaaaagugcucacaccuacgcaggucaagaacagacccaccagcaucuccugggauggccuggacucugggaaacuuuauacacuggugcucaccgauccugacgcgcccagccggaaggauccuaaauaccgcgaauggcaccauuuccugguugugaauaugaagggaaacgacauuuccucuggcacaguccugagcgauuaugugggguccggaccgcccaagggcaccggccuccacagauacguuuggcugguguaugagcaggaccggccucuuaaaugcgaugaacccauccugagcaaucgcucuggggaccauagaggaaaguuuaaagucgcuuccuuccggaagaaauacgagcuccgcgccccuguggccggcacauguuaucaagcugagugggaugacuacgugcccaagcuguacgaacagcuuagcgggaaguga

SEQ ID NO: 73605 - RNA, 684 nt, Artificial Sequence
  derived and/or modified sequence opt5 from PEBP4__Homo_sapiens__NP_659399
augggcuggaccaugagacuggugacagccgcucuccugcuugggcugaugauggucguuacgggagacgaggaugaaaacagccccugcgcccacgaggcgcuccuggacgaagauacccuuuucugucagggccuggagguguuuuacccugaacucgggaauaucggaugcaagguggucccggacuguaacaauuaucggcagaaaauuacauccuggauggagcccaucgugaaguucccuggcgcuguugauggggccaccuacauucuggugauggucgaccccgaugccccuucucgcgcugagcccagacaacgguuuuggcgccauuggcuggugacagacaucaaaggagccgaucucaagaaaggcaagauucagggccaggaacugagcgcuuaucaagccccuuccccgcccgcgcacucuggguuccauagauaccaguuuuucguuuaucuucaggagggaaaggugaucagccugcucccuaaagaaaacaagacccggggcuccuggaaaauggaccgcuuucugaauagauuccaccuuggggagcccgaggccucuacacaguuuaugacccaaaacuaccaggauagcccuacgcugcaggcuccccgggaacgcgccuccgagccgaagcauaaaaaucaggcugaaaucgccgcgugcuga

SEQ ID NO: 73606 - RNA, 2160 nt, Artificial Sequence
  derived and/or modified sequence opt5 from PECAM1__Homo_sapiens__XP_005276938
augcagcccagaugggcccaaggcgcuaccauguggcugggggugcuccugacacuucugcucugcagcucccuggagggacaggaaaacucuuucacgaucaauagcgucgacaugaagucccuuccugauuggaccguucagaacggcaaaaaucugacacuccaguguuuugccgacgugucuaccacaagccacgugaagccgcaacaucagaugcuguucuacaaagaugacguccuguuuuauaacauuuccucuaugaaaagcaccgaguccuacuucauccccgaagugcggauuuaugauagcgggacauacaaaugcaccguuaucgugaauaacaaggagaagacgaccgcggaauaucagguccucguggagggaguuccuucuccccgcgugacacuggacaaaaaggaggcuauucagggcgggaucgucagagugaauuguuccgugccugaagagaaagcccccauccacuuuaccauugaaaaacuugagcugaacgagaagauggucaagcucaagcgggaaaagaauagccgcgaucaaaacuucguuauccuggaguuuccuguggaggaacaggacagagugcuuucuuuccggugccaggcccgcauuaucuccggcauucauaugcagacaagcgaaucuaccaaguccgagcuggucacggugacagagagcuuuuccaccccgaaauuccacaucucucccacaggaaugauuauggaaggcgcucaacuccauaucaaguguaccauccagguuacccaccuggcccaggaguuuccugaaauuaucauucaaaaagauaaggcuaucguggcccacaauagacaugggaacaaagcggucuacagcgugauggccaugguugagcacuccggaaauuauacaugcaagguggaaagcucucggauuuccaaggucagcucuaucguggucaacaucacggagcuguucagcaaacccgagcucgaauccucuuuuacccaucuggaccagggcgagcgccuuaaucugagcuguuccauuccuggggcucccccggccaacuucacaauccagaaggaagauaccauugugagccagacacaagacuucaccaaaaucgcuucuaaguccgauagcggaacguacauuugcacagccggcaucgacaaaguugugaagaagucuaacaccguccagaucgugguuugugagaugcucucccagccuagaauuagcuacgacgcgcaguuugaagugaucaaagggcaaaccauugagguccggugcgaguccaucucuggaacacugcccauuagcuaucagcuucugaagaccuccaaagugcucgaaaauucuacaaagaacagcaaugauccugccguguucaaagacaaccccacggaggauguugaauaccagugugucgcugacaauugccacucccacgccaagaugcugagcgaggugcugcgcgugaaggucaucgcucccguggaugagguucagauuucuauccucuccagcaaaguggucgaaucuggcgaggacaucgugcugcaaugcgccguuaacgaaggcuccgggccuauuaccuauaaguuuuacagagagaaagaaggaaagccguucuaucagaugacaagcaaugccacccaggcuuuuuggacaaaacagaaggcgucuaaggagcaagagggcgaauacuauuguaccgccuucaaccgggcuaaucaugccagcuccgugccccgcagcaaaauccuuacggucagagugauucuggccccuuggaagaaagggcucaucgcuguugugauuaucggagucaucauugcccugcuuaucauugcggcuaagugcuacuuucugcggaaagccaaggccaaacagaugcccguggagaugucuagaccugcugugccccuccugaacuccaauaacgaaaagaugagcgauccgaauauggaggccaacucccacuacggccauaaugacgauguccgcaaccacgcuaugaagccuaucaacgacaauaaagaaccccugaacucugauguucaguauaccgaggugcaagugagcuccgccgagucucauaaggacgcggucgaaagccgguacuccagaacagaggggucucucgacggaaccuga

SEQ ID NO: 73607 - RNA, 912 nt, Artificial Sequence
  derived and/or modified sequence opt5 from PECR__Homo_sapiens__NP_060911
auggccagcugggcuaagggcagauccuaccuggcccccgggcuccugcagggacaaguggcgaucgucaccggcggggcuacaggaauuggcaaagccaucguuaaggagcuucuggaacucgggucuaacguggugauugccagccggaaacuggagcgccuuaaguccgcugccgacgaacugcaggcuaaucucccuccgacgaaacaggccagagucauccccauucagugcaacauccggaaugaggaagaggugaacaaucugguuaagucuacccuggauacauucggaaagaucaacuuucucgugaauaacggcggcgggcaauuccugagcccugcggagcacauuuccucuaaaggauggcaugccguccuugaaaccaaucugacaggcaccuuuuauauguguaaggcuguguacagcuccuggaugaaagagcacgggggaagcaucguuaacauuaucgugcccacaaaggccggcuucccucucgcuguccauucuggggccgcgcgcgccggaguguauaaucugaccaaaucccuugcucuggaaugggccugcagcggcauuagaaucaacuguguggcucccggcgucauuuacucucagacggccguugagaauuauggguccuggggacagagcuuuuucgagggcucuuuucagaagaucccugccaagcggaucggggugccggaagagguguccagcgucgugugcuuccuccugucccccgcugcgucuuuuauuaccggacaaagcguugacguggauggcgggcgcucccuguacacacacagcuaugaagucccugaccaugauaacuggcccaaaggagccggcgaccucucugugguuaagaaaaugaaggagaccuucaaagaaaaggcuaaacuguga

SEQ ID NO: 73608 - RNA, 978 nt, Artificial Sequence
  derived and/or modified sequence opt5 from PEG10__Homo_sapiens__NP_001035242
augaccgagagacggcgcgacgaacugagcgaggaaaucaacaaucucagagagaaggugaugaaacaguccgaagagaacaauaaccugcaaucucagguccagaaacuuacagaggaaaauacgacccugcgggagcagguugaacccacaccugaggaugaggacgaugacauugaacuccgcggcgccgcugccgcggcugccccgcccccucccaucgaggaagagugcccugaagaucugcccgagaaguucgacgggaacccugauaugcuugccccguuuauggcucaaugucagauuuucauggaaaagagcaccagagacuuuuccguggaucgggugcgcgucugcuucgugacaucuaugaugaccggcagagccgcucggugggccagcgcgaaacuggagcgcucccacuaccucaugcauaauuaucccgccuuuaugauggagaugaagcacguuuucgaagacccucagagacgggagguggcuaagcgcaaaaucagacggcugcgccagggaauggggucugucauugauuacagcaacgccuuucaaaugaucgcucaggaccuggauuggaaugaacccgcccucaucgaccaguaucaugagggacuguccgaccacauucaggaggaacuuagccaucuggagguggcgaagucucucuccgcccugaucggccaauguauucacaucgaaagacggcuugcuagagccgcugccgcccgcaaaccucggucucccccgagagcucugguucucccucacauugcgagccaucaccagguggaucccacagagccugucgggggagcccgcaugcggcugacccaggaagagaaggagagacgccggaaacugaaccucugccuguacuguggcacgggcgggcauuaugcugacaauugccccgccaaggccuccaagagcucucccgcuggaaacuccccugccccgcuuuga

SEQ ID NO: 73609 - RNA, 4389 nt, Artificial Sequence
  derived and/or modified sequence opt5 from PEG3__Homo_sapiens__NP_001139657
auguaccagcccgaggacgauaacaauagcgacgugaccuccgaugacgauaugacaagaaaccggcgcgaaucuagcccuccgcacuccguccauucuuucagcgacagagauugggaccggcgcggcagaucccgggauauggagccccgcgacagauggucucacacgcggaauccucgcagcagaaugcccccucgggaucugucccuccccguuguggccaagaccagcuuugaaauggaccgcgaggaugacagagacucucgggcuuaugaaucccgcagccaagaugccgagucuuaccagaacguggucgaccuggcggaggauagaaaaccucauaauacaauccaggacaacauggaaaauuaucggaagcuccugucccucgugcagcuggcugaggaugacgggcacagccauaugacccaaggacacucuuccagaagcaaacgcuccgccuacccgucuacaagccggggccuuaagaccaugcccgaagccaaaaaguccacacacagacgcgggauuugcgaggaugagagcucucauggaguuaucauggaaaaguucauuaaagacgugucccggagcucuaagagcggcagagcucgcgaguccucugaucggagccagagauuuccucgcauguccgacgauaacuggaaagacaucagccugaauaagcgggaaucugucauucagcagagaguguaugaggggaacgccuuccgcggaggcuuucgguucaauuccacccucguuagcagaaaacgggugcuggaacgcaagagacgguaccacuuugacacggauggcaaggggucuauccaugaccaaaaaggaugucccagaaagaaaccuuucgagugcggcuccgagaugcgcaaggcuaugagcgucuccucucugagcucccucucuagccccuccuuuaccgaaagccagccgaucgauuucggggccaugccuuaugugugugacgagugcggacggucuuuuuccgugauuagcgaguucgucgagcaccagaucaugcacacaagagaaaaccuguacgaguacggcgagucuuuuauucauuccguugcggugagcgaagugcagaaaucucaagucgggggaaagcgcuucgaguguaaagauugcggcgaaaccuucaauaagagcgccgcucuugccgagcacagaaagauccaugcucggggcuaucugguggaauguaaaaaccaggagugcgaggaagccuuuaugcccuccccuacauucagcgagcuccagaagauuuacgggaaagacaaguuuuaugaaugucgcguuugcaaagagaccuuccugcacucuuccgcgcuuaucgagcaucaaaagauucacuuuggagaugacaaggauaaugaaagagagcacgaacgggagcgcgaaagagagcggggcgagacguuccgccccagccccgcccugaacgaauuucagaaaauguacgggaaggagaaaauguaugaauguaaggugugcggagagacauuccuccauuccucuagccugaaagaacaccagaagauccauaccagaggcaacccuuuugagaauaaggggaaagucugcgaggaaacauucaucccgggacagucccugaagcggcgccagaaaaccuacaacaaggagaaacucugugacuuuaccgauggcagagacgcuuucaugcagucuagcgaacuguccgagcaccagaagauucacucucggaagaaucuuuuugaaggcagaggguaugagaaaagcgugauccauuccggacccuucacagagagccagaagucucacacgauuacccgcccucuggaauccgaugaggacgaaaaagccuucacaaucagcucuaaccccuacgagaaucaaaagauuccuaccaaagagaacguuuacgaagcuaaguccuaugagcggagcgugauccauucucucgccuccgucgaagcccagaaaagccacuccguggcuggccccagcaagccgaaggucauggcggagucuacaauccagagcuuugacgccauuaaucaucagagagugcgcgcugggggaaacaccuccgaaggccgggaguacucuagaagcguuauccacucccugguggccucuaaaccuccccgcagccacaaugggaacgagcuugucgaauccaaugagaagggcgaaucuagcauuuauaucuccgaucugaacgacaaacggcaaaagauuccugccagagagaaucccugcgaaggaggcagcaaaaaccgcaauuacgaggauucugugauccaguccguuuuccgggcuaagccucaaaagagcgugcccggggagggaucuggcgaauuuaaaaaggacggggaguucuccgucccgagcuccaacgugagagaauaucagaaagcccgggcgaagaaaaaguacaucgagcaucgcucuaacgaaacgagcgugauucacucccucccuuuuggagagcaaacauucagaccccggggcaugcuguaugagugucaggaaugcggggaguguuuugcucauagcucugaucugaccgaacaccagaagauccaugaccgcgagaaacccuccggcagcagaaauuacgaguggucuguuauucggagccucgccccuaccgauccgcaaacauccuacgcccaggaacaguaugcuaaggagcaggccagaaacaaaugcaaggacuuccgccaauuuuucgcuaccucugaagaucugaauacaaaccagaaaaucuacgaccaggaaaagagccacggagaagagucccagggcgagaauacggauggggaagagacccacucugaagagacacauggacaagaaaccauugaggaccccgucauccagggcagcgauauggaggacccucagaaggacgaucccgacgauaaaauuuaugaaugugaggacugcgggcuuggauuuguggaucugacagaccucaccgaucaccagaaggugcauucccggaaaugucuggucgacagcagagaauacacgcacucugugauccacacccauuccaucagcgaguaucaacgcgauuacacaggcgaacagcuuuaugagugcccuaaguguggggaguccuucauucacucuagcuuucuguucgaacaucagcggauccacgagcaagaccagcucuacuccaugaaaggcugcgaugacggauucauugcccugcugcccaugaagccuagacgcaaccgggcggccgaaagaaaucccgcucucgccggcucugcuauccgcugccugcuuugugggcagggauuuauucauagcuccgcccugaacgagcacaugagacuccaccgggaggacgaucugcuggaacagagccaaauggcggaggaagccaucaucccgggccuugcucucaccgaguuccagcgcucucagacagaagagagacuguuugagugcgccguuuguggggaauccuucgugaauccugcugagcuggccgaccaugucaccgugcacaaaaacgaacccuacgaguauggaagcucuuacacgcauacauccuuucucaccgaaccucugaagggcgccauucccuucuaugagugcaaggauugugggaaaucuuuuauccacagcacaguucuuaccaagcacaaagagcugcaucucgaagaggaagaggaagacgaggcugcggccgcugccgccgcugccgcgcaggagguggaagcuaauguccacgugccgcaaguugugcugcggauucagggccugaacgucgaggccgccgaaccugagguggaggcugccgaacccgagguggaagcggcugagccugaagucgaggccgccgagcccaauggagaagcugagggccccgauggggaagccgcugagccuaucggagaagccggccagccgaacggggaggcggagcagcccaauggagacgccgaugaaccugacggcgcuggcauugaggaucccgaggaacgcgccgaggaaccugaggggaaggcugaggaacccgaaggagacgccgaugagccugacggcguugggaucgaggauccggaagagggagaagaccaagagauccagguggaggaacccuacuaugacugccaugaguguaccgaaacauucacgagcuccaccgccuuuucugagcaccuuaaaacacaugcuagcaugauuaucuucgaaccugcgaacgccuuuggcgagugcuccggguacauugaaagagcuagcaccuccacaggaggcgccaaccaggccgaugagaaguauuucaagugugacgugugcggccagcuuuucaaugaucggcugucucuggcuagacaccaaaacacccacacgggguga

SEQ ID NO: 73610 - RNA, 1257 nt, Artificial Sequence
  derived and/or modified sequence opt5 from PELI1__Homo_sapiens__XP_011531296
auguucagccccgaccaggagaaccacccuuccaaggccccggugaaauacggcgaacugaucguccucggguauaauggaucucugcccaacggcgauagagggcggcgcaagagcagauuugcucuuuucaaacggccuaaggccaauggaguuaaacccuccaccgugcauauugcgugcacaccucaagcugccaaggccaucucuaacaaggaccagcacagcauuuccuacacgcugucucgcgcucagaccguggucguggaguauacacaugauagcaauaccgacauguuucagaucggcagauccacagaaagccccauugauuucguugugaccgacacagucccugggucucaauccaacagcgauacccagucugugcaguccacgaucagccgguuugccugucgcaucauuugcgagagaaauccgcccuucaccgcucggaucuacgccgcgggauuugacucuuccaaaaacauuuuccucggcgaaaaggccgcuaaauggaagacaagcgauggccagauggacgggcugaccacaaauggaguucuugugaugcacccucgcaacggcuuuaccgaggauuccaaacccgggaucuggagagagauuucugucuguggaaauguguucagccugcgggaaacgcgcuccgcccaacagagaggcaagaugguggagaucgaaacaaaccagcuccaggacgggagccugauugaucugugcggagcuacccuccuguggcggacagccgagggccuuucucauaccccuaccgucaagcaccuggaggcgcuccgccaagaaaucaaugccgcuagaccccaguguccgguuggcuuuaacacacuggccuucccuuccaugaaacggaaggacgugguggacgagaaacagcccugggucuaucuuaauugcgggcacgugcauggauaccacaacuggggcaacaaggaagagagagaugggaaagaccgcgaauguccuaugugccggagcguuggacccuaugugccccuguggcucggcugugaggcuggguuuuacgucgaugccggaccuccgacgcaugccuucucucccugcggccacguguguagcgagaagaccacagcuuacuggucccaaaucccucugccccacggcacccauacauuccacgcggccugcccuuuuugcgcucaucagcuggccggggaacagggauauauuagacucaucuuccagggcccccuggacuga

SEQ ID NO: 73611 - RNA, 1263 nt, Artificial Sequence
  derived and/or modified sequence opt5 from PELI2__Homo_sapiens__NP_067078
auguucagccccggccaggaggaacacugcgccccuaacaaggagccggugaaauacggggaacuggucguucucggauauaauggcgcucugcccaacggggacagaggacggcgcaaguccagauuugcccuuuacaaacggccuaaggcgaauggcgugaaacccucuaccgugcaugucaucagcacaccucaggcuuccaaggccauuucuuguaaggggcaacacagcaucuccuauacgcugucucgcaaccagaccgugguuguggaguacacacaugauaaagacaccgauauguuccaggucggaagaagcacagaaucccccauugacuuugugguuaccgauacaaucagcggcucucaaaauaccgacgaggcccagauuacgcaguccaccaucagccgguucgcuugccgcaucgugugugauagaaacgagccuuauacagcccggauuuuugcugccggcuucgacucuuccaagaauaucuuucucggggaaaaagcggccaaguggaaaaacccggauggacacauggacggccugaccacaaaugggguccuugugaugcauccccgcggaggcuucaccgaggaaagccagccugggguguggagagagauuucugucugcggagauguuuacacgcugcgggagacacgcuccgcucaacagagaggcaagcucguggaaagcgagaccaacgugcugcaggacggcucccugaucgaucucuguggggccacacugcuuuggcggaccgcugacggacuguuucacacccccacacagaagcacauugaagcccuccgccaagagaucaaugcggccagaccucagugccccgucggccugaacacgcuugcuuucccgucuauuaaucggaaagaagugguugaggagaagcagccuugggccuaucugagcugugggcaugugcacggauaccauaacuggggccacagauccgacaccgaagcuaaugagcgcgaaugccccaugugucggacagucgggccuuacgugccccucuggcugggaugcgaggccggcuuuuauguugaugccgggcccccuacccacgcuuucacaccguguggccaugugugcagcgaaaaaucugcgaaguacuggucccaaaucccccugccucacggaacccaugccuuucacgcugccugccccuucugugccacgcagcucgucggcgagcagaacugcaucaaacugauuuuccaggggccuaucgacuga

SEQ ID NO: 73612 - RNA, 2721 nt, Artificial Sequence
  derived and/or modified sequence opt5 from PELP1__Homo_sapiens__NP_001265170
auggagcuggccguggcuguccucagagaccugcuucgguacgccgcgcagcugcccgcucucuuccgcgauaucagcaugaaccaucugccuggccuucugaccucccuccuggggcugagaccggaaugcgagcaaucugcccucgaaggaaugaaggccuguaugacauauuuuccccgggcuugcggcagccugaaagggaaacuugccuccuucuuucugucucgcguugacgcucucagcccucagcugcagcagcuugccugugagugcuacuccagacugcccucucucggagcgggcuucagccaagggcugaagcacacggaauccugggagcaggagcugcacagccuccuggccucucuucauacccugcucggagcucuguaugaaggcgccgagacagcuccugugcagaaugaaggccccgggguggagaugcuucuguccagcgaggauggagacgcccacguccuccugcagcugcggcaacgcuuuucuggccucgcgagaugucuggggcuuaugcuguccagcgaguucggagccccugugucuguuccggugcaggaaauucucgauuuuaucugccggacccuguccgucagcuccaagaacauuucucuucauggcgacgggccccugcgccuccugcugcucccuagcauccaccuggaagcucuugaucugcucuccgcccugauucuggcuuguggaagcagacuucuccgguucggcauccugaucggccgccugcucccccaggugcucaauucuugguccauugggagagacagccuuucuccuggacaggagcggcccuacagcacaguucgcaccaaaguguaugccauccuggaacucuggguccaagugugcggcgccuccgcugggaugcugcagggaggcgcgucuggggaggcccugcuuacacaccuccugagcgauauuuccccgccugcugacgcccugaagcucagaagcccccggggaucuccugauggcucccugcagaccggcaagcccagcgcccccaaaaagcugaaacuugacgugggggaggcuauggccccuccgucucauagaaagggagauuccaacgcgaauagcgacgucugugcugccgcccuccgcggccugucccggacgauccugaugugcgggccccuuauuaaagaagagacccacagacgccuccaugaccugguucugccucucgugaugggagugcaacagggcgaaguccuggggucuagccccuacacauccucucgguguagacgcgagcuuuauugccugcuccuggcucugcuucucgccccuagcccccggugcccgccuccccuggcuugugcccugcaggcguuuucccucggccagagagaagauagccuggaggugucuuccuucugcagcgaggcccuuguuaccugugcugcccugacacacccucgcgugcccccucuccaacccaugggaccgaccugcccuacgcccgcucccgucccuccgcccgaagccccuucucccuuucgggcgccucccuuccacccucccggcccgaugccuuccguggggagcaugcccucugccggaccuaugcccagcgcuggcccgaugccuuccgccgggcccguuccuagcgcuagacccggacccccuacaaccgccaaccaucugggccugucugugccggggcuugucuccgugcccccucgccugcuccccggcccugagaaucaccgggccggaagcaacgaagaccccauccuggcuccuuccggcacaccgcccccuaccauucccccugaugagaccuuugggggaagagucccccggccggcguucgugcauuacgacaaggaagaggccucugauguugagaucagccucgaauccgacucugaugacagcguggucaucgugccugagggccugccuccccuuccucccccuccgcccuccggggcuacaccucccccuauugcccccacgggaccgccuaccgccucucccccuguucccgcuaaggaggaacccgaggaacugcccgccgcgccgggcccucugcccccucccccgcccccucccccucccgugccugggccggucacacugcccccuccccagcuggugccugagggcacccccggaggcgggggaccgccugcucuugaagaggaucugacagugaucaauauuaacagcuccgacgaagaggaggaagaggaagaggaagaggaggaagaggaagaggaagaggaggaagaggaagaggauuucgaggaagaggaagaggacgaagaggaguacuuugaagaggaagaggaagaggaggaagaguucgaagaggaauuugaggaggaagagggcgaacucgaggaggaagaggaagaggaagacgaggaggaagaggaggaacuggaagagguugagcgcgaaggggagagccccgccgccggacccccuccccaggaacucgucgaggaggaaccuucugcuccgcccacccugcuugaggaagagacggaagauggcuccgacaaagugcagccucccccugagacacccgccgaggaagagauggaaaccgagaccgaagcggaggcucugcaagagaaggaacaggaugacacagccgccaugcucgcugauuucaucgacuguccgccugaugacgagaaacccccucccccuaccgaacccgauagcuga

SEQ ID NO: 73613 - RNA, 645 nt, Artificial Sequence
  derived and/or modified sequence opt5 from PEMT__Homo_sapiens__NP_001254480
augaagagaagcggcaaccccggggccgaggcugacuucugcgugaugacccggcugcucggauacgucgauccucuggacccguccuuuguugccgcggugaucacaauuacguucaauccccuuuauuggaacguggucgcucgcugggaacacaaaaccagaaagcugucucgggccuuuggcagcccuuaccucgccuguuauucccugucugugacaauccuucugcucaauuuccugcgcagccauugcuuuacccaggcuaugcugucccaacccagaauggagucucucgauaccccugccgcuuacagccuggggcuugcccugcucggacugggcguugugcuuguccuguccagcuucuuugcgcucggguucgccggaacauuucugggcgacuauuucggcauucugaaagaagcucgggugacaguuuuucccuucaacauccucgauaauccuauguacugggggucuaccgccaacuaucugggaugggcuauuaugcacgccuccccgacgggccuucugcucaccgugcuggucgcgcuuacauacaucguggcccugcucuacgaggaacccuuuaccgcugagaucuaucgccagaaggccagcgggucucauaaaagauccuga

SEQ ID NO: 73614 - RNA, 804 nt, Artificial Sequence
  derived and/or modified sequence opt5 from PENK__Homo_sapiens__NP_001129162
auggccagauuccugacccucugcacauggcugcuucugcucggccccgggcugcuugcuacggugcgggccgaguguagccaggacugcgcgaccuguuccuaccgccuggucagaccugcugauaucaacuuucucgccugcguuauggaaugugagggaaagcugccgucucugaaaauuugggaaacaugcaaggagcuccugcaacuuagcaaacccgaacugccucaggacggcaccuccacacuccgggaaaauucuaagcccgaggagagccaucugcuugccaaacgcuaugggggauucaugaagagauacggcggguuuaugaagaaaauggaugagcuguauccuauggaacccgaggaggaagcuaacggauccgagauccucgccaagcgguacggcggcuucaugaaaaaggacgcugaagaggaugacucucuggccaauagcuccgaucugcucaaagaacugcuugagaccggggacaaccgcgagagaagccaccaccaggauggaucugacaaugaagaggaaguguccaagcgguauggcggguuuaugcgcggacugaagagaagcccucagcucgaggaugaagcgaaagagcugcaaaagcgguacggcggguucaugcgcagagugggacggccggagugguggauggacuaucagaaacgcuacggcggcuuucuuaagagauucgccgaagcucugcccucugaugaggaaggggaguccuacagcaaagaagucccugagauggagaagcgguauggaggcuuuaugagauucuga

SEQ ID NO: 73615 - RNA, 1482 nt, Artificial Sequence
  derived and/or modified sequence opt5 from PEPD__Homo_sapiens__NP_000276
auggccgcugccaccggccccagcuucuggcuggggaacgagacacucaaggugccucuggcgcuuuuugcucugaauagacagcggcucugcgaacgccugcggaaaaacccggccguccaagccggauccaucguugugcuucagggcggggaggaaacgcagcgguacuguaccgacacaggagugcuguuccgccaggagagcuuuuuccacugggcuuuuggcgucaccgaacccgggugcuauggagugauugauguugacacaggcaagucuacccucuucgugccuagacugcccgccucccaugcuacauggaugggcaaaauccacucuaaggagcauuuuaaagagaaguacgccgucgaugacgugcaauauguugaugaaauugcgagcgugcugaccucccagaagccuucuguccuccugacgcuuagaggggugaauaccgacagcggauccgugugucgcgaggccagcuucgauggcaucucuaaauuugaagucaacaauacaauucugcaccccgagaucguugagugcagaguguucaagaccgacauggaacucgaggugcugcgguacacaaacaaaaucuccagcgaagcucaucgcgaggucaugaaggccgugaaaguugggaugaaggaauaugagcuugagucucuguuugaacacuacuguuauuccagaggaggcaugcggcacagcucuuauaccugcauuuguggguccggagagaauagcgcugugcuccauuacggccacgccggcgcgccuaacgaucgcacgauccagaauggggacaugugccuguucgauaugggaggcgaauacuacuguuuugccuccgacauuacaugcucuuucccggcuaacgggaaguucaccgccgaucagaaagcugucuaugaggccgugcugagaagcucccgggccguuaugggagcuaugaagcccggcgugugguggccugacaugcaucgccucgcggacagaauccaccuggaggaacuugcccacauggggauucugagcggaucugucgaugcuauggugcaagcccaucucggcgccgucuuuaugccccacggccuggggcauuuccuuggaaucgacgugcacgauguuggcggguacccugagggaguggaacggauugacgagcccggccugagaucccuccgcacagcucggcaucugcagccggggaugguccugaccguggaaccuggcaucuauuuuaucgaucaccuccuggacgaggcccuugcggaucccgcuagagccagcuuccugaaucgcgaaguucuccagcgguuuagaggauucggcggggugcgcauugaggaggacgucguggugaccgauucuggaaucgaacugcuuacauguguuccucggacggucgaggaaauugaggccugcauggcuggcugcgacaaagccuuuacccccuucagcgggcccaaguga

SEQ ID NO: 73616 - RNA, 3873 nt, Artificial Sequence
  derived and/or modified sequence opt5 from PER1__Homo_sapiens__NP_002607
augagcggcccccuggagggggccgacggaggcggggauccuagaccgggagaauccuucugccccggcggggugccuucucccggaccuccccagcaccggccuuguccgggccccagccucgcugacgauaccgacgccaacuccaauggcucuagcgggaacgaguccaauggacaugaaucucgcggcgcgagccaaagauccagccacucuuccagcucugggaacggaaaggauuccgcucugcuugagacaacggaaagcucuaaauccaccaauagccaguccccuucucccccuagcuccagcaucgccuacucucugcucuccgccagcucugagcaggacaaccccagcacauccggcugcucuagcgagcaguccgcucgggcccgcacccaaaaggaacugaugacagcucuuagagagcugaaacuccggcugccgccugaacgcagagggaagggacggagcggcacccuggccacacuccaguaugcgcuggccugugucaaacagguucaggcuaaucaagaguacuaucagcaguggucucuugaggaaggcgagcccugcuccauggauaugagcaccuacacgcuggaggaacucgaacauauuaccucugaguauacacugcagaaccaagacaccuuuuccguggccgugagcuuccuuacagggcgcaucgucuacauuuccgagcaggcugccgugcugcucagauguaagcgggauguuuuucgcggaaccagauucucugaacugcuggcgccucaggacgugggcgucuuuuaugggagcacggcccccucccggcuccccacauggggaaccggcgcuucugccgggagcggacugcgcgauuucacacaagagaaguccguguuuugcagaauccggggcggcccugacagagauccggggccccgcuaccagccuuuccggcuuacccccuacguuaccaaaauuagagugagcgacggagcuccugcccagcccuguugccugcucaucgccgaacgcauccacucuggcuaugaggcuccgcggauuccucccgacaagagaaucuuuacaacgcgccauaccccuuccugucuguuccaggaugucgacgaacgggcggcuccccuucugggguaccucccucaagaucugcugggagcccccgugcuccuguuucuucacccggaggacagaccucugaugcucgccauucacaaaaagauccugcagcuugccggccagcccuucgaucauagccccauucgcuuuugcgcucggaauggggaguaugugacaauggacaccucuugggccggcuucguccacccuugguccagaaaaguugcguucgugcugggacgccauaaggugcggacagcuccgcucaacgaagaugucuuuacacccccugcccccagcccugcccccucucuggacacggauauccaggagcugagcgaacaaauucacagacuccugcuucagccugugcacucccccagcccgacaggccugugugggguuggagcugugaccucuccuggcccccuccauuccccugggagcuccucugacagcaauggaggcgaugccgaggggcccggcccgccugcucccgucaccuuccagcagaucugcaaggacgugcaccugguuaaacaucaaggacagcagcuguuuaucgaaucccgggcccgcccucagucuagaccccggcuucccgcgacaggcaccuucaaggccaaagcucucccuugccaaagcccggaccccgagcuggaggccggguccgcuccugugcaggcgccccuggcccucgucccugaagaggccgaaagaaaggaggcuucuagcuguuccuaccagcaaauuaacugccuggauagcauccuucgcuaucuggagucuuguaaucuccccuccacaacgaaacggaagugcgccuccucuuccagcuacaccacaucuuccgcuagcgacgaugacagacagcgcaccggaccuguguccgucggcaccaaaaaggauccgcccagcgccgcccugucuggggaaggagcuaccccuagaaaggagcccgugguuggcgggacgcugagcccucuugcgcucgccaacaaagcugaauccguggucucugugaccagccaguguuccuuuucuagcacaauuguucacgugggcgacaagaaacccccggaguccgauaucauuaugauggaagaccugccuggacuggcccccggccccgccccuucucccgcuccuagcccgaccgucgcccccgauccugcgcccgacgcuuaucggccuguggggcucacaaaggccgugcugucccuucauacccagaaagaggagcaagccuuccugagccgcuuuagagaucucggacggcugcgcggccuggacucuuccagcacggcucccucugcccuuggggaaagaggaugccaccacggcccggcgccucccucccggcgccaucacuguagaagcaaggcuaagcggucccgccaucaccagaauccuagagccgaggcccccugcuacguuucucacccuagccccgucccgccuuccacacccuggcccaccccuccggcuacaacccccuucccugccguggugcagcccuacccucuccccgucuuuagcccucgcgggggcccgcagccccugccucccgcuccuaccucugugcccccggccgcguucccugcuccccugguuacacccaugguggcccucguccugccuaacuaucuuuuucccacgccuuccagcuacccguauggagcccugcaaacccccgcugaaggcccucccaccccugccucucauagccccuccccgucucucccugcccuggcucccagcccuccccacagaccugauagcccccuguucaacucucgcuguagcuccccgcuucagcucaaucugcugcagcucgaggaacugccucgggcggagggggccgcuguggccggaggccccgggagcucugccggacccccuccgcccuccgcugaggccgcggaaccugaggcuagacuugccgaaguuacagagagcuccaaccaggacgcccugucuggcagcuccgaccuccuggaacugcuucugcaagaggauucucgcagcggcacaggguccgcugccagcggaucucucggcuccgggcugggaagcggcucuggguccggaagccaugagggcggcucuaccagcgcguccaucacgcggucuagccaguccagccacacauccaaauacuuugggucuaucgacagcuccgaagcugaggccggagccgcuagaggcggggccgaacccggagaucaggugauuaaguauguccuccaagacccuaucuggcugcuuauggcuaaugccgaucagcgcgugaugaugaccuaccagguucccucucgggacaugaccagcgugcugaaacaggauagagagcgccuccgggcgaugcaaaagcagcagccuagauucuccgaggaccagcggcgcgaacugggcgccguccauucuugggugagaaaagggcaacugccccgggcucuugaugugauggccugcgucgacuguggaagcuccacacaggauccgggccacccugacgauccccuguucagcgagcucgacggccuggggcucgaaccuauggaggaaggaggcggggagcagggaucuuccggcgggggaagcggcgagggcgaagggugcgaggaagcucagggaggcgccaaggccucuuccagccaagaccuggcuauggaggaagaggaggaagggcggucuuccagcucccccgcgcuuccgaccgccggaaacugcacaagcuga

SEQ ID NO: 73617 - RNA, 3768 nt, Artificial Sequence
  derived and/or modified sequence opt5 from PER2__Homo_sapiens__NP_073728
augaacggcuacgccgaguuucccccuagcccguccaaucccaccaaggaaccuguggagccccagccuucucaagucccccugcaggaagacguugauaugagcuccgggucuagcggacacgagacaaacgaaaauugcuccacgggcagagacucucaggggagcgauugugacgauuccggaaaagagcucggcaugcugguggagccuccggacgcucggcagagccccgauaccuucucucuuaugauggccaaguccgaacauaacccuagcacaucugggugcuccagcgaccaaucuuccaaaguggauacccacaaggagcugaucaaaacacucaaggaacugaagguccaucuucccgcggacaaaaaggcuaaaggaaaggccagcacccuggccacacucaaauaugcucugcgcuccgugaagcagguuaaggccaaugaggaguacuaucagcugcucaugucuagcgaaggccacccuuguggcgcugaugugcccuccuacaccgucgaggaaauggagagcgugacgucugaacauauuguuaaaaacgccgacauguucgcgguggccgucucccuggugagcgggaagauccuuuauauuucugaucagguggcuagcaucuuucacugcaaaagagacgccuucuccgacgcuaaguuugucgaguuccuggccccgcacgauguuggaguguuucauucuuucaccagcccuuacaaacucccccugugguccauguguagcggcgcggacucuuuuacacaagagugcauggaagagaaguccuucuuuugucgggugagcguccgcaaaucucacgaaaaugagauuagauaucauccuuuccggaugacccccuaccuugugaagguucgcgaucagcagggggccgaaucccagcugugcugucuccugcuggcugagagagugcacagcggauacgaggcuccccggaucccuccggaaaagcgcaucuuuacaaccacgcacacacccaacugccucuuccaagacgucgaugagagagccgugccucugcuuggcuaucugccccaggaccucauugaaaccccuguucuggugcagcuucaucccuccgaucggccgcugaugcucgccauccacaaaaagauucugcaaucugggggacagccuuucgacuacagccccauccgcuuuagagcccggaauggcgaguauauuacacuggauaccuccuggucuagcuucaucaacccuuggucccgcaaaauuagcuuuaucaucggcagacauaagguccggguggggccccucaaugaagacgucuucgcugcgcacccuuguaccgaggagaaagcccugcaucccucuauucaggaacuuacagagcagauccacagacugcuccugcaaccggugccucacuccggaagcucuggcuacgggucccuuggaagcaacggcucucaugaacaccugaugagccagacguccagcucugauuccaaugggcaugaggacagccgccggagacgcgcugagauuugcaagaacggaaauaagaccaaaaaccggucccacuauucucacgaaagcggcgagcagaagaaaaaguccguuacagaaaugcagaccaacccucccgccgagaaaaaggccgugcccgcuauggaaaaggacucucucggcgucagcuuuccggaggagcuggccugcaaaaaucaacccacauguuccuaccagcagaucucuugccuggauagcgugauuagauaucucgaauccuguaacgaggcggcuacccugaagcgcaaaugcgaguucccugccaauguucccgcccuucggagcucugacaagagaaaagcuacgguguccccugggccccaugccggagaagcugaaccucccagccgcgucaacucucggacaggcguggggacccaccugaccucccucgcccugccgggaaaggcggagagcguggccucucugacaucccaguguagcuacuccagcaccaucguucaugucggcgauaagaaaccucaacccgagcuugaaaugguggaggacgcugccucugggccugaaagccucgauugccuggcuggccccgcccuggcguguggacucucccaggagaaggaaccguuuaaaaagcugggccuuacaaaagaggugcuggccgcucacacgcagaaggaggaacagucuuuccuccaaaaauuuaaggagaucagaaagcugagcauuuuccagucccauugccacuacuaucugcaggaacgcucuaaagggcaaccuagcgagcggaccgcccccggacuuagaaauacauccggcaucgacucuccuuggaagaaaaccgggaagaaccggaaacucaagagcaagcgcgucaaacccagagauuccagcgagucuacaggauccggcgggcccgugagcgcucggccuccgcugguuggccugaaugccaccgccuggucucccuccgacacgagccaguccucuuguccugcugugcccuuuccugcgcccgucccugccgcuuacagccucccgguguuccccgccccuggaaccguugccgcucccccugcgcccccgcacgccuccuuuacagugccugcuguccccguggaucugcagcaucaguucgccguucaacccccucccuucccugccccgcuugcucccgugauggccuuuaugcugccuagcuauucuuuccccuccggcaccccuaaccucccccaggcguuuuucccgagccagccucaguuucccucucacccuacacugaccagcgaaauggcuuccgccucucaacccgaguucccuagcagaacguccauuccccgccagccgugcgccuguccugcuacacgggccaccccucccucugcuauggggagagccagcccgccccuguuucagucccgcagcucuagcccccuucagcucaaucugcugcaacucgaagaggcgccugaaggaggcacaggggccaugggaaccaccggcgcuacagagacggccgcugucggggccgacugcaagcccggcaccuccagagaucagcagccuaaagcuccccugacacgggacgagccuuccgauacccaaaacucugacgcccuuagcacauccucuggacugcucaaucugcugcuuaacgaagaccucugcagcgcguccggcagcgccgcuucugagucccuggggagcggaucucugggcugugaugccuccccgagcggggccggaucuagcgacaccucccauacgucuaaguacuucggcagcaucgauuccagcgaaaauaaccacaaagcuaagaugaauacagggauggaggaauccgagcauuuuauuaagugcgugcuccaggaccccaucuggcugcuuauggccgaugcggacucuagcgugaugaugaccuaucagcugccuucccgcaaccucgaggcuguccugaaagaagauagagagaagcugaaacuucugcagaagcuccaaccccgguucaccgaaucucagaaacaggagcugcgcgaaguucaccaguggaugcaaacaggcggacucccugccgccaucgacguggcugaguguguguacugcgagaacaaggaaaagggcaauauuuguauccccuaugaggaagauauuccgagccuggggcuuuccgaggucucugacaccaaagaggaugaaaacggaagcccucugaaucacagaaucgaggaacagacauga

SEQ ID NO: 73618 - RNA, 3576 nt, Artificial Sequence
  derived and/or modified sequence opt5 from PER3__Homo_sapiens__NP_001276790
augcccagaggcgaggccccugggccgggacggcgcggcgcuaaggacgaagcccugggggaggaaagcggagagagauggucccccgaguuccaccuccagcggaaacuggcggauucuagccauuccgaacaacaggaccgcaacagagugucugaggaacuuaucauggucguucaggagaugaagaaauacuuuccuagcgaacggcgcaauaagcccuccacccuggaugcucucaacuaugcccugagaugcgugcacucugugcaggccaauagcgaguucuuucaaauucuuucccagaacggcgcuccucaggccgacgucagcauguacucucuggaggaacucgcuacaaucgccuccgagcauacgagcaaaaauaccgauacauucguggcgguuuucucuuuccuguccgggcggcuggugcacauuagcgaacaggccgcucucauccugaaccgcaagaaggacguccuugccucuucccauuuuguggaucugcucgcuccccaagacaugagaguuuucuaugcccacaccgcgcgggcccagcugccuuuuuggaauaacuggacacagcgcgcugccgcuagauacgagugugccccggugaaacccuucuuuugccggauucgcggaggcgaagauagaaagcaggagaaaugucacagcccuuuccggaucauccccuaucuuauucauguccaccauccugcccaacccgagcuggaauccgagccgugcugucucaccgugguggaaaagauccacucuggcuacgaggcuccucgcauucccgucaauaaaagaaucuuuacaaccacgcacaccccugggugcguuuuccuggaaguggacgagaaggcggugccccugcucggauaucugccccaggaucuuauuggcacaagcauccuguccuaccuccauccugaggaccggagccugauggucgccauucaccagaaggugcuuaaauacgcugggcauccgcccuucgaacacucuccuaucagauuuuguacccaaaacggagauuauaucauucuggacuccagcuggucuagcuucguuaaucccuggucccgcaagaucucuuuuauuaucggccggcauaaagugagaacaagcccucucaacgaggacgucuucgccaccaagauuaaaaagaugaaugauaacgacaaagauaucacggaacugcaggagcagaucuacaagcugcuccugcagcccgugcacguuuccgugagcucuggguauggaucccuuggcagcucuggcucccaagaacagcuggucagcauugccuccucuagcgaggcuuccgggcaccgcguggaggaaacaaaggccgagcagaugacccuccagcaagucuacgcgucugugaauaaaaucaagaaccugggacagcagcuuuauauugaaagcaugacaaaauccagcuuuaagccgguuaccggcacccggacagagccuaacgggggaggcgagucugcuaaugggggaggcgaaugcaaaacguucaccuccuuucaucagacacugaagaacaauagcguguacaccgagcccugugaagaccucagaaacgaugagcacucuccuuccuaucaacagaucaauugcauugacagcgucauccgcuaccugaagucuuacaacauccccgcccugaaacggaaguguauuagcugcacaaauaccacguccucuagcuccgaagaggauaaacagaaccauaaggccgacgaugugcaggcucuccaagccggccugcagaucccugcuauucccaaaagcgagaugccgacaaaugggagauccaucgacaccggaggcggggccccucagauucuuucuaccgcgaugcugagccucggauccggcaucucucaaugcggguauagcuccacaauuguucacgugcccccucccgaaaccgcccgcgaugcuacacuguucugugagccguggacgcugaacaugcagcccgccccucuuaccucugaagaguuuaagcacgucggccucacagcugccgugcugagcgcgcauacccagaaggaggaacagaauuacguggacaaauuccgggagaagauccuguccagccccuauucuuccuaccuccaacaggaaagcagaucuaaagccaaguauuccuacuuucagggagacagcacaucuaaacagacccgguccgcuggcugccgcaaggggaagcacaaaagaaagaaacugccugagcccccugauagcuccagcucuaacacgggaagcggcccccggagaggggcccaucaaaaugcucagccguguugcccuuccgccgccucuagcccccacaccuccucuccuacauuucccccggcugcgaugguuccuagccaggcccccuaucuugucccugcuuuuccccugcccgccgccaccuccccuggacgcgaauacgcugccccgggcacagcgcccgaggggcuccauggccugccucugucugaaggacuucagcccuacccugcuuuccccuucccuuaucucgacaccuuuaugacgguguuccugccggaucccccuguguguccccugcucagcccuuccuuucugcccugcccguuccuuggcgccacagccagcucugcuaucuccccuagcaugucuuccgccaugagccccacccuggaucccccucccuccgucacaucucaacggagagaggaggaaaagugggaggcgcagagcgaagggcacccuuuuauuaccucccgcucuagcuccccgcuccagcugaaccugcuucaagaggagaugcccagaccuagcgaaucucccgaccagaugcggcgcaauaccuguccucagacagaguacugcgugacgggaaacaacggcagcgaauccucucccgcuaccacaggggcccucagcaccggauccccgccuagagagaaucccucucacccuacagccagcgcucuguccaccggcucucccccuaugaaaaaccccagccauccgacggccuccacacugagcauggggcucccucccucccggacccccucucacccuaccgcuacaguucugagcaccggcuccccgcccucugaaagcccuucccgcacaggaagcgccgcgucuggcuccagcgacucuuccaucuaucuuacgagcucuguguacagcuccaagauuucucagaaugggcaacagagccaggauguccagaaaaaggagaccuuccccaacguggccgaggaaccuaucuggagaaugauucggcaaacacccgagcgcauccugaugaccuaucagguuccugaaagagugaaggaggucgugcucaaagaagaccuggagaagcuggaguccaugcggcagcagcaaccgcaguuuagccauggacagaaagaggaacuugcuaagguuuacaauuggauccagucccaaacagugacccaggaaauugauauccaggccugugucacgugcgagaacgaagacucugcugauggcgccgccaccagcugugggcaagugcucguggaggacuccugcuga

SEQ ID NO: 73619 - RNA, 2091 nt, Artificial Sequence
  derived and/or modified sequence opt5 from PERM1__Homo_sapiens__NP_001278296
augcccacccaggacggccaacugagacggccugcccgcccgcccgggccuagagcuuggauggagccccggggaggcgggagcucccaguucucuagcugcccuggacccgccuccucuggcgaucagaugcagcgccuccugcaagggccugcgccgagacccccuggagaacccccuggcagccccaaguccccgggccacucuacagggagccagcggccucccgacuccccuggagcuccuccccgcagccccucucggaaaaagagacgcgccgugggcgccaaagggggaggccauacgggggcuuccgccagcgcucagaccggaucuccgcuucugcccgccgcguccccugagacagccaagcucauggcuaaagccggccaggaggaacugggccccgggccugcuggagcccccgaaccgggcccuagaagccccguccaagaggaucggccugggcccggacuuggccugucuaccccuguucccgugacagagcaggggaccgaccagauccgcacaccgagacgggcgaagcuccacaccguguccacgaccgucugggaagcccugccugaugugagccgcgcuaaguccgacauggccguuucuacacccgcuagcgagccccagccugauagagacauggccguguccaccccggccagcgaaccccaaucugaucgggacauggcugucuccaccccugcgagcgagccccagccugauaccgacauggccgugucuacgcccgcuagcgagccucagcccgauagagacauggccguuuccauuccggccucuaaaccucaaagcgacacagcuguguccacccccgccagcgaaccucagucuuccgucgcgcugagcacacccaucucuaagccgcagcucgauaccgacguggcuguguccaccccugccagcaaacauggacuggaugucgcccuucccacagcuggcccuguugccaagcuggagguggcuuccucuccucccgugagcgaagccgucccccgcaugacggaguccucuggccucgugagcaccccgguuccccgggcggacgccgcugggcuggccuggccucccacaagacgcgcuggaccugauguggucgaaauggaggccgugguuuccgagcccagcgcgggcgccccuggguguugcucuggagcuccggcccuuggccugacccaggugccccggaaaaagaaggucagauuuuccguggcugggccuagccccaacaaaccuggcucuggacaagccuccgcccgccccagcgcuccgcagacagcgaccggcgcccacgggggaccuggcgcuugggaagccgucgccguggggccccggccccaucagccucgcauucucaagcaucugcccagaccuccgcccucugcuguuacgcgggugggaccuggcagcuccuucgccgucacacugcccgaggcguacgaauuuuucuuuugugacaccaucgaggaaaaugaggaggcugaagccgccgcugccgggcaggauccugcgggcgugcaauggcccgacaugugcgaguucuuuuucccggauguuggagcucagagaagccgccggagaggcucuccugaaccccucccucgggccgaccccgugccugcccccauuccgggggauccuguccccaucuccauccccgagguguaugaacacuuuuucuuuggagaggaccgccuggagggcgugcuugggccugcuguuccgcugccccuccaggcccuggaaccucccagaagcgcuuccgagggagccggcccugggacaccccuuaaaccugcggucguggaacggcugcaccucgcccugagacgcgcuggcgagcugcggggaccggugcccucuuucgccuuuagccagaacgacaugugucucgucuucguggcuuucgccacaugggccguuagaaccuccgauccucacacacccgacgcuuggaagacggcgcugcuugccaaugugggcaccauuucugcuauccgcuacuuuagacggcaagucgggcagggacgcagaagccauuccccuucucccagcuccuga

SEQ ID NO: 73620 - RNA, 582 nt, Artificial Sequence
  derived and/or modified sequence opt5 from PERP__Homo_sapiens__NP_071404
augaucagaugcggccuggccugugagcggugccgcuggauucucccccugcuucugcucagcgcuaucgccuucgacauuaucgcgcuggcugggagaggauggcuucaguccucugaucacggccaaaccagcucccugugguggaaguguucucaggaagggggaggcagcggguccuacgaggaaggaugccagucucucauggaguaugccuggggccgggccgcugccgcuaugcuguuuuguggcuucauuauccuggugaucugcuuuauucucagcuucuuugcccugugugggccucagaugcuugucuuccugcgcguuaucggaggccuccuggcgcuugccgcuguguuucaaauuaucucccuggugauuuacccggucaaauauacacagacguucacccuccaugccaaccccgcugugacauacaucuauaauugggccuacggguuuggaugggcggccaccauuauccugaucggcugcgcuuucuuuuucuguugccugccuaacuaugaagacgaucuccuggggaaugccaagcccagauacuuuuacacaagcgcuuga

SEQ ID NO: 73621 - RNA, 1752 nt, Artificial Sequence
  derived and/or modified sequence opt5 from PES1__Homo_sapiens__NP_001230154
augggcgggcuggagaagaaaaaguacgaaagaggaagcgccaccaacuauaucacacggaauaaagcucgcaagaaacuccagcugucccuugccgacuucagacggcugugcauucucaagggcaucuacccccacgagccuaagcauaaaaagaaagugaacaaggggucuacggcggcucgcaccuuuuaucugauuaaagauaucagauuccuucugcacgaaccgauugucaauaaguuucgggaguacaagguuuucgugcgcaaacucagaaaggccuauggaaaaagcgaauggaacacaguggagcggcugaaggacaauaaacccaacuacaagcuggaucauaucaucaaagagcgcuauccuaccuuuauugacgcccucagagaucuggacgaugcucuuuccauguguuuccuguuuucuacauucccccggaccggcaagugccacguccaaacaauccagcucugucgcagacugaccguggaauuuaugcauuacauuaucgccgcucgggcccuucgcaagguuuuccugagcauuaaagggaucuacuaucaggcggaggugcucggacagccuauugucuggaucacgcccuacgccuuuucccacgaccacccuaccgauguggacuauagaguuauggcuacauucaccgaauuuuacacaacccugcugggcuucgugaauuuccggcucuaucaacugcuuaaccugcauuacccgcccaagcucgagggccaggcccaggcugaggccaaagcgggggaaggaacguaugcccuggauucugagagcugcauggaaaaacuugcugcccuguccgcuagccucgccagagucguggugccugccacagaggaagaggcugaggucgacgaauuucccaccgauggcgaggaagaccgccggaaagagcuggaagcgcaggagaagcacaagaaacuguucgaggggcucaaguuuuuccugaauagagaaguuccucgcgaggcccuugcuuuuaucauucggucuuucggaggcgaaguguccugggacaaaagccuguguaucggggccacauacgaugugaccgacucuagaauuacccaucaaaucgucgaucgccccggacagcagacauccgugauuggccggugcuacguucagccgcaauggguguuugacagcgucaacgccagacuccugcuuccuguggcugaguauuucucuggcguucagcugcccccucaccucucccccuuugugacggaaaaggagggggauuacgugcccccugagaaacugaagcugcucgcccugcagcgcggagaagacccgggcaaucuuaacgagagcgaagaggaggaagaggaagaugacaauaacgagggggauggagacgaagagggcgagaaugaagaggaagaggaagaugcggaggcuggguccgagaaggaagaggaagcccggcuggccgcucucgaggaacaaagaauggagggaaagaagccccgcgucauggccggcacccugaaacuggaggacaagcagcggcuugcucaggaagaggaaucugaggccaaaagacucgcgaucaugaugaugaagaagcgggagaaauaucuguaccagaagaucauguucggcaaacgcagaaagauucgggaagccaacaaacuggcugagaagagaaaagcccacgacgaagcuguccgcagcgagaagaaggccaaaaaggcgcggccugaauga

SEQ ID NO: 73622 - RNA, 222 nt, Artificial Sequence
  derived and/or modified sequence opt5 from PET100__Homo_sapiens__NP_001164626
augggcgugaagcuggagaucuucagaaugauuaucuaccucaccuuucccgucgccauguucuggguuagcaaccaggcugaaugguuugaggacgaugugauucagcggaaacgcgaacuguggccuccggagaaacuucaggaaaucgaggaguucaaggaaagacugcggaagcgcagagaggaaaaacuccugcgggacgcccagcaaaauuccuga

SEQ ID NO: 73623 - RNA, 246 nt, Artificial Sequence
  derived and/or modified sequence opt5 from PET117__Homo_sapiens__NP_001158283
augagcagauccucuaaggugguccugggccucagcguucugcuuaccgccgcuacaguggccggggugcacgucaaacagcaaugggaccagcagcggcugcgcgauggagugaucagagacauugagcggcagauccgcaagaaagaaaacauuagacuccugggcgagcaaaucauucuuacggaacagcuggaggcggaacgggagaagaugcuccuggcuaaagggucccagaagucuuga

SEQ ID NO: 73624 - RNA, 744 nt, Artificial Sequence
  derived and/or modified sequence opt5 from PEX11A__Homo_sapiens__NP_003838
auggacgccuucaccagauuuacaaaccagacgcaaggccgggaucgccuguucagagcuacccaguacacaugcaugcuccugcgguaucuucuggagcccaaggccgggaaagaaaagguggucaugaaacucaagaaacuggagagcuccguuucuaccggacgcaagugguuuagacuuggcaauguggugcacgcgauccaggcuacagaacagagcauucacgccaccgaccuggucccucggcucugucugacacuggccaaccucaaucgcgugaucuacuucauuugcgauaccauccuguggguuagauccguggggcuuacgucuggaauuaacaaggagaaauggcggacccgcgcugcccaccauuauuacuauagccugcuccugucccuugucagagaccuguacgaaaucucucuccaaaugaagcgggugacaugugaucgcgcuaaaaaggagaaaagcgccucccaggacccgcugugguuuagcguugcggaggaagagaccgaauggcugcagucuuuccuccugcuucuguuuagaucccucaagcagcaucccccucugcuucuggauacagugaagaaucucugcgacauccugaacccccuggaucaacucggcauuuauaaaagcaauccugggaucauuggacugggcggccuugucucuuccaucgccgggaugauuaccguggcuuacccccagaugaagcugaaaacgcgguga

SEQ ID NO: 73625 - RNA, 1080 nt, Artificial Sequence
  derived and/or modified sequence opt5 from PEX12__Homo_sapiens__NP_000277
auggccgagcacggcgcucauuucaccgccgcgagcguggcugacgaucagcccuccaucuuugaagucguugcccaagacucucugaugacagccgugagaccugcucuccagcacguggucaaggugcuggccgagagcaacccgacgcauuacggguuccuuuggcggugguuugaugaaauuuucacccugcucgaccugcuucugcagcagcacuaucucucccgcacaucugcuagcuuuuccgagaauuucuacggacugaaaagaaucguuaugggcgauacccauaagucucaacggcuggccagcgcggggcuccccaaacagcagcuguggaaguccauuauguuucuugugcugcucccuuaucugaaagucaaacuugaaaagcuggugagcucucuccgcgaggaggacgaauacuccauccaucccccuagcucuagauggaagcgguucuaucgcgccuuucuggcugccuaccccuucguuaacauggcuugggagggaugguuucuggugcagcaacucagauauauucugggcaaggcccagcaccacuccccucuucugcggcucgcggggguccagcugggacgccuuacagugcaggauauccaagcccuggaacacaaaccggcuaaggccagcaugaugcagcagcccgcuagaucuguguccgagaaaaucaauagcgcccucaagaaggccgucggcggcguugcucugucccugucuaccgggcucagcgugggaguguucuuucugcaauuccuugacuggugguacuccagcgagaaccaggaaacaauuaaaucucugaccgcgcucccuacgcccccucccccgguccaucuggauuacaauuccgacagcccucuucugcccaagaugaaaaccgugugcccucucugucggaagacacgcguuaacgauaccgugcuggccacaucuggcuaugucuucugcuacagauguguguuucacuauguucggagccaccaggcuugccccaucaccggguaccccacggaggugcagcaucugauuaaacucuauuccccugaaaauuga

SEQ ID NO: 73626 - RNA, 1212 nt, Artificial Sequence
  derived and/or modified sequence opt5 from PEX13__Homo_sapiens__NP_002609
auggccagccagcccccuccgcccccuaagcccugggagaccagacggaucccuggcgcugggcccggaccuggcccggggcccacauuccaauccgccgaccugggaccuacgcucaugacccgccccggccagccugcgcugacaagagugcccccgccuauucuuccccggccuucucagcagaccgggagcuccucugucaacacauuucgccccgcuuacagcuccuucucuagcggauauggcgccuacggcaauuccuuuuaugggggauacagccccuauucuuacggcuauaacgggcugggauacaauagacuccggguugaugaccugccuccgucccgcuucgugcaacaggccgaagagagcucuagaggcgcuuuucaguccaucgaaagcauugugcacgccuucgcuucugucuccaugaugauggaugccaccuuuagcgcgguguacaacuccuuccgggccguucuugacguggcuaaucauuuuucucgccugaaaauccacuucacaaaggucuuuagcgccuucgcucucgugagaaccauucgguaucuguaccgcagacugcagcggaugcucgggcugcgcagaggauccgagaacgaagaucuuugggccgagagcgagggcacgguugcgugccugggcgccgaagaccgggcugccaccucugcuaaauccuggcccaucuuucucuucuucgccgugauccuugggggaccuuaucugauuuggaagcugcucagcacacauucugaugaggucaccgacagcaucaauugggccuccggcgaagaugaccacgugguggcuagagcggaguacgauuuugccgcugucucugaggaagagauuagcuuccgcgccggggacaugcugaaccuggcccucaaagaacaacagcccaagguucggggauggcugcuugcuucccuggauggccagacaaccgggcucaucccugccaauuaugugaagauucugggaaaaagaaagggccgcaaaacgguggagagcucuaaggucuccaaacagcaacagagcuuuacaaaccccacccuuacaaagggcgcgaccguggcugacucucuggacgaacaggaggccgccuucgaguccguuuuuguggaaaccaauaaggucccgguggcuccugauagcaucgggaaagacggagagaagcaagaucucuga

SEQ ID NO: 73627 - RNA, 1077 nt, Artificial Sequence
  derived and/or modified sequence opt5 from PEX14__Homo_sapiens__XP_011539880
augcugaacaagcucaucugccugaugauugccaccgcugugaaauuccuucagaauagcagaguccggcaaucuccccuggccacacgcagagcguuucucaagaaaaagggccugacggacgaggaaaucgauauggcuuuccagcaguccgggaccgccgccgacgagccuagcucccuuggaccggcuacacagguugugcccgugcaaccuccccaccugauuucucagccuuacagccccgccggcucccgguggcgcgauuauggggcucucgccaucauuauggcgggaaucgccuuuggcuuccaccagcuguacaaaaaguaucugcucccucugauccuugggggaagagaagaccggaagcagcuggagcgcauggaagcuggccucucugagcugagcggcuccgucgcccaaaccgugacacagcuucagaccacacuggcuagcguucaggagcuccugauucaacagcagcagaaaauccaagaacuggcccacgagcucgcggccgcuaaggccaccacgucuaccaacuggauucuggaaucccagaauaucaacgagcuuaaaagcgagauuaauucucugaaggggcuccugcuuaacagacggcaguuuccgcccuccccuagcgcucccaaaaucccuucuuggcaaauucccgugaaguccccgagcccuuccucucccgccgccgucaaucaucacagcuccagcgauaucucuccuguguccaacgaaagcacaucuagcucccccggaaaggagggccauucucccgaagggagcaccguuacauaccaucugcucggaccucaggaggaaggcgaggggguggucgacgugaaaggacaggugcgcauggagguccagggcgaagaggaaaagagagaggauaaagaagacgaggaggaugaagaggacgaugacguuucccacguggaugaagaggacugucugggcgugcaacgggaagaccgcagagggggagauggccagaucaaugagcaggucgagaagcugcggcgcccggaaggggcuagcaacgagucugaaagagacuga

SEQ ID NO: 73628 - RNA, 1011 nt, Artificial Sequence
  derived and/or modified sequence opt5 from PEX16__Homo_sapiens__NP_004804
auggagaagcugagacuccugggccuucgguaccaggaauaugugacccgccaccccgccgcuacagcccaacuggagacggcggucagaggguucagcuaccuccuggcuggacgguuugccgacucccaugaacuuucugagcugguuuauagcgccuccaaccuccuggugcugcucaaugauggcauccugcgcaaagaacuuagaaagaaacugccugugucucucagccagcagaagcugcuuaccuggcuguccguccucgagugcguggagguuuucauggaaaugggggcugccaaaguguggggagaggucggccgguggcuggugauugcucugauccagcucgccaaggcgguucugcgcaugcuucugcuccugugguuuaaggccgggcuucaaacaucuccgcccauugugccucuggacagagaaacccaggcucagcccccugauggagaccacagccccggcaaccaugagcaguccuacgucggcaaacggagcaaucgcguggugagaacacuccaaaacaccccuucucugcacucccggcauuggggagccccgcagcagcgcgaggggagacagcaacagcaccacgaggaacugagcgcuacacccaccccucucggccugcaggaaacgaucgccgaguuccuuuauauugcgcggccccugcuccaucugcuuucucuggggcucuggggacaacgcuccuggaagccuuggcugcuggccggcgucguugaugugaccagccucucucugcuuuccgacagaaaagggcugacacggagagaacgccgggagcucagacgccggaccauccugcugcuuuacuaucuccugagaagccccuuuuacgaucgcuucuccgaggcucggauccuguuucuccugcagcuucuggccgaccacgugccgggagucggccucgugacaagaccucugauggauuaccugcccaccuggcagaagauuuauuucuacucuuggggcuga

SEQ ID NO: 73629 - RNA, 840 nt, Artificial Sequence
  derived and/or modified sequence opt5 from PEX19__Homo_sapiens__NP_001180573
auggccgcugccgaggaaggcugcagcgugggggcggaggcugacagagaacuggaggaacuccuggaguccgcccuugaugacuucgauaaggccaaacccucuccugcuccgcccagcaccacaacggccccugacgcuuccggaccccagaagcggucuccuggcgauaccgccaaagacgcgcuguuugccagccaagagaaguucuuucaggaacucuucgauuccgagcuggcuucucaggccacagcugaauuugagaaagccaugaaggagcuugcggaagaggaaccccaccuggucgagcaguuccaaaagcucagcgaagccgcugggcgcguuggauccgacaugaccagccagcaggaguuuacaucuugucugaaagagacccuguccggccucgccaagaacgcuacagaucugcagaauagcucuauguccgaagaggaacuuaccaaagccauggaggggcugggaauggacgaaggcgauggcgaggggaacauccucccuauuaugcaaagcaucaugcagaaucugcuuucuaaggacgugcuguacccgucccucaaagagauuacggaaaaguaucccgaguggcugcagagccauagagaaucccugccucccgagcaguucgaaaaguaccaagagcagcacucugugaugugcaaaaucugugagcaguuugaagccgagaccccuacagauagcgaaaccacacaaaaggcucgguucgagaugguccucgaccugaugcagcagcuucaggaccugggacaucccccgaaagagcucgcgggcgaaauggugccuguugugaacuccgucuga

SEQ ID NO: 73630 - RNA, 3852 nt, Artificial Sequence
  derived and/or modified sequence opt5 from PEX1__Homo_sapiens__NP_000457
auguggggcagcgacagacuggccggggcuggaggcgggggagccgcggugaccgucgcuuucacaaacgcccgggauugcuuucuccaucugccccgcagacuuguugcccagcugcaccuccugcaaaaucaggcuaucgaagugguguggucccaccagccugccuuccuuucuugggucgaaggccggcauuuuagcgaccagggggagaacguggcugaaauuaaucgccaaguuggacagaagcugggccucuccaacggcggacagguguuccugaaaccguguucucacgucgugagcugccagcaaguugagguggaaccccuguccgccgaugacugggagauccucgagcugcaugcggucucucuugaacagcaucugcucgaucagauuagaaucguguuuccuaaggccauuuuccccgugugggucgaccagcaaacguacaucuuuauccagauuguugcucugaucccugccgcuagcuaugggcggcuugagaccgauacaaaacugcucauucagcccaagacccgcagagccaaagaaaauacauucuccaaggcggacgccgaguacaagaaacugcacagcuauggccgggaucaaaaggggaugaugaaagagcugcagaccaagcagcuccagucuaacacagugggaaucaccgaauccaaugagaacgaaagcgagauuccuguggacucuuccagcgucgcuucucuguggacgaugaucggcuccauuuuuagcuuccaauccgagaaaaagcaggaaaccucuugggggcuuacagagaucaaugccuuuaagaacaugcagagcaaagugguuccgcuggauaauaucuuccgcguguguaagucccagcccccuagcauuuacaacgcuucugccaccuccgucuuucacaaacacugcgccauccauguguuccccugggaccaagaauauuucgauguugagccuagcuuuacagugaccuacggaaagcucgucaaacugcuuucucccaagcagcagcagagcaaaacgaagcaaaaugugcuguccccggaaaaggagaaacagaugucugaaccucucgaccagaagaaaauuagaagcgaccacaacgaggaggaugaaaaggcuuguguccuccaggugguuuggaauggccuggaggaacugaacaacgcgaucaaauauacaaagaauguggagguccugcaccuuggcaagguguggauucccgacgaucugcggaaacgccucaacaucgaaaugcaugccguugugagaaucaccccugucgaggugacacccaagauuccccggucccugaaacuucaaccucgcgagaaucugccgaaggacaucagcgaagaggauauuaaaaccguguucuacucuuggcuccagcaguccaccacaacgaugcugccccugguuaucagcgaagaggaguuuauuaagcucgaaaccaaggacgggcugaaagaguucucucuuuccaucguccacagcugggaaaaggagaaagauaagaacaucuuucugcucuccccuaaucugcugcagaaaacaaccauucaagugcuucucgaccccauggugaaggaagagaacucugaggaaaucgauuucauucugccuuuucugaagcucagcucccugggaggcgucaauucucuuggggugagcucccuggagcauaucacacacagccuccugggaagaccccugucucggcagcuuaugucccucguugcuggccugagaaacggggcccugcuccugaccggaggcaaaggcagcgggaagucuacgcuugccaaagcuauuugcaaggaagccuucgacaaacuggaugcgcauguggagcgcgucgacuguaaggcucuccggggaaaaagacuggaaaauauccagaagacacuggagguggccuuuuccgaggccguuuggaugcaaccgagcgugguccuucucgacgaucuggaccugauugcuggccucccugccgugcccgaacacgagcacucuccugaugcuguucagagccagcgccuggcccaugcgcuuaacgacaugaucaaggaguucaucuccauggggagccugguggcccucauugcuaccucucagucccaacagagccugcacccccugcuugucuccgcccagggagugcauaucuuucagugcgugcaacacauucagccucccaaucaggaacaacggugugaaauccucugcaacgucauuaaaaauaagcuggauugugacaucaacaaauucaccgaucuggaccuccagcacguugcuaaggagacaggcggguuuguggccagagauuucaccgugcuggucgaccgcgcgauccauucucggcuuagcagacaguccauuucuacacgcgagaaacuggugcucacgacccuggauuuccagaaggcccugcggggcuuucuuccggcuagccugagauccguuaaucuccacaagccucgcgaccugggaugggauaaaaucggcgggcuccaugaagugcggcaaauucugauggacacaauccagcuucccgccaaguaccccgagcuguucgcuaaccucccuauuagacagcggaccggaauccugcuguauggcccgcccgggacaggaaaaacccuucuggccggcgucaucgcccgcgaaucuagaaugaacuuuauuagcgugaaggggccugagcuccuguccaaauacaucggcgcuagcgagcaggcgguucgggacauuuucaucagagcccaagcugccaagcccugcauucucuuuuucgaugaauuugagucuaucgccccucgccggggacacgacaauacgggcgugaccgauagagucgugaaccagcugcuuacacagcuggacgggguugaaggacuccagggcguguauguccuggcugccaccucccgccccgaucugaucgacccugcgcuucugagacccgggcggcucgauaagugcguguacuguccgccucccgaccaagugagccgccuggagauucucaauguccugucugauucccuuccucuggcugacgauguugaccugcagcauguggccagcgugacagauucuuucaccggagccgaccucaaagcucugcuuuauaacgcccagcuggaagcgcuccacggcaugcugcucuccagcgggcugcaggacggcuccagcucuagcgauuccgaccuuucucugagcuccauggucuuucugaaucacucuagcggauccgaugacucugcuggcgauggggagugcggacucgaccaaagccuggugucccuugagaugagcgaaauccugcccgaugagucuaaguucaacauguacagacucuauuuuggcuccagcuacgaaucugagcuggggaauggaacguccagcgaccucuccucucagugucugagcgccccguccagcaugacacaggaucuuccuggcguucccgggaaagaccaacuguucucucagccucccgugcugcggaccgccucccaggaaggcugccaggagcucacacaagagcagcgcgaucagcugagagcugacauuagcaucauuaagggacgguaccgcucucagagcggcgaagacgaguccaugaaccaacccgggccuaucaaaaccagacuugccauuucucagagccaucugaugaccgcucucggacacacacggccguccaucucugaagaugacuggaagaauuuugccgagcuguaugagagcuuccagaaccccaagcgccggaaaaaucaguccggcacgauguucagaccugggcaaaaggucacccucgcguga

SEQ ID NO: 73631 - RNA, 918 nt, Artificial Sequence
  derived and/or modified sequence opt5 from PEX26__Homo_sapiens__NP_001121121
augaaaagcgacuccucuaccagcgccgcuccccugagaggccucgggggaccucugcgguccucugagccggugcgcgccguccccgcgagagcuccugccguugaucuucuggaagaggccgcugaccuccugguggugcaccuugauuuccgggccgcucuggaaacaugcgagcgcgccuggcagagccucgcgaaccaugccgucgcugaggaacccgccggcacgucccuggaggugaaguguucucugugcguuguggggauccaagcucucgccgaaauggacagauggcaggagguccugagcugggugcuucaguacuaucagguuccugaaaagcugcccccuaaagugcucgagcuguguauucuucuguacuccaagaugcaagagccgggagcgguccucgauguggugggcgccuggcugcaggaccccgcuaaucagaaccugccugaauauggggcccucgcugaguuucacguccagcggguucugcuuccccugggaugccucagcgaagccgaggaacugguggugggcucugccgcuuucggcgaggagcgcagacuugauguccugcaagcgauccauaccgcccggcagcagcagaaacaagaacacuccgggagcgaggaagcucagaagccuaaucucgagggaucugugucccauaaguuucugagccugcccaugcucguucgccagcugugggacucugccgugucccacuucuuuagccuuccguucaaaaagucccugcucgccgcucugauucuuugucugcucgucgugagauuugauccugccucucccagcucccugcacuuccuguacaaacucgcgcaacuguuucgguggauccgcaaggcugccuucagcagacuuuaucagcugcggauucgcgacuga

SEQ ID NO: 73632 - RNA, 918 nt, Artificial Sequence
  derived and/or modified sequence opt5 from PEX2__Homo_sapiens__NP_001165558
auggccagcagaaaggagaacgcuaaauccgccaaucgggugcugcgcaucucucagcucgacgcgcuggaacuuaacaaggcucuggagcaacucgucuggagccaguucacccagugcuuucacggcuucaaacccgggcugcuugccagauuugaaccugagguuaaggccugucuguggguguuccucuggcgguuuacaauuuacuccaaaaaugcuacggugggacagucuguccugaacaucaaguauaagaaugauuucagcccgaaccugcgcuaccaacccccuuccaaaaaucagaagauuugguaugccgugugcaccaucggcgggagauggcucgaggaacgguguuacgaccuguuucgcaaccaucaccuugcuucuuucggaaaaguuaagcagugcgugaauuuugucauuggccugcucaaacuugggggacugaucaacuuccugaucuuucuccagagaggcaaguucgccacacugaccgagcggcugcucggcauucauagcguguuuuguaagccccaaaauauccgcgaaguuggguucgaguauaugaacagagaacugcuuuggcacggauucgcggaguuucugauuuuccuccugccucuuaucaaugugcagaaacugaaggccaaacucuccagcuggugcauuccccugacaggcgcuccuaacucugauaauacccuggccacauccgggaaggagugugcucucugcggagaauggccgaccaugccccauacgaucggcugugagcacaucuuuugcuacuucugugccaaaagcucuuuucuguucgacgucuauuuuaccugcccuaagugcgggacagaagugcacucccuucagccccugaaaagcggaauugagaugucugaagugaacgcgcucuga

SEQ ID NO: 73633 - RNA, 1122 nt, Artificial Sequence
  derived and/or modified sequence opt5 from PEX3__Homo_sapiens__NP_003621
augcugagaagcguguggaacuuccucaagcggcacaaaaagaaaugcaucuuucugggcaccguccuugggggaguuuacauucugggcaaguaugggcagaaaaagauccgcgagauucaagaaagagaggccgcugaauacaucgcccaggcgcggcgccaguaucauuucgaguccaaucagagaacauguaacaugacggugcucucuaugcugcccacccuucgggaagcucugaugcaacagcucaauagcgagucccugacagcccugcucaagaaccgcccuucuaauaaacuggagauuugggaagaccuuaagaucaucagcuuuaccagauccacaguggccgucuacucuaccugcaugcuggugguucuccugcgggugcagcuuaacauuaucggaggcuauauuuaccuggauaaugcugccgucgggaaaaacggaacaaccauccucgcuccgcccgacgugcagcaacaguaucugagcuccauucagcaucugcucggcgauggccugacggagcuuaucaccguuauuaagcaggccgugcaaaaaguccuggggagcgugucucucaagcacucccugagccuucuggaccucgaacagaagcugaaagagauccgcaaucugguggagcagcacaagucuuccagcuggaucaacaaagauggaucuaagccucuccugugucauuacaugaugcccgacgaagagacaccucuugcgguccaagccugcggccugucccccagagauauuaccacaaucaaacuccugaaugaaacccgggacaugcuugagagcccugauuucuccacgguucugaacacaugucucaaucgcggguuuucuagacugcuggacaacauggcugaguucuuucggccgaccgaacaggaucuccagcacggaaauagcaugaacucccugagcucugugucccuuccccuggccaagauuaucccuauugugaacggccagauccacagcgucugcucugagacacccagccauuucgugcaagaccuccugaccauggaacagguuaaagauuuugcugccaauguguacgaggcguucuccaccccucagcagcuggaaaaguga

SEQ ID NO: 73634 - RNA, 1896 nt, Artificial Sequence
  derived and/or modified sequence opt5 from PEX5__Homo_sapiens__NP_000310
auggccaugagagagcugguggaagcugagugcggcggggccaacccccucaugaagcuggcgggacacuucacccaggacaaagcucuuagacaagaaggccugcgcccugggccguggcccccuggagcccccgccagcgaggcugccuccaagccucucggcgucgcuucugaagaugagcugguugccgaguuucuucaggaccagaaugcgccccuggugagcagagccccucagacauucaaaauggaugaccuccuggcugaaaugcaacagaucgagcaguccaacuuucggcaggccccgcaacgcgcucccgggguggccgaucuggcgcucucugaaaauugggcccaggaguuccuggcugccggagacgcugucgaugugacgcaggacuacaacgagaccgauuggagccaggaauuuauuuccgagguuacagacccucuuucugugagccccgccagaugggccgaagaguaucuggaacaauccgaggagaagcucuggcugggcgaaccugagggcaccgcuacagaucggugguacgacgaauaucaucccgaggaagaucuucagcacaccgcgagcgacuucgucgccaaaguggacgauccgaagcuggcuaauucugaguuucucaaguucguucgccagaucggggagggacaagugucccuggaaagcggcgccgggucuggacgggcccaggcugagcagugggccgcggaauuuauucagcaacagggcacauccgacgcuugggucgaucaguucacccggccugugaacacgagcgcccuggacauggaguuugaacgcgccaaaucugcuaucgagcuccaggccgagcuggaagagauggcuaagagagaugccgaagcgcaucccuggcuuuccgacuacgaugaccugaccagcgccacauaugauaaaggguaccaauucgaggaggaaaauccucuccgggaccacccccagcccuuugaggaaggacugcgcagacuucaggagggcgaucugccuaacgcugugcuccuguucgaagccgcuguccagcaagacccgaagcauauggaggccuggcaguaucugggcaccacacaggcggagaaugaacaggagcuccuggccauuuccgcccuucggcgcugucuggaacucaaacccgacaaccaaaccgcucugauggcucuugccguuucuuucacgaaugagagccugcagagacaggccugcgaaacacuccgggauuggcugagauacaccccugcuuacgcgcaccuggugacacccgccgaggagggggcuggaggcgccgggcucggaccuuccaagcgcauccugggcagccuucugucugacucccucuuucuggaagugaaggagcuguuccuugccgcuguccggcucgaucccaccagcaucgacccggaugugcaaugugggcugggaguucuguuuaaccucucuggcgaauaugacaaagccguggauugcuucaccgcggcucugagcgucagaccuaaugacuaccuucuguggaacaagcucggcgccacacuggccaaugggaaccaguccgaggaagcuguggccgcguaucgccgggcucuggagcuucagcccggauacauuagaucucgcuauaaccucggcaucagcuguauuaaucugggggcccaccgggaggccguugaacauuuucuggaggcucucaacaugcagagaaaaucccgcggaccucggggcgaagggggcgccaugagcgagaauaucuggucuacgcugagacuugcucuguccaugcucggacaaagcgaugccuacggcgcggccgacgcucgcgaucugucuacccugcuuacaauguucgggcucccccaguga

SEQ ID NO: 73635 - RNA, 1875 nt, Artificial Sequence
  derived and/or modified sequence opt5 from PEX5L__Homo_sapiens__NP_001243679
auguaccagggccacaugcaaguggucgggguuacccugaagaaaaaguggcauugccuccagaaaagcgaccugacacuugcccugggaaagggcuccagagcugccgauaaagcgguggcuauggugaugaaggagaucccccgggaagagucugccgaagagaagccucuccugacgaugaccagccagcuugucaacgaacagcaagagucccgcccgcugcucucucccagcauugacgauuuccugugugagacaaaauccgaagccaucgcuagaccugugaccucuaauacagccguucugaccacagggcucgaccugcuugaucugagcgagcccgugucccagacccagacgaaggcuaaaaagagcgaaccuucuuccaaaaccagcucucucaagaagaaagccgacggauccgaucugauuagcacagacgcggagcagcggggccaaccccuucgcgucccugagaccucuucccuggaucucgacauccagacacagcuggaaaagugggaugacgugaaauuucacggggauagaaacaccaagggacauccgauggccgagcggaaaagcuccucuagccgcacgggcuccaaggaacugcucuggagcucugagcacagaucccagcccgaacugagcggcgggaaaucugcucuuaauagcgaguccgccucugagcuggaacucguugcuccuacacaagcccggcugaccaaggagcaucgcuggggaagcgcgcuucuguccagaaaccacagccucgaagaggaguucgagcgggccaaggcugccguggagucugacacagaauuuugggacaaaaugcaggcugagugggaagagauggcccgcagaaauuggauuuccgaaaaccaggaggcccaaaaucaggucaccaucagcgcuucugagaagggcuauuacuuccacaccgaaaaccccuuuaaagauuggccuggggcguucgaggaaggacugaagcggcugaaagagggcgaccuccccgugacaauccuguuuauggaggccgcuauucuucaggauccgggggacgccgaagccuggcaguuccugggaaucacgcaagcugagaaugaaaacgagcaggccgcgauuguggcucuccagcgcugccuggaacuucagccuaauaaccugaaggcccucauggcccuggcugucuccuauaccaauacaggccaucaacaggaugccugugacgcucugaagaacuggaucaaacagaaucccaaguacaaauaucucguuaagagcaaaaagggcuccccugggcugaccagacggaugucuaagagccccguggauuccucugugcuugagggagucaaagagcuguaccucgaagccgcgcaccagaacggcgacaugauugaucccgaccugcaaacagggcugggagugcuuuuucaucucagcggcgaguucaacagagccaucgaugcuuuuaaugccgcucugaccguucgcccugaagacuauucccuguggaaccggcucggggccacgcuggcgaauggagacagaagcgaggaagccguggaggcuuacacacgcgcccuugagauucagccgggcuucauccggucuagauacaaccugggcaucuccugcauuaaucucggggcuuaucgcgaagccgucagcaacuuucugaccgcccugucucuucagcggaaguccagaaaucagcaacaggugccccacccugcuaucagcggaaacauuugggcggcccuccgcaucgcucugucucugauggaucagcccgaacucuuccaagccgccaaucugggcgaccuugauguucugcuccgggcuuucaaccuggacccuuga

SEQ ID NO: 73636 - RNA, 2943 nt, Artificial Sequence
  derived and/or modified sequence opt5 from PEX6__Homo_sapiens__NP_000278
auggcccuggcugugcucagaguccuggagcccuucccuaccgaaacaccgccccuugccguucugcucccucccggcgggccuuggcccgcggcugagcugggacuugugcuggcccuccggccugccggcgaaagcccggcugggcccgcccugcugguggcugcccucgagggaccugacgcgggcacggaggaacaggggcccggaccuccccaacugcuugucucccgcgcccugcucagacugcuugcucugggcucuggcgccugggugcgggcucgcgccguuagacggccgccugcgcucgggugggcccugcugggaaccagccucggccccgggcugggaccucgcgugggcccccuucuggucagacggggagagacacuccccgugccuggaccgcgcguucuggaaaccagacccgcccuucagggccugcucggcccugggacacggcuggcugugaccgagcugcgcgggagagcucggcucugccccgaauccggcgauucuagccgcccucccccgccucccgucguguccucuuuugccgugagcgggacagucagacggcugcagggaguucuuggcgggaccggagacucccugggcgugagcagaucuugucuccgcggccuggggcuuuuccagggagagugggugugggucgcccaagcucgggaguccagcaacacgucucagccucaccuggcgagagugcagguucucgaaccccgcugggaucuguccgaccggcugggcccugggagcggaccccucggcgagccgcuggccgaugggcuugcucuggugccugccacccucgccuuuaaucugggcugcgacccccuggaaaugggagagcuuagaauccagcgcuaccucgaaggcucuauugcucccgaggauaagggguccuguagccugcugccuggaccgcccuucgcccgggagcuccauaucgaaauugucuccucuccucacuauagcacaaacggcaauuacgacggggugcuguauagacauuuucaaaucccccgcguugugcaggagggagauguccuuugcgugccuaccauuggccaggucgaaauccuggaggggucccccgaaaaacucccucgguggagagagauguucuuuaaggugaaaaagacaguuggcgaggcgcccgacggaccggcuagcgccuaccuggccgauaccacgcacacaucucuguauauggugggcuccacccuuagcccuguccccuggcucccuucugaagagagcacacugugguccucucugagcccgcccgggcucgaagcucugguguccgagcuuugugccguucugaaaccucgccuccagcccggaggcgcucugcugaccgggaccagcucugugcuucuccggggaccucccggcugcgggaagacaacggucguggccgcggccuguucccaucugggccugcaccuccugaaggugcccugcagcucucuuugugcugaauccagcggagccguugagaccaaacugcaagcuaucuucuccagagcccggcgcugcagaccugcgguccuccugcugacagccguggaccuucucggccgggauagagacgggcugggagaggacgcucgcgugauggccguccugcggcaccuccugcuuaacgaagauccgcuuaauucuugucccccucucauggugguugcuaccacaagcagagcccaggaccugcccgccgaugugcagaccgcuuuuccucaugagcuggaaguccccgcgcuuuccgagggccaacgccugucuauucucagagcccugacggcucaccucccucuggggcaggaggugaaccuugcccagcuggcccggcgcugcgcuggauucguugugggcgaccucuacgcccugcugacacauagcuccagagcggcuugcacccggaucaagaauagcgggcuugccggcggacugaccgaagaggaugaaggcgagcucugugccgcuggguuuccgcugcucgccgaagacuucggacaggcgcuggagcaacuucagacagcucacucucaggccgucggcgcccccaaaauuccuuccgugagcuggcacgauguugggggacugcaggaggugaagaaagaaauccucgagaccauucaacugccccuggaacauccugagcuucugucucucggccugcgcagauccggccuccugcuucacgggcccccgggaacaggcaagacgcugcuggcuaaggccgucgcuaccgaaugcagccucacauuucugucugugaaagggccugagcuuaucaacauguaugugggacagagcgaggaaaauguccgggagguuuucgcccgcgcgagagccgcugcccccuguauuaucuucuuugacgaacuggauucccucgcucccagccggggccgcucuggggacuccggaggcgugauggauagaguggucagccagcugcucgccgagcuggacggccuucauuccacccaggacguguucguuaucggggccacaaaccggccugaucugcuggaccccgcucuccugagaccuggacgcuuugauaagcugguguucgucggcgcgaaugaagaccgggccucucaacugagagugcucagcgcuauuacccgcaaauuuaagcuggagccguccguuucucucgugaacguccuggauugcugucccccucagcuuacgggggccgaccuguacagccugugcuccgaugccaugaccgcugcccucaaacggagagugcacgaccuggaggaaggacuugagcccggcucuagcgcgcugaugcucacaauggaagaucugcuccaggcugccgcccgccugcagccuuccguuagcgagcaagagcuucugcgguacaagagaauccagcgcaaauucgcugccuguuga

SEQ ID NO: 73637 - RNA, 972 nt, Artificial Sequence
  derived and/or modified sequence opt5 from PEX7__Homo_sapiens__NP_000279
augagcgccgugugcggcggggcugccagaaugcugcggacccccggacgccacggcuacgcggcugaguucuccccuuaucucccggggagacuggccugugccacagcucagcauuacggaaucgccggcugcgggacgcuucugauucucgaccccgaugaagcuggacugcggcuuuuucgcucuuucgacuggaacgauggccuguuugacgucaccuggagcgagaauaacgaacacguucucaucacauguuccggcgaugggucucugcaacugugggacaccgccaaggcggccggaccucuccagguguauaaagagcaugcucaggaaguguacagcgucgauuggucccagacaagaggcgagcaacuggugguuucugggagcugggaccagaccgugaaacuuugggaucccacagucggaaagucccugugcaccuuccggggccacgagagcauuaucuauucuacgauuugguccccucauauccccggguguuuugccagcgcuucuggagaccagacccuccgcaucugggaugugaaggccgcgggcguuagaauugugaucccugcccaccaggcugaaauucuguccugcgacugguguaaauacaaugagaaccuucuggucacaggcgccguggauugcagccuccgggggugggaccugcgcaaugugagacaaccggucuucgaacugcucggacacaccuaugcuauccggcgcguuaaguuuucucccuuccaugccuccgugcuggccagcuguuccuacgacuuuacagugagauucuggaacuuuucuaagccugauagccuucuggagaccgucgagcaccauacggaguucacaugcggccucgacuuuucccugcagagccccacccagguggcugauuguucuugggacgaaacaauuaaaaucuacgauccugcgugccuuaccauucccgccuga

SEQ ID NO: 73638 - RNA, 306 nt, Artificial Sequence
  derived and/or modified sequence opt5 from PF4__Homo_sapiens__NP_002610
augagcuccgccgccggcuucugcgccucuagacccgggcugcucuuucugggacuucugcuccugccucuuguggucgcguucgcuagcgccgaggccgaagaggacggcgaucugcagugucucugcguuaagaccacaucccaagugcggccgcgccacaucacgucucuggaagugauuaaagcugggccccauuguccuaccgcccagcugaucgcuacacucaagaacggaagaaaaauuugccuggaccuucaggcuccccuguacaagaaaaucauuaagaagcuccuggagagcuga

SEQ ID NO: 73639 - RNA, 315 nt, Artificial Sequence
  derived and/or modified sequence opt5 from PF4V1__Homo_sapiens__NP_002611
augagcuccgccgcuagaucucggcugacccgcgccacaagacaggagaugcuguuccucgcgcuucugcuccugcccguggucguugcuuuugcccgggccgaagcugaggaagacggcgaucuucaaugccugugugugaagacgaccagccaggugcgcccuagacacaucacaucccucgaggucauuaaagccgggccgcauugccccaccgcucagcugaucgccacacugaagaacggacggaaaauuugucucgaccugcaggcgcuucuguacaagaaaaucauuaaggaacaccucgagucuuga

SEQ ID NO: 73640 - RNA, 405 nt, Artificial Sequence
  derived and/or modified sequence opt5 from PFDN4__Homo_sapiens__NP_002614
auggccgcuaccaugaagaaagccgcggcugaggacgugaacgucacauucgaagaucagcaaaagaucaauaaauuugccagaaacacgagccggauuaccgagcugaaggaagagaucgaaguuaaaaagaagcagcuccagaaucuggaggacgccugcgaugacauuaugcuugcugaugacgauugucugaugauccccuaccagauuggcgacguguucaucucccacucucaagaggaaacacaggagaugcucgaagaggccaaaaagaaccugcaggaggaaaucgaugcucuugagagccgcguggaauccauucagagaguccuggccgaccucaaagugcaacuguaugcgaaguuugggucuaauaucaaccuggaggccgaugaaagcuga

SEQ ID NO: 73641 - RNA, 465 nt, Artificial Sequence
  derived and/or modified sequence opt5 from PFDN5__Homo_sapiens__NP_002615
auggcccagagcaucaacauuaccgagcugaaucucccccaacuggaaaugcuuaagaaccagcuggaccaggagguggaauuucucuccacaucuaucgcucagcugaaagucguucaaacgaaguacguggaggccaaagauugccuuaaugugcugaacaagagcaaugaaggcaaagagcuccuggucccucugaccuccucuauguaugugccggggaagcuccacgacguugagcaugugcugauugaugucggaacaggcuacuauguggaaaagaccgcggaggacgcuaaagauuucuucaagagaaaaaucgacuuucuuacaaagcagauggagaaaauucagcccgcccugcaggaaaagcacgccaugaagcaagcuguuauggagaugaugagccagaaaauccagcagcucaccgcccugggggcugcccaagcgacagccaaggcuuga

SEQ ID NO: 73642 - RNA, 390 nt, Artificial Sequence
  derived and/or modified sequence opt5 from PFDN6__Homo_sapiens__NP_001252525
auggccgagcugauccagaagaaacuccaaggcgaaguggagaaguaccagcagcugcagaaagaccuuagcaaguccaugucugggagacaaaaacuggaagcucagcucaccgagaacaauauugucaaggaggaacuggcccuucuggauggaagcaacguuguguucaagcuccugggccccgugcuggucaaacaggagcucggggaagcgcgggcuacagugggaaagcgccuggacuauaucacggccgagauuaaaagauacgaaucccagcuucgggaucuggagcgccaaucugagcagcagagagaaacccucgcccagcugcaacaggaguuucagcgggcucaagccgcuaaggccggcgcgccugggaaagccuga

SEQ ID NO: 73643 - RNA, 1350 nt, Artificial Sequence
  derived and/or modified sequence opt5 from PFKFB1__Homo_sapiens__NP_001258733
augagccccgagaugggcgaacugacccagacaagacuccaaaagaucuggauuccucacuccucugggagcucccggcugcagcgcagacggggaucuagcaucccgcaguucacgaacucccccaccauggugauuauggucggccuuccugcccgcgggaaaacauacaucucuaccaagcugacaagauaucucaauuggauuggaacccccacaaaagacaacauggaggcucugcagauccggaagcaaugcgcccuugcggcucugaaagauguucauaauuaccucagccacgaagagggccauguggccguguuugacgccaccaacacgacccgcgaaagacggucccugauccugcaguucgcuaaggagcacggguauaaggucuuuuucauugagagcaucuguaaugauccuggaauuaucgccgaaaacauucgccaggugaaacucggcucucccgacuacaucgauugcgacagagagaagguucuggaagauuuucuuaaacggauugaguguuaugaggugaauuaccagccucuggacgaggaacucgauucccaucugagcuauaucaagaucuucgacgucggcacacgcuacauggugaacagaguucaagaucacauucagucucggaccguguacuaucuuaugaauauccacgucacaccgcgcuccauuuaccugugcagacauggggaaagcgagcucaacauccggggaagaauuggcggggacucuggacuguccgugcgcggcaaacaguaugcuuacgcccuggcgaauuuuauccagagccaagggaucuccucucucaagguguggaccagccacaugaagcggacgauucagacagccgaagcucugggaguccccuaugagcaguggaaagcccuuaacgagaucgaugcuggcguuugugaagagaugaccuacgaagagauucaagaacauuauccugaggaguucgcccugagagaccaggacaaguaccgcuaccgguaucccaaaggcgaauccuacgaggaucucgugcagagacuggaaccugugaucauggagcuugaacgccaggagaauguccuggugauuugccaccaagcgguuaugcggugucuccuggccuauuuucuggacaagagcucugaugagcuccccuaccugaaaugcccgcuucacacagugcugaagcucaccccugucgcuuauggguguaaaguggaauccaucuaccugaacguugaggccgugaauacccauagagaaaagcccgagaacgucgacaucacacgcgagccugaagaggcucuugauacggugcccgcccacuauuga

SEQ ID NO: 73644 - RNA, 1416 nt, Artificial Sequence
  derived and/or modified sequence opt5 from PFKFB2__Homo_sapiens__NP_001018063
augagcggcgccuccucuagcgagcagaacaauaacuccuacgaaaccaagacacccaaucugagaaugucugagaaaaagugcagcugggcuuccuauaugacgaacucuccuacccucaucgugaugauugggcugccggcccggggaaaaacauacgucagcaagaaacuuacccgcuaucugaauuggaucggcguucccacaaagguguucaaccucgggguguacagacgggaagcggucaaguccuauaaaagcuacgacuuuuuccgccacgauaaugaggaagcuaugaagauuagaaaacaaugugcccugguggcccuugaggacguuaaggcuuaucugaccgaggaaaacggacagaucgccguguuugaugcuacaaauaccacgcgggagcgcagagacaugauucucaacuucgccgaacaaaauucuuuuaaagucuucuuuguggaguccguuugcgaugacccugaugugaucgcggccaacauccuggaggucaaggugagcucucccgacuacccugaacggaaucgcgagaacgugauggaagauuuccugaagagaauugaguguuacaaagucaccuaucggccccucgacccugauaauuacgacaaggaucuguccuuuaucaaaguuauuaacgugggccagcgcuuccuugugaacagaguccaggacuauauccagagcaagauuguguacuaucugaugaauauccauguucagccgcggacaauuuaccucugccgccacggggaaucugaguuuaaccugcuuggaaaaaucggcggcgacuccgggcugagcgugagaggaaagcaguucgcucaagcccuccggaaauuucuggaggaacaggagaucaccgaucugaaggucuggacaucccagcucaagagaaccauucagacggcugaaucucugggcgugcccuaugagcaauggaaaauccuuaaugaaauugacgccgggguuugugaggagaugacauacgcggaaaucgagaagcgcuacccugaagaguucgcccugcgggaucaggaaaaauaucucuacagauaucccggaggcgagagcuaccaggaccuggugcaacgccuugagccugucauuauggaacuggagcggcaggggaacgugcucgucaucucccaucaggcugugaugagaugccugcuggccuauuuccucgauaagggagcugacgaacugcccuaccuucgcuguccgcugcacaccaucuuuaaacucacaccuguugccuauggcugcaagguggagaccauuaagcugaaugucgaggccgugaacacccaucgggauaaacccacagcugcggaaacgacccuugccguuagacgccggccuagcgcugccucucugaugcuccccuguuga

SEQ ID NO: 73645 - RNA, 1503 nt, Artificial Sequence
  derived and/or modified sequence opt5 from PFKFB3__Homo_sapiens__NP_001138915
augcccuucagaaaggccugcggcccuaaacugaccaacagcccgacagugaucgucaugguugggcuccccgcucggggaaagacguacauuuccaaaaagcugacccgcuaucuuaauuggaucggcgugccuacaaaaguguuuaacgucggggaguacagacgggaagccgugaagcaguauucuagcuacaauuucuuucgccccgacaacgaggaagcgaugaagguuagaaaacaaugugcucuggccgcccuccgggaugugaaguccuaucuggcuaaagagggaggccagauugccgucuucgacgcuaccaauacaacccgcgaaagacggcacaugauccuucauuuugccaaggagaacgauuucaaagcguuuuucauugagucugugugcgacgauccuacaguuguggccagcaauaucauggaagucaagaucuccucucccgacuacaaggauuguaacagcgcugaggccauggacgauuuuaugaaacgcauuuccugcuaugaagcuagcuaccagccucuggacccggauaagugugacagagaucucucucugaucaaagugauugacguggggcggcgcuuccuggucaauagaguucaggaccacauccaaucccggauuguguacuaucucaugaacauccaugugcagccccgcaccauuuaccugugcagacacggagagaaugagcauaaccuucagggccggaucggcggggauagcggacugucuuccagaggcaagaaauuugccagcgcgcucucuaaguucgucgaggaacagaaucugaaagaccuucgcguguggacgucccaacuuaagagcaccauccagacagccgaagcucuccggcugccuuaugagcaguggaaggcccugaacgaaauugaugcugggguuugugaggagcucaccuacgaagagaucagagacacauaucccgaagaguacgcccugcgcgaacaggauaaauauuacuaccgguauccuaccggagaguccuaccaagaccuugugcagagacuggagcccgucauuauggaacucgagcgccaggaaaaugugcugguuaucugccaccaagccgugcuucggugucugcucgcuuauuuucuggauaagucugcggaggaaaugccguaccugaaaugcccucuccacacgguccugaagcugacacccguggccuauggcuguagagucgagagcauuuaccugaacguggaguccguuugcacccaucgcgaacggagcgaggacgcuaaaaaggggccuaacccccucaugagacgcaauucugugacaccccuggccuccccugaaccgaccaagaaaccccggaucaacagcuucgaggagcacgucgccucuaccagcgcugcccuuccuuccugccugcccccugaagugcccacacagcucccgggacagaauaugaagggcucuagaagcuccgcggauagcucucggaaacauuga

SEQ ID NO: 73646 - RNA, 1410 nt, Artificial Sequence
  derived and/or modified sequence opt5 from PFKFB4__Homo_sapiens__NP_004558
auggccagccccagagagcugacccagaacccucucaagaaaaucuggaugccguacuccaauggccggcccgcucugcacgccugccaacgcgggguguguaugacaaacugcccuacgcuuauugucaugguuggacugcccgcgagaggcaagaccuauaucucuaaaaagcucacacgguaccugaauuggauuggggugccuacccgcgaguucaacgugggacaguauagacgggacgucgugaaaacauacaagagcuuugaguucuuucuucccgauaaugaagagggccugaagauccgcaaacagugugcucucgccgcccugagagacguucggcgcuuccuguccgaagaagggggacauguggcugucuuugaugccaccaacacaaccagagagcggcgcgcuacgauuuucaauuuuggcgaacagaacggcuauaagaccuucuuuguggagucuaucugcguugacccugaagugaucgccgcgaauauuguccaagugaaacucgggagcccggauuacgugaacagagacuccgaugaggccacagaggacuucaugcggcgcaucgaauguuaugaaaauucuuacgagagccuggaugaggaccuugauagagaccuguccuacauuaagaucauggaugucggacagagcuauguugugaaccggguggcugaccacauucagucuagaaucgucuacuaucucaugaauauucaugugacaccccgcuccaucuaccugugccggcacggcgaaagcgagcuuaaccugaaagggagaaucggaggcgacccugggcucucuccccgcggacgggaguuugccaagucccuggcucaguucauuagcgaucaaaauaucaaggaccugaaaguuuggaccucucagaugaagagaaccauucagacggccgaagcgcucggcgugccuuaugagcaguggaaaguccugaacgaaaucgaugccggcgugugugaggaaaugacauacgaggagauucaagacaacuauccccuugaauuugcucugcgcgaucaggacaaguaccgguacagauauccgaaaggggaguccuacgaagaucucguucagcgccuggagccugugaucauggaacuugagcggcaagagaauguccuggugaucugccaucaggccgucaugagaugucuccuggcuuauuuccuggacaaggccgccgaacagcuccccuaccugaaaugcccucuucacaccgugcugaagcucacacccguugcuuauggauguaagguggagagcauuuuccugaacgucgcggccgugaauacccaccgcgaucggccccagaacguugacaucuccagaccuccggaagaggcucuugugaccguccccgcccaucaauga

SEQ ID NO: 73647 - RNA, 2343 nt, Artificial Sequence
  derived and/or modified sequence opt5 from PFKL__Homo_sapiens__NP_002617
auggccgcuguggaccuggagaagcucagagccagcggcgcggggaaagcuaucggaguccugaccuccggcggggaugcccagggaaugaacgccgcuguucgggccgugacacgcaugggcauuuacgugggggcuaaggucuuccuuaucuaugaaggauacgagggccugguggaaggcggggagaauauuaaacaagccaacuggcucucuguuagcaauaucauucagcugggaggcacgaucaucggguccgcgagaugcaaggccuuuaccacacgggaaggacgcagagcugccgcuuauaaccuugugcagcacggcauuaccaaucugugugucaucgggggagacggcucucucacaggcgccaacauuuuccggagcgagugggggucccugcuggaggaacucguggcggagggaaaaaucucugaaaccacagcccgcaccuacagccaucugaauauugcuggccuuguuggguccaucgauaacgacuuuugcggaacggauaugaccauuggcacagacagcgcccugcacagaaucauggaggugaucgaugcuauuaccacaaccgcccagucucaucaacggacguucguccucgaggugauggggcgccacuguggauaucuggcccuuguguccgcucuggcgagcggcgccgacuggcucuuuauccccgaagcuccuccggaggauggcugggaaaauuucaugugcgagagacugggggaaacacggucucgcggauccagacugaacauuaucauuaucgccgagggcgccaucgaccggaaugggaagcccauuagcagcuccuacgucaaggaucucguugugcagcgccugggauuugacaccagagugacaguccuuggccaugugcagagagggggcaccccuagcgcuuucgaucggauccuguccucuaaaaugggaauggaggccguuauggcgcuccuggaagcuacccccgacacgccugccuguguggucacacuuagcggcaaccaguccgugcgccugccccucauggagugcguucaaaugaccaaggaagugcagaaagccauggacgauaagcgguuugacgaggcuacacagcugagagggggaucuuucgaaaauaacuggaauauuuauaaacugcucgcccaccagaagccuccgaaggagaaaucuaacuuuucccuggcuauccuuaacgucggcgcccccgcggccgggaugaaugcugccgugcgcagcgcuguccggaccggaauuucucacggccauacaguguacguugugcacgauggguucgagggccuggccaagggacaaguccaggaagugggcuggcaugacguugcgggguggcucggaagaggcgggagcaugcugggaaccaaacgcacgcuuccuaagggccagcuggaguccaucguggaaaacauccggauuuacgggauccacgcccuccuggucgugggcggauuugaggcuuaugaaggcgugcugcaacucguugaggccagagggcgcuacgaggaacuguguauugucaugugcgugauccccgcuacaauuucuaauaacgugccuggaaccgauuucagccuuggcuccgacaccgccgucaaugccgcuauggagagcugugaucggaucaaacagucugcguccgggacaaagagacgcguguucauuguugaaaccaugggaggcuauugcggguaccuggccacagugacgggcaucgcugucggagccgacgccgcuuauguguuugaggaucccuucaacauccacgaccucaaaguuaauguggagcauaugaccgaaaagaugaagacagauauucagcggggccugguccugagaaacgagaaaugucacgacuacuauaccacagaauuucuuuacaaucucuacagcucugaggggaagggaguguucgacugccggaccaacguucugggccaucugcagcaagggggagccccgacgccuuuugaucgcaauuauggcaccaaacucggcgugaaggcgaugcuguggcuuuccgaaaaacugagagaggucuaccggaaggggagaguguucgcuaacgcccccgacagcgccugcgugaucggacucaagaaaaaggcugucgccuuuuccccuguuacagagcugaaaaaggauaccgacuucgaacaccgcaugccccgggagcagugguggcugucucuuagacucaugcugaaaaugcuggcgcaguaucgcauuagcauggcugccuacguguccggcgaacucgagcaugugacaagacggacccugucuauggauaagggguuuuga

SEQ ID NO: 73648 - RNA, 2556 nt, Artificial Sequence
  derived and/or modified sequence opt5 from PFKM__Homo_sapiens__NP_001160158
augcacaaggacgaguuccaucugaaauuuuucaugugcgugauccagagcagacaacucguccggacaccccagcgcacagccggcgaggcuuccacgucuagcaugcugauuccuaagccgcccccuaaaaccgauauccuuaagucccuggacacaauggaugaccccgauaccguugggucuauuccuguguuuaaaacagaguggaucaugacccacgaagaacaucacgccgcgaagacacucggaauuggcaaggcuaucgccgugcugaccagcgggggagacgcccagggcaugaacgcugccgucagagcugugguucggguggggaucuucacgggagcccgcgucuuuuucgugcaugaaggcuaccagggccuuguugaugggggagaccacauuaaagaggcgaccugggaguccgugucuaugaugcugcaacucggcgggacagucaucggaagcgccagauguaaggauuuucgggaacgcgagggcagacugcgggcugccuauaaucuggugaaacgcgggauuaccaaccucugcgugaucggaggcgacggcucccugacaggggcugauaccuucagaagcgaauggucugaccuucuguccgaucuccagaaggccggaaaaauuacggacgaggaggcgacaaagagcucuuaccugaauaucgucggccuuguuggguccauugacaacgauuuuuguggaaccgacaugacaaucggcaccgauagcgcccugcaccggaucauggaaauuguggacgcuaucaccacaacggcccagucucaucagcgcaccuucgugcucgaggucauggggagacacugcggauaucuggcucuggugacaucccucagcuguggcgccgauuggguuuuuauucccgaaugcccuccggacgaugacugggaggaacaucugugucggcgccuuuccgagaccagaacacggggcucuagacugaauaucauuaucguggccgagggggcuaucgauaagaacggaaaacccauuaccagcgaagacaucaagaaucucgucgugaaacgccugggcuacgauacgcggguuacagugcuugggcacguccaaagaggaggcaccccuuccgcguucgaccgcauucuggggagccggaugggcguggaggccgucauggcucuccuggaaggaacccccgacaccccugccugcgugguuucucuguccggcaaccaggccgugagacucccccugauggaguguguccaggugaccaaggauguuacaaaagcuauggacgaaaagaaauuugaugaggcccuuaagcugcgcgggcggagcuucaugaauaacugggagguguauaagcuccuggcgcacgucagaccgccugugucuaaaagcggaucccauacgguggcuguuaugaaugucggcgcccccgccgcugggaugaacgccgcugugcgcucuaccgugcggaucggacuuauucagggcaauagaguccuggugguucacgacggguucgaaggccucgccaagggacaaaucgaggaagcgggcuggagcuacgucgggggauggacaggccaagggggauccaaacugggcaccaagcgcacacugccuaaaaagagcuuugagcagaucucugccaacauuaccaaguucaauauccaggggcucgugauuaucggcggauuugaggcuuauacgggcgggcuggagcuuauggagggacggaaacaguucgaugaacugugcauucccuuugugguuauccccgccaccguguccaacaacgucccuggcagcgacuucucugugggggcugauacagcccucaauaccauuuguacaaccugcgacagaaucaagcaguccgcggccggaacgaaacggcgcguuuuuaucauugagacaaugggcggguacugcggcuaccuggcuaccauggccggacuggcugccggcgccgaugcugcguauaucuucgaagaaccguuuacaauuagagaccuucaggccaacguggagcaucucguccaaaagaugaaaaccaccgugaagcgggggcuggugcugagaaaugaaaaguguaacgagaauuacacaacggauuucaucuuuaaccucuauagcgaagagggaaaaggcauuuucgacucccgcaagaauguccuggggcacaugcagcagggaggcucucccaccccuuuugaucggaacuucgcuacaaaaaugggcgccaaggccaugaauuggaugagcgggaaaaucaaggaauccuacagaaacggacgcaucuucgcuaauacccccgacucuggcugcguucuugggaugagaaagcgggcccugguguuucagccuguggcggagcucaaagaccaaacagauuucgagcaucgcauucccaaggaacagugguggcugaaacugagaccgauccuuaagauucucgcuaaauaugagaucgaccuggauaccagcgaccacgcccaccuggaacauauuacgcggaagcgcuccggagaggccgcugucuga

SEQ ID NO: 73649 - RNA, 2331 nt, Artificial Sequence
  derived and/or modified sequence opt5 from PFKP__Homo_sapiens__NP_001229268
augugcggcuacgagagaugucggcccugccgcggggcccacggauaucugagaggcgggcagggagugcuccaucugcggggccuuccugggcacggaggccgcagacugaagcaucggcgcggcagacucggggaaugucugcaacacccggcuagcggagccguccggggcgacuggcgcgagaaacccgggugcuggucccauagauucccuugucccggacggcacgcgcuuguuggcgggaccaucauuggaucugcucgcugccaggccuuuagaacacgggaaggccgccugaaggccgcuuguaaccuccugcagagaggcaucacgaaucugugcgugauugggggagauggcagccucaccggggccaaccuguuccggaaagagugguccggacuucuggaagaacucgcuagaaauggccagaucgacaaggaggccgugcaaaaauacgcguaucugaacgucguggggaugguuggaucuauugauaaugacuuuuguggcacagauaugaccaucggcacagacagcgcccuucaccgcaucauugaaguggucgaugcuaucaugaccacagcccagucccaucagcggaccuucgugcuggagguuauggggagacacugcggauaccucgcucuggugucugcccuggcguguggcgccgacugggucuuucucccugaaagcccucccgaggaggggugggaggagcagaugugcgugaagcuguccgaaaaccgcgcucggaagaaaagacuuaauauuaucauuguggccgagggagcuaucgauacgcaaaacaagccgauuaccagcgagaaaaucaaggaacuggucguuacacagcucggcuaugacacccgcgugacaauccuggggcaugugcagcggggcggaacccccucugccuucgaucgcauucuugccuccagaaugggcgucgaggcugugaucgcgcugcucgaagccacgccugacacacccgcuugcguugugagccugaaugggaaccacgccguccggcugccucucauggagugugugcagaugacccaagauguucagaaagccauggacgaaagacgcuuucaggacgcugugcggcugagaggacggucuuucgccggcaaucuuaacacauacaagcgccuggcgauuaagcuccccgaugaccaaaucccgaaaaccaauugcaacgucgcugugauuaaugucggggccccugccgcuggaaugaacgccgcugugagauccgccguucgggugggcaucgcggaugggcacagaaugcuggccaucuaugacggcuuugauggauucgcuaagggccagauuaaagagaucggguggaccgacgucggaggcuggacagggcagggaggcagcauucuugggacgaagcgcgugcugcccggcaaauaccucgaagagaucgccacccagaugcggacacauucuauuaacgcucugcugaucaucggaggcuuugaggccuaccucgggcugcuugaacuguccgcggccagagagaagcacgaagaguucuguguuccuauggugaugguccccgcuaccgugagcaauaacgugcccggauccgauuuuucuauuggcgccgacacagcucucaauaccaucacggauacaugcgaccgcauuaaacaaagcgccuccgggaccaagagacggguuuucaucauugaaaccaugggaggcuauuguggguaccuggccaacaugggcggacuggcugcgggcgccgaugcugccuauaucuucgaggagccuuuugacauucgcgaccuucagagcaaugucgaacaucucacagagaagaugaaaaccacaauccagagagggcuggugcugcggaacgaaucuugcuccgagaauuacacgaccgauuucaucuaucagcucuacagcgaggaaggaaagggcguguuugacugucgcaaaaacguccuggggcacaugcaacagggaggcgccccgucucccuucgauagaaauuuuggcacaaagauuagcgcucgggccauggaguggaucaccgcgaaacuuaaggaagcucgcgggagaggaaagaaauucacaaccgacgauuccauuugcgugcugggcaucucuaagcggaacguuauuuuucagccuguggccgagcucaaaaagcagacggacuucgaacaucgcauccccaaagagcaaugguggcugaagcugagaccucuuaugaagauccucgccaaauauaaggcuagcuacgaugucuccgacagcgggcagcuggagcacgugcagcccuggucuguuuga

SEQ ID NO: 73650 - RNA, 423 nt, Artificial Sequence
  derived and/or modified sequence opt5 from PFN1__Homo_sapiens__NP_005013
auggccggcuggaacgcuuacaucgacaaucugauggccgaugggaccugccaggacgcggcuauugugggauauaaggauagccccuccgucugggccgccguuccuggcaaaacauucgugaacaucacgccggcugagguggggguccucgugggaaaggacagaucuagcuuuuacguuaauggccugacccuugggggacaaaaauguuccgugauucgggauucucugcuccaggacggcgaguucagcauggaucugcgcacaaaguccaccggcggggcccccacauuuaacgucaccgugacaaaaaccgacaagacgcuuguucugcucaugggaaaggaaggcgugcacgggggacugaucaauaaaaagugcuaugaaauggcuucucaucugagacggagccaguacuga

SEQ ID NO: 73651 - RNA, 423 nt, Artificial Sequence
  derived and/or modified sequence opt5 from PFN2__Homo_sapiens__NP_002619
auggccggcuggcagagcuacguggacaaccugaugugcgauggguguugccaagaggcugccaucgucggauauugugacgcgaaguacguuugggcugccaccgccggcgggguguuccaguccauuacacccaucgaaauugauaugaucgugggaaaagacagagagggcuuuuucacgaaugggcucacccugggagcuaagaaaugcucugucauucgggauagccuuuauguggacggcgauuguacaauggacauccgcaccaagucccagggcggggaaccuacauacaacguugccgugggcagagcuggacgggcccuggucaucgugauggggaaagagggaguucacggcgggacccucaauaagaaggcguaugaacuggcccuuuaccugcgcagaucugauguguga

SEQ ID NO: 73652 - RNA, 1167 nt, Artificial Sequence
  derived and/or modified sequence opt5 from PGA3__Homo_sapiens__NP_001073275
augaaguggcugcuccugcuuggccugguggcccucagcgagugcaucauguacaaagucccccugauuagaaagaaaucccuucggcgcacccugucugaaagagggcuccugaaggacuuccugaaaaagcacaaccucaauccugcucggaaguauuuuccgcaguggaaagcccccacacugguugaugagcaaccucuugaaaacuaccuggacauggaguauuucggaacgaucggcauugggacccccgcgcaggauuuuacagugguguucgacaccggaagcuccaaucucugggucccuucuguguacuguagcucccuggcuugcacaaaccauaaucgcuuuaaccccgaagauucuagcaccuaucaguccacaagcgagaccguuucuaucacguacggcaccggguccaugacaggcauucuuggauaugacaccgugcaggucggcgggaucagcgauacaaaucaaaucuucggacugucugagaccgaaccuggcuccuuucucuacuacgccccguucgacgggauucugggacuggccuaucccagcaucucuuccagcggcgcuacgccuguguuugauaacauuuggaaucaggggcucguuucccaggaccuguucucuguguaccuuagcgccgaugaccaguccggaagcgucgugaucuuuggcggcauugauucuuccuauuacacagggagccugaacugggugcccgucaccguugagggauauuggcaaaucacaguggacucuauuaccaugaauggcgaagcuaucgccugugcggaggggugccaggccaucguggacaccggaacaagccuccugacgggcccuaccucccccauugcuaacauccagucugauauuggggccagcgaaaauuccgacggagauauggucgugagcuguucugcuaucuccagccuuccggacauuguuuucacaaucaacggcgugcaguacccugugcccccuucugccuauauccugcaauccgagggcagcugcauuuccggguuucagggaaugaaucuccccaccgagucuggcgaacuguggauccugggggaugucuucauuagacaguacuucacaguuuuugaccgggcgaacaaccaagugggacucgcccccgucgcuuga

SEQ ID NO: 73653 - RNA, 1167 nt, Artificial Sequence
  derived and/or modified sequence opt5 from PGA4__Homo_sapiens__NP_001073276
augaaguggcugcuccugcuuggccugguggcccucagcgagugcaucauguacaaagucccccugauuagaaagaaaucccuucggcgcacccugucugaaagagggcuccugaaggacuuccugaaaaagcacaaccucaauccugcucggaaguauuuuccgcagugggaggcccccacacugguugaugaacaaccucuugagaacuaccuggacauggaauauuucggaacgaucggcauugggacccccgcgcaggauuuuacagugguguucgacaccggaagcuccaaucucugggucccuucuguguacuguagcucccuggcuugcacaaaccauaaucgcuuuaaccccgaggauucuagcaccuaucaguccacaagcgagaccguuucuaucacguacggcaccggguccaugacaggcauucuuggauaugacaccgugcaggucggcgggaucagcgauacaaaucaaaucuucggacugucugaaaccgagccuggcuccuuucucuacuacgccccguucgacgggauucugggacuggccuaucccagcaucucuuccagcggcgcuacgccuguguuugauaacauuuggaaucaggggcucguuucccaggaccuguucucuguguaccuuagcgccgaugaccaguccggaagcgucgugaucuuuggcggcauugauucuuccuauuacacagggagccugaacugggugcccgucaccguugaaggauauuggcaaaucacaguggacucuauuaccaugaauggcgaggcuaucgccugugcggaggggugccaggccaucguggacaccggaacaagccuccugacgggcccuaccucccccauugcuaacauccagucugauauuggggccagcgaaaauuccgacggagauauggucgugagcuguucugcuaucuccagccuuccggacauuguuuucacaaucaacggcgugcaguacccugugcccccuucugccuauauccugcaauccgagggcagcugcauuuccggguuucagggaaugaaucuccccaccgaaucuggcgagcuguggauccugggggaugucuucauuagacaguacuucacaguuuuugaccgggcgaacaaccaagugggacucgcccccgucgcuuga

SEQ ID NO: 73654 - RNA, 1167 nt, Artificial Sequence
  derived and/or modified sequence opt5 from PGA5__Homo_sapiens__NP_055039
augaaguggcugcuccugcuuggccugguggcccucagcgagugcaucauguacaaagucccccugauuagaaagaaaucccuucggcgcacccugucugaaagagggcuccugaaggacuuccugaaaaagcacaaccucaauccugcucggaaguauuuuccgcagugggaggcccccacacugguugaugaacaaccucuugagaacuaccuggacauggaauauuucggaacgaucggcauugggacccccgcgcaggauuuuacagugguguucgacaccggaagcuccaaucucugggucccuucuguguacuguagcucccuggcuugcacaaaccauaaucgcuuuaaccccgaggauucuagcaccuaucaguccacaagcgagaccguuucuaucacguacggcaccggguccaugacaggcauucuuggauaugacaccgugcaggucggcgggaucagcgauacaaaucaaaucuucggacugucugaaaccgagccuggcuccuuucucuacuacgccccguucgacgggauucugggacuggccuaucccagcaucucuuccagcggcgcuacgccuguguuugauaacauuuggaaucaggggcucguuucccaggaccuguucucuguguaccuuagcgccgaugacaaauccggaagcgucgugaucuuuggcggcauugauucuuccuauuacacagggagccugaacugggugcccgucaccguugaaggauauuggcagaucacaguggacucuauuaccaugaauggcgagaccaucgcuugugccgaggggugccaagcgaucguggacacaggaacgagccuccugaccggcccuacaucccccauugccaacauccagucugauauuggggcuagcgaaaauuccgacggagauauggucgugagcuguucugccaucuccagccuuccggacauuguuuucaccaucaacggcgugcaguacccugugcccccuucugcuuauauccugcaguccgagggcagcugcauuuccggguuucaaggaaugaauguccccacagaaucuggcgagcucuggauccugggggauguuuucauuagacaguacuucaccguguuugaccgggccaacaaccaggucggacuggcgcccguggccuga

SEQ ID NO: 73655 - RNA, 765 nt, Artificial Sequence
  derived and/or modified sequence opt5 from PGAM1__Homo_sapiens__NP_002620
auggccgcuuacaagcuggugcucaucagacacggcgagagcgccuggaaccuggaaaaucgguucuccgggugguaugacgcggaucuuucucccgcuggacaugaggaagccaaacgcggcgggcaggcccugagagacgcuggauacgaguuugauauuugcuucaccagcguccaaaagcgggccauccgcacacucuggacgguucuggacgcuauugaucagauguggcuuccuguggugagaaccuggcggcugaacgaacgccacuauggcgggcucacaggacugaauaaagccgagaccgcggccaagcauggcgaggcucaggucaaaaucuggagacgguccuacgacgugccgcccccucccauggaaccugaucaccccuuuuauucuaacauuagcaaggaccgcagauacgccgaucugacagaggaccagcucccuuccugugaaucucugaaggauaccaucgcucgggcccuuccguucuggaaugaggagaucguuccccaaauuaaagaaggcaagcgcgugcugaucgcggcccaugggaacagccucagaggaauugucaaacaccuggagggccuuuccgaagaggcuaucauggaacugaaucucccuacagggauucccaucguguaugagcuggacaagaaccugaaaccuauuaagcccaugcaguuucucggagaugaggaaaccguucggaaggccauggaggcuguggccgcccagggcaaagcuaagaaauga

SEQ ID NO: 73656 - RNA, 762 nt, Artificial Sequence
  derived and/or modified sequence opt5 from PGAM2__Homo_sapiens__NP_000281
auggccacccacagacuggugaugguccggcauggcgagagcacauggaaccaggaaaaucgcuucugcgggugguuugacgcugagcucuccgaaaagggaacggaggaagccaaaagaggcgcgaaggcuaucaaagaugccaagauggaguucgacauuuguuacaccucuguucugaaacgggccauccgcacacuuugggcuauucuggaugggaccgaccaaauguggcuccccguggugagaacauggcggcugaacgagcgccacuauggaggccuuaccgggcugaauaaggccgaaacagcugccaagcauggagaggaacaggucaaaaucuggagacggagcuuugauauuccuccgcccccuauggacgagaagcaccccuacuauaacuccaucucuaaagagcgcagauacgcgggccucaagccuggcgaacugccuaccugcgagagccugaaagauacgaucgcccgggcucuccccuucuggaaugaagagauugugccgcagaucaaggccgggaagcgcguucugauugcugcccauggaaacucccuuagaggcaucgugaaacaccuggaagggaugucugaccaggcgauuauggagcucaaucugcccaccggaaucccuauugucuaugagcuuaacaaggaacugaaacccacaaagccuaugcaauuucucggcgaugaggaaaccgugcggaaagccauggaggcuguugccgcucaggggaaggccaaauga

SEQ ID NO: 73657 - RNA, 765 nt, Artificial Sequence
  derived and/or modified sequence opt5 from PGAM4__Homo_sapiens__NP_001025062
auggccgcuuacaagcuggugcucaucagacacggcgagagcaccuggaaccuggaaaaucgguucuccugcugguaugacgccgaucuuucucccgcggggcaugaggaagcuaaacgcggaggccaggcccugagagacgccggguacgaguuugauauuugucucacaagcguccaaaagcggguuauccgcacgcuguggaccgugcuugacgcuauugaucagauguggcugccuguggucagaacauggcggcucaacgaacgccacuauggaggccugaccgggcugaauaaagccgagacagcugccaagcauggagaggcccaggugaaaaucuggagacgguccuacgacguuccgcccccucccauggaaccugaucaccccuucuauucuaacauuagcaaggaccgcagauacgcggaucucaccgaggaccagcugccuuccuaugaaucuccgaaggauacaaucgcucgggcccuucccuuuuggaaugaggagaucgugccucaaauuaaagaaggcaagcgcguccugaucgcugcccauggcaacagccuccaggggauugcgaaacacguggagggacuguccgaagaggccaucauggaacuuaaucugcccaccggcauuccuaucguuuacgagcucgacaagaaccugaaacccauuaagccgaugcaguuccugggggaugaggaaacggugugcaaggcuaucgaggccgucgcugcccagggaaaagccaagaaauga

SEQ ID NO: 73658 - RNA, 2769 nt, Artificial Sequence
  derived and/or modified sequence opt5 from PGAP1__Homo_sapiens__NP_079265
auguuccugcacagcgugaaccucuggaaucuggccuuuuacgucuucaugguuuuucuugcuacccugggccucugggacguguucuuuggguucgaggaaaacaagugcuccaugucuuauauguuugaguaccccgaauaucagaaaaucgagcugccuaagaaacuugccaagagauacccggcguaugaacuguaccucuauggagagggcagcuacgcugaggaacauaaaauucugccccugacagggaucccuguccucuuccugcccggaaaugccggcuccuacaagcaagugcggucuauugggagcaucgcccuucgcaaggcugaggauauugacuuuaaauaucacuucgauuucuucuccgugaacuuuaaugaggaacugguugcccucuacggaggcucucugcagaagcagacgaaauucgugcaugaguguaucaagaccauccuuaaacuguauaagggccaggaauuugcuccuaagagcgucgccauuaucgggcacuccaugggaggccucguggcgagagcccugcugacacucaaaaacuuuaagcaugaccugauuaaucuucugaucacccaagcuacaccccacguugccccugugaugccgcucgaucgguucauuaccgacuuuuacacaaccgucaacaauuauuggauccugaacgcucgccacauuaaucuuacgacccugagcguggccgggggauucagagauuaccaggugcggucuggccucacauuucugcccaaacugucccaucacaccagcgcgcucucugucguuuccagcgccgugccuaagacaugggugucuaccgaccaucuguccaucgucuggugcaaacagcuucagcugacgacagugcgcgcuuucuuugaucucaucgacgccgauaccaagcaaauuacacagaacagcaaaaagaagcuguccguucuuuaucaccacuucaucagacaucccucuaaacacuuugaggaaaauccugcuauuaucagcgaccugaccgggaccuccaugugggugcucgucaaggugagcaaauggacauacguugccuacaacgagucugaaaagauuuauuucacguuuccccuggagaaucaucggaaaaucuacacccacguguauugucaguccacaaugcuggauaccaacagcuggaucuucgccugcauuaacucuacaagcaugugucuccagggagucgaccuguccuggaaggcugagcuucugccgaccaucaaguaccucacgcugcgccugcaagacuauccuucucuuagccaucucguggucuacgugcccuccguuagaggcagcaaauuuguggucgauugcgaguucuucaagaaagaaaagcgguauauucagcugccugugacacaccuguuuucuuucggccucuccagccgcaaaguugugcugaauaccaacgggcuuuacuacaaucuggaacuccugaacuuuggacagaucuaucaagcguucaagauuaaugucgugucuaaguguuccgccgugaaagaggaaaucaccagcaucuacagacugcacauucccugguccuaugaggacucucuuacaaucgcucaggcccccagcuccaccgagauuucucucaagcugcauaucgcccagccugaaaacaauacacacguugcucuguuuaaaauguacacgagcuccgauugccgguaugaggucaccgugaagaccagcuucucucagauucucggccaagugguccgcuuucaugggggagcccugccggcguacgugguuuccaacauccuucuggcuuauagaggccagcucuacagccuguucucuacaggguguugccuggaauacgccacaaugcuugacaaagaggccaagcccuauaagguggauccuuuugucauuaucaucaaauuccuccugggauacaagugguuuaaagaacugugggacgugcuccugcuucccgagcuggaugcuguuauucucaccugucaguccaugugcuucccucugaucagccugauucuuuuucucuucggcacgugcaccgccuauuggucuggccugcugagcuccgcuagcgugcggcuccugucuucccuuuggcuggcccucaagagacccagcgagcugccgaaagacaucaagaugauuuccccugaucugcccuuccuuacaaucguccugaucauugugucuuggaccacauguggggcgcucgccauccugcucagcuaccuguauuacguuuuuaaagugguccaccuucaggcuucccugaccacguucaaaaauucucaaccugugaaccccaagcacagccgccgguccgaaaagaagucuaaucaucacaaagacagcuccauucaucaccucagacugagcgccaacgaugcugaggacucucugcgcaugcauuccacagugaucaaucuucugaccuggauuguccuccugagcaugccuucucucaucuauuggcugaagaaccuucgguacuacuuuaaacugaaucccgacccgugcaagccucucgccuucauccugauucccacaauggcgauccugggaaacaccuauaccguuuccauuaagagcucuaaacuucugaagacaacgucccaguuuccccucccucuggccgugggcgugaucgcuuucgggagcgcccaccucuacagacugccguguuuugucuucauuccccuucugcugcacgcucucugcaacuuuauguga

SEQ ID NO: 73659 - RNA, 924 nt, Artificial Sequence
  derived and/or modified sequence opt5 from PGAP2__Homo_sapiens__NP_001138910
auggccagacugggcagcaccgggggaguguccggccgggucguuacacagcaccgcgacucugcucccuuccucggggccccuagacugggacuucgggagcugggcccgauccgcgggacggcgcccgaauggcauggaagauggaacgcugccgagcggagcgauaagauguaccaagugccucucccccuggaccgcgauggcacccuugugagacugcgguuuacaauggucgcccucgugaccguuugcuguccucugguggcuuuccuguuuugcauucucuggucccugcuuuuccacuuuaaagaaacaaccgccacacauuguggcguccccaauuaucugccuucugugagcuccgcuaucgggggagagguuccgcagcgcuacguguggagauucugcauuggccuccacucugcgccccgguuucuggucgccuucgccuauuggaaccauuaccuuagcuguaccuccccuugcagcuguuaucgcccccugugcagacucaauuuugggcugaacgugguggaaaaucuggcucuccugguccuuacguacguuucuuccagcgaggacuucaccauccacgagaacgccuuuauuguguucaucgcuucuucccugggacacaugcuccugacauguauccuuuggcggcugaccaagaaacauacagaucgcaagagcuauucuuggaaacagagacucuuuauuaucaauuucauuuccuucuuuagcgcccuggcgguguacuuccggcacaacauguacugcgaagccggcgucuauaccaucuuugcuauucuggaguacacggugguucucacaaauauggccuuccauaugaccgcuuggugggacuuugggaacaaggaacugcuuaucacaucccagccugaggagaagagauucuga

SEQ ID NO: 73660 - RNA, 810 nt, Artificial Sequence
  derived and/or modified sequence opt5 from PGAP3__Homo_sapiens__NP_001278655
auggccggccuggcugccagacucgugcugcuugcgggggcugccgcccuggcuagcggaucccagggcgaccgggagcccgucuaccgcgauugcguucuccaaugugaagaacagaacugcucugggggagcccugaaucacuucagaagccggcagccuaucuauaugucccuugcuggcuggaccugucgcgacgauugcaaguacgaauguaugugggugacaguggggcuguaucuccaggagggacauaaagucccgcaauuucacggcaaggugucucugaacgccugguucuggagcacgguuuuucauaccagagacacagaucugaccgagaaaauggacuacuucugcgcguccacagugauucuccacucuaucuaucuguguugcguccggaccgugggccuucagcaucccgccguugugagcgcuuuucgcgcccugcuccugcuuaugcugacaguccacguguccuaccucagccugauuagauucgauuauggguacaaucugguggcuaacgucgccaucggacucguuaauguggugugguggcuggcguggugucuuuggaaccagcggcgccugccucacgucagaaagugcgugguugugguccuccugcuucagggccugucucuccuggagcugcucgacuuucccccucuguucugggugcuugaugcccaugcuauuuggcacaucuccaccauccccguucaugugcuguuuuucagcuuucucgaggacgauucucuguaccuucugaaagaauccgaggacaaguucaagcucgauuga

SEQ ID NO: 73661 - RNA, 2430 nt, Artificial Sequence
  derived and/or modified sequence opt5 from PGBD1__Homo_sapiens__NP_001171672
auguacgaggcccugcccggcccugcuccggaaaacgaggacgggcucgugaaggucaaagaagaggaucccaccugggaacagguuugcaauagccaagagggauccucucacacacaggagaucuguagacugcgguuccgccauuuuugcuaucaggaagcccacggcccucaggaggcgcuugcucaacugagagaacucugucaucaguggcugcggcccgagaugcacacgaaggagcagauuauggaacuucuggugcucgagcaguuccugaccauccugccuaaagaacuccaacccugcgugaagacauacccucuggagagcggggaagaggccgucaccgugcuugagaaccuggaaacaggauccggcgacaccgggcagcaggccucuguuuauauucagggacaagauaugcauccgaugguggcugaguaccagggcgucagccucgaaugucagucccugcaacuucugcccggcaucacaacccucaaaugcgagccuccccagcgcccucaggggaauccccaggaagugucuggaccgguuccucacggcagcgcccaucugcaagagaagaaccccagagacaaggcuguggucccuguguuuaaucccgugcggucccagacgcuggucaaaaccgaggaagagacagcccaggcgguugccgcugaaaaguggagccaccucucucugacccgcagaaaccuuuguggaaauuccgcccaggagacagugaugagccugucucccaugaccgaagagauugugacgaaagaucggcuuuucaaggcuaaacaagagacauccgaagagauggaacagagcggggaggccucuggcaagccuaaccgcgagugcgcgccgcagauccccuguuccaccccuaucgccacagaaagaaccgucgcucaccugaauacccuuaaggaccggcaucccggggaucugugggcccgcaugcacauuagcucccucgaguaugcugccggagacaucacaagaaaaggccggaagaaagauaaggcccgcgugucugaacugcugcagggccucagcuuuuccggggacagcgauguugagaaagacaacgaaccugagauucaacccgcucagaagaaacugaaggugucuugcuucccggagaaguccuggacgaaaagagauaucaagccuaauuuucccagcuggucugcgcuugacagcggacugcucaaccugaaauccgaaaagcucaauccugucgagcuguucgaacucuuuuucgacgaugagaccuuuaaccugauugugaaugaaacaaacaacuacgccucucagaaaaauguuagccuggaggugaccguccaggagaugcgguguguguucggcguccuccugcuuuccggguuuaugagacacccccgccgggaaauguauugggaggugagcgacacagaucaaaaccugguuagagacgcuauccgccgggauagauucgaacucauuuucucuaaucugcauuuugccgacaacggacaccuggaucagaaggacaaguucaccaaacuucgcccucucaucaagcagaugaauaaaaacuuucugcuguacgcuccccucgaggaauacuauugcuucgauaaguccaugugcgaguguuuugacagcgaucaauuccugaauggcaaaccgauccggauuggguacaagaucuggugcggaacgacaacccagggcuaucuugugugguuugagccuuaccaggaagagucuaccaugaaggucgacgaagaccccgaucugggccucgggggaaaccuggugaugaauuucgccgacguucugcuugagagaggccaguaucccuaccaucucuguuuugauuccuucuuuacaagcgugaaacugcuguccgcccucaagaaaaaggggguccgcgcgaccggaacaauucgggagaacagaacggaaaaaugcccucugaugaauguggagcacaugaagaagaugaaacgcggcuauuucgacuuucggaucgaagagaacaaugaaauuauccuuuguagaugguacggggauggcaucauuucucugugcagcaacgcugugggaaucgagccgguuaaugaggucuccuguugcgacgccgauaacgaagagauuccccaaaucucucagccuagcauugugaagguguacgacgaauguaaagagggcgucgccaagauggaucagaucaucuccaaauaucgggugcgcauuagaagcaagaaaugguacucuauccucguuuccuauaugauugacguggcuaugaacaaugccuggcagcugcaucgggcuugcaaccccggggccagccuggauccucuugacuucagacgcuucgucgcgcacuuuuaccucgaacacaaugcccaucugucugauuga

SEQ ID NO: 73662 - RNA, 1575 nt, Artificial Sequence
  derived and/or modified sequence opt5 from PGBD5__Homo_sapiens__NP_001245240
auggccgagggcgggggaggcgcuagacggcgcgcccccgcgcugcucgaagcugccagagcccgguacgagagccugcacaucuccgacgauguguucggggaaucuggaccugacagcggcgggaacccguuuuauuccaccucugcugccagccgcuccucuagcgcugccuccagcgaugacgagagagaacccccuggacccccuggcgcggcucccccuccgccccgggccccugaugcccaggagcccgaggaagacgaggcuggcgccggguggucugcggcccuucgcgauagaccucccccgcgguucgaagacacaggaggcccuacgcgcaagaugcccccuuccgcuagcgccgucgauuucuuccaacuguuuguucccgacaaugugcucaaaaacauggugguccagaccaauauguacgcuaagaaauuccaggagagauuugggucugauggagccuggguggagguuacacugaccgaaaugaaggccuuccuuggcuauaugauuuccacaagcaucucucauugcgaguccgugcugagcauuugguccgggggauuuuacucuaaccggagccucgcucuggucaugucccaggcgcgcuucgagaaaauccugaaguauuuucacgugguugccuucagaagcucucaaaccacacauggccucuacaaggugcagcccuuucuggacucccuucagaauagcuucgauucugcuuuccggccuagccagacccaaguccugcacgaaccgcucauugacgaagaccccguguuuaucgccacguguaccgagcgcgagcugagaaaacggaagaaaagaaaguucucccuuugggugcgccagugcucuagcacaggcuuuaucauucagaucuauguccaucugaaagaagggggaggcccugaugggcucgacgcccugaagaacaagccccagcugcacuccaugguugcucggagccucuguagaaaugccgcgggcaaaaacuacauuaucuucaccggaccuucuauuacaucccugacccuuuuugaggaauuugagaagcaagggaucuacugcuguggacugcuccgcgcucggaaaagcgauugcacgggccugccccuuucuaugcugacaaauccggccaccccucccgccagaggccaguaucagauuaagaugaaagggaacaugucccucaucuguugguacaauaagggacacuuucgcuuccugacaaacgcuuauagcccugugcaacagggcgugaucauuaaacggaaguccggggaaauccccugcccucuggccgucgaggcuuuugccgcgcaucucucuuacauuuguagauaugacgauaaguacagcaaauauuucaucucccacaagcccaauaaaaccuggcaacagguguuuugguucgccauuucuaucgcuaucaacaaugccuacauucuguacaagaugagcgacgcuuaucauguuaaacgcuacucccgggcccaguuuggagagagacuugugcgcgaacugcucggccuggaggaugcgagcccgacccacuga

SEQ ID NO: 73663 - RNA, 948 nt, Artificial Sequence
  derived and/or modified sequence opt5 from PGC__Homo_sapiens__NP_001159896
augaaguggaugguggucguucuggugugccuccagcugcuugaggccgcuguggucaaagugccccugaagaaauucaagagcaucagagaaaccaugaaagagaagggccuccugggggaauuucuucggacacacaaguacgacccugccuggaaauaucgcuucggagaucuguccguuacguacgagccgauggcguauauggacgcugccuacuuuggcgaaauuucuaucgggacacccccucaaaacuuccucgugcuguuugauaccggaagcuccaaucuguggguccccucuguguauugucagagccaggccugcaccucccauucuagauucaacccuagcgaguccagcacauacucuaccaauggccagacauuuucccuccaauaugggagcggaucucugaccggcuucuuuggcuacgacacgcuuaccguucaguccauucaggugcccaaccaggaguucgggcugagcgaaaaugagccuggaacaaacuuugucuacgcucaauucgauggcaucauggggcucgccuauccggcucugucuguggacgaagccaccacagcgaugcagggaauggugcaggagggcgcccuuaccucccccgucuuuagcguuuaccuguccaaucucgugcuggagucuagcgggcugggaccucuccugacgcccucccgggcugccccucccagcucuacacuucagcugccggaaaagccucucgagcaaaccuggaacauucugacacccuucaccaaaacccuuccuguguccaaucugagccgcaaggucacaucuugggcuggcgugggcauccccguuacgugucuccccgaagccgggagcggaggcgagagacgggcggaaugcgggcugggagugccuaccacacgcggcccgcccagaucccagcaccauucuggggccuga

SEQ ID NO: 73664 - RNA, 1386 nt, Artificial Sequence
  derived and/or modified sequence opt5 from PGD__Homo_sapiens__NP_001291380
auggcccaggcugacaucgcccugauuggccucgcggugauggggcaaaaccugauccuuaauaugaacgaucacggauucgucguuugcgcuuuuaauagaaccgugagcaagguggacgauuuccuggccaacgaggccaaaggcacaaaggucgugggggcucagucccucaaagaaaugguuucuaagcugaaaaagccccggcgcauuauccuucuggugaaggccggacaggcugucgacgauuuuauugagaaacucagacggugucgcgaccugaaggccaaaggcauccuguucguggggagcggaguuuccggcggcgaagagggggcgagauacggaccuucucucaugccgggcgggaauaaggaagccuggccccauaucaaaacgauuuuucagggaaucgcugccaaggugggcaccggggagccuugcugugauugggucggagacgagggcgcuggccacuucgugaagauggugcauaacgggauugaauauggagauaugcaacugaucugcgaggccuaccaccuuaugaaagacguccugggcauggcgcaggaugaaauggcccaggcuuuugaggacuggaauaagacagagcucgauagcuuccugauugaaaucaccgccaacauucuuaaauuucaggacacagacgggaagcaucugcuccccaaaauccgggauuccgcuggacaaaagggcaccgggaaauggacagccaucucugcccuggaguauggaguuccugugacccugauuggcgaagcuguguucgcgcgcugucucagcucccugaaggacgagagaauccaggccagcaagaaacuuaagggcccccagaaauuucaguucgauggggacaagaaaucuuuucuggaagauauucggaaggcucucuacgccuccaagaucauuagcuaugcccaaggauucaugcugcuucgccaggcugccacggaguucggcuggacccugaauuacgggggaaucgcgcucauguggagaggcgggugcaucauucggucugucuuucugggcaaaaucaaggacgcuuucgaucgcaacccugagcugcagaaucuccugcuugacgacuuuuucaaauccgccguggaaaacugucaagauagcuggagacgggccguuucuacaggagugcaggcuggcauuccgaugcccugcuuuaccacagcccuguccuucuaugauggguaccgccacgagaugcucccugcuagccugauccaggcccagagagacuacuuuggagcgcacaccuaugaacuucuggccaagcccggccaauucauucauacgaauuggacagggcacggaggcaccgucuccucuagcuccuacaacgcuuga

SEQ ID NO: 73665 - RNA, 450 nt, Artificial Sequence
  derived and/or modified sequence opt5 from PGF__Homo_sapiens__NP_001193941
augcccgugaugagacuguucccuugcuuucuccagcugcuugccggccuggcucucccggccguucccccucaacagugggcgcugagcgcugggaacggauccucugaggucgaaguggugcccuuccaggaggucuggggccggagcuacugucgcgcccuugaaagacugguggacguuguguccgaguauccuucugaagucgagcacauguuuagccccuccugcgugucucuccugcgguguaccgggugcuguggagaugagaaucugcauugcguuccuguggaaacagccaacgucacgaugcagcuccugaagauccgcagcggcgacagaccguccuacguggagcuuaccuucagccaacacgugcggugugaaugccgcccccugagagagaaaaugaagccugagcgguguggggaugcugucccccgcagauga

SEQ ID NO: 73666 - RNA, 1134 nt, Artificial Sequence
  derived and/or modified sequence opt5 from PGGT1B__Homo_sapiens__NP_005014
auggccgcuaccgaggacgaaagacuggccggcagcggggagggagaacggcucgauuuccugcgcgacagacacgugcgguuuuuccagcgcugccuucaaguccugcccgagagauacuccucucucgaaacaagccggcugacgaucgcguuuuucgcucuuuccggccuggauaugcucgacucucuggauguugugaacaaggacgauauuaucgaguggauuuauagccuccaggugcugccuaccgaggaccgcuccaaucugaacagauguggguuucggggaucuagcuaccuuggcaucccguucaaucccuccaaagccccugggacagcccaucccuaugauagcggacacauugcuaugaccuacacaggccugucuugccucgucauccugggcgacgaucuuucccgcgugaacaaggaagccugucuggcugggcucagagcccugcagcuggaggacggcagcuuuugcgcgguuccugaaggaucugagaaugauaugcgguucguguauugugccuccugcaucuguuacaugcucaacaauuggagcgggauggacaugaaaaaggcuauuaccuauauccgcagaucuauguccuacgacaacggacuggcccagggcgcugggcuugagagccauggaggcuccacauuuugcggcauugccucucugugucucauggggaaacuggaagaggucuucagcgaaaaggagcuuaaucggaucaagcgcuggugcauuaugagacaacagaacggauaccacggccggcccaauaaaccuguggauaccuguuauuccuuuuggguuggggcgacgcugaagcuccugaaaaucuuccaguacaccaacuuugaaaagaauagaaacuauauucugagcacacaggaccgccucgugggaggcuucgccaaauggccggauucucaucccgacgcucugcacgccuacuucgggaucugcggacuuucccugauggaggagagcggcaucugcaagguccacccugcucucaaugugucuacccggacaagcgaaagacugcuugaucugcaucaauccuggaagaccaaagacucuaagcaguguagcgagaacgugcacauuuccacguga

SEQ ID NO: 73667 - RNA, 1254 nt, Artificial Sequence
  derived and/or modified sequence opt5 from PGK1__Homo_sapiens__NP_000282
augagccuguccaacaagcucacccuggacaaacuugaugugaagggcaaaagagucguuaugcggguggacuucaaugugcccaugaagaacaaucagaucacaaacaaucaacgcauuaaagccgcugucccuucuaucaaguuuugccuggauaacggggccaagagcgugguucucaugucccaccugggaagaccggacggcgugcccaugccugauaaauacucucuugagcccgucgcgguggaacugaaaagccuccuggggaaagacguucuguuccucaaggauugugugggaccugaggucgaaaaggcuugcgccaaucccgccgcuggcuccgugauucugcuugagaaccugcgguuucauguggaagaggaggggaagggaaaggacgccucuggcaauaaagucaaggcugaaccugccaaaaucgaggcguuccgcgccagccucuccaagcugggcgauguuuaugugaacgacgcuuuugggacggcccacagagcucauagcucuauggugggagucaaucuuccgcagaaagccggcggguuccugaugaagaaagaacucaacuacuuugcgaaggcccuggagucccccgagcggccuuuccuggcuauucucggaggcgccaagguggcugauaaaauccagcugaucaauaacaugcuugacaagguuaaugaaaugauuaucgggggaggcauggccuuuaccuuccugaaagugcucaacaacauggagauuggcacaagccuguuugaugaagagggggccaagaucgucaaagaccuuaugucuaaggcugaaaagaauggagugaaaauuacccugcccguugacuucgugacagcggauaaguuugacgagaacgccaaaaccggccaggcuacagucgccuccgggaucccugccggauggaugggccucgauugugggcccgagagcucuaagaaauaugcugaagccgugacccgcgcgaagcaaauugucuggaauggaccggugggcguuuucgagugggaggcuuucgccagaggcacgaaggcccugauggacgaaguggucaaagcuaccucccgggggugcaucacaaucauuggaggcggggauaccgccacauguugcgcuaaguggaacaccgaagacaaagugagccacguuuccacgggaggcggggccucucuggagcuccuggagggcaaggugcuuccuggagucgaugcgcugagcaauaucuga

SEQ ID NO: 73668 - RNA, 1254 nt, Artificial Sequence
  derived and/or modified sequence opt5 from PGK2__Homo_sapiens__NP_620061
augagccuguccaagaaacucacccuggacaaacuugaugugagaggcaagcgggucaucaugcgcguugacuucaacgugcccaugaagaaaaaucagauuacaaacaaucaaagaaucaaggccucuauuccuagcaucaaguacugccuggauaacggggcuaaagccgugguccucaugucccaccugggacggccggacggcgugcccaugccugauaaguauucucuugcgcccguugcuguggagcugaaaagccuccuggggaaggacguccuguuucucaaagauugugugggagccgaaguugagaaggccugcgcuaauccugcccccggcuccgugauucugcuugaaaaccugcgcuuccaugucgaggaagaggggaagggacaggacccuucuggcaaaaagaucaaagcugagccggauaagaucgaagccuuuagagcgagccucuccaaacugggcgacguguacgugaaugaugccuucgggacggcucaccgggcccauagcucuauggucggaguuaaccuuccccacaaggcuuccggcuuucugaugaaaaaggagcucgacuauuucgccaaggcgcuggaaaauccugugcgccccuuucuggccauucucgggggagcuaaaguggccgauaagauccagcugauuaaaaacaugcuugacaaggucaaugagaugaucauuggcgggggaauggcuuacaccuuccugaaagugcucaacaauauggagaucggcgccagccuguuugacgaagagggcgccaagauuguuaaggauaucauggcuaaagcgcagaagaacggggugagaaucacauucccugucgacuuugugaccggagauaaauucgacgaaaaugcccaaguuggcaaggcuacaguggccucugggauuucccccggauggaugggccuugauugugggccggagagcaacaaaaaccaugcccaggucguggcucaggcccggcugaucgucuggaauggaccucucggcguguuugaaugggacgcguucgcuaagggcaccaaggcccugauggaugagauuguuaaagccacaucuaaggggugcaucaccgugauuggaggcggggacacggcuaccuguugcgccaaauggaacacagaggauaaggucucccacgugagcaccggaggcggggcuucccuggaacuccuggagggcaaaauccuucccggaguugaagcccugucuaauauguga

SEQ ID NO: 73669 - RNA, 777 nt, Artificial Sequence
  derived and/or modified sequence opt5 from PGLS__Homo_sapiens__NP_036220
auggccgcucccgccccuggccugaucagcguguucuccucuagccaggagcucggggcggcucuggcccaacuugucgcccagagagcugccugcugucuggcuggagcccgggcgcgcuuugcccucggccuguccgggggaucucuuguuagcaugcuggcuagagaacucccggccgcuguggcccccgcgggcccugccucccuggcucgguggacccugggguucugcgacgagcgccucgugcccuuugaucacgccgaaucuacauacggacuguauagaacgcaucuucugagccggcucccuauucccgagucccaggucaucaccauuaacccugaacugccgguggaggaggcugccgaagacuacgccaagaaacuucgccaggcuuuccaaggcgauagcauccccguuuuugaccugcucauucugggcguggggccugauggacacacauguucucuguuccccgaccauccucuccugcaggagagagaaaagaucgucgcgcccaucuccgauagcccgaaaccucccccucagcgggugacccuuacacugcccguucucaaugccgcucgcaccgugauuuuugucgccacaggcgaggggaaggccgcugugcugaaaagaauccuugaggaccaggaagagaacccccugccugccgcgcucgugcaaccgcacaccggaaagcugugcugguuccuggaugaagcugccgcccggcuccugacgguccccuuugagaagcauucuacccuuuga

SEQ ID NO: 73670 - RNA, 591 nt, Artificial Sequence
  derived and/or modified sequence opt5 from PGLYRP1__Homo_sapiens__NP_005082
augagcagacgguccaugcugcucgccugggcucugcccucucuucugcgccucggcgccgcgcaggagaccgaagacccugcuugcuguagcccgaucgugcccagaaacgaguggaaggcccuggccuccgaaugcgcucaacaccuuucucugccucuccgguacgucguugugagccauacagccggguccucuuguaauacgcccgcuagcugccagcagcaggcccgcaacgugcaacacuaucauaugaaaacccugggauggugugaugucggcuacaauuuccugauuggggaggacggacucguguaugaaggcagaggguggaacuuuacaggagcgcacuccggccaucuguggaauccuaugagcaucggcauuucuuucauggggaacuacauggaucggguucccaccccucaggccauccgcgcugcccagggacuucuggcuugcggcguggcccagggggcgcucagauccaauuauguccugaagggacaccgggacgugcaacgcacacuuagcccgggcaaccagcuguaccaccucauucagaauuggccccauuauagaucuccuuga

SEQ ID NO: 73671 - RNA, 1731 nt, Artificial Sequence
  derived and/or modified sequence opt5 from PGLYRP2__Homo_sapiens__NP_443122
auggcccagggcgugcuguggauccuccuggggcuucugcucuggagcgaccccggaaccgcuucccugccucuucugauggauucugucauucaagcccucgcggagcuggaacagaagguuccggcugccaaaacaagacacacggccagcgcuuggcugauguccgcccccaacucuggcccucauaaucggcucuaccacuuccugcuuggggcuuggagccugaacgccaccgagcucgaccccugcccucugucccccgaacuucugggacucacaaaggagguggcgcgccaugaugugagagaaggcaaagaguauggggucgugcuggccccugacggaucuaccguugcuguggagccgcugcucgccggccuggaagcuggccuucaggggcggcgcgucaucaaucugccccucgauagcauggccgcgccuugggagacaggagacaccuuucccgaugugguugccauugcuccugacgugagagccacauccagccccggccugcgggaugggucuccggacgucaccacggcugauaucggagccaacaccccugacgccacaaagggcugucccgaugugcaggcuucccuuccugacgcgaaagccaagagcccucccaccaugguggacucucugcucgcugucacacuggccgggaaucugggacucaccuuccugcgcggcucccaaacgcagagccaccccgaucuuggcacagaagggugcugggaccagcugucugccccgagaaccuuuacacuccuggaucccaaggcuucccuucugaccauggccuuccucaacggagcgcuggacggcguuauucugggggauuaccucagccggaccccugagccccgcccuucccugucucaucuucugagccaguauuacggagcuggcguggccagagaccccggguuucgguccaauuuccgcagacaaaacggagccgcucucacaagcgccucuauccuggcucaacagguguggggcacgcugguccuucuccagcggcuggagccggugcaucugcagcuccaguguaugucccaggaacaacuggcccagguugcggccaaugcuaccaaagaguuuacagaagccuuccuuggcugcccugcuauccacccccgcuguagauggggagccgcgccuuaucgggggagacccaagcugcuccagcugccucugggcuuucuuuacgugcaccacaccuauguccccgccccgccuugcacagauuucacccgcugugcugccaacaugcggagcaugcagagauaccaucaagacacgcagggguggggagauauuggcuacucuuuugugguugggagcgacggcuauguguacgagggacgcggcuggcacugggucggggcucacacacucggacauaauucccggggcuucgggguggccaucgucggaaacuauaccgccgcucugcccaccgaagcggcccugagaacagugcgcgauacccuccccucuugcgcuguucgggccggccugcuuagaccugacuacgcccugcucgggcaccgccagcuggugcggacagacuguccgggcgaugcucuguuugaccuucucagaacguggccccauuucaccgccacagucaaaccucgccccgcgcggagcguguccaagagaagccggcgcgagccucccccuagaacccugcccgcuacagaucugcaguga

SEQ ID NO: 73672 - RNA, 1026 nt, Artificial Sequence
  derived and/or modified sequence opt5 from PGLYRP3__Homo_sapiens__XP_011507421
augggcacccugcccuggcuccuggccuucuuuauccuugggcugcaggcuugggacacaccuacgauugugagcagaaaggaguggggagcccggccgcucgcgugccgcgcucugcuuacccugcccgucgccuacaucauuacagaucaacucccuggcaugcagugucagcagcaauccguuugcucucagaugcugagagggcugcagagccacuccguguauaccaucggauggugugacguggccuacaacuuccucgucggcgaugacgggcggguguaugaaggaguuggcuggaauauucagggccugcauacacaaggguacaacaauaucucucuuggaaucgccuuuuucggcaacaaaauugggagcucccccucuccugcugcucugagcgccgcggagggacucaucuccuaugccauucagaagggccaccugagcccccgcuacauccagccucuucugcucaaagaagagaccugccuggauccgcagcaucccgugaugccuagaaaggucugucccaauauuaucaaacggucugcuugggaagcccgcgagacacacugcccuaagaugaaccugcccgcuaaguaugugauuaucauccauaccgccgggacguccuguaccguuagcacagacugccaaaccguggucagaaauauucagucuuuucacauggauacacggaacuucugugacaucggauaccacuuucucgugggccaggauggcgggguguacgagggagucggcuggcauauucaagggucccacaccuauggauucaaugacaucgcgcugggcauugccuuuaucggguacuucguugaaaaaccgccuaacgcugccgcucuugaggccgcccaggaucugauccagugcgcugugguggaaggauaucucacgcccaauuaccugcuuaugggccauagcgacgucgugaacauucugucuccuggccaggcgcucuauaauaucauuuccacauggccccacuuuaagcacuga

SEQ ID NO: 73673 - RNA, 1122 nt, Artificial Sequence
  derived and/or modified sequence opt5 from PGLYRP4__Homo_sapiens__NP_065126
augcugcccuggcuccugguguucagcgcccuuggcauccaggcuuggggagacuccucuuggaacaagacccaagccaaacaggucagcgaggggcugcaguaccucuuugaaaauauuucccagcugacagagaagggccuuccuacggauguuucuaccacagugagcagaaaagcguggggagcugaagccguggggugcuccauccaacugaccacaccggucaacgugcucguuauucaccaugugcccggccuggagugucacgaccagaccgucugcucucagcggcugcgcgaacuccaggcccaucacgugcauaauaacagcgggugugauguugcuuauaauuuccuggugggagacgauggcagagucuacgagggcgugggguggaacauccaaggagugcacacacagggcuauaauaacauuucccuuggguuugccuucuuuggaaccaagaaaggccacagcccuucucccgcugcccuguccgcgauggagaaucucaucacguacgccguccagaaggggcaucugucuagcuccuauguucagccucuucugggaaagggcgaaaacugccucgcuccccggcagaaaaccagccugaagaaagccuguccuggcguggugccgcgcucugucuggggagcuagagagacacacugcccccggaugacccugccugccaaguacgggaucauuauccauacagcgggccgcaccuguaauauuuccgacgaaugcagacuccuggugcgggauauccagagcuucuauauugaccgccuuaaauccugugauaucggguacaacuuucugguuggacaagacggcgccauuuacgagggggugggauggaauguccaaggcucuagcacgcccggcuaugaugacaucgcucucgggaucacauucaugggaaccuuuacaggcauuccucccaacgccgcugcccuggaggccgcucaggaucuuauccagugcgcgauggugaagggguaccugaccccgaauuaucuccugguuggacacuccgacguggccagaacccugagcccuggccaggcucucuacaacauuaucucuacauggccccacuucaagcauuga

SEQ ID NO: 73674 - RNA, 1701 nt, Artificial Sequence
  derived and/or modified sequence opt5 from PGM3__Homo_sapiens__NP_001186848
auggaccugggcgccaucaccaaguacagcgcucuccacgccaaacccaacgggcugauucuucaguauggaacagcgggcuucagaacgaaggcugagcaucuggaucacgugauguuucggauggggcuccuggccguccuucgcuccaaacaaaccaagucuacaaucggaguuauggugaccgccagccauaauccugaagaggacaacggcgugaaacuggucgauccgcucggggaaaugcuggcucccuccugggaggaacacgccacaugccuggcuaaugccgaggagcaggacaugcagagagugcucauugauaucucugaaaaggaggcgguuaaccugcagcaagacgccuucguggucauuggacgggauacccgcccuagcuccgaaaaacuuucucagagcgugaucgacggcguuacagugcugggcgggcaguuucaugauuacggacuccugaccacgccccagcuucacuauauggucuacuguagaaauaccggcgggcgguauggaaaggcuacaaucgagggcuacuaucaaaagcuguccaaagccuucguggagcucaccaagcaggcuagcugcucuggggacgaauaccgcucccugaaaguggauugugccaacggaauuggcgcgcugaagcucagagagauggaacacuacuuuagccagggccugucuguccagcuuuucaaugacggguccaagggaaaacugaaccaucucugcggcgccgauuuuguuaagagccaccaaaaaccuccccaggggauggagaucaagucuaaugaacgguguugcuccuucgacggagacgcugaucgcauuguguauuacuaucaugacgccgauggccacuuucaccugaucgacggggauaaaauugcuacacuuaucagcuccuuccugaaggagcuccugguggagauuggagaaucucugaacaucggcgucgugcagaccgccuacgccaauggcagcuccacgagauaucucgaggaaguuaugaaagugccugucuacuguacaaagaccggggugaagcaucugcaccauaaagcucaagaguuugacaucggaguuuauuucgaagcgaacggccacgggacagcccuuuuuagcaccgcuguggagaugaagauuaaacagucugccgagcagcuggaagauaagaaacggaaggccgcuaagaugcucgagaauaucauugaccuguucaaccaggccgcgggagaugcuaucuccgacaugcuugucauugaagccauccuggcccucaaaggccugaccgugcaacagugggaugcucuguacacagaccucccgaaucgccagcugaagguccagguggccgacagacggguuaucagcacgaccgaugcugagcgccaagccgugacacccccugggcuucaggaagcgauuaacgaccuggucaaaaaguacaaacucucuagagccuucgugcggcccagcggcaccgaggauguugugagagucuaugcugaggccgacucccaggaaucugcugaucaucuggcccacgaggugagccuggcgguguuucagcuugccggaggcaucggggaacgcccucaacccggauacaaggcugccgagacaacccacaacauuaauaacgcuuucggcccggggacggccaaugagcauacaguuccuuga

SEQ ID NO: 73675 - RNA, 630 nt, Artificial Sequence
  derived and/or modified sequence opt5 from PGPEP1__Homo_sapiens__NP_060182
auggagcagcccagaaaggccgucgucguuaccggcuucgggccuuuuggagaacacacagugaacgcuagcuggaucgccgugcaagagcuggaaaaacucggccugggggacuccgucgaucuucauguguacgagauuccgguugaauaucagacggugcagcggcugauccccgcgcucugggagaagcacucuccucagcuggucgugcauguuggagugagcggcauggcuaccacagucacccuugagaaaugcgggcacaauaagggauacaaaggccuggacaacugucgcuucugccccggcucccaauguugcguggaagaugggccugagucuauugacagcaucauugauauggacgccguguguaagagagucacaacccucggacuggauguuuccgugacaaucucucaggacgccggccgguaucugugcgauuuuaccuacuauacgagccucuaccagucccaugggcgcagcgcuuucgugcacgugcccccucugggaaagccguauaaugccgaccagcuuggcagagcucugcgggccaucauugaagagaugcucgaucugcuugagcaaucugaagggaaaaucaacuacugucacaagcauuga

SEQ ID NO: 73676 - RNA, 966 nt, Artificial Sequence
  derived and/or modified sequence opt5 from PGP__Homo_sapiens__NP_001035830
auggccgcugccgaggcgggcggggacgaugcuagaugcgugcggcugagcgccgaacgcgcccaggcucuccuggccgacgucgauacccuucuguucgacugugauggaguucucuggagaggcgagacagcugugcccggggccccugaagcgcugcgggcccuucgcgcuagaggaaagcggcugggcuuuaucacgaacaauuccucuaaaacccgcgccgcuuacgccgagaagcucagacggcugggguucggaggcccggcgggccccggggccagccuggaaguguuuggaacagcuuauugcaccgcccucuaccugcgccaaagacuugcuggcgccccugcccccaaggcuuauguccugggguccccugcgcucgccgcugagcuggaggccgugggaguugccucugugggcgucgggcccgaaccucuucagggagagggcccgggcgacuggcugcacgcuccccucgaaccugaugugcgggccguuguggucggguucgacccccauuuuagcuacaugaaacugacaaaagcgcugcgcuaucuccagcagccuggaugucugcuugugggcaccaacauggauaauagacugccccucgagaacgggcgguucauugcuggaacaggcugccuggugcgcgccgucgagauggccgcucaaagacaggccgacaucauugggaagccgucccgguuuaucuucgauuguguuucucaggaauacggaauuaauccugagagaaccgugauggugggcgaccgccuugauacggacauccugcucggcgcuaccugcgggcugaagacaauccugacccucacaggagucagcacccugggcgacgugaaaaacaaucaggaauccgauuguguuagcaagaaaaagauggugcccgacuuuuaugucgauucuauugccgaccuucugccugcgcuccaaggguga

SEQ ID NO: 73677 - RNA, 2802 nt, Artificial Sequence
  derived and/or modified sequence opt5 from PGR__Homo_sapiens__NP_000917
augaccgagcugaaggccaaaggccccagagcuccucacguggccgggggaccgcccagcccugaagucggcagcccccuccugugccggccugcggcugggcccuucccuggaucucagacaagcgacacgcuuccggagguuuccgccauccccauuucucuggauggccuccuguuuccucgccccugucaagggcaggacccuagcgaugaaaagacccaggaccagcaaucccuuucugauguggagggagccuacagcagagcugaagccacacggggcgcuggcggguccagcucuagcccgcccgagaaagacuccggacugcucgauucugugcuggacacccugcucgccccuuccggccccgggcagagccagccuucuccucccgcgugcgaggucacauccagcuggugucuguucggacccgaacuuccggaggaucccccugccgcucccgccacccagcgcgugcuguccccucucaugucuagaagcggcugcaagguuggggacuccagcggaacagcugccgcgcauaaagugcugccccggggccuuucuccggcccgccaacugcuccugccugcuuccgaaagcccccacuggucuggcgccccugucaagcccagcccucaggcugccgccguggagguugaggaagaggauggguccgaaucugaggaaagcgcuggaccccugcucaagggcaaaccgagagcgcuugggggagccgcugccggcgggggagccgcugccgugccucccggcgcggcugccggcggggucgcccuggugcccaaggaggacucccgguuuagcgcuccucgcguggcccuggucgagcaggaugcuccgauggcccccggaagaucuccucucgcgaccacgguuauggacuucauccaugugcccauucugccucuuaaccacgcccugcucgcugcccggacccgccagcugcuggaagacgaguccuaugauggcggggcuggagccgcgagcgccuuugcucccccuagaucuucccccugugccagcuccacaccgguggcugucggcgacuucccugauugcgccuaucccccugacgccgaacccaaagaugacgcuuacccgcucuacucugauuuucaaccucccgcgcugaagaucaaagaggaagaggagggggccgaagcuagcgcccgguccccucgcucuuaucuuguggccggcgcuaaucccgccgcguuccccgacuuuccucugggaccgcccccuccccucccucccagagcuaccccuagccggccgggcgaggccgccguuacagcugcccccgcguccgcuagcgugucuuccgccuccucuuccgggagcacccuggaauguauucuuuacaaggccgagggagcuccuccccagcagggcccuuucgcucccccgccuugcaaggcccccggggccucuggaugucugcuccccagagauggccugccuagcacguccgcgagcgccgcugccgcuggggccgcccccgcucuguauccugcgcucggccugaacggacuuccgcaacugggcuaccaggccgcuguccucaaagaagggcugccccagguguacccucccuaucugaauuaccuucgcccugacucugaggccucccagagcccccaauauuccuuugagucucucccgcagaagaucugccugaucuguggagaugaagccagcggcugccauuacgggguucugacaugcggauccuguaaaguguucuuuaagcgggcuauggagggccagcacaacuaucucugcgccgggagaaaugacuguauugucgacaaaauccgccggaagaacugcccugcguguagacugcgcaaaugcugucaggcuggcauggugcuuggaggccggaaguucaagaaauucaauaaggucagagugguucgcgcccuggaugccguggcucucccccaaccugucggggugcccaacgaaucucaggcccugagccagcgguuuaccuucuccccuggacaggacauucaacugauucccccgcuuaucaaucuccugaugucuaucgagccugauguuauuuacgcgggccacgacaacacaaaacccgauaccagcuccagccugcucaccucucugaaucagcuuggggagagacagcugcucuccguggucaaguggagcaaaucucugcccggauuucgcaaccugcauaucgacgaucagaucacacuuauucaauauuccuggaugagccucaugguguucggccugggguggcggucuuacaagcacguguccggccagaugcuguacuuugcuccugaccucauccugaaugaacagagaaugaaggagagcuccuucuauagccuuugccugacgauguggcaaauuccgcaggaauuuguuaaacuccaggucucucaggaggaguuccuguguaugaaggugcugcuucuccugaacaccaucccccuggaaggacuccggagccaaacacaguuugaggaaaugcgcuccucuuacauuagagagcugaucaaagccaucggccuucggcagaaggggguggucagcuccucucagagauucuaucaacugaccaaacuccuggauaaucugcaugaccuugugaagcagcugcaccucuacugccugaacacauuuauucagagccgcgcccucuccguugaguucccugaaaugaugucugaagugaucgcugcccagcugcccaagauucuugcuggaauggucaaaccucugcucuuucacaagaaauga

SEQ ID NO: 73678 - RNA, 432 nt, Artificial Sequence
  derived and/or modified sequence opt5 from PGRMC1__Homo_sapiens__NP_001269550
auggccgcugaggacguggucgccaccggcgcggaucccagcgaccuggaauccgggggacuccugcacgagaucuucacaucuccucuuaaccugcuccugcuuggccugugcauuuuucuccuguacaagaucguuagaggggaucagccggcugccagcggagacuccgaugacgaugaacccccuccccugccucggcucaaacgcagagacuucacgcccgccgagcugcggcgcuuugauggcgugcaagacccucggauucuuauggcuaucaaugggaagguguucgaugucaccaaaggaagaaaguuuuauggcccggugaaauaccaucacguuggcaagcugcucaaggaaggggaggagcccacaguguauucugacgaagaggaaccuaaagaugagagcgcccgcaagaacgacuga

SEQ ID NO: 73679 - RNA, 744 nt, Artificial Sequence
  derived and/or modified sequence opt5 from PGRMC2__Homo_sapiens__NP_006311
augggcggggccggaagaggcgugggggagggacggggccgcgggggaggcggcagacgguggcgcgcugucauggccgcgggggacggagauguuaagcugggcacccucgggagcggauccgaaucuagcaacgacggcggguccgagucucccggagaugcuggcgccgccgcugaaggcgggggaugggccgcugccgcgcuggcccuucugacaggcgggggagagaugcuccugaauguggcucuuguggcccugguccuccugggcgcuuacagacugugggugcggugggggcgcagaggacucggcgccggcgcgggggccggagaagagagcccugcuacgucccugccgcggaugaaaaagcgcgacuucucucuugagcagcugagacaauaugauggcagccggaacccccgcauccuccuggccguuaaugggaaaguguuugacgucaccaagggauccaaauucuacggcccugcugggcccuauggcauuuuugccggaagagaugccagccggggccuugcuacauucugccuggacaaggaugcgcuccgcgacgaauacgaugaccugucugaucugaacgccgugcagauggaguccguuagagaaugggagaugcaguuuaaggagaaauaugacuacguggggcggcuccugaagccuggagaggaacccagcgaauauaccgacgaggaagauacaaaagaccacaauaagcaggauuga

SEQ ID NO: 73680 - RNA, 1743 nt, Artificial Sequence
  derived and/or modified sequence opt5 from PHACTR1__Homo_sapiens__NP_001229577
auggacuaccccaagauggauuauuuccuggacguggagagcgcccacagacuccuggaugucgaauccgcucagcgguuuuucuacucucaaggcgcccaggcgcgcagagcuacccuucugcucccuccgacacugauggccgccagcuccgaggacgauaucgaccggcgccccauuagacggguucgcucuaaaagcgauacgccuuaucuugcugaagccagaaucuccuuuaaccugggggcugccgaggaaguggagcggcucgcggccaugcgcucugacagccuggugcccggaacccauacaccucccauuagacggcgcuccaaguucgcuaaucugggcagaaucuuuaaaccuuggaaguggcggaaaaagaaaagcgagaaguucaagcacaccucugccgcucucgaacgcaaaauuuccaugagacagagccgggaggaacugaucaagagagggguccuuaaagagaucuacgauaaggacggagagcugucuauuuccaacgaagaggauagccucgaaaauggccagucucuguccagcucccaacuuucucugccggcccucagcgagauggaacccgugccuaugccccgcgacccuugcuccuaugagguucugcagcccagcgauaucauggacgggccggacccuggagcgcccgugaagcugccuugucuccccgucaaacugucucccccucuuccgcccaagaaagugaugauuugcaugccuguuggcggccccgaucugucccucgugagcuacacagcccagaagucugggcagcaaggagucgcucagcaucaccauaccgugcugccuagccagauccagcaccaacuucaguauggcucccacgggcagcaucugcccucuacaaccggaagccucccgaugcacccuuccggcugucggaugauugacgagcugaacaaaacgcuggccaugaccaugcaaagacucgaaagcucugagcagcgcgugcccugcuccacaagcuaccauucuuccgggcugcacagcggagauggcgucaccaaggcuggcccuauggggcuucccgaaauccggcagguuccuacaguggugauugagugugacgauaauaaagaaaacgucccccacgaguccgacuacgaggauucuagcugccuguauaccagagaagaggaagaggaagaggaggacgaagaugacgauuccucucucuacacgagcucccuggccaugaaggugugucgcaaggacagccuugccaucaaacugucuaaucggccguccaagagagagcucgaagagaaaaacauccugccucgccagacagacgaggaacggcuggagcucagacaacagauuggaaccaagcugacacgccggcuuagccagagacccaccgcugaagaacuggaacagcggaauauccucaaaccccgcaacgagcaagaggaacaggaggaaaagagagagauuaagcggagacugacccgcaaacugucucagcggccuacaguugaggagcuuagagagcgcaagauccucauuagauuuuccgauuauguggaagucgcggacgcccaggauuacgaccggcgcgcugauaaaccguggacgagacugaccgccgccgacaaggcugccauccggaaagagcugaaugaguucaagagcacagaaauggaagugcaugagcucucucgccaccugaccagauuucaucggcccuga

SEQ ID NO: 73681 - RNA, 1938 nt, Artificial Sequence
  derived and/or modified sequence opt5 from PHACTR2__Homo_sapiens__NP_001093634
augggccagaccagcguguccacacugucuccccaaccugggagcgucgacggacucgauaaggccuccaucgcuaacucugacggcccgacggccgggagccagacacccccuuucaaaagaaagggaaaacuguccaccauuggcaagaucuuuaaacccuggaaguggcggaagaaaaagaccucugauaaauuccgcgagacaagcgcgguucuugaaagaaagauuuccacccggcagagccgcgaggaacugaucagacgcggggugcucaaagagcugccugaccaggauggagacgugacagucaauuuugaaaacucuaauggccacaugauucccaucggcgaggaguccacccgggaagagaacgugguuaagagcgaagaggggaauggaucuguguccgagaagacgccuccgcuugaggaacaagcugaagauaaaaaggagaacaccgaaaaucauagcgagacacccgccgccccugcucugcccccuucugcucccccgaaaccuagacccaagccuaaacccaagaaaucccccgucccuccgaagggcgccaccgccggggcgagccacaagggagacgaggugcccccuaucaaaaagaacacaaaagcccccggcaagcaggcuccuguucccccgccuaaacccgccucccggaauaccacgcgcgaagcugccgggucuagccauuccaagaagacaaccggaagcaaagcgucugccuccccuagcacaucuagcaccuccucuagacccaaggcuagcaaagagaccguguccagcaaggccggcacagucggcacgaccaaagggaagcggaagacagauaaacagccuauuaccucucaccucuccagcgacacaaccacgucuggaacauccgaucugaagggcgaacccgcugagacccgcguggagagcuucaaacuggaacagaccgugccgggggccgaggaacaaaacacaggaaaguuuaaauccauggucccucccccucccguugccccggcucccucuccucucgcgcccccucugccccuugaggaccagugcaucaccgccagcgauacaccuguggugcuggucuccgugggcgcugaccuccccguuucugcccuggacccgagccagcuucugugggccgaggaaccuacgaauagaaccacacucuacuccgggaccggacugagcgugaaccgggaaaaugcuaaguguuucacaaccaaggaggagcugggcaaaacggucccccagcuccugaccccuggccuuaugggggaaucuuccgagagcuuuucugccuccgaagaugagggacaucgcgaguaucaagcgaacgacagcgauucugacggccccauucuguacacagaugacgaagaugaggacgaagaugaggacgggagcggagaauccgcucucgccagcaagaucagacggagagauacccuggccauuaaacuuggcaaucgcccgucuaagaaagagcuggaggacaagaacauccuccagcggacauccgaagaggaaagacaggagauucgccaacagaucgggaccaaacuggugcggagacugagccagcgcccuacgacagaggaacucgagcagcggaacauccugaagcaaaagaaugaagaggaggaacaggaagcuaaaauggagcuuaagagacgccugucccggaaacucucucugagacccaccguugccgagcuucaggcucgccggauucugagauucaacgaauauguggaggucacagacagcccugauuacgaccggcgcgccgauaagcccugggcgagacucacccccgccgacaaagcugccauccggaaggaacugaaugaguuuaaguccaccgagauggaagugcacgaggaaucuagacaguucacacgcuuucaccggccuuga

SEQ ID NO: 73682 - RNA, 1671 nt, Artificial Sequence
  derived and/or modified sequence opt5 from PHACTR3__Homo_sapiens__NP_001186434
augagaggcagagggggaggccgcgccagaugccccgcuccucugcggagccuccugggggccuucggagcgcgcgacgcugccgccgcugccagagauccggcucaggacgagauggaucaaacacccccugcccggcccgaauaccuuguguccggcauccgcaccccucccgucagacggaacucuaagcuggcgacgcucgggcgcauuuuuaaaccuuggaaguggcggaaaaagaaaaaugagaagcugaagcagaccacaagcgcccuugagaaaaagauggcuggacggcagggccgcgaagaacugaucaaaaagggccuccuggagaugauggagcaggacgccgaauccaaaaccuguaacccggaugggggacccagaucuguucaaagcgagccucccacaccuaaguccgaaacccugacaucugaggacgcucagcccggcagcccgcucgccaccgggacggaucaggugucccuggacaagccucuuagcucugcggcccaccuggaugacgcugccaaaaugcccuccgcuagcucuggagaggaagccgaugccggcucccuccugccuaccacaaaugagcuuagccaggcucuggcgggggccgacucucucgauuccccuccccggccccuggaacgcagcgugggacaacugccgucucccccucuccugcccaccccucccccgaaggcuuccagcaaaacaaccaagaacgucacgggccaggccacacuuuuccaggccuccagcaugaaaucugcugacccuucccugagaggccagcucagcacccccacagggucuccucaucugaccaccgugcaccggccccuuccucccagcagaguuauugaggaacugcaucgcgcccucgcgacaaagcaccggcaagacuccuuucagggaagagagucuaaaggcagcccgaagaagcgccuggaugugcggcuguccagaacgagcucugucgagcgcgggaaagaacgggaggaggcuugguccuucgacggagcccucgaaaauaagagaaccgccgcuaaagaaagcgaggagaacaaggaaaaucugaucauuaacucugagcuuaaagaugaccugcuccuguaucaggaugaagaggcccuuaaugacuccaucaucagcggcacacugccucgcaagugcaagaaagaacuccuggcugugaagcugcggaacagacccuccaaacaagagcucgaggaucgcaauauuuuuccccggagaaccgacgaggaacggcaggaaauccgccagcagauugagaugaagcugucuaaaagacuuagccaacggccugccguugaggaacuggagagacgcaacauccucaagcagcggaaugaucagacagaacaggaggaaagacgcgagauuaagcaaagacugacccggaaacugaaccagcgcccgacgguggacgagcuuagagaucggaagauccucauucgcuucuccgacuacgucgaaguggcgaaagcccaggacuaugauagacgggcugacaagcccuggacacgccugucugccgcugauaaagccgcgaucagaaaggagcugaaugaauacaagagcaacgagauggaagugcaugccuccagcaaacaccucacccgguuucaccgcccuuga

SEQ ID NO: 73683 - RNA, 900 nt, Artificial Sequence
  derived and/or modified sequence opt5 from PHB2__Homo_sapiens__NP_001138303
auggcccagaaccugaaggaccucgcuggcagacugcccgccgggccucggggaaugggcaccgcgcuuaaacugcuccugggggcuggagccguggccuacggcguccgcgagagcguuuucacaguggaagggggacacagagcuaucuuuuucaaucggauuggcggcgugcaacaggauacgauccuugccgaggggcugcauuuucgcauuccgugguuccaguaucccaucauuuacgacaucagagcucggccucgcaagaucuccucucccaccggaagcaaagaucuccagauggucaacauuucccugagagugcugucucggccuaaugcccaagaacuccccagcauguaucagcgccugggccuugacuacgaggaaagaguucugccuuccaucgugaacgagguccucaagucugugguugcgaaauuuaaugccagccagcugauuacacagcgggcucaagugucccuucugauccgcagagagcucaccgaacgggccaaggauuucagccugauucuggacgaugucgcuaucacagagcucucuuuuucccgcgaauauaccgccgcgguggaggccaaacagguggcucagcaggaggcccaaagagcucaguuccuggucgaaaaagccaagcaggagcaacggcagaaaauuguucaggccgaaggggaggcugaagcggccaagaugcuuggagaggcucugagcaaaaacccgggcuacaucaagcucagaaagauccgcgccgcccagaauauuucuaaaacaaucgcuaccucccaaaaccggauuuaucugacggccgacaaucuugugcugaaccuccaggaugagagcuuuaccagagggucugacucccugaucaagggaaagaaguga

SEQ ID NO: 73684 - RNA, 468 nt, Artificial Sequence
  derived and/or modified sequence opt5 from PHB__Homo_sapiens__NP_001268426
auggccgcuaagguguucgagagcaucggcaaauuugggcuggcccucgcggucgcuggaggcguugugaacuccgcccuguacaauguggacgccgggcacagagcugucauuuucgaucgguuucgcggagugcaggacaucguugugggcgaagggacccauuuccuuauucccuggguccaaaagccuaucauuuuugauugcagaucucggccgcgcaacgugcccguuaucacaggaagcaaagaccugcagaaugugaacaucacgcuccggauucuguucagaccugucgccucccagcuuccccgcaucuuuaccucuauuggcgaggauuaugacgaaagagugcugccuagcaucacaaccgagauucucaaguccguggucgcucgguucgaugccggcgaacugaucacauaccugcccgcggggcagucuguucuccugcaacuuccucaguga

SEQ ID NO: 73685 - RNA, 3015 nt, Artificial Sequence
  derived and/or modified sequence opt5 from PHC1__Homo_sapiens__NP_004417
auggagaccgaaagcgagcagaacuccaauucuacaaacggcagcuccucuagcgggggauccucuagaccccaaaucgcccagaugagccuguacgaacggcaggcugugcaggcccuccaagcgcugcagcgccagccuaaugcugcccaguauuuccaccaauuuaugcuucagcagcagcuguccaacgcccaacuccauagccuggcugccguccagcaggcuacgauugccgcgucuagacaagccuccagcccgaauaccucuacaacccagcagcagacaaccacaacccaggcuuccaucaaccuugccacgaccagcgcugcccagcugauuucucggucccagagcguuuccucucccagcgcgacaacccucacacaguccgugcugcugggcaauaccacgagcccuccccucaaccaaucucaggcccagauguaccugcgcccucagcuugggaaucugcuccaagugaacagaacacugggacggaaugucccccuugcuucccagcugauccucaugccuaacggcgccguggcugccguucagcaggaggugccgagcgcccaaucucccgggguccacgcugacgcggaucaggugcagaaucuggccguucgcaaccaacaggcuagcgcccagggaccucagaugcaaggcuccacccagaaggccauucccccuggcgcuucucccgugagcucccugagccaggccucuucccaggcgcucgcugucgcccaagccagcucuggggcuacaaaucagucccugaaccuuagccaggccggaggcggguccggaaacucuaucccgggcagcauggggccuggaggcggcgggcaggcucauggaggccuggggcaacuccccuccucuggaaugggcgggggaagcugcccuagaaaaggcaccggcguggugcagccccugcccgccgcgcagaccgucacaguuucccaagggagccagacggaagccgagucugcugccgcuaagaaagccgaggcggacggauccggccagcagaauguggggaugaaccuuacccggacagccaccccugcuccgagccaaacacugaucucuuccgccaccuauacgcagauucagccccacagccucauccagcaacagcagcagauucaucugcaacagaagcaaguggucauccagcaacagauugcuauccaccaccagcaacaguuccagcaucgccagucucaacugcuccacacagccacccaucugcagcuugcccagcagcaacagcagcagcaacagcagcaacagcagcagcaacagccucaggcuaccacacugaccgcgccccagccuccccaagugccgccuacacagcagguucccccuagccagucccaacagcaggcccagacgcucgugguccaacccaugcugcagagcucuccucuuucccugcccccggaugcugccccuaaaccucccauucccauccagagcaagccgcccguggccccuaucaagcccccucaacucggagcugccaaaauguccgcggcucagcagcccccuccccacauuccgguucagguggucggcaccagacaaccugggacagcccaggcccaggcucugggccuggcccagcucgcggcugccgugcccaccucucggggaaugccuggcacaguccaaagcgggcaggcccaccuggcuuccucucccccgagcucccaggccccuggagcccuucaggaaugucccccuacccuggcucccggcaugacgcucgcgcccgugcaagggaccgcccauguugugaagggaggcgcuacaaccucuagcccugucguggcccagguuccggcugccuuuuacaugcaguccgugcaccuucccgggaaaccucaaacacuggccgucaagcgcaaagcugacagcgaggaagagagagaugacgugucuacccuuggcuccaugcuccccgcgaaggccagcccuguggcugagucucccaagguuauggaugaaaaauccagccugggagagaaggccgaaucugucgccaaugugaacgcuaauacgccuuccagcgagcugguggcccucacaccggcgcccuccgucccucccccuacccuggcuauggugagccggcagaugggcgacucuaaacccccgcaggccaucguuaagccucagauucuuacacauaucauugaaggguucgugauccaagagggagccgagcccuuucccgucggcugcagccagcugcucaaagaauccgagaagccucugcagaccgggcugcccaccggacuuacagaaaaccagucuggcgggccucucggcguggauagcccguccgcugagcuggacaaaaaggccaaucugcucaagugugaauauugcggaaaauacgcgcccgcugagcaauuccgcggcucuaagagauuuuguagcaugacgugcgccaaacgguauaacguuuccuguucucaccaguucagacugaagcgcaaaaagaugaaggaguuucaggaagccaauuacgcucgggugagacgccgggggccuagacgcagcuccagcgauaucgcccgggcuaaaauucagggaaagugccauagaggccaagaggacucuucccgcgggagcgauaacucuuccuacgacgaagcccuuagccccaccuccccuggaccccugucuguccgggcgggccacggggagagagaccucggcaauccgaacacagccccucccaccccugaacugcacggaaucaaucccguguuccugagcuccaacccuagccgcuggucuguugaggagguguaugaauuuauugcuucccuucagggcugucaggagaucgccgaagaguuccggagccaagagauugaugggcaggcucuccugcugcucaaagaggaacaucugaugucugccaugaauaucaagcugggacccgcccugaaaaucugcgcuaagauuaacguccucaaggaaacauga

SEQ ID NO: 73686 - RNA, 861 nt, Artificial Sequence
  derived and/or modified sequence opt5 from PHC2__Homo_sapiens__XP_011539177
augaccagcggcaacggaaauuccgccucuagcaucgcugggacagcgccccagaacggcgagaauaagccuccgcaagccauugugaaaccccagauccugacgcacgucauugaaggguucguuauccaggagggagcugaaccuuuucccgugggcagauccucucuccugguggggaaccuuaagaaaaaguacgcccagggauuccugccugagaaacucccccaacaggaccauaccacaaccacagauagcgaaauggaggagccuuaucugcaggaauccaaggaggaaggcgccccgcuuaagcugaaaugcgagcucuguggccgggucgacuuugcuuacaaguucaaacgcucuaagagauuuugcagcauggccugugcuaaacgguauaauguggggugcaccaagcgcguuggacuguuccacuccgauagaagcaagcugcagaaagccggcgcggccacacauaaccggcgcagagcuucuaaggccucccugcccccucucaccaaagacacgaagaaacaacccaccgggacagugccucuuagcgucaccgcugcccugcagcucacacacucucaggaggauuccagccgguguucugacaauuccagcuacgaggaaccccuguccccgauuucugcgagcuccagcaccucucgcagacggcagggacaacgcgaucuugaacugccugacaugcauaugagagaucucgugggcauggggcaccacuuucugcccuccgagccuacgaaguggaacguugaagacguguaugaguucauccggagccugcccgaguacccccaucgccaccagaucccugauucucucgucccguga

SEQ ID NO: 73687 - RNA, 2988 nt, Artificial Sequence
  derived and/or modified sequence opt5 from PHC3__Homo_sapiens__NP_079223
auggccgaggcugaguucaaggaccacagcaccgccauggauacagaacccaacccuggcacguccucugugagcaccacaaccuccucuacaaccacaaccacgaucaccacaagcuccucuagaaugcagcaaccgcagauuagcgucuacuccgggagcgaccggcaugcgguucaggugauccagcaagcucugcacagacccccuucuuccgccgcccaguaucuccagcagauguacgcugcccaacagcagcaucugaugcuucacaccgcugcccugcagcaacagcaucucucuagcucccagcugcaaagccuugcggccgugcaggcuucucuguccagcggacgccccuccacaucuccuaccggcagcgucacgcagcaguccagcaugucucaaacauccauuaaucucagcaccucucccacgccugcccagcugaucagccggucccaggcuucuagcuccaccagcgggucuauuacccagcaaacaaugcugcucggauccacgagcccgacccugacagccucucaggcgcagauguaucuucgcgcccagaugcugaucuuuacccccgcuacaaccguggccgcuguucaauccgauaucccuguggucagcuccucuagcuccucuagcugccaguccgccgccacacaggugcagaaccucacacugagaagccaaaaacuuggcguucugucuuccagccagaaugggcccccuaagucuaccucccagacccaaagccucacaauuugucacaacaaaaccacagugacgucuagcaagaucucccagcgggaccccagcccggaaucuaauaaaaagggagaguccccuagccuggaaucccgcucuaccgcugucacaagaaccagcuccauucaccagcugaucgcgcccgccucuuacagcccuauucagccccauucccucaucaagcaccaacagauuccccugcauucuccuccgagcaaagugucccaccaccagcuuauccugcagcaacagcagcagcaaauccagcccauuacacuccagaacagcacccaagauccucccccuucucagcauugcaucccccugcagaaucacggccuuccgccugcucccuccaacgcccagagccaacauuguucuccuauucagucccaccccagcccucugacggugucucccaaucagucccagagcgcccaacaguccgucguugugagcccgccuccuccccauucucccagccaguccccgaccaucauuauccacccccaggcucucauccaaccucacccccuggugucuagcgcccugcagccuggccccaaccuccagcaguccacagcgaaucaaguccaggcuaccgcccagcugaaccuuccuucucaucugccccucccggccagcccugugguucacauugggcccgugcaacaguccgcucuggucucuccuggacagcagaucgugagccccucccaucaacaguauagcucucuucaguccagcccgauuccuaucgccucucccccucagauguccacaagcccucccgcucaaauucccccgcugccccuccaguccaugcagucucugcagguucaaccugagauccugagccagggccaggugcucguccaaaaugcccugguguccgaggaggaacuucccgcggccgaagcucugguccagcucccuuuccagacccugcccccuccgcagacgguggccguuaaccugcaagugcagcccccugcucccgucgacccucccgugguuuaccagguggaggaugucugcgaggaagagaugccggaagagagcgacgaaugugugcggauggaucgcacaccucccccucccacccuuucucccgccgcgaucacaguggggagaggagaggaccucaccuccgagcacccucugcuggaacagguugagcucccggccgucgcuagcgugucugccagcgugauuaagucccccucugauccuagccacgucuccgugcccccucccccgcugcuucugccugcugccaccacacggucuaauagcacguccaugcauagcucuauccccuccauugaaaacaaaccuccccaagccaucguuaagccucagauucucacccacgugaucgagggcuuugucauucaggaagggcuggagcccuucccggugagccgcuccucucugcuuaucgagcagccuguuaaaaagagaccccuccuggacaaccaagugaucaauagcgucugcgugcagcccgaacugcagaacaauacaaagcaugcugauaacuccucugacaccgagauggaagacaugauugcggaggaaacacucgaggagauggauagcgaacugcuuaaaugugaguuuugcggaaagaugggcuaugccaaugaguuccugcgguccaaacgcuuuuguaccaugagcugcgcuaagagauacaacguuucuuguuccaaaaaguucgcccucagccgguggaauagaaaaccugacaaccagucucugggccaccgcgggcggagaccguccggacccgauggcgccgcucgcgaacauauccugcggcaacuuccuauuacguaccccagcgccgaggaagaccucgcgucucacgaggauagcgugccuuccgcuaugacaaccagacugcgccggcagucugaaagagagcgcgaacgggagcugagagacguccgcauccggaagaugcccgagaauagcgaucuccugccuguggcccagaccgaaccguccauuuggacaguggacgaugucugggccuuuauccacagccuucccgggugccaagacaucgcugaugaguucagagcccaggaaauugacggacaggcgcugcuccugcugaaggaggaccaucuuauguccgcuaugaacaucaaacucggcccugcccugaagauuugcgcccggaucaauucucugaaagaaagcuga

SEQ ID NO: 73688 - RNA, 2250 nt, Artificial Sequence
  derived and/or modified sequence opt5 from PHEX__Homo_sapiens__NP_000435
auggaagccgaaaccggcagcuccguggagacagggaagaaagcuaacagaggaacgcggaucgcccuggucguuuucgugggcgggacccucgugcugggaacaauucuuuuucuggucucucagggccuccugagccuucaagcgaagcaggaauacugccugaaacccgaguguaucgaagcugccgccgcuauucucuccaaggugaaucugucuguugacccuugcgauaacuucuuucgcuucgccugugacggguggaucagcaauaacccgauucccgaggauaugccuuccuauggaguguaccccuggcugagacacaaugucgaccucaaacugaaggagcuucuggaaaagucuaucagccggcgcagagauaccgaggcuauccagaaagccaagauucucuauuccagcugcaugaacgaaaaagcgaucgagaaggccgacgcuaaaccucugcuucauauucugcggcacucucccuuucgcuggccugugcucgaguccaauaucggcccggaaggcguuuggagcgagagaaaguucucucugcugcagacacucgccaccuuucgggggcaauacuccaacagcguguucauucgccuguaugucucucccgaugacaaggcuuccaaugaacauauccuuaaacuggaucaggccacacucagccuggcggugagagaggacuaccuugauaacuccaccgaagccaagucuuaucgggacgcucuguacaaauuuaugguggauacggccguccuccugggagcuaauagcucccgcgccgagcacgacaugaaaagcguucugagacucgagauuaagaucgccgaaaucaugauuccucaugagaaccggaccucugaagcuauguacaauaagaugaacaucuccgagcugagcgcgaugauuccccaguucgacuggcuuggcuauaucaaaaaggugauugauacacgccuguacccucaccucaaggacaucucucccagcgaaaauguggucgugagaguuccgcaguauuuuaaagaucuguuccggauccuuggguccgagagaaagaaaaccauugccaacuaccugguguggcgcauggucuauucucggaucccuaaccucagcagacgcuuucaauaccgguggcuggaguucuccagagugauucagggaacaaccacgcugcucccccagugggacaaguguguuaauuucaucgaaagcgcucugccuuauguggucggcaaaauguuuguggaugucuacuuccaggaggacaagaaggaaaugauggaggaacuuguggaggggguucgcugggccuuuauugauaugcuggagaaagaaaacgaguggauggacgccggaacaaagcggaaagcuaaggaaaaagccagagcggugcucgcuaaggucggcuaccccgaguucaucaugaaugauacccacgugaacgaggaccugaaggccaucaaauuuucugaagccgauuauuucggcaauguucugcaaacacgcaaguaccuugcucaguccgacuuuuucuggcuccggaaagccgugcccaagaccgagugguuuaccaacccuacaacggucaaugcuuucuauagcgccucuaccaaccagauuagauuuccggcgggggaacugcaaaaacccuucuuuuggggaacagaguacccucgcucccugagcuauggcgccaucggggugauugugggacaugaguucacccacggcuucgacaauaacgggcggaaguacgauaagaauggaaaccucgaccccuggugguccacagagucugaggaaaaauuuaaggagaaaaccaagugcaugaucaaucaguauagcaacuacuacuggaaaaaggcuggccugaauguuaaaggcaagagaacgcuuggggaaaacauugccgauaacggaggccugcgggaggcuuuccgcgccuauagaaaguggaucaaugaccggagacaggggcucgaagaaccucugcugcccggaauuacauuuaccaacaaucagcuuuucuuucucuccuacgcgcauguccgcuguaacucuuaucggccggaggccgcuagagaacaagugcagaucggcgcccacagcccuccccaguuccgcgugaauggggcuaucuccaacuuugaggaguuccagaaagccuuuaauugcccucccaacagcaccaugaauagaggcauggauucuugucggcugugguga

SEQ ID NO: 73689 - RNA, 1497 nt, Artificial Sequence
  derived and/or modified sequence opt5 from PHF10__Homo_sapiens__NP_060758
auggccgccgccgcgggccccggggcugcccugagcccuagaccgugcgacuccgaucccgccaccccuggagcucagucucccaaggacgauaacgaggacaauagcaacgauggcacacaaccuuccaaacggcgcagaauggggucuggagacagcucccggucuugugaaacgagcucccaggaucucggcuucagcuacuaucccgccgagaaucugaucgaauacaaguggccuccggacgagaccggggaauauuacaugcuucaggaacaggugucugaguaucugggagucacauccuuuaaacgcaaguaccccgaucucgaaagacgggaccugagccacaaagagaaacuuuaucugcgcgaacucaacguuauuaccgagacacaaugcacccugggccugacagcucucagaucugaugaggugaucgaccugaugauuaaggaauacccugccaaacaugcggaguacuccgugauccuucaggaaaaggagcggcagcgcauuaccgaucacuauaaagaauacagccagaugcaacagcagaauacgcagaaggucgaggccucuaaagugcccgaguauaucaagaaggcugccaaaaaggcugccgaguucaacuccaaucugaacagagagcggauggaggaacgcagagcguacuuugaccuccaaacccauguuauccaggugccucagggcaaauauaagguccugcccacagaacggaccaaagugagcuccuacccgguugcccuuauuccugggcaauuccaggaguauuacaagcgcuacucucccgacgagcugagauaucucccucugaauacagcucuguacgaaccuccccucgaucccgagcugccggcccuugacagcgauggagacuccgaugacggcgaagaugggcggggagacgagaaaagaaagaacaagggcaccagcgauucuuccagcgggaaugugucugaaggagagagcccucccgacucccaggaggauucuuuucagggccgccaaaagagcaaggacaaagcugccacgccccggaaggacggcccuaaaagauccguccugagcaagucugugcccggguauaagccgaaagugaucccuaacgccauuuguggaaucugccucaagggcaaagaauccaauaagaaagggaaggcugagagccugauucacuguucucagugcgaaaacuccggacaucccagcugucuugauaugacaauggagcuggucuccaugaucaagaccuacccuuggcagugcauggaguguaaaacaugcauuaucuguggccagccccaccacgaagaggaaaugauguucugcgacaugugcgaucgcggguaucauaccuuuuguguuggacucggcgcgaucccuucuggccgguggauuugcgacuguugccaaagagcucccccgaccccucgcaagguggggcggagaggcaaaaauagcaaggagggauga

SEQ ID NO: 73690 - RNA, 996 nt, Artificial Sequence
  derived and/or modified sequence opt5 from PHF11__Homo_sapiens__NP_001035533
auggcccaggcuagcccucccagaccggagcgggugcugggcgccuccucucccgaagcgcgcccugcucaagaggcccuccugcuucccaccggggucuuccagguugccgaaaagauggagaaaagaacaugcgcucuguguccuaaggacguggaauacaacgugcucuauuuugcccagagcgagaauaucgcugcccacgagaacugccugcuuuacuccucuggacuggucgaaugugaggaucaggacccccucaauccugaucggagcuucgacguggaauccguuaaaaaggagauucaacgcggcagaaaacugaagugcaaguuuugucauaaacgcggggcgacggugggaugcgaucugaagaacuguaauaaaaacuaucacuucuuuugcgccaagaaagacgaugcugucccgcagucugacggcgugcgggggaucuacaagcuccugugucagcagcaugcccaauuccccauuaucgcucagagcgccaaguuuuccggaguuaaaagaaagcggggccgcaaaaagccucuuagcggcaaucacgugcagcccccugagaccaugaaaugcaacacauucauuagacaggucaaggaggaacaugggcggcacaccgaugcgacagugaaagugcccuuucugaagaaguguaaagaagccggacuccugaauuaucuucuggaggaaauccucgacaagguccacucuaucccggagaaacugauggaugagaccacauccgaaagcgacuacgaggaaauuggcucugcucuguucgauugccgccucuuugaggacaccuucguuaacuuucaagccgcuaucgaaaagaaaauucaugccucccagcagagauggcaacagcugaaggaggagaucgaacuucugcaggaccucaagcagacgcugugcagcuuccaagagaaucgggaucuuaugucuuccagcaccuccauuucuagccuguccuauuga

SEQ ID NO: 73691 - RNA, 3015 nt, Artificial Sequence
  derived and/or modified sequence opt5 from PHF12__Homo_sapiens__NP_001028733
augugggagaagauggaaaccaaaacaaucguguacgaccuggauacgagcggcgggcucauggagcagauucaagcccugcuugcucccccuaagaccgacgaagccgagaaaagaucccggaagccggaaaaagagccccgcagaucuggacgggcgacaaaccacgauagcugcgacuccuguaaggagggcggggaucugcucugcugugaccauugcccugcugccuuccaccuucaguguugcaaucccccucuuucugaagagaugcugcccccuggagaauggaugugucaucgcugcaccgucagacggaagaaacgcgagcagaagaaagagcucggccacguuaacgggcugguggauaagagcggaaaaagaacaaccuccccgucuagcgacacagaucugcucgaccgguccgccagcaagaccgaacugaaggcuaucgcccaugcucgcauucuugagagacgggccucucgccccggcacgccuaccuccagcgcgucuacagaaacccccacauccgagcagaaugauguggacgaagauaucauugacgucgacgaggagccuguggccgcugaacccgauuauguucaaccgcagcugagacggccuuuugagcuccugaucgccgcugccauggaacgcaaccccacccaguuccagcuuccuaaugagcugacguguacaaccgcgcuccccggcagcucuaaaagacggagaaaggaagagacaaccgggaaaaacgugaagaaaacccaacacgagcuggaccacaauggacuggucccccucccugugaagguuugcuuuacauguaaccgcuccugccggguggccccgcugauccagugcgauuacuguccccuucuguuccauauggacugccucgaaccuccccugacggcuaugccucuuggcagauggaugugucccaaucacauugagcaugucgugcugaaccagaaaaauaugacccucagcaaccgcugccagguguuugaucgguuccaagacacagucucccagcacguugugaagguggauuuucugaauagaauccacaagaaacauccgccuaaccgccggguccugcagucugugaagagacgcagccucaaaguucccgacgccauuaagucccaauaucaguucccucccccucugaucgcucccgccgccauucgggauggggaacuuaucuguaaugggauuccggaggaaagccagaugcaucugcucaacucugagcaccuggcuacccaggcggagcaacaggaauggcuuugcuccguggucgcccugcaguguagcauccucaaacaccugucugcuaagcagaugccuagccauugggacuccgagcaaacagaaaaggccgauaucaaacccgugauuguuaccgacucuagcgugacgacaucccugcagaccgccgacaagacccccacaccuagccacuacccgcucucuugccccuccggcaucagcacccagaacucucuguccuguagcccuccccaccaguccccugcucuugaggauauugggugcucuagcugugccgagaaauccaagaaaacacccugcggaacggcgaauggcccugucaacaccgaagugaaggcuaauggcccccaucuguauucuagcccgacagacuccaccgauccuagacgccuccccggggccaacacaccucugcccggacugagccaccggcaaggcuggccgagaccucuuacgcccccugccgcugggggacuccagaaucauaccgucggcaucauugugaagaccgagaacgccacagggcccucuuccugcccccagcggagccugguuccugugccgucucugcccccuuccauccccagcucuugugcuagcaucgaaaauaccuccacacuccagcgcaaaaccguccaaagccagauuggaccuccccugacggacucuagaccucuuggcuccccgcccaacgccacacgggugcugaccccuccccaggcggccggcgaugggauccucgcuacaaccgccaaucaaagauuuagcuccccugcucccucuagcgacggaaagguuuccccgggcacccugucuauugggagcgcccugacagugccuuccuuccccgcgaacucuacggccauggucgaucuuaccaauagccuccgcgcuuuuauggacgugaacggagagaucgaaauuaauaugcuggaugagaaacugaucaaguuccucgcccugcagcggauccaccagcuuuuucccuccagagugcagccuagccccggcucuguugggacacaccaacuggcuuccggcggacaucacauugagguccagcgcaaagaagugcaggccagagccguguucuacccucuccugggccugggaggagcugucaacaugugcuaucggacccuuuacaucggcacaggggcggacauggaugugugucucaccaauuacggacauugcaacuauguuagcggcaagcacgccuguauuuucuacgacgagaacacgaagcauuaugaacugcugaauuacucugagcacgggacaaccguggauaacguccucuauuccugcgacuuuagcgaaaagaccccgcccacaccucccucuuccaucguggcuaaaguucagagcgugauucgcagacggcgccaccaaaaacaggacgaggagccuuccgaagaggccgccaugaugagcucucaggcucagggcccccaaagacggccguguaauugcaaggccagcuccucuagccugaucggaggcuccggggcgggaugggaaggcaccgcucugcugcaucacgggucuuacauuaaacucggaugucugcaguucgucuuuagcaucacagaguucgccacgaagcagccuaaaggcgaugccucccugcuucaagacggggugcucgcugaaaagcugucucugaagccccaucagggcccuguucuccgcagcaacuccgugcccuga

SEQ ID NO: 73692 - RNA, 624 nt, Artificial Sequence
  derived and/or modified sequence opt5 from PHF19__Homo_sapiens__NP_001009936
auggagaacagagcccuggaccccggcacccgggauagcuacggggcuacaucccaccucccuaauaagggagcccuggcgaaagugaagaacaauuucaaagaccuuaugucuaagcugacggaaggccaguauguccucugccgcuggaccgaugggcuguacuaucuuggaaaaaucaagagaguuagcuccucuaagcaaagcugucuggugacauuugaggacaacuccaaauacugggugcucuggaaggauauucagcaugcuggcgucccgggggaggaacccaaaugcaauaucugucugggaaagaccucuggcccucugaacgaaauucucaucugcggcaaaugugggcugggauaucaccagcagugccauauucccaucgccggcagcgccgaccaaccucuucugacacccugguucugucggcgcugcaucuuugcucucgccgugagaguuucccugccuagcucuccggugcccgcuuccccugccucuagcuccggggcggaucagcggcuucccagccagucucuguccagcaagcagaagggacacaccugggcccucgagacagacuccgcuucugccaccguccugggccaagaucuguga

SEQ ID NO: 73693 - RNA, 1374 nt, Artificial Sequence
  derived and/or modified sequence opt5 from PHF1__Homo_sapiens__NP_002627
auggcccagcccccuagacugagccgguccggcgcuucuagccucugggacccggccucccccgcgccuaccucugggccccgcccuagacugugggagggacaagaugugcuugcucgguggacagacggccugcucuaccuggggacgaucaagaaagucgauagcgcccgcgaaguuugccuugugcaguucgaggacgauucccaguuucuggugcucuggaaggacauuucucccgccgcucugccuggagaggaacugcucuguugcgucuguagaagcgaaaccgugguuccgggcaaccggcugguguccugcgagaaaugucgccacgccuaucaucaggauugccacguccccagagcuccugcccccggggagggagaaggcacaagcugggugugucggcaaugcguuuucgcgaucgccaccaagcgcggcggggcucuuaaaaagggaccuuacgccagagcuaugcugggcaugaagcucucucugcccuaugggcuuaaaggacuggacugggaugccggccaucucuccaaucggcagcagagcuacuguuauugcgggggaccgggcgaguggaaccugaagaugcugcagugucgcucuugccuccaaugguuucacgaagcgugcacacagugucuguccaaaccucuucuguacggcgacagauucuaugaguuugagugcugugugugccgcgggggacccgaaaagguccggagacuccagcugcgguggguggauguggcccaucuuguccuguaccaccucagcguuuguugcaaaaagaaguacuucgacuuugauagagagauucugccuuucaccucugaaaauugggacucccugcuccugggcgagcuuagcgacacacccaaaggggaacgcuccucuaagcugcucagcgcucugaacucccacaaagaucgguuuaucagcggaagagagauuaagaaacgcaagugucuuuucggccugcaugcccggaugcccccuccgguggagcccccuaccggggacggagcucucacgagagccggccccuggggccgcgggcugaccucuccuggagaagcccccgaggcuggcgcgcgggccccggaagaggaagcugagggggaguccggaggcgccggggccacacugagcucugcucagagcgccagagcgccuggcgcugaaggagccggcuccucugccgaggggaccgcugccgcucccagcggaugccuccugccuuccacacuucugcccgccccucaaggcccccucgggaccguggauccgcagacgggacacccuuggaauuuuacacuggucagcccccagaccucucugaaagugcccccuacacgcuga

SEQ ID NO: 73694 - RNA, 3039 nt, Artificial Sequence
  derived and/or modified sequence opt5 from PHF20__Homo_sapiens__NP_057520
augaccaagcaucccccuaacagacggggcaucagcuucgaggugggggcccagcuggaagcucgcgacagacucaaaaauugguacccggcccacauugaggauaucgacuaugaagagggaaagguccugauucacuuuaaacgguggaaccaucgcuacgaugaaugguucugcugggacucccccuaucuuagaccucuggagaagauccaacuccggaaagagggccugcacgaagaggaugggucuagcgaauuucagauuaaugagcagguucuugcguguugguccgacugccgcuucuaccccgcuaaggugacagccgugaacaaggauggaacguauaccgucaaauuuuacgacggcgugguucagacagugaagcauauccacgucaaagccuucucuaaggaucaaaauaucguggggaacgcuagaccuaaagagaccgaccacaagagccuguccucuagccccgauaagcgggaaaaauuuaaggagcagcgcaaagccacaguuaaugugaagaaagacaaggaagauaaaccucucaagaccgagaagagaccgaaacagcccgacaaggaaggaaaacugauuuguuccgagaagggcaaagucagcgagaagucucugccuaagaacgaaaaagaggacaaggaaaauaucuccgagaacgaucgggaauauagcggcgacgcucagguggauaaaaagcccgagaaugacauugugaaaucuccucaagagaaccuccgcgaacccaagagaaagcgggggcgcccgccuuccaucgcccccacagcggucgauagcaauucucagacccugcagccuauuacgcuugagcugagacggagaaaaaucuccaagggaugcgaaguuccccucaaacgcccccggcuggacaagaacagcucccaggagaaaucuaagaauuacagcgaaaacaccgauaaggaccuuuccagacgccggagcucuagacuguccacaaacggcacccaugagauucucgauccugaccugguggugagcgaucuggucgacacagacccgcuccaagauacccugucuagcacgaaagaguccgaagaggggcagcuuaagucugcccuggaagcuggacaggugagcuccgcccucacaugucacagcuucggcgacgggucuggagcugccggccuggagcuuaauugccccuccaugggcgagaacaccaugaaaacagaaccuaccagcccccugguugagcuccaagaaaucucuaccguggaggucacaaauacguuuaagaaaaccgaugacuucggguccagcaacgcgccugccguggaucuggaccauaaguuucgcuguaaaguuguggauugccugaaguucuuucggaaggcuaaacuccugcacuaccacaugaaguauuuccauggaauggaaaaaucccuugagcccgaggaaucuccgggcaagagacacguccagacacgcgggccuagcgccuccgacaaacccucucaggagacccugacacggaagagagugagcgcuuccagcccuaccacgaaggauaaagaaaagaauaaagagaagaaauucaaggaauuuguccgcgugaagcccaaaaagaaaaagaaaaagaagaaaaagacaaaaccugagugucccugcucugaggaaaucuccgacaccagccaggagccgucuccucccaaggccuucgccguuacccgguguggauccagccauaaacccggcgugcacaugucuccucaacuccaugggccggaaagcggacaccacaagggcaaagucaaggcucuggaggaagauaaccuuuccgagucuagcuccgagagcuuucugugguccgacgaugaauacggccaggacguggacguuacaaccaaucccgaugaggaacucgacggggaugacagauaugauuucgaggugguccggugcauuugcgaggugcaggaagagaacgacuuuaugauccagugugaagagugccaauguuggcagcauggagugugcaugggccugcuggaagagaauguuccugagaaguacacauguuaugucugccaggaucccccugggcagcgccccggauucaaauacugguaugacaaggaauggcucucuagaggccacaugcaugggcuggcguuucuugaggaaaacuacagccaccaaaaugccaaaaagauuguggcuacgcaccagcugcucggcgaugugcagcgggucaucgaggugcugcauggacugcagcuuaaaauguccauucuccaaucuagagaacacccugaccugccccuguggugucagccguggaagcagcauagcggcgaggggcgcucccacuuccggaacaucccuguuaccgauacaagaucuaaggaggaagcccccagcuaccgcacccucaauggagccguggagaaaccuagaccccuggcccuuccgcugccucgguccgucgaagagagcuauaucacaucugaacauugcuaccaaaagccccgcgcuuauuacccugcgguggagcagaaacucguuguggagaccagaggcuccgcucuggacgaugccgucaacccccugcacgaaaauggggacgacagccuuucuccccggcucggauggccucuggaucaggaccgcuccaagggcgauagcgacccgaaacccgggucuccuaaggugaaggaguauguuuccaaaaaggcccugcccgaagaggcuccugccagaaaacuccuggaucggggcggagagggccuucugagcucccagcaccaauggcaguuuaaccuccugacgcauguggaaagccugcaggacgaggucacccaccgcauggauucuauugaaaaggagcuugacgugcucgaaagcuggcuggauuacacaggggagcuggagcccccugaaccgcucgcuagacugccccagcuuaaacauuguaucaagcaacugcucauggaccugggaaaggugcagcagauugcccugugcuguuccaccuga

SEQ ID NO: 73695 - RNA, 2043 nt, Artificial Sequence
  derived and/or modified sequence opt5 from PHF21A__Homo_sapiens__NP_001095272
auggagcugcagacccuccaagaagcccugaagguggagauccagguccaccagaaacuuguugcucagaugaagcaagacccccagaacgccgaucugaaaaagcagcuccaugaacugcaggcgaaaauuacagcucuuagcgagaagcaaaagagagugguggaacagcugcggaaaaaucucaucgucaagcaggagcagccugacaaauuccaaauucagccgcugccccaguccgagaacaagcugcaaacggcccagcagcagccucuccaacagcugcagcagcaacagcaguaccaccaucaccaugcccagcaaucugcugccgcuagccccaaucuuaccgccucccagaaaacagugaccacagcgucuaugaucaccacaaagacccugccucucguucugaaggccgcuacggccaccaugcccgcuagcguggucggccagcgcccuacaauugccauggugaccgcgaucaacucccagaaagccguucuuucuacagaugugcaaaauaccccggucaaccugcagacgagcuccaaggugacagggcccggagcugaagccgugcagaucgucgcuaaaaauaccguuacacucgugcaagccaccccuccccagccuauuaaggugccccaguuuaucccgccucccagacugaccccucggcccaacuuccugccccagguccgcccuaaaccgguggcccaaaauaacauucccaucgcuccugcgcccccucccaugcucgccgcuccgcagcugauucagagaccuguuaugcuuacaaaguuuacgcccaccacacugccuaccagccaaaauucuauccaccccgugcgggucgugaacggccagacagccaccauugccaaaacguucccuauggcucagcucacauccaucguuaucgccacccccgggacccgccuggcgggaccgcagacagugcagcuuagcaagccuucucuggagaagcaaaccgucaaaucccacacagaaacggacgagaagcagaccgagagcagaacaauuaccccucccgcugcccccaaaccgaagcgggaagagaauccccagaaacucgccuuuauggugucucugggccuggucacacaugaucaccucgaagagauccaauccaagcgccaggaaagaaagcggcgcaccacggcuaacccuguguauagcggggccguuuucgagcccgagcggaaaaaguccgcugugaccuaccuuaauucuacaaugcauccuggaaccagaaaacgcggcagacccccuaaguauaacgccguccugggcuuuggggcgcugacacccaccagcccgcaguccagccacccugacucucccgaaaacgagaaaacggaaacaaccuucacauuuccugcccccgugcagccgguuucccucccuagccccaccucuaccgauggagacauucacgaggauuucugcagcgugugucggaaguccggccaacugcuuaugugcgacacauguucuagagucuaccaucuggauugccucgacccuccccugaagacgauccccaaagggauguggauuuguccucgcugccaggaucagaugcugaagaaagaagaggcuaucccguggcccggaacccucgccaucgugcacagcuauauugcuuacaaggccgcgaaagaggaagagaagcagaagcugcuuaaaugguccagcgaccugaagcaagaacgggagcagcucgaacagaaagugaagcagcugucuaauuccaucagcaaauguauggagaugaagaacacaauucuggccagacaaaaagagaugcauucuucccuugaaaagguuaagcagcucauccgccugauucacggcaucgaccugagcaaaccugucgauuccgaggcuaccgugggggccaucucuaauggacccgacugcacaccucccgcuaacgccgccaccagcacgccugcuccgucccccucuagccaguccuguacagcgaauugcaaccagggcgaagagaccaaguga

SEQ ID NO: 73696 - RNA, 1200 nt, Artificial Sequence
  derived and/or modified sequence opt5 from PHF23__Homo_sapiens__NP_001271447
augcccggcgacugcagacgggauccuccgcccacccugaagccugagacacagcccccugaaaaacgcagacggacgaucgaggacuucaacaaguuuuguagcuucgugcucgccuacgcuggguauauucccccuuccaaagaagagucugauuggccggccagcggauccucuagcccccugcgcggcgaauccgcggcugacucugaugggugggacagcgccccuuccgaucuuagaaccauccaaacauuugucaagaaagccaagagcucuaagcggcgcgcugcccaggcuggacccacccagccugggcccccgagauccacauucagccggcugcaggccccugacucugcgacccuccuggagaaaaugaaacuuaaggauucccuguuugaccucgaugggcccaagguugccagcccucugucucccacaucccugacccacacgagcagacccccugcugcccucaccccggugccccugucccaaggagaccuuucucauccuccccgcaaaaaggaucggaagaaucgcaaacugggcccuggcgcuggggccggauucggcgugcucagacggccccgcccgacaccuggggacggagagaagagaagccggauuaaaaaguccaaaaagagaaaacugaagaaggcggaacgcggcgaccggcuucccccucccgggccuccccaggccccgccuagcgauaccgacucugaggaagaggaggaagaggaagaggaagaggaggaagaggaaauggcuacagucgugggaggcgaggcccccguucccgugcugccuaccccgcccgaagcuccuagacccccugccacgguccaccccgagggcgugccucccgccgauuccgagagcaaagaaguugggucuacagagaccagccaggacggagaugcuuccucuagcgaaggcgagaugcgcgugauggacgaagauaucauggucgaguccggggacgauagcugggaccucauuacaugcuacugucggaagccguuugcgggaagaccuaugaucgagugcucucuguguggcaccuggauccaucuguccugcgccaaaauuaagaaaaccaacgugcccgauuucuuuuauugucagaagugcaaggaacuccgcccugaggcucggagacugggcggacccccgaaaagcggcgaaccuuga

SEQ ID NO: 73697 - RNA, 3291 nt, Artificial Sequence
  derived and/or modified sequence opt5 from PHF2__Homo_sapiens__NP_005383
auggccaccgugcccgucuacugcguuuguagacugccuuaugacgugacacgguucaugaucgagugcgaugcuuguaaggacugguuucacggcagcugcgugggggucgaagaggaagaggccccggauauugacaucuaccauugucccaacugcgaaaagacgcacggaaaguccacccucaaaaagaaacgcacauggcauaagcacggcccugggcaggcgcccgaugugaagccuguucaaaauggaucucagcuguucauuaaagagcuuagaagccggaccuuucccuccgcugaggacguggucgcccgcgugccuggcucucagcugacacucggguauauggaggaacauggauucaccgaaccgauccugguucccaagaaagauggccuuggccuggccgugccugcucccacauuuuacgucagcgacguggagaacuauguggggccugagagauccgucgauguuaccgacgugacgaagcagaaagauuguaagaugaagcucaaagaguucguggacuacuauuacucuaccaaucggaagcgcguccugaacgugacaaaucuggaauuuagcgauaccagaauguccagcuucguugaacccccggacauugugaaaaagcucucuugggucgagaacuacuggccugacgaugcccugcuugcuaaacccaaggugacaaaauauugccugaucuguguuaaggacuccuacaccgauuuucacaucgacagcggaggcgccucugcgugguaucacgugcucaagggggaaaagacguucuaccugauucggccugccuccgcuaauaucagccuuuaugagcgcuggagaucugccuccaaccauagcgagauguuuuucgcugaucaagucgacaagugcuacaaauguauugugaagcagggacagacacuguuuauccccuccggcuggauuuaugccacccucacacccgucgauugccuggcguucgccgggcacuuccugcauucucucagcguggaaaugcagaugcgggcuuacgagguugaacgcagacugaaacuuggaucccugacccaauuuccuaauuucgagaccgccugcugguacaugggcaagcaccuccuggaggcuuuuaagggcagccacaaaucugggaagcagcuuccgccccaucuggugcagggagccaaaauccucaacggcgccuuccgguccuggacaaagaaacaggcucuggcggaacacgaggacgaacugccugagcauuuuaagcccagccaacucauuaaggaucuggccaaagaaauccgccuuucugagaaugcuagcaaggccgucagaccugaagugaacacgguugccuccucugacgaggugugugauggggaccgggagaaagaggaacccccgagcccuaucgaagcuacacccccucagucccugcucgagaaggucagcaaaaagaagacacccaaaaccgugaagaugccuaaacccucuaagauuccgaaaccucccaagcccccuaaaccgcccagaccucccaagacacugaaacuuaaagacggaggcaagaaaaaggggaaaaagucccgcgagagcgccucuccuaccauccccaaucuggaucuccuggaagcgcacacgaaggaggcucugacaaaaauggaaccucccaagaaaggaaaggccaccaaauccgugcucagcguuccgaacaaggacgucgugcauaugcagaaugauguggagcggcuggaaauuagagagcaaaccaaguccaaaucugaggccaaguggaaauauaagaacagcaaaccugacucccuucugaagauggaagaggaacagaagcucgagaaaucuccccuggcuggcaacaaggauaauaaauucagcuuuuccuucagcaacaagaaacugcuuggcucuaaggcccuccgcccucccacauccccgggggucuuuggagcucugcagaauuucaaagaagacaagccuaagcccgugcgggaugaguacgaguauguuagcgacgauggcgaacugaaaaucgacgaguuuccuauuagacgcaagaaaaacgcccccaagcgggaucucucuuuccugcuugacaaaaaggcggugcugcccaccccugucacaaagccgaaacucgauuccgccgcuuacaagagcgacgacucuagcgaugaagggucccugcacaucgacacggauaccaaacccggaagaaaugcccgcgugaagaaagagagcgggucuuccgcugccggcauccuggaccuucuccaggcgagcgaagagguuggcgcccuggaguauaacccuuccucucaacccccugcuagccccuccacacaggaagccauucagggaaugcugucuauggcuaaucuccaggccagcgauuccugccugcaaaccacauggggcgccgggcaggcuaagggaucuagccuugcggcccacggcgcucggaagaacgggggaggcuccgggaaaagcgccggcaagagacugcucaaacgcgccgcuaaaaauucuguggaccuggaugacuacgaggaggaacaggaucaucuggacgccuguuuuaaagauuccgacuaugucuacccuagccuugagucugaugaagacaacccgaucuucaagucccggagcaagaaaagaaagggaucugacgaugcgcccuacuccccuaccgcucgggugggccccagcguuccucgccaggacagacccgugcgggaggggacgagagucgccuccauugaaaccggacucgccgcugccgcggcuaaacugagccaacaggaggaacagaagucuaaaaagaagaaaagcgccaagcgcaaacugacaccgaauaccacauccccuucuaccagcacguccaucucugccggcacaaccagcacauccaccacccccgcuucuacaacgcccgccagcaccaccccugcuuccaccagcacagccucuucccaggcgagccaagaggggucuucccccgagccuccgcccgaaagccacuccucuagccucgccgaucaugaguauaccgcugccggaacguucacaggcgcucaggccgggcggaccucccagccuauggcccccggcguguuucugacccaaagacgcccuagcgcuucuucccccaacaauaacacagcggccaagggaaaaagaaccaagaaaggcauggcuacagccaagcagcggcuugggaagauucugaaaauccaccgcaauggaaagcuccugcuguga

SEQ ID NO: 73698 - RNA, 2211 nt, Artificial Sequence
  derived and/or modified sequence opt5 from PHF3__Homo_sapiens__NP_001277189
auggacaucguggauaccuucaaccaccugauucccacagagcaucucgacgaugcccuguuucuuggcagcaaucuggaaaacgaggucugcgaagacuucuccgcuucucagaauguucucgaggauagccugaagaacaugcuuuccgacaaagauccuaugcuggggucugccagcaaucaauuuugucucccggugcuggacuccaacgaucccaauuuccagaugccuugcucuacgguggucggacuggacgauaucauggacgaaggcgugguuaaggagagcgggaacgauaccauugacgaggaggagcucauccugcccaauagaaaccuucgggacaaaguggaagaaaauuccguccgcagcccuagaaagucuccccggcugauggcgcaggaacaggugcgcucccucagacaaagcacaauugcuaaacggucuaacgccgccccucuguccaauaccaagaaggcuagcggaaaaacaguuucuaccgccaaggcuggcgugaaacagccggaacgcucccaggucaaggaggaaguguguaugagccuuaaacccgaguaccacaaggaaaacagacggugcucccgcaauucugggcagaucgagguggucccugagguuagcguguccagcucucauuccagcgugucuagcugucuggaaaugaaggaugaggacggacucgauuccaaacacaagugcaacaaccccggcgaaaucgacgucccuucucaugagcugaauuguagccugcucuccgaaacaugcgugaccauuggcgagaaaaagaacgaggcccugauggaauguaaagcgaagcccguugggagcccgcuuuuuaaauucucugauaaggaggaacacgagcaaaaugacuccaucagcggaaagacgggcgaaaccguggucgaggagaugauugccacaagaaaaguggaacaggauucuaaggagaccguuaaacugucccacgaagacgaucauauccucgaggacgcugggagcuccgauauuucuagcgacgccgcuugcacaaacccuaauaagaccgagaacucccuggugggacuucccucuugugucgacgaagugacggagugcaaucuggaacucaaagauacaaugggcaucgccgacaagaccgagaacacacuggaacggaauaagauugagccucugggguauugcgaggaugcggaaagcaaccgccagcucgaguccaccgaauuuaauaaaagcaaccuggaggucguggacaccucuacauucggacccgaauccaauauccuugagaacgccaucugugauguucccgaccagaauagcaagcaacugaacgcuauugagucuacgaaaaucgaaucccacgagaccgccaaccuccaggaugacagaaauagccagucuagcuccgugagcuaccuggaaucuaaguccgucaaaagcaagcauacaaagccugugauucacuccaaacaaaacaugaccacagaugcuccgaagaaaaucguugccgccaaguaugaggugauucacucuaaaaccaaggucaaugugaaaagcgugaaacggaacacggacguucccgaaucccagcagaauuuucaucgcccugucaaggugagaaagaagcagaucgauaaagagcccaagauccaaucuugcaacagcggcgugaaauccgucaagaaucaggcucacucugugcuuaagaaaacacugcaggaccagacccucguucaaauuuucaagccucugacccauagccuguccgauaaaagccacgcgcaucccggcugucucaaggagccgcaccacccugcccagacagggcaugugucucacuccagccagaaacagugccauaagccccaacagcaggcuccugccaugaagaccaacucucacgucaaagaggagcuggaacaccccggaguggagcauuuuaaggaggaagacaaacuuaagcugaaaaagccugagaagaaucuccagccccggcaaagacgcuccagcaaaucuuucucccuggacgaaccgccucuguuuauccccgauaacauugccacaauccggagagagggcagcgaccacuccagcucuuucgaaagcaaguacauguggacgcccuccaaacaguguggguucugcaagaaaccucauggaaaucgcuguguuugcauguguguguga

SEQ ID NO: 73699 - RNA, 333 nt, Artificial Sequence
  derived and/or modified sequence opt5 from PHF5A__Homo_sapiens__NP_116147
auggccaagcaccaucccgaccugaucuucugcagaaaacaggcuggcguggccauugggcggcucugugagaagugcgauggaaaaugugucaucugcgacagcuacguucgcccuuguacccuggugagaauuugcgaugaauguaacuauggcuccuaccaagggcggugcgugaucuguggaggcccgggggucucugacgcguauuacugcaaggaguguacaauucaggaaaaagaucgcgacggaugccccaagaucgugaaucuuggcagcuccaagacggaucuguuuuaugagcggaaaaaguacggcuucaaaaagagauga

SEQ ID NO: 73700 - RNA, 939 nt, Artificial Sequence
  derived and/or modified sequence opt5 from PHF6__Homo_sapiens__NP_115711
augagcuccucuguggagcagaagaaaggccccaccagacaacggaagugcggguucuguaaaagcaaccgcgacaaggaaugcggacagcugcucaucuccgagaaucagaaagucgccgcucaccauaaguguaugcuguuuucuagcgcccuuguuuccucucacagcgauaacgaaucccugggcggguucagcauugaggacgugcagaaggaaaucaaaagaggaacaaagcucaugugcucucugugucauugcccuggcgcgacgauugggugugaugugaaaaccugccaccggacauaccauuaucacugugcccuucacgacaaggcucaaauccgcgagaaaccgucccagggaauuuacauggucuauugcagaaagcauaagaaaaccgcccacaauagcgaggcugccgaucuggaagagucuuuuaacgaacaugagcucgagcccuccagcccuaagucuaaaaagaaaucccggaagggccgccccagaaaaacaaauuucaagggccugagcgaagacacccgguccacaucuagccacgggaccgaugagauggaauccagcucuuaccgcgacagauccccucaccggagcucucccagcgauacgcgcccuaaguguggauuuugccaugugggcgaggaagagaacgaggcuagagggaaacugcacaucuucaaugccaagaaagcggccgcucauuauaagugcaugcucuuuuccucuggaaccguucagcugacaaccacaagccgggccgaguucggcgacuuugauaucaaaaccgugcuucaggaaauuaagcgcgggaagagaauggucuguuccuucuacaucugcuaugcuacgcugcaccucauuuguugcuuuaaauuccgggugcauccgaaguuuauccaaagcucugaaaaccugaaauga

SEQ ID NO: 73701 - RNA, 3183 nt, Artificial Sequence
  derived and/or modified sequence opt5 from PHF8__Homo_sapiens__NP_001171825
augaacagaagccgggccaucgugcagcgcggcagaguccugcccccuccggcuccccucgacaccacaaaucuggccgggcggcgcacgcuucaaggcagagcgaagauggcuuccguuccuguguacugccugugucggcuccccuaugaugugacccgcuucaugauugagugcgacaugugucaggauugguuucacggaucuugcgucgggguggaagaggaaaaagccgccgacaucgaucuguaccauuguccuaacugcgagguucuucacggacccagcauuaugaagaaaagacggggcuccucuaaggggcaugacacacacaaaggaaagccugugaagaccggcagcccgacauucguccgcgaacugagaucccggaccuuugauucuagcgacgaggugauccucaaacccacaggcaaucagcugaccguugaguuccuggaagagaacuccuuuagcgugccuauucucguccugaagaaagaugggcuuggaaugacgcugcccucuccuuccuucaccgugcgcgacguggaacauuaugucggcagcgauaaggagaucgacguuaucgaugugacaagacaggcugacuguaaaaugaagcucggggacuuugugaaguacuauuacucuggaaaacgggagaagguccugaaugugauuucccuugaguucagcgauacccgccugucuaaccucguugagacacccaaaaucgugagaaagcuguccugggucgaaaaucuguggccggaggaaugcguguuugagcggccuaacguucaaaaauauugucucaugagcgugagagacuccuacaccgauuuccacauugacuuuggcgggacgucugucugguaccacgugcugaagggagagaaaaucuucuaucuuauucgccccacaaaugccaaccugacccucuuugaaugcuggagcuccagcucuaaucagaacgagauguucuucggcgaucaggucgacaaguguuacaagugcuccgugaaacagggccaaacacuguuuaucccuaccggguggauucaugcuguucuuacccccguggauugccuggccuucggaggcaauuuucuccacagccugaacaucgaaaugcagcugaaggcguaugagaucgaaaaacggcucucuacagccgaccuguucagauuucccaauuucgagacgauuuguugguacgucgggaagcauauccuugauauuuuucgcggacugcgggagaacagacgccacccugcuagcuaucucgugcacggcgggaaagcccugaaccuugcuuuccgggccuggaccagaaaggaagcgcugccggaccaugaggaugaaauccccgagacaguucgcaccgugcagcucauuaaggaccuggcccgggaaaucagacuggucgaggacaucuuucagcaaaaugugggaaaaacauccaacauuuucggccuccagcgcaucuuuccugcuggcucuauuccccugacccggccugcccacagcacguccgugagcaugucuagacuuucccugcccagcaagaaugggucuaaaaagaaaggacucaagccgaaggagcuguucaaaaaggcugaacggaaaggcaaggaguccagcgcccuggggccugccggacagcuuuccuacaaccucauggauacauauucucaucaagcucugaaaaccggcagcuuucagaaggcgaaguucaauaucaccggggccugccugaacgacuccgaugacgauucucccgaccucgaucuggacggcaaugaaagcccucuugcucugcucauguccaacggaagcacaaaacgcguuaagucucuguccaaaagcagacggaccaagauugccaaaaaggucgauaaagccagacugauggcugaacaggugauggaggacgaguucgaucuugacucugaugacgaacuccagaucgacgaacgccugggcaaggagaaggccacacugaucauucggcccaaauuuccuagaaagcucccccgcgcgaaaccguguuccgauccuaauagagugcgggaacccggggaggucgaguucgacaucgaagaggauuacacgaccgacgaagauaugguggagggaguugaaggcaagcuggggaacggaagcggcgcugggggcauucuugaccugcucaaagccucucgccaagugggaggccccgauuacgccgcucugacagaggccccugcuagcccguccacccaggaggccauccaggggaugcugugcauggcgaaucuucagucuagcuccagcucccccgccacaucuagccuccaggcuugguggaccggaggccaagacagauccucugggagcuccucuagcggacugggcacggucuccaacagcccugccucucagcggacccccgggaagcgcccuauuaagagacccgcuuauuggcggacagaauccgaggaagaggaagagaaugccagccuggaugagcaggacucucucggcgcguguuuuaaagaugccgaauacaucuauccuucccuggagagcgacgaugacgaccccgcucuuaagucucgcccgaaaaagaaaaagaacuccgaugacgccccuuggagccccaaggcuagagugaccccuacacugcccaaacaagaucggccgguucgcgaaggaaccagaguggccuccauugagacgggccucgccgcugcggccgcuaagcuggcccagcaggagcugcagaaagcccaaaagaaaaaguacaucaagaaaaagccucuucucaaagaagucgagcagccccggccucaggacagcaaucugucucugacagugcccgcucccaccguugccgcgacaccucaacucgugaccagcuccucuccgcugcccccucccgaaccuaagcaggaggcucuuagcgggucccuggccgaucacgaauauaccgccagacccaacgcuuucggaauggcccaggcgaaccgcucuacaacgccuauggcuccgggcgucuuucucacccagcggagacccagcguggggucccaaucuaaucaggccggacagggcaaacgcccuaagaaagggcuggccacagcuaagcagcggcugggcagaauccuuaagauucaucgcaacggaaaacugcuccuguga

SEQ ID NO: 73702 - RNA, 1308 nt, Artificial Sequence
  derived and/or modified sequence opt5 from PHGDH__Homo_sapiens__XP_011539533
augcugugguucaagagaagcucuccccucuccaccgcccaccaugaccugacacaccagcggcaaaucccucaggcuacggccagcaugaaagauggcaagugggagcgcaaaaaguuuauggggaccgaacuuaacggaaaaacacugggcauucucgggcugggaagaaucggccgggagguggcgacccgcaugcaguccuucgggaugaagacaauuggauacgacccgaucauuucucccgaagucagcgcuuccuuuggcguucagcaacuuccucuggaggaaaucuggccccucugcgauuucaucaccgugcauacaccucugcugcccucuaccacgggccuccugaaugacaacaccuuugcccaguguaagaaaggggugagagucgugaauugcgcccggggaggcauuguugaugagggggcccuucugcgcgcucuccagagcggacagugugcuggcgccgcgcuggacguguucacagaggaaccuccgagagaucgggcccuugucgaccacgagaacgugaucuccugcccccaucugggggcuagcaccaaggaagcccaaucucgcuguggagaggagauugcuguucaguuuguggauauggucaaaggcaagucccucacaggcguggugaaugcccaggcgcugaccagcgccuucucuccucacacgaaacccuggaucgggcuggcugaagcccucggaacacugaugagagcuugggccggcuccccuaaggggaccauucaggucaucacacaaggaaccagccuuaagaacgccggcaauugccugucucccgcuguuauuguggggcuccugaaagaggcguccaagcaggccgacgugaaccuugucaaugcuaaacugcucgugaaggaagccggacugaacguuaccacaagccacuccccggccgcuccuggcgagcagggcuuuggggaaugucugcucgccguggcgcuggcuggagcccccuaucaagccgucggccuugugcaggggacgaccccuguucugcagggacucaauggcgcuguguuccggcccgaggucccccugcgcagagaucuuccucugcuccuguuucggacacagaccucugacccggccaugcugcccacaaugaucgggcuccuggcugaggccggcgugcgccuucugagcuaccaaaccucccucgucagcgauggagaaacguggcaugugaugggcaucucuucccugcugccuagccuugaggcguggaaacagcacguuacagaagccuuccaguuucauuucuga

SEQ ID NO: 73703 - RNA, 5466 nt, Artificial Sequence
  derived and/or modified sequence opt5 from PHIP__Homo_sapiens__NP_060404
auguccugcgagagaaagggccuguccgaacuccggucugagcuguacuuccuuaucgcucgcuuucuggaagacgggcccugucagcaagcugcccaggugcucauuagagaggucgcggaaaaagagcugcuuccucggcgcaccgauuggacaggaaaggagcacccgagaacguaucagaaucugguuaaauacuaucggcaccucgcucccgaccaucugcugcagaucugccaucgccucggcccucugcuugaacaagagauuccccagagcgugccuggggugcagacccugcucggagccggcagacagucccugcuucggacaaauaagucuuguaaacacgucguguggaaggggagcgcccuggcugcccuccauugcggaagacccccugaauccccgguuaacuacggcucucccccuagcaucgcugauacccuguucuccagaaagcugaauggcaaauaucggcucgagcgccuggugcccacagccgucuaccaacacaugaagaugcacaaacgcauucuugggcaucugagcucuguguauuguguuaccuuugaccggacaggacgcagaaucuucaccggcuccgaugacugccucgugaagaucugggcgacggaugacgggcggcugcuugccacccugagaggacacgcugccgagauuagcgauauggcugucaacuacgaaaauacaaugaucgccgcgggcucuugugacaaaaugauucgcguguggugccuccggaccugugccccucuggcugugcugcaggggcauuccgccagcaucacaucucuccaguuuagcccccugugcagcggauccaagagauaccuuucuagcaccggcgcugauggcacgauuuguuucuggcugugggacgccgggacacucaagaucaacccgcgcccugccaaauuuaccgagcggcccagaccuggaguccagaugauuugcuccagcuucucugcuggcgggauguuucuggcgacaggauccaccgaucacaucauccgcguuuauuucuuuggcagcgggcaacccgaaaagauuucugagcuugaguuccacaccgacaaaguggacagcauccaguuuuccaauacaucuaaccgguucgugagcggauccagagauggcacggcccgcauuuggcaguucaagcggagagaguggaaaagcauccugcucgacauggcuacccgccccgccggccaaaaucugcaggggauugaggauaagaucacaaaaaugaaggucaccaugguggccugggaccggcaugauaacacaguuaucaccgcugugaauaacaugacgcugaaggucuggaacucuuacacaggacagcucauucacgugcugaugggccaugaagacgagguuuuugugcuugaaccucacccguucgaucccagaguccuguuuuccgccgggcaugacggaaacgugaucgucugggaucucgcgcggggcgugaaaauucgcagcuauuucaauaugaucgaggggcagggccacggagcuguuuuugacugcaaguguucuccugauggccaacacuucgccugcaccgacucccaugggcaucugcugauuuuuggauucggcagcuccucuaaauacgacaagaucgccgaucagauguuuuuccacagcgacuauagaccccuuauccgggaugcuaacaacuuugugcucgacgaacagacccagcaagccccucaccugaugcccccgccuuuccuggucgauguggacgggaauccccacccuuccagauaccagcgccucguucccggacgggagaacuguagagaggaacagcugauuccucagaugggcgugacaucuagcgggcuuaaucaaguccugucccagcaggcuaaccaggagaucagcccccucgauucuaugauucaacgccugcagcaggaacaagaccugagacgguccggcgaggccggaaucagcaauaccucucgccuuuccagaggcagcauuucuagcacauccgaagugcauagcccgccuaacguggggcuccggcgcucuggacagaucgagggcguuagacagaugcacuccaaugcgccccggagcgagauugccacggaacgcgaucuggucgcuugguccagacggguggugguccccgagcugucugccgggguggcuagccgccaggaagaguggagaaccgccaaaggagaggaagagaucaagacauaucgguccgaagagaagagaaaacaucucaccguuccuaaggaaaacaaaaucccgacagugucuaagaaucacgcgcaugagcacuuucuggaccuuggcgagagcaaaaagcaacagaccaaccagcacaauuaccgcacgcgguccgcccuggaagagacccccagaccuucugaagagauugaaaacgggagcuccagcucugaugagggcgaggucguggcuguuuccggaggcacaagcgaagaggaagaaagagccuggcauucugacggguccagcucugauuacuccagcgacuauuccgacuggaccgcugaugccggaaucaaucuccagcccccuaagaaagugcccaagaacaaaacaaagaaagccgaaagcucuagcgacgaggaggaagaguccgaaaagcaaaagcagaaacagauuaagaaagagaagaaaaaggucaaugaggaaaaagauggcccuaucucucccaagaagaaaaagccgaaagagcggaagcagaaaagacuggcugugggggaacugaccgagaacggacuuacgcucgaagaguggcugccuagcacauggauuaccgacacaaucccccgccggugcccuuucguuccccaaaugggcgaugagguguacuauuucagacaggggcacgaagcguacgucgagauggcccgcaagaacaagaucuauuccauuaauccgaaaaagcagccuuggcauaaaauggaacugcgggagcaagaacucaugaagaucgugggcauuaaauacgaggugggacugcccacccuuuguugccugaagcucgcuuuucuggacccugauaccggcaagcugacagggggaucuuucacgaugaaauaucacgacaugcccgaugucaucgacuuucuuguucucagacagcaguucgaugacgccaaguaccggcgcuggaacauuggcgauagauuucggagcgugaucgacgacgccuggugguucgggaccaucgagucccaggaaccccugcaacuggaguacccugauucucucuuucaguguuauaaugugugcugggacaacggagauacagagaaaaugagcccgugggacauggagcugauucccaauaacgcugucuucccugaagaacuuggcaccuccgugccccugacagauggcgagugucgcagccucaucuacaagccucuggacggggaauggggaaccaaucccagagaugaggaaugcgagcggauuguugccggcaucaaccagcugaugacgcuugacauugcgucugcuuuuguggccccugucgaucugcaggccuauccgauguacuguacagugguugcuuaucccaccgaccucuccaccaucaaacaaagacuggagaaucgcuucuaccggagagugagcucucucaugugggaaguccgcuauaucgagcauaacacacggaccuuuaaugaaccugggucccccauugugaaguccgccaaguucguuacagaucugcuucugcacuuuaucaaagaccagacgugcuacaacauuaucccucucuacaauuccaugaagaaaaaggugcugucugacagcgaggaugaagagaaagacgcggauguccccggaaccuccacaagaaagcgcaaagaccaccagccgcggagacgccugagaaaccgggcucagagcuaugauauucaagccuggaagaagcagugcgaggaacuucugaaucucaucuuccagugugaggacucugaaccuuuccgccagcccguggaucugcucgaguaccccgacuauagagauauuaucgacaccccuauggauuuugccacagugcgggaaacccuggaggcuggcaacuacgagucccccauggaacuuugcaaagacguccgccugaucuucagcaacucuaaggccuauacgccuagcaaaagaucccggauuuacucuaugagccucagacuguccgccuuuuucgaggaacauaucucuagcguucuguccgauuauaagagcgcccuucgcuuucacaaacggaauaccauuacaaagagacgcaagaaacggaacagaucuuccagcguguccucuagcgcggccuccucuccggagcggaagaaacgcauccugaagccccaacucaaaagcgaauccagcaccucugcuuucuccacaccuaccagaagcauucccccucggcauaaugccgcucagaucaacgggaagacagagucuuccagcgugguccgcaccagaucuaaucgggugguuguggaccccgucgugacggagcagccgagcacauccucugccgccaagaccuuuaucaccaaagcuaacgcgagcgccauuccuggaaagacaauccuggaaaauuccguuaaacacagcaaggcucucaacacccuguccucucccggccaaagcuccuucucucacggcacgcgcaauaacagcgccaaagagaauauggaaaaggagaagccugugaaaagaaagaugaaauccucuguccuucccaaggccagcacacuguccaaaagcucugcugugauugagcagggggacuguaagaacaaugcccuggucccuggaaccauccaggugaacggccaugggggacagcccuccaagcucguuaaacggggcccggggcgcaagccuaaaguggaagucaauacaaacagcggagagauuauccacaagaaaagaggccggaagcccaaaaagcugcaauacgcgaagcccgaagaucuugagcagaacaaugugcauccuaucagagacgaaguucugccgucuucuaccugcaacuuucucagcgagacaaauaacgugaaagaggaucugcuccagaagaaaaaucgcggcgggcggaagcccaaaagaaagaugaagacccagaaacuggacgcugaucuucuggucccugccagcgugaaggugcugcgccgguccaaccgcaaaaagauugacgaucccaucgacgaagaggaagaguucgaggaacucaaaggaagcgagccucacaugcgcacgcggaaucaaggcagacgcaccgccuuuuacaacgaagaugacuccgaggaggaacagcggcagcugcuuuucgaagauacaagccugaccuucgggacaucuagcagaggacgcguucggaagcucaccgagaaggcuaaagccaaucugauuggcugguga

SEQ ID NO: 73704 - RNA, 3633 nt, Artificial Sequence
  derived and/or modified sequence opt5 from PHKA1__Homo_sapiens__NP_001116142
augagaagccgguccaacucuggcgugcgccuggacggguacgccagacucguccagcaaaccauccugugccaccagaaucccguuacaggacuucugccugcuagcuaugaucagaaggacgccugggugcgggauaacguguacuccauucucgcggucuggggccuggggcuugcuuaucgcaaaaaugccgacagagaugaggacaaggccaaggcuuacgaacuggagcagucugugguuaagcucaugcggggacugcugcauuguaugauccgccaaguggauaaagucgagagcuucaaguauucccagucuacgaaggacagccuccacgccaaauacaacaccaagacaugcgcuaccgugguuggcgaugaccagugggggcaucugcagcuugaugccacauccguguaucugcucuuucuggcgcaaaugaccgccagcggacuucacauuauccauucucuggacgaagucaauuucauucagaaccucguguuuuacaucgaagcugccuacaaaacagcugauuucggcaucugggagagaggcgacaagaccaaucaggggauuuccgagcugaacgccagcucugugggaauggcgaaagccgcucuggaagcccucgacgagcuggaucuuuuuggcgucaaagggggaccgcaguccguuauccacgugcuggcugacgaagugcaacacugucagagcauucucaauucucugcuuccccgggccuccacgagcaaggaggucgaugccucccugcucucugugguuagcuucccugcuuuugcgguggaggacucccagcuggucgaacugaccaaacaagagaucauuacaaagcuccagggccgcuaugggugcuguagauuccugcgggauggauacaaaacccccaaggaagacccuaaccgccuuuauuacgagcccgccgaacugaaacucuuugagaauaucgagugcgaauggccucuguucuggacauauuuuauucuugauggcguguucagcggcaacgcugagcagguucaggaauacaaggaggcccuggaagccgugcucaucaaagggaagaauggagucccgcugcugcccgagcucuauucugugccucccgacagagucgaugaggaauaccaaaacccucauaccguggaccggguucccaugggcaagcugccgcacaugugggggcagucccuuuacauccugggaagccucauggcugagggcuuucuggccccuggggaaauugauccccugaaucgcagauucucuacggugccuaaacccgacgucgugguucaggugagcauccuugcggagacagaagagauuaagaccauccucaaagacaagggaauuuaugucgagacaaucgcugaaguguaccccauccgggugcagccugcccgcauucugucccauaucuauucuagccugggcuguaacaacagaaugaaacucuccggccggccguacagacacauggggguucugggaaccagcaaacuuuaugauauucgcaagaccaucuucacauuuacgccccaauucauugaccagcagcaguuuuaccuggcccucgauaauaagaugaucgucgagaugcugcggaccgaccugucuuaucuuugcuccagauggcgcaugacaggccaaccuaccaucacauuccccauuagccacucuaugcucgaugaagacgggaccucccugaacagcuccauccuggcugcccuccggaagaugcaggauggauacuuuggcggggcuagagugcagacgggcaaacugucugaguuccuuacaaccagcuguugcacccaucuguccuuuauggacccuggacccgagggcaagcucuacucugaagauuaugacgauaauuacgacuaucuggagagcgggaacuggaugaaugauuacgacuccacaagccacgcccgcuguggagacgaaguggcgcgguaucuggaucaucuucucgcccacaccgcuccgcauccuaaacuggcccccacaucucagaagggcgggcuggacagauuccaagcugccguccagacgaccugcgaucucaugucccuggugacaaaggcgaaagagcuucacguucagaacgugcacauguaccugccuaccaagcucuuucaagccagccgccccucuuucaaucugcuggacuccccucauccccggcaggaaaaccaggucccgagcgugagaguugagauucaccuuccucgggaucagucuggagagguggacuuuaaagcucucguccugcaacugaaggaaacaagcucccuccaggagcaggccgauauccuguauaugcuuuacaccaugaaaggccccgacuggaauacggaacuguacaacgagcgcagcgcuaccgugagagaacuccugacagagcuguaugggaagguuggcgagauucggcauuggggacuuaucagauacauuucuggcauccugcgcaagaaaguggaagcccucgaugaggccugcaccgaccugcucucccaccagaagcaccugacagucgggcuucccccugaaccgcgggagaaaaccaucagcgcuccccugccuuaugaagcgcucacgcaacugauugaugaggccuccgagggagacaugucuaucagcauucugacacaggaaaucaugguguaccuugcuauguauaugagaacccagcccggccuguucgccgagauguuucgccucagaauugggcugaucauccaggugauggccacagaacucgcucauucccugcgguguucugccgaggaggcgaccgaaggacuuaugaaucugagcccuuccgcuaugaagaaccuccugcaccauauucugucuggcaaagaguucggggucgaacgcagcguuagacccaccgauuccaaugugagcccugccaucucuauucacgagaucggcgccgugggagcuacaaagacggaacggaccggcauuaugcaacuuaaauccgagaucaagcagagccccgggacaucuaugaccccguccagcggaucuuucccuuccgccuacgaccagcaaagcuccaaggacagccgccagggccaguggcagagacggcgcagacuggauggggcgcucaaccggguccccgugggauuuuaucaaaaaguuuggaaggugcugcagaaaugccauggccucucugucgagggguucgugcugccuagcuccacaacccgcgaaaugacgcccggcgagaucaaguuuucuguucacguggaaagcguccuuaauagagugccgcagccugaguaccggcagcugcugguugaagcuauucucgugcugacaaugcuugccgacaucgagauucacuccaucggaucuauuaucgccgucgagaaaaucgugcauauugcuaacgaucuguuccuccaagaacagaagacccugggcgccgacgauaccaugcucgcuaaggaccccgccagcgggaucuguacacugcuuuacgauuccgcgccuucuggaagauuuggcaccaugacauaucugagcaaagccgcugccacguacgugcaggaguuccugccccacuccauuugcgcuaugcaguga

SEQ ID NO: 73705 - RNA, 3708 nt, Artificial Sequence
  derived and/or modified sequence opt5 from PHKA2__Homo_sapiens__NP_000283
augagaagccgguccaacucuggcgugcgccuggacggguacgccagacucguccagcaaaccauccugugcuaucagaaucccguuacaggacuucugagcgcuucccacgagcagaaggaugccugggugcgggacaacauuuacucuauccucgcgguguggggccuggggauggcuuaucgcaaaaaugccgauagagacgaagauaaggccaaggcuuacgagcuugaacagaacgucgugaagcugaugcggggacuccugcaauguaugaugcgccagguugccaaaguggagaaguucaagcauacgcagagcaccaaagacucccugcacgcuaaguauaauacagcgaccugcggcacagucgugggggaugaccaguggggacaucuccaaguugaugccaccucucuguuucuucuguuccucgcccagaugacagcuagcggccugagaauuaucuuuacccuugacgaaguggccuucauucagaaccuggucuuuuacaucgaggcugccuauaaaguggcggauuacggcaugugggagcgcggggacaagacgaaucagggaaucccugaacucaacgccuccagcgugggcauggcuaaagccgcucuggaggccauugaugaacuggaccucuucggggcccacggaggccggaagucugucauccauguucugccggacgagguggagcacugucaauccauucuuuuuagcaugcugcccagagcuucuaccuccaaggaaaucgaugcggggcuccugagcauuaucucuuucccugccuuugcuguggaggacgucaaucuugugaacguuaccaaaaaugaaauuaucuccaagcugcagggacgguacggcugcugucgcuuccucagagauggcuauaaaacaccccgggaggacccuaaccgccugcacuacgaucccgccgaacugaagcucuuugagaauaucgagugcgaauggccuguguucuggacauauuuuauuaucgacggggucuucagcggagaugccgugcagguucaagaguacagagaagcucuggagggcauucuuauccgggggaaaaacggaauuagacuggugccggaacucuaugccgucccgccuaauaagguggacgaggaguacaaaaacccccauaccgucgaucgcgugccuaugggcaagguuccccaccugugggggcagucccuuuauauccugucuagccuccuggcggaaggauuccuggcugccggcgagaucgacccgcucaaccggagauuuuccacgagcgugaagccugaugucgugguucaggugacaguccuggccgaaaauaaccauauuaaagaccuucugcgcaagcacggcgugaaugugcagucuaucgcugacauucaccccauccaaguucagccugggcggauucucucccauaucuacgccaaacugggaagaaacaagaauaugaaccugagcggccgccccuaccggcacaucgggguccuuggaaccucuaaacucuaugugauuagaaaucagaucuucacauuuacaccccaguucaccgaucaacaucacuuuuaccuggcucuggacaacgagaugauuguggaaaugcuccgcaucgagcuggccuaucuuuguacaugcuggcggaugacgggcagaccuacccugacauucccgauuagccgcaccaugcucacaaaugauggguccgacauccauucugcgguccugagcaccauucggaagcuggaggauggcuacuuuggaggcgccagagugaaacuugggaaccucuccgaguuccugacgaccagcuuuuauaccuaccugaccuuccucgaccccgauugugacgaaaaacuguuugauaaugcuucugaaggaacauucuccccugacagcgauucugaccuuguuggcuaucuggaggauaccugcaaccaggagucccaggacgaacucgaccacuacaucaaucaucugcugcagagcacaucccuucggucuuaccugcccccucucuguaagaacacggaggaucgccacguguuuagcgccauccacuccaccagagacauucugucugucauggcuaaagccaaggggcucgaagugcccuucguuccgaugacacugccuaccaaagugcuuagcgcgcaucggaagucccugaaucucgucgauagcccccaaccucugcuggagaaggugcccgaaucugacuuccaguggccuagagaugaccacggagauguugacugcgagaaacuuguggagcagcucaaggauugcuccaaccugcaggaccaagccgauauccuguauauucucuacgucaucaaaggccccagcugggacacaaaccugucugggcagcacggcgugaccgugcagaaucuucugggagaacucuauggcaaggcugggcugaaccaagaguggggacugauucgcuacaucuccggccuucugcggaaaaaggucgaaguucucgccgaggcuuguacggaucugcucagccaucagaagcagcugaccguggggcuuccgccugaacccagagagaaaaucauuucugcuccccugccuccggaggaacucacaaagcugaucuaugaggccagcggacaggacauuuccaucgccgugcugacccaagaaauugucguguaccuugcgauguauguucgcgcccagcccagccuguuuguggagaugcucagacugcggaucggccucaucauucaggucauggcuacagaacuggcccgcucucuuaauugcuccggggaggaggccagcgaaucccugaugaaccucucuccuuucgacaugaaaaaucugcugcaccauauccuuagcggcaaggaguuuggaguggaaagauccguucggcccauucacucuagcaccuccucuccuacgaucagcauucaugaggugggccacacaggggucaccaaaacagagcgcuccggaaucaacagacugcggagcgaaaugaagcagaugacccgcagauucucugcugaugagcaauuuuucuccgugggccaggccgcgucuagcuccgcucacagcucuaaauccgcccggagcuccacccccagcucuccuacagggacgagcuccucugacagcggaggccaucacaucggguggggcgaacgccagggacaguggcucagacggagacgccuggauggcgccauuaaucggguucccgugggguuuuaccaaagagucuggaagauccuccagaagugucauggacuguccauugacggcuacgugcuuccgucuagcaccacacgcgagaugaccccucacgaaaucaaauucgcugugcaugucgaguccguucugaaccgggugccccagccugaguauagacaacugcucguggaagccauuaugguccugacacuucugucugauaccgagaugacgagcaucgggggaauuauccacguggaccagaucguucagauggcgucccagcucuuucugcaagaucaggugagcauuggcgcuauggacacacucgaaaaggaucaggccaccggcaucugccacuucuuuuacgacucugcccccuccggggcuuauggaaccaugacauaccugacccgcgccgucgcuagcuaucuucaggagcugcugcccaauucuggcugucaaaugcaguga

SEQ ID NO: 73706 - RNA, 3282 nt, Artificial Sequence
  derived and/or modified sequence opt5 from PHKB__Homo_sapiens__NP_000284
auggccggcgcugccgggcugaccgcggaggugagcuggaagguccucgaaagacgggcucgcacaaaaagauccggaucuguuuacgagccccugaaguccaucaaccuuccucggccggacaaugaaacgcugugggauaaacucgaccacuauuaccgcauugugaaguccacccugcuucuguaucagucucccacaaccggccucuucccuacaaaaaccugcgggggagaucaaaaggccaagauccaggacagccuguacugugccgcuggcgccugggcucuggcccucgcguauagacggauugaugacgauaaagggcgcacacacgagcuggaacacuccgccaucaagugcaugagaggcauucuuuacuguuauaugcggcaggcugacaaagugcagcaauuuaagcaggauccccgcccuaccacgugccugcauucugucuucaacgugcacaccggagacgagcuccugagcuacgaggaauacggccaucuucagaucaaugccguuucccuguaucuccuguaccugguggagaugaucagcucugggcuccagauuaucuauaacacagaugaagucuccuuuauucaaaaucugguguucuguguugagagaguguaccggguccccgacuuuggagugugggagcgcggcagcaaauauaacaaugggucuaccgaacuucacuccagcucugugggacuggcuaaggccgcgcucgaggccaucaacggcuucaaucuguuugggaaccagggaugcuccuggagcgucauuuucguugaucuugacgcucacaauagaaaccggcagacacuguguucccuccugccucgcgaaucuagaagccauaauaccgacgccgcucugcucccgugcaucuccuaccccgccuuugcccuggaugacgaggugcuuuucagccagacgcuggauaaggugguccggaaacucaagggcaaauauggcuuuaagagauuccugcgcgacggguaccggacaucucuugaagauccuaacagauguuacuauaaacccgcugagauuaagcuguuugacggaaucgagugcgaguucccuaucuucuuucucuacaugaugauugauggcguguuccgcgggaaucccaaacaaguucaggaguaucaggaccugcugaccccggugcuccaccauacaaccgaaggauacccugucgugcccaaguauuacuauguuccugcggauuuuguggaguacgaaaagaacaaccccggcucccaaaaacgguuccccagcaauugugggagagacggaaagcuguuucuuuggggccaggcccuguacaucauugcuaaacuccuggccgaugagcugaucucuccuaaggacauugacccgguccagcgcuaugugccccuuaaagaucagcggaacgucagcaugagauucuccaaucaaggcccucucgagaacgaccuggugguucacguggcccugaucgcugaaucucagcgccuccaggucuuucugaauaccuacgggauccagacacaaacgccccaacagguggagccuauucagaucuggccccagcaggaacuuguuaaggccuaucugcagcucggaauuaacgagaagcugggccugagcgggcggccggauagaccuaucggaugccuuggcaccuccaaaauuuaccgcauccucgggaagacaguggucugcuaucccaucauuuucgaccugagcgauuuuuacaugucucaggacguguuccugcucaucgaugacauuaaaaaugcgcugcaauuuaucaagcaguauuggaaaaugcacggccggccucuuuuccuggugcucauuagagaagauaacauccggggaucccgcuuuaaucccauucuggacaugcuggcugcccuuaagaagggcaucaucgggggaguuaaaguccauguggauagacuccagacccugauuagcggcgccguggucgagcaacuggacuuccuccggaucucugauacagaggaacugccugaguucaaguccuuugaagaacuugagcccccgaaacacagcaaggugaaaagacaguccucuaccccuagcgcucccgaacuggggcagcagcccgacguuaacauuuccgaguggaaggacaagccuacgcaugaaauccuccaaaaacugaaugauuguucuugccuggccagccaggcuauucuucucggaauccugcugaagcgcgagggcccgaacuucaucacaaaagaagggaccguguccgaccacauugagcgggucuacagacgcgccggcagccagaagcucuggcuggcggugagauacggagccgcuuuuacccagaaauucucuuccagcaucgcuccccauauuacaaccuuucuuguucacggcaagcaagugacacugggggccuucggacacgaggaagaggucaucucuaauccucucagcccccgggugauucagaacaucaucuauuacaaauguaauacgcaugaugaacgcgaggccguuauucagcaggaacuggugauccacauuggcuggaucauuagcaacaacccugagcuguuuucugggaugcuuaagaucagaaucggauggauuauccaugcgauggaguaugaacugcaaauucggggcggggacaagcccgcccucgaucuguaccagcucagcccuuccgaggucaaacagcugcuucuggacauccuccaaccccagcagaauggccgcugcuggcugaacagacggcagauugauggaagccugaaucgcaccccgacaggcuucuaugacagaguguggcaaauccuugaacggaccccuaacgggauuaucguggcuggaaagcaucugccccagcagccuacacucucugauaugaccauguacgagaugaauuuuucccugcucgucgaagacacgcugggcaacaucgaucagccccaauaucgccagauuguuguggagcuucugaugguggucagcaucgugcucgagagaaauccggaacuggaguuccaggacaaaguugaucuggaccggcuugugaaggaagccuuuaacgaguuccagaaagaccaauccagacugaaggagauugaaaagcaggaugacaugaccucuuuuuacaauacaccuccccucgggaaacgcggaaccuguagcuaccugacaaaggcugucaugaaccuccugcuugagggcgaagugaaaccuaauaacgaugaccccugccugaucuccuga

SEQ ID NO: 73707 - RNA, 1260 nt, Artificial Sequence
  derived and/or modified sequence opt5 from PHKG1__Homo_sapiens__NP_001245388
augaccagagacgaggcccugcccgauagccacuccgcucaggacuucuacgaaaacuaugagccuaaggaaauccucggccgcggggugucuagcgucguucggagaugcauucauaaaccgacaucccaagaguacgccgugaaggugaucgaugucacgggaggcgggucuuuuagccccgaagaggugcgggagcugcgcgaagcgacccuuaaagagguugacauucugagaaagguguccggacacccuaauaucauucagcucaaagauacauaugaaaccaacacauucuuuuuccuggucuuugaccuuugggaggauaccgacacaauggagauggaacagaaguggugucugggcugggauucucccaagagcaccaauuuccgggcucaggggcgcgccagaaugaaacggggagagcucuuugacuaccugacggaaaaggugacccuguccgagaaagaaacacgcaagaucaugagagcccuccuggagguuaucugcacccuucauaaacugaacauugugcaccgggaucucaagccugagaauauccugcuugacgauaacaugaauauuaagcugacagacuucggcuuuagcugucaacucgaacccggcgagcgccugagagaagucugcgggaccccuucuuaucuggcuccggagaucauugaauguuccaugaacgaggaccaucccggauacggcaaagagguggauauguggagcacgggggugaucauguauacacuccuggccggaucuccucccuucuggcaccggaagcagaugcuuaugcugcgcaugauuauguccggcaauuaccaguuugggagcccugaaugggacgauuacucugacaccgucaaagaucucguuuccagauuccugguggugcagccccaaaaccgguauacagcugaggaagcccuugcgcacccguuuuuccagcaguaccuggucgaggaagugagacauuucagcccucgcggaaaguuuaaaguuaucgcccucaccgugcuggcuuccguccggaucuauuaccaguauagacgcgugaagcccguuacccgggagauugugaucagagacccuuacgcccugcgcccccuccggagacugauugaugcuuaugccuuccgcaucuacggccacugggucaaaaagggccaacagcagaaucgggcggcccuuuuugagaacacacccaaggcugugcugcucucucuggccgaagaggacuacuga

SEQ ID NO: 73708 - RNA, 1221 nt, Artificial Sequence
  derived and/or modified sequence opt5 from PHKG2__Homo_sapiens__NP_000285
augacccuggacgugggccccgaggaugaacucccugacugggccgcugccaaggaguucuaccagaaauaugauccgaaggacgucaucgggagaggaguuagcuccguggugcggcgcugcguccacagagcgacaggccaugaauuugcugugaaaauuauggagguuacggccgaacggcugucucccgagcaacuugaggaagugcgcgaggccaccagacgggaaacacacauccugcgccaggucgcugggcauccucacauuaucacccucauugauagcuacgaguccucuagcuucauguuucugguguucgaccuuaugagaaagggagagcuguuugauuaucucacagaaaaaguugcccuguccgagaaggaaacccggucuaucaugcgcagccugcucgaggcuguguccuuccugcaugccaacaauaucguccacagagaccuuaagcccgaaaacauucugcucgaugacaauaugcagauccggcugagcgauuuuggcuucucuugucaccuugagccuggggagaaacugcgcgaacucugcggaacacccggcuaccuggcgccugagauucugaaguguuccauggacgaaacccauccgggcuaugggaaagagguggaucucugggccugcggagugauccuguuuacgcuucuggcuggcucucccccuuucuggcacagacggcagauucucaugcugcgcaugaucauggaagggcaauaccaguuuagcucccccgagugggacgacagaagcucuaccgucaaggaucuuauuucccggcugcuccagguugacccugaggccagacugacagcugaacaggcccugcaacaucccuucuuugagcgcugugaaggaagccagccguggaaccucaccccucggcagagauuccgcguggcgguguggacaguccuggccgcuggccggguggcccuuuccacccacagaguucgcccccugacgaaaaaugcucuccugcgggauccuuaugcccuuagaucugugcgccaccugaucgacaacugcgccuuccggcucuacgggcauugggucaagaagggagagcagcaaaauagagcugcgcuguuucagcaccgcccucccggccccuucccgaucaugggccccgaagaggagggggauagcgccgcuauuacagaagacgaggccgugcugguucucggauga

SEQ ID NO: 73709 - RNA, 1206 nt, Artificial Sequence
  derived and/or modified sequence opt5 from PHLDA1__Homo_sapiens__NP_031376
augagacgggcccccgcugccgagcgccugcucgaacugggcuucccuccgagaugcgggcggcaggagcccccuuuuccccuuggagugacccgcggcugggggagauggccuauccaaaagcggcgcgaaggagcgagacccgucccuuucagcgagcggucccaggaagacggccgcgggccggcugccagaucuagcggaacacuguggcggauucgcacgagacucucccugugucgggaucccgagccucccccuccccuuugccugcuccgcguuucucugcugugugcccucagagcuggcggccgggggagcagauggggagaggacggcgcccgccugcuucugcucccgccugcucgggccgcggggaacggagaagccgagcccuccggcgggccuucuuacgcuggaagaaugcuggaaagcuccggcugcaaagcccuuaaggagggcgugcuggagaaacgcagcgaugggcuccugcagcuguggaagaaaaaguguugcauccucaccgaagagggacugcuucugauuccucccaagcagcuccaacaccagcagcagcaacagcagcagcaacagcagcaacagcagcagcaacccggccaggggccggcugaacccucucagccuuccggacccgccguggcgagccuggagccucccgucaaacuuaaggaacugcauuuuucuaauaugaaaacaguggacuguguugagcggaagggcaaauauauguacuucaccguggucauggccgaggggaaggaaaucgauuuuagaugcccgcaggaccaaggauggaacgcugagauuacacuccagauggugcaguauaagaaucgccaggccauccuggcuguuaaauccacccggcaaaagcagcagcaccuggugcagcaacagccucccagccagccucaaccccagccucagcuccagccccaaccgcagccucagccccagccccaaccucagccgcagucucagccccaaccucagccccagccuaaaccccaaccucagcagcugcaucccuacccgcacccucauccccacccucacucccauccccacagccauccgcacccucacccccauccucacccccaucagaucccccacccucauccgcaaccccacucccagccucacggccauagacuucugcgcucuacaagcaacuccgccuga

SEQ ID NO: 73710 - RNA, 459 nt, Artificial Sequence
  derived and/or modified sequence opt5 from PHLDA2__Homo_sapiens__NP_003302
augaaaagccccgacgaggugcugagagaaggcgagcucgaaaagcgguccgauucucuguuccagcuuuggaagaaaaagcgcgggguccugaccagcgacagacucucccuguuuccugccucuccgcgggcucgccccaaagagcuuagauuccacagcauccugaagguugauugcguggaacggacaggaaaguacguguauuuuacgauugucaccacagaccauaaagagaucgauuuccgcugugccggcgaguccugcuggaacgcggcuauugcccucgcccugaucgacuuucaaaauagacgggcucugcaggauuuccgcucuagacaggaacggaccgccccugcugcccccgcggaggacgccguggcugccgcugccgcggccccuagcgaacccuccgagccuagccgcccgucuccccagccuaagcccagaacaccuuga

SEQ ID NO: 73711 - RNA, 384 nt, Artificial Sequence
  derived and/or modified sequence opt5 from PHLDA3__Homo_sapiens__NP_036528
augaccgccgcugccacagcgacggugcugaaggagggcguccucgagaaaagaagcgggggacugcuucagcuguggaagcggaaacgcugcguucucaccgaaagaggccugcaacuuuucgaagcuaaggggacaggaggccggcccaaagagcuguccuuugcccgcaucaaggccguggaauguguggagucuaccgggagacacauuuacuucacacucgucaccgagggaggcggcgaaaucgacuuucggugcccucuggaggauccgggguggaacgcucagauuacacugggacucgugaaguucaaaaaucagcaggccauccaaaccguucgcgcuagacagagccugggcacggggacccuuguguccuga

SEQ ID NO: 73712 - RNA, 3960 nt, Artificial Sequence
  derived and/or modified sequence opt5 from PHLDB1__Homo_sapiens__NP_001138231
auggacgcccugaacagaaaucagaucggccccgggugccaaacccagacaauggugcagaagggaccucucgaucugauugagacgggcaaagggcuuaagguccagaccgacaaaccgcaccugguuagccucggauccggccggcugucuacagcuaucacccuucugccccucgaagaggggcgcacagugauuggaagcgccgcgagagauaucucccugcaaggcccuggccuggcucccgaacauuguuacauugagaaccuccgggggacccugacacuuuauccuugcggaaaugccuguaccaucgacggccugcccgugcgccagccuacgagacucacccaggggugcaugcugugucuuggacagucuacauuccugcgguuuaaccacccggccgaagcuaaguggaugaaaagcaugauccccgccggcgggcgcgcuccuggacccccuuacucccccgucccggccgagucugagagccucgugaauggcaaccauaccccucaaacagcgaccagaggccccuccgccugcgcuagccacucuucccugguuagcucuauugaaaaggaucugcaggagaucauggacucccucgugcuggaggaaccuggggccgcuggaaagaaacccgccgcgacgagcccccuuucuccuauggccaauggcgggcgguaucugcucuccccgcccacaagcccuggagcuauguccgucggcucuagcuacgagaacaccucccccgccuucagcccucugucuucccccgcuagcucugggagcugugccucccauucuccgagcggacaggaaccuggccccuccgugccuccccuuguuccugcccgcuccucuuccuaucaccuggcucuccagcccccgcaaagcagaccuucuggcgcgcgguccgagagcccccgccuguccagaaaagggggacacgaacggcccccuucuccgggccugcgcgggcuccugacagauagccccgccgcuaccgugcuugccgaggccagacgggcuaccgaauccccuagacugggaggccagcuccccgucguggccauuucucugagcgaguacccugcguccggggcucuuagccagcccacaucuaucccuggcucccccaaguuucaaccgccugugcccgccccucgcaauaagauuggaacgcugcaggaccggcccccgagcccuuucagagagcccccuggcucugaacgcguccucaccacaucccccagccggcagcugguugggagaaccuuuucugauggacuggccacacgcacccuccagcccccugagagcccgcggcugggcagacgcgggcuugacuccaugcgggaacugcccccucucagccccucucuguccagacgcgcucugagcccucuucccacgcggacaaccccugauccgaaacucaacagagagguggccgaaagcccccggccucgcagaugggcugcccauggagcgucucccgaggacuucagccugacccugggcgcccgggggagacgcacacgguccccuucucccacccucggcgagagccuggcuccgcacaagggauccuuuucuggcagacuuagcccugccuauucccuggggagccucacaggagcuucucccugccaaucccccugugugcagcgcaagcugagcucuggcgaucugagagucccugugacgcgggaacgcaaaaauuccaucaccgagauuagcgacaacgaagacgaucuucucgaguaccauagacggcagcgccaggaaagacugcgggagcaagagauggaacgccuggagagacagcggcucgaaacaauccugaaucuuugcgccgaguacucucgcgcggacgggggacccgaggccggcgaacugccuuccaucggggaggcuaccgccgcucucgcccuggccggcagacggccgagcagaggacuggcuggcgcguccgggcgcagcucugaggaacccggaguugccacacagcggcuuugggaaagcauggagagauccgaugaggaaaaccucaaggaggaauguucuagcaccgaguccacgcagcaagaacacgaggacgcuccuucuaccaaacugcagggcgaggugcuggcccucgaagaggaacgcgcccagguccuggggcacguggagcagcuuaagguucgggugaaagaacuggagcaacagcuccaggagagcgcuagagaagccgagauggaacgcgcgcugcugcaaggagagcgggaggcugaaagagcccuucuccagaaggagcagaaagccgucgaucagcugcaagaaaagcugguggcucucgagacaggcauucagaaggaacgcgacaaagaggccgaggcgcuggaaaccgagacaaaacuuuucgaagaucuggaguuucagcagcucgaacgggaguccagagucgaggaggaacgggaacuggcugggcaaggccugcuucgcucuaaggccgagcugcucagaagcaucgccaagcggaaagaacgccuggcuauucucgacucccaggccggacagaucagagcucaggccgugcaagagagcgagcggcuggcgagagauaagaaugccucucuucagcugcuccagaaggaaaaagagaagcugaccguucuggaacgccgguaucauucccuuacgggcgggagacccuucccuaaaacaaccagcacacugaaggagguguaccgcucuaaaauggacggagaggcuaccagcccccucccgcggaccagaagcggcccucugcccuccucuagcggguccuccucuuccagcucucaacucagcgucgccacacugggacgcuccccuucucccaagagcgcccuucugacgcagaacggcaccggcucccucccucggaaccuggcugccacacugcaggauauugaaaccaagagacagcuugcucugcaacagaaagggcaacaggugaucgaggaacagcgcagacggcucgcggagcugaagcagaaagccgcugccgaagcccagugccagugggacgcucuccacggagccgcgcccuuuccggcuggcccuucuggguucccuccccugaugcaucacagcauccuucaucaucugcccgccggacgcgagagaggcgaggaaggggagcacgccuaugacacacugucccucgaaagcucugauuccauggagaccagcauuuccacgggaggcaauucugcuugcagcccggacaacauguccucugccagcggccuggauauggggaagaucgaagagauggagaaaaugcuuaaggaagcgcacgcugagaagaaucggcugauggaaucccgcgagagagaaauggagcuccggagacaagcccuggaggaggaacgccggagacgcgaacagguugagcggagacuccagagcgagucugcccggcgccagcaacugguggaaaaagaggucaagaugagagaaaaacaguuuucccaggcucggccccuuacacgcuaccugccuauuagaaaggaggacuucgaucugaaaacccacaucgaaagcucuggacauggcguggacaccugucuccacgugguucuguccagcaaggucugccggggguaucuugugaaaaugggaggcaagauuaagucuuggaaaaagcgcugguucguguuugauagacugaaacggacacucagcuacuaugucgacaagcacgagaccaaacugaagggggugaucuacuuccaagccaucgaggaaguuuacuaugaucaucuccgcuccgcugccaagucucccaacccugcgcugacauuuugugugaaaacgcacgacagacuuuacuauauggucgcccccagcgcugaggccaugcggauuuggauggaugugaucguuaccggagcugaaggcuacacacaguucaugaauuga

SEQ ID NO: 73713 - RNA, 5154 nt, Artificial Sequence
  derived and/or modified sequence opt5 from PHLPP1__Homo_sapiens__NP_919431
auggagcccgccgcugccgcgaccgugcagagacugccugaacucggccgggaggaccgcgcuagcgccccggccgcugccgcugccgcggccgcugccgcugccgcggccgcugccgcucuggccgccgcugccgggggaggcagaucccccgaaccugcccuuacccccgcugccccuucugggggaaacggcagcggguccggagcccgggaggaagcucccggcgaggccccuccgggcccccugccugggcgcgcgggaggcgcugggagacggcgcagacggggagcgccccaaccuaucgccggcggggcugcccccgucccgggagcuggcggcggggccaauucucuccugcuucgcagaggacggcugaagcgcaaccucagcgcggccgcugccgcugccuccucuagcuccuccucuuccgcggccgcugccagccacucuccuggcgcugccgggcugcccgccuccugcagcgcuucugcgucccuguguacgagaagccucgaucggaagacccugcuucugaagcaccgccagacacuccagcugcagccuuccgacagagauuggguucggcaccaacuucagagaggaugcgugcacguguucgaccgccacauggccucuaccuaccugcggcccguccucuguacacuggauaccacagcuggcgagguggccgccagacugcuccagcuggggcauaaaggaggcggcguugugaagguccuugggcagggacccggcgcugccgcggcucgcgaaccugccgagccgcccccugaagccgggccccggcuggcuccucccgagccgagagacagcgaggugccucccgcccgcuccgcgccuggagcuuuuggcgggcccccucgggccccgccggccgaucucccucugcccguuggcggacccggcggguggagcagacgcgcuucuccugccccguccgacagcucucccggagaaccuuucgugggcgggcccgucagcuccccucgggcucccagaccuguggugucugauaccgagagcuucucccuuagccccucugccgaauccgucagcgaccgccuggauccguauucuuccggaggcgggagcuccucuagcuccgaggaacucgaggcggacgccgcuucugccccuacgggcguucccggacaaccucggagacccggccacccggcucagccucugccccugccucagaccgccagcagcccccagccccaacagaaagccccucgggcuauugauagccccgggggagcggugcgcgagggcucuugcgaagagaaggccgcugccgccguggcucccgggggacuccaguccacaccuggcagaagcggggucaccgccgaaaaggcgcccccucccccuccgcccccuacacuguacgugcaacuucacggcgagaccacgcggagacuggaagcugaggagaaaccccuccagauccagaaugacuaucuguuccagcuuggauuuggcgaacuguggcgcguucaagaggaagggauggacucugagauuggaugucucauccgguucuacgccggcaagccucauuccacagggagcucugaacggauccagcugagcggaauguauaacgugcgcaaaggcaagaugcagcugcccgucaauagauggacccggcgccaggugauccucugcgggacaugucugaucguuuccagcgugaaagauucucuuaccggcaagaugcacguccugccgcucauuggaggcaagguggaggaggucaaaaagcaucaacacugccuggccuuuuccagcuccgggccucagucucagaccuacuauaucuguuucgacacauuuacggaauaccugagauggcuuagacaggugagcaaaguugcuucccaacgcauuucuagcguggaucucuccugcuguucucuggagcaucugcccgccaaccucuucuacagccaggaccugacccaucuuaaucugaagcagaacuuucucagacagaaucccucccugccugcggcucggggacugaacgaacuucaacgcuucacaaaacucaagagccugaaucugucuaacaaucaccucggcgauuuuccccuggccgucugcuccaucccuacccuugccgagcugaacgugagcugcaaugcucucagaucuguuccggccgcugugggggucaugcauaaccugcagacauuccugcuugacggaaacuuccuccagucccugcccgccgagcuggaaaauaugaaacaacucagcuaucugggccuuucuuuuaacgaguucaccgauauuccugaagugcuggagaagcucacggcgguggacaagcuguguauguccggcaauugcguugaaacacugcggcuucaggcccuccgcaaaaugccccacaucaagcaugucgaucugagacugaacgugauucggaaacucaucgcugacgagguggauuuucugcagcacgucacccagcuugaccugagagacaauaagcucggggaucuggacgccaugaucuucaacaauauugaggugcugcacugugaacgcaaccaacuuguuacccuggauaucugcggauacuuucucaaagcucuguaugccagcuccaaugagcucgugcagcuggacgucuacccugugcccaacuaucuuagcuacauggauguuucucggaauagacuggaaaacgugccggagugggucugugaaagccgcaagcucgaggugcuggacauuggccauaaucagaucugcgagcugccugcccggcuuuucuguaacuccucucugagaaagcuccuggcugggcacaaucagcucgcgcgccugcccgaacggcuugagagaacaagcguugaagugcuggauguccaacauaaccagcuccuggagcugccucccaaccuucugaugaaagccgacucccuccgcuuucugaaugcuucugccaacaagcucgaaagccugccucccgccacccuuuccgaggagacaaauucuauucugcaggaacuguaucucacgaacaauagccugaccgauaaaugcgugccgcuucugacaggacacccucaccucaagauccugcauauggcuuacaaccggcuccaguccuuccccgccagcaaaauggcgaagcuggaggaacuugaggagaucgaccugucuggcaauaagcugaaagcuauucccaccacaaucaugaacuguagacggaugcacaccgugauugcccauuccaauugcaucgaagucuuuccugagguuaugcaacucccggaaauuaaguguguggaucugagcugcaacgagcuuucugaagugacgcugcccgagaaucucccucccaaacugcaggagcucgaccugaccgggaacccucgccuuguccuggaucacaagacacuggaacuccugaauaacaucagaugcuucaaaaucgaccagcccuccaccggagacgccagcggcgcuccugccguguggucccauggcuacacagaggcgucugggguuaagaauaaacuuuguguggccgcucugagcgucaacaacuuuugcgauaaucgggaagcccucuauggaguguucgacggcgaucgcaacguugaggugccguaccugcuccaauguaccauguccgacauucuggcugaggaacuucagaaaacgaagaaugaggaagaguauauggucaacacauuuaucgugaugcagagaaaacuggggaccgccggacagaagcugggcggggcugccguucucugccacauuaaacacgaucccguggacccuggaggcagcuucacacugaccucugcgaaugucggcaagugucaaaccgugcuuugccggaacgggaaaccccugccucucuccagaagcuacaucaugucuugugaagaggaacugaagcgcauuaagcagcauaaagccaucauuacagaggauggaaaggugaauggcgucacggagagcacccggauccugggguauacauuccuccaccccuccguugugccgagaccucaugugcagucuguccuucugacaccccaggacgaauuuuucauccugggaagcaaaggccucugggauucccugucuguggaggaagcuguugaggccgugcgcaacguccccgacgcucuugccgccgcuaagaaacugugcacacucgcgcaaagcuacgggugucacgauuccauuagcgccgugguugugcagcugucugucaccgaggacuccuuuugcuguugcgaacugagcgcuggaggcgccgugccucccccuuccccgggcaucuuucccccuucugucaauauggugauuaaggaucggcccagcgacgggcucggaguuccuuccucuagcuccggcauggccagcgagaucucuuccgaacuuagcacgucugagauguccagcgaaguggggucuacagcuagcgacgagcccccgccuggagcccuguccgagaacucucccgcguauccuagcgaacagagaugcaugcugcaucccauuugucucuccaauagcuuucagcgccaacuguccucugccaccuucagcuccgcuuuuucugauaacggccuugacagcgaugacgaggaaccuaucgagggggucuucaccaauggaucccggguggaaguugagguggauauccacugcucuagagccaaggagaaagaaaagcagcagcaucugcuccagguccccgcugaggccagcgacgaaggcauugugaucuccgcgaacgaggaugaaccgggccugccucgcaaagccgacuuuagcgcuguggggacaauuggaagacggcgcgccaauggcucuguugcuccccaagagagaucccauaacgucaucgagguggccaccgaugcuccccugcggaagccugggggauacuucgccgcgccggcccagcccgacccugaugaccaguuuauuauucccccugaacucgaggaagaggugaaagagaucaugaagcaccaucaagaacagcagcagcaacagcagcccccucccccgccucagcuucaaccccagcugccucgccacuaccagcuggaccagcuccccgauuauuacgacacaccgcuguga

SEQ ID NO: 73714 - RNA, 3771 nt, Artificial Sequence
  derived and/or modified sequence opt5 from PHLPP2__Homo_sapiens__NP_001275932
augaagagaaacggcagccggaauugccugaaccgcagaucccgguucgggucucgcgagagagacuggcuccgggaagaugugaaacgcggaugugucuaccuguauggcgccgacaccacaacggcuaccacaaccacaaccacaagcuccucuagcuccucuagcuccucuagcuccgaucuucaccugguucucugcaccguggagacgcccgccagcgaaaucugugcgggggagggaagagaaucucuguaccuucagcugcauggcgaccucgugcggcgccuggagccuaccgagagaccgcugcaaauugucuaugauuaccucucccggcugggguuugacgaucccgugcgcauccaggaagaggcuacaaauccugaccuuggaugcaugauuagauucuauggcgaaaagcccugucacauggaucggcuggaccgcauccuccugagcggcauuuacaacguuagaaaagggaagacccagcuucauaaaugggccgagcggcuggugguccucugcggaacaugucugaucgugucuuccguuaaggauugccagaccggcaagaugcacauccugccucucgugggcggaaaaauugaggaagucaagagacgccaauauagccuggccuuuuccucugcuggcgcccaggcucagacguaccaugugagcuucgagacacuugccgaauaccagcgguggcaaagacaggcguccaaaguggucagccagcgcaucucuaccguugaccuguccuguuauagccucgaggaagugcccgagcaccuguuuuacucucaggauauuacauaucuuaaucugcggcacaacuucaugcaacucgagagaccugggggacuggacacccuguacaaguuuagccagcucaaaggccugaaucuuucccauaacaagcugggccucuucccgauccugcuuugcgaaauuucuacccugacagagcucaaucugagcuguaacggguuucacgaccugcccucccagaucggaaaucuccugaaccuucaaacgcugugccucgauggcaauuuccugaccacacugccugaggaacuugggaaccuccagcagcugagcucucugggaauuuccuuuaauaacuucagccagauccccgaaguguaugagaagcucaccaugcuggaccgcgucgugauggccggcaacugccuugagguucugaaucucggggugcugaaccggaugaaucauaucaaacacgucgaucugagaaugaaccaccuuaagacaauggugauugaaaaucucgagggaaacaaacauaucacccacguugaccugcgcgauaaucggcugacggaccucgaucugucuucccuuuguagccuggaacaacuccauugcggcagaaaccagcugcgcgagcugacacuuuccggcuuuucucuccggacccuguacgcuagcuccaauagacugaccgccgugaacgucuauccugugcccucucuccugacauuccuugaccugagccggaaucuccuggaaugugucccggauugggcuugcgaggccaagaaaauugaggugcuggacguuuccuacaaccuucucaccgaagugccuguccgcauccugagcucucugucccucagaaagcugaugcuugggcacaaucaugugcagaaccugcccacacucguugagcacauuccucuggaagugcuggaucuucagcacaaugcgcugacgcggcuccccgacacccuguucagcaaagcccucaacaagcugaacaaacuugagcaacuggaggaacucaaucugucuggaaacaagcugaagacaauccccaccacaaucgcuaauuguaaaagacuucauacccuggucgcccacuccaacaauauuagcaucuuuccugagauucuccagcugccgcagauccaguucguggaccucucuugcaacgaucugacggaaauucuuauccccgaggcucugccugccacccuccaagaccuggaucugacaggcaauaccaaccuugugcuggaacauaagacacucgacaucuuuagccacauuaccacgcugaaaaucgaucagaagccccucccuacaaccgacuccacaguuaccagcaccuucuggucucacgggcuggccgagauggcuggacagcgcaauaaacuuugugucuccgcgcuggccauggauagcuuugcugagggcgugggggccguguacggcauguucgacggagaucggaacgaggaacugcccagacuccugcagugcacaauggccgacguccuucuggaagaggugcaacaguccacgaaugauaccguuuuuauggcuaacacauuccucgugucucaucgcaagcugggcauggccgggcagaagcucggaagcuccgcgcugcuuuguuauauuagaccggacaccgcugauccugccucuagcuuuucccugacagucgccaauguggggaccugccaagcuguucugugucgcgggggaaaacccgugccucucucuaaggucuucagccuggaacaggaccccgaggaggcccagcgggugaaagaccagaaggcuaucauuacggaagauaacaagguuaauggcgugacaugcugcaccagaaugcuuggguguaccuaccuguauccuuggauccuccccaaaccgcacauuuccagcacaccucugaccauccaagacgagcuccugauccuuggcaacaaggcccugugggaacaucugucuuacacagaggcggucaacgccgugcggcacgugcaggauccccucgcugccgcuaaaaagcugugcacgcuugcccaguccuauggaugucaggacaaugucggcgcgaugguuguguaccugaacauuggggaagagggaugcaccugugagaugaauggccucacacugcccgggccugugggauuugccagcaccacaaccaucaaagaugcuccgaagcccgccacgccuucuuccagcucuggcauugcuuccgaguucagcuccgaaaugagcaccucugaagucagcuccgagguggggucuacagccagcgacgagcauaacgccggcggacucgauaccgcucugcuuccccgcccugaaagacggugcucccugcaccccacaccuaccucuggccuguuucaacgccagcccagcuccgcgacauucucuagcaaucaguccgacaacgggcucgauagcgacgaugaccagccgguugagggagugaucaccaauggcucuaaggucgaaguggagguugauauucacuguugcagagggcgggaccuggaaaacuccccuccccuuaucgagagcucuccuacgcuguguuccgaggaacaugcccgcggaagcugcuucggcaucagacggcaaaauuccgugaacucugggaugcuccugcccaugagcaaagacagaauggagcugcagaaguccccgagcacaucuugucucuauggcaaaaagcuguccaauggaagcauugucccucuugaagauucucugaaccucaucgagguggcuaccgaaguucccaaacgcaagaccggcuacuuugccgccccuacacagauggagcccgaggaccaauucguggucccccacgaucuggaagaggaagugaaagagcagaugaagcagcaucaggacagccggcuugaaccugagccgcacgaggaagauagaaccgagcccccugaagaguuugacacggcucuguga

SEQ ID NO: 73715 - RNA, 855 nt, Artificial Sequence
  derived and/or modified sequence opt5 from PHOX2A__Homo_sapiens__NP_005160
auggacuacagcuaucugaacuccuacgauucuugcguggccgcuauggaggccagcgcguauggcgacuucggggcuuguucccagcccggaggcuuucaauacucuccucucagaccggccuuccccgccgcugggccucccugcccugcccugggaagcuccaauugugcucuuggcgcccugcgggaucaccagcccgcgccuuauucugccgucccguacaaguuuuuccccgaaccuagcgggcuccaugagaaacgcaagcagagacggauccgcaccacauuuacguccgcucagcugaaagaacuugagagaguuuucgccgaaacccacuaucccgacauuuacacacgggaggagcuggcucucaagaucgaucugaccgaagcccgcgugcaagugugguuucagaacagacgggcgaaauuccgcaagcaggagagagccgcuagcgccaagggagcugccggcgccgcuggcgcgaaaaagggggaagcccggugcuccuccgaggacgaugacagcaaagagucuacauguuccccuacccccgauagcacagcuucucugccgccucccccugcccccggacucgccucuccccgccugagcccuuccccgcuucccgucgcucugggcucugggccuggacccggcccugggccccagccgcucaagggagcccugugggcgggcguggcuggcgggggaggcgggggaccuggcgccggggccgcugaacuucugaaagccuggcaacccgcugagagcggaccuggccccuuuuccggcguucucagcucuuuccauagaaagccugggcccgcccugaagaccaaucuguuuuga

SEQ ID NO: 73716 - RNA, 945 nt, Artificial Sequence
  derived and/or modified sequence opt5 from PHOX2B__Homo_sapiens__NP_003915
auguacaagauggaguauagcuaccugaacuccucugccuaugaaagcugcauggcuggcauggacaccuccucucucgccagcgcguacgcugauuucuccucuuguagccaggccuccggguuucaauauaaucccaucagaacaacguucggagccaccagcggcugcccuucucugacaccgggguccuguagccuuggaacccugcgggaccaccagucuucccccuacgcugccgugccuuauaaacucuuuacagaucauggcgggcugaacgagaagcgcaaacagagacggauucgcaccacauucaccagcgcucagcuuaaggaacuggagagagucuuugccgaaacgcacuaccccgacaucuacacccgggaggagcucgcgcugaaaauugaucugacagaagcccgcguucaagugugguuccagaauagacgggcuaaguuucgcaagcaggagagagccgcugccgcggccgcugccgcugccaaaaacggaucuuccggcaagaaaagcgacuccucucgggaugacgaaagcaaggaggccaaauccaccgauccugacagcacaggcgggcccggaccuaauccgaaccccaccccuucuugcggcgcuaaugggggaggcgggggaggccccuccccugcgggcgcccccggggcugccggaccgggcgggccuggaggcgagcccgggaagggaggcgccgcugccgcggcugccgccgcugccgcugccgcggccgcugccgcugccgcggccgcuggcgggcucgccgcugccggaggcccugggcagggaugggcccccggccccgggccuaucacgagcauuccggauucucugggcggacccuucgcuagcgugcuuuccucucugcaacgcccuaacggcgcgaaggccgcucucgucaaaagcuccauguuuuga

SEQ ID NO: 73717 - RNA, 375 nt, Artificial Sequence
  derived and/or modified sequence opt5 from PHPT1__Homo_sapiens__NP_001129333
auggccguggcugaccuggcccucauccccgaugucgacauugauagcgacggcguuuucaaguacgugcugaucagagugcacuccgcgccucggucuggggcuccggccgccgagagcaaagaaauuguccgcggauauaagugggcugaguaccaugccgauaucuaugacaaaguguccggcgauaugcagaagcaagggugcgacugugaaugccuuggaggcgggagaauuucucaccagagccaggauaaaaagauccauguuuacggauauuccaugaugcggcccaccugugugccucugggcgcuucuggcccccgcauccaccaucaggggcucuggagcugcccugccagacacuuuaacuga

SEQ ID NO: 73718 - RNA, 4950 nt, Artificial Sequence
  derived and/or modified sequence opt5 from PHRF1__Homo_sapiens__NP_001273510
auggacgaugacagccuggaugagcucguggccagaucccccggcccugacgggcacccgcaggucggacccgcugauccugccggcgacuucgaagagucuagcguuggguccucuggagauagcggcgacgauuccgacucugaacauggggauggaaccgacggcgaggaugaaggcgcgagcgaggaggaagaccuggaggaccgguccgggagcgaagauucugaggacgauggagagacacuucuggaaguggcuggcacgcaagggaagcucgaggccgccggauccuuuaacagcgacgaugacgcugaaucuugccccaucugucugaaugccuuccgcgaucaggcugugggcaccccugagaacugcgcccacuacuuuugucuugacugcauugucgaaugguccaaaaaugcgaacagcugucccguggauagaacacuguucaagugcaucuguauucgggcccaguuugggggaaaaauccuccgcaagauuccuguugagaauaccaaggcuucugaggaagaggaagacccgacauucugcgagguguguggcagauccgaucgggaagaccgccugcugcucugcgacggcugugaugccggguaucauauggagugccuggaucccccucuucaggagguccccguggacgaaugguuuugcccugagugugcugcccccggaguugugcuggcggccgacgcuggcccggucagcgaagaggaagugucccuccugcuugccgauguggucccuaccacaucuagacugcggccccgcgcugggagaacccgggccaucgcccgcacgagacaaagcgagcggguucgcgcuaccgugaacagaaaucggaucuccacagcgagacgcgugcagcacaccccuggacggcucggcagcucucugcuggacgaggccauugaagcugucgccacagggcucuccaccgccguguaccagagaccccugacgccccgcaccccugcucggagaaagcgcaagacacggagacgcaaaaagguuccgggacggaaaaagacacccagcggcccuucugccaaaagcaaguccucugcgaccagaagcaagaaacgccagcaucgggugaagaaaagacggggcaagaaagucaaguccgaggcuaccacacgcagcagaaucgcccggacgcuugggcugagacgccccgugcacucuuccugcauuccuagcguucucaaacccguggaaccgucucugggacuucugcgggccgauaucggcgcugccucccucagccuguucggggacccuuaugagcuggaucccuuugacuccucugaggaacucagcgcuaacccucugucuccccuuuccgccaagagacgcgcgcugagcagauccgcccuccaaagccaccagccugucgcucggcccgugucugucggacugucccgcagacggcuuccggccgcugugccugagcccgaucuggaagaggaacccguuccugaccuccugggcagcauucugucugggcagucccuccugaugcuuggcagcucugaugugaucauucaucgcgacggaagccuguccgccaagagagcggccccggucagcuuccagagaaauucuggcucccucagccgcggggaggagggauuuaaaggcugucugcaacccagagcucugccuuccgggucucccgcccagggaccuagcggcaaccggccccaguccaccgggcuuucuugccaaggccgcagcagaaccccugcucggacagccggagcccccgugagacucgaccugccggcugcgccuggcgccguucaggcucgcaaucuguccaacgggucugugcccggauuccggcagagccacuccccuugguuuaauggcacaaacaagcauacccucccccuggccagcgccgcuucuaaaaucuccagcagagauucuaagccgccuugucgcuccgucgugcccgggccuccccuuaaacccgccccucggagaacggacaucagcgaacugccgcgcauucccaagauccggagagaugacggaggcgggcgccgggaugcggcuccugcccacggccagucuauugagauccccuccgccugcauuagcagacucacaggacgggaaggcaccgggcaaccuggacgcggcaccagagcugaguccgaagccagcucucgggugccccgcgagccugggguucacacaggaagcuccagaccgcccgcgccuucuagccauggcucccuggcuccccuggggccuucucggggcaagggagucggcagcaccuucgaguccuucagaaucaauauccccgggaacauggcccacucuagccagcuuuccagcccgggauuuuguaacacauuccgcccuguggacgauaaagaacagcggaaggagaaucccucuccccucuuuuccauuaaaaagacgaaacagcugagaagcgaaguguacgacccuucugaucccaccggcuccgacagcuccgccccugggucuagcccggagcgcuccggacccggccugcucccuagcgaaaucacacggaccauuucuaucaacucccccaaggcucaaacaguccaggccgugagaugcguuaccagcuauacgguggagucuauuuucggcaccgagccugaacccccgcuggggccuagcuccgcuaugucuaaacuucgcggagccgucgcggccgagggcgcuagcgauacagaacgggaggagcccaccgaaucccaggggcuggccgcuagacuccgcagaccuucucccccugagcccugggacgaagaggauggagccagcuguuccacauuuuucggcagcgaagaacggaccgugacgugcguuacaguggucgagccggaagccccucccucucccgacgugcugcaggcugcgacccaucgcguuguggagcugagaccuccgucccggagccgcuccacaucuagcuccagaucucggaaaaaggccaaaagaaagcgcgucagccgggaacacgggagaacccgcuccggaacccggagcgagucuagagaccgguccagccgcucugcuucccccagcgugggcgaagagagaccucggcgccaaagaucuaaagccaagagccggcgcuccucuagcgauagauccagcucccgggagcgcgccaagcggaaaaaggcuaaagacaagucucgggaacauagacgcggccccugggggcacagccggagaacaucccgcucucggagcggauccccuggcucuagcuccuacgagcacuaugaaagccggaaaaagaaaaagcgccggucugccuccagaccccgcgggcgggaguguagcccuacgucuucccuugaaagacucugccgccauaagcaccagcgggagagaagccaugagcgcccggauagaaaagaaucuguggcguggccccgggaccgcagaaagcggagaucccggagcccuuccagcgagcaccgcgcuagagaacaccggcgccccagaucucgggagaaauggccucagacccgcagccauucccccgagagaaagggagccguccgggaagccucuccggcuccucuggcccagggcgagcccgggcgcgaagaucugcccacaagacucccugcgcugggagaggcucacguuagccccgaaguggccaccgccgacaaagcuccucuucaagccccgcccgugcuggaggucgcugccgagugcgaaccugaugaccucgaucuggacuacggcgauuccguggaggcgggccauguuuuugacgacuucucuagcgaugccguguuuauccagcuggacgauauguccucucccccuagccccgaauccacagacagcucuccggagcgggauuucccucuuaagcccgcucucccucccgccucccuggcugucgccgccauccagcgcgaagugagccugaugcacgacgaggauccuucucaacccccgccucuccccgaggggacccaggaaccccaucugcuuagaccugacgcugcggagaaggccgaagcuccguccagccccgauguugccccugccggaaaagaggacucccccucugcuagcggccgggugcaggaagccgcgcgcccugaggaggucgugucccagacgccccugcucagaagccgggcucugguuaagagagugacauggaaucugcaagaaucugaguccagcgccccugccgaagaucgcgcuccccgggccccgcuucacagaccucagaaaccccgcgagggggcgugggacauggaggaugucgccccuaccggagugagacagguguuuucugaacugcccuucccgagccacguccucccugagcccggcuuucccgacaccgacccuucccagguuuacucucccgggcugccuccggcucccgcccaaccuagcuccauucccccuugugcucucgugucucagcccacagugcaguucauccugcagggaagccuuccucuggucggcugcggcgccgcucaaacccucgccccggugcccgcggcccugacgccugcuuccgaacccgccagccaggcuacagccgccucuaacuccgaggaaaagaccccugcucccagacuggcggccgagaaaacaaagaaggaggaauauaugaaaaagcugcauaugcaggagcgcgcuguugaagaggugaaacuugccauuaagccguucuaccaaaaacgggaagucaccaaggaggaguauaaggauauccucagaaaagccgugcagaagauuugucacagcaaauccggggaaaucaauccuguuaagguggcuaaccuggucaaagccuacguggacaaguaucgccauaugcggagacacaaaaagcccgaggcgggagaggagcccccuacacagggcgccgaaggguga

SEQ ID NO: 73719 - RNA, 2289 nt, Artificial Sequence
  derived and/or modified sequence opt5 from PHTF1__Homo_sapiens__XP_011538833
auggccagcaacgagagagacgcuaucuccugguaccagaagaaaauuggcgccuaugaucaacagaucugggaaaagucuauugagcagacccagaucaaagggcugaagaauaaacccaagaagaugggacacauuaaaccugaccucaucgauguggaccugauccggggcagcacauucgcgaaggcuaaaccggaaauucccuggacgucccuuacccgcaaggggcuggucagaguuguguuuuucccucucuuuucuaacugguggauccaagugacaagccugcggauuuucgucuggcuucugcuccuguacuuuaugcaagugaucgccauuguucuguaucucaugaugcccaucgugaauauuuccgagguccugggaccucuuugccugaugcuccugaugggcaccgugcauugucagaucguuucuacacagaucacccgccccagcgggaacaauggaaacagacggcgcagaaaacuucggaagacagugaauggcgauggcucccgcgaaaacgggaauaacagcucugacaaggucagaggaauugagacccuggaguccgugccuaucauuggcggguucugggaaacgaucuuuggaaaucggauuaaacgcgugaagcucaucagcaacaaaggcaccgagacagauaaugacccgucuugcguccaccccaucauuaagagacggcagugucgcccugaaaucagaauguggcagacccgggagaaagccaaguucuccgauggggagaaaugcagacgcgaggcuuuucggagacugggaaacggcguuagcgacgaucugucuuccgaagaagacggcgaggcccgcacacagaugauucuccugcggagaagcguggaaggggcuuccucugauaauggaugugaggugaagaaccgcaagagcauccuuucccggcaucugaacagccaggucaaaaagaccacgacaagauggugccacauugugcgcgacucugacucccucgccgagagcgaguucgaaucugcggccuuuagccaaggcucccggucugggguuagcggaggcuccagaagccugaauaugucucgccgggauuccgaaagcaccagacaugacucugagacagaagauaugcuuugggacgaucugcuccacgggcccgagugucgguccagcgugaccuccgacucugagggagcucacgucaacacccugcauagcggcacaaaacgcgauccuaaggaagacguguuccagcagaaucaccuguuuuggcuccaaaacuccucucccagcuccgauagaguuagcgccaucaucugggagggcaaugaaugcaaaaagauggacaugucugugcuggagauuuccgggaucauuaugagccgggucaacgcuuaccagcagggagugggcuaucagaugcuugggaaugucgugacgaucggacuggccuucuucccguuucuccauagacuguuccgcgaaaagucucuugaucaacugaaauccauuagcgcggaggagauccucacccuguuuuguggcgccccucccguuacaccuauuaucgugcugucuaucauuaacuucuuugaacggcucugccugaccuggauguucuuuuucaugaugugugucgcugagagaacauacaagcagcgcuuucuuuucgccaaacuguuuagccacaucaccuccgcuagaaaggcccggaaauaugaaauuccccacuuccgccucaagaagguggagaauaucaaaauuuggcugagccugagaucuuaccuuaagcggcgcgggccccagagauccguugacguggucgugagcuccguguuucuccugacgcugucuaucgccuucaucugcugcgcucagguucuccaaggccauaaaacauuccugaacgacgcguacaauugggaguuucuuauuugggaaaccgcccugcuccuguuccugcuucggcucgcuagccugggauccgagaccaacaagaaauauucuaaugucagcauccugcucacagaacagauuaaccuguaccuuaagauggagaagaaaccuaauaagaaagaacagcugacccucgugaacaacgugcugaagcuguccacaaaacuucucaaggagcuggauacgccguuucgccuguauggccucaccaugaauccccugaucuacaacauuacaagagucgugauccuuucugccguuagcggggugaucuccgaccugcucggauucaauauucggcuguggaaaaucaagagcuga

SEQ ID NO: 73720 - RNA, 2244 nt, Artificial Sequence
  derived and/or modified sequence opt5 from PHTF2__Homo_sapiens__NP_001120830
auggccagcaaggugaccgacgcuaucgucugguaccagaaaaagauuggcgccuaugaucaacagaucugggagaaauccguugaacagagagagauuaaggggcugcggaacaaacccaagaagacagcgcacgugaaaccugaccucaucgauguggaccugguccgcggaucugcuuucgccaaggccaaaccggaaagccccuggacgucccuuaccagaaagggcauugugcggguuguguuuuuccccuuuuucuuucgcugguggcugcaggucacaucuaaagugaucuucuuuuggcuccugguucuuuaccugcuccaaguggcugccaucguccuguucugcagcaccuccucuccucauagcauuccucugacagaggugaucgggcccauuuggcucaugcugcuucugggaaccgugcacugucagaucgucuccacaagaaccccuaagccgccccucagcacgggcgggaagcggcgcagaaaacugcggaaggcugcccaucuugaaguucaccgcgagggagauggaucuuccaccacagacaauacccaggagggcgcggugcagaaccaugggacaagcaccucucacuccgugggaacggucuuuagagaucuguggcacgccgcuuucuuucucagcggcucuaaaaaggccaaaaauuccauugacaagagcacagaaaccgauaacggguaugugucccuggacggcaaaaagacaguuaagucuggcgaggaugggauccaaaaucaugaaccucagugcgagaccauucggcccgaggaaaccgcuuggaacacaggaacgcugcgcaauggcccuagcaaagacacccagagaacaaucaccaacguguccgaugaggucagcucugaagagggccccgaaacaggguacucccuccggcgccacguggacagaaccagcgagggaguucugcggaauagaaagucucaucacuauaaaaagcacuacccgaacgaggacgccccuaaaagcggcacguccuguucuagccgcugcuccagcucucggcaggauuccgaaagcgcgagacccgagucugaaacagaggacgugcuuugggaagaucugcuccauugugccgagugccacuccagcuguaccuccgagaccgacgucgaaaaucaucaaaucaacccuugcgugaagaaggaguaucgcgaugaccccuuccaccagucucaucugcccuggcuucacagcucccacccugggcuggaaaagauuucugcuaucgucugggagggaaaugauuguaagaaagccgacaugagcgugcucgaaauuuccggcaugaucaugaaccggguuaauagccauauuccggggaucggauaccagaucuuuggcaacgcugugucucugauucugggccucacacccuucgucuucagacugucccaagccaccgaucuugagcagcugacagcccacagcgcuucugagcucuacgugaucgcguuuggguccaacgaagacguuauugugcugagcauggucaucauuucuuucguggugcgcguuagccuugucuggaucuuuuucuuucugcucugcguggccgagcggacguauaagcagagacugcuguucgcuaaacucuuuggacaucugaccuccgcccgccgggccagaaagagcgaagugccucacuuccgccuuaagaaaguccagaauaucaagauguggcugucucuccgguccuaccugaaaagacggggcccccaacgcagcguggauguuauuguguccucugcuuuucugcuuacaaucagcgucguguucauuuguugcgcccagcuccugcacguucaugagaucuuucuggacugccacuauaacugggagcucgugauuugguguaucucccugacccuuuuccugcucagauuugucacacuggggucugaaaccagcaagaaauacuccaauacgucuauucugcuuaccgagcagaucaaccucuaucugaagauggaaaagaaaccuaauaagaaagaggaacugacacucgugaacaauguucugaaacuugcgaccaaacugcucaaggagcuggacagccccuuccggcuguacggacuuacaaugaacccgcuccuguauaauaucacccagguggucauucuguccgcugugagcggcgugaucucugaucuccugggguucaaccuuaaacuguggaagauuaaguccuga

SEQ ID NO: 73721 - RNA, 717 nt, Artificial Sequence
  derived and/or modified sequence opt5 from PHYH__Homo_sapiens__NP_001032626
augagagacgugaccaucagcaaguccgaguacgcccccucugagaaaaugauuacaaagguccaggauuuccaagaagacaaagaacuguuucgguauugcacgcucccugagauccugaaguacguugaauguuucaccggcccgaacauuauggcuaugcacacaaugcuuaucaauaaacccccugauagcgggaagaagaccucccgccauccccugcaccaggaccuccauuauuuuccuuucagacccucugaucugauugugugcgccuggacagcgauggagcacaucagccggaacaauggaugucuugugguccugccuggcacccauaaagggucccucaagccgcacgacuaccccaaaugggagggaggcgugaacaagauguuucacgggauccaggauuaugaagagaauaaagcucgcguucaucuggugauggaaaagggagacacagucuucuuucacccucugcucauucauggcucuggccagaacaagacccaaggguucagaaaagccaucagcugccacuuugccuccgcugauugucacuacauugacgugaagggaacgagccaggagaauaucgagaaagaaguugugggcauugcccauaaguucuuuggggcugagaacucugucaaucugaaagauaucuggauguuccgggcccgccuugugaagggagaaagaaccaaccuguga

SEQ ID NO: 73722 - RNA, 993 nt, Artificial Sequence
  derived and/or modified sequence opt5 from PHYHIP__Homo_sapiens__NP_001092805
auggagcugcucagcaccccucacuccaucgaaauuaacaauaucacaugcgacucuuucagaauuagcugggccauggaggauuccgaccuggaacgggugacgcauuacuuuaucgaucuuaacaagaaagagaauaagaacucuaauaaauucaagcaccgcgacguccccaccaaacugguugcuaaggccgugccgcuccccaugacagugagaggccauugguuucugagcccucggaccgaauauuccgucgcggugcagacagcuguuaagcaaucugauggggaguaccuugugagcggaugguccgagaccgucgaguucuguacaggcgacuaugccaaagaacaccuggcccagcuccaggaaaaggcugagcagauugccgggcgcaugcugagauuuagcguguucuaccggaaccaucacaaagaguauuuucaacacgcucgcacccauugcggaaauaugcugcagcccuaccucaaggauaacucuggcucccacgggagcccuacgucuggaaugcugcauggcguuuucuuuuccuguaauaccgaguucaacacaggccagcccccucaggacagcccguaugggagauggcgguuucaaauccccgcccagcgccuuuucaauccuucuaccaaccuguacuuugcggauuucuacugcauguauacagccuaccacuaugcuauccucgugcuggcccccaaaggaucccuuggcgacagauucugucgggaucgccugccucuccuggacauugcuugcaauaaguuucugaccuguagcgucgaagauggggaacucguguucagacacgcccaggaccugauccuugagauuaucuacacggaacccguggaccugucccucggaacacugggcgagauuucugggcaucagcuuaugagccuguccaccgcggaugccaagaaagacccgagcugcaagacauguaacaucucugucggacgguga

SEQ ID NO: 73723 - RNA, 1353 nt, Artificial Sequence
  derived and/or modified sequence opt5 from PHYKPL__Homo_sapiens__NP_699204
auggccgcugaccagagacccaaggccgauacccuggcgcuccggcaacgccugaucagcuccucuugcagacuuuucuuuccugaggacccggugaaaauuguccgggcucagggccaguacauguaugaugaacagggggccgaguacaucgacuguauuagcaacguugcccacgugggacauugccacccccuggugguccaagcugcccaugaacagaaucaggugcucaacacaaauucccgcuaucugcacgauaacaucguugacuacgcucagagacuuucugagacgcugccugaacaacucuguguguucuauuuucugaauagcggcuccgaggccaacgaucuggcgcuccggcuggcccgccauuacaccgggcaccaggacgucgugguucuugaucacgcuuaucauggacaccugucuagccucauugacaucucccccuacaaguucagaaaucuggauggccagaaagagugggugcaugucgccccucuucccgacacauaccgggggccuuaucgcgaagaucacccgaaccccgcuauggccuacgcgaaugaggugaagagaguggucagcucugcccaggaaaaaggacggaagaucgcugccuuuuucgcugagucccugccuagcguuggcggccaaauuauucccccugccggguauuuuucucagguggccgagcacauccgcaaggcuggaggcguguucgucgcggacgaaauccaggugggguuuggaagaguuggcaaacauuucugggccuuucaacuccaggggaaggacuucgugcccgauauugucaccaugggaaaauccaucggcaacggccacccgguggcuugcguugccgccacacagccuguggcucgggccuuugaggcgaccggggucgaauacuucaauacauucggaggcagccccgugucuugugcugucgggcuggccgugcugaacguucucgagaaggaacagcugcaagaccaugccaccuccgugggcagcuuucuuaugcagcugcucggacagcagaaaauuaagcacccuaucgucggggaugugcgcggaguuggccuguucaucggcguggaccuuauuaaggaugaggcuacgagaacccccgccacagaggaagcugccuaucuggucucccggcucaaagagaauuacgugcugcugucuaccgacgggcccggaagaaacauccucaaguuuaaaccuccgaugugcuucagccuggauaaugcgcgccaagugguugccaaacuugacgcuauucugacagauauggaagagaagguccgguccugugaaacccucagacugcagcccuga

SEQ ID NO: 73724 - RNA, 777 nt, Artificial Sequence
  derived and/or modified sequence opt5 from PI15__Homo_sapiens__NP_056970
augaucgccauuagcgcuguguccucugcccuccuguucagccugcuuugcgaggcguccaccgucguucugcucaacucuacagacagcucucccccuacgaauaacuuuaccgauaucgaagcugcccugaaggcccagcuugacuccgcugauauuccgaaagccagacggaagcgcuacaucagccaaaaugacaugauugcuauccuggauuaucacaaccaggugagaggcaaaguguuucccccugccgcgaauauggaguacauggucugggacgaaaaccucgccaaguccgcugaggccugggcugccacauguaucugggaucaugggcccagcuaucugcugcgguuccucggacagaaucugucugugcgcaccggcagauaccgguccauucuucagcugguuaaaccuugguaugacgaagugaaggauuacgcguuccccuauccucaagacugcaacccgcgcugucccaugagaugcuuugggccuauguguacacacuacacccagauggucugggccacaagcaaucggaucggaugcgcuauucauaccugucagaacaugaauguguggggcucuguuuggcgcagagccguguaccucgucugcaacuaugcucccaaggggaauuggaucggagaggccccuuacaaagugggcgugcccuguuccagcugcccgccuucuuauggcggguccuguacggauaaccugugcuuccccggagucaccagcaauuaccuuuauugguuuaaguga

SEQ ID NO: 73725 - RNA, 1392 nt, Artificial Sequence
  derived and/or modified sequence opt5 from PI16__Homo_sapiens__NP_001186088
augcacggcagcugcuccuuccugaugcuccugcuuccccugcuccugcuucugguggccaccacagggccugucggagcucucacggacgaggaaaagagacugaugguugagcugcauaaccucuaccgggcccaggugucuccgaccgcgagcgauaugcugcacaugcgcugggacgaagaacuugcugccuuugccaaggcuuaugccagacaauguguguggggccauaauaaggaacgggggcgcagaggagagaaccuguucgcuaucacagaugagggcauggacgucccccucgccauggaagaguggcaccaugaacgggagcacuacaaucuguccgcggcuaccugcucuccugggcagauguguggacacuauacacaggugguuugggccaaaaccgagcgcauuggcugcggcagccauuuuugugaaaaacuucaggggguggaggaaacaaacaucgagcugcucgucugcaauuacgaacccccuggaaacgugaaaggcaagagacccuaucaagaggggaccccuuguucccagugcccgucuggauaccacuguaagaauagccugugcgagcccauuggcuccccugaagaugcccaggaccugcccuaucucguuacggaggcuccuagcuuccgggccaccgaagcgucugauucccgcaaaauggggacacccagcucucuggccaccggaaucccggcuuuucuugugacagaggucuccggcagccuggccaccaaggcucucccugccguggaaacgcaggcccccacaucucuggcuaccaaagacccucccuccauggcgacagaggcucccccuugugugaccaccgaggucccgagcauucuugccgcccauucccugcccucucucgaugaggagccuguuacauuccccaagagcacgcacgugccuauccccaaauccgccgacaaggugaccgauaagacaaaagucccgagcagaucuccugaaaacucccuggaccccaagaugagccugaccggcgcucgggagcuccugccucacgcccaagaagaggcggaggcugaagccgagcuucccccuucuagcgaagugcuggccuccguuuuucccgcucaggauaaaccgggggagcuccaggccacacuggaccauaccggacacacgucuagcaagucccuuccuaauuuccccaacacaagcgcuaccgccaaugcgaccggcgggcgcgcccuggcucuccagucuucccugcccggagccgagggcccugacaaaccgagcguggucucugggcugaacuccggacccggccauguguggggcccucuccuggggcuucugcuccugcccccucugguucuugcuggaaucuuuuga

SEQ ID NO: 73726 - RNA, 354 nt, Artificial Sequence
  derived and/or modified sequence opt5 from PI3__Homo_sapiens__NP_002629
augagagccagcuccuuccugaucguggucguuuuucucauugcuggcacccuggugcuugaggccgcggugacagggguccccgugaagggacaggacacgguuaaaggccgggugccuuucaacgggcaagauccggucaagggacaggugucuguuaaaggccaggacaaggugaaagcucaggaacccgucaaggggccugugagcaccaagcccggauccugcccuaucauucugauccgcugugccaugcucaaucccccuaacagaugccugaaagauacagacuguccgggcauuaagaaaugcugugagggcucuugcgggauggccuguuuugugccccaauga

SEQ ID NO: 73727 - RNA, 1440 nt, Artificial Sequence
  derived and/or modified sequence opt5 from PI4K2A__Homo_sapiens__NP_060895
auggacgagaccagcccccugguguccccugaaagagcccagccgcccgauuacacauucccuucuggcagcggggcucacuuuccccaagucccuggaggcgccguucggguggcggcugccgccggguccggacccucuccuccgggcagccccgggcaugaccgcgagagacagccucuccuggaucgggcucgcggagccgcugcccagggccagacgcaaaccguggcggcccaggcucaggcccuugcugcccaggcggccgcugccgcucacgccgcccaagcucauagagaacggaacgaguuccccgaagacccugaguuugaggcggucgugcgccaggccgaacuggcuaucgagagaugcauuuuccccgaacggaucuaucagggcuccucugggagcuacuuuguuaaggauccgcagggacgcauuaucgccguguucaaaccuaagaaugaggagcccuauggccaccucaacccuaaauggacaaaguggcugcaaaaacuuuguugccccuguugcuuugggagagacugucugguccucaaucagggauaccuguccgaagccggcgcuagccugguggaucagaagcucgagcugaacauuguuccccggaccaagguggucuaucuugccucugaaacauucaauuacuccgcgaucgaccgcgugaaaagcagagggaagcggcuggcucucgagaaagugccuaaggucggacaacgcuuuaacagaaucggccugccgcccaaaguuggcucuuuccagcuuuuuguggaaggguauaaggaugccgacuacuggcugcggagauucgaggccgagccucuccccgaaaauaccaaccgccagcugcugcuccaguuugagcggcuggugguccuugauuacauuaucagaaauacagaccgcggaaacgauaauuggcugauuaaguaugacugcccuauggacuccagcucuagccgggauaccgacugggugguugugaaagaacccgucaucaagguggcugccauugauaacggccucgcuuucccgcugaaacauccugacagcuggagagccuaccccuucuauugggcguggcuuccucaagccaagguucccuuuucccaggagaucaaagaucugauucucccuaagaucucugaccccaauuucgugaaagaucuggaagaggaccuguacgagcucuuuaagaaggauccgggguucgaccgcggacaguuucacaaacagaucgcugucaugcggggccaaauucugaaccuuacgcaggcccugaaggauaauaaaagcccucuccaccuggugcagaugccucccgucaucguggaaaccgcuagaucccaucagcgcuccucuuccgagagcuauacacaaucuuuccagagccggaagcccuuuuucuccuggugguga

SEQ ID NO: 73728 - RNA, 1446 nt, Artificial Sequence
  derived and/or modified sequence opt5 from PI4K2B__Homo_sapiens__NP_060793
auggaggacccuagcgaaccugauagacuggccuccgcugacggcgggucuccggaggaagaggaagauggagagcgggagccccuccugccucgcaucgccugggcgcaccccagacggggcgcuccugggagcgccgugcgccuucuggacgccgcuggagaagagggcgaagccggggaugaggagcucccccugccuccgggagacgucggcguuuccagaucuagcuccgcugaacuugaucggucucgccccgccgugagcgugaccauuggcacauccgagaugaacgcguuccuggacgauccugaauuugccgacaucaugcucagagcugagcaggccauugaagucgggaucuuccccgagcggauuagccaaggaucuuccggcagcuacuuugugaaggauccuaaacgcaagaucaucgggguuuucaaacccaagucugaggaaccguauggacagcugaauccuaaauggacgaaguacgugcauaaggucugcugucccugcuguuuuggcagagggugccugauuccuaaccagggauaucucuccgaggcuggcgccuaccugguggacaauaaacuucaccugagcaucguucccaagaccaaaguggucuggcucgugucugaaacauucaacuauaaugcgauugaucgggccaagucccgcggcaaaaaguacgcucuggagaaggugcccaaagucgggagaaaguuucaucggaucggacuuccuccgaaaauuggcagcuuccagcuguuuguugaaggguauaaggaggccgaguacuggcuccgcaaauucgaagcugacccccugccugagaacaucagaaagcaauuucagucccaguucgaacggcuggugauucucgacuacaucaucagaaauaccgaucgcggaaacgacaauuggcuggugcgguaugagaaacagaagugugaaaaggagauugaucacaaagagucuaaguggaucgacgaugaagaguuucuuauuaaaaucgccgccauugacaacggccuggcuuuccccuucaagcauccugaugaauggagagcguaccccuuucacugggccuggcucccgcaagcuaaagucccuuucagcgaggagauccgcaaucugauccuucccuauauuuccgacaugaacuuugugcaggaucugugcgaagaccucuacgagcuguucaagacagauaagggguuugacaaagccaccuucgaaagccagaugucuguuaugcggggacagauccugaaucucacacaagcccugagagacggcaaguccccuuuucagcuugugcagauucccugugucaucguggagcgcagccaaggcgggucucagggacggauuguucaccugagcaacuccuucacccagacggugaauugcagaaaacccuuuuucucuagcugguga

SEQ ID NO: 73729 - RNA, 6309 nt, Artificial Sequence
  derived and/or modified sequence opt5 from PI4KA__Homo_sapiens__NP_477352
auggccgcugcccccgcgagaggcgggggaggcgggggaggcgggggaggcggcugcuccggguccggaucuagcgcuucccggggcuucuacuucaacaccgugcugucucucgcccgcagccuggccguccagagaccugcuucccuugagaagguucaaaagcugcucuguaugugcccgguggacuuccacgggaucuuucagcuggacgaacggcgcagagacgccgugauugcucuuggaaucuuccugauugagucugaucuccagcacaaggacugugucgugcccuaucugcugcggcuccugaagggccuuccuaagguuuacuggguggaagagagcacagcccgcaaagggagaggagcgcugcccgucgccgaauccuuuagcuucugccucgugacgcugcuuucugauguugcuuaucgggacccuucccugcgcgaugagauccucgaggugcugcugcagguccuccacgugcugcuuggcaugugucaagcccuggaaauucaggacaaggaguaccucugcaaguaugcuauccccugucugaucggcauuagcagagccuuugggcgguacucuaauauggaagagucccuucugagcaaacucuucccuaagaucccgccccauucucugcgcgugcuggaggaacucgagggagucagacggcgcuccuuuaacgauuucagaagcauucugccuuccaaucuucugaccguuugccaggaaggcacacucaaacggaagaccucuagcguguccagcaucucucaggugucccccgagagagggaugccucccccgagcucuccuggaggcagcgcguuucacuauuucgaagccuccugucugcccgacgggacagcucuugagccugaguacuacuuuucuaccauuagcuccagcuucucugucagcccgcuguucaacggagugacauauaaagaauuuaauaucccccucgagaugcugcgcgaacugcucaaccugguuaagaagauuguggaggaagccguccuuaaaagccuggaugcuaucguggccucuguuauggaggccaauccuuccgcugaccucuacuauaccagcuucuccgauccgcuguaccugacgauguuuaagaugcuucgggacacccucuauuacaugaaagaccugcccacaucuuucgugaaggagauccaugauuuuguccuggaacaauucaacaccagccagggcgagcuccagaaaauucugcacgacgcggauagaauccacaaugaacuuuccccucugaagcuccgcugccaggccaacgcugccuguguggaccugauggucugggccgugaaagaugagcaaggcgcugaaaaucugugcauuaaacuuucugagaagcuccagagcaaaacauccagcaagguuaucauugcccaucugccccugcucaucugcugucugcaggggcuuggacggcugugcgagagauuuccuguggucgugcacucuguuacccccucccuccgcgacuuccuggugaucccgagcccuguccuggugaaacuuuauaaguaccauucucaauaccacacgguggcgggcaacgauauuaaaaucuccguuacaaaugaacacagcgagucuacccucaacgucaugagcgggaagaagucccagcccagcauguaugaacagcugcgggacauugcuaucgauaauauuuguagaugccugaaagccggacucacaguggacccugugaucgucgaggccuuucuggcuucucuuuccaaccgccuguacaucagccaggaguccgauaaggacgcccaucucauucccgaccacaccauccgggcucugggccauauugccguggcgcugagagauaccccuaaaguuauggaacccauccuucaaauucuccagcagaaguucugucagccgccuucuccccuggacgugcugaucauugaucaacucgggugccuggucaucacaggcaaccaguauaucuaccaggagguguggaaucuuuuucagcaaauuagcguuaaagccuccucuguggucuauagcgcuacgaaggacuacaaggaucacggauaucgccauuguucccuggccgugaucaacgcucucgccaauauugcggccaacauccaggacgaacaccugguugaugagcugcuuaugaaucugcucgaacuguucgugcagcucggccuggaggggaaacgggcuucugagagagccagcgaaaagggacccgcucuuaaagccuccagcucugccggcaaccuggggguccucauuccugugaucgcugugcugacccggcgccugccgcccaucaaggaggcgaaaccuagacuucagaagcuguuucgggacuucuggcucuacuccguccugaugggauucgccguugaaggcagcgggcucuggcccgaggaaugguacgagggcgugugcgagauugcuacaaagucuccucugcuuaccuuucccuccaaagaaccucugagaagcgugcuccaauauaauucugccaugaagaacgauacagucacccccgccgagcuguccgaacugcgcagcacgaucauuaaucuucuggacccgccucccgagguguccgcucucaucaacaaacuggauuucgccaugagcacauaccuccugucuguuuaucggcuugaauacaugagagugcugcgcagcaccgacccugauagauuucaggucauguucuguuauuuugaggacaaggcgauucagaaagacaaguccggaaugaugcaaugcgugaucgcuguugccgauaaaguguucgacgccuuucugaauaugauggcugauaaggccaagaccaaagagaacgaagaggaacucgagcggcacgcgcaguuccugcuugucaauuuuaaccauauccacaagcgcauuagacggguggcugacaaauaccugucuggccucguugauaaguucccccaucugcucuggagcgggacagugcugaaaaccaugcuugacauccugcagacacugucccucucucugagcgccgauauucacaaggaccagccguauuacgauaucccugacgcccccuaccgcauuacggucccugauaccuaugaggcuagagaauccaucgugaaggacuuugccgcucgguguggaaugauccuucaagaggccaugaaaugggcgcccacagugaccaagucucaucugcaggaauaccucaauaaacaucagaacugggucagcggccugucccagcacacagggcucgccauggcuaccgagagcauucugcauuucgccggauauaacaagcaaaauacgacccuuggcgcuacacagcugucugaacgccccgccugcguuaaaaaggauuacuccaacuuuauggccagccugaaucucagaaaccgguaugcuggggagguguacggcaugauccgcuucucuggaaccacaggccagauguccgaccugaauaagaugauggugcaggaccuucacagcgcgcuggauagaucccauccucaacacuauacccaggccauguucaaacucacggcuaugcugauuucuagcaaggacugcgauccgcagcuccugcaccaucuuuguugggggccccugcggauguuuaacgagcacggaauggaaacagcccuggccugcugggaguggcuccuggcuggcaaagacggggucgaagugccuuucaugagagagauggccggagcguggcauaugaccguugaacaaaaguuuggccuuuucuccgcugagaucaaagaggccgauccccuggccgcuagcgaagccucucagccuaagcccuguccuccggaggugacaccccacuacauuuggaucgacuuucucguccagcgcuucgaaauugcgaaguacugcuccagcgaucagguggagaucuuuucuagccugcugcaacgguccaugucucucaauaucgggggcgcuaaaggaagcaugaacagacauguugccgccauuggcccucgcuucaaacuucugacccuggggcucucccugcuucacgcugacgugguccccaaugccaccauccggaacgugcugagagagaaaauuuauucuacagcuuuugauuacuucagcuguccucccaaguuuccgacgcagggagaaaaacgccuccgggaggacaucuccauuaugaucaaguucuggaccgccauguucagcgauaaaaaguaucugacagcgucucagcuggucccucccgacaaucaggacaccagauccaaccucgauaucacagugggcagccgccaacaggccacccagggguggauuaauacguacccccuuuccucuggaaugagcacaaucuccaagaaaucuggcaugagcaagaaaaccaaccggggcucccagcugcacaaguauuacaugaaaagacggacccugcuccugagccuucuggcuacagaaauugagcgccucaucaccugguauaauccucugucugcccccgaacuggagcucgaccaagcuggggagaacuccguugccaacuggagaagcaaguacauuucucuuuccgaaaagcaguggaaagauaaugugaaccuggccuggagcaucucuccuuaccuggcuguccagcucccggcgcgguuuaagaauacagaggccaucggaaacgaagugacgcgccugguuagacuugaccccggcgcugugagcgaugucccugaggccauuaaauuccuggugaccuggcauacaaucgacgccgaugcucccgaacucucccacgugcugugcugggccccuaccgaucccccgacagggcugucuuauuuuagcuccauguacccuccccauccucucaccgcgcaguauggaguuaagguccuucggagcuuucccccugaugcuauucuguuuuacaucccccaaauugugcaggcccugagauaugacaaaaugggcuacgugcgcgaguauauccucugggccgcuuccaagucucagcugcuugcccaccaauucauuuggaauaugaagacgaacaucuaccuggaugaggaagggcaccagaaagacccggauaucggagaccuccuggaccagcuggucgaggaaauuaccggcagccucuccggcccugcgaaggauuuuuaccagcgggaguucgacuuuuucaauaaaaucacaaacgugucugccauuaucaagcccuaucccaaaggggaugaaagaaagaaggcuugucuuagcgcccuguccgagguuaaagugcaaccuggaugcuaccugccgucuaaucccgaggcuauuguccucgacaucgauuauaagagcggcaccccuaugcaguccgccgcuaaagcccccuaccuggcgaaguuuaaagugaagcgcugugggguuagcgaacuugagaaggaaggacugcggugcagaucugacuccgaggaugaauguagcacacaggaggccgacggccagaaaaucucuuggcaagcugccauuuucaaggugggggaugacugccgccaggauaugcucgcucugcagaucauugaccuguuuaaaaacaucuuccagcucgucggacuugaucuguucguguuuccuuaucggguuguggccaccgcccccggcugcggcgucauugaguguaucccugacugcacauccagagaccaacuggggcgccagaccgauuucggaauguacgacuauuuuacgagacaguacggcgaugaaagcacacucgcuuuccaacaggcgcgguacaauuuuauccgcucuauggccgcuuauucccugcuucuguuccuccugcagauuaaggacagacauaacgggaauaucaugcuggauaaaaagggacacauuauccauauugacuuuggcuucauguuugagagcucccccgggggaaaccucggcugggaacccgauaucaaacuuaccgacgagauggugaugauuaugggcgggaagauggaggccaccccuuucaagugguuuauggaaaugugugugcggggauaccuggccguccgccccuauauggaugcuguugugagccuggugacacucaugcuggacaccggccuuccuugcuucagagggcagacgaucaaacugcucaagcaccgguuuucucccaauaugacagagagagaagccgcgaacuucaucaugaaagucauucaaagcuguuuccuguccaaccgcucucggaccuacgauaugauccaguauuaccagaaugacauuccguauuga

SEQ ID NO: 73730 - RNA, 2406 nt, Artificial Sequence
  derived and/or modified sequence opt5 from PI4KB__Homo_sapiens__NP_001185703
augggcgacaccguggucgagcccgccccucugaagccgacaagcgaacccacguccgggccucccggaaacaauggcgggucucuccugagcguuaucaccgagggagugggcgaacuuuccgugauugauccugaggucgcucagaaagccugccaagaagugcuggagaagguuaaacuccugcacgggggaguggcggucucuagcagaggcacaccccuugagcuggugaacggcgacgggguugauuccgaaauccggugucucgacgauccuccggcucagauucgcgaggaagaggacgagaugggagccgccguggcuucuggcaccgccaagggggcuagacggcgcagacagaauaacagcgccaaacaguccuggcugcugcggcuguucgaaagcaagcuguuugauaucucuauggcgauuuccuaccuuuauaauagcaaggagcccggaguccaagccuacaucggcaaccgccuguucugcuuuagaaaugaagacguggauuucuaucucccucagcugcuuaacauguacauccauauggacgaggaugugggggacgcuauuaaacccuauaucguccaccggugucgccagucuauuaauuuuucccugcagugcgcccuccugcugggagcuuacagcucugauaugcauaucuccacacaaagacacagccggggcaccaagcuccgcaaacugauucuuuccgacgaacugaagccugcccauagaaaacgggagcuccccucucugagcccggcgccugacacaggccuuucccccagcaagcgcacccaccagagaucuaaguccgaugccacggcuagcaucucucugagcuccaaccucaaacggaccgccucuaauccuaagguugagaacgaagacgagcccgugagacuggcucccgaacgcgaguucauuaaaagccugauggccaucgggaagcggcucgccacacugccuaccaaagaacagaagacacagagacuuaucuccgagcugagccuccugaaucacaaacuuccggcucgcguguggcugcccaccgcgggauuugaucaucacgucgugcggguuccucauacgcaagccgugguccucaacucuaaggacaaggcucccuaucugauuuacguggagguucuggaaugugagaauuucgauacaaccuccgugccugccagaauccccgaaaaccgcauucggagcacaagaucugucgagaaccucccggaaugcggcaucacccacgagcagcgcgccggguccuuuagcaccgugccuaauuacgacaacgaugacgaggcuugguccgucgaugacauuggagaacuccagguggagcuucccgaaguucacacaaauucuugugauaacaucagccaauucuccguggacucuaucacgagccaggaguccaaagagccugucuuuauugccgcgggcgacauccggagacgccugagcgaacagcucgcucauacccccacagccuucaagcgggauccugaggaccccucugccguggcucugaaagaaccguggcaggagaagguuagacggauucgcgaaggguccccuuauggacaucugcccaauuggagacuucucagcgugaucgucaaaugcggcgaugaccugcggcaagagcugcucgccuuucaggugcugaagcagcuucagucuauuugggagcaagaaagagugccccuguggaucaagccuuacaaaauccucguuauuuccgcugauagcggcaugaucgagccggucgugaacgccgugucuauucaccaggucaagaaacagagccagcugucccugcuugacuauuuccuccaagaacacgggagcuacaccacagaggcguuccugucugcccagcgcaauuuugugcaguccugugcuggauauugccugguuuguuaccuccuucaggugaaggaucggcauaacggcaauauccugcuggacgccgaagggcacauuauccacauugauuucggauuuauccucagcuccucucccagaaaccugggcuucgagaccagcgcuuuuaaacugacgacagaguucgucgacgugaugggcgggcuugauggagacauguuuaauuauuacaagaugcucaugcugcaaggccugaucgccgcgcgcaagcauauggauaaaguugugcagauugucgaaaucaugcagcaagggucccagcucccuugcuuccacggaucuagcaccauuagaaaccugaaggagcgguuucauauguccaugaccgaggaacagcuucagcugcucguggaacaaaugguugacggcucuaugcgcagcaucacaaccaaacuguacgacggguuccaguaucugacaaauggaauuauguga

SEQ ID NO: 73731 - RNA, 1956 nt, Artificial Sequence
  derived and/or modified sequence opt5 from PIAS1__Homo_sapiens__NP_057250
auggccgacagcgcugagcugaagcagauggugaugucccucagagucucugaacugcaaguucuucugggcuacgccgggcggaacaaacacggacgcaagcaugagcuccugaccaaagcgcuucaucugcucaaggcuggcugcagccccgccgugcagaugaaaaucaaggaacuguauagacggcgcuucccucagaagauuaugacaccggccgaucuguccauccccaaugugcacucuagcccuaugcccgcuacgcucuccccuucuaccauuccccagcugacauacgacgggcacccugccagcuccccgcuucugcccgucagccuccugggaccuaaacaugagcuugaacugccccaccucaccucugcucugcacccugugcaucccgauaucaagcugcaaaaacucccguuuuaugaccugcuugaugagcugauuaagccuacaucccucgccagcgacaacucucagagauuccgggagaccuguuuugcguucgcccugacaccccagcagguucaacagaucuccagcucuauggauaucuccggcaccaaaugcgacuuuacggugcagguccagcuucgcuucugucugagcgaaaccuccugcccucaagaggaucacuuuccucccaaucucugugugaagguuaacacaaagcccugcucucugccgggguaccugcccccuaccaaaaauggaguggaacccaagagaccuagccggcccauuaacaucacaucccucguccgccugagcaccacggugccgaauacaauuguggucucuuggaccgcugagaucggcagaaacuauuccauggccguuuaccuugugaaacagcugagcucuacagugcuccugcagcggcuucgcgcuaagggcauuagaaauccugaccauagccgggcccugaucaaagagaagcucaccgcggaucccgacuccgaaauugccaccacaucucugcgcgucagccugcucuguccucuggggaaaaugagacuuacgauccccugccgggcucugaccuguucccaccuccaaugcuucgaugccacacuguauauccagaugaacgagaagaagccuaccugggugugucccguuugcgacaaaaaggcuccguacgaacaccugauuaucgacggacuuuuuauggagauucucaaauacugcacagauugugacgaaauccaguucaaggaggauggcaccugggccccuaugagaagcaaaaaggaggugcaggaagucucugccuccuauaaugggguggacggaugccugagcucuacgcuggagcaucaaguugcuucccaccaucagagcuccaacaagaauaaaaagguggaagucauugaucucacaaucgacucuagcuccgaugaggaagaggaggaacccucugcgaaacgcaccugucccagccuguccccuaccagcccgcuuaacaauaagggcauccugucucucccccaccaggccuccccugugagccggacacccucucugccugcugucgacaccuccuacauuaacacaagccugauccaggauuauagacaucccuuucacaugacgccuaugcccuacgaccuucaagggcucgauuucuuuccguuccugucuggagacaaccagcacuauaauaccagccugcucgccgccgcugccgcggcuguguccgacgaucaggaccugcuucauagcucucgcuucuuuccuuacacauccagccagauguuccuggaucaacucuccgccggcggcucuaccagccugcccacaaccaacggguccucuagcggauccaauucuagccugguuuccagcaacucucuucgggagucccacagccauacggugaccaauagaucuuccacagacaccgccagcauuuuuggcaucauuccugauaucaucucucucgacuga

SEQ ID NO: 73732 - RNA, 1866 nt, Artificial Sequence
  derived and/or modified sequence opt5 from PIAS2__Homo_sapiens__NP_004662
auggccgacuucgaggaacugagaaacauggugagcuccuuucgggucucugagcuccagguucugcuuggcuucgcugggcgcaauaagagcggaagaaaacacgaucugcucaugcgggcccugcaucuucugaaguccggcugcucucccgcggugcaaaucaaaauucgcgaacucuacagacggcgcuauccuagaacccuggaggggcugagcgaccucuccacaaucaagucuagcguguuuucccuggauggaggcagcucuccggucgaacccgaccuugcuguggccgggauucacucccugccuagcacgucuguuacaccccauuccccuagcucucccgugggauccguccuccugcaggauaccaaaccuaccuucgagaugcagcagccgucucccccuauucccccugugcaccccgacguucaacuuaagaaccugccguuuuacgaugugcucgacguccugaucaagccuacaucccuggugcagucuagcauccagcgguuccaggagaaauuuuucaucuuugcccucacaccccaacaggugcgcgaaauuuguaucuccagagauuuccugccuggcggccggcgcgacuauaccguccagguucagcuuagacugugccucgcugagaccagcuguccccaagaagauaauuaccccaacucucugugcauuaaggugaaugggaaacuuuuuccucugccgggauaugcucccccucccaagaacggcaucgagcagaaacggccugggcgcccccucaauauuacgucccuggugagacugagcucugccgucccgaaccagaucagcauuuccugggccucugagaucggaaagaauuacagcauguccguguaucucguucggcaacugaccagcgcgaugcuucugcagagacucaagaugaaaggcauccgcaacccugaccauucucgggcccugauuaaggaaaaacuuacagcugaucccgacuccgagaucgccaccacaagccugagagugucucucauguguccucuggggaagaugcgccugaccauucccugccgggcugucacguguacacaccuccagugcuucgacgccgcgcuguaccuucagaugaaugagaaaaagccuaccuggaucugucccgugugcgauaaaaaggccgcuuacgaaucccugauucucgacggacuguuuauggaaauccugaacgauuguagcgacguugaugagaucaaguuccaagaggacggcuccuggugcccgaugagaccuaaaaaggaagccaugaaagugucuagccagcccugcacaaagauugaguccucuagcguccuuuccaaacccuguagcgugaccgucgcuucugaagccuccaagaagaaaguggauguuaucgaccucaccauugagagcagcuccgaugaagaggaggacccuccggccaagcgcaaaugcaucuucaugagcgaaacacagucuagccccacgaagggcgugcugauguaucagccuuccagcguccgggugcccucuguuaccuccguggauccugcugcgauucccccuagccugacagacuacuccguccccuuucaccauaccccgaucucuagcauguccucugaccucccugggcuggauuuccuuagccugauccccguggacccucaauauugucccccgauguuucucgauucccugacaucuccucugaccgccagcuccacgagcgugacaaccaccucuucccacgagagcucuacacauguuuccucuagcuccagcagauccgaaaccggagucauuacaagcucuggcagcaauauccccgacauuaucucccuugauuga

SEQ ID NO: 73733 - RNA, 1533 nt, Artificial Sequence
  derived and/or modified sequence opt5 from PIAS4__Homo_sapiens__NP_056981
auggccgcugagcugguggaagccaagaacauggucaugagcuucagaguuuccgaccuccagaugcugcuuggcuuuguggggcggucuaaaagcggacugaagcacgagcucgugacccgcgcgcugcaacuuguccaguucgauugcucccccgaacuguuuaaaaagaucaaagagcucuacgaaacaagauaugcuaagaagaauagcgagccugccccgcagccccaucggccucuggacccccugacgaugcacagcaccuacgaucgcgccggcgcugugccuagaacaccccucgccgggccuaacauugacuauccgguucuguacggaaaauaucuuaauggccuggggcggcuccccgcuaagacccugaaaccugaggugcgccuugucaagcugcccuucuuuaacaugcucgaugaacugcugaaaccuacagagcucgugccccagaauaacgaaaagcugcaagaguccccguguaucuucgcccuuaccccuagacagguugagcugauucgcaauucucgggaacuccagcccggagugaaggcgguccagguggugcugagaaucugcuacagcgacacauccuguccucaagaggaucaguauccucccaacauugccgucaaaguuaaucauagcuacugcucugugcccggcuacuauccguccaacaagcccggcguggaaccuaaacggcccugucgcccuaucaaucuuacccaccugauguaccucagcucugcuacgaacagaaucaccgucacaugggggaauuauggaaaguccuacagcguggcccuguaucugguucggcagcucaccucuuccgagcugcuucagcgccugaaaacaauuggcgugaagcaucccgaacucugcaaagcucuggucaaggagaaacuuagacuggacccggauagcgagaucgccaccacgggggugcggguuucccucauuuguccucuggugaagaugagacugucuguccccugccgcgcggaaacaugugcccaccuccaaugcuuugacgcuguguucuaccugcagaugaacgagaagaaaccuaccuggaugugucccgucugcgauaagccugcccccuaugaccagcuuaucauugauggacugcucagcaaaauccuguccgaaugcgaggacgcugacgaaauugaguaccugguggauggcagcugguguccgauccgggccgagaaggaaagaucuugcuccccucaaggggccauccuuguucucggacccagcgacgcuaauggccugcugcccgcgccuucugugaacggcagcggggcccucggauccacaggcgggggaggcccggucgggucuauggagaacggaaagcccggcgcugaugugguugaccugacccuugauagcuccucuucuuccgaagacgaggaagaggaggaagaggaagaggaggaugaagacgaggaaggcccucgccccaaacggagauguccuuuucagaaggggcuggugcccgccugcuga

SEQ ID NO: 73734 - RNA, 2274 nt, Artificial Sequence
  derived and/or modified sequence opt5 from PIBF1__Homo_sapiens__NP_006337
augagcagaaagaucuccaaagagucuaagaaagugaacauuagcuccucucuggaaagcgaggacaucucccucgaaaccacaguccccacggaugacauuucuagcuccgaggaacgggagggcaagguucgcaucaccagacagcugauugagcggaaagaacuucugcacaauauccaacuccugaagaucgagcuuagccagaagacaaugaugauugauaaccugaaaguggacuaccucaccaagaucgaagaacuggaggaaaaacugaaugaugcccuccaucagaagcagcugcuuacacugcgccucgacaaccaacuggcuuuccagcagaaagaugccucuaaguaucaggagcuuaugaagcaagaaauggagaccauucugcucagacagaaacagcuggaagagacaaaucugcagcuccgggagaaggcgggggacgugcgcagaaaccugcgggauuuugaacuuaccgaggaacaauacaucaaacugaaggcuuucccugaggaccagcucuccauuccggaauaugucagcgugcgcuuuuacgagcugguuaauccccuuagaaaagagaucugcgaacuucaggugaagaaaaacauucucgccgaggaacugucuacgaauaagaaccaacugaagcagcucaccgagacauaugaagaggaucggaaaaauuacuccgagguccagauccgcugucagagacuggcccuugaacuggcugacaccaagcaacucauccagcagggagauuaucggcaggagaacuacgacaaaguuaagagcgaacgcgacgcccuggagcaagaggugauugaacuuagacggaaacacgagauccuggaagcuagccauaugauucagacaaaggagagauccgaacucagcaaggagguggucacccuggagcagacggugacacugcuccagaaagauaaggaauaccugaaucgccaaaacauggagcuuuccgugcggugcgcccacgaagaggacagacuggaacgccuccaggcgcagcuggaggagucuaaaaaggcccgggaagagauguaugaaaaauacgucgcuagcagagaucauuauaagaccgaguacgaaaauaagcugcacgacgagcuugagcagauccgccucaaaacaaaccaagaaauugaucagcugcggaacgccuccagagagauguaugaacgcgagaaucggaaccugagagaggcucgcgacaaugccguugcggaaaaggagcgggccgugauggcugaaaaagaugcccucgagaagcacgaccagcugcuugauagauaccgggaacugcaacucagcaccgagucuaaagugaccgaguuccugcaucaguccaagcugaagucuuuugaaucugagcgcguccagcuucuccaggaagagacagcuagaaaccugacgcaaugucagcuggaaugcgagaaauaucagaagaaacucgaggugcugaccaaggaguucuacagccuucaggccuccucugagaaacggaucacagaacugcaagcccagaauagcgagcaccaggcuagacucgacaucuacgaaaagcuggagaaagagcuggaugaaauuaucaugcagaccgcggagauugaaaacgaggacgaggccgaacgcguucuguuuuccuauggcuacggggcuaaugugccuacaaccgccaagcggagacucaagcaaagcguccaucuggcccgcagagugcugcagcucgagaaacagaacucucugauccuuaaggaccuggaacaccggaaagaucaaguuacgcagcucucccaggagcuggaccgcgcuaauagccugcuuaaccagacacaacagcccuauagauaccucauugaaucugugcggcagcgcgauuccaagaucgacagccugaccgaguccaucgcccagcuggagaaagaugucucuaaucucaacaaggaaaagagcgcgcugcuucaaaccaaaaaucagauggcucuggaccucgagcagcugcugaaccacagagaggaacuugccgccaugaagcagauucuggugaaaaugcauuccaagcacucugaaaauagccuccugcucacaaaaaccgagccuaagcaugucacagagaaccaaaaguccaaaacgcugaacgugcccaaggaacacgaggauaauaucuucaccccuaaaccgacacuuuuuaccaagaaagaagcucccgaguggagcaagaagcagaaaaugaagacauga

SEQ ID NO: 73735 - RNA, 1833 nt, Artificial Sequence
  derived and/or modified sequence opt5 from PICALM__Homo_sapiens__NP_001008660
augagcggccagucccugaccgacagaaucacagccgcucaacacucugugacggggagcgccgucuccaagaccguuugcaaagcgacaacccaugagauuaugggacccaagaaaaagcaccucgauuaccugauccaguguacaaacgaaaugaaugugaacauuccucagcuugcugacucucuguucgagcggaccacaaauagcuccuggguggucguguuuaaaucucucaucaccacgcaucaccugaugguuuauggcaacgaacgcuucauucaguaccuugccagcagaaauacccuguuuaaccucuccaauuuccuggauaagagcgggcugcaaggauaugacaugucuacauuuauccggcgcuacuccagauaucucaacgagaaggccgugagcuaccggcaggucgcuuucgauuuuaccaaagugaagcgcggcgccgacgggguuaugagaacaaugaauaccgaaaaacugcuuaagacggugccgaucauucagaaccagauggaugcucugcucgacuucaaugucaacucuaaugagcugacaaacggagugaucaaugccgcguuuaugcuucuguucaaagaugccauucggcucuuugcugccuauaacgagggcaucauuaaccugcuggaaaaguacuucgacaugaagaaaaaucaaugcaaggagggccucgauaucuacaaaaaguuucugacccgcaugacaagaauuuccgaguuccuuaaaguggcugagcaggucgggaucgaccggggagauauccccgaccugagccaggccccuucuucccuccuggacgcgcuugagcagcaucuggccagccucgaaggcaagaaaauuaaggauuccaccgcugccucucgcgcuaccacacugagcaacgccguuuccagccuggccucuacggggcucucccugaccaagguggacgagagagaaaaacaagcugcgcuugaggaagaacaggcccggcugaaggcucucaaagagcagcgccugaaggaacuugccaaaaagccccacacaagccugaccacagccgcuucuccugugagcaccuccgccggaggcaucaugacggcgcccgcuauugauaucuucucuacaccuagcuccagcaauucuaccuccaagcucccgaacgaccugcuggaucuccaacagcccaccuuucacccuagcguccaucccaugucuacagccucccagguggccagcaccuggggaggauucacaccuucccccguugcucagccgcacccuucugccggccugaauguggacuuugagagcgucuucggcaacaaauccacgaaugugauuguugauucugggggauuugacgaacuuggcgggcugcucaagcccaccguggcuagccaaaaccagaaucugccugucgccaaacugccucccuccaaacuugugagcgaugaccucgauucuucccuggcgaaccuggucggaaaucucggcaucgggaacggaacaaccaagaaugacgugaacuggagccagcccggcgagaagaagcugacaggcgggucuaauuggcagccgaaaguugcccccaccacggcuuggaacgccgcuaccaugaacggaaugcauuucccucaauaugcgcccccugugauggccuaccccgccacaaccccgacaggcaugaucggguaugggauuccuccccagaugggcuccgucccugugaugacccagcccacgcuuaucuacagccagccuguuaugagacccccgaauccuuuugggcccgugucuggcgcucaaauucaguucauguga

SEQ ID NO: 73736 - RNA, 1248 nt, Artificial Sequence
  derived and/or modified sequence opt5 from PICK1__Homo_sapiens__NP_001034673
auguucgccgaccuggauuacgacaucgaggaagauaagcucggcauucccaccgugccugggaaggucacacugcagaaggacgcucaaaaccuuaucggaauuagcaucggcgggggagcccaguauugcccgugucuguacauuguucagguguuugauaauacgcccgcggcucucgacggcaccguggccgccggggaugagaucacaggagucaacggcagauccaucaaaggcaagaccaaaguggaaguugcuaagaugauucaggaggugaagggggaagucacaauccacuauaauaaacugcaagccgacccuaagcagggaaugucucuugauauugugcugaaaaagguuaaacaucggcucguggagaacaugagcuccggcaccgcugacgcccuggggcugucucgcgcgauccucugcaaugauggacuggucaagagacuugaggaacuggagcggacagccgaacucuacaagggcaugaccgagcacacgaaaaaccugcuucgcgcuuucuaugagcugagccagacccauagagccuuuggggacguguucuccgugauuggaguccgggaaccccagccugcugccucugaggcguuuguuaaguucgccgaugcucaccgcagcaucgaaaaauuuggcauuagacuccugaagacaaucaaacccaugcugaccgaccucaauacauaccugaacaaggccaucccugacacccggcuuacgauuaaaaaguaucuggaugugaaguucgaguaccucuccuacugucugaaagugaaggaaauggacgaugaggaguauagcugcaucgcucuuggcgaaccgcuguaccgcgucucuacagggaauuaugaguacagacucauucugcggugucgccaagaagccagagcccgguuuucccagaugcgcaaagacgugcuggagaagauggaacuccuggaucagaaacauguucaggacaucguguuccaacuucagagacuggucagcaccaugucuaaguauuacaacgauugcuaugcugugcuccgggacgcggauguuuuucccauugagguggaccuggcccacacaacccuugcuuacggacugaaucaggaggaguucaccgauggcgaagaagaggaagaggaggaagacacagccgccggggagccuuccagagacacgcgcggagcugccggcccccucgauaaagggggaagcuggugugacucuuga

SEQ ID NO: 73737 - RNA, 654 nt, Artificial Sequence
  derived and/or modified sequence opt5 from PID1__Homo_sapiens__NP_001094288
auguggcagcccgccaccgagagacugcaacacuuccagacaaugcucaagagcaaacugaacgugcuuacgcugaagaaagaaccucucccggcugucaucuuucaugagcccgaagccauugagcugugcaccacaaccccucuuaugaagacacggacccacuccggcuguaaaguuacauaccuggggaaggugucuaccacgggaaugcaguuccucagcggcugcaccgaaaagcccgugaucgagcuguggaaaaagcauacacuggcgcgcgaggacgucuuuccugcuaaugcccuccuggaaauuagacccuuccagguguggcuucaccaucuggaucacaaaggggaggccaccguucacauggacacauuucaaguggcucggaucgccuauuguaccgcugaucauaacgucuccccuaauauuuucgccuggguguaccgcgaaaucaacgacgaucucucuuaucagauggacugccacgcgguugagugugagagcaagcuggaagccaaaaagcuggcucaugccaugauggaggcuuuuagaaagacguuccacuccaugaaaucugauggacggauccacagcaauuccagcucugaagaggugucccaggaacuugagagcgacgauggcuga

SEQ ID NO: 73738 - RNA, 2763 nt, Artificial Sequence
  derived and/or modified sequence opt5 from PIDD1__Homo_sapiens__XP_011518511
augcagcugcccagagcccucccuggccaggcuugccugcgggccgggaccugucuugcgagcaaggaccgcagaugggcuauggccgccacaguggagggaccggaacuggaggcugccgcugccgcgggcgaugccuccgaagacucugaugcugggagccgggcccuccccuuccugggaggcaaccgccuuucccuggaccucuacccugggggaugccaacagcugcugcaccucuguguccagcaaccccugcagcuucugcagguugaguuucucagacugucuacgcaugaagauccucagcuucuggaggcuacccucgcccaacugccccagagccuguccugccuccggucucuggugcuuaaaggcggccagcgcagagacacacugggggcgugucuccggggagcccugaccaaucuuccugcuggccugagcgggcucgcccaccuggcucaucuggaucucuccuucaacagccuggagacacuuccggccugcgugcugcagaugcgcggacucggcgcccugcuucugucucacaauugucucuccgaacugcccgaggcucugggggcgcucccugcccugaccuuucuuacagucacccauaacagacugcaaacgcugcccccugcucucggagcccugagcacccuucagcggcucgaccugucucagaaucugcucgauacacugcccccggaaaucggcggccuugggucccugcucgagcugaaccuggccagcaaucgccuucaaucucucccugcuucccuggccggacugagaagccuccggcugcuugugcugcacuccaaccuccuggcgucuguucccgcugaccuggcccgccuuccucuccugaccagacuggaucuccgggacaaucagcugagagaucuuccucccgagcugcucgacgcccccuucgugcgccugcagggcaacccgcugggggaagcuagccccgacgccccuuccagccccgucgcugcccuuauuccugagaugccccggcucuuucugacaucugaucuggacuccuucccggugaccccucagggaugcagcguuacgcucgcguguggcgugagacugcaauuucccgccggggcuacagccaccccuaucacaauucgcuaucggcuucugcuccccgaaccuggacuggucccccugggcccgcacgaugcccuucugucucaugugcucgagcugcagccucacggcguggccuuccagcaggacgucgggcucuggcugcuuuuuaccccuccccaagcgagacgcugccgggaaguuguggugagaacccgcaaugauaacagcuggggagaccuggagacauaccucgaggaagaggcuccccagcggcugugggcccauugucaggucccgcacuucuccugguuucuggugguuucuagacccgugagcaaugccugccuugucccucccgaaggcacgcugcucugcuccagcgggcacccuggagugaagguuaucuuucccccuggcgcuaccgaggaaccccgccgggugucuaugcaggucgugagaauggccgggcgggagcugcaagcccuccugggcgagccggaagcugcggucuccccucuucugugucucagccagucuggacccccuuccuuccugcagcccgugacaguucagcugccgcuuccuagcggcauuaccgggcugucccucgaucgcucuagacugcaucuccuguauugggcucccccugcugccacaugggacgauaucaccgcccaagugguccuugagcugacgcaccuguacgcucgguuccaggugacacauuucagcugguauuggcucugguacaccaccaaaaacugcguuggaggccuggccagaaaggcgugggaacgccuucggcugcacagagugaaucucaucgcucugcagcgcagacgggaccccgagcaaguccuccugcagugucuuccccgcaacaaaguggaugccacacugagacggcugcucgaacgcuauagagggccugagccguccgacaccguggagauguuugaaggagaggaguucuuugccgcuuucgaacggggcauugacguugaugccgaccgccccgauugcgucgaggggagaaucuguuuuguguucuacucucaucugaagaacgugaaggaagucagcuuuuaccggggcgcggugccuguucgcgugcccgaggaagcugaggccgccagacagcggaaaggagcugacgcccuuuggauggcuacacugccuauuaagcuccccagacugcgcggcuccgaagggccucggagaggagccggccucagccuggcgccgcuuaaucugggggaugccgagacgggauuccugacccagucuaaccuccuguccgucgcuggccgccuugggcuggacuggcccgccguggcucuccaccugggcguuagcuaucgggaggugcaaagaauccgccacgaauuucgggaugaccucgaugagcagauuagacauaugcuguucucuugggccgaacgccaggccggacagccuggcgcugucgggcuucuggugcaagcgcuggagcaguccgaccggcaggauguugccgaagaggugagagcuguccucgagcugggacggcgcaaauaccaggacagcaucagacggaugggccuugcccccaaggauccugcccugcccgggucuagcgcuccgcaaccucccgaacccgcccaggcguga

SEQ ID NO: 73739 - RNA, 7566 nt, Artificial Sequence
  derived and/or modified sequence opt5 from PIEZO1__Homo_sapiens__NP_001136336
auggagccccacgugcugggcgccguccucuacuggcugcuucugccuugcgcucuccuggccgccugucuucugagauucuccgggcucucccugguuuaucugcucuuucugcuucugcucccgugguuccccggaccuacccggugcggccugcaggggcauaccggaagacuucugagagcucuccugggccugucucuccuguuucuuguggcccaccuggcccuccaaauuugucugcauauugugccccggcuugaucagcugcucgggccuagcugcuccagaugggaaacgcugucuagacacaucggagucacccggcuggaucucaaggacauucccaacgcuaucagacugguggccccugaucuuggcauucugguugugagcuccgucugucucggcaucugcgggagacuggcucggaauacaagacagucuccgcaucccagagagcuugacgaugacgaacgggauguggacgccagcccuaccgcgggacugcaggaggccgcuacacucgcccccacccgcagaucccggcuggcugcccgcuucagaguuacagcgcacuggcugcucguggccgcuggccggguccuggccgugacccuucuggcucucgccgggaucgcccacccuagcgcucugucuuccguguaccugcuucucuuucuggcgcuguguacguggugggccugccauuuccccauuagcaccagaggauuuucucgccucugugucgcuguuggcugcuucggggccggacaccugaucugucuuuauugcuaccaaaugccgcuggcccaggcucuccugccucccgccggcauuugggcgcgggugcugggccuuaaagauuuuguggggccuacaaacugcuccagcccccaugcucucguccugaauaccggacuggacuggcccguguaugccucuccuggcguucuccugcuucuguguuacgccacagcuucccucagaaagcugcgcgccuaucggccgagcgggcagagaaaagaagcugccaagggauacgaggcgcgcgagcuggaacuugccgagcucgaucaguggccccaagaacgggaguccgaccagcacguggucccuaccgcucccgauacggaggccgacaacugcaucgugcacgaacugacaggccagucuagcguucugagacgcccugugcggcccaaaagagcugagccgcgcgaagccuccccucuccauagccuggggcaccuuauuauggaccagucuuacgucugugcgcugaucgccaugauggugugguccauuaccuaucauagcuggcucacauucguccugcugcuuugggcuugccucaucuggaccgugcggucuagacaccaacuggccaugcuguguagccccugcauccuccuguacggaaugacccuuuguugccugcgguauguuugggcuauggaucuccgcccugagcugcccacaacgcugggcccugugucccuuagacagcugggccucgaacauacccgguaccccugucuggaccucggggccaugcugcuuuauacacugaccuuuuggcuccugcugagacaguucgucaaggagaaacuucugaaaugggccgagucuccggcugcgcucacagaagugaccguugccgauacggagccuacacgcacccaaacccugcuccagagccugggagaacuugugaagggcgucuacgcuaaauauuggauuuacgugugcgccgggauguuuaucgugguuuccuucgccggacggcuggucguguacaagauuguguauauguuccucuuucugcugugucuuacacuguuccaggucuacuauagccucuggagaaaacugcucaaggcuuuuugguggcuggugguugccuacaccaugcuugugcugaucgcggucuauacauuccaguuucaagacuuccccgcuuacuggcgcaaucugacgggcuuuaccgaugagcagcucggggaccugggccuugaacaguucucuguguccgagcuguuuagcucuauucucguucccggauucuuucugcucgccugcauccugcagcuucacuauuuccacagaccuuuuaugcaacugacagauauggagcaugugucccugccgggcacccggcucccccgcugggcccacagacaggacgcugucagcgggacaccucugcuucgggaagaacagcaggaacaucaacagcagcagcaagaggaagaggaggaagaggaagauucccgcgacgagggacugggcguggccacaccccaccaggcgacgcagguuccugagggggcugccaaguggggacucguggccgaaagacugcucgagcuggcugccggcuucucugauguccuuagccgggugcaaguguuccugcgcagacugcucgaacugcacgucuuuaaacuuguugcucuguacaccguguggguggcccucaaggaggucuccgugaugaaccugcuccugguugugcuuugggcguucgcccugcccuacccucgguuucgccccauggcuucuugccugagcacagucuggaccugugugaucauuguuugcaaaaugcucuaucagcugaagguggucaauccgcaggaauacuccagcaacuguacagagccuuuccccaauucuaccaaccuucugccuacggagaucucccagagccuccuguauagagggcccguggacccggccaauugguuuggcguucggaaaggauucccuaaccugggcuacauucaaaaucaucuccaggugcuucugcugcucgucuuugaagcuaucguguauagacgccaggagcacuaccggagacagcaucaacuggcgccccuuccugcccaggcuguguucgcgucugggacacgccagcagcuggaccaagaucuccugggaugccugaaguauuuuauuaacuucuuuuucuacaaauuuggccucgaaaucuguuuccuuauggccgucaauguuaucgggcagcggaugaacuuccuggugacccugcacggaugcuggcucguggcuauucugacaagacgccaucggcaggccaucgccagacuuuggcccaacuacugucuguuucucgcucuguuccugcucuaucaauaccuucugugccugggcaugcccccugcccucuguauugacuauccguggcgcuggucccgggcgguccccaugaauagcgcucugaucaaguggcuuuaccugccugacuuuuucagagcccccaacucuaccaaucucauuagcgacuuucugcugcuccuuugcgccucccagcaguggcaaguguucagcgcugagcggaccgaagaguggcaacgcauggccgggguuaacacagauagacuggagccucugcggggcgaacccaauccugugccgaacuuuauccacugucgcucuuaucucgacaugcugaaggucgcgguguucagauaccucuuuuggcugguucucguggucguguucgucacgggagcuacccggauuuccaucuuuggccugggguaucugcucgccugcuucuaccuucugcuguucggaacagcccuccugcagagagauacccgcgcucggcuugugcugugggacugccucauccuguacaauguuacagugauuaucagcaaaaacaugcugucccuccuugccugugucuuuguggagcagaugcagaccggcuucugcuggguuauucaacuguuuucucugguguguacggucaagggguauuacgaucccaaagaaaugauggacagagaucaggacugccuccugccuguggaggaagcuggaaucauuugggauagcguguguuucuuuuuccuucugcuccagcgccggguuuuucugucccacuauuaccugcaugucagagccgaccuccaggcgacagcccuucuggcuucucgcggcuucgcccuguauaaugcugccaaccucaagagcaucgacuuucaccggagaaucgaggagaaaucccuggcccaacuuaagcgccagauggaacgcauucgggcuaagcaggagaaacaucgccaggggagaguggaucggucucgcccccaagacacccugggcccuaaggaucccggacucgaaccgggcccugacagccccgggggauccuccccucccagacggcagugguggagacccuggcuggaucacgcgaccgugauccauucuggcgacuacuuccuguuugaguccgauagcgaggaagaggaagaggccgucccugaagacccgcgccccucugcucaguccgccuuccaacucgccuaucaggcuugggugacaaaugcccaggcgguucuucggagacgccagcaagagcaggagcaggcucggcaggaacaagccgggcagcugccuaccggaggcggccccagccaggagguggaaccugccgaggggcccgaagaggcugccgcgggaagaucucacgucgugcagcggguucuguccacagcccaauuucucuggaugcugggccaggcucuuguggaugagcugacgcgcuggcuccaggaguucaccagacaccaugggacaaugagcgacguccugcgggccgagcgcuaccugcucacccaagaacuucugcagggaggcgaggugcacagagggguucuggaucagcucuacacaucccaggcugaagccacccugccgggaccuacggaggcucccaacgccccuagcaccgugucuagcggccuuggcgcggaggaaccccuguccucuaugacagacgauauggggagcccucucuccaccggauaucauacacggucuggcagcgaggaagccgucaccgaccccggggagcgcgaggcuggagccucccuguaccaaggccugaugagaacagcuucugaacuccugcuugaccggcgccugcgcauuccggagcucgaagaggccgaacuguucgccgaggggcagggacgggcucuuagacugcuccgcgcgguguaucagugcguggccgcucacagcgagcugcuguguuacuuuaucauuauccucaaucacauggucaccgccuccgccggcagccugguucuuccugugcugguguuccucugggcuaugcugucuaucccccggcccuccaaaagauuuuggaugacggccauugucuucacagaaaucgcggugguugugaaguaucuuuuucaguucggcuuuuucccuuggaacagccaugucgugcugcgccgguacgagaauaaaccguauuuucccccucgcauucuugggcuggaaaagaccgauggauacaucaaguacgaccugguucaacucauggcccuguucuuucacagaucucagcuucugugcuauggccucugggaucaugaggaagacucccccagcaaagagcacgauaaguccggggaggaggaacagggagcugaagagggcccuggggugcccgccgcuaccacagaagaccauauucaggucgaggcccgggugggaccuaccgauggcacgccggagccccaagucgaacugagaccucgcgacacacggagaaucucucuucgcuuccggagacgcaaaaaggagggccccgcgagaaaaggggccgcugccaucgaagcugaggaucgggaggaagaggaaggagaggaagagaaggaggccccuaccggccgcgaaaagagacccagccgguccgggggaagagugcgggcugccggccgcagacugcagggguuuugucucagccuggcgcagggaacauaccggccgcugcgcagauucuuccacgacauucuccacaccaaauaucgggccgcuacagauguuuacgcccugauguuucuugcugacgugguggacuucaucauuaucauuuuuggcuucugggccuuuggcaagcauucugccgcgaccgauaucacguccagccugucugacgaucaggucccugaggcuuuccucguuaugcugcuuauucaauuuagcaccauggugguggaccgcgcccuguaucucagaaaaacaguccuggggaagcuggcuuuccagguggcccucguucuggccauccaccuuuggauguuuuucauccugcccgcugugaccgaacggauguuuaaccagaacgucguggcccaacucugguacuucgucaaaugcauuuauuuugcgcuguccgccuaccagauccgcuguggauaccccacacgcauucuuggcaauuuccugaccaagaaauauaaccaucucaaucuguuccuguuucagggguuccggcucgugccuuuucugguugagcuucgcgcugugauggauugggucuggacggacacaacccugucucucagcuccuggaugugcguggaagauaucuacgccaacauuuucaucaucaagugcucuagagagacagagaagaaauauccccagccuaagggacagaagaagaaaaagauuguuaaguacggcaugggagggcugaucauucuuuuucugaucgcuauuaucugguucccgcuccuguuuaugagccuggugcgguccgucgugggcgugguuaaucagcccaucgacgucaccgugacccucaaacugggcggguaugaaccucuuuucacaaugagcgcccagcagcccucuauuaucccuuuuacggcgcaagccuacgaggaacugucccgccaguucgauccccagccgcucgcuaugcaguuuauuagccaauauuccccugaggacaucgugaccgcccagauugaaggaucuagcggcgcucuguggagaaucucucccccuagccgggcccagaugaagagagagcuuuacaacgggacagcugauauuacccugcgcuucacauggaauuuucaacgggaccucgccaaaggaggcaccgucgaguacgcgaacgaaaagcacaugcuggcccuggcucccaauagcacggccagacgccagcuugcuucccugcucgaggggacaagcgaucagucuguugugaucccuaaccuguuccccaaauauauccgggccccgaauggaccugaagccaaccccgugaagcagcuccaacccaaugaggaggcggacuaccugggcguccgcauucagcuucgccgggaacagggcgcuggggccaccggauuccuggaguggugggugaucgaacugcaggaguguagaaccgacugcaaccuccugccuaugguuaucuuuuccgauaaggugagcccgcccucucuuggcuuccuggccggguauggaaucaugggccucuacgucuccauugugcugguuaucgggaaauuugugcgcggcuucuuuagcgaaaucucucacagcauuauguucgaggagcucccuugugucgaccggauccugaagcugugccaagauauuuuucuugugagagaaacacgcgagcuggaacucgaggaggaacuguaugcuaaacuuaucuuccuguaccggucccccgagaccaugauuaaguggacaagagaaaaagaguga

SEQ ID NO: 73740 - RNA, 8259 nt, Artificial Sequence
  derived and/or modified sequence opt5 from PIEZO2__Homo_sapiens__NP_071351
auggccagcgagguggucugcggccugaucuucagacuccugcuucccauuugucuggcuguugccugcgcguuucgguacaacgggcucuccuucguguaucugaucuaccuucugcucauuccucuguuuucugaaccgaccaagacaacgaugcagggacacaccggccgccugcucaaaagccuguguuucaucucccuuucuuuucugcuccugcauauuaucuuccacaucacacuugugagccuggaggcucaacauagaauugcccccggguauaauugcuccaccugggaaaagacauuucggcagaucggauucgagucucucaaaggcgccgacgcugggaacggaauucgcgucuuugugccugauaucggcauguucauugccagccugaccaucuggcugcucuguagaaauauuguucagaagcccgugacagacgaagcugcccaguccaacccugaguuugagaaugaagagcuggcggaaggcgagaaaaucgauagcgaggaagcccuuaucuacgaggaagacuucaacgggggagauggcgucgagggggaacuggaggagucuaccaagcucaagauguuucggcgccuggcuuccguggccagcaaacuuaaggaauucauuggaaauaugaucacgaccgcuggcaaaguuguggucacaauucugcucgggucuuccggaaugaugcugcccagccugaccucuuccguguauuucuuuguguuccucggccugugcacaugguggagcugguguagaaccuuugacccucuucuguucuccugccucuguguccugcuugccaucuuuacggcgggccaccugauugggcucuaccuguaucaauuccaguuuuuccaggaggccguuccgcccaacgauuacuacgcucggcuguuuggaaucaagucugugauccagacagacugcagcuccaccuggaaaauuaucgugaauccugaucucagcugguaucaucacgccaaccccauucugcuucuggucauguacuauacacucgcuacccugauccgcauuuggcugcaagaaccucuugugcaggacgagggcaccaaggaagaggauaaggcccucgccuguucucccauccagaucacagcugggagacggcgcucccugugguacgcgacgcacuauccgaccgacgagagaaaacugcucagcaugacacaggaugacuacaagccuucugacggacugcuuguuaccgugaauggcaaccccgucgauuaucauacaauucacccuagccugcccauggaaaaugggcccggaaaagccgaccucuacuccaccccucaauaccggugggagccgucugaugaaagcuccgagaagcgcgaagaggaggaagaggaaaaagaggaguucgaagaggaaagaagccgggaggaaaagagaucuaucaaagugcaugcuaugguuuccguguuucaguucauuaugaagcagagcuauaucugcgcccugauugccaugauggcuuggucuaucacguaccacuccuggcugacauuuguccuucucauuuggagcugcacccuguggaugauccgcaaccggagaaaguaugccaugaucuccucucccuucaugguggucuacggcaaucugcuccugauucuucaauauaucuggagcuucgagcugccugagauuaaaaaggugcccggcuuucucgaaaaaaaggagccuggggaacuggcguccaaaauccuguucaccauuacauuuuggcuucuccugcgccagcaccugaccgagcagaaggcucuccaggaaaaggaggcccugcuuucugagguuaaaaucggaagccaagaaaacgaggaaaaggacgaggaacugcaggauauccagguggagggcgagcccaaagaagaggaagaggaggaagccaaggaggaaaaacaggagcggaagaaggucgaacaagaggaggcugaagaggaagacgagcaggauauuaugaaagugcucgggaaccugguuguggccauguucaucaaguacuggauuuaugucuguggaggcauguuuuucuuuguguccuucgaagggaaaaucgugauguacaagauuaucuacaugguucuguuucuuuucugcgucgcucucuaucaggugcauuacgagugguggagaaaaauccugaaguauuuuuggaugagcguggucauuuacacaaugcuggugcucaucuucauuuauacguaccaguuugagaauuucccgggccuguggcaaaacaugaccggacuuaagaaagaaaagcuggaggaccucggccugaaacaguucacaguugccgaacuguuuacccgcaucuucauuccuacaucuuuucuucugguguguauccuccaccugcauuauuuccacgaucgguuucucgagcugaccgaccuuaaguccauccccagcaaagaagauaauacgauuuacagacuggcgcauccugaggggucucuccccgaccugaccaugaugcaccugacagccucccuugagaagccugaaguccgcaaacuggcugagcccggagaagagaagcucgagggcuacagcgaaaaggcccagaaaggggaccugggaaaggauucugaggaaagcgaggaagacggcgaggaggaagaggaauccgaggaagaggaggaaaccagcgaucuccggaacaaauggcaccuggugaucgacagacuuacaguucuguuccucaaguuucuggaguauuuccauaaacugcagguguuuaugugguggauucuugaacugcacaucauuaagaucgucucuuccuacauuaucugggugagcguuaaggaggugucccucuucaauuaugucuuucugaucucuugggcuuucgcccucccguacgcgaaacugcgccggcuugccagcuccgugugcaccguguggacgugugucauuaucguuugcaagaugcuguaucaacugcagacaauuaaaccugaaaacuucucugugaauuguagccuccccaacgagaaucagaccaacauccccuuuaaugagcugaacaagucccuucuguacucugcuccuauugauccgacagaauggguggggcucagaaaaagcuccccccugcucgucuaucugcggaauaaccuucugaugcuggccauccucgcuuucgaggugaccaucuaccgccaucaagaauacuauagaggccggaauaaccugaccgccccuguuagcagaacaauuuuucacgacaucacgcgccuucaccuggaugacggacucauuaacugcgccaaguacuucaucaauuauuuuuucuacaaguuuggccuggagaccuguuuccucaugucugugaacgucauugggcagcggauggauuuuuaugcuaugauccaugcgugcuggcugaucgccgugcuuuacagacgcagacggaaagcuauugccgagaucuggcccaaguauuguugcuuccuggccugcauuaucacauuucaguacuucauuuguaucggaauuccucccgcuccuugccgcgacuaccccuggagauuuaaaggcgccuccuucaaugauaacaucaucaaguggcuguauuucccggacuuuauuguucggccuaaucccguguuccucgucuacgauuuuaugcugcuucugugugcgagccuccagcgccaaaucuucgaagacgagaacaaagcugccgugagaauuauggccggggacaauguugaaaucugcaugaaccuggaugcugccucuuuuucccagcacaauccugugcccgacuucauucauugucggagcuaucucgauaugucuaaggucaucaucuuuuccuaccuguucugguuugugcuuaccauuaucuucauuacaggaaccacgcgcaucagcauuuuuugcaugggcuaucugguggcguguuucuacuuucugcucuucgggggcgaccugcuucugaagccgaucaaauccauccucagauauugggauuggcugauugcuuacaacgucuucguuaucacaaugaagaauauucugagcaucggagccugcggcuacauugggacccucgugcacaacucuuguuggcuuauccaggccuuuagccuggcuugcaccgugaaaggauaucagaugccugccgcuaauucccccuguacacugccuucuggcgaggccgggauuaucugggacagcaucugcuucgcguuucuccugcuucaacggcgcgucuucauguccuacuauuuucugcaugugguugccgauauuaaggcuucucagauccucgccagcagaggagcugaacuguuccaggccaccauugugaaagccgucaaggcucggaucgaggaggaaaaaaaguccauggaccagcugaagagacaaauggaucgcauuaaagcgcggcagcagaaguacaaaaagggcaaagagagaaugcucucucuuacacaagaacccggggagggccaggacaugcagaagcugagcgaagaggaugacgagcgcgaagccgauaagcagaaagcuaagggaaaaaagaaacaaugguggcggcccuggguggaccacgccuccaugguuagaagcggcgacuauuaccuguuugagacggauucugaagaggaagaggaggaagagcucaagaaggaagacgaggagccuccgcgccgguccgccuuccaguuuguguaucaggcuuggaucaccgaucccaaaacagcccugagacagcgccacaaggaaaaaaagcggagcgcgagagaggaacggaaacgcagacggaaggggucuaaggagggaccugucgaaugggaggaccgcgaggaugaacccaucaaaaagaaauccgacggcccugauaacauuaucaagagaauuuucaauauccuuaaauuuaccugggugcuguuccucgcuacagucgacagcuuuaccacguggcugaacuccauuucucgggagcauaucgauaucagcaccgugcugagaauugaacgcugcaugcucacacgggagaucaagaaggggaacguucccaccagagaauccauucacauguacuaccaaaaucauaucaugaaccuuagccgcgagucuggacuggacacaauugaugagcacccuggcgccgccuccggcgcucagaccgcccaucggauggacagccuggacucucacgauagcaucuccucugaaccgacacaguguaccaugcucuauagcagacaggggacgacagagaccauugaagagguggaagcggagcaagaggaagaggcuggauccaccgcccccgaaccucgcgaggccaaagaguacgaagcuacaggcuaugacgucggggccaugggagcugaggaagccucucugacccccgaggaagagcuuacgcaguucagcacacuggauggcgacguggaggcgccucccuccuacagcaaggccguuucuuucgaacaccucuccuuugggagccaggaugacuccgcuggaaaaaaucggauggccgugucuccggaugacagcagaaccgauaagcugggcuccucuauccugccuccccucacacaugagcuuaccgcuagcgaacugcugcucaaaaagauguuccacgacgaugagcuggaagaguccgagaaauuuuaugucggccagccccgcuuccuucugcucuuuuacgccauguauaacacacugguggccagaagcgaaauggugugcuacuucguuaucauucugaaucauauggucucugcuuccaugaucacccuccuucugccuauucugaucuuucucugggcgaugcugagcgugccccggccuucucgcagauucuggaugauggccauuguguacacggaggucgcuaucgugguuaaguauuuuuuccaauuuggguucuuuccguggaacaagaauguggaagucaacaaagacaagcccuaccacccucccaauaucauuggaguggagaaaaaggaaggcuauguucuuuacgaucugauccagcuccuggcccuguucuuccaccgguccauucucaaaugucaugggcuuugggacgaggacgauaugaccgagagcggaauggcccgcgaagagucugacgaugaacugagccugggccacgggagacgggacuccucugauagccucaaguccaucaaccuggcugccagcguggaguccguccaugugacauuuccugagcagcaaaccgcgguuagacgcaagcggucuggaagcuccucugaacccagccagagauccucuuucagcuccaaucgcagccagcggggcucuacauccaccagaaacagcucucagaaaggcuccagcgugcuuucuauuaagcaaaaagggaagcgggagcuguauauggaaaaacuccaggagcaccugaucaaggcuaaggccuuuacgaucaaaaagacacuggaaauuuacgucccgaucaaacaguucuuuuauaaucucauucauccugaguacuccgccgugaccgacguguacguccuuauguuccuggcugauacaguugacuuuaucauuaucguguucggauuuugggccuucggcaagcacagcgcggccgcugauauuaccuccagccugucugaggaccaggugcccgggccuuuucucgucauggugcugauccaauucggaaccaugguuguggaucgcgcccuuuaucugagaaaaacaguccucggcaaggugaucuuucagguuauucugguguucgggauccacuucuggauguuuuucauucugcccggagucacggaacggaaguuuagccagaaccucguggcucagcuuugguacuucgucaaaugcguguauuuuggccuguccgccuaccaaauccgcuguggcuauccuaccagaguucuggggaauuuccucacaaagucuuacaacuaugugaaccuguuucuuuuccagggauuucggcuggugcccuuccucaccgagcugcgcgcugucauggacuggguuuggacagauaccacgcugagccucuccucuuggauuugcguggaagacaucuacgcccauaucuuuauucuuaaauguuggagagagagcgaaaagcgguacccgcagccucgcggccaaaaaaagaaaaagguggucaaguaugggaugggaggcaugaucauugugcugcugaucugcauuguuugguucccccuccuguuuaugucccuuaucaaaucuguggcgggggucaucaaucagccccuggacgugagcgucacaauuacccucggaggcuaccagccuaucuucaccauguccgcccagcaaagccagcugaaggugauggaucagcagucuuucaacaaauuuauucaagcuuucuccagagacacaggcgccaugcaguuucuggagaauuaugagaaggaagauaucaccguugcugagcucgaagggaacagcaauucucuguggacaauuuccccgcccagcaaacagaagaugauccacgagcuucuggacccuaacuccucuuucagcguggucuuuuccuggagcauccagcggaaucucucucugggagccaaguccgaaauugccacggauaaacuuagcuucccccugaagaacaucaccagaaaaaauauugcuaagaugaucgcgggcaacucuacagagagcuccaaaaccccugugacaauugagaagaucuaccccuauuacguuaaggccccuucugacagcaauuccaaaccgauuaagcaacuccugucugaaaacaauuuuauggauaucaccaucauucugagccgcgacaacacgaccaaauauaauuccgaguggugggugcucaaccugacagggaaucggaucuacaaccccaacagccaggcucuugaacuggucguguucaaugauaaggugucuccucccucccucggauuucuggccggcuacgggauuaugggacuuuaugccagcguuguccuggugaucggcaaauucgugagagaguuuuucuccggcauuucucauagcaucauguucgaggaacucccuaacgucgaccgcauccugaagcuguguaccgauauuuuucucguucgggagacaggggaacuggagcuugaagaggaccuguacgcuaagcucaucuuccuguauagaucccccgagaccaugauuaaauggacacgcgaaaagacgaauuga

SEQ ID NO: 73741 - RNA, 2124 nt, Artificial Sequence
  derived and/or modified sequence opt5 from PIF1__Homo_sapiens__NP_001273426
augcugagcggcaucgaggccgcugccggggaauacgaggacuccgaacucagaugccggguggcggucgaggaacugucucccggaggccagccucgcagacggcaagcucugcgcaccgccgagcugagccucgggagaaacgagcggcgcgaacugaugcuuagacugcaggccccgggacccgcuggccggccucgcuguuucccccucagagccgcucggcuguuuacacgcuucgccgaggcggggagauccacgcugcggcucccugcccacgauacccccggagcuggcgccguucagcugcuucugucugacugcccuccggaucgccucagacgguuucugagaacacuucgccugaagcucgcugccgcgcccggcccugggcccgccagcgcucgggcccagcugcugggaccuagaccccgcgacuucgugaccauuuccccggugcaaccugaagaacggagacuccgcgcugccacacggguccccgauaccacacuggugaaaagaccuguugagccccaggccggcgcugaacccucuaccgaggcgccucgcuggccgcuucccgugaagcggcugagccucccuuccacgaaaccccagcugagcgaggagcaggccgcuguccuuagagccgugcugaaggggcaaucuaucuuuuucaccggauccgccggcacagggaaaagcuaucuccugaagcgcauucugggaucucucccucccaccggcacaguugcuaccgccuccacgggcguggcggcuugucauaucgggggaacaacccugcacgccuuugccggcauugggagcggacaggcuccgcuugcccagugcgucgcucuggcccagcggccuggcgugagacaaggguggcucaauugucagcggcuggugaucgacgaaaucucuauggucgaggcggaucuuuucgacaagcuggaggccguugcucgcgccgugagacagcaaaacaaacccuuuggaggcauucagcucaucauuugcggcgauuuccugcagcugccucccgugacaaaggggucccagccuccccgguuuuguuuccaaagcaaauccuggaagagaugcgucccggugacccucgaacugaccaaaguuuggcgccaggcugaccagacauuuaucucucuucugcaggccgugcggcucggaagauguagcgaugaggucacgcgccaacugcaggcgaccgccucccauaaggugggcagagacgggauuguugcuacacggcugugcacccaccaggaugacguggcccuuacaaaugaacgcagacuccaggagcugccuggaaagguccaucgguucgaagcuauggacagcaaccccgagcuggccucuacccucgaugcccaaugucccgugucccagcugcuucagcugaaacucggcgcucaggucaugcuggugaagaaucugagcguuucucgcgggcuugugaacggcgcgagaggagucgugguuggcuucgaggccgaagggcggggacucccucaagugcgcuuucugugcggcgucacggaggugauccacgcugacagauggacagugcaggccaccgggggacagcugcucagccggcaacagcugccgcuucagcuggccugggcuauguccauucacaaaucucagggcaugacccucgauugcguugaaaucagccuggggcgcgucuucgccuccggccaagcguacguggcucugagcagagcccggucucuucagggacucagagugcuggacuuugaucccauggccguccgcugugacccucgggugcugcauuucuaugcuacacucagacgcggccggucccugagccuugccgcggaggggagaggaaaugaagaucgcugcucuggcuccagcauccgggcucuugggggagacugguggggccucagacugggggccgccuccaagcagcgcaccgagcugcgguguguuucuacagcuagacccagccuugcccagccucggacgaacacccuccaaucccugacaaaagagcacaagcugcagaaugugcaucccuacuuuaaacuccuguuccagggcauuaacucugucuggggacacuga

SEQ ID NO: 73742 - RNA, 477 nt, Artificial Sequence
  derived and/or modified sequence opt5 from PIFO__Homo_sapiens__NP_001287760
augugcuucagcagagccgacgcugccgauaacuaccccuuuggcaccugucagcaacggaagcuguucccucacuuucauccgcccaaucucaucgggaacaaauucgugccucugcgcggaucuccccacagaggcccugggugcuauuuuuccgacgagaugacaccccaugcgggacgguaccagaaggucagcccucagcaggaaaaacacaagcaaaauuucgcuccguuuaacguucuugugccccgcuucaaaaauuauccuaaggauacguacuaucccuccccuggcgccuacaaccccgagaagaaaccgccucccaagauugccuggccuaugaaauuugggucucccgacugggcucaggugcccugucugcagaagagaacccucaaagccgaacugagcacagauaaggacuuccggaagcaucgcaauagagucgcuuaucuuucccuguacuacaacuga

SEQ ID NO: 73743 - RNA, 1455 nt, Artificial Sequence
  derived and/or modified sequence opt5 from PIGA__Homo_sapiens__NP_002632
auggccugcagaggcggggcuggaaacggccaccgggccagcgcgacccugucccgcgugucucccgggagccucuacacauguagaacgcggacccauaauaucugcauggucuccgacuucuuuuauccuaacaugggaggcguugagucucacauuuaccagcugagccaaugucuuaucgaacgcgggcauaaggugauuaucgugacacacgcuuauggaaauagaaaaggcauucgguaccugaccuccggccucaaggucuauuaccugccgcuuaaagugauguauaaccagucuacagccaccacacuguuccauagccucccccugcugcgcuacaucuuuguuagagagcgggugaccaucauucacucccacagcucuuucuccgccauggcucaugaugcccucuuucacgcuaagacgauggggcugcagaccgucuucacagaccauagccuuuuuggauucgccgaugugucuuccguucugaccaauaaacuccugacagugagccuuugcgacaccaaccacaucauuugugucucuuacacguccaaggaaaauacagugcugcgcgcggcccucaacccugagaucgugagcgucauucccaaugcuguugauccuaccgacuuuacacccgauccuuucagacggcacgacuccaucaccauugugguggucucucgccugguguauagaaagggcaucgaucugcucagcgggaucauuccggaacugugccagaaauaccccgaccuuaacuuuaucauuggaggcgaggggccuaagcggaucauucuggaggaaguucgcgagagauaucaacuccaugaucgggugagacugcuuggagcccuggaacacaaagacguccgcaaugugcucguucagggccauaucuuccugaacaccucccugacagaggcuuuuuguauggccaucguggaggcggccagcugcggccuccaggucgugucuacgcgggucgggggcauucccgaagugcugccugagaaucuuaucauucugugugaacccuccguuaagagccucugcgagggacuggaaaaagcuaucuuccagcuuaagucugggacccugccggccccugagaacauucacaauaucgugaagacauucuacaccuggagaaacgucgcugagcgcacagaaaaaguguaugaucggguuagcguggaggccguccuccccauggacaagagacuggaccgccugaucucccauuguggaccugugaccggcuacauuuuugcccuccuggcuguguucaacuuucuuuuccugaucuuucuccgguggaugacgcccgauucuauuaucgacguugcgauugaugccacagggcccagaggagcuuggaccaauaacuauagccacuccaaacgcggcggcgaaaauaacgagaucagcgaaacccgguga

SEQ ID NO: 73744 - RNA, 660 nt, Artificial Sequence
  derived and/or modified sequence opt5 from PIGF__Homo_sapiens__NP_002634
augaaggacaacgauaucaaaagacugcucuacacccaucugcuuugcauuuucagcaucauucuguccguguuuauccccucucucuuccuggagaauuuuagcauucuugaaacacaccugacguggcucuguaucugcuccggcuucgucaccgccguuaaccuggugcuguaucucguggucaagccuaauacaucuagcaaacgguccucucugagccacaaggugaccggguuucuuaaauguugcaucuacuuccugauguccuguuuuagcuuccauguuauuuuugugcucuauggagcuccgcugaucgagcuugcccuggaaacauuccucuuugcggucauucugucuaccuucacaaccgugcccugccugugucuccugggcccuaaccuuaaggcuuggcugcgcguguuuuccagaaaugggguuacgagcaucugggagaacucucuccagauuaccacaaucuccagcuucgucggagccuggcugggcgcccuucccauuccucuggacugggaacggcccuggcaaguguggccuaucucuugcacccucggggcuacauucggauacguggccggccuggucaucuccccgcuguggauuuauuggaaucgcaagcagcucaccuacaaaaacaauuga

SEQ ID NO: 73745 - RNA, 2952 nt, Artificial Sequence
  derived and/or modified sequence opt5 from PIGG__Homo_sapiens__NP_001120650
augagacugggcagcgggaccuucgccacaugcuguguggcuaucgagguccucggaauugccguuuuucugcggggcuucuuucccgcgccugugcgcuccucugcuagagccgaacacggggccgagccgcccgcuccugaacccagcgccggagcuuccucuaacuggacgacccuuccucccccucuguucagcaagguggucaucgugcucauugacgcccugcgggaugacuuuguuuucggcuccaaaggggugaaguuuaugccguacacaaccuaucuugucgagaaaggagcgucucacagcuucguggccgaagcuaagcccccuacaguuaccaugccccgcaucaaagcccugaugacaggcucccucccuggcuuuguggaugucauuagaaaucugaacagccccgcucugcucgaggacucugugauccggcaggccaaggcggccgggaagcgcaucguguucuacggagaugagaccugggucaaacuguuuccgaagcacuucguugaauaugacggcacgaccuccuuuuucgugagcgauuacacagagguggacaauaacgucaccagacaucuugauaaagugcugaagcgcggggacugggauauucucauccugcacuaucuuggacuggaccauauuggccacaucucugggccuaauagcccccucauuggacaaaaacuguccgaaauggauucuguucugaugaagauccacacaucccuccagagcaaggagcgggagaccccucugcccaaccuucuggugcucugcggcgaccauggcauguccgaaacggggucucacggagcuagcuccacagaggaagucaauacaccccugauucuuaucagcucugccuucgagagaaaaccuggcgacauccggcauccgaagcacgugcagcagaccgauguugcugccacccuggccauugcucucgggcugcccaucccuaaagacuccgugggaagccugcucuuucccgucguggaaggccgcccuaugagagagcaacugcgguuccuucaccugaacaccguccagcucucuaagcugcuucaggagaaugugcccagcuacgaaaaagauccgggguuugagcaguucaagauguccgaacgccugcauggaaacuggauuagacucuaucuggaggaaaaacacucugagguucuguuuaaucucggcagcaaggugcugcggcaauaccuugacgcgcugaagacacucucccugagccugucugcccaggucgcucaguacgauaucuauuccaugauggugggcacgguugugguccuugaggugcucacccugcugcuccugagcgugccucaggcccuuagacgcaaagccgaacuggagguuccccucucuuccccuggguucagccugcuguuuuaccuugucauucucgugcuguccgcugugcaugucaucguguguacaucugccgaaagcuccugcuauuucuguggacugucuuggcucgcggcuggcgggguuauggugcuggccagcgcccuucugugcgucaucguguccguucucaccaacgugcuggucggaggcaauacaccccggaagaacccuaugcaccccagcucuagaugguccgagcuggaccuucucauucugcuggggaccgcuggccaugugcucagccugggagccucuuccuuuguugaagaggagcaccaaacgugguacuuccuugugaauacacugugucucgcucugagccaggaaaccuaucgcaacuacuuucugggcgaugacggggagccgccuugcggacuuugugucgaacagggccacgauggggccaccgcggccuggcaagacggacccggcugcgaugugcucgagcgggacaaagggcauggcucucccagcacauccgaggugcugagaggacgcgaaaaguggaugguccuggcuagcccuuggcucauccuggccuguugccggcuucugagaucucucaaccagaccggcguucagugggcucaccgcccggaccuggggcauuggcugacauccagcgaucacaaagccgagcuuuccgugcuggcggcccucucucugcucguggucuucgugcugguucagcggggaugcagccccguguccaaggcugcccuugcucugggccuccugggggucuauuguuacagagccgccauuggaucugugcgcuuuccuuggcggcccgacagcaaggauaucuccaaaggcauuaucgaagcuagauucguuuacguguucguccuggggauccuuuuuacgggcaccaaggaccugcucaaaucucaagugauugcggccgauuucaagcugaaaacaguuggacucugggagaucuauagcggccuggugcuucuggcugcccuccuguuucggccucacaaucugcccguccuugccuucucccugcucauucagacccugaugacaaaguuuaucuggaagccucuccgccaugacgcugccgaaauuaccgugaugcacuacugguucgggcaggcguuuuucuauuuucagggaaacagcaauaacaucgcuacgguggauauuucugccggcuucgucgggcuggacaccuacguugagauccccgccgugcuucugacagcuuuuggaaccuaugccggcccggugcugugggcgucccaucucguccacuuccugagcucugagacaagauccgggagcgcucuuucucaugccugcuuuuguuacgcccugaucugcuccauuccuguguucaccuauaucguucucgugacgagccugcgguaccaccucuucauuugguccgucuuuagccccaaacugcuuuacgaaggcaugcaucugcugaucacagcugccguguguguuuucuuuaccgcuauggaucaaacaagacucacccagucuuga

SEQ ID NO: 73746 - RNA, 759 nt, Artificial Sequence
  derived and/or modified sequence opt5 from PIGL__Homo_sapiens__NP_004269
auggaggccauguggcugcucugcguggcucuggccguccuugcguggggcuuccuguggguuugggacagcuccgaaagaaugaagucucgggagcaagggggacgccucggcgcugaaagcagaacccugcuugugaucgcccaccccgaugacgaggccauguuuuucgcuccuacagugcuggggcucgcccggcugcgccauugggucuaccugcucuguuuuuccgcuggaaacuauuacaaucagggcgaaacgcggaaaaaggagcugcuucagucuugcgaugugcuggggauuccgcucagcuccguuaugaucauugacaacagagauuuccccgacgauccuggaaugcagugggacaccgagcacguggcccgcguccugcuucagcauaucgaagugaauggcauuaaccugguugugacauuugaugcgggcggggucucuggacacagcaaucauaucgcccucuaugcugccgugagagcucugcacuccgagggcaaacugcccaagggguguagcgugcucacccugcaaucugucaacguucuucggaaauacaucucccugcucgaccugccucuuagccugcuccacacacaggaugugcuguucgugcucaauucuaaggaagucgcccaggcgaagaaagccauguccugccaucgcagccagcugcugugguuuagacggcuuuauauuaucuucucucgcuacaugagaauuaacucccugagcuuucucuga

SEQ ID NO: 73747 - RNA, 1272 nt, Artificial Sequence
  derived and/or modified sequence opt5 from PIGM__Homo_sapiens__NP_660150
augggcagcaccaagcacuggggagaguggcugcucaaccugaaaguggcccccgcuggagucuucggcguugccuuucuugcgagaguggcucugguguucuacggggucuuucaggaccggacacuccaugugcgcuauacggauaucgacuaccaaguuuucaccgaugccgccagauuugugacagaaggacgguccccuuaucugcgcgcuaccuacagauauacaccgcuucugggcuggcuccugacccccaauauuuaccugucugaacucuucgggaaguuucuguucaucagcugcgaccuucugacagccuuucuccuguaucggcuucugcuccugaaaggacugggccgcagacaggcuuguggcuacugcgucuucuggcuccugaacccucuucccauggccguguccucucgggggaaugcggauagcauuguugccucccuggugcucaugguccuguaccuuaucaagaaacgccugguggcuugugccgcuguguuuuauggauucgccguccacaugaagauuuacccuguuaccuauauccuccccaucacgcugcaucugcucccugacagagauaacgacaagucucugcggcaguuucgcuacaccuuccaggcgugccuuuaugagcugcucaaaagacuguguaaucgggccgugcuucuguucguggcugucgccggccucacauuuuucgcucugagcuuuggguucuacuaugaguacggaugggaauuucuggagcacaccuacuucuaucaucucacacgcagagauauucggcacaacuuuuccccguacuucuauaugcuguaccuuaccgccgagagcaaguggucuuuuucccugggcaucgccgcuuuccucccccaacugauucugcuuagcgcggugucuuuugccuauuacagagaccucguuuucugcuguuuucugcacacguccaucuucgugacauucaauaaagucugcaccagccaguauuuucugugguaccucugucugcuuccucuggugaugccccucguucgcaugccuuggaagcgggcugugguccugcugaugcuuugguucauugggcaggccauguggcucgcccccgcuuacgugcuggaauuucaggggaaaaacacauuccuguuuaucuggcucgccggccuguucuuucuucugauuaauugcucuauccucauccaaauuaucucccauuauaaggaggaaccgcugaccgagagaauuaaguacgauuga

SEQ ID NO: 73748 - RNA, 2796 nt, Artificial Sequence
  derived and/or modified sequence opt5 from PIGN__Homo_sapiens__NP_789744
augcugcuguucuuuacccugggccuucugauccacuucguguuuuucgccagcauuuuugacaucuacuucacaucuccccucguccaugggaugacgccucaguuuaccccgcugcccccucccgcuagacggcuuguucuguucguggccgauggacuccgcgcggacgcucuguaugagcuggaugaaaacggcaauuccagagccccuuuuauucggaacaucauuaugcacgaggggagcuggggaaucucccauacacgcgugcccaccgaaucuagaccuggccacgucgcccucaucgcuggguucuacgaggacgugagcgccguugcuaagggauggaaagaaaauccgguggaguuugauucccuguucaacgagucuaaguauacauggagcuggggcucccccgacauucuuccuauguuugccaaaggcgcgagcggggaucaugucuacaccuauucuuacgacgccaagcgggaagauuucggagcucaagacgccacaaaacuggauaccuggguguucgacaauguuaaggacuuuuuccaccacgcucgcaacaaucagucccucuuuagcaagaucaacgaggaaaagauuguguucuuucugcaucuucugggcaucgauacgaaugggcacgcccauagacccucuucccgggacuauaagcacaacauuaaaaaggucgaugacggagugaaagagaucgugagcauguucaaucacuuuuacggcaacgaugggaagaccacauucauuuuuaccucugaccauggaaugacagauuggggcucccacggcgcggggcauccuagcgagacccucacgccccuggucacauggggagccggcaucaaguacccgcagcgcguuuccgcucagcaauucgacgaugccuuucugaaagaauggagacucgagaauuggaagcggcuggacgugaaccaggcugauaucgccccucuuaugaccucucugauuggggugcccuucccucucaauagcgucggaauccugcccguggacuaucuuaacaacacagaucuguuuaaagccgaauccauguucaccaaugcuguucagauucucgagcaguucaaggugaaaaugacccaaaagaaagaagucacacugcccuuucuguucacgccuuuuaagcuccugagcgacucuaagcaguucaacauccuucgcaaagcgagauccuacauuaagcaccggaaauuugacgaggugguuagccugugcaaggagcucauccaucuggcccuuaaaggccugucuuauuaccacaccuaugaucgcuucuuucucggggugaaugucgugaucggauucgucggcuggauuagcuacgcuucccugcugaucauuaagucucacagcaaccucaucaagggcguguccaaagaaguuaagaaaccgagccaucugcuucccuguucuuuuguggccauugggauccuggucgccuucuuucuccugauccaggcuugcccuuggacauauuacguguacggacugcuuccccucccuauuugguaugccguucugagagaguuccaggugauccaagaccuggucguguccgugcucaccuacccccugagccacuuuguuggcuaucuucuggcguucacacucgggauugaaguccuggugcugucuuucuuuuaccgguauaugcuuaccgcuggacucacggccuucgccgcuuggccguuucugacaagacuguggacccgcgccaagaugaccucccucagcuggacauucuuuucccugcuucuggcuguguucccucucaugcccgucgugggccggaaaccugauaucucucugguuaugggggccggccugcuugugcuccugcugagccucugugucgugaccucccugaugaagagaaaggacucuuuuauuaaagaggaacuucugguucaucuccuccaggugcugagcacaguccuuuccauguacgugguuuauagcacgcagucuucccuccugcgcaagcaaggacugccccucaugaaucagaucauuagcugggcgacccuggccucuucccuuguggucccucugcucagcucucccgugcuguuccagcggcuguuuagcauccuucugucccucaugagcacauaccugcuccugucuaccggcuacgaggcucuuuucccgcuggugcucuccugccugauguuugucuggaucaacauugagcaggaaacacugcaacagagcgggguuuguugcaaacagaaacuuaccuccauccaguucucuuauaauacggauauuacccaauucagacagcuguaccucgacgauauccgccgggccuuuuuccugguguuuuuccucgugacagccuuuuucggaaccggcaacauugcuagcaucaauuccuuugaccuggcgucugucuauuguuuccuuacaguguuuagcccuuucaugaugggggcccugaugauguggaaaauccucauucccuuuguucuggugaugugcgcuuucgaggccguccagcugaccacgcagcuuuccucuaagagccuguuucucaucgugcugguuauuuccgauaucauggcucuccacuucuucuuucuggugaaggacuacggaagcuggcuugauauuggcacaucuaucucccacuaugucaucgugaugagcaugaccauuuuccugguuuuucugaacgggcucgcccaacugcuuacaaccaaaaagcugagacucuguggcaaacccaagucucauuucauguga

SEQ ID NO: 73749 - RNA, 2019 nt, Artificial Sequence
  derived and/or modified sequence opt5 from PIGO__Homo_sapiens__NP_001188413
augcagaaggccagcgugcugcuguuccuggcuugggucugcuuucuuuucuacgccggcaucgcgcuguuuaccuccggguuccuccugacaagacuugagcugacgaaccacucuagcugucaagaacccccuggaccgggcucccuccccugggggucucagggaaaaccuggcgcuugcuggauggccagccgguuuucccgcguugugcuggugcugauugacgcccucagauucgauuuugcucagccccagcauucucacgucccucgggagcccccugugagccugccguuccuugggaagcuguccagccuccaacgcauccuggaaauucagccccaucacgccagacuuuaucggucucagguugacccucccaccacaaccaugcagcgccugaaagcucucacaaccggaucccugccuacauuuaucgaugccggcagcaauuucgcgucucaugccauuguggaggacaaccugaucaagcaacucaccuccgcuggcagacgggucguguuuaugggggaugacacguggaaagaucuguuccccggagccuuuagcaaggcuuucuucuuuccgucuuucaauguucgcgaccuugauaccguggacaacggcauccuggaacaccucuacccuacaauggauuccggggagugggacguccugauugcccacuuucuuggaguggaucauuguggccacaagcaugggccccaccacccugagauggcgaaaaagcugagccagauggaccaggugauccagggacucgucgaaagacuggagaaugacacccugcucguuguggccggcgaucauggcaugacaaccaacggggaccacggaggcgauuccgaacuggaggugucugcugcccuuuuccuguauagccccacggcugucuuucccuccacaccuccggaggaacccgaggugauuccucaaguuagccucgugcccacccuggcccuucugcucgggcugccuauccccuucggaaauauuggcgaagucauggccgagcuguuuucugggggagaagacucccagccgcauagcucugcucucgcgcaggccagcgcucugcaccuuaacgcccaacaggugucccgguuccugcauacauacucugccgcuacccaggaucuccaggccaaagagcugcaccaacugcagaaucuuuuuagcaaggcguccgcugacuaucaguggcuccugcagagcccuaaaggcgccgaggccacccugcccacaguuaucgcugaacuccaacaguuccugcgcggcgccagagcuaugugcauugagucuugggcccgguuuucccuuagcuuccugcuccugcaccuccuugcggccgggaucccugugacgacccccggaccuuuuacaguccccuggcaggcugugucugccugggcucucauggccacccagacauucuacuccaccggccaucaaccggucuucccugcgauccacuggcaugccgcuuuugugggguuccccgaaggacacggcagcuguacguggcugcccgcccugcucguuggggcuaacacauuugccucccaucugcuuuucgccgugggcugcccucugcuccugcuguggccguuucuuugugagucucagggacuccgcaagagacagcagcccccuggcaaugaagcugaugcgcgggucagacccgaggaggaagaggaaccucugauggagaugcgccugcgggacgcuccccaacacuucuaugccgcccuccugcagcuugggcugaaguaccucuuuauucugggaauccagauucuggccugcgcucuugccgcgagcauccucagacgccaccugaugguguggaaaguuuucgcuccuaaguuuauuuucgaagccgugggcuuuaucgucuccucuguggggcugcuccugggaaucgcccuugugaugcggguugauggcgcugucagcuccugguucagacaacuguuucucgcccagcagcgcuga

SEQ ID NO: 73750 - RNA, 477 nt, Artificial Sequence
  derived and/or modified sequence opt5 from PIGP__Homo_sapiens__NP_710148
auggugcccagaagcaccucccugacacucaucgucuuccuguuucaccggcuuucuaaggccccuggcaaaaugguugagaacagcccgucuccccugccugaacgcgcuauuuacggguucgugcucuuucuguccagccaguucggauuuauccuuuaucuggugugggccuucauucccgaguccuggcucaauucucugggccugacguacuggccucaaaaguauugggcggucgcucuccccguguaccugcuuaucgccauuguuaucggguaugugcugcucuuuggaaucaacaugaugagcaccuccccucuggacagcauucauacaaucaccgauaauuacgccaaaaaccagcagcagaagaaauaucaagaagaggcuauuccggcccuuagagacaucucuauuuccgaagucaaucagauguucuuucuggcugccaaggagcucuacacaaagaacuga

SEQ ID NO: 73751 - RNA, 1746 nt, Artificial Sequence
  derived and/or modified sequence opt5 from PIGQ__Homo_sapiens__NP_004195
auggugcugaaggccuucuuuccuaccugcugugucagcacagacuccggccuccugguugggagaugggugcccgagcagucuagcgcugugguccuugccgugcugcacuucccguuuauccccauucaaguuaaacagcuccuggcucaggugcggcaggcgucccaagucggaguggccguucuuggcacguggugccauugucgccaggaaccugaggaaucucuggggagauuccucgagagccugggagccguguuuccccacgaaccuuggcugcggcucugccgcgagagaggcgggaccuucugguccugugaggcuacacaucggcaggcccccaccgcuccuggagccccgggcgaagaucaggucaugcugaucuuuuacgaccaacgccaggugcuucugucucagcuccaucugcccacagugcuuccugauagacaggcgggcgccaccacagcuagcaccgggggacuggccgcugucuucgacacgguugcccgguccgaggugcucuuucgcagcgauagauucgacgaaggccccgugcggcugucucacuggcaauccgagggggucgaggcgagcauucuggccgaacucgcucgcagagccucuggaccuaucugccugcuucuggcuucccuccugagccuugugucugccguuuccgccugucggguguuuaagcuguggccccucagcuuccugggcuccaaacugucuaccugcgagcagcuccgccacagacuggaacaccuuacacugauuuuuagcacccggaaggcugagaacccggcgcagcucaugagaaaagccaauacagucgcuuccgugcugcuugauguugcccuggggcucaugcugcugagcuggcuccauggacgcucucggaucggccaccuggccgacgcucuugugccugucgccgaucauguggcggaggaacugcaacaccuccugcaguggcugaugggcgcucccgccgggcuuaagaugaacagagcccucgaccagguccugggacgcuucuuccuguaucacauccaucucuggauuuccuacauccaccugaugagcccuuuuguggagcauauucuuuggcacguuggccugucugcuugucucgggcugaccguggcccugagccuucucuccgauaucauugcucugcugacguuccauaucuauugcuuuuacgucuauggagcccggcucuacugucugaagauucacggccuuucuagccuguggagacucuuccgcgggaaaaaguggaaugugcugcggcagagaguugacuccugcagcuaugaucuggaccaacuuuuuaucggaacacuccuguucaccauccugcucuuucugcuucccacaaccgcgcuguacuaccucguguucacccugcugcgccuucucgucguggccgugcagggccugauucaucugcucguugaccugaucaacucucuuccccuguauucccucggccugcggcugugcagaccuuaccgccuugcugccggggucaaauuucgggugcugagacacgaagcuggacggccgcuccgccugcucaugcagauuaauccccugccuuauagcagagugguccacacauaccggcuucccucuuguggcugccauccuaagcacuccuggggagcccuguguagaaaacucuuccugggggagcugaucuaucccuggcgccagcggggcgauaagcaagacuga

SEQ ID NO: 73752 - RNA, 2295 nt, Artificial Sequence
  derived and/or modified sequence opt5 from PIGR__Homo_sapiens__XP_011507931
augcuccuguucgugcugaccugccuucuggccgucuuucccgcuaucagcacaaaguccccuauuuucggcccggaggaaguuaacucuguggaggggaauagcguguccaucacguguuacuaucccccuaccucugucaacagacacacacggaaauacuggugccgccagggagccagaggcggguguauuacccucaucagcuccgaaggauaugugucuagcaaguacgcgggccgggcuaaucugacaaacuuucccgagaaugggaccuucguugugaacauugcccaacuuucccaggacgauagcggacgcuauaaaugcggccugggcaucaauucuagagggcucuccuuugacgucagccuggaagugucucagggaccuggccugcucaacgauacaaagguuuacaccguggaccuggggcggacggucaccaucaauugucccuucaaaacagagaacgcccagaagcgcaagucccuuuauaaacaaauuggacuguacccugugcucgugaucgauagcucuggcuacgucaauccgaacuauaccgggcggauuagacuggacauccagggaacaggccagcuucuguuuuccguugugauuaaucagcuccgccugagcgaugcuggccaauaccugugccaggccggggacgauuccaacucuaauaagaaaaacgcugaccuccaggugcugaagcccgagccugaacuugucuaugaggaucugagaggaagcgugaccuuccauugugcccucggccccgaaguugcgaacguggccaaauuucugugccggcaguccagcggggagaauugugacgucgugguuaacacgcuuggaaagcgcgcuccugccuucgagggcagaauccugcucaauccccaagauaaggacgggucuuuuuccguggucauuacaggacugcggaaagaagacgcuggccgcuaccugugcggcgcccacagcgaugggcagcuccaggagggaucuccgauccaagcguggcagcuguucgugaacgaagagagcaccaucccuagaucccccacagucgugaagggcguugccgggggaucuguggcuguccuuuguccuuauaaucggaaagaaagcaaguccauuaaauacuggugccugugggagggcgcccagaacgggagaugcccccuccugguggacagcgagggcuggguuaaggcucaguaugaaggacgccuuucucugcucgaggaacccggcaaugggaccuuuaccgugauccugaaccaacugacaucccgggaugccggauucuacuggugucucacgaauggcgacacccuguggagaacaaccgucgagauuaaaaucauugaaggggagccuaaccuuaaggugccgggaaaugugacagccguucugggcgagacccucaagguccccugccauuucccuuguaaauuuagcucuuacgaaaaguauuggugcaaauggaacaauacggggugucaggcucugcccucccaggaugagggcccuagcaaggcguucgugaacugcgacgaaaauucccgccuggugucucuuacacucaaccuggucacccgggccgaugagggaugguacugguguggcgugaaacaggggcacuuuuauggagaaaccgcugccguuuacguggccgucgaggagagaaaggcugccggcagccgcgacgugucccuggcgaaggcugaugccgcccccgacgaaaaaguucucgauucuggguuccgggagaucgaaaacaaggcuauccaagacccgagacuguuugccgaggagaaagcuguggccgacacacgcgaucaggcggacggaagccgggccuccgucgauagcgggucuuccgaggaacagggcggcagcucuagagcucuuguguccacccugguuccucucggacuggugcuggccgucggcgcuguggccgugggggucgcgcgcgcccggcauagaaagaauguugaccgggugagcauucgcucuuauagaacagauaucagcauguccgacuucgaaaacagccgggaguuuggagcuaaugauaacaugggcgccucuuccauuacgcaggaaaccagccuugggggaaaagaggaguucguggcuacaaccgaauccacaaccgagacgaaggaacccaagaaagccaagagaucuagcaaagaggaagccgagauggcuuacaaggacuuucuccugcaauccucuaccgucgcggccgaggcucaggauggcccucaggaagccuga

SEQ ID NO: 73753 - RNA, 1569 nt, Artificial Sequence
  derived and/or modified sequence opt5 from PIGT__Homo_sapiens__NP_001171657
auggccgcugccaugccccuggcgcuccuggugcuucugcuccugggcccugggggauggugccuugcugagccgcccagagacagccugcgggaggaacucgucaucaccccucugcccuccggcgauguugccgccacauuccaguuucgcacgagaugggacucugaacugcaacgggagggggugagccacuaccgccucuucccuaaggcucugggacagcuuauuuccaaauauucucugagagaacuccaucugagcuuuacccagggcuucuggcggacacgcuacugggggcccccuuuucuucaggccccguccgauaccgaccacuauuuccugagauacgcugugcucccccgggaggucguguguacagagaaccugaccccuuggaagaaacugcuccccugcucuagcaaggccggacuguccguucuucugaaagcggaucgccucuuucauacaagcuaucacucucaagccgugcauaucagaccugucugucggaaugcucgcugcaccuccauuagcugggaacugagacagacgcuuucugugguuuucgacgccuuuaucaccggccagggcaagaaggauuggucccuguuccggauguuuagccgcacacucaccgagcccuguccgcuggcuucugaauccagaguguacgucgacauuacaaccuauaaccaggauaaugagacgcuggaggugcacccucccccuacaaccacauaccaagacgugauccucgggacccggaaaaccuacgccaucuaugaucugcuugacacagcgaugauuaacaauagcagaaaccugaauauccagcucaaguggaaacgcccucccgaaaacgaggcucccccgguccccuuccugcacgcccagcgguacguuuccggauauggccuucagaagggggaacugucuacgcuccuguacaauacccauccuuauagagccuuucccgugcugcuccuggauacagugccuugguaccuucgccuguauguccacacccucacaauuaccagcaaaggaaaggagaacaagcccuccuacauccauuaccaaccggcucaggaccggcugcagccucaucugcuugaaaugcucauucaacugcccgccaauagcgugacgaaaguuucuauccaguucgagagagcccugcucaaguggacagaguauaccccugaccccaaccacggcuucuacguguccccuagcguccugucugcucuugugcccagcaugguugcggccaaaccgguggauugggaagaguccccucuguuuaauucucucuuccccgucagcgacggguccaacuauuuugugcgccuguacaccgaaccccugcuugucaaucucccuacaccggauuucagcaugcccuauaacgugauuugccugaccuguacaguuguggcugucugcuacggaucuuuuuauaaccugcucacgcggaccuuccacaucgaggaaccuagaacaggcggccuggccaagcgccuugccaaucugauccggagagcucgcggggugcccccucucuga

SEQ ID NO: 73754 - RNA, 1308 nt, Artificial Sequence
  derived and/or modified sequence opt5 from PIGU__Homo_sapiens__NP_536724
auggccgcuccccuggugcucguccugguuguggccgugaccgucagagcggcucuuuuccggagcucccuggccgaguuuaucucugaacgcguggagguugugagcccucucuccucuuggaagagagucguggaaggccugagccuucuggaccucgggguuuccccguacucuggagccguguuccacgagacaccccugauuaucuaucuguuucauuuccucauugauuacgcugaacuggucuuuaugaucacggacgcccuuaccgcuauugcccuguauuucgcgauccaggauuuuaacaaagugguguucaagaaacaaaagcuccugcuugagcuggaccaguacgccccugaugucgcugagcucauccggacacccauggaaaugcgcuauauuccucugaaaguugcccuguuuuaccuccugaaucccuauaccauccuuagcugcguggcuaaguccacaugugccauuaacaauacccugaucgcguucuuuauucucacaaccaucaagggcagcgccuuccugucugcuauuuuucuugcccuggcuacguaccagucccucuacccucugacccuguucgugccggggcuccuguaucuucugcagagacaauacauccccgucaaaaugaaaagcaaggccuucuggaucuuuucuugggaguaugccaugauguacgugggaucccucguugugauuaucugccugagcuucuuucuucugucuuccugggacuucauuccugcugucuauggcuuuauccucagcgugcccgaucugacaccuaacauugggcuguucugguacuuuuucgcggaaauguuugagcacuucucccucuuuuucguuuguguguuucagaucaaugucuucuucuauaccaucccccuggccauuaaacuuaaggagcauccgaucuuuuucauguuuauucagaucgcugugauugccaucuucaagucuuacccuacagucggagacguggcccuguacauggccuuuuuccccguuuggaaccaccucuaucgguuucugcgcaauaucuucgugcugaccugcauuaucauugucuguagccuucucuuuccugugcuguggcaucuguggaucuacgcuggcuccgcgaacagcaauuucuuuuaugcuauuacgcucacauucaacguuggccagauccugcuuauuucugauuacuuuuaugccuuccugagacgggaauacuaucucacccacgggcuguaccugacagccaaggacggaaccgaggcuaugcuugugcucaaauga

SEQ ID NO: 73755 - RNA, 1515 nt, Artificial Sequence
  derived and/or modified sequence opt5 from PIGW__Homo_sapiens__NP_848612
augagcgagaagcagaugaaagaagccuucguguccaaccugaauggcaccacaguccucgagaucacgcaagggcugugcuuucccgcuuucuguauucuuugcagaggauuucugaucauuuucucucaguaccucuguagcuuuuccccuaccuggaagacacgguuccugaccgacuuuguugugcuuaucgugccgauggucgccacacugaccauuugggcgucuuucauccuccuggaacugcucggcgugaucauuuuuggggcuggacugcuuuaucagaucuaccgcagacggacaugcuaugcccgccugcccuuccucaaaauucuggagaaguuucuuaacaucagccuggaauccgaguacaauccugccauuucuuguuucagaguuaucaccagcgcuuuuacggccauugcuauccucgccguggauuucccccuguucccucggcgcuuugcgaaaaccgagcuguauggcacaggggccauggacuucggagucggcggcuuuguguucggguccgcuaugguuugccucgaagugagacggcgcaaguacauggagggaagcaagcugcacuauuuuaccaacucucuuuacuccgucuggccccugguguuccucggcaucgggagacuggccauuaucaaaagcauuggauaccaggaacaucuuacagaguauggcgugcacuggaacuuuuucuuuaccaucauugucguuaagcugaucacgccucuccugcugaucauuuucccgcucaauaaaucuuggaucauugcucuggggaucacagugcuuuaccaacuggcccucgauuuuaccucccugaagcggcuuauucuguauggaacagacggcagcggcacccgcguggggcuccugaaugcgaacagagagggaaucaucucuacccugggcuacgucgccauucauauggcuggggugcagacaggacucuauaugcacaaaaaucggucccauaucaaggaucugauuaagguugccuguuuccuucugcucgcugccaucagccuguuuauuucccuguacgugguccaggugaacguugaagccgugucucgcagaauggcuaaucuugcguucugcaucuggauugucgccagcucccucauccugcugagcucucuccugcuuggcgacaucauucuguccuucgcuaaauuucucaucaagggggcccuggugcccuguagcuggaaacugauucagucuccugucacgaacaagaaacacagcgagucccuugugcccgaagccgagcggauggaaccuucucucugccugaucaccgcucugaauagaaagcaacucauuuucuuucugcuuagcaacaucacaaccggacugaucaaucucaugguugauacacugcacuccagcacccugugggcccuuuucguggucaaccucuauauguuuucuaacugucugauuguguacguucuguaccuccaggacaaaacggugcaguucugguga

SEQ ID NO: 73756 - RNA, 216 nt, Artificial Sequence
  derived and/or modified sequence opt5 from PIGY__Homo_sapiens__NP_001036081
auguuccucagccuccccacccugacagugcuuaucccucuggucucccucgccggccuguuuuacucugcuagcguugaggaaaacuucccgcaggggugcacguccaccgccucucuuuguuuuuauagccugcuccugcccauuacaaucccuguguacguguucuuucaccuguggaccuggaugggaauuaagcuguucagacauaauuga

SEQ ID NO: 73757 - RNA, 873 nt, Artificial Sequence
  derived and/or modified sequence opt5 from PIH1D1__Homo_sapiens__NP_060386
auggccaaccccaagcugcucggcauggggcugagcgaggcugaagccaucggagcggacuccgcuagauucgaggaacuucugcuccaggccucuaaagagcugcaacaggcccagaccacacggccugaaagcacgcagauucaaccgcagcccggcuuuugcaucaagaccaauuccucugaggggaaaguguucauuaacaucugucacagcccuuccauucccccucccgcugaugucacagaggaggaacuucugcagaugcucgaagaggaccaggccggauuucgcaucccuaugucucugggcgagccgcaugcugaacuggaugccaaggggcaaggaugcaccgcguacgacguugccgugaauagcgauuucuauagacggaugcagaacuccgacuuucuccgcgagcuggugaucacaauugcuagagaaggccuugaggauaaauacaaucugcagcucaaccccgaauggcggaugaugaagaaucgcccuuucaugggcagcaucucucagcaaaacauuagauccgagcagcggccccgcauccaggagcugggggaccuuuauaccccugcccccgggagagcugaaagcggcccggagaagccucaccugaaucucuggcuggaagcccccgaucugcuccuggcggaggucgaccuuccuaaacuggauggggcccucggacugucucuugaaauuggcgagaaccggcuggugaugggaggaccccaacagcucuaccaucuggacgcuuauaucccccugcagauuaauucccacgagagcaaggccgcuuuucaucgcaaaagaaagcagcucaugguugccaugccucugcuuccggugcccucuuga

SEQ ID NO: 73758 - RNA, 2418 nt, Artificial Sequence
  derived and/or modified sequence opt5 from PIK3AP1__Homo_sapiens__NP_689522
auggccgcuagcggcgugcccagagggugcgacauccugauugucuacuccccugaugccgaggaauggugucaguaucuccaaacccuguuccuuucuagccggcagguucgcucccagaagauccugacacacagacucggaccggaggcgucuuuuagcgcugaagaccugucccuuuuccugucuacgcggugcguggugguccuccugagcgccgagcuggugcagcauuuucacaaacccgcccuccugccucuucugcaacgcgcuuuccaucccccucacagaguugugcggcuccuguguggcguccgcgauuccgaagaguuucuugacuucuuucccgauugggcccauuggcaggagcugaccugcgacgaugaaccugagacauacguggcugccguuaagaaagcgauuagcgaagacucugggugugauuccgugaccgacacagagccggaggaugaaaaggucgugagcuauucuaaacagcagaaccuccccaccgugacauccccuggaaaucugauggucguucaacccgacagaauccggugcggcgccgagaccacgguguacgugauuguccgcuguaagcuggaugacagaguggcuaccgaagccgaguucagcccugaagacucucccuccguucggauggaggcuaagguggagaacgaauauacaaucagcgucaaagccccgaaucucuccucugggaacgugagccugaagaucuacuccggagaucuuguugugugcgagaccgucauuagcuauuacacagacauggaagagaucggcaaucugcucucuaacgcggccaauccuguggaauuuaugugucaggcuuucaaaauuguccccuacaacaccgagacgcuggauaagcuccugacagagucccucaaaaauaacaucccugccagcggccugcaccuguuugggauuaaucagcucgaagaggaagacaugaugaccaaccagcgcgaugaggaacugcccacacuucugcacuucgcugccaaguauggacucaagaaucugaccgcccuucugcuuaccugccccggcgcucugcaagcguacucuguggccaacaaacaugggcacuauccuaauacaaucgcugagaagcauggauuuagagaccugcggcaguucauugaugaguacguugaaacgguggacaugcucaaaagccacaucaaggaggaacugaugcacggcgaggaggccgaugccgucuaugaauccauggcucaucuuucuaccgaccugcucaugaaauguagccugaacccggggugcgaugaggaccuguacgaauccauggccgcguucgugcccgcugccacagaggaccuuuauguugaaaugcuccaggccagcaccucuaacccuauccccggagauggcuuuucccgcgcuacaaaggacagcaugauuagaaaauuccuggagggcaauucuauggggaugaccaaccuggagcgggaucaaugccaccucggacaggaagaggacguguaccauacggucgaugacgaugaagccuuuuccguggaccuggcuagcagaccucccgugccgguuccucgccccgagacaaccgccccuggcgcgcaccagcuucccgauaaugaaccuuacaucuucaaggucuuugccgagaagucccaggagcggcccgggaacuucuaugugucuagcgaauccauuagaaaaggaccgccugugcgccccuggcgggacagaccccaaucuagcaucuacgauccuuuugcuggcaugaagaccccggggcagcgccagcugauuacacuccaggagcaagucaaacugggaaucgugaauguugacgaagccgugcugcauuucaaggaguggcagcuuaaccagaaaaagcgguccgagagcuuuagauuccagcaagaaaaucucaagcgccugcgggauucuaucaccagacgccagcgggagaaacagaaguccggcaaacagacagaccuggaaauuacgguccccaucagacacagccaacaccucccugcuaagguggaguuuggcguuuaugaaucugggccccggaaauccgugauuccuccccgcaccgagcugagacggggagacuggaagacagauagcaccucuagcacagccuccagcaccucuaacagauccagcacgcgcucccuucugucugucagcuccggcauggagggggacaaugaagauaacgaggugccugaaguuacccggucuagaagccccggaccgccucagguggacggcacacccaccaugucccucgagcgcccucccagagucccgccucgggcggccucucagagacccccuacacgcgaaaccuuccaucccccucccccggugcccccucgggggcgcuga

SEQ ID NO: 73759 - RNA, 5061 nt, Artificial Sequence
  derived and/or modified sequence opt5 from PIK3C2A__Homo_sapiens__NP_002636
auggcccagaucagcuccaacucuggauucaaggagugccccagcucccacccugaaccgaccagagcuaaagacguggauaaggaggaagcccugcaaauggaggcggaagcucucgccaaacugcagaaggacagacaggugacagauaaucagcggggguuugagcuuucuagcuccacgcgcaaaaaggcccaaguuuacaacaagcaggacuaugaucugaugguguuccccgagucugacagccagaaacgggcucucgauauugacguggaaaagcugacccaggccgagcuugaaaaacugcuccuggaugacuccuuugagacaaagaaaaccccuguccugcccgugacaccuauccucagccccucuuucuccgcucaacuguacuuucgcccuaccauucagagaggacaguggccgcccggacuuccugggcccagcacauaugcccugccuucuaucuaccccuccaccuauagcaagcaggcggccuuccaaaauggauuuaacccgcggaugccuacguuccccucuaccgagccuauuuaccucucccugcccggccagagccccuauuuuuccuacccucuuacaccggcuacccccuuccauccucaggggucucugcccaucuaccgcccuguugugagcacagauauggccaagcucuuugacaaaaucgcuuccaccagcgaguuccugaagaauggaaaagccagaacggaucuggagauuacagacucuaaggucuccaaccuccaagugagccccaaaucugaagacaucagcaaguuugauuggcuggaccuugauccgcuguccaaaccuaagguugacaauguggagguccucgaucacgaagaggagaagaacgugucuagccugcuugcgaaagaccccugggaugccgugcugcucgaagaacgguccaccgcuaauugucaucuggaacgcaaggucaacggcaaaagccugucuguugccacagugaccagaucccagagccucaauauucggaccacacagcuggcuaaggcccagggccacaucucucaaaaagacccuaacgggacguccagccuucccaccggauccucucugcuccaggagguggaaguccagaaugaggagauggccgcuuucugccgcagcauuacaaagcugaagaccaaauucccuuauacaaaccauagaaccaaucccggcuaccuucuguccccggugacggcgcagcggaacaucuguggggaaaacgccucuguuaaggugagcauugauaucgagggauuucaacucccugucacauucacaugcgacguguccagcaccguugaaaucauuaucaugcaggcucuguguugggugcacgaugaccugaaucaggucgacgugggcucuuauguccucaaagugugcgggcaggaggaaguucugcaaaacaaucacugucuuggaucccaugagcacauucagaacugccgcaagugggauacagagaucagacugcagcuccugaccuuuagcgccaugugucagaaucuggcccggacagcugaagacgaugagacgcccguggaccuuaacaaacaucucuaccaaauugaaaagcccugcaaggaggccaugaccagacacccugucgaggaacugcuggauucuuaucacaaucagguggagcucgcgcugcagaucgaaaaccaacaucgcgcuguugaccaggugaucaaagccguccggaagauuuguuccgcccuugauggcguggagacacuggcuaucaccgaaagcgugaaaaagcucaaaagagccguuaaucugccgcgcucuaagacagcugacgucaccagccuguucggcggggaggauacgucccggagcucuaccagaggaucccuuaaccccgagaauccuguccaggugagcauuaaccagcucacagccgcgaucuacgaccugcugcgccuccacgccaauuccggccggucucccaccgauugcgcucaaagcuccaagucugucaaagaagccuggacaaccacggagcagcugcaguuuacaauuuucgcugcccaugggaucagcuccaacugggugucuaauuaugaaaaguacuaccuuaucugcagccugucccacaacggaaaagaccucuuuaagccuauucagagcaaaaagguuggcaccuauaaaaacuucuuuuaccugaucaagugggaugagcugauuaucuuccccauucaaaucucucagcuuccucucgaauccgugcugcaucugacacucuuugggauucugaaucagagcucuggauccagccccgacucuaacaagcagagaaaaggcccggaggcgcuuggcaaggucucccugccucucuucgacuuuaaacgcuuccugaccugugggaccaagcugcuuuaucucuggacaagcucccacacgaauagcgugcccggaaccguuaccaaaaagggcuacgugauggagcggaucguccugcaaguggauuucccuucucccgccuuugacaucauuuauaccacaccgcagguugauagaagcaucauucagcaacacaaccuggaaacccucgagaaugacaucaaggggaaacugcuugauauucugcauaaggacuccucucucggacugagcaaagaagauaaggcuuuccugugggagaaacgcuacuauugcuuuaagcacccuaacugucuucccaagauccuggccuccgcuccuaauuggaaaugggugaaccucgccaagacguacucucugcuccaucaguggcccgcccuguacccccuuaucgcucuggaacuccuggacagcaaauucgcggaucaggagguccggucccuggccgugacauggauugaggcuaucucugacgaugaacuuaccgaccugcucccucaguuugugcaagcccugaaguaugagauuuaccucaauagcucccugguccaguuccuucugagcagagcccucggcaacauccagauugcucacaaucuguauuggcugcuuaaagaugcccugcacgacguucaguuuucuacccgguacgaacaugugcucggggcgcugcucuccgugggcggaaagcgccugagagaggagcuucugaagcaaacaaaacugguccagcuccugggcgggguggcugaaaagguucggcaggccagcggaucugccagacaggugguccuucaacgcuccauggagcgggugcagagcuucuuucagaaaaacaagugcagacugccgcucaaacccucccugguugcuaaggaacucaauaucaaaucuuguagcuucuuuuccagcaacgccgugccucugaaggucaccauggugaaugcggaccccaugggcgaggaaaucaacguuauguucaaggugggggaggaucuucgccaggacaugcuggcucugcaaaugauuaaaaucauggauaagauuuggcucaaagagggacuggaccuuagaauggucaucuuuaagugccugucuacaggccgggaucgcgggaugguggaacucgugccugccuccgacacgcugagaaaaauucaggucgaguauggcguuaccggcagcuucaaggauaagccccucgccgaauggcugcggaaauacaacccuucugaggaagaguaugagaaggcuagcgaaaauuucaucuacuccugugccggcugcuguguggcuacauacgugcuugggaucugcgaccgccacaacgauaauauuaugcugagaucuaccggacauauguuucacaucgacuucggcaaauuucuggggcaugcccagauguucggcagcuuuaagcgggaucgcgcgccguucguccucacauccgacauggccuaugugauuaacggcggggagaaacccaccaucagauuucaacuguucguugaccuuuguugccaggcuuacaaucugauucggaagcagacgaaccucuuucugaaucuccugucucuuaugaucccuagcggccugcccgaacugaccuccauucaggaucucaaguaugugcgcgacgcccugcaaccucagacaaccgaugcugaggccacaaucuucuuuaccagacuuaucgaaagcucucugggauccauugccacaaaauucaacuucuuuauccacaaucucgcucagcugcgguucagcggccugcccuccaacgacgagccgauucucucuuuuagcccuaagaccuacuccuucagacaggaugggcgcaucaaagaggucucuguguuuacguaucacaagaaauacaaucccgacaagcauuauauuuacguugugcggauccuuagagaaggacaaaucgagcccagcuucgucuuucgcacauucgaugaauuucaggagcugcacaacaagcuguccauuaucuucccucucuggaaacugcccggcuuuccuaaucggauggugcuugggagaacccauauuaaggacgucgcggccaaacgcaagaucgagcugaacagcuaccuccagucucugaugaaugcuuccaccgauguggccgaaugcgaccugguuuguacauucuuucacccgcuccuucgggaugagaaagccgaaggaauugcuagaagcgccgacgcgggcucuuucucccccaccccugggcagaucggcggagcugugaagcugagcaucucuuaucgcaacggcacgcuguucauuauggucaugcauaucaaggaucucgugacagaggacggggccgaccccaacccuuacguuaaaaccuaucugcuucccgauaaucacaagacaagcaaacggaagaccaaaauuuccagaaagacacggaacccgaccuuuaaugaaaugcugguguacucuggauauagcaaagagacgcuccgccaaagagagcugcagcuguccguccucagcgccgaaucccuucgggagaacuucuuucugggcggggugacccugccucucaaggacuucaaucugucuaaggaaacagugaaaugguaccagcuuaccgcugccacauaucuguga

SEQ ID NO: 73760 - RNA, 4905 nt, Artificial Sequence
  derived and/or modified sequence opt5 from PIK3C2B__Homo_sapiens__NP_002637
augagcuccacccagggcaacggggagcacuggaagucucuggaaagcgugggaaucuccagaaaagagcucgccauggcugaagcccugcaaauggaguacgacgcgcuuucucggcugcgccaugauaaggaagagaauagagcuaaacagaacgccgaccccagccucauuuccugggaugagccuggcgucgacuucuauucuaagccggccgggcggcgcacagaucugaaacuucugagaggacucagcggcuccgaccccacgcugaauuacaacagccugucuccucaggaagggcccccuaaucacuccaccagccagggaccccaaccuggcucugauccguggcccaagggcucccucagcggggacuaucuguacaucuuugauggaucugacggcgggguuuccagcuccccuggacccggcgauauugaggggucuugcaagaaacuuagcccucccccgcugccuccccgggcuuccaucugggacacaccuccccugcccccucgcaagggaagcccgucuuccagcaaaauuucucagcccagcgauaucaacaccuucucccucguggaacagcuuccuggcaagcugcucgagcauagaauccuggaggaagaggaagugcugggcgggggaggccaggggcggcuccugggaucugucgacuaugacggcauuaaugaugccaucacacgccuuaaccugaaaagcaccuacgacgcugagaugcucagagaugccacacggggguggaaggaaggacgcggcccccuggacuuuuccaaggauaccagcggcaaaccuguggcgagaucuaagacgaugcccccgcaaguuccuccccggaccuaugccucccgcuacgggaaucggaaaaacgcuacaccuggaaagaauagaagaauuagcgccgcucccgugggcucucgcccucacaccgucgccaacgggcaugagcuuuucgagguguccgaagaacgggacgaagagguugcggccuuuugucacaugcuggauauccucagaagcggauccgacauucaggauuacuuccugacaggcuauguguggucugcugucacccccagcccggaacaccugggggacgaggugaaucucaaagugacgguccugugcgaucgccuucaggaggcccugacauuuaccuguaacugcuccucuacaguugaccuccugaucuaccagacccuuuguuauacccaugacgaucugcggaauguggacgugggcgauuucguccucaagccuugcggacuggaagaguuucugcaaaacaaacacgcucucggcagccaugaauacauucaguauuguagaaaguucgacaucgauauccgccugcagcuuauggagcaaaaggugguucgguccgaccuggccagaacagugaacgaugaccagagccccucuacgcucaauuaccugguccaucugcaggaacgccccgugaaacagaccauuucccggcaagcccuuagccuccuguuugauacauaucacaacgagguugacgcuuuccugcucgcggauggggacuuuccucugaaggccgauagagugguccagucugugaaagcuaucugcaaugcccuugccgcugucgagaccccggaaauuacauccgcccugaaccagcugcccccuugucccagccgcaugcagccuaagauccaaaaagaccccucugugcucgcgguucgggagaauagagaaaagguggucgaggcucugaccgccgccauucuugaccucguggagcuguacugcaacacguucaaugcugauuuccagacagccguuccuggaagccggaagcacgaccuggugcaggaggcuugucacuuugcccgcucccucgcguucaccgucuacgccacccauagaauccccaucauuugggcuacaagcuaugaggauuuuuaccugucuugcucccuuagccacggcgggaaagaacugugcuccccgcuccagacccggagagcccauuucucuaaguaucuguuucaccugaucgugugggaccaacagauuuguuucccugugcagguuaaccgccuuccccgggagacacuccugugcgcuacgcuguacgcccucccuauucccccgccuggaagcuccucugaagcgaauaaacagagacgcguccccgaggcccugggcugggugaccacaccucuuuuuaacuucagacaagugcugaccugugggcggaagcuccugggccuguggcccgcuacacaggagaaucccagcgcccgcugguccgcuccuaacuuucaccagccggauucugucauccuucaaaucgacuuccccaccagcgccuuugauaucaaauucacguccccucccggagacaaguuuagcccuagauaugaguucggcucucuccgggaagaagaucagcgcaagcugaaagacauuaugcagaaggagucccuguacuggcucaccgaugccgacaaaaagagacugugggaaaaacgguauuacugccauagcgaggugucuucccuuccccugguucucgcuagcgcgccuucuugggagugggccugucugccggauaucuacgugcugcuuaagcaguggacacacaugaaucaucaagacgcucuggggcuccugcacgccaccuuccccgaccaggaaguccgcagaauggccgugcaguggauuggaucccucagcgaugcugagcugcuugacuaucugccucagcucguucaagcccugaaguacgaaugcuaucuggauagcccccuugugcgguuucugcucaaacgcgcggucuccgaccugagagugacacacuacuucuuuuggcuccugaaggauggccuuaaagacucucaguucagcauccgguaucaguaccugcucgcugcccugcuguguugcugugggaagggacuuagagaggaauuuaaccgccagugcuggcugguuaaugcccucgcuaaacuggcccaacaggugcgggaggcggcuccuuccgccagacagggcauucuccgcaccgggcuggaggaagucaagcaauucuuugcccuuaacggcucuugucggcugccccugagcccgucccuccuggugaaaggaaucgugccuagagauugcucuuauuucaacagcaaugcugucccccuuaagcuguccuuucagaacguugacccccucggcgagaauauucgcgugaucuucaagugcggggaugaccugcggcaggauaugcucacgcugcagaugaucagaauuaugucuaaaaucugggugcaagaaggacuugacaugcgcauggucauuuuucgguguuucagcacaggcagagggcggggaaugguggagaugaucccuaacgccgagacccugcgcaagauucagguugaacauggcgugacaggguccuuuaaagacagaccccuggcugauuggcuccagaagcacaauccuggcgaggacgaauacgagaaagccgucgaaaacuucaucuacagcugcgcgggauguugcguggccaccuauguucugggcaucugugaucggcauaaugacaacauuaugcuuaagaccacagggcacauguuccauaucgauuuuggacgcuuccugggccacgcucagauguuugggaauauuaagagagaccgggccccguucguguuuacgucugauauggcuuacgucaucaacggaggcgacaaacccuccagcagauuccacgauuuuguggaccucugcugucaagccuauaaucugauucgcaagcauacccaccucuuccugaaccuucugggccugaugcucucuugcgggaucccugagcuguccgaucuugaggaccugaaauacguuuaugaugcccuccggccccaggacacagaagcuaaugcgaccacauacuuuaccagacugaucgagagcucccucggaucuguggccacgaagcugaacuucuuuauucauaaucuugcucagaugaaauucacaggcagcgacgaucgccugacccuguccuucgccagccggacccacacacucaagucuuccgggagaaucagcgacgucuuucugugucgccaugaaaagauuuuccacccuaacaaaggauauaucuacguggugaaggucaugcgggagaacacccacgaagccacauacauucagagaacguuugaggaguuccaagaacuucauaauaaacugcgccuccuguuucccucuagccaucugccguccuucccuucuagauuuguuaucggccggagccgcggggaggcuguggccgaaagacggcgcgaggaacucaacggauauaucuggcaccuuauucacgcgcccccugagguggcugagugcgaucuggucuacaccuucuuucacccccugccuagagacgaaaaggccaugggcacaucccccgccccgaaaucuagcgauggcaccugggcucggccuguggggaagguuggaggcgaggugaagcucuccaucagcuauaaaaauaacaagcuguucauuauggucaugcauaucagagggcuucagcugcuccaggacggaaaugaucccgaccccuacgugaaaauuuaucugcugccugauccgcagaagacaaccaaacgcaagacgaaaguugcccggaagaccuguaaccccacauacaaugaaaugcucguguaugacggcaucccuaagggggaucuucaacagagagagcugcagcugucuguccucuccgagcaaggauuuugggaaaacgugcugcuuggcgaggucaauauucgccugcgggaacucgaccuggcgcaggagaaaaccggcugguucgcucuggggagcagaucccacggaacacucuga

SEQ ID NO: 73761 - RNA, 4461 nt, Artificial Sequence
  derived and/or modified sequence opt5 from PIK3C2G__Homo_sapiens__NP_001275701
auggccuacagcuggcagaccgaccccaacccuaaugagucccacgaaaagcaauaugagcaucaggaguuccuguuugugaaccagccgcacucuagcucccaggucucucucggcuucgaucaaaucguugacgagauuagcgggaaaaucccccauuacgaauccgagauugaugagaauacauuuuucgugccuacggcucccaagugggacucuaccggacacagccugaacgaagcccaucagaucucccuuaaugaguuuacaagcaaaucuagagaacuguccuggcaccaggugagcaaggcgccugcuauuggcuucucucccuccguccucccuaaaccgcagaacaccaauaaggagugcagcugggggucucccaucggaaagcaccauggcgccgaugacucccgguuuagcauccuggccccuuccuucacaucucuugauaaaauuaaccuggagaaggaacucgagaaugaaaaccacaauuaucauaucggguuugagagcuccauucccccuaccaacagcucuuucuccagcgacuuuaugcccaaagaagagaauaagcgcucuggacacgugaacaucguugagccgagccugaugcugcucaaaggcucccugcaaccuggcaugugggaaucuacauggcagaagaauauugagagcaucggguguuccauucagcuuguggaagucccccagagcucuaacaccucccuggcuagcuucugcaacaaggugaaaaagaucagagagcgguaccacgccgcugauguuaauuuuaacucuggaaaaaucugguccacgaccacagccuucccuuaucaacucuucagcaagaccaaauuuaauauucauaucuucauugacaacuccacacagccccugcacuuuaugcccugugcgaauuaccuugugaaggaucugaucgccgaaauucuccauuucugcaccaacgaccagcugcugccuaaagaucacauccucucugucuguggcagcgaggaguuucugcaaaaugaccauugccuugggucccacaagauguuccagaaggacaaaucugugauccagcugcaccuccaaaagagccgcgaagcuccgggaaaacuguccagaaagcaugaggaagaucacagccaguuuuaucuuaaccagcugcucgaguucaugcauauuuggaaagugucucggcagugucugcugacgcucauccgcaaguacgacuuucaccugaaguaccuucugaaaacacaggaaaaugucuauaacauuaucgaggagguuaagaaaauuugcuccgugcucggcuguguggaaaccaagcaaaucacagaugccgucaaugagcugagccuuauccugcagagaaaaggggaaaacuucuaccagucuuccgagaccagcgcuaagggacucauugagaaggugaccacagaacugucuacgagcaucuaucagcugauuaauguuuacugcaacuccuuuuaugccgacuuccaacccgugaaugucccucgguguaccagcuaccucaaccccggccugccuucucaccuuuccuuuacaguguaugcggcccauaacauccccgagaccuggguucacagcuacaaggcuuucuccuucacaugcuggcugaccuacgccggcaagaaacucugccaggugcgcaauuauagaaacauuccggauaagaaacuguuuuucuuucuggucaauuggaacgaaacgaucaauuucccucuugagauuaagucucucccccgggaaagcaugcugacagugaagcuguuugggaucgcuugugccaccaacaaugccaaccuccuggcuuggaccugccuuccucuguuccccaaagagaaguccauccucggaucuaugcuguuuagcaugacacugcaguccgagccucccgucgaaaugauuaccccgggcgugugggacguuucucagccuagccccgugacacuucaaaucgauuuccccgcgacggggugggaguacaugaaaccugacuccgaagagaaucgcagcaaccucgaggaaccgcugaaggaguguauuaaacauaucgccagacugucucagaagcagacaccccuccugcuuuccgaagagaaaaagcgguaucugugguuuuaccgcuucuauugcaauaacgaaaauuguagccucccucugguccugggaucugcucccggcugggaugagagaaccguguccgaaaugcacaccauucuucggagauggacauuuagccaaccucucgaggcccuggggcugcucaccucuuccuuccccgaccaggagauccgcaagguugccgugcagcagcuggauaaccuucugaaugacgaacuccuggaguaccugccucaacuuguccaggcugugaaauuugaauggaaccucgagagcccccuggugcagcugcuccugcaucggucccuucagagcauccaaguugcccacagacuguauuggcuccugaagaacgcggagaaugaggcuuacuucaaaucuugguaccagaagcugcuugccgcccugcaguucugcgcuggaaaagcccucaacgacgaauuuagcaaggaacagaagcugauuaaaauccucggcgauauuggcgagcgcgucaaguccgcuucugaccaccaacggcaggaagugcugaaaaaggagaucgggagacuugaggaguucuuucaggaugugaauacgugucaucugccgcucaacccugcccugugcauuaaaggaaucgaccacgaugcguguagcuauuucaccuccaaugcccugccccuuaagaucacauuuauuaacgcuaauccuaugggcaagaacaucucuauuaucuucaaagccggggacgaucugcgccaagacaugcucguccugcagcucauucaggugauggauaauaucuggcugcaggaaggacuugacaugcaaaugaucauuuaccggugccugagcaccggcaaggaucaggggcucguucagauggugcccgacgcugucacacuggccaaaauccauagacacuccggccugauuggaccgcuuaaggaaaacaccaucaaaaagugguuuucucagcauaaucaccugaaggcggauuaugagaaagcccuccgcaacuucuuuuacagcugugcuggcuggugcgugguuacguucauucugggggugugcgaccggcacaaugacaacaucaugcucacaaaguccggacauauguuucacauugauuucggcaaauuccuggggcaugcccaaaccuuuggaggcaucaagagagaccgcgcuccuuucaucuuuacaagcgaaauggaguauuucauuaccgaagggggcaaaaauccccagcacuuucaggauuucgucgaacuuuguugccgggccuacaacaucauuagaaagcacucucagcugcugcucaaccugcuugagaugaugcuguaugccggacucccugaacuguccggcauccaagaccucaaauacguguacaauaaccugcggccccaggauaccgaccuugaggcuacaagccauuuuacgaagaagauuaaagaaucucuggaguguuuccccguuaagcugaauaaccucauccacacccuggcgcagauguccgccaucagcccugcuaaauccacaucucagaccuuuccgcaagagagcugccuucuguccacaacccgcagcauugaaagagccacgauccucggguucucuaagaaauccagcaaucuguaucucauucaggugacacauucuaacaaugagaccagccugaccgaaaaguccuuugagcaguucucuaaacuucacagccaacugcagaaacaguuugccucccugacacuccccgaguucccucauugguggcaucugcccuucaccaacucugaucaccggagauuucgcgaccuuaaucacuacauggaacagauccugaacgucagccacgaggugacaaauuccgauugugugcucagcuucuuucugucugaagcuguccaacagacgguugaggaauccagcccuguguaucucggagagaaguuccccgacaaaaagccuaaagugcagcuggucauuuccuacgaggaugugaaacuuaccauccugguuaagcauaugaagaacauccaucugccggacggcucugcccccagcgcgcacguggaauuuuaucuccugccuuaccccuccgagguccggagacgcaagacaaaaucugugccuaagugcaccgaucccacauauaaugaaauuguuguguacgacgaggucaccgaacuucaggggcacgugcugaugcucaucguuaaaagcaagacgguguucgucggagcuauuaacaucagacuguguuccgugccgcuggacaaggagaaaugguacccucucggcaauagcauuaucuga

SEQ ID NO: 73762 - RNA, 2664 nt, Artificial Sequence
  derived and/or modified sequence opt5 from PIK3C3__Homo_sapiens__NP_002638
augggcgaggccgaaaaguuccacuacaucuauagcugcgaccuggauauuaacgugcagcucaaaaucgggucccuggagggaaagagagaacaaaaaucuuacaaggcuguccuugaggaccccaugcugaaauuuagcggccucuaucaggaaaccuguuccgaucuguacguuacaugccagguguucgccgaggggaagccucuugcgcugccggugcggacgucuuauaaggcuuuuagcacccgcuggaauuggaacgaguggcucaaacugcccgucaaguacccugaccugcccagaaaugcccagguggcccucacaauuugggauguuuauggaccuggcaaagcugugcccgucgggggaaccacagugucccuguucggcaaguacggcauguuucggcaagggaugcaugaccuuaaaguuuggccuaacguggaagccgauggaucugagccgaccaagacacccggccgcaccagcuccacgcugagcgaagaccagaugucuagacucgcuaagcugaccaaagcccaccggcaggggcauauggucaagguggauuggcuugaccgccugacauucagagagaucgagaugauuaaugaauccgagaaacggagcucuaacuuuauguaccucaugguggaguuccgcugugucaagugcgaugacaaagaguauggaaucguuuacuaugaaaaggauggcgacgaguccagcccuauccugaccucuuuugagcuggugaaagugcccgacccucagauguccauggaaaaucucgucgagagcaagcaccauaagcuggcgagaucccuucggucugggcccagcgaucacgaccugaaaccgaacgccgcuacacgcgaucaacucaauauuaucguguccuacccucccaccaagcagcugacguaugaagaacaggaccuuguuuggaaauucagauacuaucugacaaaccaggaaaaggcccucaccaaauuucugaagugugugaauugggaucugccucaagaggcuaagcaggcccucgagcugcuuggaaaauggaagcccauggacgucgaagauagccuggagcuccugucuucccacuacacaaaccccaccgugcggcgcuacgcgguugccagacuucggcaggcugacgaugaagaccugcucauguaucugcugcaacucgugcaggcccugaaauacgagaauuucgaugacauuaagaacggccuugaaccuaccaaaaaggacagccagucuagcgucuccgagaaugugucuaacagcggcaucaacuccgcugagauugauagcucucagaucauuacauccccgcugcccagcgucucuuccccucccccugccagcaagacgaaagaagugcccgacggggagaaucucgaacaagaucugugcaccuuucugaucuccagagccuguaagaacucuacacuugcuaauuaucucuacugguauguuaucguggagugcgaggaccaggauacccagcagcgcgacccgaaaacacaugaaauguaccugaacgucaugcggagauucagccaagcgcugcucaagggagauaaauccgugcgcguuaugcggucucugcuugccgcucagcagaccuucguggacagacugguccaccucaugaaggccgugcagcgcgagagcggcaaucggaagaaaaagaacgaaagacugcaagcccugcuuggggauaaugagaaaaugaaccucuccgacguggaacugauuccucugccccucgagccucagguuaagauccgcggaauuauccccgagacggcuacacuguuuaaaagcgcccuuaugccugcgcagcuguucuuuaagaccgaagauggcgggaaauaucccgucauuuucaagcauggagacgaucuccggcaggaccaacugauccugcagaucauuucucuuauggacaagcuccugagaaaagagaaucuggaucucaagcugaccccguacaaagugcuugcuacauccaccaagcacggcuuuaugcaguucauccaaagcgugccugucgccgaagugcuggacacagagggcucuauucagaacuuuuuccgcaaauacgcccccuccgaaaaugggcccaacggaaucagcgcugagguuauggauacguaugugaagucuugugccggcuacugcgucauuaccuauauccucggggugggagaccggcaccuggauaaucugcuucucacaaagaccggcaaacuguuucauaucgacuucggguacauucugggcagagauccuaagccgcugcccccucccaugaaacugaacaaggagaugguugaaggaaugggcgggacacagagcgagcaguaucaagaauuucggaaacaguguuacaccgcuuuccuucaccuccgcagauauuccaaucucauccugaaccuguuuagccuuaugguggacgccaacauuccugauaucgcgcuggagcccgacaagacggucaagaaagugcaggauaaguuccggcucgaccugucugaugaagaggccguucauuacaugcagucccucauugacgagagcgugcacgcucuguucgccgcugucguggaacaaauccauaaauuugcccaguacuggagaaaguga

SEQ ID NO: 73763 - RNA, 3207 nt, Artificial Sequence
  derived and/or modified sequence opt5 from PIK3CA__Homo_sapiens__NP_006209
augcccccuagaccgagcuccggcgagcugugggggauccaccucaugcccccucggauucugguggaaugccuucugcccaacggaaugaucgucacccucgagugucugcgcgaagccacacuuauuacgaucaagcaugagcuguucaaagaagcuagaaaguacccucuccaccagcugcugcaagacgagucuagcuauauuuuuguuuccgugacccaggaggccgaacgggaggaguucuuugaugagacacgcagacucugcgaccugcggcuuuuccagcccuuucugaaagugaucgagccugucggcaaucgcgaagagaagauccucaacagagaaauuggguucgcgaucggaaugccggugugugaguuugauaugguuaaagaccccgaagugcaggauuuccggcgcaauauucugaacgucugcaaggaggcuguggaccuuagagaucucaauucuccucauagccgggccauguacguuuaucccccuaacguggaguccucucccgaacugccgaagcacaucuacaauaaacuggacaagggccaaauuaucgucgugauuugggugaucgucagcccuaacaaugauaaacagaaguauacccugaaaaucaaccaugacuguguucccgaacaggugauugccgaagcuauccgcaagaagacaagauccaugcuccugagcucugagcagcuuaaacugugcgugcucgaauaccaagggaaguauauucugaaagucuguggaugcgaugaguacuuucuugagaaguacccucugucccaguauaaauacauccggagcuguauuaugcucggccgcaugcccaaucugaugcugauggccaaggaaucucucuauucccagcugcccauggacugcuucaccaugccuagcuacucuagacggaucuccacagcuaccccguauaugaacggcgagacgagcaccaaaucccuuugggugaucaauucugcccugagaauuaagauccucugugcgacauacguuaacgugaauauucgcgauaucgacaagauuuauguccggaccgggaucuaccacggaggcgaaccccugugcgacaacgugaacacacagagaguuccuugcagcaauccccgcuggaacgaguggcuuaauuacgauaucuauauuccugaccugccccgggccgcuagacucugucuguccaucugcagcgugaaagggcgcaagggagccaaagaagaacacuguccgcuggcuuggggcaacauuaaucucuuugauuacaccgacacgcuggucucugggaagauggcccuuaaccuguggccugugccccauggacucgaggaucugcugaauccuaucggcgucacaggcuccaaccccaauaaagaaaccccuugccuugagcucgaguucgacugguuuagcucugugguuaaguuccccgauaugagcgugauugaggagcacgcgaacugguccgucucucgggaagccggguucagcuauucccaugcuggacugagcaauagacuggcccgcgacaacgagcuccgggaaaaugauaaggagcaacugaaagcuaucucuacaagagacccgcuuuccgaaauuaccgagcaggagaaggauuuucuguggagccaccgccacuacugugugaccaucccugaaauccuccccaaacugcugcuuucuguuaaguggaacucccgggacgagguggcccagauguauugccucgucaaagacuggcccccuauuaagccggaacaagccauggagcugcuggauuguaauuaccccgacccuauggugagaggcuucgcugugcggugccucgaaaaguaucugacagaugacaaacuuagccaguaccugauccagcucguucagguccugaaguacgagcaauaucuggauaaccuucucgugcgcuuucugcugaaaaaggcgcucacgaaccagagaauugggcauuucuuuuucuggcaccugaaauccgagaugcauaauaagaccgugucucagcgguuuggacuucugcucgaaagcuacuguagagccugcggcauguaucugaagcaccugaaccgccaggucgaggcuauggaaaaacuuaucaaucucacagacauucugaagcaagagaaaaaggaugaaacccagaaagugcagaugaaguuccugguugagcagaugcggagacccgacuuuauggaugcccuccaaggguuccuguccccucuuaaccccgcccaucagcugggaaaucuccgccuggaggaauguagaaucaugucuagcgcuaaacggccucuguggcuuaacugggagaaucccgacaucauguccgaacugcucuuucagaacaaugagauuaucuucaagaacggcgaugaccugcgccaggauaugcucacacugcaaauuaucagaauuauggagaauaucuggcagaaccagggccuugaccugcggaugcucccguacgggugccugagcaucggagacugcgugggccugauugaagucgugcgcaauucucacaccaucaugcaaauucaguguaaagggggacuuaagggcgcccugcaguuuaacucccacacgcuccaucaguggcugaaggauaaaaauaagggggagaucuaugacgcggcuauugaucucuucacaagaagcugcgccggcuacuguguugccaccuucauccugggaaucggcgaccggcacaacucuaacauuauggugaaagaugacgggcaacuuuuucauaucgauuucggacacuuucuggaccacaagaagaaaaaguucggcuauaaacgcgaaagagucccuuuugugcucacccaggauuuccugauuguuaucuccaagggggcucaggagugcacaaaaacccgggaauuugagcgcuuccaggagauguguuacaaggccuaccuggcuauuagacaacaugccaaucuuuuuaucaaccuguucagcaugaugcucggaucuggcaugcccgaacugcagagcuuugacgauauugcguauauccggaagacacucgcccuggacaaaacggagcaggaagcucuugaguacuucaugaagcagaugaaugaugcccaccaugggggcuggaccacaaaaauggacuggaucuuucacaccauuaagcaacaugcucugaacuga

SEQ ID NO: 73764 - RNA, 3213 nt, Artificial Sequence
  derived and/or modified sequence opt5 from PIK3CB__Homo_sapiens__NP_006210
augugcuucagcuuuaucaugcccccugccauggcugacauucuggauaucugggccguggacucccagauugcgucugauggcagcaucccggucgacuuccuccugcccaccgggauuuacauccaacuugagguuccuagagaagcuacaaucuccuauauuaagcagaugcuguggaaacaggugcacaacuaccccauguuuaaucuccugauggauaucgacucuuauauguucgccugugugaaccagacggccgucuacgaggaacuugaggaugaaacccggcgccugugcgacgugagaccuuuucuccccguucugaagcuggugacacggagcugugauccuggagagaaacucgacuccaagauuggcguccugaucgggaaaggacuucaugaguucgauucucugaaggacccggaagugaaugaguuucgcagaaagaugcggaaauucagcgaagagaagauucucucccugguuggccuuagcuggauggauuggcugaaacaaaccuaucccccugagcacgaacccucuaucccugagaaccucgaagacaagcuguacgggggaaaacugauuguggcuguccauuuugagaauugccaggacguguucuccuuucaggugagccccaacaugaauccgaucaaggucaacgaacucgccauccagaagcgccugacaauucacggcaaagaggaugagguuucuccuuaugacuacgugcuucaaguguccggcagagucgaauacguguucggggaucauccccugauccaguuucaguauauucggaauuguguuaugaaccgcgcucucccucacuucauccugguggagugcuguaagauuaaaaagauguacgaacaggagaugaucgccaucgaagcggccauuaauagaaacagcucuaaucuuccccugccccucccuccgaaaaagacccggaucauuucccacgucugggagaacaauaaccccuuccaaaucgugcugguuaaaggaaacaagcugaauacagaggaaaccgugaagguccaugugcgcgcuggccucuuucacgggacggagcugcuuugcaaaaccauugucagcuccgaagugucuggaaagaacgaccauaucuggaaugagccucuggaguucgauaucaacauuugugaccuccccagaauggcccggcugugcuuugcuguuuaugccgugcuugauaaagucaagaccaaaaagagcacaaagacaaucaauccuuccaaauaccagaccauucgcaaggcgggcaaagugcacuaucccguugccugggugaacacgauggucuucgacuuuaaggggcagcugagaacaggagauaucauucuccacagcuggucuuccuucccggacgaacuggaggaaaugcugaauccuaugggcaccgugcaaacaaaccccuacaccgagaaugcuaccgcccuccaugugaaauuuccugaaaacaagaagcagcccuauuacuacccucccuucgauaaaaucauugagaaggcugccgagaucgccagcucugacagcgcuaauguuuccucucggggcgggaaaaaguuucugccgguccuuaaagaaauccuggacagagauccucucagccagcugugugagaacgaaauggaccugauuuggacacuucgccaggauugccgggagaucuucccccaaucccuccccaagcugcugcucagcauuaaguggaauaaacuggaagacguggcgcagcuucaggcccugcuccagaucuggccuaagcugccgcccagagaggcucuggagcuucucgauuuuaacuauccugaccaauacgugcgcgaauaugccgucggaugccugcggcagaugucugaugaggaacugucccaguaccuccugcagcuugugcaaguucugaaauaugagcccuuccucgacugugcccugagcagauuucugcuugaacgcgcucucggcaaucggagaauugggcaguuccuguucuggcaucugcgcucugaggugcacaucccugccgucuccgugcaguuuggaguuauccucgaggcguacugccggggcagcguggggcacaugaagguccuguccaaacagguggaagcucuuaacaagcugaaaacgcucaacucucugauuaagcugaaugccguuaagcugaacagagccaaaggaaaggaggcuaugcauaccugucucaaacaaagcgccuaucgcgaagcucuguccgaucugcagucuccccucaauccuugcgugauccugagcgagcuuuacgucgaaaaguguaaauacauggacuccaagaugaagccccuguggcucguguauaacaauaaaguguucggcgaggauagcgucggcguuauuuuuaagaacggggacgaucugcggcaggacaugcugacacuucaaaugcugagacucauggaccugcucuggaaagaggccggacuggaucuucggaugcugccguacggcugccucgcgaccggggaccgcucuggacugaucgaagugguguccacaagcgagaccauugccgauauccagcuuaauucuuccaacgucgcugccgcugccgcguucaauaaggacgcccuucugaacuggcucaaagaauauaauagcggcgaugaccuggauagagcuaucgaggaguuuacgcucucuugugccggguacugcguggcuagcuauguucugggcauuggagaccggcacuccgauaacaucauggugaagaagacaggccagcuuuuccacauugacuuugggcauauccugggaaauuucaaaagcaaguuuggcauuaaaagagaacgcgucccuuucauccucaccuacgauuuuauccacgugauucagcaagggaagaccggaaacacagagaaauucggccgguuuagacaguguugcgaagacgccuaucugauccugcgcagacaugggaaucuuuucauuacccuguucgcccucaugcugacagcuggccuccccgagcugacgucuguuaaggauauccaguaccuuaaggacucccuggcgcugggaaaaagcgaagaggaggcccucaagcaguuuaaacaaaaguucgacgaagcucugcgggaguccuggaccacaaaagugaacuggauggcccacaccguccgcaaggauuacagaucuuga

SEQ ID NO: 73765 - RNA, 2487 nt, Artificial Sequence
  derived and/or modified sequence opt5 from PIK3CD__Homo_sapiens__XP_011539885
auggccugcgcucugagaaagaaagccaccguguuccggcagccccucgucgagcaaccugaagacuacacacugcagguuaacggccgccacgaguaucuuuacgggagcuauccgcugugucaguuucaguacaucugcuccugucuccauucuggacugacgccccaccuuaccauggugcauagcuccucuauucuggcgaugagagaugaacaaagcaauccugcuccccaggugcagaagccucgggccaaacccccuccgauccccgccaagaaaccuuccucugucagccucuggucccuggagcagcccuuccgcauugaacugauccaaggcagcaaggugaacgcugacgagagaaugaagcucguugugcaggccgggcuguuucacggaaaugagaugcuuugcaaaacagucucuuccagcgaagugucuguuuguuccgagccuguguggaagcagcggcuggaguucgauauuaacaucugcgaccucccccgcauggcuagacuguguuuugcccuuuaugcggucaucgagaaagccaagaaagcucggagcaccaagaagaaaucuaagaaagccgauugcccgauugcuugggccaaucugaugcuuuucgacuacaaggaucagcugaaaacaggcgagcgcugucuguauauguggccuuccgugcccgacgaaaagggggagcuccugaacccuaccggaacagugagaagcaaucccaacaccgauuccgcggccgcccuucugaucugccuccccgaagucgcuccucauccgguuuacuaccccgcucuggagaaaauucuugaacugggccggcacucugagugugugcacgugacggaggaagaacaacuccagcugcgcgaaauccuggagagacggggcagcggggaacucuaugagcaugagaaggaccuggucuggaagcuccgccacgaagugcaggagcauuuuccugaagcccuggccagacuccugcuuguuaccaaauggaauaagcacgaggauguggcucaaaugcuguaccuccugugcuccuggcccgaacugccuguccucagcgcgcuggagcuucuggacuucucuuuucccgauugccacgugggauccuucgccauuaaaagccuccggaagcugacagacgacgagcuguuucaguaucuucuccagcugguucaggugcugaaauacgaaucuuaucucgauugugagcugaccaaguuccuucuggacagagcucucgccaaccgcaagaucggccauuuucuguucuggcaucugcggagcgaaaugcacgucccguccguggcccuuagauucgggcucauucuggaggcuuacugccgcggaucuacacaccauaugaaaguccugaugaagcaaggcgaggcccucagcaaacugaaggcgcuuaaugauuuugugaaacuguccagccagaagaccccuaagccccagacgaaagaacucaugcaccuguguaugcggcaggaggcuuaucuggaagcccuuucucaccuccaauccccucuggaccccagcacacugcucgccgagguuugcguggaacaguguaccuucauggauucuaagaugaaaccucuguggaucauguacuccaacgaggaggcugggagcggaggcuccgucggcaucauuuuuaagaauggggacgaucuuagacaggacaugcugacacuccagaugauccaacugauggaugugcuguggaaacaggaaggacuugaccuccgcaugacccccuacggcugccugccgaccggggaucggacaggacugauugagguugugcucagaucugacacgaucgccaacauucagcugaauaagagcaacauggcugccaccgcggccuucaacaaggacgcccuucugaauuggcucaaauccaagaacccuggcgaagcucuggaucgcgcuaucgaggaauuuacacugucuugugccggguauugcgucgcgaccuacgugcuuggaaucggcgaccggcauagcgauaauauuaugaucagagaguccggccagcuguuccacauugacuuugggcauuuccucggaaacuuuaaaacaaaguucggcaucaaucgcgagcgggugcccuuuauucugaccuaugauuucguucacgucauccaacaggggaaaacgaacaauagcgaaaaguuugagagauuccggggauacugugaacgcgccuauacaauccucagacggcacggccugcuuuuccugcaucucuuugcucugaugagagccgcugggcugcccgagcuuucuugcuccaaagacauucaguaccugaaggauagccucgcccugggcaagaccgaagaggaggcccucaaacacuuccgcgugaaguuuaacgaagcucugcgggagucuuggaaaaccaaggugaauuggcuugcgcauaacgucuccaaagacaauagacaauga

SEQ ID NO: 73766 - RNA, 3309 nt, Artificial Sequence
  derived and/or modified sequence opt5 from PIK3CG__Homo_sapiens__NP_001269355
auggagcuggaaaacuacaagcagcccgugguccucagagaggacaauugccggcgcagacggcgcaugaaaccuagaagcgccgcugccucccugucuagcauggaacuuaucccgauugaguucguucugcccaccucccaacggaaguguaaaucuccugaaacagcgcuccugcacguggcuggccaugggaacguggagcagaugaaggcccaggucuggcuucgcgcccuggagacgagcguggcugccgauuuuuaucacagacucggaccccaucacuuccugcugcucuaccagaaaaagggccaaugguaugaaaucuacgacaaguaucagguugugcagacccuggauugccuucgguacuggaaagcuacacaucgcuccccugggcagauucaccugguccaaagacaucccccuucugaggaaagccaggccuuucagcggcagcucaccgcgcugaucggauaugacgugacagauguuuccaaugugcacgacgaugagcuugaguucacccgcagaggccuggucacaccgcggauggccgaaguggcuagccgcgaccccaagcucuacgccaugcacccuugggugaccucuaaaccccugccugaguaccuguggaagaaaauugcuaacaauuguaucuuuaucgucauucauagauccacgaccagccaaacaaucaagguuucucccgaugacaccccgggggccauucuccaguccuucuuuacaaagauggcgaaaaagaaaagccugauggauaucccugaaucucaguccgagcaagacuucgugcuucgggugugcggaagagaugaauaucuggucggcgagacccccauuaagaacuuucagugggugcgccacugucucaaaaauggcgaggaaauccacguugugcuggacacgccucccgaccccgcccuugaugagguccggaaggaagaguggccucugguggacgauugcacagggguuaccggauaccaugaacagcucacaauucacggcaaagaccaugagagcguguucaccgucucccugugggauugugacagaaaguuucgcgugaagauccgggggaucgauauuccgguccugcccagaaacaccgaccucacaguguucguugaggcuaauauccagcacggacaacaggugcugugccagcgccggacgucuccuaaacccuuuaccgaagagguccuuuggaacguguggcuggaguucagcauuaagaucaaagaucucccuaagggcgcccugcuuaaucugcagauuuauugugggaaagcucccgcccucuccagcaaggccucugcugaauccccgagcucugaaagcaagggaaaaguucaacugcuguacuaugugaaccuccugcuuaucgaccauagauuccugcuccgccggggcgaguacguccugcacauguggcagaucuccggcaagggggaggaucagggaucuuuuaaugcggacaaacugacaagcgccaccaacccugacaaggaaaauuccaugagcauuucuauccuucucgauaacuauugccaccccauugcucugccuaaacaucagcccacaccugaccccgagggcgauagagugcgcgccgaaaugccgaaccaacugcggaagcagcucgaggccaucauugcuaccgacccucugaauccccuuacggccgaggauaaggaacugcucuggcacuucagauacgagucccugaaacaucccaaggcguacccuaaacuguuuagcucugugaagugggggcagcaggaaaucguugcuaaaacauaucaacuucucgcccggcgcgaggucugggaccaguccgcccuggaugugggacugaccaugcagcuccuggacuguaacuucagcgaugaaaaugugagagcuaucgccguccaaaaacuugagucccuggaggacgaugacgugcuccacuaccugcugcagcuuguucaggcugugaaguuugaaccguaucacgauucugcccucgcgcgguuccugcugaaaagaggccuccgcaacaagcggauugggcauuuucuguucugguuucuuagaagcgagaucgcccagucccgccacuaccaacagagauucgcugucauucuggaagccuaucuccggggaugcggcaccgcuaugcugcaugacuuuacacaacaggugcagguuaucgagaugcugcagaaagugacccuugacauuaagucucucagcgccgaaaaauacgaugucuccagccaggugaucucucagcugaagcaaaaacuggagaaucuccagaacucccagcugcccgagagcuuccgcguuccuuaugaccccggccuuaaggcgggggcccuggcuauugaaaagugcaaagugauggccucuaagaaaaagccucucuggcuggaguuuaaaugugcugaucccacagcccuguccaaugaaacgaucggaaucauuuucaagcacggcgacgaucuuagacaagacaugcugauccuccagauucugcggaucauggagagcauuugggaaaccgagucucucgaucugugccuucugccuuacggguguaucagcacaggagacaagaucggcaugauugagaucgucaaagaugccaccacaauugcuaagauccagcaguccaccguggggaacacgggcgcguucaaagacgaagugcucaaucauuggcugaaggagaaaagccccaccgaagagaaguuucaagccgcugucgagcgcuucguuuacucuugcgccggauauuguguggccacauuugugcugggcauuggggauagacacaacgacaauaucaugaucaccgaaacaggaaaccuuuuccacauugauuuuggccauauccuggggaauuacaaguccuuccucggaauuaacaaagagcgggucccguuugugcugaccccugacuuccucuuuguuaugggcacgagcgggaagaaaacaucuccccacuuccagaaguuucaggacaucugcgugaaggcuuaucuggcccuucgccaucacaccaaucugcucauuauccuguucuccaugaugcugaugacaggcaugccucagcuuaccagcaaggaagauaucgaguacauuagagacgcgcugaccgucggaaagaacgaagaggaugcuaaaaaguauuuucucgaccaaaucgaggugugucgggauaaaggcuggacaguucaguucaacugguuccugcaucucgugcuggggauuaagcagggagaaaaacacuccgccuga

SEQ ID NO: 73767 - RNA, 522 nt, Artificial Sequence
  derived and/or modified sequence opt5 from PIK3IP1__Homo_sapiens__NP_001129383
augcugcucgccugggugcaggcuuuccuggucagcaacaugcuucuggccgaggcguacggcuccgggggaugcuuuugggacaauggccaccucuauagagaagaucaaaccucucccgcuccugggcugcggugucuuaacuggcuggacgcccagagcggacucgccuccgcuccgguuucuggcgccgggaaucauagcuacugccgcaaccccgaugaggacccuagaggacccugguguuauguguccggcgaagcuggcgugccugagaagcggcccugcgaagaucugcgcuguccugagacaacgucucaggcccugccggcguucaccacagagauccaggaagccagcgaggggcccggagcugacgaaguccaaguguuugccccugcuaaugcccuccccgcgagauccgaggccgcugccguucagccugugauuggcaucagccagcggguccgcaugaacucuaaagagaagaaagaucuggggacccuuggaggcagaauuuga

SEQ ID NO: 73768 - RNA, 1086 nt, Artificial Sequence
  derived and/or modified sequence opt5 from PIK3R1__Homo_sapiens__NP_001229395
augcacggcgacuacacccugacacucagaaaagggggaaacaauaaacugaucaagauuuuccaucgggauggcaaauauggguuuagcgacccccuuacguucuccucuguggucgagcugaucaaccacuaccgcaaugaaagccucgcccaguauaacccuaagcuggauguuaaacuucuguacccgguguccaaguaucaacaggaccagguggucaaggaggauaauauugaagcugugggaaagaagcuccaugaguacaacacccaguuucaagaaaaaucuagagaguaugaccggcuguacgaggaauacacacgcaccagccaggagauccagaugaagagaacagccauugaagcguucaaugagaccaucaaaaucuuugaggaacagugccaaacacaggagcgguauuccaaggaauacauugagaaguucaaacgcgaaggcaacgagaaggagauccagagaauuaugcacaauuaugauaaacugaagucucggaucagcgaaauuaucgacucccgcagacggcucgaggaagaucugaaaaagcaggcugccgaguaccgcgaaauugacaaaagaaugaacagcaucaagcccgaucuuauccaacugcggaagacccgcgaccaguaucucauguggcugacgcagaaagggguuagacaaaagaaacuuaaugaguggcugggaaacgagaauaccgaagaucaguacucucucguggaggacgacgaagaucugccucaucacgacgagaagacauggaacgucggcuccagcaaucggaacaaagccgaaaaccugcucagaggcaagcgcgaugggaccuuucuggugcgggagucuuccaagcagggauguuaugcuugcagcguuguggucgacggcgaggugaaacacugugugauuaauaagacagccaccggguacggauucgcugaacccuacaaccuuuauucuucccugaaagagcucguccugcauuaccagcacacgagccuuguucaacauaaugauucccugaacgugacacucgccuauccuguguacgcgcagcagagacgcuga

SEQ ID NO: 73769 - RNA, 2187 nt, Artificial Sequence
  derived and/or modified sequence opt5 from PIK3R2__Homo_sapiens__NP_005018
auggccggccccgagggguuccaguacagagcucuguauccuuuucggcgcgaaagaccggaggaccucgaacugcuucccggagaugugcuggucguuagccgggccgcgcuccaagcucugggcguggccgaagggggagaacgcugcccucaguccgugggcuggaugcccgggcuuaacgagagaacccggcagcgcggagacuucccuggcacauacgucgaguuucugggccccguggcccucgcuagaccugggccgcggccccgcggaccuagaccccugccugcccggccccgcgauggcgcuccggaaccugggcugacgcuccccgaccugccugagcaguucucuccucccgauguugccccuccgcuucuggugaagcucgucgaagcgaucgagagaaccggacuggacagcgagucccacuaucggcccgaacuuccugcuccccgcacagauuggucucugagcgacguggaucaaugggacaccgccgcccucgcugauggcauuaaauccuuucugcuggcccucccugcgccccugguuacaccggaggccucugcugaagccagacgggcucuuagagaggccgccgggccugugggacccgcucuggaaccucccacccucccucugcaucgcgcgcuuacacugcgguuccuccugcagcaccugggcagagucgcccgccgggcucccgcccucggcccggccgugagagcucugggggccaccuuuggaccucuucugcuccgcgcgcccccucccccgagcuccccuccucccggcggggcucccgacggaagcgagcccucucccgauuuccccgcccugcuuguggagaagcugcuccaggaacaucuggaggaacaggaggucgccccgccugcucugcccccuaaacccccgaaggccaaaccugcucccacgguucucgccaauggcggguccccucccagccugcaagacgcggaaugguacuggggagacaucucucgggaggaggugaacgaaaagcugagagauacccccgacggcacauuucuugugcgcgaugccuccagcaagauucagggcgaguauacccucacacugcggaaagggggaaauaacaagcugaucaaagucuuccacagagacggccauuacggguuuucugaaccucuuaccuucuguuccgugguugaucucauuaaucacuaucgccacgagagccuggcucaguacaacgccaagcuggacacgcggcuccuguacccgguguccaaauaucagcaagaucagaucgucaaggaagacucuguggaggcuguuggagcccagcuuaagguguaccaucaacaguaucaggauaaaagcagagaguacgaccagcuguaugaagaguacacacggaccucccaagaacuccagaugaagcgcacagcgaucgaggccuuuaaugagaccauuaaaaucuucgaggagcagggccagacccaagaaaagugcagcaaagaguaucuggaaagauuccggagagaggggaacgagaaggaaaugcagcgcauucugcuuaauucugagcggcucaaauccagaaucgcugaaauucacgagagccgcacaaagcuggaacagcagcugagagcccaggcuucugauaaccgggagaucgacaagcgcaugaauagccucaaacccgaccugaugcaacuuagaaagauucgggaucaguaccuggucuggcucacgcagaaaggcgcccgccaaaagaaaaucaacgaguggcugggaaucaagaaugaaaccgaggaccaguacgcccugauggaagaugaggacgaucuuccucaucacgaagagagaacaugguaugugggcaagauuaaccggacccaggcugaggaaaugcucuccgggaaacgcgacggaacauuucugaucagagagucuagccaacggggcuguuacgcgugcuccgucgugguugauggggacaccaagcacugugugauuuaucgcacggccacaggauucggcuuugcugaacccuacaaucuguaugggagccucaaagagcugguccuucauuaccagcacgccucucuggugcagcauaacgaugcccucaccguuacccuggcucacccugugagagcccccggcccuggaccgcccccugcggcucgguga

SEQ ID NO: 73770 - RNA, 1524 nt, Artificial Sequence
  derived and/or modified sequence opt5 from PIK3R3__Homo_sapiens__NP_001290356
augggccccagcagacuggugcgggggccucgcccgcagggaaugagaucccccuaccggcgcccuggcaugggguggcccagaccucgguucccccgcauguuuaagugcucuagacggcgcuaucaacagggacucagaggccggaccgccagcuccgcugccaucaacccugcgacacgcgcuauggggauuaauaacacgcacaccgacacaaccaucgucuggauuuucccgccccaggcccugccucccaaaccucccaagccgaugacaucugccguuccuaauggaaugaaagauagcuccgugucucuucaggacgcugagugguacuggggcgauaucagcagagaagaggugaacgacaagcugcgggauaugcccgacggcaccuuucucguccgcgaugccuccacaaaaaugcaaggggacuauacccugacgcuuagaaagggaggcaauaacaagcugauuaaaaucuaccaucgggaugggaaguauggauucagcgacccucucaccuuuaauucugugguugaacugaucaaccacuaccaucacgagucccuggcucaguauaaucccaaacucgaugugaagcugauguaccccgucagcagauaccagcaggaccaacuugugaaagaagauaacauugacgccguuggcaagaagcugcaggaguaucauucucaguaccaggagaaauccaaggaauaugaccgccucuacgaggaauauacacggaccagccaagagauccagaugaaaagaacagcgauugaggccuucaaugaaaccaucaagauuuuugaggaacagugucacacgcaagagcagcacucuaaagaauacaucgagcgcuuccggagagaggggaacgaaaaggagauugaacgcaucaugaugaauuaugauaaacugaagucccggcuuggagagauccaugacagcaagaugagacuggaacaggaucucaaaaaccaggcucuggacaaucgcgagauugauaagaaaaugaacuccaucaagccugaccugauucaacuccggaaaaucagagaucagcaccugguguggcuuaaccauaagggcguccgccagaagcggcugaauguguggcucggcauuaaaaacgaggacgccgaugaaaauuacuuuaucaacgaggaagacgagaaucugccgcacuacgaugaaaagacaugguucguggaggacaucaacagaguccaggcugaggaccuucuguaugggaaacccgauggagccuuucucauucgggaaucuagcaagaaaggcugcuacgcguguuccguuguggccgacggggaggugaagcacugcgucaucuauagcaccgcucgcggauacggcuucgccgaaccuuauaaucuguacucuucccugaaggagcucgugcugcauuaucaacagacaagccuuguucagcacaacgauucucugaaugugagacucgcuuaccccguccaugcccagaugccuagccugugucgguga

SEQ ID NO: 73771 - RNA, 4077 nt, Artificial Sequence
  derived and/or modified sequence opt5 from PIK3R4__Homo_sapiens__NP_055417
augggcaaccagcuggccgggaucgcucccagccaaauucucuccguggagucuuacuucagcgacauccacgauuuugaauaugacaagucccugggaucuaccagauucuuuaaagucgcccgggcgaagcaucgcgagggccuuguuguggugaaagucuucgcuauucaggauccuacacugccgcucacgagcuacaagcaggaacuggaggaacuuaaaaucagacuuaauuccgcccagaacugccuccccuuucaaaaggccucugagaaggcuagcgagaaagccgcuaugcuguuccggcaguaugugcgcgacaaucuguacgauagaauuuccacccggccuuuucucaacaauaucgaaaagcgcuggaucgccuuccagauucugacagcgguugaccaggcccacaaaagcggggugagacauggagauaucaagaccgagaacgucauggugacaucuuggaauuggguucuucugaccgacuuugcuuccuucaaacccacauaucucccugaagauaaccccgccgacuuuaauuacuucuuugauaccagccggcgcagaacguguuauauugcuccugagcgguucguggacggcgggauguucgccaccgagcuggaauacaugcgcgauccgucuacaccccuugucgaccugaacuccaaucaaagaacccggggagagcucaagcgcgcgauggacaucuuuagcgccggcugcgugauugcugaacuguucacagagggcgugccucuguuugaucucucucagcugcuugccuacagaaacgggcacuucuuucccgaacagguccugaauaagaucgaggaccauuccauucgggagcucguuacccagaugauccacagagaaccugauaaacgccuggaggcugaagacuaucuuaagcaacagcggggaaacgccuuccccgagaucuuuuacacguuccugcagccguauauggcccaauuugcuaaagaaacauuccucagcgcggaugagcgcauucuggugaucagaaaggaccugggcaauauuauccacaaccucugugggcaugaucugccugagaaagccgaaggagagcccaaggaaaacggccuugugauucuggucuccgugaucaccucuugccuccagacacugaaauacugugacagcaagcuggcugcccuggagcucauccugcaccuggccccucggcucuccguugaaauucugcuugauagaaucacccccuaucugcuccauuuuagcaaugacucugugccccgcguccgggcugaggcccugagaacccugacaaaggugcuugcgcucguuaaagaggugccucgcaacgauauuaauaucuacccggaauauauucugcccgggaucgcucaccuggcccaggacgacgccacgaucguccggcucgcuuacgccgagaacauugcucugcuugccgaaaccgcgcugagauuccucgagcuggugcagcugaagaaucuuaacauggagaaugauccuaacaaugaagagaucgacgaagucacacaccccaacggaaauuacgauaccgagcuccaagcccugcaugaaauggugcagcagaaaguugugacacugcucuccgacccugagaacauugucaagcagacccugauggagaauggcaucacgcgccuuugcguguuuuucggccggcaaaaagcuaacgauguucugcucagccacaugauuacauuccugaaugacaagaacgauuggcaucugagaggggccuuuuucgacucuaucgugggagucgcugccuaugugggcuggcagagcuccucuauucuuaagccccuccugcagcaggggcugagcgaugcggaagaguuugugaucguuaaagcccucuacgcucugaccuguaugugccaacuuggacugcuccagaagccgcacgucuaugaguucgccuccgacaucgcuccuuuucugugucaucccaaccuguggauucgguacggcgccgugggguucaucaccguggucgcccgccagauuagcacagcugauguguauugcaaacuuaugccuuaccucgaccccuauaucacccagccuauuauccaaaucgaaagaaagcugguucugcucucugugcugaaagaacccgucucccggagcauuuuugauuacgcgcuuagaucuaaggacaucacaucccuguuccgccaccuccacaugcggcagaagaaaagaaauggaagccugccggacuguccuccucccgaggaucccgccauugcucagcugcuuaagaaacugcucucccaaggcaugacggaggaagaggaagacaagcugcucgcccugaaagauuuuaugaugaagucuaacaaggccaaagcuaauaucguggaccagagccaucuucacgauuccucucagaagggcguuauugaccuggccgcgcucgggaucaccggacgccagguggaucuggucaaaacaaagcaagagccggacgauaaaagagcucggaagcaugugaaacaggacagcaacguuaaugaagaguggaaguccauguucggcagccuggaucccccuaacaugccccaggcccuuccuaaggggucugaccaggaggugauccaaaccggaaaacccccucgcuccgaaagcucugccggcauuugcgucccccuguccacaagcucucaggugccggaggugaccacgguccagaauaagaaaccuguuauccccgugcucagcuccaccauucugccuagcacauaccagaucagaauuaccacaugcaagaccgaacuccaacagcugauccagcaaaaacgggagcaguguaacgcugagcgcaucgccaagcagaugauggaaaaugcggagugggaaucuaagcccccgccucccggguggagaccuaaaggccuucugguggcucaccuccacgagcauaaguccgccgucaaccggauucgcgugagcgaugaacacucccuguuugccacgugcucuaaugacggaacaguuaaaaucuggaacagccagaagauggagggcaaaaccacaaccaccagauccauucugacauauucucggaucgggggacgcgugaagacgcuuaccuucugucaaggcagccauuaccuggcuauugccuccgacaauggggcuguccagcuccugggaaucgaggccucuaagcuccccaaaagccccaagauucacccucugcaguccagaauccuugaucagaaagaagacggcugcgugguugauaugcaucacuuuaacagcggggcgcaaucugugcuggccuaugcuacagucaauggcucccuggugggaugggaccuccggucuagcuccaacgccuggacccugaagcacgaucuuaaaagcggccugaucacaucuuucgcuguugacauucaucaguguuggcucugcaucgggaccuccagcggaacgauggccuguugggauaugagauuccagcugccgauuuccagccacugccaucccucucgcgcccggaucagacgccucagcaugcacccucuguaccaguccugggugauugcugcgguccaaggcaacaaugaggugucuaugugggacauggaaacaggggaucggagauuuacccuuugggccagcuccgcucccccucugucugagcugcagcccagcccucauuccgugcacggaaucuauuguucuccggccgacggcaaccccauccuccugaccgccgggagcgauaugaagauucgcuucugggaccuugcuuacccugaacgguccuaugucguugccggcagcacaucuucccccagcgugucuuacuacagaaagaucauugagggaaccgaggugguccaggaaauccagaauaaacaaaaggugggcccuuccgacgauacaccccgccgggggccggagagccugccuguuggacaccaugacauuaucacggauguggcgaccuuucagacaacccagggcuucaucgucacagcuuccagagacgggauugugaaaguuuggaaguga

SEQ ID NO: 73772 - RNA, 2643 nt, Artificial Sequence
  derived and/or modified sequence opt5 from PIK3R5__Homo_sapiens__NP_055123
augcagcccggcgccaccacaugcacggaggacagaauccaacacgcucuggaacggugucuccaugggcugagccuuucccgcagaucuaccagcugguccgccggacugugccucaacuguuggucucugcaggagcuugugagccgggauccuggccacuuccugauucuccuggaacagauccugcagaagacacgcgagguccaagaaaaagggaccuacgaccuccugacaccgcuugcgcugcucuuuuauuccaccguucugugcacaccccauuucccucccgauucugaccuucugcucaaggcugccagcaccuaccacagauuucugacguggccugugcccuauuguuccauuugccaggagcugcucaccuucaucgaugccgagcugaaagcuccuggaauuagcuaccagcggcuugugcgcgccgaacagggccugccgaucagaucucaucgguccagcacagucaccgugcuccugcuuaaucccguugaggugcaagcugaauuucuggccgucgcgaacaagcucucuacaccugggcacagcccccacagcgccuauaccacgcugcugcuccaugcuuuccaggccacauuuggagcucacugugacgugccuggccugcauugccgccuucaggccaaaacccuggcggagcucgaggauaucuucacagaaaccgccgaggcucaggaacuggccucuggcauuggggacgcugccgaggccagacgguggcuucgcaccaagcugcaagcuguuggagaaaaggcgggcuuucccggggugcucgauacagccaaaccgggaaagcugcacacgaucccuauucccgucgcuagauguuacaccuauuccuggagccaggacuccuucgauauccugcaggagauucuccugaaagagcaagaacuucugcagccuggcauccucggggacgaugaggaagaggaagaggaggaagaggaaguggaggaagaccuggagacagacggacacugcgccgagcgggauucucugcuuagcaccuccagccucgccucucaugacuccacacugagccuggcuucuagccaggccuccggccccgcgcucucucgccaucugcuuaccagcuuuguguccggccugagcgaugggauggacucuggauacgucgaagauuccgaggaauccucuuccgaguggcccuggagacggggcagccaggagagacgcgggcaccggagaccuggacaaaaguucauucgcaucuacaaacucuuuaaguccacgucucagcugguucugcggagagacagccgcucccuugaaggcucuagcgauacagcucucccgcugcggagagccgggucccuguguagcccccucgacgagccugugucucccccuucccgcgcccagcggagcagaucucugccccagccgaaacuuggaacccaacugccuuccuggcuccuggcucccgccagccgcccucagcggagacggcccuuccugucuggcgaugaagacccuaaggcuagcacccuucgcguggucguguucggcuccgauagaaucagcgggaagguugcccgggcguauucuaaucucagacgccuggagaacaaucggccccugcucacaagauuuuucaaacugcaguuuuucuacgugccggucaagcgcucccacggaaccagcccuggcgccugcccuccgcccagaucccagacacccucucccccuacggacagcccccggcaugcuuccccuggggaacuuggaaccacacccugggaggagucuaccaacgacauuagccacuaucugggcaugcucgauccuugguacgaacgcaaugugcuggggcugaugcaccuucccccggagguucucugccaacagucccugaaagccgaagcucaggcccuggagggcucuccuacacagcuccccauccuggcggacaugcuucuguauuacuguagauuugccgcucggccugugcuccugcaagucuaucagaccgaacugacguucauuaccggagagaagacaaccgagaucuuuauucauagccuugaacugggccacuccgccgcuacacgcgccaucaaagccagcgggcccggaucuaagagacucggcaucgauggggaccgggaggcugugccgcugacccuccagauuaucuacuccaagggagcgauuagcggccgcucuagaugguccaaccuggaaaaagucugcacgagcgugaaucuuaacaaggccugucggaaacaagaggaacuggauucuuccauggaggcucucacacugaaucugaccgagguugugaagcgccagaacagcaaauccaagaagggguucaaucagaucagcacaucucagauuaaagucgacaaggugcaaaucaucggcagcaacuccugcccuuuugccguuugucuugaucaggacgaaagaaaaauucugcagucugugguccggugcgaggugagccccuguuacaagccugaaaaauccgaucucucuagcccuccccagaccccgcccgaccugcccgcccaagcugccccugaucucugcucccugcuuugucugcccaucaugaccuucucuggagcgcucccuuga

SEQ ID NO: 73773 - RNA, 1647 nt, Artificial Sequence
  derived and/or modified sequence opt5 from PIKFYVE__Homo_sapiens__NP_001171471
auggccaccgacgauaagacaagccccacgcuggacuccgcuaacgaucucccuagaucuccgaccagccccucccaccugacacauuucaaaccucuuacccccgaccaggaugagccucccuuuaagucugccuacagcuccuucgugaaucuguuucgguucaacaaagaacgcgcggagggcgggcaaggagaacagcagccucucucuggcagcuggacauccccgcagcugcccagcagaacccaaucuguccgguccccuacacccuauaagaaacagcuuaaugaggaacugcagcgcagaagcucugcucucgacacccggcgcaaggccgagccuacguuugggggacacgaucccagaaccgccguucagcugcggucccugagcacagugcucaagcgccugaaagagaucauggaaggcaagucucaagacuccgaucuuaaacaguacuggaugccggacagccagugcaaggaguguuaugauugcuccgaaaaauucaccacauuuagacggcgccaucacuguagacugugcgggcagauuuucuguucucggugcuguaaccaagagaucccuggaaaguuuaugggcuacaccggcgaccuccgcgcuugcacguauuguagaaagauugcccugagcuacgcucauuccacagauagcaauucuaucggggaggaccuuaacgcccuguccgacagcgcgugcucugugagcguccucgaucccuccgaaccucggacccccgugggaucuagaaaagccagccgcaauauuuuccuggaggacgaucuggcuuggcagucccucauccaccccgacagcucuaacacaccucuguccacccggcuuguuagcgugcaggaagaugccggcaagucuccggcuagaaaucgcuccgccagcaucaccaaccugucccucgaccggucugggagccccauggucccuuccuaugagacaucugugagcccccaagcgaauagaacguacguucgcaccgaaacaaccgaggaugagcggaaaauucugcuugacuccgugcagcugaaggaucucuggaaaaagaucugucaccauagcucuggaauggaauuucaggaccacagauacuggcugcgcacacauccuaacugcauugucggcaaagagcuggugaauuggcucauccggaacgggcacauugccaccagagcucaggccaucgcuauuggacaagccaugguggauggccgcuggcuggacugcgucucccaccaugaccagcuuuuccgggaugaauaugcccuguacagaccccuccagagcacggaguuuucugaaacaccguccccugacagcgauucuguuaauagcguggagggccacuccgagcccagcugguucaaggacaucaaguucgaugacucugauaccgaacagaucgcugaggaaggggacgauaaccuggcgaacuccgccagcccuuccaaacggaccucugugagcuccuuucaaucuacagucgacagcgauuccgcugccucuauuagccuuaauguggagcuggacaacguuaauuuccauaucaagaaacccuccaaguauccucacgugcccccgcauccugccgaucagaaaggacgcagauga

SEQ ID NO: 73774 - RNA, 912 nt, Artificial Sequence
  derived and/or modified sequence opt5 from PILRA__Homo_sapiens__NP_038467
augggcagaccccugcuccugccucuucugccgcuccugcuucccccugccuuccugcagcccagcggguccaccggaucuggcccuagcuaccucuauggggugacacaacccaagcaccuguccgcuucuaugggaggcagcgucgagaucccuuuuuccuucuacuauccgugggaacuggccacggcgcccgacguucggauuucuuggcgcagagggcauuuucaccggcagagcuucuacuccacccgcccucccagcauccauaaagauuaugugaacagacucuuucugaauuggacagagggacagaagucuggcuuccuucggauuuccaaccugcagaaacaagaccagagcguguacuuuugccgcgucgaacucgauaccagaucuuccggccggcagcaguggcaaagcaucgaggggacaaagcugucuauuacccaggcugugacaaccacgacccagcgcccuuccagcaugacaaccacauggagacuuuccucuaccacgacaaccacaggacugcggguuacccagggcaaacgcagaagcgacuccuggcacaucagccucgaaaccgccgugggggucgccguggcuguuacagugcugggaaucaugauucugggccucaucugucugcuucgguggcgcagacggaaggggcaacagagaacgaaggccaccacacccgcucgcgagccguuccagaauaccgaggaaccuuaugagaacauucggaaugaaggacaaaacacagaucccaaacugaauccuaaggacgauggcaucgucuacgccucucucgcgcuguccagcucuaccagccccagagcucccccuucccaucgcccgcuuaaaucuccccagaacgagacgcuguacagcgugcucaaggccuga

SEQ ID NO: 73775 - RNA, 1215 nt, Artificial Sequence
  derived and/or modified sequence opt5 from PIM1__Homo_sapiens__NP_001230115
augccccacgagccucaugaaccgcugacacccccuuucagcgcccuccccgacccugcuggcgcccccuccagacggcagucucgccaaagaccucagcugagcuccgauucuccgagcgcguuucgggcuucccgcucucacagcagaaacgccacccggucccauagccacucucauuccccucgccacagccuuagacacucucccggguccggaagcugcggcagcuccagcgggcaucggcccugugccgacauccuggaggugggaaugcuccuguccaagauuaauucucuugcucaucugcgcgccgcuccuugcaacgaucuccacgccacgaaacuggcgcccggcaaggaaaaagagccgcuggaaagccaguaccaggucgggccucuccugggauccggcggcuucgggagcguuuauucuggaaucagaguguccgacaaucuucccguggccauuaagcacgucgagaaagaucggaucagcgacuggggcgagcugccuaacgggacccgcgugcccauggaaguugugcuccugaagaaggucucuagcggauuuuccggcgugauuagacuucuggauugguucgagcggcccgacucuuuuguucucauccuggaacgcccugagccggugcaagaucuguucgacuuuaucacagagagaggggcucuccaggaggaacuggcccggagcuucuuuuggcagguccuugaagcugugagacacugucauaauugcggagugcugcaccgcgauauuaaagacgagaacauccucauugaucugaaucggggcgaacuuaagcugaucgacuucggcuccggggcccuccugaaagacaccgucuacacagauuuugacggaaccagaguuuauucucccccugaguggauucgcuaccaucgguaucacggcagaucugcggccguguggucccuggggauccuccuguacgauaugguguguggagacauucccuucgagcaugaugaagagaucauccgcggccaggucuuuuuccggcaaagagugagcucugaaugccagcaccuuauucgcuggugucuggcucuccggccuuccgacagacccacauucgaggaaauccagaaccacccguggaugcaggauguucugcuuccucaagagaccgccgagauucaucugcacagccucucccccgggccuucuaaguga

SEQ ID NO: 73776 - RNA, 936 nt, Artificial Sequence
  derived and/or modified sequence opt5 from PIM2__Homo_sapiens__NP_006866
augcugaccaagccccuccagggcccuccggcucccccugggacacccacgccucccccuggaggcaaagacagagaggccuucgaagccgaguaccggcuggggccgcuucugggaaagggcggguuuggaaccguguucgcgggccaccgccucacagauagacugcaagucgcuaucaaaguuauuccccggaaccgcgugcuuggcuggagcccucuguccgacucugugaccugcccccucgaagucgcccugcuguggaaggugggggccggaggcgggcauccuggaguuaucagacuccuggauugguuugagacacaggaaggcuucaugcuugugcuggagcggccccucccggcucaggaccuguuugauuauauuaccgagaaagggccucuuggagaaggccccagccgcuguuucuuuggccaggucguggccgcuauccaacacugccauuccagagggguugugcaccgggacauuaaggaugagaauauccugaucgaccuccgcagaggaugugccaagcugauugauuucggcucuggggcgcugcuccaugacgaaccuuacacagauuuugacggaacccgggucuauagcccucccgaguggaucucccgccaccaguaccacgcccugcccgcuacgguguggucucuuggcauucugcucuaugauauggugugcggggacaucccguucgagagagaccaggaaauucuggaggccgaacuucauuuucccgcucacgucagcccugauuguugcgcccugauccggcgcugucucgcgcccaaaccuuccagcagacccucucuggaggaaauucugcucgacccguggaugcagaccccugccgaggauguuccccugaacccuuccaagggaggccccgcuccucuugccuggagccugcuccccuga

SEQ ID NO: 73777 - RNA, 981 nt, Artificial Sequence
  derived and/or modified sequence opt5 from PIM3__Homo_sapiens__NP_001001852
augcugcucagcaaguucggcucccuggcccaccuuugcgggcccggaggcguggaccaucugccugucaaaauccuccagccggcuaaggccgauaaagagucuuuugaaaaggcguaccaaguuggggcugugcugggaagcggcggguucggaaccguguaugccggcuccagaauugccgacggccuucccgucgcugugaaacacguugugaaggagcgggucacagaaugggggucucugggaggcgccacggugccucucgagguugugcugcugcgcaaggucggggcugccggaggcgcgagaggggugauccggcuccuggauugguuugaacgccccgacggauuccuucuggugcucgagagaccugagcccgcccaggaucuguuugacuucauuaccgaacggggcgcucuugaugagccucuggcccgcagauuuuucgcucagguccucgccgcgguucggcauugucacagcugcggcguggugcaucgcgacaucaaagaugaaaaccugcuggucgaccucagauccggggagcugaaacuuauugauuuuggaucuggcgcccugcucaaggacacaguguacaccgauuucgacgggacacggguuuauagcccgcccgaguggauccgcuaccacagauaucacggacgguccgcuaccguguggagccugggcguccuucuguacgacaugguguguggggauaucccuuuugaacaggacgaggaaauucuccgcggaagacugcuguuccggagacgcguuucucccgagugccaacagcucauccgguggugucugucccuuagaccuagcgaacgccccucucuggaucagauugccgcucauccguggaugcucggcgccgacggcggggugccugaguccugcgaucugcggcuuuguacacuggaccccgaugacgucgccagcaccacgucuuccagcgagucccucuga

SEQ ID NO: 73778 - RNA, 492 nt, Artificial Sequence
  derived and/or modified sequence opt5 from PIN1__Homo_sapiens__NP_006212
auggccgacgaggaaaagcugcccccuggcugggagaaaagaaugagccgguccucugggcgcguguacuauuucaaccacaucaccaaugcuagccagugggaaagaccguccggaaacucuagcuccggcgggaagaauggacaaggcgagcccgcccggguccgcugcucucaucuccugguuaaacacagccaguccagacggccuagcucuuggcgccaggaaaagauuacaagaacgaaagaggaggcgcuugaacugaucaacggguacauucagaagaucaaguccggagaggaagauuuugagagccucgcuucucaauucuccgacuguagcucugccaaagcccggggcgaucugggcgcuuuuucccgcgggcagaugcagaagcccuucgaggacgccagcuuugcucuuagaaccggagaaauguccggcccuguguucacagauucugggauucauaucauccugcggaccgaguga

SEQ ID NO: 73779 - RNA, 402 nt, Artificial Sequence
  derived and/or modified sequence opt5 from PIN4__Homo_sapiens__NP_001164218
augcccauggccggccugcucaaggggcuggugagacagcuugagcgguucagcguccaacagcaggcuuccaaaaugccuccgaagggaaaaucuggcagcgggaaggccggaaaaggcggggcggcuuccggaucugacagcgccgauaagaaggcccagggccccaaaggcgggggaaacgcuguuaaggugcgccacauccugugcgaaaaacauggcaagauuauggaggccauggaaaaacucaaguccgggaugagauuuaaugagguggcugcccaauacucugaagacaaggcgcggcagggaaucccuagccugcagcagcacgccggccaucaccgcgaucuuagauccacccugauuagccucgucucuuaucugcaaacaacgcccuga

SEQ ID NO: 73780 - RNA, 525 nt, Artificial Sequence
  derived and/or modified sequence opt5 from PINX1__Homo_sapiens__NP_001271285
augagcaugcuggccgagagacggcgcaagcagaaaugggcuguggacccccaaaacaccgccugguccaaugaugacucuaaguucggccagagaaugcucgagaaaaugggguggagcaagggaaaaggccugggggcgcaggagcagggagcuacagaucacaucaagguccaaguuaagaacaaucaucuuggccugggggccacgauuaacaaugaagacaacuggaucgcccaccaggaugacuuuaaucagcuccuggcugagcuuaauaccugccauggacaggaaacaaccgauuccucugacaaaaaggagaaaaagagcuucucccuggaggaaaaaucuaagauuagcaagaaccgggugcacuacaugaaauuuacaaagggccgcugucaaucccuccauagcagaggcgagcggaaccacgauaaucagcgccugcaccauccuggggugcugugccaggccgacggaucuaccgaagaacaggcuccgggcuccagcucuagagucuga

SEQ ID NO: 73781 - RNA, 1221 nt, Artificial Sequence
  derived and/or modified sequence opt5 from PIP4K2A__Homo_sapiens__NP_005019
auggccacccccggcaaccuggggagcuccgugcucgcuucuaagacaaaaacgaagaaaaagcacuucgucgcccagaaaguuaagcuguuuagagcgagcgacccucuucuguccgugcucauguggggagugaaucauucuaucaacgagcugagccacguccaaauuccggugaugcuuaugcccgaugacuucaaggcuuacuccaaaaucaagguugauaaucaucuguuuaacaaagaaaauaugccuucucacuucaaguuuaaagaguauugccccaugguguuccggaaccuccgcgaaagauuuggcauugacgaucaggacuuccagaauagccugacccgguccgccccucugcccaacgauagccaggcccgcucuggggcuagauuucauacauccuacgacaagcgguauaucauuaagaccaucacaagcgaggaugucgccgaaaugcacaauauccucaaaaaguaccaccaauauauuguggagugucauggaaucacccugcuuccucaguuccugggcauguaccgccucaacguugacgggguggagauuuaugucaucgugacaagaaauguguuuucucaccggcuguccgucuaccgcaaauacgaucuuaagggaagcaccguugcuagagaagccucugacaaagagaaggcgaaagaacugccgacgcucaaggauaacgacuucauuaaugagggccagaagaucuauauugacgauaacaauaaaaagguguuucuggagaaacugaagaaagacguggaguuccucgcccagcugaagcugauggauuacucccugcucgucggcauccaugacguggagcgggcugaacaagaggaaguugagugcgaggaaaacgauggggaggaagagggagaaagcgacggcacccaccccguggggacaccucccgauuccccuggaaacacccuuaauucuagcccgccccuugccccuggcgaguucgaccccaacaucgaugucuaugggauuaagugucacgaaaauuccccucgcaaagaaguguacuuuauggcuaucauugacauccugacacauuaugaugccaagaaaaaggcggcccacgcugccaaaaccguuaagcauggagcuggcgccgagauuagcacggugaaccccgaacaguacucuaagagauuccucgacuuuaucggccacauccugacauga

SEQ ID NO: 73782 - RNA, 1251 nt, Artificial Sequence
  derived and/or modified sequence opt5 from PIP4K2B__Homo_sapiens__NP_003550
augagcuccaacugcaccucuacaacggccguggcugucgcgccccugagcgccuccaagaccaaaacaaagaaaaagcacuucguuugucagaaagugaagcucuuuagagcuucugagccuauccugagcgugcuuauguggggcgucaaucauaccauuaacgaacuguccaaugugccgguucccgugaugcucaugccugacgauuucaaggccuacucuaaaaucaaggucgacaaccaccuguuuaauaaagagaaccuucccagccgguucaaguuuaaagaauauugcccuaugguguuccgcaaucugagagagcgguuugggauugaugaccaagauuaccagaacuccguuacacgcagcgcccccaucaauucugacucccagggaagauguggcacccgguuccucacaaccuaugaucgcagauuugugauuaagacggucagcucugaagacguggcugagaugcauaacauccugaagaaauaccaccaguucaucguggagugccaugggaauacccugcucccucaauuucugggaauguaucggcuuacagucgauggcguugaaaccuacaugguggugacacgcaacgucuucucccacagacugaccgugcaccggaaguaugaccucaaagggagcacgguugcccgcgaggcuucugauaaggaaaaagccaaggaccugccgacauuuaaagauaaugacuuccuuaacgagggacagaagcugcaugugggcgaggaauccaagaaaaauuuccucgagaagcugaaaagagacgucgaauuucuggcgcagcucaagauuauggauuacagccugcuugugggcauccacgacguugaucgggccgagcaggaagagauggagguggaagaacgcgcugaagacgaggaaugugagaacgauggggucggaggcaaccugcucugcuccuacgggacacccccugacucucccggaaaucugcuuagcuucccuagauuuuucggccccggggaguuugauccguccguggacgucuaugccaugaaaagccaugaaucuuccccuaagaaggagguguacuucauggcuauuaucgauauucugacccccuaugacaccaaaaagaaagccgcgcacgccgcuaagaccguuaaacacggagccggcgcugaaaucagcacagugaacccugagcaauacucuaagcgguuuaaugaguucaugagcaacauucucacguga

SEQ ID NO: 73783 - RNA, 1212 nt, Artificial Sequence
  derived and/or modified sequence opt5 from PIP4K2C__Homo_sapiens__NP_001139731
auggccagcuccucugugcccccugcuaccgucagcgccgcgacagcuggcccggggcccggauucggcuuugccuccaagacgaaaaagaaacacuucguucagcaaaaggugaaaguguuuagagccgcugacccucuggucgggguguuccucuggggaguugcccauucuaucaacgagcugagccaggugcccccucccgucaugcuucugccugaugacuuuaaggcuuccucuaagauuaaagaauacugcccccagguguuccggaaucuccgcgauagauuuggcaucgacgaucaggacuaucugguuagccuuacccggaacccgccuuccgagagcgaagggucugauggacgcuuccugauuuccuacgacagaacacucgugaucaaggaggucagcucugaagauauugccgacaugcacuccaaucugagcaacuaucaucaauacaucgugaaaugucacggcaauacccugcucccccaguuucugggcauguaucgggugucugucgauaacgaggacuccuacaugcuuguuaugcgcaauauguucagccauagacugccugugcaccggaaguaugaucucaaagggucccuggugucucgcgaggcgagcgacaaggaaaaggucaaagagcuucccacacugaaggacauggauuuucucaacaaaaaucagaagguguacaucggagaagaggagaaaaagauuuuccuggaaaaacugaagagagacguugaguuucucgugcagcugaagaucauggauuacucccuucugcucggcauucacgacaucauucgggggagcgaaccggaggaagaggccccuguccgcgaggaugaaucugagguggacggagauugcucccugaccgggcccccugcucuuguuggcagcuauggaacaucucccgaaggcaucggcggguacauucauagccacagaccccugggaccuggcgaguucgaauccuucaucgacguguaugccauccggucugcugagggggccccgcaaaaagaggucuacuuuaugggacucauugauauccugacccaguaugacgcgaagaaaaaggccgcucaugccgcuaaaacggugaagcacggcgccggggccgaaauuagcaccguccaccccgagcaguacgcuaagcgcuuccuggauuuuaucacaaacauuuucgcguga

SEQ ID NO: 73784 - RNA, 1569 nt, Artificial Sequence
  derived and/or modified sequence opt5 from PIP5K1A__Homo_sapiens__NP_001129108
auggccagcgcuuccucuggccccagcuccucugugggguucagcuccuuugacccugccgucccgucuugcacccugagcuccgcggcuagcggaaucaagagacccauggccucugagguuccuuacgccuccggcaugcccauuaaaaagaucgggcaccggagcguggauucuuccggagaaacaacguauaaaaagaccacaagcucugcucucaaaggcgccauucagcuggggaucacccauacagugggaucccuuagcaccaagccugagcgcgacguccugaugcaagauuucuacgugguugaauccauuuucuuccccucugagggcagcaaccucaccccugcucaccauuauaaugacuuuagauucaagacauacgccccgguggcguuucgguauuuccgcgaacuguuuggcaucagacccgaugacuaccuuuauucccuguguagcgagccucucaucgagcugugcagcuccggggccagcggaucucuguucuacgucagcuccgaugacgaauuuauuaucaaaacggugcagcacaaggaggcugaauuucuccagaaacugcuucccggcuacuauaugaaccugaaucagaacccucggacccuccugcccaaguuuuacgggcuuuauuguguucaagccggaggcaaaaauauucgcaucguggucaugaacaaucugcucccgagaucugugaagaugcauauuaaguacgaucugaaagggagcacauauaagcggcgcgcuucccagaaagagagagagaagccucugcccaccuucaaagaccucgauuuccugcaggacaucccugauggacuuuuucuggacgccgacauguacaacgcgcucugcaagacacugcagcgggauugucuugugcugcaaucuuucaaaauuauggacuauucucuccugauguccauccacaauaucgaucacgcccagcgcgaaccccugagcucugagacccaguacuccgucgacacgagacggcccgcuccucagaaggcccucuacagcacagcuauggaauccauucaaggcgaggcccgcagaggcgggaccauggaaacagaugaccaguuuguuaagaaacuggagcauucuuggaaggcccuugugcacgauggagacaccgugagcguccaucggccgggcuucuaugcugagagauuucagcgcuucaugugcaacaccguguuuaaaaagaucccccugaaaccuucccccucuaagaaguuccggagcggguccagcuuuucuagacgcgcgggauccagcggcaauucuuguauuacauaccaaccuuccguuagcggggaacacaaagcccaggugacgaccaaggcugaggucgaacccggagugcaccucggccggccggauguucugccucagacacccccucuugaggaaaucucugagggcagccccauuccugaccccuccuucagcccgcuggugggggagacccuccagaugcugacaaccucuacgacacuggaaaaacucgaggucgccgaauccgaguuuacccauuga

SEQ ID NO: 73785 - RNA, 1509 nt, Artificial Sequence
  derived and/or modified sequence opt5 from PIP5K1B__Homo_sapiens__XP_006717364
augagcuccgccgcugagaacggcgaagccgcgcccgggaagcaaaaugaggagaaaaccuacaagaaaacagcuucuagcgccaucaagggagccauucaacugggcaucggguauacggugggaaaccucaccuccaaaccugaaagagacguccugaugcaggauuucuacguuguggaaucuguguuucuuccgagcgagggcuccaaucugacacccgcucaccauuauccugacuuccgguuuaagaccuacgcuccccucgccuuccgcuauuuuagagagcuguucgggauuaagccugaugacuaccuuuauucuaucugcagcgaaccccugauugagcucuccaacccuggagccagcggcucucuguuuuucgucacauccgaugacgaauuuaucaucaaaaccgugcagcacaaggaggcggaguuccugcagaaacuccugccgggcuacuacaugaaucuuaaccaaaauccccggacacugcucccuaaguuuuaugggcuguacuguaugcagagcggaggcauuaacauccgcauuguugugaugaauaacguccuucccagaucuaugcggaugcauuucaccuaugaucugaaaggguccacguacaagcgcagagccagccggaaggaacgcgagaaaucuaauccuaccuuuaaggaccucgauuuccugcaggacaugcacgaaggacuguauuucgauacagagaccuacaacgcucucaugaaaacacugcagagagacugccgggugcuugaauccuuuaagaucauggauuauagccugcuccugggcauucauuuccuugaccacucccugaaagagaaggaggaagagacgccccaaaauguuccggacgccaaacgcaccgggaugcagaaggugcucuacucuacagcuauggaaagcauccagggaccuggcaaguccggcgaugggauuaucaccgagaaccccgacacaaugggaggcaucccugccaaaagccacagaggggaaaagcugcugcucuuuaugggaauuaucgauauucugcagucuuaccggcuuaugaaaaagcuggagcauuccuggaaagcgcucgucuaugacggcgauaccgugagcgugcaccgccccucuuucuacgccgacagauuucugaaguucaugaauagccgggucuuuaagaaaauccaagcucuuaaggccucccccucuaaaaagagauguaacagcauugcugcccugaaagccaccucccaggagaucguuagcucuaucucccaggaauggaaggaugagaagcgcgaccuccugacagaagggcagagcuucucuucccuggaugaggaagcucucggaagccggcauagaccugaccuggugccguccacgcccucucuuuuugaggcggccagccuggcuaccacaauuuccucuagcucccucuaugugaacgagcacuacccucacgaucgccccacccuguauagcaauucuaaauga

SEQ ID NO: 73786 - RNA, 1923 nt, Artificial Sequence
  derived and/or modified sequence opt5 from PIP5K1C__Homo_sapiens__NP_001182662
auggagcuggaagugcccgacgaggccgaaagcgcugaggccggcgcggucccuuccgaagcugccugggccgcugagucuggggccgcugccggacucgcgcagaagaaagccgcuccgaccgagguucugagcaugacagcccaacccggcccugggcacggaaagaaacuuggccauagagggguggaugcuuccggagaaacgaccuacaagaaaacaaccucuagcacacugaagggcgccauccagcucggcauuggguauaccgugggacaccuguccucuaagcccgagcgggacguccuuaugcaggauuucuacgugguugaaagcaucuuuuucccuuccgagggcagcaaccugacacccgcgcaucacuuucaggacuuccgcuuuaaaaccuaugccccuguggcuuucagauacuuucgggaacucuucgggauucgcccggaugacuaucuguacucucugugcaaugaaccccucaucgagcuguccaacccuggagccagcggcucucuguuuuaugucacguccgaugacgaguucauuaucaagaccgugaugcauaaagaggcugaauuucugcaaaagcuccugcccggguacuacaugaaucuuaaccagaauccuagaacacugcuccccaaauucuauggacuguacuguguucagagcggcggcaagaacauccggguggucgugaugaauaacauucugccgcgcguggucaagaugcaccucaaauuugaucugaaggggucuaccuauaaaagacgggccuccaagaaagagaaggagaaauccuucccuacauacaaggaccuugauuucaugcaggacaugcccgaaggacugcuccuggaugccgacaccuuuagcgcucuuguuaagacgcugcaacgcgacugccucgugcuggagucuuucaaaaucauggauuauagccugcuccugggcgugcacaauauugaccagcaugaaagagagcggcaggcgcagggggcccaauccacaagcgaugaaaagcgcccugucggacagaaagcucuuuacucuaccgccauggaguccauccagggcggggccgcuagaggagaggccauugaaagcgacgauacaaugggcggcauccccgcggugaacgggcggggagagcgccugcuccugcacauuggcaucaucgacauucuucaaucuuauagauuuaucaagaaacuggaacauaccuggaaggcucucguucacgauggggacaccgugagcguccaccggcccuccuucuacgccgagagauuuuucaaguuuaugucuaauacaguguuccgcaaaaacagcucccuuaagagcucuccuuccaaaaagggacggggcggggcccugcucgcuguuaaaccgcugggccccacggccgcuuuuagcgccucucagauuccuuccgaaagagaggaggcgcaguacgaucuucgcggagcccggagcuaucccacccuggaagacgagggcagaccugaucuccugcccuguacaccgccuuccuucgaagaggcuaccacagccucuaucgcuaccacgcugagcuccacaucucuuagcauucccgagcgcuccccuagcgaaaccucugagcagccccgguacagacgccggacccaauccagcgggcaggacggaagaccucaggaggaacccccggccgaagaggaccuccagcaaaucacagugcaggucgagccugcgugcucuguggaaaucgucgugcccaaggaggaagaugccggcguugaggcuucccccgccggggcuagcgccgccguggaagucgagaccgcuucucaggcgagcgacgaggaaggagccccugcuucccaggccagcgaugaggaagacgccccggcuacagauauuuauuuuuga

SEQ ID NO: 73787 - RNA, 1185 nt, Artificial Sequence
  derived and/or modified sequence opt5 from PIP5KL1__Homo_sapiens__NP_001128691
auggccgcucccagcccuggcccgagagaggugcuggcccccuccccugaagcggggugccgggcugucaccucuagccgcagaggacuccuguggcggcuucgcgacaagcaguccagacugggccucuucgagaucucucccgggcacgaacugcauggaaugacauguaugaugcaagccggccuuugggccgcuacgcagguuagcauggaucacccucccaccgggccuccgucccgggacgauuuuucugaggugcugacacaggugcaugaaggauucgagcucggcacccuggccggccccgcuuuugccuggcugcgcagaagccucgggcuggcggaggaagacuaccaggccgcucuuggaccuggcgggcccuaucugcaauuccucuccacaagcaaaucuaaggccuccuuuuuccugagccacgaucagcgguuuuuccuuaaaacccagggacgcagagagguccaggcucugcucgcccaucugccucgguacgugcaacaucugcagcgccacccccacucucuccuggcgagacuucugggcguucacucccuccggguggaccgcgggaagaaaacauauuuuauugucaugcagagcguguucuacccggccggaagaaucucugaacgguaugauauuaagggcugcgagguuuccagauggguggacccugcucccgagggcagcccucugguccuugugcugaaggaucucaacuuucaggggaaaaccaucaaucugggaccccaacgcuccugguuccugcggcagauggaacucgacacgaccuuucugagagagcuuaacgugcuggauuacucucuccugauugccuuccagcgccuucaugaagacgagcggggccccgggagcucccugaucuucagaacagcucgcagcguccaaggagcccagucuccugaagagucccgggcccagaauagacgccuccugccggaugcucccaacgcgcugcacauccucgacggcccugagcagcgguauuuucuggggguuguggaccuugccaccguguacggacugagaaagcgccucgaacaccuguggaaaacacugcgguaccccggcagaaccuucagcacggucucuccugcucgguaugcccgcagacuuugucaauggguggaggcccauacagaauga

SEQ ID NO: 73788 - RNA, 441 nt, Artificial Sequence
  derived and/or modified sequence opt5 from PIP__Homo_sapiens__NP_002643
augagacugcuccagcugcuuuuccgggccagccccgcuacccugcuccuggugcuuugccugcaacucggcgccaacaaggcgcaggacaauacacgcaaaaucauuaucaagaacuuugauauuccuaaauccgucagaccgaaugacgagguuacggcugugcuggccgugcagaccgaacugaaggaguguauggucgugaaaacauaccucaucucuagcauuccccugcagggggccuucaacuauaaguacaccgcuugccuuugugaugacaauccuaagacauuuuauugggauuucuacaccaaccggacaguucaaaucgccgcuguggucgacgugauccgcgaacugggaauuugccccgaugacgccgcgguuaucccuauuaaaaauaacagauuuuauaccaucgagauucucaagguggaauga

SEQ ID NO: 73789 - RNA, 1173 nt, Artificial Sequence
  derived and/or modified sequence opt5 from PIPOX__Homo_sapiens__NP_057602
auggccgcucagaaggaccugugggaugccaucgugauuggcgcggggauccaaggaugcuucaccgcuuaccaccucgccaaacauagaaagcggauucugcuucuggagcaguuuuuccucccccacagccgcggcuccucucaugggcagagcagaaucauucggaaagccuaucuggaagacuuuuacacacgcaugaugcacgaguguuaucagaucugggcucaacuugaacaugaggccggaacgcagcugcacagacagaccggccuccugcugcucgggaugaaggaaaaccaggagcugaaaacaauccaagcuaaucuuucccggcagcgcgucgagcaccagugccugucuagcgaggaacucaagcagagauucccuaacauucggcugccgcgcggagaaguuggccuucuggauaauuccggcggggugaucuacgccuauaaggcgcucagagcccugcaagacgcuauucggcagcugggaggcaucgugcgcgauggggagaaagucguggagauuaaccccggacuccugguuaccgugaagacaaccucuagaagcuaccaggccaaaucccuugucaucacagcuggcccuuggaccaaucaacugcuccggccccuggggauugaaaugccucuucagacgcugcgcaucaacguguguuauuggagagagaugguucccggaagcuacggcgugucucaggccuuuccuugcuuccucuggcugggccuguguccgcaucacaucuacgggcuccccaccggagaauauccuggccugaugaaggucuccuaccaucacgggaaucacgcggaccccgaggaacgggauugcccuacagccagaaccgacauuggagaugugcagauccuuagcucuuuugugcgcgaccaucugcccgaucucaaaccggagccugcugucauugaguccuguauguauacaaacacccccgacgaacaauucauccuggaucggcacccuaaguacgacaauauuguuaucggcgccggguuuagcggacauggcuucaaacuugcucccguggugggcaagauccuguaugagcucucuaugaagcugacgcccuccuacgaccuggccccuuuuagaauuagccgcuucccgucccucgggaaagcccaccuguga

SEQ ID NO: 73790 - RNA, 873 nt, Artificial Sequence
  derived and/or modified sequence opt5 from PIR__Homo_sapiens__NP_003653
augggcagcuccaagaaagugacccugucuguccucagcagagagcaguccgaagggguuggagcccgggugcgcagaucuaucggccggcccgagcugaagaaccuugacccuuuccugcucuuugaugaguucaaagggggacgcccgggcggguuucccgaccacccucauagaggauucgagacagugagcuaccugcuugaaggcggcuccauggcucacgaggauuuuugcgggcauacgggaaagaugaaucccggcgaccugcaauggaugaccgccgggcggggcauucuccacgcggagaugccuuguucugaagaacccgcucauggacugcagcugugggucaaccuccgcagcuccgaaaagaugguggagccucaguaucaggagcugaaaagcgaagagaucccgaagcccucuaaagaugggguuacaguggccgucauuuccggagaagcccuuggcaucaagagcaaaguguacaccagaacaccuacccuguaucucgacuucaagcuggaucccggcgcuaaacacucucaaccuauucccaagggguggacauccuuuaucuacaccaucagcggagacguuuauauuggcccggaugacgcccagcagaagaucgagccucaccauacggcugugcuuggggaaggagauucuguccagguggagaauaaagaccccaagcggucccacuucgugcugauugccggcgagccucuccgcgaacccgucauccaacaugggcccuuuguuaugaacaccaaugaggaaauuagccaggcgauccuggauuucagaaacgccaaaaauggauuugagcgggcuaagacauggaaauccaagauuggcaacuga

SEQ ID NO: 73791 - RNA, 1230 nt, Artificial Sequence
  derived and/or modified sequence opt5 from PISD__Homo_sapiens__XP_005261512
auggccaccagcgugggccacagaugccuggggcuccugcauggagucgcucccuggcgguccucucuucacccuugugagaucacagcccugagccagucccuccaaccgcugcgcaaacuucccuucagagcguuucggacggacgcucgcaagauucauaccgccccugccagaacaauguuccugcuccggccccugccuauccugcucguuaccggcgggggauacgcuggcuaucgccaguacgaaaaguauagagagcgggaacuggagaaacuugggcuggaaauucccccuaagcucgccggacacugggagguggcucuguacaaaucugugccgacacgccuucugagcagagccuggggccggcucaaccaggucgagcugccccauuggcugcgcagaccuguguauucccucuacaucuggaccuuuggcguuaauaugaaggaagcggccguggaggaucugcaccacuaucggaaccuuucugaguucuuucgcagaaagcugaaaccccaggcucggccugucugcgggcuccauagcgugauuucccccagcgacggaagaauccugaauuucggccaaguuaagaacugugaaguggagcaggucaaaggggugacauacucucuugaauccuuucugggaccgcgcaugugcaccgaggaucucccuuuucccccugccgcuagcugugacucuuucaagaaucagcuggugacgcgggaaggcaacgagcuguaccacugcgucaucuaucucgcccccggggauuaccauuguuuccacucccccaccgacuggacaguuagccacagacgccauuuuccuggaucucugauguccgugaauccgggcauggcgcgguggauuaaagaacuuuucugccacaacgagagagugguccugaccggcgauuggaagcauggguuuuucagccucacagccgugggagcuaccaauguuggcuccauccgcauuuauuucgaccgggaucugcacacgaacucucccagacauagcaagggguccuacaaugacuuuagcuucgugacacacaccaaccgcgagggagucccuaugcggaaaggcgaacaccuuggggaguuuaaucugggaucuacaaucgugcucauuuucgaagcccccaaggauuuuaacuuccagcugaaaaccggccaaaagaucagauuuggcgaggcucuggggucccucuga

SEQ ID NO: 73792 - RNA, 813 nt, Artificial Sequence
  derived and/or modified sequence opt5 from PITPNA__Homo_sapiens__NP_006215
auggugcugcucaaggaguacagagucauccugcccguuagcguggacgaauaucaggugggccaacuuuacuccgucgccgaggcuucuaaaaacgaaaccgggggaggcgaggggguggaaguucuggugaaugagccuuaugagaaggauggagaaaaaggccaguacacacacaagauuuaucaucuccagagcaaagucccgacguucgugcggaugcuggcccccgagggggcgcuuaacauccacgaaaaggcuuggaaugccuacccuuauugccgcaccguuauuacaaacgaguacaugaaggaggacuuucugaucaaaauugaaaccuggcauaagcccgaucucggaacacaggagaaugugcacaaacuggaaccugaggccuggaagcaugucgaagcuguguacaucgacaucgccgauagaucccaagugcugucuaaagacuauaaggcugaggaggaucccgccaaguucaaaagcauuaagaccggccggggcccucucgggccgaacuggaaacaggaacuggucaaucagaaggacugucccuacaugugcgcguauaaacuuguuacagugaaguuuaaaugguggggacugcagaacaagguggagaauuucauccacaagcaagaacgcagacucuuuaccaacuuccaccggcagcuguuuuguuggcuugauaaaugggucgaccugacgauggaugacauucgcagaauggaggaagagaccaagcggcagcucgaugagaugcgccagaaagacccugugaagggcaugacagccgacgauuga

SEQ ID NO: 73793 - RNA, 3732 nt, Artificial Sequence
  derived and/or modified sequence opt5 from PITPNM1__Homo_sapiens__NP_001124320
augcugaucaaggaguaccacauucuccugcccaugagccuugacgaauaucagguggcccaacuguacaugauccagaaaaaguccagagaggaaucuagcggcgagggguccggagucgaaauucucgcuaaccggccuuauaccgauggccccgggggaucuggccaguacacacauaaaguuuaucacguggggagccauaucccgggaugguuccgcgcccugcuuccuaaggcggcucuccagguggaggaggaauccuggaaugccuaccccuauacgagaacccgguacacaugcccuuuugucgagaaauucucuauugaaaucgagaccuacuaucugcccgacggcggccaacagccuaacguguuuaaucugagcggggccgagcgcagacagcggauccuggauacaauugacaucguucgcgaugcuguggccccgggagaauacaaggcugaggaagaccccagacucuaucacuccgucaagaccggccgggggccucugagcgaugacugggcccgcacagcggcccagaccggaccccuuaugugugcuuacaaacugugcaagguggaguucagauauuggggcaugcaagccaaaauugaacaguuuauccaugauguugggcuccggcgcgugaugcugagagcucaccggcaggccugguguuggcaggacgaguggacggagcuuucuauggcggauauucgcgcccuggaagaggaaaccgcuagaaugcucgcccaacggauggcuaagugcaacacaggauccgagggcagcgaagcccagccucccggcaaaccgucuaccgaggccagauccgcugcgagcaauacagggaccccugacggacccgaggccccucccggccccgaugcuucuccugacgccuccuucgggaagcaguggagcuccucuagccgcuccagcuacucuucccaacacggaggcgccgucagcccgcagucucugagcgaauggcggaugcagaacaucgcuagagacuccgaaaauucuagcgaagaggaauuuuucgaugcccaugagggguuuuccgacagcgaggaaguguuccccaaggagaugacgaaauggaacucuaaugauuuuauugacgcguucgcuuccccuguggaagccgagggaacacccgagccuggcgccgaagcugccaagggcaucgaggauggggcucaggcuccccgcgacagcgaaggacuggauggcgcgggggagcucggagccgaggcuugugccguccacgcucuguuucuuauccugcauucuggcaacauucucgacuccgggccgggcgaugccaauagcaaacaagcggacguucagacccuguccucugccuucgaggcugugacacggauccacuucccugaggcccuuggacacguggcucugagacucguccccugcccucccauuugugccgccgcuuaugcgcuggugagcaaccuguccccuuacucucaugauggcgacagccucucccgcagccaggaccacaucccccuggccgcccuuccgcugcucgccaccucuuccagccgguaccagggggccguugcuaccgugauugccagaacaaaucaagcguauucugcuuuucugcgcuccccugaaggagccggcuucugcgggcaggucgcccuuaucggagauggcguugggggcauccugggauuugacgcucucugucauagcgccaacgcgggcacggggucucggggaagcuccagacgcggcagcaugaauaacgagcugcugucucccgaguucgggcccgugcgggauccucucgcugacggaguggagggccuggggagaggcuccccggaacccagcgcccuuccuccccagcggauuccuuccgauauggccucucccgagccugagggaagccagaacucccugcaagcugcccccgcuaccacaucuagcugggaaccgcgcagagccuccaccgcguuuugcccucccgccgcuucuagcgaggccccugacggccccuccagcacagcucggcucgauuucaaggucucuggguuuuuccuguuuggauccccgcugggccuugugcucgcccugagaaaaaccgucaugccugcccuggaagcucagaugcgccccgcgugugagcagaucuacaaucucuuccacgccgcugacccuugcgccagccggcuggaaccccuucuggcccccaaguuucaggcuauugccccucucacggugccgagauaucaaaaauucccccugggggauggaucuucccugcuucucgcggacacacugcagacccauagcucucuguuucucgaggagcuggaaaugcuuguuccuuccacccccacaagcaccuccggcgcuuucuggaaggggagcgagcuggccacagauccucccgcccagccugcugccccgucuacgaccagcgaaguggucaagauccucgagcgcugguggggcacaaaaagaauugacuacucccuguauugccccgaggcgcugaccgcuuucccuacagugacccuuccccaccucuuucacgccucuuacugggaaagcgccgauguuguggcuuucauccugcggcaagucaucgagaaggaacgcccucagcuggccgagugugaagaacccuccauuuauucuccggcuuuuccuagagagaaauggcagcggaagcgcacccaggugaaaaucagaaacgugacgagcaaucaucgggccuccgacacaguugucugcgaaggacgcccccaagugcucucuggcagauucauguacgggccccuggacguggucacccuuacaggagagaagguggauguuuacauuaugacccagccucugagcggcaaguggauccacuuugggacggaagugacaaacuccagcggacggcucaccuuccccgucccuccggagcgcgcgcugggcauuggcguguaucccguuagaaugguggucagaggggaccauacauacgccgaauguugccugaccgugguugcucggggaaccgaggccguggucuuuucuaucgauggcuccuucacagcuagcgugucuauuaugggguccgacccuaaagugcgcgccggagccgucgauguugugcggcacuggcaggacagcggcuaucuuaucguguacgucacggggagacccgauaugcagaagcaccgcgugguugcuuggcucucccaacauaauuuuccucacggaguggucucuuucugugacggccugacccaugauccccugcggcagaaagcgauguuucuccagagccuggugcaggagguugaacuuaacaucguggccggcuauggguccccgaaggacgucgcuguguacgccgcccugggacucagcccuucucaaacauauauuguuggcagagcugugcgcaaacugcaggcccagugccaauuccuguccgauggguacgucgcgcaccuuggacagcuggaggcuggcagccauucucacgccagcuccgggcccccucgggccgcucucggaaagucuagcuacggcguggccgcgcccguggacuuucugagaaagcagucccagcuccugcgcucucggggcccuagccaagccgaaagagaggggcccggaaccccgccuacaacccuugcucggggcaaagcccgcuccaucagccugaagcucgauucugaagaguga

SEQ ID NO: 73794 - RNA, 2817 nt, Artificial Sequence
  derived and/or modified sequence opt5 from PITPNM3__Homo_sapiens__NP_001159438
auggccaaggcuggcagagccggcggacccccuccgggcgggggagcgcccuggcaucugcggaacgugcucagcgacuccgucgagucuagcgaugacgaguucuuugaugcucgcggcgaggggaccgccccuugcacauccucuauccugcaggaaaaacaaagagagcuuuaccggguuagccugcgcagacagcgguuccccgcccagggauccauugaaauccacgaggacucugaggaaggcuguccucagcgcagcugcaagacgcacgugcuccugcuugugcugcauggcgggaauauucucgauaccggagcuggcgaccccuccuguaaagccgcugauauccacacauuuagcucuguccuggagaaggugaccagagcccauuucccugcggcccuggggcacauucucaucaaauuuguuccgugccccgcuaucuguuccgaagccuucagccuggugucucaccuuaacccuuauucccaugacgagggaugccuguccucuucccaagaucacgucccccucgcugcccugccucuucuggcgauuagcagcccccaguaccaggacgccguggcuacaguuaucgagcgggccaaucagguguaucgcgaauuucucaagucuagcgauggcauuggguucuccggacaagucugucugaucggcgacugcgugggcgggcugcucgcuuuugaugccauuuguuacagcgccggaccgucuggcgacuccccugcuagcucuagcagaaagggguccaucucuagcacccaggacacacccguggcggucgaggaagauugcucccuggccagcucuaaacggcuuuccaagagcaacauugacaucucuuccggacuggaggaugaagaaccuaaacgcccccuccccagaaagcagagcgacuccucuaccuaugauugugaggcuaucacgcagcaucacgccuuccugagcuccauucacucuagcguucuuaaagacgaauccgagaccccugccgcuggcgggccgcaacugcccgaagugagccucggacgguuugauuucgacgugucugacuuuuuccuguucggcuccccucugggccucguccuggccaugcgcagaacagugcuucccgggcuggauggauuucagguucggccugcgugcagccagguguacucuuucuuucauugcgcugaucccuccgccagcagacucgagccgcugcuugaaccuaaguuccaccuggugcccccugucucuguuccccgcuaucaacgguuuccucucggcgacgggcagagccugcugcucgccgacgcucugcauacccacagcccccuuuuccuggagggauccucuagagauuccccgccucuccuggacgcccccgcuagcccgccucaggccucccgcuuucagcggccgggcagacgcaugucugaggggagcucccauucugaaagcuccgagucuagcgauuccauggcgcccgugggcgccagccggaucacagcuaagugguggggaucuaaaagaauugacuacgcccuguacuguccugauguccuuaccgcuuuccccacgguggcccucccucaccuguuucacgcguccuauugggaaagcacagacgucguggccuucauccugcgccaaguuaugcgguacgagucugugaauauuaaggaauccgcuagacucgaucccgccgcucugagcccugccaacccccgcgagaaauggcuucggaagagaacccaggucaaacugcggaaugugacagccaaccaucgcgcuaaugacguuaucgcggccgaggauggcccccaggugcucgucgggagauuuauguauggaccucuggacaugguggcucugaccggcgaaaagguggauauccuuguuauggccgagcccucuuccgggcgguggguccaccucgacaccgaaauuacaaacagcuccggaagaaucacguacaaugugccucgcccccggagacugggcgugggggucuauccggugaaaaugguugugcgcggcgaucagaccugcgccaugagcuaccugacaguccucccuagaggaauggagugugugguuuucucuauugacggcagcuuugcugccuccgugucuaucauggggagcgaccccaagguccggccuggagcgguggauguugugcgccauuggcaagaccugggcuauaugauucuuuacaucaccgggagacccgauaugcagaagcagcgggucguguccuggcugucucagcacaacuucccccaaggaaugaucuucuuuagcgacggccucgugcacgauccucugcgccagaaagcuauuuuccugagaaaucuuaugcaggagugcuuuaucaagauuuccgccgccuacgggucuacaaaagacaucagcgucuauuccguucucggccugccggcuagccagauuuucaucgugggacggcccaccaagaaauaccaaacgcagugucaguuucugucugaaggcuaugccgcgcaucucgcugcccuggaggccucccaccgcagcagaccuaagaagaacaauucucggaugauucuucgcaaaggguccuucggacugcaugcucaacccgaauuucucagaaagcggaaccaccugagacgcacaaugagcgugcagcagccugaucccccugccgcuaacccgaaacccgagcgggcccagucccaaccugaaucugacaaggaucaugagagaccccugccugcgcuuagcugggcccgcgggcccccgaaauucgaguccgucccuuga

SEQ ID NO: 73795 - RNA, 3117 nt, Artificial Sequence
  derived and/or modified sequence opt5 from PITRM1__Homo_sapiens__NP_001229236
auguggagaugcggcgggcggcagggacugugugugcuccgcagacugagcggcgggcacgcccaucaccgggcuuggcgcuggaacuccaauagagccugcgagcgggcgcuucaauacaagcugggagacaaaauccauggcuucaccgucaaccagguuacaucugugcccgaacucuuucugacggcugugaaacuuacccacgaugacacaggggcccgcuaucugcaucucgccagagaggauaccaauaaccuguucagcguccaguuucggacaaccccuauggacuccacaggagugccgcacauucuggaacacaccguucucuguggcucucagaaguaccccugccgcgauccuuucuuuaagaugcugaauagaagccuuuccacguucaugaacgcuuuuaccgccucugacuauacacuguaccccuucagcacccaaaauccuaaagauuuucagaaccuccuguccguguaucuugacgcuacauucuuucccugucugcgggagcucgauuucuggcaggaaggcuggcgccuggagcaugagaauccuagcgacccgcagacaccccuggucuuuaagggggugguuuucaacgaaaugaagggagccuucacggauaaugagagaaucuuuucucaacaccuccagaaccggcugcuuccugaccauacauacuccguggucagcggcggggauccccugugcauuccugaacucaccugggagcagcugaaacaguuccacgcgacacacuaucaucccucuaaugcccgcuuuuucaccuacggaaacuuuccgcuugagcaacaccugaagcagauccaugaagaggcucucuccaaauuccagaagauugaaccuagcaccguggugcccgcccaaacaccuugggacaaacccagagaguuucagaucacguguggccccgacucuuucgcuaccgauccuuccaagcagacaaccaucagcgucuccuuucugcugccggacauuacagauaccuucgaagccuuuacgcucucucugcuuagcucccugcucacaagcgggcccaauucuccuuucuacaaggcgcugaucgaguccggacuuggcaccgacuuuagccccgauguuggcuauaacggguacacccgggaggccuauuucucugugggacugcagggcauugcugaaaaagacaucgagacagugagaagccucauugaucgcaccaucgacgaagucguggagaagggguucgaagaugaccggauugaggcccugcugcacaaaaucgagauccaaaugaagcaucaguccacaucuuuuggacucaugcugacgagcuacauugcuuccugcuggaaccacgauggcgacccuguugaacuucugaaacucgggaaucagcuggccaaguucagacagugucugcaagagaaccccaaauuucuucaggaaaaggugaagcaguauuucaaaaauaaccagcacaagcucacccugagcaugcgcccggacgauaaauaccaugagaagcaagcccaggucgaagcuacaaaacugaagcagaagguggaggcgcucucuccuggagaccggcagcaaaucuaugagaaaggccuggaacuuagaucccagcagagcaagccccaagaugccucuugccugccugcucucaaaguuuccgacauugagcccaccaucccugugacagaacuggaugucgugcugaccgccggcgacauucccguccaguacugugcccagccgacgaaugggaugguguacuuucgcgcuuucagcucccuuaacacccucccugaggagcugcggcccuauguuccccuguuuugcucugugcucacaaagcugggaugcggccuucuggauuacagagaacaggcccaacagaucgagcucaaaaccgggggaaugagcgcguccccucacguccugccggacgauucucauauggacacauaugaacaggugggcguucuguucagcucccuuugucucgaucgcaaucugcccgacaugaugcagcuguggagcgagaucuuuaacaauccuugcuucgaagaggaggaacacuuuaaggugcucgucaagaugaccgcucaagagcuggccaacgggauucccgauucuggccaccuuuacgccuccauccgggcuggaagaacgcugaccccugccggcgaccuccaggaaaccuucagcgggauggaccaggugcgccugaugaaacggauugcugagaugacagauaucaagcccauucugagaaaacuuccucggaucaagaaacaucuccugaauggagacaacaugcgcuguucugugaaugccacaccccagcaaaugccgcagaccgaaaaggcgguugaggauuuucugagauccaucggccggagcaagaaagagagacgcccuguccggccccacaccguggaaaagccugugcccucuagcuccgggggagacgcccaugucccgcacggcagccaggugauuagaaaacucguuauggagccuacguucaagcccuggcaaaugaaaacccauuuccugaugccuuuucccgugaacuaugucggggaaugcauccgcacagugcccuacaccgauccugaccacgcuucucuuaagauucuggccagacucaugacagcuaaauuccugcacaccgagauccgggaaaagggcggagccuauggcgggggagcgaagcugucccauaauggcauuuuuacgcuuuacagcuaccgcgauccgaacacaaucgagacccugcaguccuucgggaaagccguugacugggcuaagucuggaaaauuuacccagcaggauauugacgaggccaagcucagcguguucuccacagucgaugcucccguggccccuucugacaaaggcauggaucacuuucuguaugggcucagcgacgaaaugaagcaagcccauagagagcagcuguucgcuguuucccacgacaaacuucuggcggugucugaucgguaccucggcaccggaaagagcacacauggccuggccauccuggggcccgaaaacccuaagaucgcuaaagaccccuccuggauuauccaguga

SEQ ID NO: 73796 - RNA, 945 nt, Artificial Sequence
  derived and/or modified sequence opt5 from PITX1__Homo_sapiens__NP_002644
auggacgccuucaagggcgggaugagccuggagagacuccccgaaggacugcggccuccgcccccucccccucacgauaugggccccgcuuuucaucuugcccgcccugcggacccgagagagccccuggaaaacuccgcuucugagagcuccgauaccgaacucccugagaaagagcgcgggggagaacccaagggcccugaggacucuggggccggaggcacaggcugcgggggagccgaugaccccgcuaaaaagaaaaagcagcggagacaacggacgcacuucaccagccagcagcugcaggaacuugaggccacauuucaacgcaauagauacccggauauguccaugcgggaggaaaucgcuguguggaccaaccugacagagccucgcgucagaguuugguucaagaaucggcgcgccaaauggagaaagcgggaacgcaaccagcagcucgaccuguguaaaggcggguaugugccccaguuuucuggacuggugcaaccuuacgaggaugucuaugcggccggcuacagcuauaauaacugggcugccaagucccucgcucccgcgccccugagcaccaaaucuuucacauuuuucaauuccaugagcccucuuucuucccagagcauguuuucugccccguccagcauuuccucuaugaccaugcccagcuccauggggccuggagccgugcccggcaugccuaacagcggccugaauaacaucaauaaccucacggggucuucccugaauagcgcuaugucucccggagccugcccguacggcaccccugcuagccccuauuccguuuacagagacacauguaacucuagccuugccucccugcggcucaagagcaagcagcauucuuccuucggguacggaggccugcaggggccugccagcggacugaaugcuugccaauauaacucuuga

SEQ ID NO: 73797 - RNA, 975 nt, Artificial Sequence
  derived and/or modified sequence opt5 from PITX2__Homo_sapiens__NP_000316
augaacugcaugaagggcccccugcaccucgagcauagagccgcugggaccaaacugagcgccguguccucuagcuccugucaccauccucagccgcuugcgauggcuucuguccuggcccccggacaaccucggagccucgacuccucuaagcaccgccuggaaguucauacaaucagcgauacguccagccccgaggccgcugaaaaagacaagucucagcagggcaaaaaugaggaugugggggccgaagacccuuccaagaagaaaagacagcggcgccaaagaacccacuucacaagccagcagcuucaggagcuggaggcuaccuuucaacggaaccgcuaccccgauaugucuacaagagaagagauugccguguggaccaaucucacagaagcgcggguccgcgugugguucaagaacagacgggccaaauggcgcaagagagagcggaaucagcaggcugagcugugcaaaaacggauuuggcccucaguucaaugggcugaugcaaccguaugacgauauguaccccggauauuccuacaacaauugggccgcuaagggccucaccagcgccucucuguccaccaagagcuuuccuuucuuuaacuccaugaauguuaacccccuuucuagccaguccauguucagcccucccaauucuaucuccagcaugucuaugagcuccucuauggugccgagcgcggucaccggcgugccuggguccagccugaacucucucaauaaccugaacaaucuuuccagccccucucugaacuccgccguuccuacacccgcuugucccuaugccccuccgacgcccccuuacguguaucgcgacacaugcaauagcucccucgcuucucugagacugaaagccaagcagcacagcuccuuuggauacgccucuguccaaaaccccgcuagcaaucucuccgcgugucaguacgccguggaucggccuguguga

SEQ ID NO: 73798 - RNA, 909 nt, Artificial Sequence
  derived and/or modified sequence opt5 from PITX3__Homo_sapiens__NP_005020
auggaguucggccugcucagcgaagccgaggcuagaucccccgcccugucucuuagcgacgcggggaccccucacccgcagcugcccgaacauggaugcaagggccaagagcacuccgauucugaaaaagcuagcgccucccucccugggggaucucccgaggacggcagccugaagaaaaagcagcggcgccagagaacacauuuuacgucccagcaacuucaggagcuggaagccaccuuccagcggaaccgcuacccugauaugagcacaagagaggaaaucgcuguguggaccaaucucacagaggcccggguccgcguuugguuuaaaaacagacgggcuaaguggcgcaagagagagcggucucagcaagccgaacuguguaaaggguccuucgcggcuccccugggaggccucgugccuccguaugaggaaguguaccccggcuauagcuacgggaauuggccucccaaggcccuggccccuccccuugcugccaaaaccuuuccguucgcguuuaacucugucaaugugggaccucuggccucccagcccguuuucagcccucccucuuccauugcugccagcauggugcccuccgcugccgccgcuccuggcacagucccggggcccggagcgcuccagggccuugggggaggcccucccggccuggccccugcugccgugucuagcggggccguuuccugccccuaugcuagcgccgcggcugccgccgcugccgcugccucuuccccguacguguaucgcgacccuuguaacagcucucuggcgagccucagacugaaggccaaacagcacgcuuccuuuucuuaccccgccguccauggaccucccccugcugccaaucugagccccugccaauacgcgguggagcggccgguguga

SEQ ID NO: 73799 - RNA, 2490 nt, Artificial Sequence
  derived and/or modified sequence opt5 from PIWIL1__Homo_sapiens__NP_001177900
augaccggcagagcccgggcucgcgccagagggcgggcgcgcggacaggagacagcucaacuggugggcagcacggccucccagcagcccggguacauccagccuagaccgcaacccccucccgccgaaggagagcuuuucggccgggggcgccagagaggaaccgcuggcggcacagccaagucucaggggcugcagauuagcgcuggauuucaagaacuuucccuggccgagcggggcgggcgcagacgggacuuccacgaucucggagucaacacccgccagaaucuggaccauguuaaagaaucuaagacaggcagcuccgggaucauugugagacuuucuaccaaccacuuucggcugacaagccgcccucagugggcgcucuaucaguaccauaucgauuauaauccccugauggaggccagacggcugagauccgcucuccuguuccaacacgaggaccuuauuggaaaaugccaugccuuugauggcaccauccuguuccucccuaagcgccugcagcagaaagugacggaagucuuuagcaagacccggaacggcgaggacgugagaaucacaauuacccuuacaaaugaacugccgcccaccucuccuacgugucuccaauucuacaacaucauuuuucgccggcugcugaagaucaugaaucuccagcagauugggagaaacuauuacaaucccaacgauccuaucgacauucccucccaccgccugguuaucuggccgggauucacaaccagcauccuucaguaugaaaauucuauuaugcugugcacagaugugucccacaaaguccuccggagcgagaccgugcuggacuuuauguucaacuuuuaccaucaaaccgaggagcacaaguuccaggaacagguuucuaaagagcuuaucggccuggugguccucacaaaguacaauaacaaaacguauagaguggaugacauugauugggaccagaauccuaaguccaccuucaagaaagcugacgggagcgaaguguccuuucuggaguacuaucgcaagcaauacaaccaggagaucacagaucugaaacagcccguccucguuucucagccuaagcggagacgcggacccggcgggacccugcccggaccugccaugcuuauuccggaacuguguuaucucacaggccugaccgacaaaaugcggaacgauuucaaugugaugaaggaccuugcggugcauacgagacugacacccgagcaacggcagcgcgaagucggcagacucaucgauuacauccacaaaaacgacaaugugcagcgggagcugagagauugggggcugagcuuugacuccaaccuccugagcuucucuggacgcauucuucagaccgaaaagauccaccaaggcgggaagaccuuugauuauaauccucaguucgccgacugguccaaagagacacggggagcuccccugauuagcguuaagccucucgauaacuggcugcugaucuacaccagacgcaauuacgaggccgcuaacucucuuauucagaaucucuuuaaagugacacccgccaugggcaugcaaaugagaaaggccaucaugaucgaagucgacgaccggacggaggcuuaucugcgcgugcugcagcagaaaguuaccgcggauacacagauuguggucugccuccugagcuccaacagaaaggacaaguacgaugccaucaaaaaguaucuuuguaccgacugcccgacaccuucucaauguguggucgcucggacccuggggaaacagcagacggugauggccauugccaccaagaucgcucuccagaugaauugcaaaaugggcggagaacuguggcgcguugauauuccccugaagcucgugaugaucgucggcauugacuguuaccaugauaugacagccgggagacggagcaucgcgggauucguggcuuccaucaacgagggcaugacccgcugguuuagcagaugcauuuuccaagaccgggggcaggaacucguugauggacugaaggugugucugcaggccgcccuccgcgcuuggaacucuugcaaugaguauaugccuuccagaaucauugucuaccgggacggcgugggggauggccagcugaaaacacuugugaauuaugagguuccccaauuucuggacugccucaagagcaucggaagaggcuacaacccucgccugaccgucauuguggugaaaaagcgggucaacacgagauucuuugcccagucugggggacgccugcagaauccccuuccgggcacagugaucgauguugaagugacccggccugagugguacgacuucuucaucgucucccaagcugugagaagcggguccguuucucccacacacuauaacgugauuuacgacaauagcggacucaaacccgaucauauccagcgccugaccuauaagcugugucacauuuacuauaacuggccugucuccgccucuaccugcuga

SEQ ID NO: 73800 - RNA, 2922 nt, Artificial Sequence
  derived and/or modified sequence opt5 from PIWIL2__Homo_sapiens__NP_001129193
auggaccccuucagaccuagcuuucggggccaguccccgauccaccccucucaaugccaggccgugcgcaugccuggguguuggccccaggcuagcaagccucuggaucccgcccucggaagaggcgcgccugcugggcggggacaugucuucggcaaaccggaggaacccuccacccagcgcgggccugcccaaagagagucuguuggacuggugagcauguuucggggccuuggcauugaaacaguguccaagacgccccugaaacgcgagaugcucccuucugggagaggaauccugggccgggggcuuagcgccaaccugguccgcaaggacagagaggaacucucccccaccuucugggauccgaaagugcuggcugccggagacagcaagauggcugagacaucuguuggcuggucccggacccuggggcgcggaagcucugaugccucccuccugccucuuggcagagcggccggcgggauuagccgggaaguggacaagcccccuugcacauuuucuacccccucccgcggacccccucagcugagcuccccgcccgcucucccucagucuccccugcacagcccugauagaccccuuguccugacaguggagcauaaagaaaaggagcucaucguuaaacagggcuccaaggggaccccgcaaagccugggacugaaucucgugaaaauucagugucacaacgaggccgucuaccaguaucaugugacguucucuccuaauguggaaugcaaguccaugcgguuuggcaugcugaaggaccaccaggcugucaccgggaacguuacagccuucgauggaagcauccuuuaccugcccgugaaacuccaacaggugcuggagcuuaagucucagagaaaaaccgacagcgcggaaaucuccauuaagauccaaaugacaaaaauucuggagccuuguucugaucucugcauccccuuuuauaaugucguguuccgccggguuaugaagcugcuggacaugaaacucgugggcagaaacuuuuacgauccuaccagcgccaugguccugcagcagcaccgccuucagauuuggcccggcuaugcugccuccauccggagaacggacgggggacuguuccuccuggcugacgugagccauaagguuauucgcaaugauugugugcuugacgucaugcacgccaucuaccaacagaacaaggaacauuuucaggaugagugcacaaaacugcucgugggcaauaucgucauuacccgguauaacaauagaacauaccgcaucgacgauguggacuggaacaagaccccgaaagauucuuucaccauguccgacgggaaggagauuacauuccuggaauacuauagcaaaaauuacggaaucacgguuaaggaggaagaucagccucugcucauucaccggcccucugagagacaagacaaccacggcaugcugcuuaagggggaaauccugcuccugcccgagcuguccuuuaugaccggcaucccugagaaaaugaagaaagauuuccgcgccaugaaggaccuugcucagcagauuaaucucagcccgaaacagcaucacuccgcgcuggaaugucugcuccaacggaucgccaagaacgaggcugccacaaacgaacugaugagauggggacuucggcugcagaaggacgugcauaaaauugagggccgcguccuccccauggaaagaaucaaucugaagaacaccucuuuuauuacaagccaggagcugaauugggugaaagagguuacccgggauccuuccauccuuacgauccccaugcacuucugggcccucuuuuauccuaagagagcuauggaccaggcccgcgaacuggugaacaugcuggagaaaauugcggggcccaucggaaugcggaugucuccucccgcuugggucgaacucaaggaugacagaauugagacauacgugcgcaccauccaaagcacccugggcgccgaggggaagauucagauggugguuugcaucauuaugggaccgagagaugaccuuuauggcgccaucaaaaagcuguguugcguccaguccccugugcccagccaaguggucaaugugcggacaaucgggcagccuacccgccucagaucuguugcucagaaaauucugcugcagaucaacugcaaacuuggcggagaacucuggggcguggauauuccccugaagcaacugauggucaucgggauggacguguaccaugauccgucccggggaaugcgcagcguugugggcuucgucgccucuauuaaucucacacugacgaagugguauuccagagugguuuuucagaugccucaccaggagaucguggacagccuuaaacugugucucgucgggucucugaagaaguucuacgaagugaaccacugccugcccgagaaaaucguggucuaccgggauggaguuagcgacggccagcuuaagaccguggcuaauuaugaaauuccucaacuccagaaauguuuugaggccuucgagaacuaccagcccaagaugguggucuuugugguucagaaaaagaucuccacaaaucuguaucuggcggcuccccaaaacuucgugaccccuacaccggggaccgucguggaucauacgauuaccagcugcgaauggguugacuuuuaccuccuggcccaccaugugcgccagggcuguggaauccccacacacuaugucugcgugcuuaauaccgccaaccugucuccugaccacaugcagagacucacauucaagcugugucauauguacuggaauuggcccggcaccauucggguuccugcucccugcaaauaugcccacaagcuggcguuccuuuccgggcauauccugcaccaugagccugccauccaacucugugaaaaccuguuuuuccucuga

SEQ ID NO: 73801 - RNA, 2649 nt, Artificial Sequence
  derived and/or modified sequence opt5 from PIWIL3__Homo_sapiens__NP_001008496
augcccggcagagcccggacccgcgcuagagggcgggcccgcagacgggagagcuaccagcaagaagcgccuggaggcccgcgcgcucccggguccgccacaacgcaggagccuccccagcugcagucuaccccuagaccccuccaagaagaggugccugucguucggccgcugcagccccgcgccgcuagaggaggcgccgggggaggcgcucagagccagggcgugaaggaaccugggcccgaggccggacuucacacagcgccucugcaagagcggcgcaucggcgggguguuccaggaccucgucgugaacaccagacaggauaugaaacauguuaaggacuccaaaacaggaucugaaggcaccgugguccagcugcuugccaaucacuuucgggugauuagccgcccccaauggguugcuuauaaguacaacguggauuauaaaccggacaucgaggaugggaaucugagaacaauucuccuggaccagcaucggagaaaguucggagaacgccacaucuuugauggcaacucccugcuccugucucggccucuuaaggagagacgcgucgaguggcugagcaccacgaaagacaagaauauugugaaaaucaccguggaauuuuccaaggagcucacacccaccagcccugauugccugcgguacuauaacauccuuuuuagacgcacauucaaacugcucgacuuugaacaggucggccggaauuacuauaccaagaagaaagccauucaacuguacagacaugggacgucucuggagaucuggcucggauacguuacauccgugcugcaguaugaaaacagcauuacccuuugugcugaugugucucacaagcugcuccgcaucgagacagccuacgacuucauuaaacggaccuccgcgcaggcccagaccggcaauaucagagaggaagucacaaacaagcugauugggagcaucgugcuuacgaaauauaauaacaagaccuaccgcguugaugacaucgacuggaaacaaaaucccgaggauacauuuaacaagucugacggauccaagauuaccuauaucgauuacuaucggcagcagcacaaagaaauugugacagucaagaaacagccccugcucgugagccaaggcagauggaagaaagggcugaccggaacgcagcgggagccuauccugcucauuccgcagcugugccauaugacaggccuuaccgacgaaaucuguaaggauuacuccaucguuaaggagcuggcuaaacacacccgccucucucccagacggagacaucacacacugaaggaguucauuaauacccuucaggacaacaaaaaggugcgcgaacugcuccaacugugggaucugaaauuugacacaaacuuccucagcgucccuggccgggugcugaagaaugccaacaucguccaggggagacgcauggugaaggcuaauucccagggagauuggagcagagagauucgggaacuuccccugcucaacgccaugccucugcacucuuggcugauccuuuacucccgcagcucucauagagaggccaugagccucaaaggccaucugcaguccguuacggcucccauggggauuaccaugaagccggcggaaaugaucgagguggacggagaugccaauucuuauaucgacacacugcggaaauacacccgcccuacacuccaaaugggcaugagcugccugcuugucuuuaaggugauuuguauccugcccaacgacgauaaaagacgguaugacuccauuaagcgcuaccucugcaccaaguguccuauccccagccagugcguugugaaaaagacgcuggagaaaguccaggcuagaaccauugugacaaagaucgcccaacagaugaauuguaaaaugggcggggcccuguggaagguggaaaccgauguucagcggacaauguucgucggaauugacugcuuccacgauaucgugaaccgccagaaaucuaucgcuggcuuuguggccuccaccaaugcggagcuuacgaagugguauagccaaugugucauucagaagacaggggaggaacucgugaaagagcuggaaaucugccugaaggcugcccucgacguuuggugcaaaaacgagucuuccaugccucacagcgugauugucuacagagauggagugggcgacgggcagcugcaggcccuucuggaucaugaagcuaagaaaauguccaccuaucucaagacaaucucucccaauaacuucacccuggccuuuauuguugugaagaaacggaucaauaccagauucuuucugaagcacggaagcaacuuccaaaauccgccucccggcacagucaucgacguggagcuuacgcgcaacgaaugguacgauuucuucauuguuucccagucugugcaggacgggaccgucacacccacccacuacaacgugaucuaugauacaauuggccucagcccugacaccgugcagcggcugacguacugucugugccauauguauuacaaucucccgggaaucauuagaguccccgcuccuugucacuaugcccauaaacuggcguaccuuguuggccaauccauccaccaggagcccaaccgcagccugucuacacggcucuuuuaucuguga

SEQ ID NO: 73802 - RNA, 2559 nt, Artificial Sequence
  derived and/or modified sequence opt5 from PIWIL4__Homo_sapiens__NP_689644
augagcggcagagcccgggugaaggcucgcgggaucgccagaucccccucugcgaccgaggucggacggauucaggcuagcccucugccgcgcuccguugaccucucuaacaaugaagccagcuccucuaacggcuuccuggggacaagcagaaucuccacgaaugauaaauacggaauuagcucuggcgacgccggguccaccuuuauggagcggggagugaagaacaaacaagauuucauggaccuuagcaucugcacacgcgaaaagcuggcucacgugagaaauuguaaaaccgggucuuccggcauucccgucaagcucgugacaaaccuguuuaaucuugauuucccucaggacuggcagcuguaucaguaccauguuaccuauauccccgaucucgccagccggcgccugagaaucgcucugcucuacucucacuccgagcugagcaacaaggccaaagcguuugacggcgccauucuuuuccugucccaaaagcucgaagagaaagugacagagcugucuagcgaaacccagcggggagagacgaucaagaugaccauuacacuuaaacgcgaacugccuuccagcucucccgucugcauccagguguuuaauauuaucuucagaaagauucucaagaaacuguccauguaucagaucggccggaacuuuuacaauccuagcgagccgauggagaucccccaacauaagcugucucucuggccuggguucgcuauuagcguuuccuauuuugaacgcaaacugcuuuucucugccgaugugagcuacaagguccugagaaacgagaccgugcucgaauuuaugacagcucugugucagcggaccggacuuuccugcuucacgcagacaugugagaaacagcugaucggccucauugugcugaccagauacaauaaccgcacauauagcaucgacgauauugacuggucugucaagcccacccacaccuuccaaaaacgggaugggacagaaaucacguacguugacuauuacaagcagcaguaugacaucaccguguccgaucugaaucaaccuaugcucgugagccugcuuaagaaaaagagaaacgacaacucugaggcccagcuggcgcaucucauucccgagcugugcuuucuuacaggacugaccgaucaggccacauccgacuuccagcucaugaaagcugucgccgaaaagacccgccugagcccguccggccggcaacagagacuggcucgccucguggauaauauccagcggaacacgaaugccagauuugagcuggaaacauggggccuucacuucgggucucagauuagccugaccggacgcaucguuccuuccgagaaaauucucaugcaagaccacaucugucagcccgugucugccgcugauuggagcaaggacauccggaccugcaagauucugaacgcgcagucccugaauacauggcuuauccucuguagcgauagaaccgaauacgucgccgagucuuuucugaacugccugcgccggguggcuggcuccaugggguucaauguugacuauccuaaaauuaucaaggugcaggagaaccccgccgccuuugucagagcuauucaacaguacguggaucccgacguccagcucgugauguguauccugccuagcaaucagaaaacauacuaugacucuauuaagaaauaccuuuccagcgauugcccgguucccucucaaugcgugcuggcccggacgcucaacaagcagggaaugaugaugagcaucgcgaccaagaucgcuaugcagaugacauguaaacugggcggggaacugugggccgucgagauuccucuuaagucccucauggugguuggaaucgacgugugcaaagaugcccugagcaaggacgucaugguggugggcuguguugcuucugucaauccccgcauuaccagaugguucucccggugcauccugcaaagaacaaugaccgauguggccgacugucucaaaguguuuaugacgggcgcucugaacaagugguauaaguacaaucaugaucuuccugcccgcauuaucgucuaucgggcgggggugggagacggccagcugaaaacccucaucgaauacgagguuccccagcugcugagcuccguggccgaaucuagcuccaacacaucuagcagacuuuccgucauugugguucgcaagaaaugcaugccgagauucuuuaccgagaugaaucggacagugcagaacccuccccucgggaccgucguggauucugaggcuacgcgcaacgaaugguaugacuucuaccugaucagccaaguugccuguagaggaacaguguccccuaccuacuauaaugucauuuacgaugacaacggccugaagcccgaucacaugcagcggcucacauuuaaacugugccaucuuuauuacaauuggccugggaucgugagcgugcccgcuccgugucaguaugcccacaagcugaccuuccucgucgcgcagucuauucacaaagagccuucccuggaacuggccaaccaucuuuucuaccucuga

SEQ ID NO: 73803 - RNA, 1368 nt, Artificial Sequence
  derived and/or modified sequence opt5 from PJA1__Homo_sapiens__NP_071763
augggccaggagagcuccaagcccguguggccuaacccgaccgggggauaccaaucuaauacaggcagacgguaugggcgcagacacgccuacgucagcuuccggcccccuacgucccagcgcgaaagaaucgcuucucagcggaaaaccaacagcgagguucccaugcaucgcuccgccccuucucagacaaccaagagaagccggucccccuucagcacaacccgcagaucuugggacgauuccgaaagcucuggaacaaaucugaacauugacaaugaggauuauuccagcaccucucgguggcgcgacacggcgaacgauaaugaaggccacuccgacgggcucgcuagacggggacgcggcgagagcuccucuggcuacccugagccgaaauaucccgaagauaagagagaggcccggagcgaccaagugaaaccugaaaaggugcccagacgccggagaaccauggccgauccugacuucuggacacauuccgaugacuacuauaaguacugcgaugaggacagcgacucugauaaagaguggaucgcugcccugcgccggaaguacagaucccgcgaacagacccuuagcucuagcggggaguccugggaaacacugcccggaaaagaggaacgggagccgccucaggcuaaggucucugccagcaccggcacgucccccgggccuggagcgagcgccucugcuggcgccggggcuggagccuccgcgggcagcaacggcucuaauuaucucgaggaagugagagagcccucccugcaggaagaacaagccagccuugaagagggggagauucccuggcugcaguaccacgaaaacgacuccucuagcgagggagauaaugacuccggccaugaacucaugcagccugggguuuuuaugcuggauggaaacaauaaccuggaggacgauucuagcguguccgaagaccucgaggucgauuggagccuguucgacggcuuugcugaugggcuuggaguggccgaggcuaucucuuauguugacccgcaguuccugacauacauggcccucgaggagcgccuggcccaagcuauggaaaccgcgcuugcccaccuggagucccucgcuguggacgucgagguggccaaucccccugccagcaaagaaucuauugaugcucugcccgagauccuggugacagaagaccacggcgccgucggccaggagauguguugcccuaucuguugcuccgaauauguuaagggggagguggcgaccgagcuccccugucaucacuacuuucauaagccgugcgugagcauuuggcugcagaaaucuggaaccuguccugucugccgguguauguuucccccuccccuuuga

SEQ ID NO: 73804 - RNA, 2127 nt, Artificial Sequence
  derived and/or modified sequence opt5 from PJA2__Homo_sapiens__NP_055634
augagccaguacaccgagaaggaacccgccgcuauggaccaagaguccggcaaagccguguggccuaagccggcgggaggauaucagacaaucacgggcagacgguacgggcgcagacacgcuuaugucucuuucaaacccugcaugacccggcaugaacgcagccuggggagagccggcgaugacuacgagguucucgaacuggaugacgugccuaaggagaacuccucugggagcagcccccuugaucagguggacucuagccugccuuccgagcccauuuuugaaaaauccgagacagaaaucccuaccuguggaucugcccucaaucagacaaccgaguccagccaaucuuucgucgcugugcaccauuccgaggaaggccgggauacacugggcagcucuaccaaccuucacaaucauuccgagggggaauauauuccgggagccugcagcgcuuccucuguucagaacggcaucgcccuggugcacacggacagcuacgaucccgacgggaagcacggagaggauaaugaccaucuccagcuguccgcggaagucguggagggcagccgcuaucaggagucucuggggaacaccguuuuugaacucgagaauagagaagccgaggcuuacacaggacuguccccucccgugccuagcuucaacugugaaguccgggaugaguuugaggaacuugacucugugccccuggucaagagcuccgccggcgacaccgaguucgugcaccaaaauucucaggaaauucagcgcagcucccaggaugagaugguuagcacaaaacaacagaacaauaccucucaggaaagacaaacggagcauuccccggaggacgcugccugcggcccugggcacaucuguagcgaacagaacacaaaugaucgggagaagaaccacggaucuucccccgaacagguggugcgcccuaaagucagaaagcucaucagcuccucucagguggaccaagagaccggcuuuaaucggcaugaggcgaaacagcgcagcguucagagauggcgggaagcccuggagguggaagaguccgggucugaugaccuucugauuaagugcgaagaguacgauggagagcacgacuguauguuccucgauccucccuauagcagagucaucacacagcgcgaaaccgagaacaaccaaaugaccuccgaaagcggcgcuacagccgggcggcaggagguggacaauacguuuuggaacggaugcggcgauuacuaucagcuguacgacaaggacgaagauucuuccgaguguagcgacggcgaguggucugcuucccugccccauagauucagcgggaccgaaaaagaucagucuagcuccgacgagagcugggaaacacucccgggaaaggaugagaaugaacccgagcugcaaucugacuccagcggcccugaggaagagaaccaggaacuuucccugcaggagggggagcagaccucucucgaagagggagaaauucccuggcugcaauauaaugagguuaacgaaagcuccucugaugagggcaaugagccugccaacgaauuugcccagcccgcuuucaugcuugacgggaauaacaaucuggaggaugacagcuccgugucugaagaucucgacgucgauuggagccuguuugacggcuucgcggacggacugggcguggccgaggcuaucuccuacgucgauccgcaguuccucacauauauggcccuggaggaacgccuugcccaagcuauggagaccgcccuggcgcaccucgaaagccuggcuguggacguugagguggccaacccucccgccucuaaagaauccauugaugggcuuccugagacgcugguccucgaagaccauacagcuaucggacaggagcagugcugucccauuugcugcagcgaguacaucaaggaugacaucgccaccgaacugccuugucaccacuuuuuccauaaacccugcgugucuauuuggcugcagaaguccggcaccuguccgguuugccggagacacuuuccucccgcugugaucgaggccagcgcggcccccucuuccgaaccugauccggacgcucccccuagcaaugauuccauugccgaggcucccuga

SEQ ID NO: 73805 - RNA, 12909 nt, Artificial Sequence
  derived and/or modified sequence opt5 from PKD1__Homo_sapiens__NP_000287
augcccccugccgcuccggccagacuggcccucgcucugggccuugggcuguggcucggagcccuggccggcgggcccggacggggcugcgggccuugugagcccccuugccuuuguggacccgcuccuggcgccgcuugccgcgugaacuguuccggcagagggcugcggacccucggaccggcccugcgcauccccgccgacgccacagcucuggaugugucccacaaucuccugagagcccuugacguuggccugcucgcuaaccugucugcccuugcggaacuggauauuuccaauaacaagaucuccacgcucgaggaagggauuuucgccaaucuguuuaaccugucugagaucaaucucagcggaaacccuuucgaaugcgacuguggccuggcuuggcuuccccggugggccgaggagcagcaagugcgcgugguccagccugaagcugcgaccugcgccgggcccggaucccuggcuggccagccgcuccugggcauuccucuucuggauucuggguguggagaggaauacguggcgugccuccccgacaauagcuccggcacaguugccgcugugagcuuuucugccgcccaugaggggcugcugcagccugaggcuuguuccgccuucugcuuuagcaccggacaaggccucgcggcucugucugaacagggguggugccuuuguggagccgcccagcccuccagcgcuucuuucgccugccugucccucuguagcggacccccuccgcccccugcucccacaugcagaggcccuacccugcuucagcacgucuuucccgccuccccgggggcgacacuggugggaccucauggcccccucgccucugggcaacuggcugccuuccacaucgcugccccucugcccguuaccgcgacgcggugggauuuuggagacggcagcgccgagguggaugcugccgggccugcugccucccaucgcuauguccuccccggcagauaccacgugaccgccgugcuggcucuuggagcgggcagcgcccugcucgggacagacguccagguugaagcugccccggccgcucuggagcugguguguccuucuuccgugcagagcgaugaaucucuugaccucagcauccagaaccggggaggcuccgggcuggaggccgcguauucuauugucgcucugggagaggaacccgcccgcgccgugcacccccucugcccuagcgauaccgagaucuucccgggcaaugggcauuguuacagacugguuguggaaaaggcugccuggcuucaagcgcaggagcagugccaggcuugggccggcgccgcucuggccauggucgacucccccgcugugcagcgguuucucguuagccgcgugacaagaucucuggacgucuggauuggauucuccaccgugcagggcgucgaaguggggccugcgccccaaggagaggcguuuagccuggagucuugucaaaacuggcuuccuggcgaaccccacccugccacggcugagcauugcguucggcucgggcccacaggaugguguaauaccgaucugugcuccgccccgcacagcuaugugugcgaacugcagccuggcgggcccguccaggacgcugagaaccuccuggugggcgccccuuccggagaucuucagggcccccugacaccgcucgcccaacaggacgggcugucugcuccucacgaacccguugaggugauggucuucccuggacugagacuuagccgcgaggcguuccucaccaccgccgaauuuggcacacaggagcugcggagacccgcucagcugcgccuccaaguguaccggcugcuuuccacggccgggacccccgaaaauggaucugagccugagagcagauccccggauaaccgcacacagcuggcccccgcuuguaugccuggcgggcgguggugccccggcgccaacaucugucucccucuggacgcgagcugccauccccaggcuugugccaauggaugcaccucuggcccugggcugccgggagcccccuaugcucuuuggagagaguuccucuuuuccgugccugccggacccccugcgcaguacagcguuacacugcacgggcaagauguccugaugcuccccggagaccuggugggccuucagcaugaugcuggcccgggggcccugcuccacuguucuccugcccccggacaucccggcccucaggcucccuaccuguccgccaacgcuagcucuuggcugccucaccuuccggcccaacuggaggggaccugggcgugccccgccugugcucuccgccugcucgccgcuacggaacagcugacagugcuucugggacuccggccuaaucccggccugagacugccugggcgcuaugagguccgggccgaagugggaaacggcguuagcagacacaaucuuuccugcagcuucgacguggucucucccguggccggccugcggguuauuuacccggcuccucgcgaugggagacucuaugugcccaccaacggauccgcgcugguccuccagguggacagcggcgccaaugcuaccgccacagcccgguggccugggggauccguuucugcuagauuugagaacgugugucccgcccuggucgcgaccuucgugccuggcugccccugggagacaaaugacacgcuuuuuagcguggucgcucugccguggcucuccgaaggggagcauguuguggauguggucguggaaaacucugccagccgcgccaaucugucccugcggguuaccgcugaggaaccuaucugcggacuuagagccacacccucucccgaggcgcgcgugcugcagggcguccucgugagauacagcccuguuguggaggccggcuccgacauggucuuccgguggaccauuaacgauaagcaaagccugacauuucagaaugugguuuucaacgugaucuaucagucugcugccgucuuuaaacucucccugaccgcuagcaaucacgugucuaacgugacggucaacuacaauguuaccguggaacgcaugaacagaaugcaggggcuucaaguguccacagucccggccgugcugagccccaaugcuacccuggcccucacagcgggaguucugguggacucugccgucgagguggcuuuccuuuggaccuuuggcgauggggaacaggcccugcaucaguuccagccucccuauaacgaguccuucccuguucccgacccuagcguggcucaaguccucguggaacacaaugucaugcacacguacgccgccccgggagaguaccugcucacagugcuggcuuccaacgcguuugagaaucuuacccagcagguucccgugagcguccgggccucucugccuagcguggcuguuggcguguccgaugggguccugguggccggacgccccgugacauucuauccucauccccucccgucuccuggcggcguucuguacaccugggacuuuggggauggaagccccguccuuacccaaucccagcccgccgcuaaccacacauaugccucuagaggcacguaccaugugcggcuggaagugaauaacaccgucagcggggcggccgcucaggccgacgugcgcguuuucgaggaacucagaggacuguccguggauaugucucucgcugucgagcagggcgccccugugguugugagcgcggccguccaaacaggggacaauaucaccuggacauuugauaugggagacggcaccgugcuguccggccccgaggcuacgguugaacacguguaucuucgggcccagaacuguacagucaccgugggggcugccagcccugcuggacaucuggcccgcucucugcacgugcucgucuucguucuggaggugcuuagaguggaaccggcggccugcauucccacccagccugacgcucggcugacagccuacgucaccggcaaucccgcucacuaucucuuugauuggacauucggggacggauccagcaacacgaccgugagaggcuguccuacaguuacccauaauuuuacacgcucugggaccuucccccuggcccucgugcuguccagccgggucaacagagcccacuacuuuacguccaucugcguggagccggaaguuggaaacgugacccuucagccugagcgccaauucguccagcugggcgaugaggcguggcugguggcuugugccuggcccccuuuucccuaccgguauacaugggacuucggcaccgaagaggcugccccuacaagagcccgcgggcccgaagucaccuucauuuaccgggauccgggaucuuaucucgugacaguuaccgcuagcaauaacaucuccgccgcgaaugacagcgcccugguggaggugcaggaaccuguccuuguuacgucuauuaaggugaacggcucccuggggcucgagcugcagcaacccuaccuguuuagcgcugugggaagaggccgccccgccucuuaucucugggaucuuggggacggaggcuggcuggagggcccugaagucacacaugcuuacaauagcaccggggauuucaccgugcggguugccggauggaacgagguguccagaucugaagcguggcugaaugucacagugaaacggcgcgucagaggccucgugguuaacgccagccggaccguggucccgcugaauggguccgugucuuuuagcacgucccuugaggcuggaagcgacguucgcuauucuugggugcugugcgauagauguacacccaucccuggcgggcccaccaucuccuacacauuccggagcgucggcaccuuuaacauuaucgugacagccgaaaaugaggugggauccgcucaggacucuauuuucguuuacguccuccagcugaucgagggccuccagguggucgggggcggcagauauuuuccuaccaaccacacggugcaacuccaggccguugugcgcgaugggaccaaugugagcuacuccuggacagcuuggcgggacagaggacccgcccuugcgggcucugggaagggcuucagccugaccguccuggaagccggaacauaucaugugcagcuccgcgcuaccaacaugcugggcuccgccugggcugacugcacgauggauuuuguugagccugugggguggcuuauggucgccgccagccccaauccggcggcugugaacacaucuguuacccuguccgccgaacucgccggaggcagcgggguggucuacacauggucucuggaggagggacuguccugggaaaccagcgagccuuucaccacacacucuuuucccacgccuggccuccaccuugugaccaugacagcugggaacccccugggcagcgccaaugcuaccguggaagucgacguucaagugccgguguccggacugucuauucgggccagcgagccuggcggguccuucgucgcggccggaagcuccgugcccuucuggggccagcucgcuacagggaccaacguuucuugguguugggccgugcccggaggcagcuccaagagaggcccucaugucacgaugguguuucccgaugcugggacauucucuauccgccugaaugccagcaacgcgguuuccugggugucugccaccuauaaucuuaccgcugaggaaccuaucgucggacuggugcucugggccagcuccaaaguuguggcuccgggccagcugguccacuuucagauucugcucgccgcugggagcgccgugacauuccggcuucaagucggaggcgcgaaccccgaggugcugccugggcccagauuuucucauuccuucccucgcguuggagaccacguggucagcgugagaggcaagaaucacgugucuugggcccaggcucagguucggaucgugguccuggaagccguguccggccuccagguucccaacugcugugagccugggauugccaccggaacagaacgcaauuuuacggcuagagugcaacggggcagccgcgucgccuacgcgugguauuucucucugcagaaagugcagggggauucccuugucauccugagcggaagagacgugaccuacacaccgguugcugccggccuccuggagauucaggugcgggccuuuaacgcucugggguccgaaaauagaacccucguccuugaggugcaagaugccguucaguacguggcucugcagagcggacccugcuucacaaaccgcucugcccaauuugaggcggccaccagcccuagcccccggagagucgcuuaucauugggacuucggcgauggcucuccugggcaggacacggaugaaccccgcgccgagcacagcuaccugcggccgggagacuauagaguccaggugaaugcuuccaaccucguuucuuucuucgucgcccaggcgaccgugacagugcaaguccuggccugccgggaaccugagguggacguugugcuuccccugcagguccucaugcgcagaagccagcggaauuaccuggaagcucauguggaucugcgcgacuguguuaccuaucagacagaguacagaugggagguguaucggaccgccuccugccaacgccccggcagaccugcucgggucgcccuccccgggguggauguuucucgcccuagacuugugcugccgcggcuggcccuccccgucggacacuacuguuucguguuuguggucagcuucggcgacacaccucugacgcaguccauccaggcuaacguuaccguggcgcccgaaagacuugugccuauuaucgaagggggcagcuaccgcgucuggucugauacacgggaccuggugcucgauggcuccgaaagcuaugaccccaaucuggaggauggcgaccagaccccgcugucuuuucauugggccugcguugcuuccacccaaagagaggccgggggaugugcccucaacuucggcccucgcgggagcuccacagugacgaucccccgggaaagacuugcugccggagucgaguacaccuuuucucugacaguguggaaggcgggccgcaaagaagaggcuaccaaccagacaguucugauucggagcgggagagugccuaucgucucccucgaaugcgugagcuguaaggcccaggccgucuaugaggugucucgcuccagcuacguuuaucuggagggacggugccuuaauuguucuagcggcuccaagagaggccgcugggcugcccggaccuucucuaacaaaacgcuggugcucgaugaaacaaccaccagcacaggguccgcuggaaugagacugguccugcgcagaggcgugcuccgggacggggagggauacaccuuuacacuuaccguucugggccgcucuggggaagaggaaggaugcgccagcauuagacugucccccaaucggccgccucucggcggcagcuguagacuguucccccuuggggcggugcacgcccugacgacaaagguccacuuugagugcaccggauggcaugaugcugaggacgccggcgcuccccucguguaugcccugcugcuccggcgcugcagacaggggcacugugaagaguucugcguguacaaaggaucucuuuccagcuacggcgcgguucugccucccggguuucggccucauuucgaagucggacuggccguggugguccaagaccagcucggcgcugccgugguugcucugaaccgcucccuugccaucacacugccggagcccaauggcucugccaccgggcucacgguguggcugcacggacugaccgcuagcguccucccuggccugcuuagacaggcggauccccaacacgugauugaauauucccuggcccucguuacagugcugaacgaguacgagcgggcucuugacgucgccgccgaaccuaagcaugagcgccagcacagagcucagauccggaaaaauaucaccgaaacacuggugucucuccgcgugcauaccguugaugacauucagcaaaucgccgcggcucuggcccaguguauggggcccagcagagagcuggucugccgguccugucucaagcagacacugcacaaacuugaggccaugaugcugauucuccaggcugaaaccacggccggaacagugaccccuaccgcuaucggcgauagcauucugaacaucacaggggaccuuauccaucuggccucuuccgaugugcgcgcgccgcaacccagcgagcucggcgccgaaucuccuuccagaauggucgcuagccaggccuauaaucugaccucugcucugaugcggauucucaugcgcuccagaguucugaacgaggaaccccuuacacuggccggagaggagaucguggcgcagggcaagcggagcgacccuagaucucuccugugcuacgggggagcccccggcccggggugucacuuuagcauuccugaggcuuucuccggagcccuugcuaaucugagcgaugugguccagcucaucuuccugguggacuccaaccccuuucccuucggcuauauuucuaauuacacgguuagcaccaagguggccuccauggccuuucaaacacaggcuggggcgcagaucccuaucgagcgccuggccucugaacgggcuauuaccgucaaagugcccaacaauagcgauugggccgccagaggccaccgcuccucugcuaacagcgccaacuccguugugguccaaccucaggcgagcgugggagcuguggucacacucgacucuuccaauccggccgccggccugcaucuucagcugaacuauacccuccuggaugggcacuaccuuagcgaggaacccgagccuuaccuggcuguuuaucuccauucugagccccggccuaaugaacacaacugcuccgccagcagacgcauccggcccgagucucugcagggagcugaccacagaccguacacguucuuuauuuccccuggcagccgcgaccccgccgggucuuaucaucugaaucucuccagccacuuccgguggagcgcgcugcaaguguccgugggacuuuacaccucucugugucaguauuuuagcgaagaggauauggucuggagaacagaaggccuccugccucuugaggagaccagcccccgccaggccguuugccugacacggcaucucaccgcuuucggggccucucuguuugugccucccagccacgugagauucgucuuuccggaacccacggcugacgugaacuacaucguuaugcugacaugugccgugugccucgucaccuauauggugauggcggccauucugcauaaacuugaucagcuggacgcuucccggggcagagccaucccuuucugcggacaacgcggccgguuuaaauacgagauucucguuaagacaggguggggaagaggcucugggaccaccgcucacgugggaaucaugcuguacggcgucgauagccgcuccgggcacagacaucuugacggcgaucgggccuuccaccgcaauagccuggacaucuucagaauugcgacaccccauucucucggauccguguggaaaauccgggucuggcacgauaacaagggccugagcccugccugguuucugcagcaugugauuguucgcgaccuccagacggcuagaucugccuucuuucuggugaaugauuggcuuuccgucgaaaccgaggcuaacgggggacugguggagaaggaagugcucgccgccagcgacgcugcccugcuucgguuccgcagacugcucguugcggagcugcagcggggcuuuuucgacaaacacaucuggcuguccauuugggaucgcccgcccagaucucgguuuacacgcauccaaagagcuaccuguugcguccuucugaucugucucuuccugggggccaaugccgugugguauggagcugugggcgacagcgccuacuccacaggccacguuucucggcucagcccucuguccgucgauaccguggcgguggggcuugucagcucugugguuguguaucccgucuaccuggcuauucuguuucucuucagaaugucccgcagcaagguggccggaucuccuagccccacgccugccggccagcagguucuggacaucgauuccugccuugacucuagcgugcuggauuccagcuuucucacauucucugggcugcaugcugaagccuuugucggacaaaugaaauccgaccucuuccuggaugacagcaagucccugguguguuggcccucuggcgaggggacccuuagcuggccggaucugcucuccgacccuucuauugugggaagcaaccugcggcagcuugcuagaggccaggccggccacgggcugggacccgaagaggauggcuucucccucgcgucuccuuauagccccgccaaauccuuuagcgcuucugacgaggaccugauccagcaaguucucgccgaaggggucuccagcccggcuccuacccaggauacacauauggagaccgaccugcugucuucccuuagcucuacacccggagaaaagacggagacccuggcccuccagcgccugggcgaacuugggcccccuagccccggacugaauugggagcagccucaagcggcccggcucuccagaacaggccugguggagggccugcgcaagcggcuccugccggcuuggugcgccagccuugcucacgggcugucccuccugcuuguggccgucgccguggcuguuucuggaugggugggcgccagcuuucccccuggggucuccguggcguggcugcucucuagcuccgcuucuuuucuggccagcuuccugggaugggaaccccucaaaguucugcuugaggcccuguacuuuucccucguggcuaagagacugcacccugaugaagacgauacccuugucgagagccccgccgugacaccgguuucugcgcgcgugccucgggucagacccccucauggcuucgcucuguuucucgccaaagaagaggcccggaaggugaaacgccugcacgggaugcugagaucccuccugguguauaugcuuuuccugcucgucacccugcuugcuagcuacggagacgccucuugucauggccacgcuuaccggcugcaguccgccauuaagcaggagcuccauagccgcgcguuucuggccaucacgagaucugaggaacuguggcccuggauggcucacguucuccugccuuaugugcacggcaaccaguccagccccgaacuugggccgccccggcugagacaagugcgccuccaggaggcccuguacccugaucccccuggaccccggguccauaccugcucugcugccggcggguucuccacaagcgacuaugaugugggaugggaguccccucacaauggcagcgggaccugggcguacucugccccggaccuucugggagcuuggagcuggggcuccugugccguuuaugauucuggcggguacgugcaggaacucggacugagccuggaggaauccagagaccgccuccgguuucugcagcuucauaacuggcuggacaacagaucucgcgcugucuuccucgagcugacaagauauagccccgccgugggccuucacgccgcuguuacccugcggcucgaauuuccugccgcggggcgcgcucuggccgcccuguccgugagacccuucgcucuccggcgccugagcgccggacuuucucugccucuccugacauccgucugccugcuccuuuucgcggugcacuuugcugucgccgaggccagaaccuggcaucgggagggccgcuggagagugcugcggcugggggcuugggccagauggcuccugguugcucuuacggccgcgacagcccuggugcgccucgcucaacugggagccgcugaucggcaguggaccagauucguccgcggccggcccagacgcuuuaccagcuucgaccagguggcccaacugucuuccgcggcccggggccuugcugccagccuccuguuucugcuccugguuaaggcugcccagcagcuuagauucgugcggcaguggucugucuuugggaaaacacugugucgcgcccucccggaacugcugggagugacgcuuggccucgugguucugggggucgcuuacgcccaacuggcgauccuccugguguccagcugcguggauucccuuuggucugucgcucaggcccugcucgugcuguguccuggaaccggccugagcacacuuugccccgccgaguccuggcaccucagcccucugcugugcguugggcucugggcucugagacuuuggggagcccugcggcucggcgcggugauucugcgcuggagauaccaugcucugcggggcgaacuuuaucgccccgccugggagccgcaggacuacgaaauggucgaacuguuccugagacggcugagacucuggauggggcugucuaaggugaaagaguuucgccacaagguucgguucgaaggaauggagccucuucccuccagaagcucucgcggcagcaaagugucccccgaugucccucccccuucugccgggagcgacgcuucccauccgagcaccucuuccagccagcuggauggacucucugugucccugggccggcuggggacaagaugugaacccgagccuagccgccuucaagccguuuuugaagcucuccugacccaguucgaccggcugaaucaggccacagaggauguguaucagcucgagcaacagcugcacucccuucagggcagacgcucuagccgggcgcccgccggauccucuagaggcccuagccccgggcugcgcccugcucucccguccagacuggcccgggcuagccgcggagucgaccuggccaccggccccucuagaacgccucuucgggcgaagaacaaagugcaccccuccagcaccuga

SEQ ID NO: 73806 - RNA, 8550 nt, Artificial Sequence
  derived and/or modified sequence opt5 from PKD1L1__Homo_sapiens__NP_612152
auggcugaagaagcugcccagaauaucagcgacgaccaagaaagaugccugcaggcggcuuguugccuguccuucggcggggaacugucugugagcaccgacaaguccuggggacuucaccuguguucuugcucucccccuggcgggggacucuggguggaaguuuacgccaaucaugugcugcuuauguccgauggcaaaugugggugcccguggugugcccugaacggaaaggcugaagaccgggaaucccagagccccuccagcucugccuccagacagaaaaauauuuggaagacaacgagcgaagcugcccucucugugguuaacgagaagacccaagcggugguuaaugagaagacacaggccccucuggauugcgacaacuccgcugauagaaucccccacaagccuuuuauuaucauugcccgggcuuggagcucuggcggcccccgcuuccaucacagacggcugugugccaccgggacagcggacuccaccuuuagcgcccuccugcagcuucagggaacaaccuccgcugccgcuccuugcucucugaaaauggaagccagcuguugcgugcuccgccugcuuugcugugccgaggaugucgcuacgggccugcucccggggaccgugacaauggagacccccacaaagguugcgagaccuacccaaacguccagccagcgggugccccuguggccuauuucucauuuccccacauccccgcgcagcucucacggacugccucccggcaucccuagaacccccagcuuuacagccucccagucugggagcgaaauucucuaucccccuacccagcacccgcccgucgcuauccuggcccggaacagcgacaacuucaugaauccugugcuuaacugcagccuggagguggaagcccgcgcucccccuaaucucggauuuagaguccauauggccucuggcgaggcgcugugucuuaugauggauuucggcgacuccagcgggguugaaaugcggcugcacaacaugucugaggcuauggccgugaccgccuaccaucaauauuccaaaggaaucuuuuuccaccuccugcacuuucagcuggauaugagcacauacaaggaggcugaaacgcagaauaccacacucaacguguaucugugccaauccgaaaauucuugucuugaagacagcgaccccuccaaccugggcuacgagcucaucucugccuucgucaccaaagggguguauaugcugaaggcuguuauuuacaacgaauuucauggaacagagguggagcuuggcccguacuaugucgaaaucgggcacgaggccgugagcgcguucaugaacagcagcucuguucaugaagaugaggugcuggucuucgccgacucccaggugaaccagaaaagcaccgucgugauucaccauuuuccuucuauccccuccuacaauguuagcuucaucucucagacgcaagugggagauagccaggcuuggcacuccaugacagucugguauaaaaugcagagcgugucuguuuacaccaacggcaccguguuugccacagacaccgauauuacauucacggcugucaccaaggaaacaaucccucucgaguuugagugguauuucggcgaagaucccccugugcgcaccacauccagaagcauuaaaaagcggcuguccaucccccagugguacagagugaugguuaaagccucuaaucgcaugagcuccgucgugucugagccgcacgugauucggguccaaaagaaaaucguggcgaacagacugaccagcccuuccucugcccucguuaaugcuagcguggccuuugaaugcuggaucaacuucgggacggaugucgcuuaucugugggacuuuggagauggcaccgugucccuuggguccucuuccagcucucauguuuacucccgcgagggagaguucacaguggaaguccuggccuuuaauaacgugagcgccucuacccuccggcagcagcuguucauuguuugugagcccugccagcccccucuggugaagaauaugggcccggggaagguccaaaucuggagaucccagcccgugcgccuuggcgugacauuugaagcugcggucuucugugacauuagccagggacucuccuacaccuggaaccugauggauagcgagggccugccuguuucucuccccgccgcuguggacacgcaccggcagacacugauccuuccuagccauacccuggaauaugggaauuacacagcccucgccaaagugcaaauugagggauccgucguguauucuaacuacugcguuggccuggaggugagagcucaggcccccgucagcgugaucuccgaagggacccaccuguucuuuucucgcaccacaagcuccccuaucguucuucggggaacgcagucuuucgaccccgaugacccgggcgcgacccucagauaucacugggagugugcuacagccgggagcccugcccaucccugcuuugauuccagcaccgcucaccaacuggacgccgcggcuccuacagugucuuucgaagcccaguggcuguccgauagcuacgaccaguuucucgucaugcugcgcgugucuuccggcggacggaauagcuccgagaccagaguuuuccuuucucccuauccggauagcgccuuucgguucgugcauauuuccugggucagcuuuaaggacacguucgugaacuggaacgaugaacugucucuccaggcuaugugcgaggacuguuccgagaucccuaaucugagcuacucuugggaucuguuucuugugaacgccacagagaagaaucgcauugagguccccuucugcagaguugugggccuccuggggagccugggacucggcgcuaucuccgaaucuagccaacugaaccuucugccuaccgagcccgggaccgccgaccccgaugcgacaaccacaccuuuuucccgggaaccgucucccgugacgcucggacagccugccaccagcgcucccagaggcacaccuaccgagcccaugacaggggucuacuggauuccuccggccggcgacuccgcugugcugggagaggcccccgaagagggcagccuggaccuugaaccugggccccagucuaagggaucccucaugaccggccgcagcgagcggucccagccuacgcacucucccgauccgcaucugagcgacuucgaggccuauuacuccgauauccaagaagcuauuccuucugggggaagacagcccgcgaaagacaccagcuuccccggcuccgggccuagccugucugccgaggaaucccccggcgauggagacaaucucguugauccuagccugucugcuggccgcgccgagccggugcuuaugaucgacuggcccaaggcccugcucgggagagcugucuuucagggauauuccagcucuggcaucacagaacagaccgugacaauuaagccuuacagccuguccucuggggagaccuauguucugcaagugagcgucgccuccaaacacggacuucugggcaaggcgcagcucuaccugacagugaaccccgcuccucgggauauggccugucagguccaaccccaccauggccucgaggcccacaccguguucagcgucuuuugcauguccgggaaaccggacuuccauuaugaauuuucuuaccagaucggaaauacgagcaagcacacacuguaccauggccgcgauacccaguauuacuucgugcuuccugcuggggagcaccuggacaacuauaaagucaugguguccaccgaaauuacagauggaaagggcucuaagguucagcccuguaccguggucgugacggugcucccuagauaccacgggaaugacugccugggagaggaccuguauaacagcucccuuaaaaaucugucuacacuccaacugaugggcagcuacaccgaaauccggaacuauauuacaguuaucacccgcauccucuccagacugagcaaggaggauaaaacagccucuuguaaucaguggucccggauucaggacgcgcuuaucagcucugucugccgccuggcuuuuguggaucaggaggaaaugauuggcuccgugcucaugcugagagaccuggucagcuucucuaacaaacuuggguuuauguccgccgugcugauccucaaauacacccgggcccugcucgcucaaggacaguucagcggccccuuuguuauugauaagggggugcgccuggagcuuaucggacugaucuccagagucugggaagugagcgagcaggaaaauucuaaggaggagguuuaccggcaugaagagggcauuacggugaucagcgaccugcuccuggggugucuuucccugaaccacgucucuaccggacagauggaguucagaacacuccugcauuauaaccuccaaagcuccgugcagucucugggcagcguucaggugcaccuuccuggcgaucuggccgggcacucccccgcuggagccgagacccagucuccgugcuacauuagccaacugauccucuucaaaaagaauccuuaucccggcucccaggcgcccgggcagauuggaggcgucguggggcugaaccuuuacacauguagcucucgccggccuaucaauagacaauggcugcgcaaaccggugauggucgaguuuggagaagaggacggccucgauaaccggagaaauaagaccacguucguucugcuccgcgacaaagugaaccugcaucaguuuacagaacuuuccgagaauccccaggaaagccugcagaucgagauugaguucucuaagccugugacccgggccuuucccgucaugcugcucgugagauucuccgaaaaaccuacacccagcgauuuucugguuaagcaaaucuauuucugggacgaguccauugugcagaucuacauuccugcugccucucagaaggacgcuagcgucggcuaucuuucccugcucgaugccgacuacgaucgcaaaccgcccaaccgguaccuggccaaggcugugaauuauaccguucacuuucaguggaucagaugccucuucugggacaaacgggaauggaaaagcgagcgcuuuucuccucaacccgggaccuccccugaaaaagugaacugcagcuaccauagacuggcggccuucgcccuucugcggcgcaagcugaaggccucuuuugaggucagcgauauuuccaaacuccagucucaccccgagaaucugcuuccgagcaucuucaucaugggauccgugauucuguauggcuuccucgucgccaagucuagacagguggaccaucacgagaaaaagaaagcuggguacaucuuucugcaggaggccagccugccuggacaccaacucuaugcgguugugauugauacaggcuuccgggcucccgccagacuuacguccaagguguacaucguccuguguggggacaacggacugagcgaaaccaaggagcucucuugccccgaaaaaccucuguuugagcgcaauucccggcauacauucauucuuagcgcccccgcucagcugggccuccugagaaagauccgccuguggcacgauucccggggcccuucuccggggugguuuaucagccauguuauggugaaagagcuccacaccggacagggcugguucuuucccgcccaauguuggcuuuccgcggggagacacgacggacgcguggaacgggagcugacaugccugcagggcgggcucggauucagaaagcuguuuuauuguaaauucaccgaauaccuugaggauuuucaugucuggcugucuguguacagccgcccuuccagcucuagauaucuccacacgccccggcugacaguuuccuucagccugcucugcguguacgccugucuuaccgcucuggucgccgcuggcggccaggagcagccucaucuggacgugucucccacccucggguccuuucgcgucggacugcuuugcacacugcucgccagcccgggcgcucaacugcugucucuccuuuucagacuguccaaggaagccccugggagcgcgcggguggagccccacucuccucugcgcggaggcgcccagaccgaagcuccccaugggccuaacagcuggggacgcauucccgaugcccaggagccgcggaagcagccugcuuccgccauccucagcggcuccggcagagcccaacgcaaagcugcgucugacaaugggacagccugucccgcucccaagcugcagguucacggagccgaccacagccggacgucccuuaugggcaaaucucauugcuguccuccgcacacccaggcccccagcuccgggcuggaaggacucaugccucaguggucuagagcucugcaacccugguggagcuccgccgugugggcgauuugcggcacagccagccuggcuugcucucucgggaccggcuuccuugccuaucgcuuuggacaggagcaguguguccaguggcugcaucugcucucccugagcgugguuugcuguaucuucauuacacaaccucuuauggugugccugauggcucucggcuuugccuggaagcggagagcggauaaccacuucuuuaccgagucucugugugaagccacgcgggaccuggauuccgagcucgcugaacgcagcuggaccagacuucccuucucuuccagcugcucuaucccugacugugccggggaggucgaaaaagugcuggcugcccggcagcaggcucgccaccugagaugggcccaucccccguccaaggcgcaacuccggggaacacgccagagaaugcggcgcgagagcagaacccgggccgcucugagagauaucagcauggacauucuuaugcugcuccugcugcucugcgugaucuacggccgcuuuucccaggaugaguauucucuuaaccaggccauucggaaagaguucacaagaaaugcucgcaacugucucgggggacugcggaauaucgccgacuggugggauuggagccucaccacacugcuugacggccuguacccugggggcacgcccuccgccagaguuccuggagcgcaacccggcgcucucgggggaaagugcuaucugauuggcucuagcgucauccgccagcugaagguguuuccgcggcaccucuguaaaccucccagacccuucuccgcccuuauugaggauucuaucccuaccugcagccccgaagucgggggaccugagaacccguaccugaucgaccccgaaaaucagaacgucacacugaauggcccugggggcugcggaacccgcgaggauuguguucucucccugggccggaccagaacagaggcucauacggcccuuagccgccugcgggccucuauguggauugacagauccacccgcgcugugagcgugcacuuuacacucuacaaucccccuacccagcuguucacaucugucucccugagaguggaaauccuccccaccgggagccuuguuccuuccucucugguggagagcuuuuccauuuuccggucugacagcgcccugcaauaucaucucaugcugccgcagcuugucuuccuggcgcucucccugauccaccugugcgugcagcucuaccgcaugauggauaagggaguucugagcuauuggagaaaaccccggaauuggcuugaacugucuguggucggcgugucccucacguacuaugccgugagcgggcaccuggucacacuugcuggagacguuaccaaccaguuucauagaggccugugucgggccuucauggaucucacccugauggcuucuuggaaucaacgcgccagauggcugcggggcauucuccuguuucuuuucacacugaagugcguguaccucccugggauccagaacaccauggcgagcuguuccucuaugaugcgccacagccugcccuccaucuuuguggccggacuugucggcgcucugaugcucgccgcucugagccaucugcacagauuccuccugucuaugugggugcuuccucccgggacauuuaccgacgccuucccgggacugcucuuucauuucccucggcgcucccagaaagauugccugcuuggccugagcaaguccgaccaaagagcuauggccuguuauuuugggauucuccugaucguuucugcgacgcugugcuucggaaugcuccggggcuuucugaugacacuuccccagaagcgcaagagcuuccaguccaagucuuucgugagacugaaagaugucaccgccuacaugugggagaaggugcucacauuucugcggcuugagacccccaaacuggaagaggcugaaaugguugagaaucacaacuacuaucucgacgaguucgccaaucugcuggaugagcuccugaugaagauuaacggccuuagcgacucccugcagcucccucugcuugagaagacgucuaauaacaccggggaagcucgcacagaggaaagcccccugguggauaucuccagcuaccaagccgccgagccugcggacauuaaagacuuuuga

SEQ ID NO: 73807 - RNA, 2976 nt, Artificial Sequence
  derived and/or modified sequence opt5 from PKD1L2__Homo_sapiens__NP_001070248
augagcgccgugggccugguccuccugguucuugcucugagacuccgggccaccacagugaagcccgaggaaggguccuucugcucuaacagccagguggcguuucgcgacgcuuguuacgaguucgucccucugggaagaacguuucgggaugcccaauccuggugcgaaggccaagggggacaccuuguguucauccaggacgagggcacccagugguuucugcagaaacauauuucucaggaucgcgaaugguggaucgggcucacauggaaucuggccagaaacggaaccacagagggcccgggcaccuggcuggacacaagcaauguuaccuauuccaacuggcacgggggacaggcugccgcugcccccgauacguguggccauauugggcggggaccuucuagcgagugggugaccuccgacugcgcgcagacauucgccuuuaugugugaguuccgcgucggccaaagccucgcuugcgaggggcugaaugccaccgugcacuguggacuuggccagguuauccaggugcaggaugcugucuacggcagacaaaacccccauuuuugcacacaggacgccgggcggccuucugaucuggaacagggauguuccugggcgaaugugaaggaggagguggccggccaaugccaggaacuccagagcugucaggucgcugccgacgagaccuauuucgggaaccugugccccacgcaaggaucuuaccuuuggguucaguaucagugccgcgaagcucugcagcucaugguguccagcgagucuuuuauuuucgauaaugugacaaucucccugaccuggcugcucagcccuuacaucggcaaccuguccuguauuaucucuacaggggacagccacaccuuugauccguauaaucccccuuccgucagcucuaacgugacccaccaauucacaucccccggagaguucacgguuuuugccgaaugcaccacaagcgaguggcaugugaccgcccagagacaggucacagugcgggacaaaauggaaacccuuucuguuacggcuuguagcggccugucccagucuggcgcggggccucucugccaagccguguucggagacccccuguggauucaggucgagcuugauggcgggacaggagugaccuacaccguccugcucggcgacaucacacuggcugaaagcaccacacagaaggggucccugccguacaaucucauucuggaucgcgagacgcagaaacuuaugggcccuggaagacaccggcuggaaauccaagccaccggcaacacaaccacaagcaccauuucucgcaauaucacggugcaucucguugagcugcuuuccgggcugcaggccagcugggcuucugaccaccucgagcugggacaggaucugcucaucaccauuucccuggcccaaggcacacccgaagaacuuaccuuugaaguggcggggcugaacgcuacauucagccacgagcaggucuccuuuggagaaccuuucggcaucuguagacucgccgugcccguugaggggaccuuucuggugacgaugcugguccggaacgccuucucuaaucuuagccucgagauuggcaacaucacaauuaccgcucccuccggacugcaggaaccuucuggcaugaaugccgagggaaagagcaaggacaaaggggauauggaaguguauauccagccgggccccuacguggacccuuuuacaaccguuacccugggguggcccgauaacgacaaggagcucagauuccaaugguccugcggaagcuguugggcucuguggucuuccugcgucgagcgccagcuucugcggacagaucagagagaacucguggugccugccagcugucugcccccgccugacucugcggucacgcugcgccuugccgugcuccggggccaggagcuggaaaauagagcugagcaaugccuguauguuuccgcccccugggaacuccgcccucgggugagcugugagagaaacugccgccccgucaaugcuucuaaagacauccugcuucgggugaccaugggggaggauagcccuguugccauguuuuccugguaccuggacaacacacccaccgaacaggcggagccgcuccuggaugccugcagacugcgcggcuucuggccucggagccuuacacuccugcagucuaauaccuccacgcugcuccugaacagcuccuuucuucagucuagaggagaagugauucggauccgcgcuacagcccugaccagacaugcuuauggcgaggacaccuacgucauuagcacagugccuccccgggaaguucccgccuguaccaucgccccggaggaggggacagugcucacguccuucgcuauuuucugcaaugcgucuaccgcccugggaccccuggaauuuuguuucugccuugagagcggcuccugucuccacugcgggccugaacccgcucugccuucugucuaucugccccucggagaggaaaacaaugauuuugugcugacaguggucaucagcgccaccaacagagccggcgacacacaacagacccaggcuauggccaagguugcgcuuggggauacguguguggaggacguggcuuuccaagccgccgucuccgagaaaaucccuaccgcucugcagggcgaaggaggccccgagcagcuccugcagcuggccaaggcggugagcucuaugcuuaaucaagaacaugagucccaggggagcggacagucucuguccauugauguucgccagaaggugcgggagcacguccucggcagccugucugcugugacaaccgggcucgaagacguucaaagagugcaggagcuggccgaaguccuucgcgaggugacaugcagauccaaagaacugaccccgagcgcccagggauccuguaugggcgauagcugggagggcgcuccucccgccgcucauguuucucacgcccgguga

SEQ ID NO: 73808 - RNA, 5199 nt, Artificial Sequence
  derived and/or modified sequence opt5 from PKD1L3__Homo_sapiens__NP_853514
auguucuuuaagggcgggagcuggcuguggcucuacaucagaaccuccauuauccugggaucugagcuuaacagccccgccccucacggccagaauaacugcuaucaacugaaucgguuccaguguuccuuugaagaggcucagcacuacugccacgugcagagaggguuccucgcccauauuuggaacaaggaaguccaagaccugaucagagauuaucuugaggaaggaaagaagugguggauuggccagaauguuaugccgcugaagaaacaccaggacaacaaguaccccgcggauguggcugccaaugggccucccaagccucucucuuguacauaucugagccggaacuuuaucagaaucuccucuaaaggagacaagugccugcucaaauacuauuucauuugucagacgggcgauuuucuggacggcgaugcccauuacgagagaaaugggaacaauagccaccuuuaccaacggcacaagaaaaccaagcgcggaguggcuaucgccagagacaagaugcccccuggcccggggcaucugcccacaaccugccacuauccucuccccgcucaucuguccaaaacacuuugucacccuauuagccaguuccccucuguucuguccagcaucaccucucaggugacauccgccgcgagcgagccgucuucccagccucuccccguuauuacccaacugacgaugccugugagcgucacccacgccggacagucccuggcugaaacaaccucuagccccaaggaggaaggccaucccaacacauuuaccuccuaccuccaggugagccugcaaaaagccucugggcagguuaucgaugagauugcuggaaauuucucccgggccgugcacggccuucaggcgcugaacaagcuccaggaggccugcgaauuucugcaaaaacuuacggcucugacaccucgcuucagcaagccggcccaggucaaucucaucaacucucugaucuaucugagcgaggaacuccugcgcauucccuuucagaacaauaacucccuuggcuucaaagugccucccaccguguguccuuuccauucucugaauaacgucacaaaggcuggggagggaagcuggcucgaauccaagcggcacaccgagcccguugaggacauccuggaaaugagccuuguggaguuuggcaauauuggggaagccuuccuggagcagaaccaaucuccggaauccagcgugacccucacaucugccaaugcuacgcugcugcucucccgccagaacaucagcacccugccucuuuccucuuacacacugggacaucccgcgccugucagacucggcuuucccagcgcccuggcucugaaagagcuucucaauaagcacccuggggugaacguucagauuaccggacuggccuucaaucccuuuaaagaucuggacaaccggaauaucgugggcuccaucggcucuguccuccugagcgccaaccgcaaacuucuccaggugcacgaucucauggaggacauugaaaucaugcuguggagaaauguuucccuggagacacauccgaccagccuuaacaugucuacgcaccaacucacaauuaccgugaacgucaccucccuggagaagucccugaucgugucuauugacccugauagcccccugcugaugacacuuuaucugggguuccaguaccagcccaauugcacccauuuucaccucaacaucacacugccuaaggacaaggucuggcagaaagaugaggaauauacgugggugcugaauccggagcaccuucaacauggaaucggcaccuacuacauuacagcuguucucagcgagcggcaggaaggggcccagcaaacccccucucuggugagcgucaucacagcggugacccaguguuauuacugggagauucacaaccagacgugguccagcgcuggaugccagguuggcccucaaucuaccauccugagaacacagugccucuguaaucaucugaccuucuuugccuccgacuucuuuguggucccccgcacagugaacguggaagauaccauuaaacuuuuccugcggguuacgaauaacccugucggggugagccuccuggccucccugcuuggcuuuuaugugaucacagucgugugggcucgcaagaaggaccaggccgauaugcagaaaguuaaggugaccguccucgcugacaaugaucccucugcccaauuccacuaccugauucagguguauacaggauaccgccggagcgcggccaccaccgcuaagguugugaucacacuguauggcuccgaggggagaucugagccucaucaccucugcgacccccagaaaacggucuucgaacgcggaggccuggauguguuucuucugaccacauggaccagccucgggaaccugcacucccugcggcuuuggcaugacaauucuggaguuagcccguccugguacgugagccaggucaucgugugugacauggccgugaagagaaaauggcacuuccugugcaacuguuggcucgcugucgaucugggcgacugcgagcucgaucgcguuuuuauuccugugucuaagcgggaacuguucuccuuuagacaucuuuucagcucuaugaucguggagaaauuuacacaagacuaccuguggcucuccauugccacccgccaccccuggaaucaguucacgcggguccagagacugagcuguugcaugacacugcuucuguguaacauggugaucaauguuauguuuuggaagauuaacucuaccaccgcgaagcgggaugaacaaaugcgcccuuucgccguggcuugguccgagcuccuggucagcauccauacagccgugauccucuuucccauuaaccugguuaucgggagacuuuucccgcugauugagccucaggaaacccucccccuguuuccucccauccaggcuuccugccugagcgacgccucuguggagccccuuagcgccacaauggucguggaagaacugaaagaaacgguucgguuccuccugagacgcaauaccuaucuccuguccaagugugagcagccuccguggucuagcugggauauuacaaaacuugugaagcugcuguccucucucgucagcucccaccuggagggccaaggaugccaccagcagggcgaacggcauugggcuagaguggugcccgagaaccaccaucacuucugcuguuaccuucaccgcguccugcagagacucaaaucucaucuggggacccucggacugacacaaggccaccagagcugcgacuuucuugaugcggccucccagcugcagaagcugcaagaacuccuggagacccauauccuuccuacggaacaggagcccagccgggagguuaccucuuucgcuauccuguccagcgaagaggggaaaaagccuauuucuaauggacucuccaaguggcugacaagcguguguuggcuccugcuuggcuuuaccucccuggccucugccuucuuuacagcucuguauagccucgaacuguccaaagaccaggccaccagcuggaugaucucuauuauccuuuccgugcugcagaacauuuucaucagccaacccgucaagguggucuuuuucacauuucucuacucucugaugaugagccgcaugccuagacucaauaaagagaacgagcagcagaccaagcggauccuggcgcuucuggcuaaaugcuccucuagcgugccggggucccgcgauaagaauaaccccgucuauguggccccugccauuaauucucccacgaagcacccugaaagaacacugaaaaagaagaaacucuucaaacugaccggcgacauccuuguucaaauucuguuucucacccugcugaugacagcuaucuacagcgccaaaaacuccaaucgguucuaucuccaucaggcgauuuggaagaccuucagccaccaguuuucugagaucaaacuucugcaggauuucuaccccugggcuaaccacauucugcucccgucccuguacggagacuaucgcggcaagaaugccgugcuugaaccuagccauuguaaaugcgggguccaacugaucuuucagauccccagaacgaagacauacgagaaaguggacgaaggacagcucgccuucugugauaacggccauaccugcgggcggcccaagucccuguuuccuggacugcaucuccgcagauucucuuauauuuguagcccccggccuaugguccuuaucccgacagacgagcugcacgagagacugaccuccaagaaugaaaacggcuuuucuuacauuaugcgcggggcuuucuuuacaagccuccggcuggaguccuucaccagccuucagaugucuaaaaagggcugcgugugguccaucauuagccaaguuaucuauuaccugcucguguguuauuacgccuuuauccagggaugccagcugaaacagcaaaaguggagauucuuuacgggcaaacgcaacauucuggauaccucuaucauucucaucuccuucauucuucuggggcuggacaugaaaagcaucucucuccacaaaaagaauauggcucgguacagagaugaccaggaucgcuucaucagcuuuuaugaagccgucaaggugaacuccgcggccacacaucugguuggauuccccgugcuucuggcuaccguccagcucuggaaucugcugcggcacucuccuagacuccgcgugauuagccggacacuuuccagagccugggacgaggugguuggcuuucugcugaucauucucauccugcuuaccggguacgcuauugccuucaaccugcucuuuggaugcagcaucuccgauuaucggacguucuuuucuagcgccgucacaguggugggccugcugaugggcauuucccaucaagaagaggucuucgcucucgaccccgugcuugggaccuuucugauccugacaucuguuauccucauggugcuggucgugauuaaucuuuucguuagcgcgauccugauggccuuuggaaaagagcgcaagucccucaaaaaggaagcugcccugauugauacccugcuccagaaacuuucuaaccugcugggcaucagcuggccucagaagaccuccagcgagcaggccgcuacaacggccguggggucugacaccgaaguccucgaugagcugcccuga

SEQ ID NO: 73809 - RNA, 2907 nt, Artificial Sequence
  derived and/or modified sequence opt5 from PKD2__Homo_sapiens__NP_000288
auggugaacagcuccagaguccagccccaacagccuggcgacgccaagcggccgcccgcuccucgcgcccccgauccugggagacugauggcgggaugcgcugccguuggcgccucucucgcugcccccgggggacugugugagcagcggggccuugaaaucgagaugcagcgcauuagacaagcugccgcgcgggacccuccggccggggcugccgcuagccccuccccuccccugucuagcugcucccgccaggccuggucuagagauaauccuggauucgaagcggaggaagaggaggaagagguggaaggcgaggagggcgggaugguggucgaaauggacguggaguggcggcccggaagccgcagauccgccgcuagcucugccguuuccagcgugggcgcucggucucgcgggcucggaggcuaccacggggccggacauccguccggcagacggcgcagacgggaagaucagggcccucccuguccuagccccgucgggggaggcgacccccugcacagacaucuuccucuggaggggcagccgccccgcguggccugggcugaacggcucguuagaggacugcgcggccugugggggacccggcucauggaggagucuuccacaaacagagaaaaauaucuuaagagcgugcuucgcgagcuggucacguaccuccuguuucuuaucgugcugugcauucucaccuauggaaugauguccucuaauguguacuauuacacacggaugaugagccaacuguuccuggauaccccugucuccaaaacagaaaagaccaacuuuaaaacacucagcucuauggaggacuucuggaaguuuaccgaaggcucccugcuugauggccuguauuggaagaugcagcccagcaaucagacggaggcggacaacagaucuuucaucuuuuacgagaaucuccugcuugggguuccucgcauucggcagcugagagugcgcaacggaagcuguuccaucccccaagaucuccgggacgaaaucaaagagugcuacgauguguauucugucagcuccgaagacagagccccguucggcccucggaaugggaccgcuuggauuuacacaagcgagaaggaccugaacggaucuucccacuggggcaucauugccaccuauagcggggccggcuacuaucuggaucucucucgcacaagagaagagaccgcugcccagguggcgucccugaaaaagaauguuuggcuugaccggggaacgagagcuacauuuaucgauuucagcguguacaacgccaauauuaaccuguuuugugucgugcgccuccugguugaguuccccgccaccggcggggugaucccuuccuggcaguuucaaccccuuaaacugauucgguaugucacaaccuucgacuucuuucucgcugccugcgaaaucaucuucuguuucuucaucuuuuacuacguggucgaggaaauucuggagauuagaauccauaagcugcacuauuuccgcucuuuuuggaauugccucgaugugguuauugugguccugagcgugguugcuaucggaaucaacauuuacagaaccuccaacguggagguccuucugcaguuccucgaagaccagaauacauuuccuaacuucgagcaccuggccuauuggcagauccaauuuaauaacauugcggccgugacgguguucuuuguuuggaucaagcuguucaaauucauuaauuuuaaccggaccaugucucagcuuagcacaaccaugucccgcugugcuaaggaucucuucggcuuugccaucauguucuuuaucauuuuccuggcuuacgcccagcuggcguaucucgucuuugggacacagguggacgauuucagcaccuuucaagaaugcaucuucacgcaguuuagaauuauccugggagacauuaauuucgccgagaucgaagaggcuaaccgggugcuuggccccauuuacuuuacaaccuucgucuucuuuauguucuuuauccugcucaauauguuccuggccaucauuaacgauaccuauucugaggugaaauccgaccuggcucagcagaaggccgaaauggagcuuagcgaccucauccgcaaaggguaccauaaggcccugguuaaacugaagcucaagaaaaauacaguggaugacauuucugaaucccugagacaaggcggaggcaagcugaacuuugaugagcugcggcaggaccucaaagggaagggacacaccgaugcugaaaucgaggcgauuuucacaaaauacgaccaggauggcgaccaggagcugacggaacaugagcaccaacagaugcgcgaugaccuggaaaaggagagagaagaucuugaccucgaucacagcucucugccgcggccuaugagcucccgcagcuuucccagaucucuggacgacuccgaggaggaugacgaugaagacagcgggcauuccucucggagacgcggaagcaucuccucuggcgucagcuaugaggaauuucaggugcucguucggagaguggaucgcauggagcacuccaucgggucuauugucagcaagaucgacgccgugauuguuaaacuggagaucauggaacgggcuaaacuuaagagacgcgaggugcugggccggcuccuggauggagucgccgaagacgagagacugggccgcgauuccgaaauucaucgggagcaaauggagagacuugugcgggaggaacucgaacgcugggagagcgacgaugccgcuucucagaucucccacgggcugggaacccccgugggccugaaugggcagccuagaccgcggagcucucgccccuccagcucucaguccacagaaggaauggagggcgccgggggcaacggaagcuccaauguccauguuuga

SEQ ID NO: 73810 - RNA, 2277 nt, Artificial Sequence
  derived and/or modified sequence opt5 from PKD2L1__Homo_sapiens__NP_001240766
augaaccccagacggcgccacaccggcccuagaugcccggccgcugccagcaucuccgugaaggcgucugaggcuagccugcccuguccucucgggcuguggggaacaacgcuuaccgaaaauacagccgagaaccgggaacuguacauuaaaaccacacuccgcgagcugcuugucuauaucguuuuccugguggacauuugccuccugaccuacggcaugacauccucuagcgccuauuacuauaccaaggugauguccgaacuguuucuccauacgcccucugauaccggggucagcuuccaggcuaucuccagcauggccgacuuuugggauuucgcucaaggaccucugcuugacucucuguacuggacaaaaugguauaauaaccagucccucggccacgggagccauucuuuuauuuacuacgagaauaugcugcuuggagugcccagacugcggcagcucaagguucgcaacgauuccugugugguccacgaggacuucagagaagauauccugagcugcuaugacguguacucuccugauaaagaggaacagcugccguuuggccccuucaauggcaccgccuggacauaucauucccaagacgagcucgggggauuuagccacuggggccggcugaccuccuacucugggggaggcuauuaccuugaucugccugggagccgccagggauccgcggaggcccucagagcucugcaggaaggccuuuggcuggaccggggcacgcgcguuguguucaucgauuuuagcgucuauaacgccaauauuaaccucuucugugugcugagacugguggucgaguuucccgcuacagggggagccaucccuucuuggcagauucggaccguuaagcucauccgcuacguguccaauugggacuucuucauugugggcugcgaagucaucuuuuguguguucaucuuuuacuauguuguggaggaaauucuggagcuucacauccauagacugcgguaccucagcucuauuuggaacauccuggaccuugucgugauucugcucagcaucguugcggugggguuccacauuuuuagaacacuggaggucaaucgccugaugggaaagcuccugcaacagcccaacaccuaugccgauuucgaauuucuugcuuucuggcagacccaguacaauaacaugaacgccgugaaucuguuuuucgcuuggaucaaaaucuuuaaguauauuuccuucaacaaaacaaugacgcaacucucuagcacccuggcccggugcgccaaggacauccugggcuuugcugucauguucuucauuguguuuuucgcguacgcccagcuuggguaucuccuguuuggaacacagguugagaauuucuccaccuuuaucaaauguauuuucacacaauuuagaaucauccugggcgauuucgacuacaacgcuauugauaaugccaaccgcauccucggcccggccuacuuugugaccuaugucuucuuuguguucuuuguucugcuuaauauguuccuggcuauuaucaacgacacguacagcgaagugaaggaggaacucgccgggcagaaggaugagcugcagcugucugaccuucucaaacagggauauaauaagacacugcugcggcucagacugcgcaaagagcgggucuccgaugugcaaaaggugcuucagggcggggaacaggagauucaguucgaagacuuuaccaacacccugagagagcucggacaugcggaacacgagaucacagagcugaccgcuacauucacgaaauuugaucgcgacggcaaucggauucuggacgaaaaggagcaagagaaaaugagacaggaucuugaagaggaacgcguugcccucaacaccgagaucgaaaagcuggggcggagcaucgucucuuccccucagggcaagagcggacccgaggccgcuagagccggcggguggguguccggagaagaguucuacaugcugacacggcgcgugcuccagcuggagaccguccuugaaggcgugguuucucaaauugacgcuguggggagcaaacugaagaugcucgagagaaaaggauggcuggccccuucccccggcgucaaggaacaggcgaucuggaaacacccccagccugccccggcugugacacccgauccuuggggcguucaagggggacaggagucugaagugcccuauaagcgggaggaggaagcccuggaggaaagacgccuuagccggggcgagauuccuacccuccagagauccuga

SEQ ID NO: 73811 - RNA, 1482 nt, Artificial Sequence
  derived and/or modified sequence opt5 from PKDCC__Homo_sapiens__NP_612379
augagacggcgcagagccgcuguggccgcgggcuucugcgcuagcuuucugcucggguccguccugaacguucuuuucgcccccggaucugagccuccgcggcccggccagagcccugaacccuccccugcccccgggccuggacgcagaggcgggcggggagagcuggcucgccaaaucagagcccgguacgaagaggugcagcgcuauucuagaggcggcccggggcccggagcuggccggccugaacgcagacggcucauggaccuggcccccgggggaccuggccuuccccgcccgagaccucccugggcgcggccucugagcgauggggcccccggauggcccccugcuccgggccccggcuccccugggcccggaccuagacucggcugugccgcucugcgcaaugugucuggggcccaguacaugggaagcggcuauaccaaggcggucuaccgggugagacugcccgggggagccgcuguugcccucaaagcuguggacuuuuccggccacgaucugggcagcugcguccgcgaguucggggugcggagaggauguuaucgccuugccgcccauaagcugcucaaagagaugguucugcuugaacggcugagacacccgaacgugcuccagcuguacggcuauugcuaccaagacucugaggauauuccugacacacugacgaccaucacagaacucggggcucccgucgagaugauucagcugcuucagaccuccugggaggaucgcuuucggaucugucugagccucggaagacugcuucaucaccuggcgcauucuccucucggcuccgugacacugcuggacuuccgcccccggcaguuugugcucgucgauggggaacugaagguuaccgaccuugaugacgccagaguggaggaaacaccuugcgcuggcagcaccgauuguauucuggaguuccccgcccggaauuuuacgcucccgugcucugcccaaggauggugugaaggcaugaacgagaaacgcaaucuguacaacgcuuauagauucuuuuucaccuaccuucugccucacuccgccccucccagccuccggccccugcuggacuccaucgugaaugcgacaggggagcucgcuuggggagucgacgaaacccuggcccagcuugagaaggugcugcaccucuauagaucuggccaguaccugcagaacagcacagccuccagcucuaccgaauaucaaugcaucccggauuccacgauuccccaggaggacuaccgcuguuggccuagcuaucaucacgggucuugccugcuuagcguuuuuaaucucgcugaagccguggaugucugcgagucccaugcucagugucgggccuucgugguuacaaaccaaaccacauggaccggaagacagcugguguucuuuaagaccggcuggucucaggucgugcccgacccuaauaaaacaacguacgucaaggcgagcggguga

SEQ ID NO: 73812 - RNA, 6762 nt, Artificial Sequence
  derived and/or modified sequence opt5 from PKDREJ__Homo_sapiens__NP_006062
augagacccggaccugcccugcuccugcuuggggugggacugucccucuccgugggacggcugccgcuucccccuguuccccgcggggcucaggccgcggugucuggagcuccuggcgggcugcuccggggagcccccggccugggcgugagagggggacgcgcccugcucagccugagaccuuccgcuguccgggccggcggggcugugcuuucuggacgcggcagccugugcuucccgcacgggggaaccggcagacggugguacugucucgaccugcgcguucuucuguccgcccaaagacuccccuggccugcggcccccgcucuggcccugguggaucuccagcugucugcucggggcgggcgccuuagccugacaugguccgucagacucccucggagccccggacgccuggccugggcguuuagacuucggcugcucggcccgggggccgcuagaccugccucucccgcugcccgcguguccccucggagcgccgcucccggacccagaccucagcagggcuucguugcgcgcacggagugcccgaccgacgggcccgcccgggugaugcugcaagcugucaacucuuccagccauagagccguggaaucuuccgugagcugucagauuaaugccugcgucauucagcgcguucggaucaacacagaucagaagggagcuccugugagacuguccaugcaagccgaggcgaccauuaaugcuucugugcagcucgacugucccgccgcccgcgcuaucgcccaguauuggcaggucuuuagcgugccugcuguuggccaagcccccgauuggacacagccgcuggaccuuccucagcuggaaauucggaacagcccccuguucauccacaucccuaauaacagccugcaauggggcguguacgucuuuaauuucaccgugucuauuacaaccgggaaccccaagaugccugagguuaaggauuccgacgcgguguaugucuggaucgugagaagcucucuucaggccgucaugcugggagaugcuaauauuacggccaacuuuaccgaacagcucauccuggacggcagcacauccucugaucccgacgcugauagcccgcugcaggggcuccaauucuuuugguacugcaccacagacccucgcaauuauggaggcgaccggauuauccugggguccaaggaggugugucaucccgagcaggccaaccuuaaguggcccugggcgagcggcccuguucugacccuccugccggaaacgcugaaaggagaucacguguacuucuuuagaauggucauucggaaggacucucgcacagccuucuccgauaagagagugcauguucuucagggccccaaagcuaucgcccacauuaccugcaucgagaauugugaacggaacuuuaucgugagcgacagauucucucucuuccugaauugcacaaacugugcuucccgcgauuuuuauaaguggagcauucuguccucuagcgggggagagaugcuguucgacuggaugggcgagaccgucaccgggcggaacggagccuaccuguccaucaaagccuuugcuuucagacacuuucuugaagcggaguucucuauuagccuguaccucgccugcugguccggcgugacaagcguguuucgccauucuuucaucaucaaucacgggccucagauuggcgaaugcaagaucaaccccgcuaaaggaauugcccugaucacgaaguuuguuguccaauguuccaauuucagagauaagcaugugccucugaccuauaaaauuaucgugagcgaccuucacucugucggcgagaucuccagcgugaaggaaaacacacucgggaccauucuguaccugggaccccagucuacaguuccucccagcuuucucccggugggcaugcuggccucccaguaugggcuuaaaaucuacgcucaggucuaugauagccugggagccuucucucaagugacccuccacgcgacggcucaggccccuacagacaaaaauuccagcaaaaccguucugaaccagcugcuuuccuuuaccgugggccccucuagccuccuguccacacugauucagaagaaagauuuccucccugccggguaccugcuuuauaucgucgcuucugugcugaauaacaugaagaccgagcucccccugcgggacgaccgcguuaaucugagaaagcaucuuauugaucaauccuuccuccugccgguguccacacuggucgagaucggccagguggugaugacgauuaccaaacucacacagaagccuucugaauuuaccugggacgcccaaaaacgggcgacaaugcgcgucuggcaggcuaaccaggcccugcaggaguaccaacagaaggauaaaagauuccggagcgaacagaucgagaucguuuccaccggcauucuuaugagccugucuaauauccucaagaugacgagcccccaccagguggugaaggacccuuuuuacgucauugaaagccugucugauaccauccuggccaacaaagugcccggcaauaagacaaccuccaugcgcacacccaacuucaauauguauguuaaaaagguggagaaaugggggauuaaccaacuuuuuagaaacgagaagcauugccggaauuguuucuacccuacccugaacgucagcucugugccgggacucuccgcuaauggccccaucagcacgauguuuugcgacuucacaaacgaucuguuuccuuggcucaaugaccaggaaaacaccuccguugaggugagcggguuccgcaugacaggagucgccgauaauggcucugugcuggaaaucacccccgacguugcugagguguaucuugucagaaagaaccugaccuuugccgcguucaaucucacaguggggccuaacagcgaaguggauggcucccugaaaaagacgaccggaggcuuuucuuuccaggucgacagcacaguucugcgggaggugcuugugcacauugucaccgaggugaugguucuguucacagugcucgucuacaccgggucccagaucacgcccacagcccugguggcuaccuuucucguuccucaugauauuccgcccuucgccucucaaagcgcucuguuugacccugccuguaccgugaaaaaggccagagucgugugccuucccgucucccugcuccagcugaucgcucagcacucucacagcccucauuguacaguguccauuguucugcaagcgccccgcuucgugaugaaacuuaaugacaagcugguccggaucagcaucuuuucugugcagugccucgauauguauggcauucaguccgaauggagagagggcuacuguauccugggggaaaagaccagcugguaugagguucacugcauuuguaaaaacgugguccgcgcccggagacagcucggaacaaucggccugacgggcauucaucuucacacccacuacgugauggcuaaggugaucguuaucccgaauccugucgaccugcgccugaacauuaucaaaucucuccaucaaaaucccgugacacuguucaccgugcuuuuuauuauccugcucuacgucgggcuggccuucugggcccucuaucgggaugagauggaccagcaccugagaggacaugugauuguucuucccgauaacgacccuuacgauaaccugugcuaucuggugacaaucuuuaccggcucccgcugggggagcggaacgcgggcuaaugucuucgugcagcucagaggcaccguuuccacaucugacgugcacugccugagccauccccacuuuaccacacuuuaccggggguccauuaacaccuuccugcucacaaccaagagcgaucugggagacauccacucuauccgcgucuggcauaauaacgaaggcagauccccuagcugguaucucucucggauuaaaguggagaaucuguucagccgccacaucuggcuuuuuauuugucagaaguggcuguccguugauacgacacuggacagaaccuuccaugugacccacccggaugaacggcucacaagaaaagacuuuuucuuuaucgacgucucuagcaaccugcgcaagaaucauaugugguucuccauuuuugccucugugguggcgaagaccuucaaccggcuucaaagacugagcugcugucucgcuaugcugcucuccagccugcuuugcaauaucauguuuuucaaccugaaucgccaggagcagacggaaucucgggagagaaaauacaugcgcuccaugaugaucggcauugagagcguccugaucacaauucccguucagcuccugaucaccuuucuuuucacauguucccaacggaagccucaggccgaucugaaagaagugucuccccagaagcacccucucaugagcgaggccuccgaacacugggaggaauaucugagaaaauggcaugcuuacgagaccgccaaggugcacccccgcgaggucgcgaagccggcuucuaaagggaagccuagacugcccaaagccagcccuaaggccacauccaaacccaagcaucggcaccgcaaggcucagauuaaaaccccugaaacgcucggacccaacaccaauagcaacaauaacaucgaggacgaucaagacgugcacucugaacagcauccgucccagaaggaucuucaacagcugaaaaagaaaccuagaaucguucugcccugguggugcguguacgucgccugguuucucguguucgcuacaagcucuauuuccagcuucuuuaucguuuucuauggccugaccuacggguaugacaagucuauugaguggcuuuuugccagcuucuguuccuuuugccagucugugcugcucguccagcccagcaagaucauucugcuguccggauuccggacaaacaaaccuaaguacuguaaaaaucucagcugguccaccaaguauaaauacacggaaauccgccuugauggcaugagaaugcacccggaggagaugcaacggauucaugaccagaucgugagaauccgcgggacacggauguaucagccccugaccgaagaugagauuagaaucuuuaagcgcaaaaagcggauuaagagacgggcgcuccucuuccugucuuacauccuuacacacuuuauuuuccuggcccuccugcugauccucaucguccuucugcgccauaccgacugcuuuuacuauaaccaguucauuagagaucgguuuagcauggaccuggcuaccgugacaaaacucgaagacaucuaccgcuggcucaauuccguucuucugccucuccugcacaacgaucugaaucccacguuccucccugagucuagcuccaagauucuuggacugccccugaugagacaagugcgggccaaaucuagcgagaagaugugucucccugcugaaaaauucgugcagaacuccauccgcagagagauucacugccauccgaaguauggcaucgaccccgaagauaccaagaauuacagcggcuuuuggaacgaggucgacaaacaggccaucgaugaaucuacaaauggguucaccuauaagccucagggaacacaauggcuguacuauuccuacggccuucugcacaccuacgggagcggaggcuaugcccucuacuuuuuccccgagcagcagcgguuuaacucuacgcugcgccugaaagagcuccaagaauccaauuggcuugacgagaagacaugggcuguugugcuggaacugaccaccuucaacccugauauuaaucucuuuugcagcaucucugugauuuucgaggucucccagcugggggugguuaacacaagcaucucccuucauagcuuuucucuggcggacuucgauagaaaagccagcgcugaaauuuaucucuacguggccauccugaucuuuuuccuggccuaugucguggacgagggauguaucaucaugcaggagcgggcuuccuacgucagaucuguguauaaucuccuuaacuuugcccugaagugcauuuucaccguucugaucguccucuuccugcgcaagcacuuucuugcgacaggcauuauccgguucuaccugagcaaucccgaagauuuuauuccguuccacgcugugucccagguggaccauaucaugagaaucauucucggcuuucugcuguuccucacgauccuuaaaacccugcgcuacucucgguuuuucuaugauguuagacuggcccaacgcgccauucaggcugcccucccugggaucugucacauggcguuuguggucagcguguacuucuuuguguauauggccuucggauaccugguuuuuggccagcaugaguggaacuauuccaaccuuauucacucuacacagaccgucuucagcuacugcguguccgcuuuccaaaauacagaauuuagcaacaaucggauccuggggguccucuuccugucuuccuuuaugcuggucaugaucuguguucucauuaaccuuuuccaggccgugauccugagcgcuuaugaggaaaugaagcagcccguguacgaggagcccucugacgaagucgaggccaugaccuaccugugcagaaaacuccgcacgauguuuuccuuccugaccagccaguccaaggcuaaagacgaaccugaguuuuucauugauaugcuuuauggacaacccgagaaaaauucucaucgguaccugggccucaagacaagaaacaucaaugggaaaaagaugguguaucugguuguguga

SEQ ID NO: 73813 - RNA, 10191 nt, Artificial Sequence
  derived and/or modified sequence opt5 from PKHD1__Homo_sapiens__NP_733842
augaccgccuggcugaucagccugauguccauugaggugcugcuucuggcuguuagacaccugucucugcauaucgagcccgaggaaggaagccuugccgggggaaccuggauuacgguuaucuucgauggccuggagcugggggugcuguacccuaauaauggaucccagcuggaaauucaccucgugaacgucaauauggugguuccggcgcugcggucugugcccugcgaugucuuuccuguguuccuugaccugcccguugugaccuguagaacaagaagcguccucuccgaggcucaugagggccuguauuuucuugaagccuacuucgggggacaacuggugucuagcccuaaccccggcccucgggauuccugcaccuuuaaguucagcaaggcccagacaccgaucgugcaccaggucuaucccccuucuggcguucccgggaagcucauccauguguacggauggauuaucaccggccgccuggagacauuugacuucgaugcugaauauauugacuccccugugauccuggaggcccagggggauaaaugggucacccccuguagccucauuaauagacaaaugggaucuugcuacccgauccaggaggaccacggccuggggacgcuucagugucacguggaaggagauuauauuggcucccagaacguuagcuuuucuguguucaauaagggcaaauccaugguccauaagaaggcuuggcugaucagcgccaaacaagaccucuuucuguaccagacccacuccgagauccuuucuguguucccugaaacagggagccugggaggccggaccaacauuacaaucaccggggacuuuuucgacaauuccgcgcagguuacgauugccggaauccccugcgauauucgccaugugagcccuagaaagaucgaguguacaacccgggcucccggcaaagacguccgccucacaacaccccaaccugggaacagaggacugcuguucgaagugggcgacgccgucgagggccucgagcugaccgaagcuacaccgggguaccgguggcaaaucgugcccaaugccucuuccccuuuuggauucuggagccaggagggccagcccuuucgcgcgagacuuucuggguucuuuguugccccugaaacgaacaauuauaccuucuggauucaagcugauagccaggccucccugcacuuuucuuggagcgaggaaccccggacaaaggugaaagucgcuuccaucagcgugggaaccgccgacugguucgauucuugggagcagaaccgcgacgagggcacauggcagcaaaagaccccgaagcucgaacugcuugggggcgccauguacuaucuggaggcugaacaccauggaauugcgccuuccagaggcaugcggaucgggguucagauucacaauacguggcucaaccccgauguggucacaaccuaccugagagagaaacaucagauccgcgugcgggcccagagacugccugaagugcaaguucucaacgucagcggacgcggcaacuuuuuccugaccugggacaacgugucuucccagcccaucccugcuaaugccacagcccaccuuauucagaccacaaucgaggagcugcucgcugugaagugcaaacuggaaccccuguggagcaacauucuucuccggcugggguuugagagaggaccggaagucuccaauucugauggcgaccugacgagcgggaccgagccuuucuguggccgcuuuucccuccggcagcccagacaucuggugcuuacacccccugccgcgcaaaagggauaucgccuggaucaguacacccaccucugccuggcuuauaaaggccacaugaacaagauccugaaaaugauuguuucuuucacaaucggguuccagaauauggugaagaacaccacgugugacuggagccuuacccggacauccccggagagcuggcaguuugauugcaccgaccucugggaaacaugcgucagauguuucggagaccugcaacccccucccgccaauucuccugugcugguucaucagauuaaccuccugccccuugcccaggagaccggccuguuuuacguggaugaaaucaucauugcugacacgaaugucacagugucccaagccgauagcgggaccgcucgcccuggaggcaaccucguugagucuguguccgucguggggucucccccgguguacuccgucacaagcuggcuggccggcugcggaaccgaacugccucuuaucaccgcgcgguccguucccacagagggcacggaggaagggagcggacucgugcuggugaccacacagagacggcagcgcaccucuccuccccugggcgggcacuuccgcauucagcucccgaauacagucaucuccgacgugccuguucaaauuagcgcccaucaucugcaccagcuucugcagaacaaugcugaugacuuuaccucccgguaucucaacgccucugauuucacggugaaggaggaccuguacacauguuaugaacaugucuggacccugagcugguccacccagaucggagaucuucccaacuuuaucagagugucugacgagaaucucacaggcguuaacccugcugccgcgacccgcguggucuacgaugggggcguguuccugggacccauuuuuggcgacaugcuggccacagcuaaucaacacacgcagguugugguccgggugaacgaugugcccgcccauugcccugggagcuguuccuuccaguaucuccagggaucuaccccgugcguccacagcguuugguacuccaucgacggcgacauuaaucugaugaucuauauuacagggaccggauuuagcggcgauucucaauuccuucaggugacagugaacaaaaccuccuguaaggucaucuuuagcaaucagacgaacgugguuugccaaaccgaccugcuccccgugggcaugcauagaauccugaugcugguccgcccuucugggcuugcuauuuccgccacaggagaagaucuguuccucaaugugaaacccagacuggacaugguugagccuagccgggccgcugauaucggcgggcucugggcgaccauucgcggaucuucccuggagggcgugagccuuauccuguucggguccuacagcugugccauuaacgucgcuacaucuaauagcuccagaauccagugcaaggugcccccucggggaaaagacggccgcaucgucaacgugaccguuauuagaggcgauuacucugccgugcucccgcgggccuuuacauaugucagcucccugaaucccgugaucguuacccugucucgcaacauuagcaauaucgcugggggagaaacgcuugugauuggcgucgccagacugaugaacuacacagaccucgauguggaggugcacguucaggacgcgcuggcuccuguccacacccaguccgccugggggcucgaaguggcccugcccccucuucccgcuggacugcaucggaucucugugagcauuaacggcgucuccauccacagccaagggguggaucuccauauccaguaucugaccgagguuuucucuauugaaccguguugcggaucccugcuuggcggcacaauccugagcauuucugggaucggauuuucccgcgacccugcccucguguggguccuggugggcaauagaagcugcgauauuguuaaccucaccgaggcguccaucuggugugagacgcugcccgcuccccagaucccugacgccggggcccccacagugccugcugccgucgaagugugggcuggaaaucgguucuuugccagaggcccgucucccagccuuguugggaagggauucaccuuuauguacgaggcggccgcuacaccuguggucaccgccaugcagggcgaaauuacaaacuccagccugucucugcacgugggcggguccaaucucagcaacucugugauccugcuuggaaaucugaacugcgacgucgagacccagagcuuccagggcaauguuucccucucuggguguagcauuccccugcauucccucgaggcuggaaucuauccucuccaggugcgccagaagcaaaugggcuuugccaacaugucugugguccuucagcaguucgccgugaugccccggauuauggcuaucuuuccgagccagggguccgcgugcggaggcacgauccugaccguuagaggccugcuccugaauagccgccggagaucugugcgcgucgaucuuuccgggccuuucacaugugugauucugagccucggagaccacaccauccugugccaaguuucccucgaaggcgauccccugccuggggccucuuucagccuuaacgugacaguccuggugaauggacugaccuccgagugucagggcaacugcacgcucuuuauucgggaagaggcuucucccgucauggacgcccugagcacaaauaccuccgggagccuuacaaccgugcugaucagaggacagcgccucgccaccacagcugaugaaccuaugguuuucguggacgaucaacugcccuguaacgugacguuuuucaacgccucucacgucguuugccagacccgggaccucgcgccgggcccucauuaccuguccguguuuuauacaagaaauggcuacgcuuguagcgggaacgugucucggcacuucuacauuaugccccaggucuuucauuauuuccccaaaaauuuuucccuucacggaggcagccugcugaccaucgaggggacaggacuccgcggccagaacaccacgucuguguacauugaucaacagacaugccugaccguuaauaucggggccgagcuuaucagaugcauugugccuaccggaaacggcagcgucgcccuggaaaucgagguggacggccucugguaucacauuggggucaucggauacaauaaggcuuucacaccggaacugauuuccaucucucagagcgaugacauccugaccuuugccguggcgcagauuuccggcgcugccaacaucgacauuuucaucgggaugagccccuguguuggaguguccggcaaucauacaguccuccaaugcgugguuccuucucuucccgccggggaguaucacgugcggggcuacgauuguauucgcggaugggcuagcuccgcccuggucuuuacgucuagagugaucaucaccgcugugacagaaaacuucggcugccucggcgggcggcucguucaugucuucggggccggguuuagcccuggaaauguguccgcggccguguguggcgcucccugcagaguccuggccaacgcuaccguuucugccuucagcugucuugugcugccucucgacgugucccuggccuuucugugcgggcucaaacgcgaggaggauagcugugaagcugcgcggcacacauauguccagugcgaccuuaccguggccauggcuacggagcagcugcuggaaucuuggccguaccucuacauuugugaggaauccagccagugccuguucguucccgaucauugggccgagucuauguuuccuuccuucagcggccuuuuuaucucucccaagcuggagagagacgaagugcucauuuauaauuccagcugcaacaucaccauggagacagaagccgagauggagugugaaaccccuaaucaacccauuacagucaaaaucaccgagauucgcaagcgguggggacagaacacacagggcaauuucucccugcaauuuugcagacgcuggagccggacgcacucuugguucccggaaagacugccucaggauggggacaacgugaccguugagaacggacagcuccuucugcuggauacaaauaccagcauccucaaccugcuucacaucaagggcgggaaacugauuuuuauggcucccggacccaucgaacuccgcgcccaugcgauucugguguccgacggcggggagcugagaaucggcucugaggauaagccuuuccagggacgggcucaaauuacccucuacggcagcuccuauucuacacccuuuuucccuuacggggucaaauuccuugccgugcgcaauggaacgcugagccugcacggcucccucccggaagugaucgucaccugucugagagccacagcucaugcccuugacaccguucuggcgcucgaggaugccguggacuggaaccccggggacgaaguggucaucauuucuggaacaggcgugaagggcgcuaaaccuauggaggaaaucguuaccguggagacgguccaggauacagaccuguaucucaagagcccccuccgguacucccacaauuuuaccgagaacuggguggccggggaacaccauauucuuaaggcuaccguugcccugcugagccgcucuaucacaauucagggaaaucucaccaacgagagagaaaaacugcuuguguccugccaggaggcuaaugccccugaaggcaaccugcaacacugucucuauagcaugucugagaagaugcuggggucccgggauaugggagcgagagucaucgugcagagcuuccccgaggaaccgucccagguucagcugaaaggcgugcaauuucagguccucgggcaggccuuccauaagcaccuuucuagccugacacuggugggagcuaugcgcgaguccuuuauccagggcugcaccguccggaauagcuucucuagaggccucuccaugugugggacgcugggacuuaaaguggacagcaacgucuuuuacaauauucugggccaugcccuccugguggggacaugcaccgaaaugcgcuacaucucuugggaggcuauucacggacggaaggaugacuggagcggccacgggaacaucauuagaaauaacgucaucauucaaguguccggagccgagggccugucuaacccugaaaugcucacacccagcggcaucuauaucuguuccccuaccaaugugauugaggggaaccggguuugcggagccggcuacggguauuucuuucaucuuaugacgaaucagaccucucaggcuccccugcugagcuucacacaaaacaucgcgcacuccuguacccgcuacggacucuuuguguauccuaaauuccagcccccgugggauaaugucacaggcaccacacuguuucagagcuucaccgugugggaaucugccgggggagcucagauuuucagauccagcaaccuucggcugaagaauuuuaagguuuacuccugccgcgacuucggcaucgaugugcucgagucugacgccaacacgagcgucacagauucccugcugcucggccauuuugcccacaaagggucucuuugcaugagcuccggaauuaagaccccuaaaagaugggaacugauggugagcaauaccacauucgucaacuuugaccugaucaauuguguggcuauccggaccugcucugauuguucccaaggccaagggggauucacaguuaagacgagccagcucaaauuuaccaacucuuccaaucugguggccuuccccuuuccccacgcggccauucuugaggaccuggacggcagccucucugggaagaaccgcucccauauccuggcuagcauggagacacugucugccagcugccucgucaauuccagcuucggaagagugguucacggcuccgcuuguggcgggggagugcuuuuucaucggaugucuauuggccuggccaacaccccugaagucagcuaugaucugacaaugaccgacucccgcaacaagacgaccacagugaauuacgugagagauacccucucuaacccgcggggguggauggcgcugcuucuggaccaggagacauacagccuccaauccgaaaaucuguggaucaacagaucucugcaguauagcgccaccuucgauaauuuugcucccggaaacuaccuccugcuuguucacacggaccugccucccuauccugauauucuccugcgcugcggcucccgggucgggcuuagcuuccccuuccugccuucucccggacagaaucagggcugugacugguuuuucaacucccaacucagacagcugacauaccuggugagcggcgagggacaggugcaagucauccuccgcgugaaagaaggaaugccgccuaccaucucugccuccacaagcgcucccgagucugcccugaaguggucccuuccugagaccuggcagggcguugaagagggguggggaggcuauaauaacaccauucccgggccgggagaugacgugcugauccucccuaaucggacaguccugguggauacggaccuucccuuuuucaaaggccuguacguuaugggcacccucgacuuucccguggauagaagcaacguccugucuguggcuugcaugguuauugccgggggagaacugaaggugggcacacucgagaauccucuggaaaaagagcagaaacuucugauccuccugcgcgcguccgagggggucuucugugaccggaugaacggcauucacaucgaucccggcaccauugggguguauggcaaggugcaccuuuacagcgccuacccuaaaaauagcuggacacaccugggagcugacaucgccuccggcaacgaaagaaucauugucgaggaugcuguugacuggcgcccgcaugauaagaucgugcucucuagcuccucuuaugaaccccacgaggccgaggugcugaccgucaaagaagugaaggggcaucacguucggauuuacgagagacugaaacaucgccacaucggaagcgugcacgucacggaagacggccggcauauuagacucgccgcggagguggggcugcuuacacgcaacauccagauccaaccugauguuuccugcagaggacggcuguuugugggcucuuuccgcaagagcuccagagaagaguuuagcgggguccuccagcugcuuaauguggagauucagaacuucggcucuccccuguauuccagcgucgaauuuucuaauguguccgcuggaagcuggaucauuuccucuacccuccaccagagcuguggcgggggaauccaugccgcugccucccacggcguucugcugaacgacaauauuguguucgggaccgccggacacggcaucgaucucgaggggcaggcuuacacagucaccaacaaucuggugguucuuaugacacagccugccuggucuacgaucuggguggcgggcauuaaggucaaccaggugaaagacaucaaucugcauggaaacgugguugccggcagcgaacggcucggguuucacauuagaggacauaagugcuccagcugcgagcugcuuuggucugauaaugucgcucacuccagccugcauggccuccaccuguauaaagaaucugggcuggacaacuguacccggaucagcggauuccucgccuucaagaauuuugacuacggcgcuaugcugcacguggagaacuccguggagauugaaaauaucacacuugucgauaacaccaucgggcugcucgccgugguuuauguguucucugcgccccagaacagcgucaaaaaggugcaaauuguucugcgcaauuccgugaucgucgccacaagcucuagcuuugacugcauucaggauaaagugaagccucauagcgcuaaccuuaccuccacggacagagccccgucuaauccccggggcggacgcaucggcauucuguggccuguguucaccagcgagcccaaccaguggccucaagaacccuggcacaagguuagaaaugaucauuccaucucugggauuaugaaacuccaggacgucacauuuagcuccuucgugaagucuuguuacagcgaugaccuggaugugugcauccugccgaacgcugaaaauuccggaaucaugcacccuauuaccgccgaacggacacgcaugcucaaaaucaaggacaaaaacaaguuuuacuuccccagccugcagcccagaaaggaucuuggcaaagucguuuguccugagcuggacugcgcuucuccccggaaguaucucuuuaaagaccuggaugggcgcgcccuuggacugccuccgcccguguccguguucccuaagaccgaggcggaauggacagccagcuuuuucaaugcugucaccacggagcaggcccucaaaauuucugaauga

SEQ ID NO: 73814 - RNA, 231 nt, Artificial Sequence
  derived and/or modified sequence opt5 from PKIA__Homo_sapiens__NP_006814
augaccgacguggagacaacguacgccgauuucaucgcuagcggcagaaccgggcggcgcaacgccauucacgacauccuggucuccucugcgagcggaaauuccaacgaacucgcucugaaacuugccggccuggauauuaauaagacagagggggaagaggacgcccagagaucuagcaccgaacaauccggagaggcucagggcgaggccgcuaagucugaaagcuga

SEQ ID NO: 73815 - RNA, 258 nt, Artificial Sequence
  derived and/or modified sequence opt5 from PKIB__Homo_sapiens__NP_001257323
augagccaccaggacguggccaugagaaccgauuccucuaagaugacagacgucgagagcggcguugcuaacuucgccuccucugcgcgggcugggcgcagaaaugcccugcccgauauccaaagcuccgccgcuacggacggaaccucugaucucccucugaaacuugaagcccugagcgugaaggaggacgcuaaagaaaaggaugagaaaacaacccaggaccagcucgaaaagccgcagaacgaggagaaguga

SEQ ID NO: 73816 - RNA, 1725 nt, Artificial Sequence
  derived and/or modified sequence opt5 from PKLR__Homo_sapiens__NP_000289
augagcauccaggagaacauuuccucucugcaacucagaagcuggguguccaagucucagcgggaccuggccaaaagcauccuuauuggcgcucccgggggaccugccggcuaccugcgcagagcguccgucgcucagcucacccaggaacuggggacagccuucuuucaacagcagcagcuuccggccgcuauggccgauacguuccuggagcaccucugccugcuggacaucgauucugaacccguugcugcccggagcaccuccauuaucgcgacaaucggaccugccagccgcucuguggagagacucaaggaaaugauuaaagcuggcaugaauaucgcccggcugaacuuuucccaugggagccacgaguaucaugcugagucuauugccaaugugcgcgaagcggucgaguccuucgccggaagcccccuuucuuacagaccuguggcuaucgcccuggacaccaagggccccgaaauucggacaggcauccuccaagggggaccugaguccgagguugaacuggugaaaggcagccagguccuugugaccguugauccggcuuuucgcacaagagggaacgccaauaccgugugggucgacuaucccaacauugugcggguggucccuguuggaggccgcaucuacaucgaugacgggcugauuucccucguggugcagaagaucggacccgagggccuggucacccagguggaaaauggcgggguucugggaucuagaaagggcgugaaccucccuggggcccaagucgaucugcccggacuuagcgagcaggacgugcgggaucugcgcuucggcguugaacacgggguggacauugucuuugcuuccuucgugagaaaagcgagcgaugucgccgcugugcgggccgcccucggaccggagggccauggcaucaagauuaucucuaaaaucgagaaucacgaagggguuaagagauuugacgagauucuggaaguguccgacggaaucauggucgcucgcggcgaucuugggauugagaucccugccgaaaaaguguuccuggcgcagaagaugaugauuggacgguguaaccucgcuggcaagcccguugugugcgccacgcaaaugcuggagagcaugaucacaaaaccuagacccacccgcgccgagacaucugacgucgcuaaugccgugcuggauggggcugacuguaucaugcucagcggcgaaaccgccaagggaaacuuucccguggaggcgguuaaaaugcagcacgccauugcucgggaagccgaggcugccgucuaucauagacagcuguucgaggaacuucgccgggcggccccucuguccagagauccgacggaggugacagcuaucggcgccguggaagcugccuuuaagugcugugccgcugcgauuaucguccucaccacaaccgggcgcucugcccagcugcuuagccgguacagaccccgcgcugccgugauugccguuacccgguccgcucaagccgcgagacaggugcaccugugccggggagucuucccucuccuguaucgcgagcccccugaagcuaucugggccgacgauguggacagacggguucaguucggcauugagagcgggaaacugagaggauuucuccgcgugggcgaucuggucaucgugguuacaggguggcggcccggcucuggauacacgaauaucaugagagugcuuuccauuagcuga

SEQ ID NO: 73817 - RNA, 1818 nt, Artificial Sequence
  derived and/or modified sequence opt5 from PKM__Homo_sapiens__NP_001193725
augcaguggagcuccgagagaggcgaacggcugcucacccccggggccugcucuagcgaggugccuuccgcugucccgucucgcagcggaggcucccccgggcacacaguuuucucuagcgaaagaucccugcuugugcggccucgcagccaucccgagccuaagggagaacacuacgugacgggcucucccaccccugagaaccaaagaacauccgccgcgaugagcaaaccgcauucugaggcugggaccgccuuuauccagacacagcagcugcacgccgcuauggccgacaccuuccucgaacauaugugucggcuggauauugacuccccucccaucacagcucgcaauaccggaauuaucugcacgauuggccccgccagcagaucugucgagacccuuaaggaaaugaucaaauccggcaugaacguggcgcggcugaauuuuagccacgggacacacgaguaucaugccgagaccaucaagaacguucgcacagcuaccgaauccuucgccucugauccuauucucuacagacccguggcugucgcccuggacacgaaaggaccggagauccggacaggccugauuaaggggagcggaaccgcggaaguggagcucaagaaaggcgccacacugaagaucacccuugauaaugcuuauauggaaaaaugugacgagaacauucuguggcucgauuacaagaauaucugcaaaguuguggaggucggguccaagauuuauguggacgauggacugaucagccuucaagugaagcagaaaggcgccgacuuucuggucaccgaaguugagaacggcgggucucucggauccaagaaaggcgugaaucugccuggggcugccguggaucugcccgccgucagcgaaaaggacauccaggaucucaaauucggaguggagcaggacguugacaugguguuugcuucuuucauucgcaaggcgagcgauguccacgaagugagaaaaguucugggcgagaaggggaagaacaucaaaauuaucuccaagauugagaaucaugaaggagugcggcgcuuugacgagauccuugaagccucugauggcaucauggucgcuagaggcgaccuggggauugagaucccugccgaaaaaguguuccucgcccaaaagaugaugauuggacgguguaacagagcuggcaaacccgucaucugcgccacacagaugcuggagagcaugauuaagaagccccgcccuacgcgggcggagggguccgauguggcuaaugccguucuugacggagccgauuguaucaugcugagcggcgaaaccgcuaaaggggacuacccgcucgaggccgugagaaugcagcaccugaucgcucgcgaagccgaggcggccauguuucaccggaagcuguucgaggaacucgucagagcuucuucccauagcacagaucugauggaggccauggcuaugggcucuguggaagccuccuauaaaugccuugcggccgcucugauuguucucaccgagagcggacgcuccgcccaccagguggcucgguacagaccccgcgccccuaucauugccgucacacggaacccccaaaccgcuagacaggcgcaucuguaccgcggcaucuuuccugugcuuuguaaggaccccgugcaggaagccugggcugaggauguugaccugcgggucaauuucgccaugaacguggggaaagccagaggauucuuuaagaagggcgacguggucauugugcucacgggguggcggccgggaucuggcuucacaaacaccaugcgcguugugccuguccccuga

SEQ ID NO: 73818 - RNA, 1293 nt, Artificial Sequence
  derived and/or modified sequence opt5 from PKMYT1__Homo_sapiens__NP_001245379
augcuggagagauggcaccagcuccaaccccggcgcgugagcuucagaggcgaagccuccgagacccugcagucuccuggguacgacccgagccggcccgaauccuuuuuccagcagucuuuucaacgccuuagcagacugggacauggcuccuauggggaggucuucaagguucggucuaaagaagauggacgccucuacgcugugaagagaagcauguccccuuuucggggccccaaagaccgcgccagaaagcuggcggagguggggagccacgagaaagucggacagcauccuugcugugugcggcuugaacaggcuugggaggaaggcggcauccuguaucuccagacagagcugugcgggcccucucugcaacagcacugugaggccuggggagccucccucccugaagcucagguuuggggcuaccugcgcgauacgcuucuggcccucgcucaucugcacagccaggggcuugugcaccuggacgucaagccggccaacauuuuccucggacccagaggccggugcaagcugggggauuuuggacugcucguggagcugggcaccgcgggcgccggggaaguucaagagggagacccucgcuauauggcucccgaacuucugcagggcucuuacgggacagccgcugauguguucucccucggacugaccauccuugaggucgccuguaauauggagcugccucauggcggggaaggauggcagcaacucagacagggcuaucugcccccggaguuuacagcgggccugagcucugaacuccgguccgugcuggugaugaugcuugagccugaccccaaacugagagccaccgcugaagcccuccuggcccuuccuguccugcgccagccccgggcuuggggaguucucuggugcauggccgcugaggcgcugagcagagggugggcccuguggcaggcucuccuggcccuucuguguuggcucuggcacggccuggcccaucccgcuuccuggcugcaaccucuugggccgcccgccacaccucccggaucuccucccugcagccuccugcuggauuccagccucucuuccaacugggacgaugacagccugggcccgucucuuagcccugaggcggugcuggcucgcaccgugggguccacgucuacaccccggagcagauguaccccucgcgaugcccucgaccuguccgacauuaauagcgaacccccucggggcucuuuccccuccuuugagccgagaaaccugcuuagccucuucgaagauacccuggacccuacauga

SEQ ID NO: 73819 - RNA, 2829 nt, Artificial Sequence
  derived and/or modified sequence opt5 from PKN1__Homo_sapiens__NP_002732
auggccagcgacgcugugcaguccgagcccagaucuuggagccugcucgaacaacugggccuugccggggcggaucuggcugccccuggaguccagcagcagcucgagcuggaacgggagcgccuuagacgggaaauccgcaaggagcugaaacucaaggagggcgccgaaaaccugagacgggcuaccacagaccuggggcgcucccucggaccgguugagcugcuucugagaggcucuagccggcgccucgaucugcuucaccaacagcugcaggaacuccaugcccacguggugcugcccgacccugcugccacgcaugaugggccccaguccccuggagcgggcggcccuaccugcucugccacaaaucugagcagagucgcugggcucgagaaacaacuggccauugagcuuaaggugaaacagggagcugaaaacaugauccagaccuacuccaauggcagcacaaaggaccggaagcugcuccugaccgcccagcaaaugcuucaggauucuaaaacaaagauugacaucauucgcaugcagcugagacgggcgcuccaagccgggcagcuggagaaccaggcugcccccgaugacacccagggauccccggaucugggcgcuguugaacuccgcaucgaggaacugagacaccauuuccggguggagcacgccgucgccgagggggcuaaaaaugugcuuagacugcucagcgcggccaaggcucccgaccgcaaagccguuucugaagcccaagagaagcugacggaauccaaccagaaacuuggacugcuccgggaggcucuggaaagacgccugggcgagcucccugccgaucaccccaagggccggcugcuuagagaggaacuggcggcugccagcucugccgcuuuuuccacccgccucgccgggccuuuccccgcuacacauuauagcacccuguguaagccggccccucugacaggaacccuugaggugcgggucgugggcugcagagaccuccccgaaacgaucccuuggaaucccacacccuccaugggagggccuggcaccccggacucucggcccccuuuucugagccgccccgcgagagggcuguacucccgcagcggaucucucuccggccggagcucucugaaagccgaggcugaaaacacaagcgagguguccaccguccuuaagcuggauaauaccguugugggccagacaucuuggaaaccuugugggcccaacgccugggaccagagcuucacgcucgagcuggaaagagcucgggagcuggaacuugccguguuuuggcgcgaucaaagaggacucugcgcgcugaaguuccugaaacucgaggacuuucuggauaaugagcggcacgaaguccagcuugacauggagccgcagggcugucugguggccgaaguuaccuucagaaacccugugauugagcgcaucccccggcucagacgccagaagaagauuuucuccaaacaacaggggaaggcuuuccagagagcccggcagaugaauaucgaugucgcuacaugggugcgccugcugagacggcuuauuccuaacgccaccggaacaggcaccuuuagccccggggccucuccuggcuccgaagcucgcacgacaggagacaucagcguugagaaacucaaucugggcaccgauucugacuccagcccccaaaaguccucuagagauccgccuagcucccccucuagccuguccagccccauucaggagucuaccgcgccugaacucccguccgagacacaggaaacccccgggccugcccugugcagcccccuucggaaaucuccucugacacucgaggacuucaaguuucuggcugugcugggacgcggccauuucgggaagguccuucucuccgaauuuagacccagcggagagcuguuugccaucaaagcccugaagaaaggcgacaucguggcucgggaugaggucgaaucucucaugugugagaagcgcauucuggccgcggugacgagcgcugggcacccuuuccuuguuaaccuguuuggcugcuuccaaacccccgaacacguguguuuugucauggaguauuccgccggaggcgaccucaugcugcauauccacagcgauguguucucugaaccgagagccaucuuuuacuccgcuugcguugugcuggggcuucaguuccugcaugagcacaaaauugucuaucgggaccucaagcuggauaaccuccugcuugacacagagggauacgugaagauugccgauuuuggccuguguaaagaagggaugggauauggcgacagaaccagcacauucugcgggaccccugaguuucucgcgcccgaagugcugacggauaccuccuacacacgcgcuguugacugguggggccugggaguccuucuguacgagaugcucgugggcgagucuccuuuccccggggaugacgaagaggaaguguuugauagcaucgucaaugacgaggugcgguauccgagauuccuguccgccgaagccaucggaauuaugcgccggcuccugagacgcaacccugagcggagacuuggcucuagcgagcgcgacgcugaagauguuaagaaacagcccuucuuucggacccuggggugggaggcccuccuggcuagacggcugccuccucccuucgugcccacacuuuccggacgcaccgacgucucuaauuuugaugaagaguucacgggcgaagccccgacacugagcccucccagagacgcgcggccccucaccgccgcugagcaggccgcuuuucuggauuucgacuuuguggccgggggcugcuga

SEQ ID NO: 73820 - RNA, 3036 nt, Artificial Sequence
  derived and/or modified sequence opt5 from PKN2__Homo_sapiens__XP_011540071
auggccagcaaccccgagagaggcgaaauccugcucaccgagcugcagaauugcgggcacuccggaggccuugcuuguuucauuuacugggaauuucaagggugggagaaggugcagaacgaaaaaucuggagacagccggucccugccuuucucugagaaugucagcgccguucagaagcucgauuuuuccgacacaauggugcagcaaaaacuggaugacaucaaggaucgcauuaaaagagagauccggaaggaacuuaagauuaaagagggcgcggaaaaccugcgcaaggugacgaccgacaaaaagucucucgcuuaugucgauaauauccugaaaaagagcaacaagaaacuggaggagcuccaucacaagcugcaggaacuuaaugcccauaucgugguuuccgacccggaggauauuacagacugccccagaaccccugauacacccaacaaugacccucgguguagcaccucuaacaaucgccugaaagcccuccagaagcagcuggauaucgaacuuaaagugaagcaaggggcugagaacaugauucagauguacuccaauggaagcucuaaagacagaaagcugcacggcacagcccagcagcuccugcaagacuccaagaccaaaaucgaagucauucggaugcagauccugcaggcugugcaaacgaacgagcucgccuucgauaaugcgaagcccguuauuagcccucuggagcuucgcauggaagaacugagacaucacuuucggaucgaguucgccguggcugagggcgccaaaaacgucaugaagcuccuggggucuggaaaagugaccgaccgcaaggcucuuuccgaagcccaggcgagauuuaacgagagcucccagaagcuggaucuccugaaauauucucuggagcagcggcucaaugaagugccgaagaaccaccccaaaagccgcaucauuaucgaggaacugucccuugucgccgcuagcccuacacugucucccagacaauccaugauuagcacccagaaucaguacucuacacucagcaagccugccgcucugaccggcacgcuugagguucggcugauggggugccaggacauccucgaaaacgugcccggaagauccaaagccacaucuguggcccugccgggcuggagcccuuccgagacccgcagcucuuucaugucccggacaagcaagucuaaguccgggagcuccagaaaucugcucaaaaccgaugaccugucuaacgaugucugugcugugcuuaagcuggacaauaccguugugggacaaacaagcuggaaacccauuuccaaccagucuugggaucagaaguuuacgcucgagcuggaccgcagccgggaacuggagaucuccgucuauuggagagauuggcgcagccuuugcgcggugaaauuccuccggcuggaagacuuucuggacaaucagagacauggcaugugucucuaccuggagccucaaggcacccuuuucgccgagguuacauuuuucaaccccgugaucgaacgccggcccaagcugcagagacagaagaaaauuuucucuaagcagcaagggaaaaccuuucuccgcgcuccucagaugaauaucaacauugccacauggggacggcuggucagacgggccaucccgaccgugaaucacuccggcacguucagcccccaggcuccuguccccacaaccgugccuguuguggauguccgcauuccccaacuggccccgccugcgucugacuccaccgugacaaaacuugauuuugaccucgagcccgaaccucccccugcucccccgagagccagcucucugggggagaucgaugaaagcuccgagcugcggguucucgacaucccuggacaggauagcgagaccguguucgacauucagaacgauagaaauucuauccugcccaagucccagagcgaauauaagcccgacacaccucaauccggccuugaguacucugggauucaggaacuggaggaucgccggagccagcagagauuucaauucaaccuccaggacuuucgcugcugugccguccugggaagaggccauuucggcaaagugcugcuugcugaauacaagaacacgaaugagauguuugccaucaaggcucucaaaaagggggauauuguggcccgggacgagguugacucccugaugugcgaaaaacgcaucuucgagaccgucaacucugugagacacccguuucuggugaaucucuucgcguguuuucagacaaaggaacacgucugcuucgugauggaguaugccgcuggaggcgaucugaugaugcauauucacaccgacguuuucagcgaaccccgggccguguuuuacgcugccugcgucgugcuugggcugcaguaucuccaugagcacaaaaucguuuaccgcgaucugaagcuggacaaccuucuccuggauacagagggauucgugaagaucgcggacuuuggccuguguaaagaagggaugggcuauggagauagaaccuccacguucugcggcaccccugaguuucucgcccccgaaguccugacagagaccucuuacacacgggcuguggacuggugggggcuuggaguucugauuuaugagaugcucgugggcgaaagcccuuuccccggggaugacgaggaagaggucuuugauuccaucgugaaugacgaagugcgcuacccuagauuccugagcaccgaggccauuucuaucaugcggcgccugcuuagacggaaccccgagagacgccugggagcuuccgaaaaggaugccgaggacgucaaaaagcauccguuuuuccggcucauugacuggagcgcccugauggauaaaaagguuaagccucccuuuaucccuacgaucagaggccgcgaagacgugucuaauuucgaugacgaguuuacauccgaagcucccauucucaccccgccucgggagcccagaauccugagcgaggaggaacaagaaauguuccgcgauuucgacuacauugcggauugguguuga

SEQ ID NO: 73821 - RNA, 2670 nt, Artificial Sequence
  derived and/or modified sequence opt5 from PKN3__Homo_sapiens__NP_037487
auggaggaaggcgcccccagacagccugggccgagccaauggcccccugaggacgaaaaggaggugauccggcgcgcuauucagaaagaacugaagaucaaagagggagucgagaaccucagacggguugccaccgaucgcagacaccugggccaugugcagcagcuucugcgguccucuaaucgcagacucgaacaacugcacggggagcuucgggaacugcaugcgcgcauucuccugcccggaccuggccccgggccugcugagccgguggccagcggacccagaccuugggccgagcagcugcgggcucgccaccucgaagcccugagacggcagcuucaugucgagcugaaggugaaacagggcgcugaaaacaugacacacacgugcgccuccggcacccccaaggagcgcaagcuccuggcggccgcucaacagaugcuuagagacucucagcugaaaguugcccuccugcggaugaagaucagcucccuggaagccucugggagcccugagcccggaccggagcuccuggccgaggaacuucagcacagacugcauguggaagcggccgucgcugagggcgccaaaaaugugguuaagcuccuguccagccgccggacacaagauagaaaagcucuugccgaagcccaggcucagcugcaagagucuucccagaagcucgaccugcugcgccucgcgcuggagcagcuucuggaacagcucccucccgcccacccucugcggagcagagugacccgcgagcuucgggcugccguccccggguacccccaaccuucuggaacaccggugaagcccaccgcccugacaggcacccuccaggugagacugcuggggugugaacagcuccugacggcugucccuggacgcucccccgccgcggcucuugccagcucuccuuccgagggcuggcugcggaccaaagccaagcaucagagaggccgcggggaacucgcuagcgagguucuggccgugcugaaaguggauaaccgggucgugggacaaacaggcugggggcagguugcugagcaguccugggaccagaccuucgugauuccccuugaaagagcccgggagcucgaaaucggaguccacuggcgcgauuggagacaacugugcggcguggcguuucugcggcucgaggacuuccuggauaaugccugucaccagcuuucucugagccucguuccgcaggggcugcuguuugcucaggugacauucugcgacccugucaucgagagacgcccccggcuucaaagacaggaacgcaucuuuuccaagagacggggacaggauuuccuccgcgccagccaaaugaaccugggcauggcugccuggggcagacuggugaugaaucuccugccucccuguucuuccccuagcaccauuucucccccgaaagggugcccucggacgcccacaacccuucgcgaggcgagcgaccccgccacaccuuccaacuuucugccgaagaaaacaccccucggagaagagaugaccccucccccuaagcccccuagacuguaucugccccaggaaccgaccucugaggagacgccucggaccaagcgcccccauauggaaccuagaacacggcgcggccccagcccgccugcuucccccaccagaaaaccuccccggcuucaggauuucagaugucucgccguccuggggcgcggacacuuuggcaaggugcugcucguucaguucaaagggacaggcaaguacuaugcuauuaaagcccugaagaagcaagaggugcuuagccgggacgaaaucgagucucuguacugcgaaaaacgcauucucgaggccgucggauguaccggccaucccuuucugcugucccuucucgcuugcuuccagacgagcucucacgcguguuuugugacagaguucguuccugggggagaccugaugaugcagauccaugaagauguguucccggagccccaggccagauuuuaugucgcuugcguggugcugggccuccaauuccugcacgaaaagaaaauuaucuaccgggaccuuaagcuggauaaucuccugcuggacgcccagggguuucuuaaaaucgccgauuucggacugugcaaggagggcauuggguuuggcgacagaaccuccaccuucuguggaacaccugaauuucucgcucccgagguucugacccaggaggccuauacacgcgcggucgauugguggggccucggggugcugcuuuacgaaaugcuggugggagagugcccuuuccccggcgacacggaagaggaggucuuugauuguaucgugaacauggacgcuccuuacccgggguuccucagcguucagggacuggaauuuauucaaaagcugcuucagaaaugccccgagaagcggcugggcgccggggaacaggaugccgaggaaaucaaagugcaaccuuucuuuagaaccacaaauuggcaggcucuccuggcccgcaccauucagcccccuuucguccccacacucuguggcccggcggaccugcgguauuucgagggagaguuuaccggccuuccucccgcucugacgcccccugcuccccacucccuccugaccgccagacagcaagcugccuuccgggacuuugauuucgugucugaacgcuuucuggagccuuga

SEQ ID NO: 73822 - RNA, 960 nt, Artificial Sequence
  derived and/or modified sequence opt5 from PKNOX1__Homo_sapiens__NP_001273187
auggugaaggccauccagguccugcggauucaccuccuggagcuugaaaaaguuaacgagcugugcaaggacuucuguagcagauacaucgcuugccucaaaaccaagaugaacuccgaaacacugcuuucuggcgagcccgggagcccuuauuccccggugcaaucucagcagauucagagcgccaucacgggaaccauuucuccccaaggcaucguggucccugcguccgcucugcagcaggggaauguggccauggccacaguugcuggaggcaccguguaccagcccgucacagugguuaccccucaaggccagguggucacacagacccucagccccggaacgauccgcauucaaaauucccagcugcagcugcagcucaaccaagaucugagcauccuucaucaggacgaugggucuuccaaaaauaagagaggcgugcugccuaagcacgccaccaacgugaugcggagcuggcucuuucagcauauugggcacccguaucccacagaagacgagaaaaagcagaucgcugcccaaaccaaucugacacuucugcaggucaacaauugguucauuaacgcgcgcagacggauccuccagccuaugcuggauucuuccuguagcgagacccccaaaacgaagaaaaagacagcccagaaucgcccuguucaaagauuuuggcccgacucuauugcuuccggaguggcccagccgccucccagcgaacugaccauguccgagggcgcuguggucacaaucaccaccccugugaacaugaauguugauucucuccagagccuguccagcgacggggccacacuugcggugcagcaagucaugauggccggacagucugaagaugaguccguggacagcacggaggaagaugcuggcgcccuggcucccgcccauaucucugggcucguucuggagaacagcgacucccuucaguga

SEQ ID NO: 73823 - RNA, 1332 nt, Artificial Sequence
  derived and/or modified sequence opt5 from PKNOX2__Homo_sapiens__XP_005271700
augaccgccacagcucagcccccuagcaaggcccaagcggugcacaucuccgcuccgucugccgccgcuagcacgcccgucccuuccgcccccauugacccucaggcucagcuggaggccgauaaaagagcgguuuaccggcauccccucuucccucugcuuacccugcucuuugaaaagugcgagcaggccacacaaggcucugaauguaucaccagcgcuuccuucgacguggauauugagaacuuugugcaccagcaggaacaggagcauaaaccguucuuuucugacgaucccgagcuggacaaucuuauggucaaggccauccaagugcugcgcauucaccuccuggaacuggagaaaguuaacgaacucugcaaggauuucuguaauagauauaucacaugccugaagaccaaaaugcauagcgacaaccuucugcggaaugaucucgggggaccuuacucccccaaccagccuagcaucaaucugcacucucaggaccuucugcagaacucccccaauagcaugucuggcguguccaacaauccgcaagggauugucgugccugcuagcgcccuccagcagggaaacaucgcgaugacaaccguuaauucucaaguggucuccggcggggcccuguaucagcccgugacgauggugaccagccagggacaggucguuacacaagcuauuccucagggcgccauccagauucagaacacccaagugaaucuggaucucacaucccugcuugacaacgaggauaagaaaucuaagaacaaacgcggcgugcugcccaagcacgcuaccaauaucaugagaagcuggcucuuucagcaucugaugcaccccuacccuacggaggacgaaaagcggcagauugccgcccagacaaaccuuacccugcuccaagucaauaacugguucaucaaugcucgcagacggauccugcagccgaugcuggacgcguccaaccccgauccugcccccaaagcuaagaaaauuaagagccagcaucgcccuacacagagauuuuggcccaauucuaucgccgccggggugcuccaacagcagggaggcgcuccggggaccaacccugacggauccauuaaucuggauaaccuucaaagccugucuagcgacuccgccaccauggcgaugcagcaggcuaugauggccgcccacgaugacucucucgauggcacagaggaagaggacgaagaugagauggaggaagaggaagaggaggaacuggaggaagagguugacgaacuucagacgaccaaugugagcgaucuggggcucgagcacuccgacagccuggaauga

SEQ ID NO: 73824 - RNA, 2244 nt, Artificial Sequence
  derived and/or modified sequence opt5 from PKP1__Homo_sapiens__NP_000290
augaaccacagcccccugaagaccgcccucgcuuacgagugcuuccaggaccaagauaauuccacacuggcccuuccuucugaccagaaaaugaagacgggcaccagcgggagacagcgggugcaggaacaagucaugaugacaguuaaacgccagaaguccaaaucuagccaguccucuacccugagccauuccaacagaggaagcauguaugauggccucgcggacaauuacaacuaugggacaaccucucgguccagcuacuauucuaaguuucaggcuggaaauggcuccuggggguacccgaucuauaacggaacacugaagcgcgagcccgauaauagacgguucagcucuuacucccaaauggaaaacuggagccgccacuacccuagaggcuccuguaauaccacgggcgccgggucugacauuugcuuuaugcagaaaaucaaggccagccgguccgagcccgaucuuuauugugacccucgcggaacccugagaaaaggcacacucgggagcaagggacagaaaaccacacagaaccgguacucuuucuauuccacgugcagcggccaaaaggcuauuaagaaaugucccgugcgcccuccgucuugcgccagcaagcaggaucccguguacaucccucccauuuccuguaauaaagaccugucuuuugggcauagcagagcuuccagcaagaucugcucugaagauaucgaguguuccggacugaccauuccuaaagccguccaguaucucagcucucaagacgagaaguaccaggcgaucggcgccuauuacauucagcacacaugcuuccaggaugaauccgcuaaacaacagguguaccagcugggcgggaucuguaaacuuguugaccugcuccggagccccaaccagaaugugcaacaggccgcugccggagcgcugcgcaaccuugucuuuagauccaccacaaauaagcuggagacccggagacagaacggcauucgcgaagccgugucucuccugcggagaaccgggaacgcugagauccagaagcaacugacaggacuccuguggaaucuuagcuccacggacgagcugaaggaggaacucauugccgaugcucugccgguucuugccgaccgcgugaucaucccuuucucuggcuggugcgaugggaacagcaauaugucccgggaagucguggaccccgagguguuuuucaacgccaccggaugccugagaaaacgccucggcaugcgggaacugcuggcucucgucccucagagagcgacaagcucucgcguuaaucuguccagcgccgaugcuggccggcagaccaugagaaacuauucugggcuuauugacucccugauggccuacgugcagaauuguguggccgcuagccgcugcgaugacaagucugucgagaacuguaugugcgugcuccauaaucugagcuaucggcuugaugccgagguucccacaagauaccggcaacuggaauauaacgcgcgcaaugcuuacaccgagaaauccagcacgggauguuuuucuaacaaguccgacaagaugaugaauaacaauuaugauugcccccucccugaagaggaaacaaacccgaaaggcagcggguggcuguaccacuccgacgccaucagaaccuaccugaaccucaugggaaagucuaaaaaggacgccacccuggaggcuugugccggcgcccuucagaaucugacagcuagcaaagggcucauguccucuggcaugagccagcugauuggacugaaggagaagggccuuccccaaaucgcgcggcuccugcaguccgggaacucugauguggucagaagcggagccucccugcucagcaauaugucucgccacccucugcuucaucgggugaugggcaaccagguuuuccccgaagugaccagacugcucacaucccacacggggaauaccagcaacucugaggacauucuguccagcgcuugcuauacaguccgcaaucugauggccucucagccucaacuugcuaaacaguacuuuuccagcuccaugcucaacaauaucaucaaccuguguagaagcucugccagccccaaggcggccgaagcugcccggcugcuccuguccgauauguggucuagcaaagagcuucagggagugcugcgccagcaaggcuucgacagaaauaugcucgggacccuggcuggcgccaacucccugcggaauuucacaucucgcuuuuga

SEQ ID NO: 73825 - RNA, 2514 nt, Artificial Sequence
  derived and/or modified sequence opt5 from PKP2__Homo_sapiens__NP_001005242
auggccgcucccggcgccccugcggaguacggguauaucagaaccgugcugggacagcaaauucucggccagcuggacagcuccucucuugcucugccgagcgaagccaagcucaaacuggccggguccucuggacggggcgggcagacagucaagagccuucgcauccaggagcaaguucagcagacgcuggcuagaaaaggacgguccucugugggcaacggcaaucuccaccgcaccagcuccgugcccgaauacgucuauaaccugcaucugguggagaaugauuucguugggggaagaagcccugugcccaagacauacgacaugcucaaagccggcaccacagcuaccuaugaagggcgguggggacgcggcacagcccaguacucuucccaaaagagcgucgaggagagaucucugcggcacccucuucgcagacuggaaauuucccccgauagcucuccugagcgggcgcauuauacccacuccgacuaccaguacagccagcgcucccaggccgggcauacgcuccaccaccaagaaucuagacgggcugcccugcuugugccgccccgcuaugcuagaagcgagaucguuggagugucccgggccggcaccacaagcagacagcgccauuuugauaccuaccaccggcaguaucaacauggcucugucuccgacacaguguucgauagcauuccugcgaaccccgcccugcucaccuacccuagacccgggacgucucgcagcaugggaaaucugcuggagaaggaaaacuaucucacagcuggccugaccguggggcagguccggccgcuuguuccucugcagcccgugacacagaauagagccucccgcucuagcuggcaccaauccagcuuucacucuacccggacccucagagaggcuggaccuuccguggccgucgacagcucuggccgccgggcccaucugacaguggggcaggcugcggccggaggcuccggcaaccuucugacggaaagaagcaccuucacagauucccagcucgggaaugcugacauggagaugacccuggaacgcgccguuucuaugcuggaggccgaucacaugcuccccagccggaucuccgcugccgcgacauuuauccagcaugagugcuuccaaaaaucugaagcuagaaagcgggugaaccagcugcgcggcauucuuaaacugcuccagcugcuuaagguccagaaugaggacgugcaaagagccguuuguggagcccugcggaaccucguguuugaagauaaugacaacaaacuggaggucgcugaacugaauggggugcccagacuccugcagguccuuaagcagacccgcgaccuggagacgaagaaacagaucacaggacuccuguggaaccugagcuccaacgauaaacuuaaaaaucucaugauuaccgaggcccugcugacccucacagaaaacaucauuaucccuuucagcggcuggccggagggggacuaccccaaggcuaauggccugcuugauuuugacauuuucuauaacgugaccggaugccugcggaauaugucuuccgccggcgcggaugggagaaaagccaugcgcagaugugacggacucaucgauagccugguucacuacgugcggggcacaaucgcugacuaccaaccugaugacaaggccacggaaaacugcgucuguauucugcauaaucuuucuuaucagcucgaggcugaacugcccgagaaauacucccagaacaucuauauucaaaaucgcaacauccagaccgauaauaacaagagcauugggugcuuuggaucuagaagccggaaggugaaagagcaguaccaggacguuccuaugcccgaagagaaguccaauccgaaaggcguggaauggcuguggcacagcaucgucauccgcauguaucucucucugauugccaaguccgugagaaacuacacacaagaggcgagccuuggggcccugcagaaucucaccgcuggcuccggaccuaugcccacaucuguggcccagaccguuguccagaaagagagcggccugcaacacacgcggaagaugcugcaugugggggacccuuccgugaagaaaaccgcuaucucucuucuccgcaaccugagcagaaaccugucccuccagaaugaaauugccaaggagacacugcccgaucuugucucuaucauuccugacaccgugcccagcacagaucugcucaucgaaaccacggccuccgcuuguuauacacugaacaauaucauucagaacagcuaccagaaugcgcgggaccugcuuaacaccggaggcauccaaaagauuauggccaucucugcuggggaugccuacgccuccaauaaggcuagcaaagccgcgucuguucuccuguauucccugugggcucacacagagcuccaucacgccuacaagaaggcccaguucaaaaagaccgacuuugugaacagccgcaccgcuaaagccuaucacucucugaaggauuga

SEQ ID NO: 73826 - RNA, 2394 nt, Artificial Sequence
  derived and/or modified sequence opt5 from PKP3__Homo_sapiens__NP_009114
augcaggacggcaacuuccugcucagcgcccugcaacccgaggcuggggugugcucccuugcccugccuucugaucuccagcuggacagacggggagcggaaggcccggaggcugaacgccuuagagccgcccggguccaggagcagguucgcgcuagacugcuccaacuggggcagcagccccggcacaauggagccgcugaaccugagcccgaggccgaaaccgcgcgcggcacaagcagagggcaguaccauacgcugcaagccggauuuuccucucggagccagggccucuccggcgauaagaccucuggguuccgcccuaucgcuaaacccgccuauagcccugcuuccuggagcucuagauccgccguggaccugagcuguucucggcgccuuuccagcgcgcacaacggaggcucugccuuuggggcugccggauacggcggggcucagccgacacccccuaugcccaccagaccuguguccuuccaugagcggggaggcgucggcagccgcgccgauuaugacacacugucccucagaucucugcggcuugggcccggaggccuggaugacagauacagccucguguccgaacagcuggagccggccgcuaccagcacauaucgcgcguuugccuacgagcggcaagcuagcuccagcucuagcagagccgggggacuggauuggccugaagccaccgagguuucccccucucgcacgauucgggcuccugccgugagaacccuccagcgcuuccagagcucccaccggagcagaggcgucgggggagcggugcccggcgcuguucuggaacccguggcccgcgccccuucuguccggucccuuagccugucucucgcugacuccggccaucugccggaugugcacggguuuaauagcuauggaucccacagaacacuucaacgccugucuagcggcuucgacgauaucgaccuccccuccgccgugaaguaccugauggcuucugacccuaaccugcagguccucggggccgcguacauucagcauaaaugcuauagcgaugccgcugccaagaaacaggcucggucccugcaagccguucccagacuugugaagcuguuuaaucacgcgaaccaggaggugcagcggcaugccaccggagcuaugcgcaaucucaucuacgacaacgccgauaauaagcuggcucuugucgaagagaacggcauuuucgagcugcucagaacacugcgggaacaggacgaugagcugcgcaaaaaugugaccgggauccucuggaaccugucuucuuccgaccaccuuaaggauagacuggcccgggacacgcucgaacaacugacagaucugguucuuagcccucucucuggcgccggagggcccccgcugauccagcagaaugcuuccgaggcggaaaucuuuuauaacgccaccggcuuccugagaaaucucagcucugcuagccaggccacacgccagaaaaugagagagugucacggacugguggacgcccuugucaccuccauuaaccaugcucuggaugccggcaagugcgaggacaaaagcguggaaaacgcgguuugugugcuccggaaucugucuuaccgccuguaugacgagaugccucccuccgcccuucaaagacucgaagggcggggacgcagagaucuggcuggcgccccucccggggaggucgugggcugcuuuaccccucagagccggcgccugagagaacucccccuggcugccgacgcgcuuacauucgcugaggucuccaaggauccgaagggacuggaguggcucuggucuccucagauugugggccuguacaaccggcugcuucaacgcugugaacucaauagacacacgaccgaggccgccgcuggggcccugcagaacaucacagcuggagaccggagaugggccggcguucugagccgccucgcgcuggaacaggagcggauucuuaauccccugcucgauagagugcgcaccgccgaccaucaccaacugcggucccugacagggcuuaucagaaaccucucucgcaaugcucggaacaaagaugagaugagcaccaaggucgugucccaucugauugaaaaacugcccggaucuguuggcgaaaagagcccuccggccgaggugcucgucaauaucaucgcugugcugaacaaucuugugguugccucccccauugccgcuagagaccugcucuauuucgaugggcugcgcaaacugaucuuuauuaagaaaaagcgggacagcccugauucugagaaguccagcagagcggccucuucccuucuggcuaaccucuggcaguacaauaaacugcaccgggacuuccgcgccaagggcuacagaaaagaagauuuucucggacccuga

SEQ ID NO: 73827 - RNA, 3450 nt, Artificial Sequence
  derived and/or modified sequence opt5 from PKP4__Homo_sapiens__NP_001005476
augcccgccccugagcaggcuagccugguggaagagggccaaccgcagaccagacaggaagccgcguccacagggcccggaauggagccugaaacgaccgcuacaaccauccucgccucugucaaggagcaggagcugcaauuccagcggcuuacacgcgaacuggagguugaaagacagauuguggccagccagcucgagcggugccgccugggcgcugagucccccucuaucgccagcaccuccucuacagaaaagagcuuuccuuggagauccaccgacgugcccaacacgggggucagcaagccucgggugucugaugcuguucaaccgaauaacuaccuuauucgcaccgagcccgaacagggaacacuguauuccccugagcagaccagccuccacgaaucugagggcucccuggggaauagcagaucuuccacacagaugaacagcuacuccgacucuggauaucaagaggccggcagcuuccauaauucccagaacgugagcaaagcggauaaucggcagcaacacucuuuuaucggcuccaccaacaaucaugucgugcgcaacagcagagccgaagggcagacgcugguucagcccucuguggcuaaucgggccaugcgcagagucagcuccgugccuucucgggcucagagccccuccuacgugauuagcacaggagucucuccgucccgcggcagccucagaaccucucugggguccggauucggcagcccuuccguuacagacccccggccucuuaaccccucugccuauagcuccaccacccugcccgcggccagagcugccucuccuuacagccaacgcccggcuucccccacagccauccggagaaucgggagcgugacgucucgccagaccuccaauccuaacggacccacaccucaguaucagaccacagcccgggugggcagcccccucacccugacggaugcucaaacaagagucgcgucuccgucccagggccagguggggagcucuagcccuaagcgcuccggaaugaccgccguuccccagcaccuuggcccuagccugcaacggaccgugcaugacauggagcaguuugggcagcagcaauacgauauuuacgaaagaauggugcccccucgccccgacucucucacaggacugcgguccagcuaugcuucccagcacucucagcugggccaagaucucagaagcgccgucuccccggaccugcacaucaccccuauuuacgaggggcgcacauauuacucucccguuuaucggagccccaaucauggaacgguggaacuucagggcucccagaccgcccuguacagaacaggcucugucgggaucggaaaccuccagcggaccagcucccaacgcagcacacugaccuaucagagaaacaauuacgcucuuaacacgaccgccacauacgcggagccuuaucggccgauucaguacagagugcaggaguguaauuauaaccgccugcaacacgcuguccccgccgaugacggcaccacacggucuccuuccaucgauagcauucagaaagaccccagagaguucgccuggcgcgacccugaacuccccgaagugauccauaugcugcagcaccaguuuccuucuguucaagcuaaugccgcugccuaccugcagcaccucugcuucggggauaacaaggugaagauggaggucuguagacugggaggcaucaaacaucuuguggaccugcucgaucaccggguucuggaagugcagaagaaugcgugcggggcccuucgcaaccuggucuuuggcaaauccaccgacgagaauaagauugcuaugaaaaacgugggaggcauccccgcccuccugagacugcuccggaaaagcauugaugcugaggugcgcgaacugguuacggggguccuuuggaaucugucuuccugugacgccgugaagaugacaaucauuagagaugcgcucagcacccugacaaacaccgugaucgucccgcauuccggauggaauaacagcucuuucgacgaugaccacaaaaucaaguuucaaaccagccuggugcuucggaauacaacgggcugccuccgcaaccuguccucugccggggaggaagcuagaaaacagaugcggagcugugagggacugguugauucccuccuguaugugauucauaccugcgucaacacaucugacuacgacagcaagaccguggagaauuguguuugcacacuucgcaaccuguccuauagacucgaacuggaggugccucaggcccggcugcuuggccucaaugaacuggaugaccugcucgggaaagagucucccagcaaggauuccgaaccuagcuguuggggcaaaaagaagaaaaagaaaaagagaacgccccaggaggaccaaugggauggagucggcccgaucccugggcugucuaaaucccccaagggaguggagaugcuuuggcacccuagcguugugaagcccuaccugacccuccuggcugaaucuuccaaccccgccacacuggagggcagcgccgggucccuucagaaucucucugcuggaaacuggaaauucgcggccuacauucgcgcugccguccggaaggaaaaaggccugccuauccugguggagcuccugagaauggacaaugaucgcguggucagcuccguugccaccgcccuucggaacauggcucuggacgugagaaauaaggaacucauugggaaauaugcgaugcgcgaucuggugaaccggcugccgggcggaaauggccccagcguccuuucugacgagaccauggcugccaucugcugcgcccuccacgaggugacauccaagaacauggaaaaugcuaaggcccuggcggauagcgggggaaucgagaaacugguuaacauuaccaagggcagaggggaccgcucuagccucaaaguggucaaggcugccgcccaggugcugaauacacuuuggcaguaccgggaucugagauccaucuauaaaaaggacggauggaaccaaaaccauuuuauuacgccuguuucuacccucgaacgggaccgcuucaagagccaccccucccugucuacaaccaaucagcagaugagcccuaucauucaguccggcagcucuaaacccuccccuaucuacauuagcuccuauucuagcccggcuagagagcaaaaccggcgccugcagcaucagcagcuuuacuauucccaagaugacucuaauagaaagaacuucgaugccuaccggcuguaccuccagagcccccacuccuaugaagacccuuacuuugaugacagagugcacuuccccgcuagcacagauuauucuacccaguacgggcugaaauccacgaccaauuaugucgacuuuuacagcacaaagcgcccuucuuaucgggccgagcaauaccccggcuccccggauagcuggguguga

SEQ ID NO: 73828 - RNA, 1323 nt, Artificial Sequence
  derived and/or modified sequence opt5 from PLA1A__Homo_sapiens__NP_001193889
augcccccuggcccgugggagagcugcuucugggucgggggacugauccucuggcuguccgugggcucuagcggggacgcucccccuacaccccagccuaagugugcugauuuucaauccgccaaccuuuucgaaggaaccgaccugaaaguucaguuucuccuguucgugcccucuaauccuagcugcggccagcuuguggagggguccucugaucugcagaacagcggauuuaaugcgacgcucggcaccaagcugauuauccacggcuucagaguccuggggacaaaaccguccuggauugacaccuuuauccggacacuccugcgcgcuaccaacgccaaugugauugccguugauuggaucuacggaagcacaggcguguauuucucugcugucaagaacgugcuugggguuuccgaaagcucuauccauauuaucggagugucccugggcgcccacgucgggggaauggugggccaacucuuuggcgggcagcugggacagauuaccggccuugaccccgcugggccugaguacacgagagccagcguggaggaacggcuggaugcgggagacgcccucuucgucgaggcuauccauaccgauacagacaaucugggcauucgcauccccguugggcacguggauuauuuugugaacggaggccaggaccaaccuggcugucccaccuucuuuuacgccggguauucuuaccugauuugcgaucauaugagagcuguccaccucuauaucuccgcccuggaaaauagcuguccgcuuauggcguucccuugcgccuccuacaaagccuuccuggccggacggugucucgacugcuuuaaccccuuccugcuuucuuguccucgcaucggccugguggagcaagggggaguuaagauugaaccccuccccaaggaggugaaagucuaccugcugacaaccagcuccgcuccuuauugcaugcaccauagccucguggaguuucaccugaaggaacuuagaaauaaagacacgaacaucgagguuacauuccugucuuccaauauuaccagcucuagcaagaucacaauuccgaaacagcagcgguacggcaaggggaucaucgcccaugccacaccccagugucagauuaaccaggugaaguuuaaauuccaauccucuaaucgcgucuggaagaaagauagaaccaccaucauuggcaaguuuugcacggcucuccugccugugaacgaccgggagaaaauggucugccuucccgaaccugugaaccugcaggcgagcguuaccguguccugugaucucaagaucgccugcgucuga

SEQ ID NO: 73829 - RNA, 498 nt, Artificial Sequence
  derived and/or modified sequence opt5 from PLA2G10__Homo_sapiens__NP_003552
augggcccccugccugugugccucccgaucaugcugcuucugcuccugcccagccuucugcuccugcugcuccugccugggcccggauccggcgaggccucucggauucuuagaguccaccgcagagggauccuggaacucgcuggaaccguuggcuguguggggccucggacacccauugccuacaugaaguauggaugcuucuguggccugggcgggcauggacagccucgcgacgcgaucgauuggugcugucacggccaugacugcuguuacacgagagcugaggaagccgggugcagcccgaaaaccgagcgguauuccuggcaaugugugaaccagucuguccuuugcggacccgccgaaaauaagugucaggagcugcucugcaaaugcgaucaggagauugcuaacugucuggcccaaacagaauacaaucugaaguaucucuuuuacccucaguuccugugcgagcccgacagcccuaaaugugauuga

SEQ ID NO: 73830 - RNA, 570 nt, Artificial Sequence
  derived and/or modified sequence opt5 from PLA2G12A__Homo_sapiens__NP_110448
auggcccugcucagcagacccgcucugacccuucugcuccugcuuauggccgcggugguccggugccaggagcaagcucagacaacggacuggcgcgccacccugaagacaaucagaaacggcguucacaaaauugauaccuaccucaaugccgcucuggaccugcucgggggagaagauggccugugucaguauaagugcuccgacgggucuaaaccuuucccgcgguacggauauaagcccagcccucccaacggcuguggguccccucuuuuuggagugcaucugaauaucggcauucccucucucacaaaaugcuguaaccagcacgaucgcugcuacgagaccuguggcaagagcaagaaugacugcgaugaagaguuccaauauugucuguccaaaaucugcagagacgugcagaagacacuugggcugacccagcauguccaggccugugaaacgaccguggagcuccuguuugauucuguuauucaccugggaugcaaaccuuaccucgacagccaacgggcugccugccgcugucauuaugaggaaaagacagaucuguga

SEQ ID NO: 73831 - RNA, 588 nt, Artificial Sequence
  derived and/or modified sequence opt5 from PLA2G12B__Homo_sapiens__NP_115951
augaagcuggccagcggcuuccucgugcuguggcuuucccugggaggaggccucgcucagucugacaccagccccgauacagaggaauccuacucugacugggggcugagacaccuucgggggagcuuugaguccgucaacucuuauuucgauagcuuucuggaacuccugggcgggaaaaauggaguuugccaauaccgcuguagauauggcaaggccccuaugccgcggcccggcuacaaaccucaggagcccaacgggugcggauccuauuuccugggccucaaggugccugaaagcauggaccuggggauccccgcgaugacgaaauguugcaaucagcuugauguguguuacgauaccugcggagcuaacaaguaucgcugugacgccaaguuuagauggugccugcauucuauuuguuccgaccucaaacggagccugggcuucgucucuaagguggaggccgcuugcgauucccuuguugacacaguguuuaauaccgucuggacacuggggugucgcccuuucaugaacagccagagagccgcuugcaucugcgccgaggaagagaaagaggaacucuga

SEQ ID NO: 73832 - RNA, 1239 nt, Artificial Sequence
  derived and/or modified sequence opt5 from PLA2G15__Homo_sapiens__NP_036452
augggccugcaccucagacccuaccggguggggcugcuuccugacggacuucucuuccugcuucugcuccugaugcugcucgccgauccggcucugcccgccggccgccauccucccgucguucuugugccuggggaccugggaaaccagcucgaggcgaagcuggauaaacccaccgugguccacuaucuuugcagcaagaaaacagaauccuacuuuacgaucuggcugaaucucgagcugcugcucccugugauuaucgacuguuggauugauaacaucagacugguuuauaauaagaccucucgggcuacacaauucccggacggcguggauguccgcgugcccggguuuggaaaaaccuucagccuugaauuucuggacccuuccaagucuagcguuggcuccuacuuccauacaaugguggagucucucgucggcuggggguauaccagaggagaagaugugcggggcgcccccuacgacuggcgcagagccccuaacgagaaugggcccuauuuucuggcucugcgggagaugauugaagagauguaccagcuguacggaggcccggugguccucguugcccacagcauggggaacauguauacacuguacuuccugcagcgccagccucaggcuuggaaggauaaauauaucagagccuuugugucccucggagcgcccuggggcggcguggccaagacccugcggguccuugcuagcggggacaauaaccgcaucccugugauuggaccccugaaaaucagagaacaacagcggucugccguuuccacgagcuggcuccugcccuacaauuauaccuggucuccugagaagguguucguccagacaccgaccauuaacuacacacuucgcgauuauagaaaauuuuuccaagacaucggcuuugaggacggguggcugaugcggcaggauaccgaaggacucguggaggcuacgaugcccccuggcguucagcugcauugccuguacgggacaggagugcccaccccugacuccuucuacuaugagagcuuccccgauagagacccgaagauuuguuuuggcgauggcgacgggacagucaaucucaagucugcccugcagugccaagcguggcagucccgccaggaacaccaagugcuucugcaggaacucccuggaagcgagcacaucgagaugcuggccaacgcuaccacccuggccuaccuuaaacggguccuccugggccccuga

SEQ ID NO: 73833 - RNA, 489 nt, Artificial Sequence
  derived and/or modified sequence opt5 from PLA2G16__Homo_sapiens__NP_009000
augagagcccccaucccugagccgaagcccggcgaccugauugaaaucuuccggccuuuuuaccgccacugggcuauuuaugugggggauggauacgucguucaucucgcgcccccuagcgagguggccggcgcuggggccgccuccgugaugucugcucugaccgacaaagccaucgucaagaaagaacuucuguaugauguggcuggaagcgacaaguaccagguuaacaauaaacacgaugacaaguauucuccccucccuugcuccaagauuauccaaagagccgaggaacuggugggccaggagguccuuuacaaacugacaagcgagaacugugaacauuucgugaaugagcuccgguaugggguugcgcgcuccgaucaggugagagacgucaucauugccgcuucuguggccggaaugggccuggcugccaugagccugaucggcgugauguuuucccggaacaagcgccagaaacaauga

SEQ ID NO: 73834 - RNA, 447 nt, Artificial Sequence
  derived and/or modified sequence opt5 from PLA2G1B__Homo_sapiens__NP_000919
augaagcugcucgugcuggccguccuucugacaguugcugccgcggacagcggcaucucccccagagcuguguggcaguuccggaaaaugauuaagugcgugaucccugggucugauccguuucucgaauacaacaauuauggauguuacugcggccuugggggaagcggcacacccgucgacgaacuggauaaauguugccaaacgcacgacaacuguuaugaucaggccaagaaacuggacuccugcaaguuccuccuggauaauccuuacacccauacauauucuuacagcuguuccgggucugccauuaccugcagcuccaagaacaaagagugugaggcuuuuaucugcaauugugaccgcaacgccgcuauuugcuucagcaaggcccccuauaauaaagcgcacaagaaccuggauaccaaaaaguacugccagucuuga

SEQ ID NO: 73835 - RNA, 1530 nt, Artificial Sequence
  derived and/or modified sequence opt5 from PLA2G3__Homo_sapiens__NP_056530
augggcgugcaggccgggcuguucggaaugcucggcuuucugggggucgcucuuggaggcagccccgcccugagaugguaccggaccuccugccaccucacaaaggcgguuccugggaacccgcugggauaucuuucuuuccuggcuaaagacgcccaaggccucgcccugauccaugcucgcugggaugcccacagacggcugcagagcuguuccugggaggacgaacccgagcucacggcugccuacggcgcgcugugcgcccaugaaaccgcuugggggucuuuuauucacacaccuggacccgagcuucagcgcgcccuggcuacccuccagagccaaugggaagccuguagagcgcuggaggaguccccugccggcgcucggaagaaacgcgccgcugggcagucuggagugcccggcgggggacaucagagagaaaagcggggcuggacaaugccuggcacccuuuggugcggggugggagauagcgccggcaauuccagcgagcugggggucuuccagggaccggaccucuguugccgcgaacacgauagauguccccaaaacaucucuccucugcaguauaauuacggcauucggaacuaucgcuuucacacaaucucccauugcgacugugauaccagauuccagcagugccugcaaaaucagcacgacagcauuucugauaucguggggguugccuuuuucaacgugcucgagauccccuguuuuguccuggaggaacaggaggcuugcguggcgugguacugguggggaggcugccggauguauggcacgguuccucuugcccgccugcaacccagaaccuucuacaaugcuuccuggagcucucgggccacauccccgaccccuagcuccagaucucccgccccucccaaaccccgccagaagcagcaucuccggaaggggccuccgcaccagaaaggaagcaagagacccuccaaagcuaacacaaccgcccugcaagacccuauggugagcccccgccuugaugucgcgccuacgggccugcaggggccccagggaggccucaagccgcagggggcucgguggguguguagaucuuuucgccggcaccuggaccaaugcgaacaucagauuggcccuagagagaucgaguuccagcugcucaauuccgcccaggaaccccuguuucacuguaacugcacacgccggcuugccagauuccugcgccuccauagcccucccgaggugaccaauaugcugugggaacuucugggaacaaccuguuucaaacucgcuccuccccuggauugcgucgagggcaagaacuguucucgggacccgagagccauucggguuagcgcucgccaccugagacggcuccaacagagacgccaucagcugcaggacaaggggaccgaugaacggcaaccuuggcccuccgagccccuuagaggaccuaugucuuuuuacaaucagugccugcagcucacacaagccgcgcgcagaccggaccggcagcagaaaagcuggucccaguga

SEQ ID NO: 73836 - RNA, 2250 nt, Artificial Sequence
  derived and/or modified sequence opt5 from PLA2G4A__Homo_sapiens__NP_077734
augagcuucaucgaccccuaccagcacauuaucguggagcaucaauauucccacaaguuuaccgucguugugcugagagccacaaaagugacgaagggcgcuuucggggauaugcucgacaccccugauccguacgucgaacuguuuauuucuacaacccccgacagccggaaacgcacaagacauuucaacaaugauaucaacccuguguggaaugagaccuuugaguucauucuugaccccaaccaggagaauguucuggaaaucacacucauggaugccaacuaugugauggacgagacccugggaacggcgaccuuuacagucuccucuaugaaggugggcgagaaaaaggaaguuccuuucaucuuuaaucaggugaccgagaugguccuugaaaugagccuggaggugugcuccugucccgaucuccgguucucuauggcucugugcgaccaggagaagacauuucgccaacagagaaaagaacacauucgggagagcaugaagaaacugcucgggccuaagaacuccgaaggacugcauagcgcccgcgaugugccggucguugccauccuuggcucugggggaggcuucagagcuauggugggcuuuuccggggugaugaaagcccuguacgagagcgggauucucgacugugcuaccuaugucgccggccugucuggguccacgugguacaugagcacacuuuauucucaccccgauuucccugaaaagggacccgaggagaucaaugaagaacugaugaagaacgugucccacaauccucuccugcugcucacaccccagaaaguuaagcgguacguggaaagccuguggaaaaagaaauccucuggccagccggucaccuucaccgacauuuuugggaugcuuaucggagagacccugauucauaaccgcaugaauacaacgcucagcucccugaaggaaaaagugaacaccgcgcaaugcccucuuccccuguucacaugucuccacguuaagccugacgugagcgagcugauguuugccgauugggucgaguucucucccuacgaaaucggcauggcuaaguauggcaccuuuauggcccccgaccuguucggguccaaauuuuucaugggaacaguggucaagaaauacgaggaaaauccucuccauuuucugaugggcgugugggggagcgcuuucucuauccuuuuuaacagaguucugggagugagcggcucccagucucgggggagcaccauggaggaggaacucgagaacauuacgacaaagcacaucgucuccaaugauagcucugacuccgaugacgaaagccacgagccgaaaggaaccgaaaacgaggaugccggcucugacuaucaguccgauaaucaggcgagcuggauucaucgcaugaucauggcccugguguccgacucugcucuuuucaacaccagagagggccgggccgggaagguucacaauuuuaugcugggacucaaccugaauacaagcuacccccuguccccucucucugauuucgcuacccaagacagcuucgacgaugacgaacuggaugccgccguggcugaccccgaugaguuugaacgcauuuaugagccucuugacgucaaguccaaaaagauccaugugguggauagcggccugacauucaaccuccccuacccgcugauccugagaccucagcggggaguugaccuuauuaucucuuuugauuucuccgcgagacccagcgacucuuccccucccuuuaaagaacuccugcuggccgagaagugggcuaaaaugaauaagcucccuuuccccaagauugauccguaugucuuugaccgcgagggacugaaagaaugcuacguguucaagccuaaaaaccccgauauggagaaggacugucccacgaucauucacuuugugcuugccaauaucaacuuccggaaauacaaggccccuggcgucccgagagaaaccgaggaagagaaggagaucgcugacuuugauauuuucgacgaucccgaaagcccuuuuucuacauucaauuuccaguaucccaaccaagccuuuaaacgccugcaugaccucaugcacuucaauacccugaacaacaucgaugugauuaaggaggcgaugguugaaagcaucgaguaccggagacagaauccuucccgcugcagcgugucucuguccaacgucgaagcucggagauuuuucaauaaagaguuucuuagcaagcccaaagccuga

SEQ ID NO: 73837 - RNA, 2346 nt, Artificial Sequence
  derived and/or modified sequence opt5 from PLA2G4B__Homo_sapiens__NP_001108105
auggccguggcugaggucagcagaaccugccugcucacaguucgggugcugcaggcccaccgccuucccuccaaggaccuggugacgccuucugauuguuacgucacccucuggcugccgacagcgugcagccauagacuucaaacccggacagugaaaaacuccucuagccccguuuggaaucaguccuuccacuuucgcauccauagacagcugaagaacgugauggaacucaaagucuucgaccaggaucuggugaccggcgacgauccuguucugucugugcucuuugacgcugggacacugcgggccggagaguuccgcagagagagcuuuucccuuagcccccaaggcgaggggcggcuggaagucgaguuccgccuccagucucuggccgauagaggagaguggcuuguguccaauggcgugcuggucgcucgggaacucagcugucugcacguucagcuggaggaaaccggggaccagaagucuuccgagcaucgcgugcaacucguggucccuggaagcugcgagggcccccaggaagccucugugggcacggggaccuuuagauuccacuguccugcuugcugggagcaggaacuguccauucggcuucaggaugccccggaggaacaacugaaagcgccccucagcgcccugccuuccggacagguugugcgccuugucuuucccacaucucaggagccucugaugagaguggagcucaagaaggaagcuggccugcgggagcuggccguuagacucggguucggacccugugcugaagaacaagccuuucugagccgccggaaacagguggucgcggccgcucuuagacaggcccugcagcucgacggcgaucugcaagaagacgagaucccgguggucgcuauuauggccaccgggggaggcauccgcgccaugacaucccuuuauggccagcuggcugggcucaaggagcugggacugcucgauugcgugagcuacauuaccggcgcgucuggguccacgugggcccuggcuaaccuuuaugaagacccugaguggagccagaaagaccuggccggacccacagaacuccugaagacccagguuaccaaaaauaagcugggcgugcuugccccuucucaacuccagcgguacagacaggagcuggcugaacgcgcccggcugggguaucccagcuguuucacaaaccucugggcgcugaucaaugaggcccuucugcacgaugagccccaugaccacaagcucuccgaucagagagaagcucugucucauggacaaaacccucugccgaucuacugcgcccuuaauaccaaaggccagagccucacaacguuugaguucggcgaauggugugaguucucccccuaugaggucggguuuccuaaguacggagcuuucauucccagcgaacuguuuggcucugaguucuuuauggggcagcugaugaaacgccucccugaaucccggaucugcuuccuggagggaauuuggagcaaccuuuacgccgcuaaucugcaggacucucucuauugggccuccgaacccagccaauuuugggauagaugggugcgcaaccaggcgaaucuggacaaggagcagguuccgcugcuuaaaaucgaggaaccucccuccaccgccggccggauugcugaguucuuuacagaucuccugaccuggagaccucuggcccaagcuacacacaacuuccuccgggggcugcacuuucauaaggacuacuuccagcacccccauuuuucuaccuggaaagccacgacacuugauggccugccuaaucagcucacccccagcgaaccgcaccugugccugcuugacgugggauaucucaucaacaccuccugucugccucugcuccagcccacacgcgaugucgaccugauucuuucucuggacuacaaccuccauggcgcguuccaacagcugcagcugcuugggagauucugccaggagcaaggaauccccuuuccuccgaucagccccuccccugaggaacagcugcagccccgggagugucacaccuucagcgauccuacaugccccggcgccccugcugugcuccacuuuccccuggugucugacuccuucagagaauauagcgccccggggguucgccggacgccugaggaagcugccgccggagaggucaaucucucuuccagcgauucucccuaccauuauaccaaggugacauacagccaggaagacguggauaagcugcuucaccugacccauuacaacgucuguaauaaccaagagcagcuccuggaggcucugagacaggcggugcaacgcagacggcagcgcagaccucacuga

SEQ ID NO: 73838 - RNA, 1656 nt, Artificial Sequence
  derived and/or modified sequence opt5 from PLA2G4C__Homo_sapiens__NP_001152794
augagaacccggccccgcccuagacugcggcgcacagagaacuuccucacggccgugcaccauggcaagaaagaagagaaggcugccgucgaaagacggcgccugcacguucuuaaagcgcugaagaaacucagaaucgaggcugacgaagccccggugguggccguccuggggagcggaggcgggcuucgggcucauauugccugccugggagugcucuccgagaugaaggagcagggccugcuggaugcuguuaccuaccucgccggggugucuggaagcacaugggcgaucuccucucuguauaccaaugacggcgauauggaagcccuugaggcugaccugaagcaccgcuuuacaagacaagaaugggaucucgccaaaagccugcagaagaccauucaggcugcccgguccgagaacuacucucuuacagacuucugggcguauauggucaucagcaaacagacccgcgagcugcccgaaucccaucucagcaauaugaagaaaccuguggaggaaggcacgcugcccuacccuauuuuugccgcuaucgauaacgaccugcaacccucuuggcaggaggccagagcuccugaaaccugguucgaguuuacaccgcaccacgccggguucuccgcccucggagcuuuuguuagcaucacccauuucggcucuaaguuuaagaaagggcggcuggugcgcacacaccccgagagagaucuuaccuuccugcggggacucuggggcuccgcgcuggggaauacggaagucauuagagaguauaucuuugaccagcuucgcaaccugacacucaagggacuguggcggagagccguggcuaaugccaaaagcauuggccaucugaucuucgcccgccuccugcggcuucaggaaucuucccaaggcgagcacccucccccugaagaugaagggggagagcccgagcacaccuggcugacagagaugcucgaaaacuggaccagaaccagccuggagaagcaggaacagccgcaugaggacccugagcgcaaaggcucccuuucuaaucugauggauuuugugaagaaaacagggauuugugcuagcaagugggaauggggaacgacccacaacuuccucuacaagcauggcgggauccgggacaaaauuauguccagcagaaagcaucugcaccuggucgacgccggacucgcgaucaauacacccuucccucugguucuuccucccacccgcgaggugcaccugauccucucuuuugauuucuccgcuggcgaccccuuugaaacaauucgggccaccacggauuauugcagacgccacaaaaucccguucccccagguggaggaggccgaacuggaccuguggagcaaggcuccugccucuuguuacauucuuaaaggcgagacagggcccgucgugaugcauuuuccucucuucaacaucgaugcuugcggaggcgacauugaagccuggagcgauaccuacgacaccuuuaagcuggcggauacauauacccuggacguugugguccuccugcuugcccuggcuaagaaaaaugugcgggagaacaagaaaaagauccucagagaacugaugaauguugccgggcuguacuaucccaaagauuccgcucggucuuguugccuugccuga

SEQ ID NO: 73839 - RNA, 2457 nt, Artificial Sequence
  derived and/or modified sequence opt5 from PLA2G4D__Homo_sapiens__NP_828848
auggagagccugucccccggcgggccuccgggacaccccuaccagggcgaagccucuaccugcuggcaacucacagugagaguccuggaggcucggaaccuucgcugggccgaccugcucagcgaagcggauccuuauguuauccugcagcuuuccacggcucccgggaugaaguucaaaaccaagacacugaccgacacaucucauccuguguggaaugaggccuuuagauuccucauucagagccaggugaaaaacguccuggaacuguccaucuacgaugaggacucugugaccgaggaugacauuuguuuuaagguucucuaugauaucagcgaagugcugcccggaaaacuucugcggaagacauucucccaaagcccucagggcgaggaagaacucgacgucgaguuucugauggaagagaccucugaucgcccggaaaaucuuauuacgaacaaggugaucguugccagagagcuguccugccucgacgugcaccuggauagcaccgggucuacagcugucguggccgaccaggauaaacuggaacucgagcuggugcuuaagggauccuacgaggacacccagacaucuuuccugggcaccgcuucugccuuucgguuccauuauauggcggcccucgaaacggagcuguccggccgccuuagaagcucccggucuaauggguggaacggagacaauagcgcuggcuaccugacagucccccuccgcccucugaccaucgggaaagaaguuacaauggaugugcccgccccuaacgcucccggagugagacugcaacucaaggccgagggcuguccggaagaacuggcgguccaccuuggguuuaaucugugcgccgaggaacaggcuuuccucucccggcgcaaacaggugguugccaaggcucugaagcaggcccuucaacuggacagagaucuccaggaggacgaagugccugucgugggaauuauggccaccggcggcggggcucgggcgaugaccagccuguauggacaucugcucgcccugcagaaacuuggccugcucgauuguguuacauacuuuucugggaucuccggaagcacguggaccauggcucaccuguacggcgaccccgaguggucucaacgcgaucuggaagggccuauuagauaugcccgggagcaccuugccaagagcaaacucgagguguucucccccgaaagacuggcuucuuaccgccgggagcuggaacucagagccgagcagggacaucccacaaccuuugucgaccugugggcgcuugugcuggagagcaugcuccacggccaggucauggaucagaagcuguccggccaacgcgcugcccuggaacgggggcagaacccucuuccgcucuaucugagccugaaugugaaagagaacaaucucgaaacacuggacuucaaggaguggguugaguucucucccuacgaggugggauuucuuaaauauggcgccuucgucccucccgagcuguuuggguccgaguucuuuaugggaagacucaugcgccggaucccugagcccagaauuugcuuccuggaagcuaucuggagcaacauuuuuagccugaaucuucucgaugccugguacgaccugaccuccagcggcgaguccuggaagcagcauaucaaggacaaaacgcgcucucuggaaaaggagccgcucacaaccagcgggaccuccucucggcuggaggcuagcuggcuucagccuggcacagcccuggcgcaagccuucaaaggauuucucaccggcagaccccugcaccagcgcuccccuaacuuccugcaggggcuucagcuccaccaagauuauuguagccauaaggacuuuucuacaugggcugauuaccagcuggacuccaugcccagccagcugacgccuaaagaaccccggcucugccugguggaugccgcuuacuucaucaacaccucuuccccgagcauguuuagaccuggacggcgccuugaccugauucucucuuucgauuauagccuguccgcccccuucgaggcgcugcagcaaacagaacuuuacuguagagcccggggccugcccuuuccuagaguugagccgagcccccaggaccagcaccaaccucgcgaaugccaucucuucucugaucccgcuuguccugaggcccccauccugcuccacuuuccucuggugaaugcuuccuucaaggaccauagcgcccccgggguccagcgguccccggccgagcuucagggaggccagguggaucugaccggggcuacaugcccuuauacccucucuaacaugacguacaaggaagaggacuuugaaagacugcugcgccuuagcgauuauaaugugcaaaccucccagggcgcgauucugcaggcccucagaacagcucugaaacaccggacccucgaggccagacccccucgcgcccagacauga

SEQ ID NO: 73840 - RNA, 510 nt, Artificial Sequence
  derived and/or modified sequence opt5 from PLA2G5__Homo_sapiens__XP_011539888
auggaggugagaaccaagcggccccgcaucggcacagacacgaacagaccuuucgucgaagaggaaauucagauggccauccggaccccggagaugaaagggcugcucccccuggcuugguuucuugccugcagcguuccugcggugcaaggaggccugcucgaucugaaguccaugauugaaaaagugacagggaagaaugcucuuaccaacuacggauucuauggcuguuacugcggguggggaggccgcggcacacccaaagacgggaccgauugguguugcugggcccacgaccauuguuauggaagacuggaggagaagggcugcaauauccggacacagucuuacaaguaucgcuuugccuggggagucgugaccugugaaccugggcccuucugccacguuaaccucugugcuugcgauagaaaacugguguacugucugaagcggaaucuccgcagcuauaacccucaguaccaguacuuuccgaauauucugugcuccuga

SEQ ID NO: 73841 - RNA, 2259 nt, Artificial Sequence
  derived and/or modified sequence opt5 from PLA2G6__Homo_sapiens__NP_001186491
augcaguucuuuggcagacuggugaacaccuucagcggggucacaaaucucuuuuccaaccccuuccggguuaaggaaguggccguggcugacuacacgucuagcgaucgcgucagagaagagggacaacugauccuuuuucagaauaccccuaaccggacaugggacugcgugcugguuaauccgcgcaacucccagucuggcuucagacucuuucagcuggaacuugaggccgaugcgcuggugaauuuccaccaauauagcucccagcuccugcccuuuuacgaaucuagcccucagguccugcauaccgaggugcuccagcaccugacagaccuuauucggaaccaucccuccuggagcguugcucaccuggccguggagcucgggauccgcgaauguuuccaucacucuagaauuaucuccugcgccaauugugcugagaacgaagagggaugcaccccucugcaccuugccugucggaaaggcgauggggagauucuggucgaacucgugcaauauugccauacacagauggacgugaccgauuacaagggagagacggucuuucacuaugcuguucagggcgacaauagccaggugcugcaacugcucggccgcaacgccguggcggggcugaaucaggucaacaaucagggacuuacaccccugcaucucgccugucaacugggcaaacaggaaauggugagaguucuucugcucugcaacgcucgguguaacaucauggggccuaauggauacccgauccacucugccaugaaguucucccagaaaggcugcgcugagaugauuaucagcauggauucuucccagauucacagcaaggacccccgcuauggggccuccccucugcauugggcgaagaacgccgaaauggcuagaaugcugcucaaacggggauguaaugugaacucuaccagcuccgccggcaauaccgcucugcacgucgccgugaugcgcaacagauuugauugcgccaucguucuucugacacauggcgcuaaugcggacgcccggggagagcacggaaacacgccccuccaucuggcuaugagcaaggauaauguggagaugauuaaagcccuuaucgucuucggcgccgaaguggacaccccuaacgacuucggggagacacccaccuuucuggcuucuaagauuggaagacaacuccaggaucugaugcacaucucccgcgcccggaaaccggcguucauccugggcagcaugagagacgaaaagcgcacacacgaucaucuccugugccuugacgggggaggcgucaagggccugauuaucauucagcuccugaucgcuauugagaaagccucugggguggccaccaaggaucuguuugacuggguugcuggaaccagcacaggcgggauccuugcccucgcuauccugcacuccaaaucuauggccuacaugcggggaauguacuucagaaugaaggaugaaguguuucgcggcagccggccuuaugaguccgggccccuggaggaguuccucaaaagagaauuuggcgaacauacgaagaugaccgacguccgcaaaccuaaggugaugcugacaggaacccuuagcgaucggcagcccgcggagcugcaccucuucagaaauuacgacgcccccgaaacaguucgcgagccucgguuuaaccaaaaugugaaccugagaccgcccgcucagccuucugaucagcuggucuggcgggccgcucgcuccagcggcgccgcgcccaccuauuucagaccuaaugggcgguuucuugacggaggccuccuggccaacaaccccacgcuggacgcuaugacagagauucacgaauacaaucaggaucucaucagaaaggggcaagccaacaaagugaagaaacugucuauugugguuucccuuggaaccggccgcagcccgcaggucccugugaccuguguggacgucuuccggcccuccaauccuugggagcuggcuaagacaguguuuggggccaaagaacucggcaagaugguuguggauugcuguaccgaccccgaugggagagccgucgaccgcgcuagagcguggugcgagauggugggcauccaguauuuccggcugaacccucagcuggggacagauauuaugcuugacgagguuucugauacggugcucgucaaugcccugugggaaaccgagguguacaucuaugaacaucgcgaggaguuccaaaagcugauccagcuccugcuuagccccuga

SEQ ID NO: 73842 - RNA, 1326 nt, Artificial Sequence
  derived and/or modified sequence opt5 from PLA2G7__Homo_sapiens__NP_005075
auggugcccccuaagcugcacguccucuucugccuguguggcugccuugccguuguguacccguuugacuggcaguauaucaaccccguggcucauaugaaaagcuccgccugggucaauaagauucaggugcugauggcggcugccucuuucgggcagaccaaaaucccuagaggaaacggccccuacagcguuggguguacagaucucauguuugaccacacgaauaagggaaccuuccugcggcuuuauuacccuucccaggauaacgaccgccuggauacacucuggauucccaauaaagaguauuuuuggggccugucuaaguuccuggggacccauuggcucaugggaaacauccugagacuucuguuuggcagcaugacaaccccugccaauuggaacuccccgcuccggcccggcgaaaaguacccucugguggucuucucucacgggcuuggagcuuuucgcacacuguauagcgccauuggcaucgaccucgcuucccauggguucaucguggccgcgguugagcacagagaucggagcgccucugcuaccuacuacuuuaaagaccaguccgccgcugaaauuggagauaagagcuggcuguaucugcgcacgcucaaacaagaggaagagacccacaucagaaaugaacaggugcggcagcgcgccaaggagugcucucaggcgcugucccuuauucuggacaucgaucauggcaaacccgucaagaacgcccucgaccugaaguucgauauggagcaacuuaaagacagcauugacagagaaaagaucgcugugauugggcacucuuuuggaggcgccacagugauccagacccuguccgaggaucagcgguuccgcuguggcaucgcucucgacgccuggauguucccucugggggaugaggucuacagccggauuccccagccgcuguuuuucaucaauuccgaauauuuucaauacccugccaacauuaucaaaaugaagaaaugcuauucucccgacaaggagagaaaaaugauuacaauccgcggaagcguucaucagaauuucgcugauuuuaccuucgcgacgggcaagaucauugggcacaugcucaagcugaaaggagacaucgauuccaacguggccauugaccuuagcaauaaggcuucucuggccuuucuccagaaacaccugggccuucauaaggauuucgaccaaugggauugucugaucgaaggggacgacgagaaccucauuccuggaacaaacaucaauaccacaaaccagcacaucaugcugcaaaauuccagcggcauugaaaaauacaacuga

SEQ ID NO: 73843 - RNA, 3975 nt, Artificial Sequence
  derived and/or modified sequence opt5 from PLA2R1__Homo_sapiens__NP_001007268
augcugcucagccccucccugcuucugcuccugcuucugggcgccccuagagggugcgcugagggaguggccgcggcucucaccccggaacggcugcuggaguggcaggacaagggcaucuucgucauucaaucugaaagccucaaaaaguguauccaggccgggaaauccguucugacacuugagaacugcaagcaggccaauaaacacaugcuguggaagugggugucuaaccauggacucuuuaauauuggcgggagcggaugucugggccuuaacuucuccgcucccgaacagccucugucucucuacgagugcgauagcacgcuggugucccugcgcuggagauguaaucggaagaugaucaccggcccccuccaauauagcguccagguggcccacgacaacacaguuguggcuucucgcaaauacauucauaaguggaucuccuaugggagcggaggcggggauaucugcgaguaccugcacaaagaccuucauaccauuaagggaaauacacacggcaugccuuguauguuucccuuccaguauaaccaccaguggcaucacgaaugcaccagagaggggcgggaagaugaccugcucuggugugccacaaccucucgcuacgagagagaugagaaauggggauuuugcccugacccgacguccgcggaagucggcugugauaccaucugggagaaggaccugaauagccauauuugcuaucaauucaaccuucugucuucccucagcugguccgaagcccacucuagcugccagaugcagggcgggacacugcuguccaucaccgaugagacagaagagaauuuuauucgggagcacaugagcucuaagaccguggaaguuuggaugggacucaaccagcuggacgagcaugcuggcuggcaaugguccgaugggacgccccuuaauuaccugaacuggagcccugaagugaauuucgagcccuuugucgaagaccacuguggaacauucucuagcuuuaugccuuccgccuggcgcucuagagacugcgagagcacccuccccuacaucuguaaaaaguaucugaaccauauugaucacgagaucguggaaaaagacgcuuggaaguacuaugccacacauugcgagccgggcuggaacccuuacaaucggaacuguuauaaacuucagaaggaagagaaaaccuggcacgaagcgcugcgcuccugccaggccgauaauagcgcucucaucgacauuaccucucuggccgagguggaguuccuggucacacuccugggggaugaaaacgcuuccgagacguggaucggacuuagcucuaauaagauucccguuuccuuugaauggagcaacgacuccucugugaucuucaccaauuggcacacacuggagccucauauuuuccccaacagaagccaacucuguguguccgccgagcagucugaaggccacuggaaggucaaaaauugcgaggaacggcuguuuuacaucuguaagaaagccggccaugugcugagcgaugcugaguccgggugccaggaaggaugggagcgccacggcggguucuguuauaagaucgacaccguucuuagauccuuugaucaggcgucuuccggauacuacugucccccugcccucgugacaauuaccaaccgguucgagcaggcuuuuaucacgagccugauuucuuccgucgugaaaaugaaggacagcuauuucuggaucgcccugcaagaucagaaugacacaggcgaauacaccuggaagccgguugggcagaaacccgagccugugcaauauacccacuggaacacacaucagcccagauacucuggcggaugcgucgccaugcgcggccggcacccucucgggagaugggaagugaagcauugccgccacuuuaaagcuaugagccugugcaagcagcccgucgagaaucaggaaaaagccgaguaugaggaacgguggccguuccauccuuguuaccuugacugggaguccgaacccggacuggcgagcugcuuuaagguguuccacucugagaagguucucaugaaaagaaccuggcgcgaagcugaggccuuuugugaggaguucggcgcccaccuggcuuccuuugcccauauugaagaagagaacuucgugaaugagcugcuucacagcaaguucaacuggacagaggaacggcaauuuuggaucggguucaacaaaagaaauccucucaacgcuggauccugggaauggucugaucgcacgcccgucgugagcuccuuucuggacaauaccuauuucggcgaggaugcccggaacugcgcgguuuacaaggccaauaaaacacugcucccucugcauugugggucuaagagagaauggaucugcaagauuccccgcgacgugaaaccgaagaucccuuuuugguaccaguaugauguccccuggcuuuucuaccaggacgcugaguaucuguuucacaccuucgccagcgaguggcucaacuuugaguucguguguuccuggcugcauucugaucugcuuacaauucacagcgcucacgaacaggaauuuauccauuccaaaauuaaggcccucagcaaauacggcgcgucuugguggaucggacugcaagaggaacgggccaaugacgaguucagauggcgggauggcacccccgugauuuaucagaacugggacacggggcgcgagagaaccguuaauaaccagucccaacggugcggauuuaucagcucuaucacaggccuguggggguccgaagaguguagcgucucuaugccuuccauuugcaagcgcaaaaagguguggcucaucgaaaagaaaaaggauaccccgaaacagcacggaacaugccccaagggcuggcuguacuucaauuauaaaugucuucugcucaacauuccuaaggaccccagcuccuggaagaauuggacccaugcucagcacuucugcgccgaggaagggggcacgcugguggcuaucgagagcgaggucgaacaggccuuuauuacaaugaaccuguucggacaaaccacaucuguguggaucggccuucagaaugaugacuacgagaccuggcucaacgggaaaccuguuguguacagcaacuggucccccuuugacaucauuaauaucccuucucacaacaccacagaaguccagaagcauauuccccugugugcccugcucagcuccaauccgaacuuccacuuuacgggaaaaugguauuucgaggauugcggcaaggagggguacggauuugugugugagaaaaugcaggacaccucuggccaugggguuaauacaagcgauauguauccuaugcccaacacccuggaauacggcaauagaacauauaagaucauuaacgcuaauaugaccugguacgcggccaucaagacgugccuuaugcacaaagcucaacugguguccaucacagaccaguaucaucagucuuuccucaccgucgugcugaaccggcugggauacgcccacuggauuggccuuuuuaccacagauaaugggcugaacuucgacuggagcgauggaaccaaguccagcuuuacauucuggaaagacgaagagucuucccuccugggcgauuguguuuucgccgacagcaaugggagauggcacucuacggcuugcgaauccuuucuccagggagccaucugucaugugccucccgagacccgccaaagcgagcacccggaacugugcuccgagacaucuauuccuuggaucaaguucaaaagcaacuguuacuccuuuagcaccguccuugauucuauguccuucgaagcggcucaugaguuuugcaagaaggaaggcagcaaucugcucacaauuaaagacgaggccgagaacgccuuccugcuggaggaacuuuuugcuuucggcucuagcgugcagaugguguggcugaacgcccaguuugaugggaauagcaaguga

SEQ ID NO: 73844 - RNA, 2388 nt, Artificial Sequence
  derived and/or modified sequence opt5 from PLAA__Homo_sapiens__NP_001026859
augaccagcggcgccacaagauaccggcuguccugcucucuccgcgggcacgagcuggacgugagaggacuugucuguugcgcuuaucccccuggcgccuucguuagcgugucccgggaucgcacgaccagacugugggcgccggacucucccaaccggagcuuuacagaaaugcauuguauguccgggcacucuaauuucgugagcugcgucuguaucauuccuuccagcgauaucuacccccauggacucauugcuaccggcgggaacgaccacaauaucugcaucuuuucucuggauuccccuaugccccuuuauauucugaagggacauaaaaacacaguguguagccucucuuccggcaaguucggcacccugcugagcgggucuugggacacaaccgccaaaguuuggcucaaugauaagugcaugaugacgcugcagggacacaccgccgcugugugggccgucaaaauccuuccugagcaaggccugaugcucacaggguccgcugacaagaccgugaagcuguggaaagccggacgcugugaaagaacauuuagcggccacgaggauugcguucgggggcuugcgauucuguccgaaaccgaguuccucucuugugccaacgacgcuagcauccgcagauggcagauuacgggagagugccuggaaguguacuauggccauacaaauuacaucuauuccauuagcgucuuuccgaacugccgggauuucgugaccacagccgaggaccgcucucugagaaucuggaagcacggcgaaugugcucagaccauucggcuccccgcccaguccaucuggugcuguugcgugcuggauaauggggacaucgucguuggagcgagcgacggcauuauccgcguguuuaccgagucugaggauagaacagccagcgcugaagagauuaaagccuucgaaaaggagcuuucccaugcuacgaucgacucuaaaaccggggaucugggagacauuaacgccgaacaacucccuggccgggagcaccugaaugagcccgggacaagagaaggacagacccgccuuauccgggauggcgagaagguggaagccuaccaguggagcgucuccgagggcagauggaucaagauuggggacgugguuggaagcucuggcgcuaaccagcaaacauccgggaaagugcuguacgaaggaaaggaguuugauuaugucuucagcaucgacgugaaugagggcgggccuucuuacaaacuccccuauaacaccuccgaugacccguggcugacggcguacaauuuucugcagaagaacgaucucaacccuauguuccuggaccagguugccaaauucauuaucgacaauacaaagggccagaugcuuggacugggcaaccccagcuuuuccgauccuuucaccgggggaggccgcuaugugcccgggucuagcggauccucuaauacccuccccacagcugacccuuuuaccggcgccgggcgguacgucccgggcagcgccuccaugggaacaacgauggcuggcguggaucccuucaccgggaacagcgccuauagaucugcggcuuccaaaacaaugaauauuuacuuuccuaagaaggaagccgucaccuucgaccaagccaaccccacacagauccugggaaaacuuaaggagcugaauggcaccgcuccugaagagaaaaagcucacggaagaugaccugauccugcucgagaaaauucugagccuuaucuguaacucuuccagcgagaagcccaccgugcagcaacugcagauucucuggaaggccaucaauugcccggaagauauuguuuuuccugcucuggacauccugcgccuuucuauuaaacaccccagcgugaacgagaauuucuguaacgaaaaggagggggcccaguuuuccagccaucucaucaaucugcugaacccuaaaggaaagcccgcgaaucagcuccuggcccuucggacauucugcaacuguuuugucggccaagcugggcagaaacugaugaugucucagagagagucccucaugagccacgccaucgaacugaaguccggcucuaacaagaauauucauaucgcucuggccacccuugcgcucaacuacagcgugugcuuccacaaagaucauaauauugagggaaaggcccagugucugucccugaucucuacaauucucgaaguugugcaagaccuggaggcuaccuuucgccuucuggucgcccucggcacgcugaucagcgaugacuccaacgcugugcagcuggccaaaucucuugggguggauagccagaucaagaaauauuccagcguuucugaaccugccaaggucuccgagugcugccgguucauucucaaucugcuguga

SEQ ID NO: 73845 - RNA, 639 nt, Artificial Sequence
  derived and/or modified sequence opt5 from PLAC1__Homo_sapiens__NP_068568
augaagguguucaaauuuaucggccugaugauucuccugaccagcgccuucuccgcugggucuggacagagccccaugacaguccuuugcuccaucgacugguuuaugguuacggugcacccuuucaugcugaacaaugauguguguguccauuuucacgagcuccaucugggccuugggugcccgcccaaccacgugcaaccucaugccuaccaguucaccuauagaguuacagaauguggcauucgggcgaaggcugugucucaggacauggucaucuacagcaccgagauucacuauuccucuaaaggaacacccagcaaguuugugaucccuguuuccugcgccgcuccccagaaaagcccuuggcugaccaagccguguucuaugcgcguggccuccaagagcagagccacagcucaaaaagaugaaaagugcuacgaggucuucucucucucccagagcucucagcggcccaauugugacugcccucccuguguguuuuccgaagaggagcacacccaggugccuugccaucaagccggggcgcaggaagcccagccccugcagccgagccacuuccuggauaucuccgaggacuggucucuccauacggaugacaugauuggaagcauguga

SEQ ID NO: 73846 - RNA, 348 nt, Artificial Sequence
  derived and/or modified sequence opt5 from PLAC8__Homo_sapiens__NP_001124187
augcaggcccaagcucccguggucguugugacccagccuggcguggggccgggacccgccccucagaacagcaauuggcagacaggcaugugcgacuguuucuccgauugcggggucugucugugcggaacguuuuguuuccccugccucggcugucaaguggcggcugacaugaacgagugcugucugugcgggaccucuguugccaugagaacacuuuaccggacccgcuauggaaucccuggcagcauuugugaugacuacauggccacacugugcugcccccacuguacccucugccagaucaagagagauauuaaucggcgcagagcuaugcggacauuuuga

SEQ ID NO: 73847 - RNA, 1503 nt, Artificial Sequence
  derived and/or modified sequence opt5 from PLAG1__Homo_sapiens__NP_001108106
auggccaccgugauccccggcgaccugagcgaggucagagauacacagaagguuccuuccgggaaacggaagcgcggagaaacgaaaccgagaaagaacuuccccugccaacucugugacaaggcuuuuaauucuguggagaagcugaaggugcacagcuacucccauaccggcgaacggccuuauaaaugcauucagcaggauuguacaaaggccuucgucucuaaauacaaacuucagcgccacauggcgacccauagccccgagaaaacacacaagugcaacuauugugaaaagauguuucauagaaaagaccaccugaagaaucaccuccauacccacgauccuaacaaagagacauucaagugcgaggaaugugggaaaaauuacaacaccaagcugggauuuaaacggcaucuugcucugcacgccgccacguccggcgaccugaccugcaaggugugucugcaaacauucgagucuaccgggguucugcucgaacaccucaagagccaugcuggaaaauccagcggcggcgugaaggagaaaaagcaccagugcgagcauugugaucgcagauuuuauacacggaaagacguccgcagacacauggugguucauaccgggcggaaggauuuccuuugccaguacugcgcccagcgcuuuggaagaaaggaccaccugacgcggcacaugaaaaagucucauaaucaagaacuccugaaagugaagacagagcccgucgauuuccuugacccuuuuaccuguaacguguccgugccgaucaaagaugaacugcuccccgucaugagccugccuucuuccgagcugcucagcaagcccuucacaaauacccugcagcuuaaccuguauaauaccccuuuucagucuaugcaguccagcggcuccgcucaccaaaugauuacaacgcucccccuggggaugaccugcccgaucgacauggacacaguucauccuucucaccaccuuagcuucaaguaccccuucuccagcaccucuuacgccauuuccaucccugaaaaagagcagccccugaagggagagaucgaaagcuaucucauggagcugcagggcggggugcccucuagcucccaagauucucaggcgagcuccagcucuaaacugggacucgacccucagauuggcucccuggaugacggcgccggggaucuuagccugucuaaguccagcaucuccauuucugacccgcucaacacacccgcucuggauuuuagccagcuuuucaauuuuaucccucugaacggacccccuuacaauccccucuccgugggcucucuggggaugagcuauucccaagaagaggcccauagcucugucucccagcugccgccucagacccaggaccuccaagaucccgcuaacacgauuggacugggcagccuucacucucuguccgccgcguucacaagcucucucagcaccuccaccacacugccucgcuuucaucaggccuuccaguga

SEQ ID NO: 73848 - RNA, 1236 nt, Artificial Sequence
  derived and/or modified sequence opt5 from PLAGL1__Homo_sapiens__NP_001275966
auggccacccacagcccccagaagucccaucaaugcgcucacugugagaaaacauucaacagaaaggaccaucugaaaaaucaccuccagacgcaugauccuaacaagauggccuuuggcugcgaagagugugggaaaaaguacaauaccaugcugggauauaagcggcaccuugcgcugcacgcugccucuagcggcgaccucacaugcggggugugugcccuggaacuuggauccaccgagguccugcucgaucaucugaaagcucacgccgaagagaagccgcccucuggcacaaaagagaagaaacaucagugcgaccacugugaacgcugcuucuacaccagaaaggauguucggcgccaccugguggugcauacaggguguaaggacuuucucugccaguucugugcucaaagauuuggacggaaagaucaccugacccgccauacgaagaaaacccacagccaggagcuuaugaaggaaucccugcagacaggcgaccuccugucuaccuuccauacaaucagcccuuccuuucagcuuaaagccgcggcccugcccccuuucccccucggcgcuagcgcccaaaacgggcuggcuucuucccugccugccgagguccacagccucacccugucuccgcccgagcaggcggcccagccuaugcagccccuuccugaaucccuggcuagccuccaccccucuguguccccgggaagcccucccccuccccugcccaaucauaaguauaacacgacauccaccucuuacagcccucuugccucccugccgcucaaagcugauacaaagggcuuuugcaauauuagccuguucgaggaccugccccuccaagaaccucagucuccccagaagcugaacccuggguuugaucuugccaaaggaaaugccggcaagguuaaccugcccaaagagcucccggcugacgcggugaaucugaccaucccugccucccuugaucugagcccccuccugggguucuggcaacugccucccccugcuacccagaacacauuuggaaauucuacgcucgcccugggccccggcgaaagccuuccgcacagacuguccugccucgggcagcagcaacaggagccuccccuggccaugggaaccgucucucugggccagcuuccccucccuccgauuccccauguguucagcgcugggacaggauccgccauccugccucacuuccaccaugcguuucgguga

SEQ ID NO: 73849 - RNA, 1491 nt, Artificial Sequence
  derived and/or modified sequence opt5 from PLAGL2__Homo_sapiens__NP_002648
augaccacauucuuuacgagcgugcccccuuggauccaggacgccaagcaagaggaagaggucggcuggaaacugguuccgagaccccgggggcgcgaagcugagucccaggugaagugccagugugaaauuucuggaaccccuuucagcaacggcgagaaacucagaccccacucccugccucagcccgagcaacggccuuacucuugcccgcagcuucauugugggaaggccuuugcgagcaaauauaagcuguaccgccacauggcuacacauuccgcccagaagccccaccagugcauguauugugauaaaauguuccauagaaaggaccaccuccggaaucaucugcaaacccacgauccuaacaaagaagcccuucacugcucugaguguggaaagaauuacaacacaaaacugggcuaucgcagacaucucgcuaugcacgccgcuagcuccggggaccugagcugcaaggugugucugcagaccuuugaaucuacacaggcccuccuggagcaccuuaaggcgcauucccggcgcgucgccggaggcgcuaaagagaagaaacaccccugcgaucauugugacagacgguucuacacccgcaaggaugugagacggcaccugguugugcauacgggccgcaaagacuuucucugccaguauugcgcccaaagauucgggcggaaggaucaccugaccagacacgucaaaaagagccauucucaggaacuucugaagaucaaaacagagccuguggacaugcucggacugcuguccuguagcucuaccguuuccgugaaggaggaacucagccccguccugugcauggcuucccgcgaugugaugggcacaaaagccuuuccggggaugcuuccuaugggaauguacggcgcgcacauucccaccaugccuucuacgggggugccccauagccugguccacaauacacuccccaugggaauguccuacccucuggaaagcucuccgaucuccagccccgcccagcuuccucccaaguaucaacugggcucuaccagcuaccucccugacaaacugcccaagguugagguggauuccuuccuggcugagcucccgggcucucugagccuuuccagcgccgaaccucagcccgcuucuccucagcccgccgccgcugcggcccugcucgacgaggcucugcuugccaaguccccugccaaccugagcgaagcucucugugccgcgaauguggacuuuucucaucugcugggguuccucccccugaaccuuccgccuugcaauccucccggagcuacaggcgggcuggucaugggauauucccaggccgaggcccaaccccuccugaccacccugcaggcucagccgcaggauagccccggcgccgggggaccucuuaacuuuggcccccuccacucccugccucccguguucacaucuggccugagcuccacgacccucccucgguuccaccaggcuuuucaauga

SEQ ID NO: 73850 - RNA, 1689 nt, Artificial Sequence
  derived and/or modified sequence opt5 from PLAT__Homo_sapiens__NP_000921
auggacgccaugaagagaggccugugcugugugcuccugcuuugcggggcugucuucguuagccccucccaggagauccacgcccgguuucgcagaggagcgcggucuuaccaagugauuugucgcgaugagaaaacccagaugaucuaucagcagcaucaaagcuggcugagaccugugcuccgguccaaccgcgucgaauacugcugguguaauucuggcagagcucagugccacagcgugccgguuaaguccuguucugaaccccggugcuucaacgggggaacaugucagcaggcccuguauuuuagcgacuucgugugccaauguccugagggcuuugccgggaaaugcugcgaaauugauacgcgcgcuaccuguuacgaggaccagggaaucuccuauagaggcacauggagcaccgccgagucuggcgcugaaugcacaaauuggaacuccagcgcccuugcgcagaagcccuacucugggcggcgcccugaugccauuagacugggacucggcaaucauaacuauugucggaaucccgaccgcgauuccaaaccuuggugcuacgucuucaaggcugggaaguacagcucugaguuuuguuccaccccggccugcagcgaaggaaacuccgacuguuauuucggcaaugggucugcuuacagaggaacacacagccugaccgaguccggcgccagcugccugcccuggaacucuaugauccucaucggcaaaguguauacggcgcagaauccuuccgcccaagcucuggggcuuggaaagcauaacuacugucggaaucccgauggcgacgccaaaccuuggugccacguucugaagaacagacgccucaccugggaguauugugaugugcccagcugcucuacaugcgggcugcggcaguacagccagccgcaauuuagaauuaaaggaggccuuuucgcugacaucgccucccacccuuggcaggccgcuauuuuugcgaagcaucgccggucucccggggaaagauuccuguguggaggcauccucauuagcuccugcuggauccugagcgccgcucacuguuuucaggagcgcuucccuccccaucaccugaccgucauucucggccggacauauagaguggugcccggggaagaggaacagaaguucgaggucgagaaauacaucguucacaaggaauuugaugacgacaccuacgauaaugacaucgcccugcuucaacugaaaucugauuccagccgcugcgcccaggagucuuccguggugcggacggucugucucccuccggcugaccugcagcuucccgauuggacagaaugcgagcugagcggauauggcaagcaugaagcccucuccccuuucuacucugagagacugaaagaggcgcacgugcgccuguaucccagcucccgguguaccucucagcaucuccugaacagaacaguuaccgacaacaugcuuugcgcuggggauacccggagcggaggcccucaagccaaucugcacgacgccugucagggggauuccggcggaccccucgugugccugaacgacggccgcaugacacuugucgggauuaucagcuggggacugggcugugggcagaaggaugugccgggaguuuacacgaaagugaccaauuaucucgacuggauuagagacaacaugcggccuuga

SEQ ID NO: 73851 - RNA, 1245 nt, Artificial Sequence
  derived and/or modified sequence opt5 from PLAU__Homo_sapiens__NP_001138503
augguguuccaccugagaacccgguacgagcaggccaacugcgacugucucaauggcgggacaugcgucagcaacaaguauuuuuccaauauccauugguguaacugccccaaaaaguucggaggccaacacugugaaauugauaaaucuaagacgugcuacgaggggaauggacauuuuuaucgcggcaaagcuagcaccgacacaauggggagaccuugucugccguggaacuccgccaccguucuucagcagacauaccacgcgcaucggucugaugcucugcagcucggacugggcaagcacaauuauugccgcaaccccgacaauagacggcgcccuugguguuacgugcaagugggccuuaagccccugguccaggaaugcauggugcacgauugugccgacgggaaaaagccuagcucucccccugaggaacucaaauuccagugcggacagaagacccugagaccgcgguuuaaaaucauuggcggggaguucacaaccaucgagaaccaacccugguuugccgcuauuuaucgcagacaucggggaggcuccguuacguacgugugcgggggaagccugaucuccccuuguugggucaucagcgccacccacugcuucauugauuaccccaagaaggaagacuauaucguguaccucggccgcucuagacuuaauuccaacacacagggcgagaugaaauuugaaguugagaaucugauucugcauaaggauuauagcgcugacacccucgcccaccacaacgauaucgcgcugcuuaaaauucggucuaaggaggggcgcugugcccagccuuccagaacaauccagaccauuugccugcccagcauguacaaugacccgcaauucggaacgucuugugaaaucacaggcuuugggaaagagaacuccaccgauuaucucuacccugaacagcugaagaugacaguggucaaacugaucagccaucgggagugccagcaaccccacuauuacggauccgaagugaccaccaagaugcucugugcugccgacccucaguggaagacagacucuugccagggcgauagcgggggaccccugguguguucccuucagggcagaaugacgcugaccggcauugucagcugggggcgcggaugcgcucucaaagacaagcccggcguuuacacacgggugucucauuuccugccuuggaucagaucccacaccaaagaggagaacgggcuugcccuguga

SEQ ID NO: 73852 - RNA, 846 nt, Artificial Sequence
  derived and/or modified sequence opt5 from PLAUR__Homo_sapiens__NP_001005376
augggccacccuccccugcucccgcugcuucugcuccugcauaccugcgugcccgccagcugggggcuuagauguaugcagugcaagacaaacggagacugucgggucgaggaaugcgcucugggccaagaucucugucgcacgaccaucguuagacugugggaggaaggggaggaacuggagcucguggagaaauccugcacacacucugaaaagaccaaucggacacugagcuaccgcaccggacuuaaaauuacaucccugaccgagguggucuguggccucgaccugugcaaccagggaaauucugggagagccgugacguauagccggucccgcuaccuugaauguaucucuugcggcagcuccgauaugagcugugagagaggccggcaucagucucugcagugccgcuccccugaggaacaaugccucgacguugugacccacuggauucaggagggggaagagggaagacccaaggaugaccggcaucugcgcggcuguggguaucugccuggaugccccggcagcaacggguuccacaauaacgauacauuucacuuccucaaauguugcaauaccacaaaguguaacgaaggaccuauccuggagcuugagaaucugccgcagaacggcagacagugcuacucuuguaagggcaauuccacccaugggugcagcucugaagagacguuucucauugacugucggggacccaugaaccaaugccuggucgcgacaggcacccacgaacgcucccuuugggggagcuggcugccuuguaaauccacaaccgcucucagacccccuugcugcgaggaagcccaggccacccauguguga

SEQ ID NO: 73853 - RNA, 4344 nt, Artificial Sequence
  derived and/or modified sequence opt5 from PLB1__Homo_sapiens__NP_001164056
augggccugagacccgggaucuuccuccuggagcuucugcuccugcuuggacagggcaccccucaaauucacacaagcccgcggaaguccacgcuggaagggcagcucuggcccgagacccugaaaaacucuccuuuucccugcaauccuaacaagcugggagugaauaugcccagcaaauccguccauucucucaagccuagcgacaucaaauucguugccgcuauuggcaaccuggaaaucccgcccgauccugggacaggagaccuugagaagcaggauuggaccgaacgcccccagcaaguguguaugggcgugaugacaguccuguccgacauuaucagauacuuuucuccuagcgugcccaugccgguuugccacaccggcaagcgggugaucccucaugauggggccgaggaccucuggauucaggcgcaggagcugguccgcaauaugaaagaaaaccuucagcuggauuuccaauuugacuggaagcucaucaauguguucuuuuccaacgcuagccaguguuaucugugccccucugcccagcaggccccuucccugagcacaguucuccugucucaaaauggacuugcugccggcgggguggaugagcugaugggaguccucgacuaccugcagcaggaagugcccagagcuuucgugaaccuugucgaucuguccgagguugccgaggugagccggcaauaucacggcaccuggcucucucccgcgccugaaccguguaauugcuccgaggaaacgacccgccuggccaaaguggucaugcaguggagcuaccaggaggcuuggaacucccugcucgccucuagcagauauuccgaacaggagagcuuuacagugguuuuccaacccuuuuucuacgagaccacaccuucucugcauuccgaagacccccggcuucaggauagcaccacgcuggcuuggcaccucuggaaucgcaugauggagccugccggggaaaaggacgagccccugucugugaaacacggaagaccgaugaaguguccuagccaggaaucccccuaucuuuucucuuaccggaacagcaauuaccugacacgccuccagaagccucaagacaaacuggaggucagagagggcgcggaaauucggugccccgauaaggacccuuccgauaccgugcccacaagcguucaucgccugaaaccggccgacaucaacgugauuggcgcucucggggauucucugaccgccggaaacggcgcuggguccaccccuggaaauguccuugacgugcugacacaguauagaggccucagcuggucugucgggggagaugagaacaucggcacggugaccacacuggccaauauucugcgggaauuuaaccccucccuuaagggcuucagcguugggaccggaaaagagacaucccccaaugccuuucucaaccaggcuguggcgggcgggagagccgaagaccugccuguccaggcucgccggcugguggaucucaugaagaaugacaccagaauccacuuccaagaggauuggaaaaucauuacgcuguuuaucggaggcaacgaccuuugugacuucugcaaugaucugguuccgcgcgccuuugugaaccucgucacagugcuggagauugugaaucugcgggaacuuuaccaggagaagaagguuuauugucccagaaugauccuccgcucucugugcccuugcguccugaaauucgacgauaacagcaccgaacucgccacccugauugaguuuaauaagaaauuccaggagaagacacaucagcuuaucgaauccgggcgguacgacaccagagaggauuuuacaguggugguccaacccuucuuugaaaacguggacaugccuaaaacgucugagggccugcccgauaauagcuucuuugcuccugacuguuuccacuucuccagcaagucucacucccgcgccgcgagcgcucucuggaacaacaugcuggaacccguuggacagaagaccacacggcauaaauuugagaauaagaucaacauuaccugcccgaaucaggugcaaccuuuccugagaacauauaaaaacucuaugcagggccacgggaccuggcuucccugucgcgaucgggccccuuccgcccuccaucccacgagcguccacgcucugagaccggccgacauccaggugguugcugcccugggagauucucucaccgcgggcaaugggauuggaagcaagccugacgaucugcccgacgugacaacccaguaccggggccuuuccuauagcgccgggggcgacggaucucuggagaacgucacaacccucccuaauauccugcgcgaauuuaacagaaaucugacgggcuacgcuguggggacaggagaugccaacgacaccaaugcuuuccuuaaccaagccguucccggcgcgaaagccgaggaucucaugucccaggugcagacacugaugcagaagaugaaggacgaucaucgggucaauuuucacgaagacuggaaagugauuaccgugcugaucgggggaagcgaucucugcgacuacuguaccgauuccaaccuguauucugcugccaauuucguccaccaucuuagaaacgcucuggacguucuccaccgcgaggugccccgggugcuggucaaccugguggauuuucuuaauccuacaaucaugagacaaguuuuccugggcaacccggacaagugccccgugcagcaggccagcguccucuguaauugcgugcugacgcuccgcgaaaacucccaggagcuggccagacuugaggcuuuuucucgggcguaccgcagcuccaugagagaacugguugggucuggccgguaugauacccaagaggacuucagcgugguccuccagcccuuuuuccagaauauucaacugcccgugcuggccgacggacuuccugauacauccuuuuucgcucccgacuguauccauccuaaccagaaauuccacagccagcuggcccgcgcccucuggaccaauaugcuggaaccgcucggcucuaagacagagacccuggaucuuagagcugaaaugcccauuacgugcccuacacagaacgagcccuuucugcggaccccucgcaauuccaacuacaccuaucccaucaaaccggccauugagaauugggggagcgacuuccucuguacagaauggaaggcgucuaacuccguuccuaccagcgugcaccaacugagacccgcugauaucaaggucguggccgcccugggagacucucuuacaacggcugugggcgcccggcccaauaacuccagcgaucugccuaccuccuggcgcgggcucagcuggucuauuggaggcgacgggaaucuggagacacauaccacacuccccaacauccugaaaaaguuuaacccuuaccuucugggcuucagcaccuccacgugggaaggaaccgcgggccugaaugucgcugccgagggggccagagcucgggauaugccggcccaggcuugggaccucguugagagaaugaaaaacucucccgauaucaaucuggaaaaggacuggaaacuugugacacuguuuauuggagugaacgaccucugccacuauugcgagaauccugaagcccaucuggcgaccgaguacguccagcacauccagcaagcccucgauauucugagcgaggaacuuccccgcgcuuucgugaacguuguggaggucauggaacuggccucccuguaccagggccaagggggaaagugugcuaugcucgccgcccagaauaacugcacaugucugcggcauucucagagcucccuugagaaacaggaacugaagaaggugaauuggaaccuccagcacggcaucucuagcuuuuccuauuggcaccaguacacccaaagagaggacuucgcuguugugguccagccguuuuuccagaauacacugaccccucucaacgaacgcggcgauacggaccugacauuuuucagcgaggauugcuuccauuuuucugaccgggggcacgcggagauggccauugcucuuuggaauaacaugcuggaaccugugggaagaaaaaccaccuccaauaacuucacacauagccgcgccaagcugaaauguccuucucccgaguccccuuaucucuacacccugcggaauagcagacuucugcccgaucaagccgaagaggcuccugaaguccucuauugggccgugcccguugcggcuggcguggggcuggucgugggaaucaucggcacgguuguguggcgcugccggagagggggacggcgcgaggacccgccuaugucccucagaacagucgcccuguga

SEQ ID NO: 73854 - RNA, 1662 nt, Artificial Sequence
  derived and/or modified sequence opt5 from PLBD1__Homo_sapiens__NP_079105
augaccagaggcgggcccggaggccggccugggcugccgcagcccccuccccuccugcuucugcuccugcuucugccucuccugcuggugacagccgagcccccuaagccggcuggagucuacuaugccacggcguacuggaugcccgcugaaaagaccguucaagugaagaacgugauggacaaaaauggcgaugccuauggguucuacaacaauagcgucaagacaaccggauggggcauccucgagauucgcgccggcuaugggucccagacacugucuaacgaaaucauuauguuuguggcuggauuccuugagggcuaccugaccgccccucacaugaaugaccauuauacaaaccucuacccccagcugaucaccaaaccuagcauuauggauaagguucaggacuuuauggaaaagcaagauaaauggacgagaaagaauaucaaagaguacaagaccgacuccuucuggcggcacacaggguaugugauggcucagaucgauggacuuuacgucggcgccaaaaagcgcgcgauucuggaggggaccaagcccaugacacucuuucagauccaguuccugaacucugugggagaccugcucgaucugauuccgagccuuuccccuaccaaaaauggcucucugaagguuuuuaaaagaugggacaugggccauugcagcgcccucaucaaggugcugcccggguucgaaaacauucuuuuugcucacuccagcugguauacguacgccgcuaugcugcggaucuauaaacauugggauuucaaugucauugacaaggauacaucuuccagccgccucucuuuuuccagcuacccuggauuccuggagucucuggacgacuuuuauauccucuccagcggccugauccuucugcaaaccacaaacuccguguucaauaaaacccuccugaaacaggugauucccgaaacccuucugucuuggcagagaguccggguugccaacaugauggcggauagcgggaagcgcugggccgacaucuucuccaaauacaauagcggaacauacaacaaccaguauauggugcucgaucugaagaaagugaagcugaaucacucucucgacaaaggcacgcuguacauugucgagcaaauccccaccuauguggaguacuccgaacagacagauguucuuagaaagggguauuggccuagcuacaacgugccguuucacgagaagauuuauaauuggucuggauacccccugcucguccagaaacugggccuggacuacagcuaugaucuugcuccucgggccaagaucuuccgcagagaccaaggcaaagugaccgauacagcuuccaugaaguacaucaugcgguauaacaauuacaaaaaggaccccuauucucgcggggauccuuguaacaccauuugcuguagagaagaccucaauagccccaacccguccccuggaggcugcuacgacacgaagguugccgauaucuaucuggccagccaguacacaucuuacgcuauuuccgggcccaccgugcagggaggccugccugucuuucggugggacagauucaauaaaacccuccaucaggggaugcccgagguguauaacuuugauuucaucacaaugaagccuauucugaaacuugacaucaaguga

SEQ ID NO: 73855 - RNA, 3651 nt, Artificial Sequence
  derived and/or modified sequence opt5 from PLCB1__Homo_sapiens__NP_056007
auggccggcgcucagcccggggugcacgcccugcaacucaagccugucugcguuagcgacucccugaaaaagggaaccaaauucgugaagugggaugacgauucuacaaucgugacgccgauuauccuuagaaccgacccccagggcuuuuucuuuuacuggacagaucagaacaaagagaccgaacugcucgaccugagccuugucaaggaugcgcggugugggcgccaugcuaaggccccuaaagaccccaagcugagagagcuccuggaugugggaaauauuggccggcuggaacagcgcaugaucacaguuguguaugggccugaccucgucaacauuucccaccugaaucuuguggccuuccaagaggaaguugcuaaagaguggaccaacgagguguuuucucuggccacaaaucuccuggcucagaacaugagcagagaugccuuccuugaaaaggcguacaccaaacugaagcuccaggucacgcccgagggacggaucccucugaagaauaucuaucgccuguuuuccgccgacagaaaacggguggaaaccgcucucgaggccugcucucugccgagcucccgcaacgauagcauuccccaggaggacuucacaccugaaguguacagagucuuucuuaauaaccuguguccccggccugagaucgacaauauuuucucugaauuuggcgcuaaguccaaacccuaucucaccguugaucaaaugauggacuucaucaaccugaagcagcgcgauccgagacuuaaugagauucuguacccuccccucaaacaggaacaggugcaagugcugaucgagaaguaugagccuaacaauagccuggcccggaaaggccagauuucugucgacggguuuaugcgcuaccucuccggagaagagaacggcgugguuagccccgaaaagcuggaucuuaacgaggacaugucucagccccugucccauuacuucaucaauagcucccacaacacauaucucaccgcggggcaacuggccggaaauucuagcguggaaauguacagacagguccuucuguccggcugccgguguguggagcucgauugcuggaaggggagaacggcugaggaagaaccuguuaucacacauggauucaccaugacaaccgaaauuagcuuuaaagaggugaucgaagccauugcugagugugccuucaagaccucuccguuucccauccugcuguccuucgagaaccacgucgacagcccuaaacagcaggccaagauggcugaauauugccgccucauuuuuggcgaugcgcugcuuauggagccccuggaaaaauacccucucgagucuggcgugccccugccgagcccuauggaccugauguauaagauccuugucaagaauaaaaagaaaucccacaagucuagcgagggguccgggaaaaagaagcucagcgaacaagccucuaacacauacuccgauucuagcuccauguucgagcccagcuccccuggcgcuggggaagccgacacggagucugacgaugacgaugacgaugacgauuguaaaaagagcuccauggacgaaggaaccgccggcucugaggcuauggccacagaggaaaugagcaaucuggugaacuauauccagcccguuaaauuugaguccuucgaaauuagcaagaaacggaauaagucuuuugagauguccagcuucguggaaaccaaggggcuggagcagcucacaaaaucuccugucgaguuuguggaauacaacaagaugcagcuguccagaaucuaccccaaaggaacccgcguugauagcucuaauuauaugccgcaacuuuucuggaacgcgggcugccagaugguggcucugaauuuucagacgauggaccucgccaugcagauuaacaugggcauguacgaguauaauggaaagagcggauaccggcugaaaccugaguucaugagacgccccgauaagcauuucgaccccuuuacagagggcaucgucgaugggauuguggccaacacccuguccgugaaaaucaucagcggacaauuccuuucugacaagaagguuggcaccuaugucgaaguggacauguuugggcucccuguggauacacggagaaaagccuucaagaccaaaacaucccagggcaacgccgucaauccggugugggaggaggaacccauuguuuuuaagaaagugguccugccuacgcuggcuugucuccgcaucgccguguacgaggaaggaggcaaguucauugggcaccggauccugcccguucaggcgauuagaccuggauaucauuacaucugccuucgcaacgagcggaaucagccccugacccucccugccguguuugucuacauugaggugaaggacuauguucccgauacauacgcugacgugaucgaagcccugagcaacccgaucagauaugucaaucugauggagcaacgggcuaaacagcuugccgcgcucacccuggaagaugaggaagaggugaagaaagaggccgacccuggcgaaacacccuccgaggcuccuucugaagcccgcaccacgcccgcugagaacggggugaaucacaccacaacccugacaccgaagccucccagccaggcccuccacucccaaccugcccccggaucugucaaagcucccgcgaagaccgaagaucugauucagagcguucuuacggagguggaggcccagacaaucgaggaacugaagcagcaaaaauccuucgugaagcuccagaaaaagcauuacaaagaaaugaaggaccuggucaagagacaccauaaaaagaccacagaucugauuaaagagcacaccaccaaguauaacgaaauccagaaugacuaccuucggagacgcgcugcccucgagaaaucugccaagaaagauagcaagaagaaauccgagccuagcucuccggaccauggcuccagcacaauugaacaggaucuggcugcccuggacgcggagaugacgcaaaagcucaucgaccugaaagauaagcagcagcagcaacuucugaaccuccggcaggaacaguauuacucugagaaauaccaaaagagagagcacaucaagcugcugauucagaaacuuaccgacguggcugaagagugccagaauaaccagcugaagaaacucaaggaaaucugugagaaagaaaagaaggagcugaaaaagaaaauggauaagaaacgccaagagaagauuacagaagccaaguccaaagacaagagccagauggaggaagagaaaaccgaaaugaucagaucuuauauucaggagguugugcaguacaucaagcggcucgaggaagcccaauccaaacgccaggagaagcuggucgaaaagcacaaagagaucagacagcagauucuugaugaaaagcccaaacugcaaguggagcucgagcaggaauaucaggacaaguuuaaacggcugccucuggagauccuugaguucguucaggaagcuaugaaggggaaaauuagcgaggauuccaaucauggcagcgcuccccugucucucagcuccgacccuggaaaggugaaccacaagacacccucuagcgaggaacugggcggggauaucccuggaaaagaauuugacaccccgcucuga

SEQ ID NO: 73856 - RNA, 3546 nt, Artificial Sequence
  derived and/or modified sequence opt5 from PLCB2__Homo_sapiens__NP_001271226
augagccugcucaaccccgugcugcuuccuccgaaggucaaagccuaccugucccagggcgagagauucaucaagugggacgaugaaaccacaguugcuucucccgugauucuccggguggacccuaaaggguauuaccuguauuggacguaccaaagcaaggagauggaauuucuugauaucaccuccauucgcgacacaagauucggaaaauuugccaagaugcccaagucucagaaacugcgggaugucuucaauauggacuuuccugauaacagcuuccuccugaagacccugacagugguuuccggccccgacaugguggaucucaccuuucacaauuucgucucuuauaaagagaacguggggaaggcgugggcugaagacguucuggcccuugugaaacauccucugacagccaaugcuagccgcuccaccuuucucgauaagauccuggucaaacuuaaaaugcagcugaacagcgagggaaagauuccggugaaaaauuucuuucagauguuccccgccgacagaaagcggguggaggcugcccucucugcgugccaucugccuaaaggcaagaacgaugccaucaaucccgaagacuuuccugagcccgucuacaaauccuuccugaugagccucuguccgcgcccugaaaucgacgagauuuucacgucuuaucacgcuaaggccaagcccuacaugaccaaagagcaccugacaaaguuuaucaaccaaaaacagagagauucccggcuuaauagccuucucuucccucccgcucgccccgaccagguucaggggcugauugauaaguacgaaccuucuggaaucaacgcccaaagaggccagcuuuccccggagggcauggugugguuucugugcgggcccgaaaauagcgugcucgcgcaggacaaacugcugcuccaucacgauaugacccagccucugaaccacuauuucauuaauuccucucauaacacauaccuuaccgccggacaauuuagcggccuguccagcgcugagauguaucggcagguccuccugucugggugucgcugcguggaacuugacuguuggaagggaaagcccccugaugaggagcccaucauuacgcacggcuucacaaugaccacagacaucuuuuucaaagaagccaucgaggcuauugccgaauccgccuuuaagaccagcccguacccuaucauucugucuuucgagaaccauguugauagccccagacagcaagcuaaaauggcggaauauugccggaccaucuuuggggacaugcuccugacagagccucuggagaaguucccccucaaaccuggagugccccugccguccccugaagaucuucgcggcaagauucugaucaagaauaaaaagaaccaguuuucuggccccacgagcuccagcaaagacaccgggggagaggccgaaggcucuagcccucccuccgcuccggccgucugggccggggaggaaggaacagagcucgaggaagaggaaguggaggaggaagaggaagaggaaucuggcaaucuggacgaggaggaaaucaagaaaaugcaguccgaugaggggaccgcuggacuggaaguuacagccuacgaggaaaugagcucccuugugaacuauauucagcccaccaaguucgucucuuucgaguuuagcgcgcaaaagaauagauccuacgugaucucuagcuucacggagcucaaggcuuacgaccugcuguccaaggccagcguccaguuuguggauuauaacaaacggcagaugucuagaauuuacccuaagggcacacgcauggacuccagcaauuauaugccccagauguucuggaacgccggcugucaaaugguugcucucaauuuucagaccauggaucugccuaugcagcagaacauggccguguucgaauuuaaugggcaaucuggauaccuucugaaacacgaguucaugcggagacccgacaagcaguuuaacccuuucuccgucgaucgcaucgacgugguuguggcuaccacacucagcauuaccgucaucucuggccaguuucugagcgaacgguccgugagaacauauguggagguugaacuguucgggcuucccggagauccgaaacgccgguacagaacgaagcucagcccuucuaccaauuccaucaaccccgucuggaaggaggagccuuuuguguucgaaaagauucugaugcccgagcuggccagccuccgcguggcggucauggaagagggcaauaaguuccuggggcaccggaucauuccgaucaacgcccuuaacuccggcuaucaucaccugugccuccauucugagagcaauaugccucugacaaugcccgcucuguuuauuuuccuugaaaugaaagacuacaucccuggagccugggcugaucucaccguggcccuggcgaaccccauuaaguuuuucuccgcccacgacacaaaaucuguuaagcugaaggaggcuaugggcgggcuccccgaaaaaccuuuuccgcuggccagccccguggcuucccaggucaauggagcccuugccccuaccucuaacggcagccccgcugcgagagccggggcucgcgaggaagccaugaaggaggccgcugagccucggacggccucccuggaggaacucagagaacugaaaggagugguuaagcugcaacggcgccaugagaaagaacuuagagagcucgagcggagaggcgcgcgccggugggaggaacugcugcagagaggggcugcccagcucgccgaacugggacccccuggcgugggcggggucggagcuuguaaacuuggcccggggaagggaagccgcaaaaagagaucucugccccgggaggaauccgccggcgcggcuccuggggagggccccgagggaguggauggccgcguuagagaacucaaagaccggcuggagcuggaacuucugcgccaaggggaggagcaguacgaaugcgugcucaagagaaaagagcagcacgucgccgaacagaucagcaagaugauggagcuggcccgggaaaagcaagcugccgagcucaaagcucugaaggagaccucugaaaaugacacaaaagagaugaagaaaaagcuggaaaccaaacgccuggagagaauccagggaaugacaaaggugaccacggauaagauggcccaggaacggcucaaacgcgagauuaacaauucccacauccaggaggugguccaaguuauuaagcagaugacagaaaaccuggagagacaucaggaaaaacuggaggaaaagcaggcggccugucuugagcaaauccgggagauggaaaaacaguuccagaaggaggcucuggccgaauaugaggcuagaaugaagggccucgaggccgaagugaaagagagcgugcgcgccugccugcggaccugcuuuccuucugaagcuaaggacaaacccgagagagcgugugaaugcccgccugagcucugugagcaagauccccugauugccaaggcugacgcccaggaaucccgccuuuga

SEQ ID NO: 73857 - RNA, 3504 nt, Artificial Sequence
  derived and/or modified sequence opt5 from PLCB3__Homo_sapiens__NP_001171812
auggccggcgcucagcccggggugcacgcccugcaacucgagccuccgaccgucguugaaacacugagacggggaagcaaguucaucaagugggacgaggaaaaacuuaugacggugguguccggccccgauccugucaacaccguguuucugaauuucauggcgguucaggacgauacagcuaagguguggucugaggaacucuuuaagcuggccaugaacauucuugcccagaaugcuagccgcaacaccuuccugagaaaagccuacacaaagcucaagcugcaggucaaucaagacgggcggauccccgugaaaaacauucugaagauguuuuccgcugauaaaaagcgcguugagaccgcccucgagucuugcggacugaaauucaauagaagcgaauccauccggccugacgaguuuucucuugaaauuuucgagcgcuuucugaacaagcucugucugagacccgauaucgacaagauccuucuggagauuggcgcgaaagggaagccuuaucucacacuggaacagcugauggauuucaucaaucagaaacagcgggacccgcgccucaacgaggugcuguaucccccucuuagacccagccaagcccggcugcucauugaaaaguacgagccuaaucagcaguuucuggaacgcgaucagauguccauggagggauucagcagauaccuuggcggcgaggaaaacgggauccugccccucgaggcucuggaccugucuaccgauaugacgcaaccgcucuccgccuauuuuauuaauagcucucauaacaccuaccugacagcuggacagcuugccggcaccuccagcgucgaaauguaucggcaggcgcugcucugggggugccgcuguguggagcuggacguguggaaaggaagaccucccgaagaggagccuuucaucacacacggcuucaccaugacgacagaagucccccuucgggacguucuggaggccauugcugaaaccgccuuuaagacaucucccuacccugugauccucuccuucgagaaucauguggauagcgcuaaacaacaggccaagauggccgaauacugcagauccaucuuuggggacgcucugcugauugagccgcucgauaaguauccccuggcgccuggagucccccuuccuucuccccaggaccugaugggccgcauccucgugaaaaacaagaaacggcacagaccgagcgccggcgggccugauuccgcuggacgcaagcggccccuggagcagagcaacucugcccuguccgaaagcucugccgcuaccgagccuagcagcccccaacuuggcucuccuagcuccgacagcugucccgggcucucuaauggagaagagguuggccuggagaaaccgucccuggaaccucagaagucccucggggaugagggacugaacagaggccccuacgugcuuggccccgccgaccgcgaagaugaggaagaggacgaggaagaggaggaacagaccgauccuaagaaaccgacaacggacgaagggaccgcgucuuccgaggucaaugcuacagaggaaaugagcacccuggugaacuauauugagcccguuaaguucaaauccuuugaagccgcccggaagagaaauaaaugcuucgagaugucuagcuuuguggaaacaaaggcuauggagcagcucaccaaguccccuauggaguucgucgaauacaacaaacaacagcugucucgcaucuaucccaagggaacgcggguggacagcuccaauuacaugccucagcuguuuuggaacgucggcugucagcuuguggcccucaauuuccaaacacuggauguugcuaugcagcugaacgccgggguguuugaguauaauggaagaagcggcuaccuccugaaacccgaguucaugcgccggccugacaagucuuuugaucccuucaccgaagucauuguggacgggaucguugcgaacgcccuuagagugaaagucaucuccggccaguuccugagcgaucggaaggugggaauuuacguggagguugacauguuuggccucccggucgauacccgcagaaaguaucggacaagaaccucucaggggaacuccuucaauccugugugggacgaggaacccuuugauuucccuaaagugguccugcccacacuggcuagccuucgcaucgccgcuuuugaagagggaggcaaguucguggggcaucggauucucccgguuucugccaucagaagcggauaccacuaugugugccugcgcaaugaagcgaaccaaccucugugucuccccgcccugcuuauuuacacggaggcuuccgacuauaucccugaugaccaccaggauuacgccgaggcucugaucaaccccauuaaacaugucagccucauggaccagagagcccggcaacuggccgcucugaucggcgaaucugaggcgcaggccgggcaggaaaccugccaggacacacaaucccagcagcuuggcagccagcccuccucuaauccuaccccgagcccccucgaugcuuccccucgcagacccccuggacccacaaccucuccugccagcacgucccugucuagcccgggccaacgggacgaucugauugccuccauccucagcgagguggcucccaccccucuggacgaacuucgcgggcacaaggcccugguuaaacucagaucucggcaggagcgcgaucugagagagcugcggaagaaacaucagcgcaaggcggugacacuuaccagacggcugcucgacggacuggcucaggcccaagccgaaggcagaugucgccuccggcccggggcucugggaggcgccgcggaugucgaggacacaaaggaaggggaggaugaagcuaaaagauaucaggaguuucagaaccgccaagugcagucccuucuggagcuccgggaagcccagguugacgccgaggcucagagacgccuggaacaucugcggcaagcccuucagagacugcgcgaggugguccucgaugcuaauaccacgcaguucaagcggcugaaagagaugaacgaaagagagaagaaagaacuccagaagauucuggaccggaagcgccacaauagcaucucugaggccaaaaugagagauaagcacaaaaaggaagcggagcuuacagagauuaaccggcgccacaucaccgaauccgugaauagcaucagacggcuggaggaagcccaaaaacagagacaugaccgccucguggcuggccagcagcaaguccugcagcagcuggccgaggaggaaccuaaacuucuggcucagcucgcccaagagugccaggaacagcgggccagacugccccaagagauucgccggucucuccugggagaaaugccggagggccuuggggacggaccucugguugcuugcgcguccaacggccacgcccccgggagcuccggacaucugagcggcgcugauucugaaagccaggaggagaauacacagcucuga

SEQ ID NO: 73858 - RNA, 3585 nt, Artificial Sequence
  derived and/or modified sequence opt5 from PLCB4__Homo_sapiens__NP_000924
auggccaagcccuacgaguucaacuggcagaaagaagugccuagcuuucugcaagagggcgcugucuucgacagauaugaagaggaauccuuuguuuucgagccgaauugccucuuuaagguggaugaguucggguuuuuccugaccuggcggucugaaggaaaagagggccaggugcuugaauguagccugaucaacuccauucgcucuggggccauccccaaggacccuaaaauucucgcggcucuggaggccgucggaaagagcgagaaugaucuugaaggcagaaucgugugcguuuguuccgggacagaccuggugaacauuucuuuuacguacauggucgccgagaaucccgaagugaccaagcaguggguugagggacuccggagcaucauccacaacuuccgcgcuaauaacguguccccuaugacaugccugaaaaagcauuggaugaaacuggccuuuaugaccaauacaaacggcaagauucccgucagaagcaucacccggacauucgcuucuggcaaaaccgaaaaggugauuuuucaggcccucaaggagcuggggcuuccuuccgggaaaaaugaugagaucgaaccgacggcguucagcuaugagaaguucuacgaacugacccagaaaauuuguccccgcacagacaucgaggaucucuuuaagaaaauuaacggcgacaagaccgauuaucugacaguggaccaacuugucucuuuccugaaugaacaccagagagauccucggcucaacgagauccuguuucccuucuacgacgccaaacgcgcuaugcagaucauugagauguaugaaccugaugaggaccugaagaagaaagggcucaucuccagcgacggauuuugcagauaccugaugucugaugaaaaugcccccguuuuccuugaccggcuggagcucuaccaagaaauggaucauccgcuggcucacuauuuuauuuccagcucccauaacaccuaccuuacgggccgccaguucgggggaaagucuagcguggagauguauagacaggugcugcucgccggcugucggugcgucgagcuggacuguugggauggcaaaggggaagaccaggagccuaucauuacacacggaaaggcgaugugcaccgauauccuguuuaaagacgugauccaagccauuaaggaaacagcuuucguuaccuccgaguaccccgugauccucagcuuugagaaccacuguucuaaguaucagcaguacaaaauguccaaguauugcgaagaucuguucggcgaccuucugcucaaacaagcccuggagagccauccucuugaacccgggcgcgcucugcccucuccuaaugaucucaagagaaaaauucugaucaagaacaagcggcugaaaccggaggucgaaaagaaacagcucgaggcccugagaagcaugauggaggccggagaauccgcuucucccgcgaauauucuugaggacgacaacgaagaggaaaucgagagcgccgaucaggaggaagaggcucacccugaauuuaaguucggcaaugagcuguccgccgacgaucucgggcauaaagaagccguggcuaacagcguuaagaagggacuggugaccgucgaggacgagcaggccuggauggcgucuuacaaauacgugggcgcuacaacgaauauccaccccuaucuguccaccaugauuaacuacgcccaaccugucaaguuccagggcuuucacguggccgaagaacgcaauauccauuauaacaugagcucuuucaaugaauccguugggcuuggauaccucaaaacacacgcuauugaguuugugaacuauaauaagcggcagaugagcagaaucuaccccaaaggcgggcgcgucgauuccucuaacuauaugccgcagauuuucuggaaugccggaugccaaauggugagccugaacuaccagaccccugaccuggcuaugcagcucaaccagggcaaguuugaguacaauggguccuguggcuaucugcuuaaacccgauuucaugcggagaccugaccgcacauuugaucccuucucugaaaccccuguugacggagugaucgccgcgacgugcagcguccaagugauuuccggccaguuucugagcgauaagaagaucgggacauacguggagguugacauguauggacuccccaccgauaccauccggaaagaguucagaacacgcauggucaugaacaauggccugaacccgguguacaaugaggaaucuuuuguguuccggaaggucauucugccugaccuugccgugcucagaaucgcuguuuaugacgauaacaauaaacugauugggcagcgcauccugccccucgacggacugcaggccggcuaccggcauauuucccuuagaaacgaggggaauaagccccugagccucccuaccaucuuuuguaacaucgugcugaaaacauaugucccggauggcuucggagacauuguggaugcucugucugaccccaagaaguuccuuuccaucacggagaaacgggccgaucaaaugcgcgcgaugggcauugaaaccagcgacaucgccgauguuccuucugacacaagcaagaaugauaaaaaggggaaagcuaacaccgccaaggcuaaugugacaccccaguccagcucugagcucagaccuaccacgaccgccgcccuggcuuccggagucgaagcgaagaaaggcauugagcugaucccccaggugcggaucgaagaccucaagcaaaugaaagccuaccugaagcaccuuaaaaagcagcagaaggagcugaacagccucaaaaagaaacaugcuaaggagcacuccacaaugcagaaacugcacugcacccaaguugauaagauuguggcccaguacgacaaagaaaagucuacacaugagaagauccuggaaaaagccaugaagaaaaagggaggaagcaauugucuugagaugaaaaaggaaaccgagauuaagauccagacgcucacauccgaccacaaaucuaaggucaaagagauuguggcucagcauaccaaggaauggagcgagaugaucaacacacacuccgccgaggaacaagagaucagagaucugcaccugucucagcagugcgaacuccugaaaaagcugcugauuaacgcgcaugagcagcaaacccagcagcucaagcugagccacgaccgcgaauccaaagagaugcgggcucaucaagccaagaucagcauggaaaauucuaaagccauuucccaggauaagagcaucaaaaacaaggcugagagagagcgcagagugcgggaacuuaauucuuccaacaccaagaaauuucuugaggaacgcaagagacuggccaugaaacagagcaaggagauggaccagcucaaaaagguccaacuggaacaccucgaguuccuggagaagcagaaugaacagcuucugaaaucuugucaugcgguuucccagacacaaggcgagggggaugcugccgacggcgaaauuggaagccgggauggcccucagacguccaacagcucuaugaagcuccagaaugccaacuga

SEQ ID NO: 73859 - RNA, 2334 nt, Artificial Sequence
  derived and/or modified sequence opt5 from PLCD1__Homo_sapiens__NP_001124436
augcagugccugggcaucagaagccggucccgcucuagagagcucuaccugcaagaacggagccuuaagguggccgcucugaacgggcgcagacucggacugcaggacgaugaggaccuucaggcccugcucaaaggcucccagcugcugaaggucaaaucuagcuccuggcggcgcgaaagauucuauaagcuccaagaggauuguaaaaccauuuggcaggaaucucggaagguuaugcgcacacccgagagccagcuguuuuccaucgaggacauucaggaagugagaauggggcaccggacggagggacuugaaaaguucgcgcgcgaugugccugaggacagaugcuuuagcaucgucuucaaagaucaacggaauacccuggaccucauugcuccgucucccgccgaugcccagcauugggugcugggccuucacaagaucauccaucacuccgggagcauggaccagcgccagaaacugcaacauuggauucacucuugucucagaaaggcugauaaaaacaaggacaauaagauguccuuuaaagagcugcagaacuuccugaaggaacucaauauccagguugaugacagcuacgcccggaaaauuuuuagagagugcgaccacucucaaacagauucccuggaagacgaggaaaucgaggcuuucuauaagaugcuuacccagcgcguggagauugaucggacauuugccgaagcggccggaagcggcgagacccuguccgucgaccagcucgugacauuccugcagcaucaacagagagaagaggcugccggcccugcucuugcccugucucucaucgaacgcuacgagcccagcgagaccgcgaaagcccagcggcagaugacgaaggauggguuucugauguaucugcucuccgcugacggaagcgccuucucucuggcucacagacgcguuuaccaagauaugggccagccucuuucccauuaucuggugagcucuagccacaacaccuaccuccuggaagaccagcuugccgggcccuccucuacagaggccuacauucgggcucuguguaaaggaugcagaugucucgaacuggauugcugggacggcccuaaucaggagccgaucaucuaucacggguacaccuuuacaagcaagauucuguucugugauguccuccgcgcgauccgggacuaugccuucaaggcuucccccuacccugugauucugagccuugaaaaccauugcacccuggagcaacagagagugauggcccgccaccuccaugccauccugggacccaugcugcuuaaucggccucucgacggcgucacgaacucucugcccuccccggagcagcugaaaggcaagauucuccugaaagggaagaaacuuggaggccugcucccucccgggggagaaggcgggccugaggcuacaguugugagcgaugaagacgaggccgcggagauggaagaugaggcugugagaucucggguccagcacaagcccaaggaagacaaacugcgccuggcccaagagcuuuccgauauggugaucuauuguaagagcguucauuuuggaggcuucuccucucccggcaccccugggcaggccuuuuacgaaauggcuagcuucuccgagaauagagcccuccggcugcugcaggagucuggaaacggcuuugugagacacaaugucgggcaccucagccgcaucuauccggcuggauggcggacagacuccagcaacuacucucccguggaaauguggaauggcgggugccaaauuguugcccugaacuuccagaccccuggccccgagauggauguguaccagggaagauuucaggacaacggcgcgugcggguauguccuuaaaccugccuuccugcgcgaucccaauggaaccuuuaacccgagagcucucgcccaaggcccuuggugggcucggaagcgccugaauaucagagugauuuccgggcagcagcugcccaaagucaacaagaauaagaacagcaucguggacccuaaaguuacaguggaaauucauggagucucucgggauguggccucccgccagacggcgguuaucaccaauaacggcuucaaucccuggugggacacagaguuugccuucgaaguggucgugccugaucuugcucucaucagauuucugguggaggacuacgacgccagcucuaagaacgauuucauugggcaaagcaccaucccccucaauucccugaaacagggcuaucggcacguucaucugaugagcaagaacggagaccagcacccgucugcuacacuuuucgucaaaauuucccugcaggauuga

SEQ ID NO: 73860 - RNA, 2370 nt, Artificial Sequence
  derived and/or modified sequence opt5 from PLCD3__Homo_sapiens__NP_588614
augcugugcggcagauggcggcgcuguagacggcccccugaggaaccgcccguggccgcucaggucgccgcgcaaguugcugccccuguggcccuccccagcccucccaccccuuccgacgggggaacaaagcgcccgggccugagagcucuuaaaaagauggggcugacggaggaugaagacgugcgggccaugcuccgcggaucuagacugcggaaaauccgcagcagaaccuggcacaaggagcggcuuuaccgccugcaggaagauggccucuccgucugguuccagagacggauuccccgcgcuccuucucagcacaucuuuuucgugcaacacauugaggccguuagagaggggcaucagagcgaaggacugcggagauuuggcggcgcguucgcccccgcucgcugccugacaaucgccuuuaaagggcggagaaagaaccucgaccuggcugccccuaccgcggaggaagcccagcgcugggugcggggacuuacaaagcugagagcucgccucgaugccaugucccagcgggagagacuggaccacuggauucauucuuaucuucaccgcgcugauagcaaucaagacuccaaaaugagcuucaaggagaucaaaucucugcuccggauggucaacguggauaugaaugacauguacgccuaucugcuguuuaaggaaugugaucacuccaacaaugacagacucgagggcgccgaaaucgaggaguuccugcgccggcuucugaaaagacccgaacucgaggaaauuuuucaucaguacagcggggaggaucggguucugucugcuccggaacuucuggaguuccucgaagaccagggagaggagggcgcgacccuggcccgcgcucagcaacugauccagacauaugaacucaacgagaccgccaagcagcacgaacugaugacgcuugacggguuuaugauguaccugcucuccccugagggagccgcucuggauaauacccauacaugcguguuccaagacaugaaccagccccuugcccacuauuuuauuuccucuucccacaauaccuaccugacagauagccagaucggcggcccuuccucuaccgaagcguacgucagagcuuucgcccaggggugucggugcguggagcucgacuguugggagggacccggcggggaacccgugauuuaucauggacacacgcugacaagcaagauccuguucagagaugucguucaagccgugcgcgaccaugcuuuuacccucuccccuuacccggugauucugagccuugagaaccacugcggccuggaacagcaggccgcuauggcccggcaucucuguacaauccugggggauaugcuggucacccaggcgcuugacucucccaauccugaggagcuccccuccccugaacaacugaaaggaagagugcugguuaagggcaaaaagcuccccgccgcucgcagcgaggauggcagagcccugucugaccgggaagaggaagaggaggaugacgaagaggaagaggaagagguggaggcugccgcgcagcgcagacuugccaaacagaucagcccggaacuguccgcucucgccgucuauugccacgcuacccggcugcgcacacugcacccugcccccaacgccccucagcccugucaagugucuagccuuuccgagagaaaggcuaaaaagcucauucgggaagcggggaauagcuucguucgccauaacgccagacagcugacgcggguguacccucugggacuccgcaugaacucugcuaauuauagcccccaggagauguggaacagcggcugccagcuggucgcccuuaauuuucaaaccccgggguacgaaauggaccugaacgccggaagauuccucgugaauggccagugcggguauguccugaagccugcuugucugcggcagcccgauucuacauuugaccccgaguacccuggcccgcccagaaccacacuuuccauccaagugcucaccgcccagcagcugccuaaacugaacgcggagaagccccacagcauuguugauccucucgugcgcaucgaaauucauggaguccccgcugacugcgcccggcaggagacggauuacgugcugaauaacggcuucaauccuagaugggggcaaacacuucaguuucagcugcgcgcccccgaacucgcucugguucgguucguggucgaggacuaugaugccaccuccccgaacgacuuugugggacaguucacccugccucuuucuagccucaaacaaggcuacagacacauccaucugcuguccaaggauggggcgucucucagccccgcuacacuguuuauccagauucgcauccagcgguccuga

SEQ ID NO: 73861 - RNA, 2289 nt, Artificial Sequence
  derived and/or modified sequence opt5 from PLCD4__Homo_sapiens__NP_116115
auggccagccugcuccaggaccaacugaccacagaucaggaccuucugcucaugcaggagggcaugcccaugagaaaggugcgguccaaaucuuggaagaaacugcgcuacuucagacuucagaacgaugggaugacggucuggcacgcucggcaagcccgcggaagcgcgaagccuuccuuuucuaucagcgacguugaaaccauuagaaauggccaugauuccgagcugcuccggucucuggcugaggagcugccgcucgaacagggguucacaaucguguuucacggacgcagaagcaaccuggaccuuauggccaauuccguggaggaggcccagauuuggaugcggggccugcagcuccuggucgaucuugugaccagcauggaccaucaagaacgccuggaucaguggcucucugacugguuccagagaggggauaaaaaccaggacggaaagauguccuuucaagagguucagcggcugcugcaccucaugaauguggaaauggaucaggaguaugcuuucagccuguuucaagccgcugacacaucucaguccggcacccuugagggcgaagaguucguccaguuuuacaaggcccugacaaaacgcgcggaagugcaggaacucuucgaaucuuuuagcgccgacgggcaaaagcugacccuucuggaguuccucgauuuucugcaggaggaacagaaagagagagacugcacguccgaacuggcucucgagcugaucgaucgguaugaacccagcgacuccggaaaacuucgccauguucugucuauggauggcuuccucagcuaccuguguuccaaggacggggauauuuucaacccugccugccuucccaucuaucaggacaugacccaaccucugaaucacuacuuuaucuguagcucucacaacacauaucucgugggagaucagcugugcggccaguccagcgucgagggguacauuagagcucugaagcggggauguagaugcguggagguggacgucugggauggccccucuggcgaaccuguuguguaccaugggcacacccucacaagccgcauccuguucaaggacguggucgccaccguggcgcaguaugccuuucaaacguccgacuacccgguuauucuuucucuggagacacauuguagcugggaacagcagcagaccauggcucggcaccucacagagauccugggagaacaacugcuuuccaccacccucgauggcgugcugcccacacagcugccuagccccgaggagcucagacgcaaaauucuggucaaggggaaaaagcugacgcuggaagaggaccucgaauaugaggaggaagaggccgaaccugagcuggaagagucugagcuggcucuugaaucccaguucgagaccgaacccgagccgcaagaacagaaucuccagaacaaagauaagaaaaagaaaagcaagccuauccugugccccgcccugucuucccucgugauuuaccuuaagagcguuuccuuucggucuuucacacacagcaaagagcauuaucacuuuuacgagaucuccucuuucagcgaaaccaaggccaaaagacuuaucaaggaggcuggaaaugaauuugugcagcauaacacauggcaacugucccgcgucuauccuagcggccuccggaccgacucuuccaauuacaacccccaggagcuguggaaugcggggugucagaugguggccaugaacaugcagacggcuggacuggaaauggauauuugcgacggccacuucagacaaaacggcggguguggauacguccuuaagcccgauuuucuccgcgacauccagagcucuuuccauccugagaaaccgauuucccccuuuaaggcccagacacugcugauccaggugauuagcggccaacagcucccuaaaguugauaagaccaaagaggggucuaucguggacccccuggucaaggugcagaucuucggaguucggcuugauaccgccagacaagaaacaaauuauguggagaacaauggcuucaacccuuacugggggcagacccugugcuuucgcguccucgugcccgaacuggcuaugcugcgguucgugguuauggacuaugauuggaaaagcagaaaugacuuuauuggccaguacacacuuccguggacgugcaugcagcaaggauaucggcacauccaccuccuguccaaggacggcauuagccugcgcccugccucuaucuucgucuacauuuguauccaggaggggcucgagggagaugaauccuga

SEQ ID NO: 73862 - RNA, 5985 nt, Artificial Sequence
  derived and/or modified sequence opt5 from PLCE1__Homo_sapiens__NP_001159451
auggugagcgagggcuccgccgcugggagagacuucgccggaauggaagagguccggcagcugcacguucgcuuuugcaagggcaucaaaauuuggcaucaagcgugguuccucuguucucugcuugggagagaaccccaggagcgggaagcuggaugccagcuguggcucuguacccugagcgccgugcuuaaggugggcuggcuguuuccucucuccgaggucccgaacuucacacugcugaaagaugggugcggauguuggcgccucaaggaggaccagaucuacaaugccgugagacgggaagagacggaaaacaccguuggcucucugcuucacuuucugacaaaacuccccgcuagcgagaccgcccauggccgcauuuccguggggccuugccugaagcaaugugucagagauacagugugcgaguaucgggcuacccuucagcgcacaucuaucagccaguacauuaccggaucccugcucgaagccacgaccagccugggcgcgagaucugggcugcucuccacauucggaggcagcaccgggcggaugaugcugaaggagcgccagcccggaccuucuguugccaauuccaacgcucuucccagcucuuccgccggcaucagcaaagaacugaucgaccuccaaccucugauucaguuuccggaggaaguggcuuccauccuuauggagcaggagcagacaauuuauagacggguccugcccguggauuaccucuguuuccugacccgcgaccugggcacgccugaaugccaaucuagccuccccugucugaaggccuccaucagcgcgucuauucuuacaacccagaauggggagcacaacgcccuggaagaucucgugaugagauuuaaugaggucuccagcuggguuacauggcugauccuuaccgcuggaucuauggaagagaaacgggagguguucagcuaucuggugcaugucgccaagugcugcuggaacaugggcaauuacaacgcugugauggaauuucucgccgggcugagaucccgcaaaguucugaagauguggcaguucauggaccaaucugauauugagaccaugcggagccucaaggacgccauggcucagcacgaauccagcugugaguauagaaaaguggucacacgcgcgcugcacaucccuggaugcaaggugguucccuuuuguggcguguuccuuaaagaacugugcgagguccucgauggggccucuggacugaugaagcuguguccgcgguacaauucccaggaggaaacgcuugaguucguggcugacuacagcggccaggauaacuuucuccaaagagucggccagaaugggcugaaaaacucugaaaaggaguccaccgugaauagcaucuuccagguuauucgcuccugcaaccggucucuggagacagacgaagaggacagcccuuccgaaggaaacucuagcagaaaauccagccucaaggauaagucucgcuggcaguuuaucauuggcgaccugcuugauuccgacaaugauaucuucgagcaaagcaaagaauaugacucucauggguccgaggauagccagaaggccuuugaccacggaaccgagcugauucccugguacgugcucucuauccaggccgauguccaucaguuccugcugcaaggcgcuacagugauccacuaugaccaggauacccaccuuagcgcccgguguuuucuccagcugcagccugacaacuccacgcugacauggguuaaacccaccaccgcgagccccgcuucuuccaaggccaaacucggggugcugaauaacacagccgaaccuggcaaguucccgcuucugggaaaugcuggccucagcucccugaccgaggggguccuggaccuuuuugccgugaaggcuguguacaugggacaucccggcauugauauccacacaguuugcguccaaaacaaacucgggucuauguuccugagcgaaacgggagugacccugcucuauggccugcagacaaccgacaauagacuucugcauuuuguggccccuaagcacacagcgaaaaugcucuucuccgggcugcuggagcuuacccgcgccguccggaagaugagaaaauuucccgaucagcggcaacaguggcuccgcaagcaguacgugucucuguaucaggaagacggcagauacgagggaccuacgcuggcucaugccguugagcucuucggcgggcggagauggagcgcucgcaaccccuccccgggaaccucugccaagaaugcggaaaaaccuaacaugcaacggaauaacacacugggcauuagcaccacaaagaaaaagaaaaagauccuuaugagaggggaguccggagaagugaccgaugacgagauggccacgcgcaaggcuaaaaugcacaaggaauguagaagccggucuggcuccgauccccaggacauuaaugagcaggaggaaagcgaggucaacgccaucgcuaauccucccaacccucugcccucucgcagagcccacucccucacaaccgccgggagcccgaaccuggcugcgggcacaucuuccccuauccggcccgugagcucccccguucugagcucuagcaauaaauccccuucuagcgccugguccucuagcuccuggcauggacgcauuaagggcgggaugaaaggauuccagucuuuuauggugagcgauuccaacaugagcuucgucgaauuuguggagcuuuucaagucuuuuuccguuagaagccggaaagaccugaaggaucucuucgacguguacgcugucccgugcaaucgcucuggcuccgagagcgccccccuguauaccaaccucaccaucgaugaaaauacauccgaccugcaaccugaccuugaucugcucacgagaaacgugucugaccuggggcuguuuauuaagagcaaacagcagcuuuccgauaaucagcggcaaaucagcgacgccauugcugccgcgucuaucgugaccaacggaacaggcauugaguccaccagccuggggaucuucggcgucggaauccuccagcugaaugauuuucucguuaacugucagggcgaacacugcacauacgacgagauucugucuaucauucaaaaguucgaacccagcaucuccaugugccaucaggggcuuaugucuuuugagggauucgcucgcuuucugauggauaaagagaauuucgccagcaagaacgacgaaucccaggagaauauuaaagaacuccagcugccucugucuuauuacuauaucgagagcucccacaacaccuaccuuacgggccaccaacugaagggggaaagcucuguggagcucuauucccaggugcugcuccagggauguagaagcgucgagcuggauugcugggacggcgaugacggcaugcccaucauuuaccaugggcacacacuuaccaccaagaucccuuucaaagaagugguugaggccauugaucgguccgcuuuuaucaauucugaccugcccauuaucaucagcauugaaaaccauuguucccugccgcagcaaagaaagauggccgagaucuucaaaacaguguuuggagaaaagcucgucaccaaauuccuguuugagacagacuucucugaugacccuaugcuucccagcccugaucagcugcgcaagaaggugcuccugaaaaacaagaaacucaaggcgcaccagacgcccguugacauucugaaacagaaggcucaucaacuugccuccaugcaggugcaggccuacaauggcgggaacgcuaauccgcggccugccaacaaugaggaagaggaagaugaggaggacgaauaugauuacgacuaugagagccugucugaugacaacauccuggaagauagacccgagaauaaguccugcaacgacaaacuccaguuugaauacaaugaggagauuccuaagcgcaucaaaaaggcugacaacagcgccuguaauaaaggaaaggucuaugauauggaacugggcgaggaauucuaccuugaccaaaacaaaaaggagucucggcagaucgcgcccgaacuguccgaucucgugauuuauugccaggccguuaaguuucccgggcugagcacccucaaugcuucuggaagcuccagaggcaaagagcgcaagucucggaaaagcaucuucggcaacaauccugggagaauguccccgggagagacagccagcuuuaacaagaccuccggcaaaucuagcugugaagggauucgccaaacaugggaggaauccucuagcccccugaacccuaccacgucccuuucugcuaucauucggacccccaagugcuaccacaucagcucccugaaugagaacgccgccaagagacugugucggcgcuacagccagaaacucacacagcacaccgcuugccagcugcuuagaacauauccugcggccacccggauugacucuuccaaucccaacccucugauguucuggcuccauggaauccaacugguggcucucaauuaccagacagaugaccugccgcuucaccugaacgccgccauguucgaagcuaauggcggguguggauauguccugaagcccccugugcucugggauaaaaacugccccauguaccagaaguuuagcccucuggagcgcgaccuugauucuauggaccccgccguguauucccugaccaucgucagcggccagaauguuugcccgucuaacuccaugggcagcccuuguauugagguggaugugcucgggaugccccuggacuccugccauuucagaacgaaacccauccaccggaauacacugaacccuauguggaaugaacaauuucucuuccauguccacuuugaggaucuuguguuccugagauuugcgguuguggaaaacaauagcucugcugucaccgcccagcgcauuaucccccugaaggcccucaagcggggauacagacaccugcagcuucgcaaccugcauaaugaggugcucgagauuagcucccuguucaucaacucucggagaauggaagagaacagcuccggcaauaccaugucugcuagcuccauguuuaacacagaagagcgcaaaugucugcagacccaccggguuacggugcauggggucccuggaccggaacccuucacaguguuuaccaucaauggcgggacaaaggccaaacaacuccuucagcagauucugaccaacgagcaagacaucaagccugucacaaccgacuauuuccugauggaggaaaaauacuuuauuucuaaggagaagaaugaaugcagaaaacagcccuuccagcgcgcgaucggaccugaggaagagauuaugcagauccucagcuccugguuccccgaggaaggcuacaugggcagaaucgugcugaagacgcaacaggagaaccuugaagagaaaaauauuguucaggaugacaaggaagugauccugagcucugaggaggaauccuuuuucguccaggugcacgauguuagcccggagcaaccucggaccgugauuaaagcuccccgcgucucuacagcccaggacgugauccagcagacccucuguaaggccaaguauuccuacagcauucuguccaacccuaaucccucugauuaugugcugcucgaagagguugucaaagacacaaccaacaagaaaacgacaaccccuaagagcucccaaagagugcuucuggaucaggagugcguguuucaggcucagagcaaauggaagggggccggaaaauucauccugaagcucaaggaacaaguccaggcuucucgggaggacaaaaagaaaggcauuuccuuugccagcgaacugaagaaacuuacaaagucuaccaagcagccccgcgggcugaccagcccgucccaacuccugacaucugagagcauccagacgaaagaagagaagccugugggaggccuguccucuagcgauaccauggacuacagacaguga

SEQ ID NO: 73863 - RNA, 3876 nt, Artificial Sequence
  derived and/or modified sequence opt5 from PLCG1__Homo_sapiens__NP_002651
auggccggcgcugccagccccugcgcgaacggguguggaccuggcgcuccguccgacgccgaggugcugcaccucugcagaucucuggaagucgggaccguuaugacacuuuucuacagcaagaaaucccagcggcccgagcgcaagacguuucaagugaaacuggaaaccagacagaucacauggucucggggagccgauaagauugagggcgcuaucgacauucgcgaaaucaaagagauuagaccugggaagaccagccgggauuucgaccgcuaucaggaggaucccgccuuuagaccugaccagucccauuguuucgugauccucuacggaauggaauuucggcugaagacacuuucucugcaagcuaccagcgaggaugaagucaauauguggaucaaaggccucacauggcugauggaggacacccugcaggcccccacgccucuccagauugagcgcuggcugagaaagcaguucuauuccguggaucggaaccgcgaagacagaaucagcgcgaaagaucuuaagaauaugcugucucaaguuaacuaccgggugccgaauaugcgcuuucucagagagcggcugaccgaccuugaacagagauccggcgauauuacauaugggcaguucgcccagcuguaccgcagccucauguauucugcucagaaaaccauggaccugcccuuucuggaggccuccacacuccgggcuggagaaagaccugagcugugccgcgucagccuucccgaguuccaacaguuucugcucgacuaccaaggcgaacugugggccguggaucggcuucagguucaggaguucaugcugucuuuucucagagacccucugcgcgaaaucgaggaacccuacuucuuccuggaugaguuugugaccuuccucuuuuccaaggagaacagcgucuggaacucccagcuggacgcgguguguccggauacgaugaauaauccucuuucucacuauuggauuagcuccagccauaacacauaccugaccggggaccaauucucuuccgaaagcucucucgaggccuaugcucggugccugagaaugggaugucgcugcaucgaacuugauuguugggacggccccgaugggaugccugugauuuaccacggacauacacugaccaccaagaucaaauuuagcgacguccuccacacaaucaaggagcacgccuucguugcuuccgaauaucccgugauucugucuaucgaggaucauugcagcauugcccagcagcggaauauggcccaguacuuuaaaaaggugcugggcgacacgcuccugaccaaacccgucgagaucuccgcugacggccuuccuagcccgaaccaacugaagagaaaaauucucaucaagcacaagaaacuggcggaagggucugccuaugaggaagugcccacauccaugauguacagcgagaaugauaucucuaacuccauuaagaauggaauccuguaccuugaggacccuguuaaccaugaaugguauccccacuacuucgugcucaccagcuccaaaauuuauuacucugaggaaacaagcuccgaucagggcaacgaggacgaagaggagccuaaggaagucucuagcuccaccgagcugcacagcaaugaaaaaugguuucaugggaagcugggagcuggccgcgaugggcggcacaucgccgagagacuccugacggaauauuguauugagacaggagcccccgacggcucuuuccuugugcgggaguccgaaaccuuuguuggcgauuacacccugagcuucuggcgcaacgggaaggugcagcauugcagaauccacucucggcaggacgcuggaacaccgaaauuuuuccucaccgauaaucuggucuucgacucccuguaugaucuuaucacacauuaccaacaggugccucucagaugcaacgaguuugaaaugcgccugagcgagcccgucccucagacgaaugcccacgaaucuaaggagugguaccacgcgagccugacccgggcucaggccgagcauaugcucaugagagugccccgcgacggcgccuuccugguuagaaaacggaacgaaccuaauuccuaugcuauuagcuuucgcgccgaggggaagaucaaacacuguagagugcaacaggaaggacagacagucaugcuuggcaacucugaguucgauucccugguggaccucauuagcuacuaugagaagcauccccuguaccggaagaugaaacugcgcuauccgaucaaugaagaggcucuugaaaagauugggaccgccgagccugacuacggcgcgcucuaugaaggaagaaaccccggcuuuuacguugaggccaaucccaugccuacauucaaaugcgcugugaaggcccuguuugauuacaaagcucaacgggaggacgaacugaccuucaucaaguccgccauuauccagaacgucgagaagcaggaagggggaugguggcgcggcgauuaugggggaaagaaacagcucugguuuccgucuaauuacguggaggaaauggugaaccccguugcgcuggagccugagagagaacaccuugacgagaauagcccccugggcgaucuccugcggggaguccuggacgugccugccugucaaaucgcuauucgccccgaaggcaaaaacaacagacuuuucguguuuuccaucucuauggccagcgucgcucacuggucccucgauguggccgccgacucucaggaggaacugcaggauuggguuaagaaaauucgggagguggcucagacggcggacgccagacugaccgagggaaagaucauggaacgccggaaaaagauugcucucgagcugagcgaacuugucguguauugcagaccuguucccuucgaugaggagaagaucggcacagaacgcgccuguuaccgggacauguccagcuuuccggagaccaaagccgaaaaguaugugaauaaagcuaaggggaaaaaguuccugcaauacaacagacuccagcugucucgcaucuauccuaagggacagcggcuggauuccagcaauuacgacccccuuccuauguggauuugcggcucucagcuggucgcccucaacuuccaaacacccgacaaaccgaugcagaugaaucaggcgcuguuuaugaccgggagacauuguggauacgugcuccaaccuuccacgaugcgcgaugaggcuuucgaccccuuugauaagagcucucugcggggccuugaaccuugcgccaucuccauugagguucugggggccagacaccuccccaaaaacggccggggaaucgugugucccuucgucgagauugaaguggcuggcgccgaguaugacagcacaaagcagaaaaccgaauuuguggucgauaaugggcugaacccuguuuggccggcgaagcccuuccauuuucagaucuccaauccugaguucgcuuuucugcgcuucgugguguacgaagaggacauguuuagcgaucagaacuuccuugcccaagccacauuccccgucaagggacugaaaaccggcuauagagcugugccucucaagaauaacuacucugaggaccuggaacucgccagccugcuuaucaaaauugauaucuuucccgcuaagcaggagaauggggaccuguccccuuucucuggaaccagccuccgggaacgcggcuccgaugccucugggcagcuguuucacggcagagcgcgggaggggagcuucgaauccagauaucagcaaccguuugaggacuuccgcauuucucaggagcaucuggccgaccacuuugauagccgggaaagacgcgcuccccggagaacacgcguuaacggcgacaaucggcuuuga

SEQ ID NO: 73864 - RNA, 3798 nt, Artificial Sequence
  derived and/or modified sequence opt5 from PLCG2__Homo_sapiens__NP_002652
augagcaccacagugaacgucgacucccuggccgaguacgaaaagucucagaucaaaagagcucucgagcugggcacgguuaugaccguguucagcuuucggaaguccacacccgaacgcagaaccgugcaagucauuauggagacacgccagguggccuggucuaaaaccgcggauaagaucgaaggguuccuugacauuauggagaucaaagagauucggccuggaaagaauagcaaggauuuugaaagagcuaaagccguucggcagaaggaggacugcuguuucacaauccuguauggcacccaguuugugcucuccacgcugucucuugccgcugauagcaaagaagacgccgucaacuggcuguccgggcucaagauccugcaccaagaggcuaugaaugccagcaccccgacaauuaucgagucuuggcugcgcaaacagauuuacuccguggaucagaccagacggaacagcaucucucuccgcgaacugaagacaauucuuccccugaucaauuucaagguuuccagcgcgaaauuucucaaggacaaauucguggagauuggagcccauaaggaugaacugucuuuugagcaguuccaccuuuucuauaaaaagcugauguucgaacaacagaaauccauccucgacgaguuuaagaaggauagcuccgucuucauccugggcaacaccgacagaccugaugcuucugccguguaccugcaugacuuccagcgguuucucauucacgagcagcaagaacauugggcucaggaccugaauaaagugcgcgagagaaugacgaaguucaucgaugacacaaugcgggaaaccgccgagcccuuucuuuucgucgaugaauuucugacauaucucuucagccgcgagaacuccauuugggacgagaaauacgaugcgguugacaugcaggauaugaauaacccucugagccacuauuggaucucuuccagccacaauaccuaccuuaccggggaccaacugagaucugaaagcucccccgaggccuacauucggugccucagaaugggaugucgcugcaucgaacuggauuguugggacggcccugauggcaagccggugaucuaucauggguggacacggacgaccaaaauuaaguuugacgacgugguccaggcuaucaaggaucacgccuucgugacaucuagcuuucccguuauucuguccaucgaggaacauugcagcguggagcagcagagacacauggcuaaagccuucaaggaggucuuuggagaccuccugcuuaccaaaccuacagaagccucugcugaucaacugcccuccccuagccagcuccgcgagaagauuaucaucaaacacaagaagcugggcccccggggagacguggauguuaacauggaagacaaaaaggaugagcauaaacagcagggagagcuuuacaugugggacucuauugaucaaaaguggaccagacacuauugugcgaucgccgacgcuaaacuguccuucagcgaugacauugaacagacgauggaggaagaggugccgcaggauaucccucccacagaacuccauuuuggcgagaagugguuccacaagaaagucgagaagcgcaccuccgccgaaaaacugcugcaggaguacugcauggaaaccgggggaaaggacggcacauuccucgugcgggagucugaaaccuuuccuaaugacuauacacugagcuucuggagauccggccgcguccaacauugucggauuagaucuacgauggaagggggaacccuuaaauacuaucugacagauaaccucaccuuuagcuccaucuacgcccugauucagcacuaccgcgagacacaucugcggugcgcugaauuugagcuuagacucaccgaccccgugcccaauccuaacccgcacgaaagcaagcccugguauuacgauucucugucccggggcgaggccgaagacaugcugaugcgcaucccuagagauggggcguuucucauccggaaaagagagggaagcgacucuuaugcuauuacguuccgcgcccggggcaagguuaagcacuguagaaucaaccgcgaugggagacauuuugugcugggaaccuccgccuacuucgagagccuugucgaacuggugucuuauuacgagaaacacagccucuaucggaagaugcgccugagauaccccguuacaccugaacugcuugagcgguacaauauggagcgcgacauuaacucccucuaugaugugagcagaauguacgucgaccccucugaaaucaauccguccaugccucagcggaccgugaaagcucuguaugauuacaaggccaaacgcagcgacgagcuguccuuuugcagaggcgcucucauucacaacgugucuaaggaacccggcgggugguggaagggagauuauggcacacggauccagcaauacuucccuagcaauuauguugaggacaucuccaccgccgacuuugaagaacuggagaaacagauuaucgaagauaacccccuugggucucugugccgcgggauucucgaccugaauacguacaacgucgugaaggcgccucagggcaaaaaucaaaagagcuucguguuuauccuggagcccaaacagcagggggauccgccugucgaguucgccacagacagaguggaggaacuuuucgagugguuucaguccauucgggagaucaccuggaagaucgauacaaaggaaaacaauaugaaauacugggagaagaaccaaucuauugcuaucgaacucagcgaccugguuguguauuguaaacccaccuccaagaccaaagauaaucuggagaaccccgacuucagagaaauucgcagcuuugucgagacaaaggccgauucuaucauucggcagaagccuguggaccuccugaaauacaaucagaagggccuuacgagaguuuauccgaaaggacagcgcguggauuccagcaacuacgaccccuuccggcuguggcucugcggcucucaaauggucgcucugaacuuucagaccgccgacaaguauaugcagaugaaucaugcgcuguucucccuuaacgggagaacaggauacgugcuccagccugagagcaugcgcaccgaaaaauaugaucccaugccucccgagucucaacggaagauccugaugacacugaccguuaaagugcucggcgccagacaucugccuaaacuugggcgcuccaucgcuugucccuuugucgaaguggagauuugcggagccgaguacgacaauaacaaguucaagacgacaguggucaaugauaacggccugagcccgaucugggcuccuacccaggaaaagguuaccuuugagauuuacgaccccaaucucgccuuccugcgguuugugguguaugaagaggauauguucuccgacccuaacuuccuggcccacgcuacauaccccaucaaagcggucaagagcggguuuagaucugugccgcuuaaaaauggcuauagcgaagauauugagcuggccucccuccugguuuucugugagaugcggccugugcucgaaucugaggaggagcuguacagcuccugccgccagcuuagacggcgccaagaggaacugaacaaucagcucuuucuguaugacacccaccagaaccugagaaaugcuaaccgggaugcccuugucaaggaguucucugugaaugaaaaccagcugcaacucuaccaggagaaguguaacaaaagacugcgcgaaaagcggguuagcaauuccaaauuuuauucuuga

SEQ ID NO: 73865 - RNA, 5082 nt, Artificial Sequence
  derived and/or modified sequence opt5 from PLCH1__Homo_sapiens__NP_001124432
auggccgaccuggagguguacaagaaccucagccccgaaaaagucgagagaugcauguccguuaugcagucuggcacccaaaugaucaagcugaaacgggggacaaagggacuugugcgccuguucuaucucgaugaacacagaacgcggcugcgcuggagaccuagccggaaauccgagaaggcuaagauucuuaucgacucuauuuacaaagugaccgaaggccgccagagcgagaucuuucauagacaggccgaggggaauuucgauccguccuguugcuuuacaauuuaucacggaaaccauauggaaucucuggaccucaucaccagcaaucccgaggaagcgcggacauggaucaccggccugaaguaccugauggcugggauuuccgaugaggacagccucgccaaacgccagagaacacacgaucaaugggucaagcagaccuucgaggaagccgacaaaaacggagauggccugcuuaauaucgaggaaauucaucagcugaugcacaagcucaacgugaaucugccucggcgcaagguuagacagauguuucaagaggcugacacggaugaaaaccagggcacccuuacauucgaggaguuuuguguguucuauaaaaugaugucucugcggcgcgaccucuaccugcugcuccuguccuauagcgauaagaaagaccaccuuaccgucgaagagcuggcccaguuucucaagguggaacagaaaaugaauaacguuacaaccgacuacugccuggauaucauuaagaaauucgaggugucugaagagaauaaggucaagaacgugcuugggaucgagggauuuacgaauuucaugagaucccccgcuugugacauuuuuaacccucugcaucacgaaguguaccaagauauggaccagccccucugcaauuauuacaucgccagcucucauaacacauaucugaccggcgaucagcugcucucccaaagcaaagucgacauguacgcgcggguucugcaggagggguguagaugcguggaaguggauuguugggacggaccugauggcgagccggucgugcaccacggguauacacuuaccuccaagauccuguuccgcgacguuguggaaaccauuaacaaacaugccuucgucaagaaugaguuucccgugauccucucuauugagaaccacugcagcauccagcagcaacggaaaauugcucaguaccugaagggaaucuucggcgauaagcuugaccuguccagcguugacacaggcgaauguaaacagcucccuucuccccagucccugaaggggaaaauccuggugaagggaaaaaagcucccuuaucaucugggcgaugacgccgaggaaggggaggucagcgaugaggacucugcugaugaaauugaggacgaaugcaaguuuaaacuucacuacagcaauggaacgaccgagcaucaaguggaauccuucaucagaaagaaacuggagucucuccugaaggagagccagauucgcgauaaagaagaccccgauuccuuuacaguccgggcccugcuuaaggcgacccacgagggccucaacgcccaccugaagcagagcccggacgugaaagaaucugggaagaaaucccauggaagaagccugaugacaaauuucggcaagcacaaaaagaccacgaaaucucgcuccaagagcuacuccacagaugacgaggaagauacccagcaaucuaccggcaaggaggggggacagcucuaucggcugggcagacgccggaaaacaaugaagcuuugcagagagcugagcgaccucguuguguacaccaacuccgucgcugcccaggacaucguggaugacgggacaacgggaaauguucugucuuuuagcgaaacccgcgcucaucaggugguccaacagaaauccgagcaguucaugauuuauaaccaaaagcagcugacacggaucuacccuagcgccuauagaaucgauucuuccaauuuuaacccccuuccuuacuggaaugccggcugucagcucguggcucugaacuaucagagcgaagggcggaugaugcaacugaaucgcgcgaaauucaaggccaacggcaauugcggauacgugcucaagccccagcagauguguaaaggcaccuuuaaccccuucucuggggacccucugccggcuaaccccaagaaacagcuuauucugaagguuaucuccggacaacagcucccuaaacccccugauagcauguuuggcgacagaggggagauuaucgaucccuucgucgaaguggagauuaucggacugccgguggacugcuguaaggaucagacacgggucguggacgauaauggcuucaacccuguuugggaggaaacccugacguuuaccgugcacaugcccgagauugcccuugucagauuccucgugugggaccacgauccuaucgggcgcgacuuuguuggccagcggacagugaccuucucuagccugguccccggauacagacauguguaucuggaaggccucacagaggccuccaucuuuguucacauuaccaucaaugagauuuacgggaaguggagcccucugauccuuaaccccucuuauacgauucugcauuuccucggagcuacaaaaaaucgccaacugcagggccugaaggggcuuuuuaacaaaaauccgagacacuccagcuccgaaaacaauucucauuacgugcggaagcgcagcaucggagacagaauccuccggcgcaccgccuccgcgccugcuaaaggcagaaagaagucuaaaaugggguuccaggagauggucgaaauuaaggauagcguguccgaggccacacgggaccaagauggcgugcugcgcagaaccacccggucucugcaggcccgccccgucagcaugcccguugacagaaaccuccugggagcucuuucccugccugugagcgaaacagccaaagauaucgagggcaaggagaauucucucgcugaagacaaagaugggcggagaaagggaaaagccuccauuaaggacccgcacuuucugaacuucaauaagaaacugagcucuuccagcucugcgcuucugcacaaggauacgucccagggcgacaccaucgugagcacagcccauauguccgucaccggggagcagcucggaaugagcucuccccgcggcgggcggacaaccagcaacgcuacguccaauugccaagaaaacccuugucccucuaaaagccuguccccuaagcagcaccucgcccccgauccugugguuaaccccacacaggaccugcauggcgugaaaauuaaggagaagggaaauccggaagacuuugucgagggcaaaucuauccuuagcggguccgugcugucucacagcaaccucgagaucaagaaucuggaaggaaacagaggcaaagggcgcgcugccaccuccuucagccugucugauguuuccaugcuuugcagcgacauuccugaucugcauucuaccgcgauccuccaggaguccgugauuagccaccugaucgacaaugucacacucaccaacgaaaaugagcccggauccucuauuagcgcccugaucggccaauuugaugaaacaaacaaucaggcucuuacggugguuucccaccugcauaacaccagcgugaugucuggccacuguccucuccccucccuggggcugaagaugccgaucaaacauggauucugcaagggcaagagcaaaucuagcuuccuuuguuccucuccugagcugauugcccucagcuccucugagacaaccaagcacgcuacaaauaccgucuaugaaacgaccugcacacccaucagcaaaaccaagccugacgaugaccuguccagcaaagccaagacagccgcucucgagucuaaccugcccgggucccccaauaccagccggggauggcuuccuaaguccccgacaaaaggcgaagauugggagacccugaagucuugcagccccgcguccucuccugaccugacgcucgaggaugugauugccgaccccacacuguguuuuaacagcggggaauccagccuuguggagaucgauggagaaucugagaaucugucccucaccaccugcgaauacagacgcgagggcacaagccagcuggcuucuccucucaaacugaaguauaaccagggcgucguugagcacuuccaacgggggcuuagaaacggauacuguaaagaaacccugcgccccuccgugccugagauuuuuaauaacauccaggacgugaagacgcagagcauuucuuaccuggccuaucagggcgccggguucguccauaaucacuuuagcgacuccgaugcuaagauguuccaaacaugcgugccgcagcagucuagcgcccaagacaugcauguucccgugccuaaacagcucgcgcaccugccccuuccugcucugaagcuccccuccccguguaaaagcaagucccugggagaucucaccucugaagacaucgccugcaacuuugagagcaaauaccaguguaucuccaagucuuucgucacaaccggcauucgggauaaaaagggggugacaguuaagaccaaaagccuggaaccuaucgacgcccuuacggagcagcugagaaagcugguguccuuugaucaagaggacaauugccagguccucuauucuaaacaggaugcuaaccagcugccccgggcccuugugcgcaagcugagcuccagaagccaaucucggguccgcaauauugcguccagagcuaaagaaaagcaggaggccaacaagcagaaagugcccaauccuagcaacggagccggcguugugcuccggaauaagcccucugcuccuaccccggccgucaacagacauuccacaggcagcuacaucgcuggguaucugaaaaauaccaagggaggcgggcucgaaggacgcggcauucccgagggggccuguacagcgcugcacuacggacacguggaccaguucugcucugauaacuccguucuucaaaccgaaccuagcuccgacgauaaacccgagaucuauuuucugcugcggcucuga

SEQ ID NO: 73866 - RNA, 3288 nt, Artificial Sequence
  derived and/or modified sequence opt5 from PLCL1__Homo_sapiens__NP_006217
auggccgagggcgcugccgggagagaagaccccgcgccuccggaugcugccggaggcgaggacgauccccggguggggccugacgccgcuggagauugcgucaccgccgcuagcggcgggcgcaugagagaccggcgcuccggaguugcccugcccggcgcggccggcacgccugcugauucugaagccgggcuccuggaggcugccagagcgacaccccggcgcagcuccaucauuaaggacccuucuaaccagaaauguggaggcagaaagaaaaccgugagcuucuccucuaugccgagcgaaaagaaaaucuccagcgccaaugauugcauuucuuuuaugcaagcugggugugagcuuaagaaggugcggcccaacucccgcaucuacaauagauucuuuacacuggacaccgaucuccaggcccugcggugggagccuagcaaaaaggaccuugaaaaagcuaagcuggauauuucugccaucaaagagauccgccucggaaagaacacagaaaccuucagaaauaacggccuggccgaccagauuugcgaggacugugcuuuuuccauccugcacggggagaauuaugaaagccucgaucuggucgcgaacucugccgacguggcuaauauuuggguuuccggacuucgguaccuggugagccgcuccaagcagccccucgauuucauggagggcaaccaaaauacaccuagauuuauguggcugaaaaccgucuucgaagccgccgacguggauggcaacgggaucaugcuugaggacacgucuguugaacugauuaagcagcucaaucccacccugaaagaggcuaagauccggcugaaauuuaaggagauucagaaaagcaaggaaaagcucacaaccagagugacagaggaagaguucugcgaagccuuuugugagcugugcacccgcccggaggucuauuuccuucuggugcagaucuccaaaaacaaggaauaccucgaugcgaaugaccugaugcuuuuucuggaggcugaacaaggagugacgcauaucacagaggauauuugucucgacaucauucggagauaugaacugagcgaggagggccgccagaaaggguuccuggccaucgauggauucacccaguaccuccugucuuccgaaugcgacauuuuugacccugagcagaagaaagucgcccaagauaugacacagccccuuagccacuauuacaucaacgcuucucauaacaccuaccugaucgaagaccaguuccggggcccugccgauauuaauggguauaucagagcucucaagaugggaugucgcagcguugagcuggacguguccgauggcucugacaacgagcccauucuuugcaaucggaacaauaugaccacacacgugagcuuuagauccgucaucgaagugauuaacaaguucgccuuuguugcgagcgaguacccccugauccucugccugggcaaucauuguucucugccucaacagaaagugauggcccagcagaugaagaaagucuucgggaacaagcucuauacggaagcuccgcugcccuccgagagcuaccuuccuucucccgaaaaacugaagcgcaugaucauugugaagggcaaaaagcucccuuccgaucccgacguucuggagggagaggugaccgaugaagacgaggaagccgagaugagccggagaauguccgucgauuauaauggggaacaaaaacagauccgccugugccgggagcuuucugaccucgugagcauuuguaaguccguccaguacagagauuuugagcugucuaugaaaagccagaacuauugggaaaugugcuccuucagcgagacagaggcuucucggaucgccaaugaguacccggaagacuuugugaacuacaauaagaaguuccugucccgcauuuauccuagcgcgaugagaaucgacucuuccaaccucaauccccaagauuuuuggaacuguggaugccagauuguugccaugaacuuccagaccccuggccccaugauggaccugcacacagggugguuucuucagaauggcggauguggcuacgugcugcggccuagcaucaugagagaugaggucucuuauuucagcgcuaacaccaaagggauccuccccggaguguccccgcuggcccugcacauuaagaucauuagcggccaaaauuucccuaaacccaagggggcuugcgccaaaggagacguuaucgaucccuacguguguauugagauccauggcaucccugccgacugcucugaacagcgcacgaagacaguccagcagaacuccgauaauccgauuuuugacgagaccuucgaauuucaagugaaccuucccgagcucgcuaugauccgguucgugguucuggaugacgauuauauuggggacgaguuuaucggccaguacaccauuccuuucgaaugucugcagcccggauauagacacgucccucuccgcagcuuugugggcgauaucauggagcaugugacacuguucguccacaucgcgauuaccaauagauccgggggaggcaaagcccaaaagcggucucuuagcgugcgcauggggaagaaaguuagagaauacacaaugcugcggaacaucggacucaagacgauugacgacaucuuuaaaauugcugugcacccccugcgcgaggccaucgauaugagagaaaauaugcagaacgccaucgucuccauuaaggagcugugcggccuuccucccaucgcuucucucaaacagugccugcugacccucagcucccggcugauuacaucugacaauaccccgagcgugucccuuguuaugaaggauagcuucccuuaccuggagccccucggggccaucccugacgugcagaagaaaaugcugacagcguaugaucugaugauucaagaaucucgcuuucuuaucgagauggcugacaccguccaggaaaagauugugcagugucagaaagccggcauggaguuccaugaagaacuccacaaccugggagccaaggagggccugaaagggagaaagcucaauaaggcuacggaauccuuugccuggaacaucaccguucugaaaggacaaggcgaucuucugaagaaugcgaaaaacgaggcuaucgaaaacaugaagcagauucagcucgccugccugagcugugggcugucuaaagcccccuccagcucugcugaggccaaguccaagcggagccuugaagcuaucgaggagaaagaauccagcgaggaaaauggaaagcuguga

SEQ ID NO: 73867 - RNA, 3384 nt, Artificial Sequence
  derived and/or modified sequence opt5 from PLCL2__Homo_sapiens__NP_001137854
auggccgagugcggcagagggggagcugccggcggggcgcugcccaccagcccuggaccggcucucggcgccaagggggcccugaaagcuggagugggcgaaggcgggggaggcgggggacggcuuggccacgggcgcgccagauacgacuccggaggcgucucuaacggcgauuguagccuggggguuuccggagacgaggcucgggccucucccacacgcggcccuagagggguggcgcucgcccccacgccuagcgcuguggucugcacccugccccgggaauccaagccuggaggccuuccgcgcagaucuagcaucauuaaagaugggacaaagcagaaacgggagcgcaagaagaccguguccuucagcucuaugcccacagaaaagaagaucuccagcgccucugacuguauuaauuccaugguugagggaagcgagcugaaaaaggugagaucuaacucccggaucuaucaucgcuacuuucuccuggaugcugacaugcaaagccugagaugggaaccuuccaaaaaggauucugagaaggccaaaauugacaucaagagcaucaaagaaguccggaccggcaagaauacagauauuuuccgcuccaacggcaucagcgaccagauuucugaggauugcgcguuuuccgugaucuauggggagaauuacgaaagccucgaccugguugccaacucugcugauguggccaauauuugggucaccggacuuagauaucugaucagcuacggcaaacacacgcucgacaugcuggaguccucucaggacaacaugcggaccagcugggugucccagauguucagcgaaauugauguggacaaucuugggcauaucacacuguguaacgcuguccaaugcaucagaaaucucaaccccggacugaagaccucuaaaauugagcugaaguuuaaggaacuccacaaauccaaggauaaagccggcacagagguuaccaaggaggaguucaucgaaguguuucaugaacuguguacgcgcccugagauuuauuuccuucuggugcaguuuagcucuaauaaagaguuccucgacacaaaggaucugaugauguuucuugaagccgagcagggggucgcucacaucaacgaagagauuucccuggaaaucauccacaaguacgagcccagcaaagaaggccaggagaagggauggcucuccauugacggcuucaccaauuaccugaugucuccggauugcuauaucuuugacccugagcauaaaaaggugugucaagauaugaaacagccccugagccacuacuucauuaacuccucucauaacacauaucucaucgaagaccaguuccgggggccuagcgauauuaccggauacaucagagcgcugaagaugggcugccgcuccguugagcuugacgugugggacgggcccgauaaugaacccgucaucuauaccggacacacaaugacgagccagauuguguuucggucuguuaucgacauuaucaacaaguacgccuucuuugcuuccgaguauccucugauucucugucuggagaaucacugcagcaucaaacaacagaaggugaugguccagcauaugaaaaagcugcugggcgauaaacucuacaccacaucuccgaacguggaagaguccuaccugcccagcccugacguccugaaggggaagauucucaucaaagccaagaaacugucuagcaauugcuccggcguggaaggagauguuaccgacgaggaugaaggcgccgagaugagccaaagaauggggaaggagaacauggaacagcccaauaacgugccugucaaacgcuuccagcuuuguaaggagcugucugaacucguguccaucugcaaaagcguucaguuuaaggaguuccaaguguccuuucagguccagaaguauugggaaguguguucuuucaaugaggugcuggcuagcaaauacgccaacgagaaucccggagacuuuguuaacuauaauaagcgguuccuggcgagagucuuuccguccccuaugcgcauugauucuagcaacaugaauccccaggacuucuggaaaugcggcugucaaaucguggcuaugaacuuucagacaccugggcuuaugauggaucucaacauuggaugguuccggcagaauggcaacugcggguacgugcugagacccgccaucaugcgcgaagaggucuccuucuuuucugccaauaccaaggacagcgugccuggcguuagcccccagcugcuccacauuaaaaucaucuccggacaaaacuucccgaagccuaagggcucuggggcuaaaggagauguggucgaccccuauguguacguugaaauucauggcauccccgccgacugugcugagcagcggacgaagacagugcaccagaauggggaugccccuauuuuugacgaauccuucgaguuucagaucaaccugccggagcuugcgauggucagauucgugguucuggaugacgauuauauuggagacgaauuuaucggccaauacaccauccccuucgagugccuccagaccggguaccggcaugugccucugcagagccugacaggcgaaguccuugcccacgcuucucucuuugugcacguggccauuaccaaucgcagaggaggcgggaaaccccauaagcggggacuguccgucagaaaaggcaaaaagagccgcgaguaugcuucucugcggacacucuggaucaaaacgguugaugagguguucaagaacgcccaaccucccauuagagacgcgaccgaucugcgcgaaaauaugcagaacgccguggucuccuuuaaagagcuuugugggcugagcuccguggcuaaucucaugcagugcaugcuggccguuagcccuagauuccugggacccgacaacacaccgcuugugguccucaaucugucugaacaguacccuaccauggagcugcaaggcaucgugcccgaaguucucaagaaaauugugacaaccuaugauaugaugauccagagccugaaggcucuuaucgagaacgccgacgccgucuacgagaagauugugcacugucagaaagcugcgauggaauuucaugagcaccuucacuccaucggcacgaaggaagggcucaaagagcggaagcugcagaaagccguugaaucuuucaccuggaauauuacaauccugaagggacaagcugaucuucucaaauaugccaagaacgagacccuggagaaccugaagcagauucauuucgccgcugugagcugcggccucaauaaaccugggacagaaaacgccgacguccagaagccccgcagaucccuggaggugaucccggaaaaagcgaaugacgagaccggagaauga

SEQ ID NO: 73868 - RNA, 918 nt, Artificial Sequence
  derived and/or modified sequence opt5 from PLCXD2__Homo_sapiens__NP_001172035
augcuggccgugagaaaggcucggcgcaaacucagaaugggcaccaucugcagccccaacccuuccgggacaaagacgucuagcgaggucuguaaugccgacuggauggcgucccugccgccccaccuucauaaccugccucucucuaaucuggcuauucccggaagccacgauuccuucucuuacuggguugacgagaaaagcccugugggccccgaucagacccaagccaucaagcggcuugcccgcauuucccuggugaaaaagcucaugaagaaauggagcgucacacagaaccugaccuuuagagaacagcuggaagcugggauccgguauuucgaccuccgcgugucuuccaagccuggagaugccgaccaggagauuuacuuuauccauggccuguucgggaucaaaguuugggauggacuuauggaaauugacagcuuucugacacaacacccgcaggagaucauuuuccucgauuuuaaucauuucuaugcuauggacgagacccaccacaagugccuggugcuuagaauccaggaagccuuuggcaacaaacugugucccgcgugcucugucgagucccucacacugcggacccugugggaaaagaauugucaggugcucauuuucuaccauugcccuuuuuauaagcaauaccccuuccuguggccuggcaaaaagauccccgccccgugggcuaacacgaccagcguucgcaaacuuauucuguuucucgagacaacccugucugagagagccucccgggggagcuuccacgugucccaggcuauccuuacaccucgcgucaagaccaucgccagaggacuggugggcgggcucaaaaauacgcuggugcauucuaaccgguggaauagccacggacccucccugcucagccaggaacgcucuuga

SEQ ID NO: 73869 - RNA, 966 nt, Artificial Sequence
  derived and/or modified sequence opt5 from PLCXD3__Homo_sapiens__NP_001005473
auggccagcucccagggcaagaacgagcugaaacucgcugacuggauggccacccugcccgaaucuaugcacagcaucccucuuacaaaucuggcgauuccggggucccaugauucuuucagcuuuuacaucgacgaggcuucccccgugggaccugaacaacccgagacgguccagaacuucguuucuguguuuggcaccguggccaagaaacucaugagaaaguggcuggccacacagaccaugaauuucacagggcagcuuggagcuggcauucgguauuuugaucugcgcaucagcaccaaaccuagagaccccgauaacgaacucuacuucgcccacgggcuguuuuccgcuaaggucaaugagggacuggaggaaauuaacgccuuccucacagaccaucacaaggaggugguuuuucuggauuucaaucauuuuuauggcaugcaaaaauaccaccacgaaaaacuugugcagaugcugaaggacaucuauggcaacaagaugugcccugcgaucuucgcccaggaggucagccucaaauaccugugggagaaggauuaucaggugcuuguguuuuaccauucuccgguugcucuggaaguccccuuccucuggccugggcaaaugaugcccgccccuugggcuaauaccacggaccccgagaagcugauucaguuccugcaggccuccaucaccgaacggcgcaaaaagggcagcuuuuucauuucucagguggugcucacaccgaaagcguccaccgucguuaagggaguggccagcgggcugagagagacaaucaccgaacgggcccuuccugcuaugaugcaaugggugcgcacgcagaaacccggagagucuggcauuaacaucgucacagcugauuuuguggagcugggggacuucauuuccaccguuaucaagcucaauuacguguuugaugaaggagaggccaacacauga

SEQ ID NO: 73870 - RNA, 1827 nt, Artificial Sequence
  derived and/or modified sequence opt5 from PLCZ1__Homo_sapiens__NP_149114
auggagaugagaugguuccugagcaagauccaggacgauuuucggggcgggaaaauuaaccucgaaaagacccaacgccugcuugagaaacuggacaucagaugcuccuacauucacgugaagcagaucuucaaagauaaugaccggcucaagcagggacgcauuacaaucgaagaguuuagagccaucuaucggauuaucacgcaucgcgaagagauuaucgagauuuucaacaccuacucugaaaauagaaagauccugcuugcuagcaaccuggcccaguuucucacacaagagcaguaugcggcugaaauguccaaagccauugccuucgagaucauccagaaguacgagcccauugaagagguccggaaagcucaccagaugucucuggaaggcuuuacccgcuauauggauagcagagagugucuccucuucaagaaugaaugccggaaaguuuaccaagacaugacacauccucugaacgauuauuuuaucuccucuagccacaauaccuaccuuguguccgaccagcugcucgggccgagcgaucuguggggauacgugucugcccuugucaagggcugucgcugccuggagauugacuguugggauggggcucagaacgagcccgugguuuaucauggauacacacucaccuccaagcugcuguucaaaacggugauccaggccauucacaaguaugcguuuaugaccagcgacuacccugucgugcucucucuggaaaaucacugcuccacagcccaacaggagguuauggcugauaaccuucaggccaccuucggcgaaagccugcucucugacaugcuggacgauuuucccgacacacuuccuucccccgaggcucugaaauucaagauccucgugaaaaauaagaaaaucggcacccugaaggaaacgcaugagagaaaggggagcgauaaacggggagacaaccaagauaaggagacaggcgucaaaaagcugccuggggugaugcuguucaaaaagaagaaaacccgcaagcugaaaauugcccuugcgcuguccgaccucgugaucuauacaaaggccgaaaaauuuaagucuuuccagcacagcagacuguaccagcaguuuaaugagaacaauuccauuggagaaacccaagcucggaaacuuagcaagcugagaguccaugaguucaucuuucacacccgcaaguucauuacacggaucuauccgaaagccacgagagcugauucuuccaacuuuaacccccaggaguucuggaauaucggcugucagaugguugcccucaacuuucagaccccugggcugcccauggaccugcaaaauggaaaguuccucgauaacggcggcagcggguacauucugaaaccucacuuucuucgcgaaucuaagagcuacuucaaucccuccaacaucaaggagggaaugccgauuacacugaccauccggcucauuucuggcauccagcugccucugacacauagcuccagcaauaaaggggacucucuugugauuaucgaaguguuuggaguccccaacgaucagaugaagcagcaaaccagagugaucaaaaagaaugccuucuccccucgcuggaacgagacguucacauuuauuauccacguucccgaacucgcucugauucgguucguggucgagggccaggggcugaucgcgggaaaugaguuucucggccaguauacccugccccuucugugcaugaacaaaggcuacagacgcauuccucucuucagccggaugggggaaucucuggagccggccucccuguuuguguauguuugguacgugagauga

SEQ ID NO: 73871 - RNA, 3111 nt, Artificial Sequence
  derived and/or modified sequence opt5 from PLD1__Homo_sapiens__NP_001123553
augagccugaagaacgagcccagagugaauaccuccgcccuccagaaaaucgcugccgacaugucuaacauuaucgaaaaucuggauacacgggagcuucacuucgaaggcgaggaagucgacuacgauguuagcccuuccgacccgaagauucaagagguguauauccccuuuucugcgauuuacaacacgcagggguucaaagagccuaauauccagaccuaucugagcggaugccccaucaaggcucaggugcucgaagucgagcgcuuuacauccaccacaagagugccuucuauuaaccuguacaccaucgaacuuacacauggcgaguucaaauggcaaguuaagcggaaguuuaaacacuuccaggaguuucaucgcgaacugcucaaguauaaagccuucauuagaauccccauuccuacccggcgccacacguuuagacggcagaaugugcgcgaggaaccgagagagaugcccagccugccucgguccagcgaaaacaugauccgcgaggagcaguuccuggggagacggaagcaacucgaagauuaccugaccaaaauucuuaagaugcccauguaucgcaauuaccaugccacaaccgaguuucuggacaucucucagcucuccuucauccacgaucugggaccuaagggcauugaagggaugaucaugaaaagaagcggaggccaccggauucccggccuuaacuguugcgggcagggcagagcuuguuaccgcuggucuaagcgguggcugaucgucaaagacuccuuucuccuguauaugaagccggauagcggagccauugcuuucgugcugcucguugacaaagaguucaagaucaaaguggggaagaaggaaacagagaccaaauacggaaucagaauugauaaucugucucgcacgcuuauccugaagugcaacuccuaucggcaugccagaugguggggcggggcgauugaggaauuuauccagaaacacggaacaaauuuccucaaggaccaucgcuuuggcagcuacgccgcuauucaagagaacgcccuggcuaaaugguaugucaaugccaagggcuacuucgaagauguggcgaacgccauggaggaagcuaacgaggagaucuuuaucaccgacugguggcuuuccccugaaauuuuccugaagcggcccguggucgaggggaauagauggcgccucgacuguauccugaaacggaaggcccagcagggaguuagaauuuuuaucaugcuguauaaagaaguggagcucgcucugggcauuaacucugaguacacaaagcgcacccuuaugcggcugcacccuaauaucaaagugaugagacaccccgaucaugucagcuccaccguguaccucugggcccaccaugaaaagcugguuauuaucgaccaaagcguggccuucgucgggggaaucgaucuugcuuauggccggugggacgauaacgagcaccgccugacagacguggggucuguuaagagagugacguccggacccagccucggcucucugccuccggcggccauggaaagcauggagucccugcggcucaaagauaagaaugaacccguccagaaccugccuauucagaaaucuaucgacgauguggacagcaagcugaaaggcauugggaagcccagaaaguuuuccaaauucagccuguacaagcagcuccaucgccaccaccuucaugaugcugacucuaucuccagcauugacucuaccuccaauacaggaagcauccggucccugcaaaccggcgucggggagcuucacggagagacaagauuuuggcauggcaaagauuauugcaacuucguguuuaaggacuggguucagcucgauaaaccuuucgccgacuucaucgaucgcuacucuacccccagaaugccguggcacgacauugccagcgcugugcacgggaaggccgcgcgggaugucgcucgccauuuuauccagagauggaauuucacgaaaauuaugaaguccaaguaucggucucugagcuacccuuuucugcuccccaaaucccagacaaccgcccacgaacugcgcuaucaagugccuggcagcguucaugccaacgugcagcuucugagaucugcugccgacugguccgcuggaaucaaguaccacgaggaaagcauucaugccgcguacguccacgugaucgaaaauucucggcacuauaucuacauugagaaccaguucuuuaucuccugugccgaugacaaagugguuuucaauaagauuggcgaugcuaucgcccagcgcauucucaaagcucauagagagaaccaaaaguaucgggucuacguggugaucccccugcugccuggguuugagggagacaucagcaccggcgggggaaaugcccuucaggcgauuaugcacuucaacuaucgcacaaugugcagaggcgaaaacucuauccucgggcagcugaaggccgagcugggcaaucaguggauuaacuacaucagcuuuuguggacuccggacccaugcugaacuggagggcaaucuugucacagaacugauuuaugugcacuccaaacuccugaucgccgaugacaacacgguuauuaucgggagcgcuaauaucaacgacagaucuaugcugggaaagcgcgauuccgagauggccgugauuguccaagacaccgagacagugcccagcguuauggauggcaaagaauaccaggccgggcgguucgcuagaggacuucgccuccagugcuuucgggugguccugggcuaccuggacgauccguccgaggacauccaagauccugugucugacaaguucuuuaaagaaguuugggugagcaccgcggccagaaaugcuacaauuuaugauaaggucuuccgcugucuccccaacgacgaggugcauaaucugauccagcuucgggauuucauuaacaagcccgugcuggccaaagaggacccuaucagagccgaagaggaacucaagaaaauccgcggguuucugguccaguucccguuuuacuuccuguccgaggaaucucuucuccccagcguuggcaccaaggaggcuauugugccuauggagguguggacguga

SEQ ID NO: 73872 - RNA, 2769 nt, Artificial Sequence
  derived and/or modified sequence opt5 from PLD2__Homo_sapiens__NP_001230037
augaccgccacacccgagagccuguucccuacgggcgacgaacucgauuccucucagcugcaaauggagagcgacgaaguggauacccuuaaggagggggaagacccggcugauagaaugcaccccuuucuggccaucuacgagcuccagucccugaaaguccauccucuuguuuucgcgcccggagugccugugacagcucaggucgugggcaccgagcgguauacaucugggagcaagguuggaaccugcacacuguacuccgugcgccucacccacggcgacuuuucuuggacgaccaaaaagaaauauagacauuuccaggaacugcaccgggaucugcuccgccauaagguccugaugagccuucugccccucgccagauuugccguggcuuacuccccugcccgggacgcugggaaccgcgagaugccgagccugcccagagccggaccugaaggcucuacacggcacgcggccuccaagcaaaaauaucuugagaauuaccugaaccgccuccugaccaugagcuucuauagaaauuaccacgcuaugacagaguuucuggaaguuucucagcucuccuucauucccgaucugggccggaaggggcuugagggaaugauccgcaaaagaagcggcgggcaucgggugccuggacugaccuguugcggccgcgaccaggucuguuacagauggucuaagcgguggcucguggugaaagauuccuuucugcuuuauaugugccuggaaacgggggccauuagcuucguccagcucuuugaccccggauucgagguucaagugggcaagagauccacagaagcucgccacggcgugcggaucgauaccucucauagaagccugauucugaaguguuccagcuaccgccaggcccgguggugggcgcaggagaucacagagcucgcccaggggccgggaagagacuuucugcaacuucaccgccacgacucuuaugcuccuccccggccuggcacccuggccagaugguucgucaacggggcuggauacuucgccgccguggcugaugcgauccuccgcgcccaggaagagauuuuuaucaccgacugguggcugucccccgaaguuuaucuuaaacggcccgcucauagcgaugacuggagacuggauauuaugcucaagcgcaaagccgaggaaggcgugcgggucucuauccugcuguucaaggagguggagcucgcccuggggauuaauagcggauacuccaaaagagcucuuaugcugcuccacccuaacaucaagguuaugcggcauccggaccaggugacacugugggcccaccaugaaaaacugcuugucguggaucaagucguggcguuucucggcggccuggaccuggcuuaugggcgcugggaugaccuccacuacagacugacggaucuuggagacucuagcgaguccgccgccagccagcccccuacgccccggccugacucucccgcuacaccggaucugucccacaaucaguucuuuuggcucggcaaggacuacagcaaccugauuaccaaggauuggguucagcuggacagaccuuucgaagauuuuaucgaccgcgagacaacgccccggaugccuuggagagaugugggggucgugguucauggacuucccgcccgcgaccucgcuagacacuucauccaacgguggaauuuuaccaaaacaaccaaggccaaauauaagaccccuacauaccccuaucugcugccgaaaucuaccuccacagcgaaccagcucccuuucacgcugcccggcgggcagugcaccacagugcagguccuucgcagcguggauagaugguccgccggcacccuggaaaauucuauucucaacgcuuaccugcauacaauccgggagagccaacacuuucuguauauugagaaucaguucuuuaucuccuguucugacggacgcaccgugcuuaacaagguuggcgaugaaauugucgacagaauccucaaggcccacaaacagggguggugcuaccggguguaugugcugcugccccuccugccuggauucgagggcgauaucagcaccgggggaggcaauuccauucaggcuauccuucauuucaccuaccgcacacuguguagaggggaauacagcauucuccaccggcugaaggccgcgaugggcaccgccuggcgcgacuauaucucuauuugcggacugagaacacauggcgagcuugggggacacccggucuccgagcucaucuacauccauagcaaagugcugauugcugacgaucggaccguuaucauuggcucugccaacaucaacgacagaucccugcucgggaagcgcgauagcgaacuggcugugcuuauugaggacacggaaacagagcccucucugaugaauggagccgaauaucaagccggcagcgucauccucggggcuaacacccggccugaucuggaccugagagaucccauuugugacgacuuuuuccagcuuuggcaggauauggcggaguccaaugccaacaucuacgagcagaucuuucgcugccugccuagcaaugcuacacggucucucagaacccugcgcgaauauguggccguugagccccucgccaccguguccccuccccuggcucggagcgaacuuacacaaguccagggccaccuggugcacuucccgcucaaauuucuggaggaugaaucccugcuuccuccccugggaucuaaggagggcaugauuccucucgagguuuggacguga

SEQ ID NO: 73873 - RNA, 1473 nt, Artificial Sequence
  derived and/or modified sequence opt5 from PLD3__Homo_sapiens__NP_001026866
augaagcccaaacugauguaccaggagcucaaggugccugccgaggaaccggcuaacgaacugcccaugaaugagaucgaagccuggaaagcggcugagaagaaagccagauggguccuucugguucucauucuggccguggugggcuucggggcucuuaugacccaacuguuucucugggaguauggagaccugcaccuguucggcccuaaccagcggcccgccccuugcuacgaucccugugaagcuguccucguggagagcaucccugaagggcuggacuuuccgaaugccuccacaggaaaccccucuacgagccaggcguggcuuggccugcucgccggggcucauuccucucuggauauugccagcuucuauuggacccuuacaaauaacgacacccacacacaggagccuuccgcucaacagggagaggaaguucugcgccagcuccagacccuggcccccaagggcgugaaugucagaaucgcggugucuaagccuagcggcccccaaccgcaggccgaucugcaggcucuccugcaguccggggcccaaguucggaugguggacaugcagaaacuuacacauggaguccugcacaccaaguuuugggugguggaucagacgcauuucuaccucggcagcgcuaacauggacuggcgcucucugacccaagucaaagagcuugggguugugauguauaauugcuccugucuggccagagaucucacaaagauuuuugaagccuacugguuccugggacaggcuggcagcucuaucccuuccaccuggccccgguuuuaugacacacgcuacaaccaggagaccccuauggaaaucugccugaaugggacgcccgcgcucgccuaccuggcuagcgcucccccuccgcuuugucccucuggaagaacaccugaucugaaagcccuccugaacguggucgacaaugcccgguccuucauuuauguggccguuaugaacuaccuucccacccuggaguuuagccacccucaccgcuucuggcccgcgaucgaugacggccucagacgggcuacauaugagcgcggcgugaaggucagacugcugauuuccugcugggggcauucugaaccgagcaugcgggccuuucuccugucccuugccgcucugcgcgacaaucacacccauagcgauauccaggugaaacucuucguugugccugccgacgaggcucaagcccggauucccuacgcgagagucaaccacaacaaguauauggugaccgaaagagccacauacaucggaacgucuaauugguccggcaacuauuucaccgagacagcugggaccagccugcuggucacacagaauggacgcggcgggcuucggucucagcucgaagccauuuuucugagagauugggacagcccuuacucccacgaucuggacaccucugcugauagcgugggaaacgccugucgccuccuguga

SEQ ID NO: 73874 - RNA, 1521 nt, Artificial Sequence
  derived and/or modified sequence opt5 from PLD4__Homo_sapiens__NP_620145
augcugaagccccucuggaaagccgcuguggccccuaccuggccgugcagcaugcccccuagacggcccugggaccgcgaggcgggcacacugcagguccuuggggcucuggccguucucuggcugggauccguggcccuuaucugucugcucuggcaagugccuagacccccuacguggggccagguccagccgaaggaugugccccggucuugggaacacgggagcuccccugcuugggagccccuggaagccgaggcucgccagcaaagagacucuugccagcugguucucguggaaagcauuccucaggaucugcccuccgccgcgggaucuccgagcgcccagccucuuggccaggcuuggcugcagcuccuggacaccgcccaggaguccguccauguggcuagcuacuauuggucucuuacagggcccgauaucggaguuaacgacuccagcucucagcugggcgaggcccuccugcaaaaacugcagcagcuccugggccggaauauuucccuugcgguggccaccagcucuccuacacuggcucgcaccuccacagaucuccaaguccuggccgcuagaggggcccacgugcggcaagugcccaugggacgccuuaccagaggcguccugcauagcaaguucuggguuguggacgggcggcacaucuacaugggauccgccaacauggauuggcgcucucucacccaggugaaagaacugggcgcugucauuuauaauuguagccaucuggcgcaggaccucgagaagacguuucaaacauacugggugcuggggguucccaaggccgugcuuccuaaaaccuggccgcagaacuucuccagccacuuuaauagauuccagcccuuucacggacuguucgauggcgucccuacaaccgcuuauuuuucugccuccccucccgcccucugcccccagggccggacgcgcgaccuggaagcccuucuggcugugauggggagcgcgcaagaguucaucuacgcuucuguuauggaguauuuuccgacaaccagauucagccauccuccccgguacuggccugugcucgauaacgcccugagagccgcugccuuuggaaagggcguccgcgugcggcugcucgucggguguggacugaauacagaccccaccauguucccuuaccuuagaucccugcaggcucucucuaaccccgccgcgaaugugagcguugacgugaaagucuuuaucgugccgguuggcaaccacuccaauauuccuuucagccgcgugaaccauucuaaguucauggucaccgaaaaagccgcuuauaucgggacauccaauuggagcgaggauuacuuuucuuccacggccggagugggccuggugguuacccagagccccggcgcucagcccgccggggcgacaguccaagaacagcugcggcagcuuuucgagagagacugguccucucgcuaugccgugggacucgauggccaggcuccugggcaagacugcguguggcagggauga

SEQ ID NO: 73875 - RNA, 1425 nt, Artificial Sequence
  derived and/or modified sequence opt5 from PLD5__Homo_sapiens__NP_001182740
augagccagcaaaagugcaucgugauuuucgcccuggucugcugcuuugcuauccucguugcccugauuuucuccgcgguggacaucaugggcgaggaugaagacgggcuuucugagaaaaacugucagaauaagugcagaauugcucugguggaaaacauccccgagggacucaauuacagcgaaaacgccccuuuucaccugucccuuuuccagggcuggaugaaucugcucaacauggccaaaaagucugucgauaucgugagcucccauugggaccugaaucacacccauccgucugcuugucaggggcaacggcuguuugagaaacuccugcagcuuacaagccagaacauugagaucaagcugguuuccgaugugacggccgacagcaagguccucgaagcucugaaacuuaagggagccgaggugaccuauaugaauaugacagcguacaacaaaggccgccugcagucuuccuucuggauuguugauaagcaacacguguauaucgggagcgccggacucgacuggcagucucugggccagaugaaagaacugggcgucaucuuuuacaauugcuccugucucgugcuggaucuucagagaauuuucgcucuguauagcucucucaaguuuaagucccgggugccccaaaccuggagcaaacgccuguacggggucuaugacaacgagaagaaacuucagcugcagcucaaugagacaaagucccaagccuucguuucuaacagcccuaaacuguuuugccccaagaauagauccuucgauauugacgcuaucuacagcgugaucgaugacgccaaacaguacguguauauugcggucauggacuaccugccuaucucuuccaccagcacaaagcggaccuauuggcccgaucucgacgccaagauucgcgaagcucuggugcuuagaucuguucgggugcgccugcuccugagcuuuuggaaagagacggauccucuuaccuucaacuucaucuccucucugaaggccauuuguacagaaaucgcuaacugcagccucaaagucaaguuuuucgaccuggagagagaaaaugccugugccaccaaagagcagaagaaccauacauuuccgcggcugaaucgcaacaaguacauggugaccgauggagcugcguauaucggcaauuucgacuggguugggaacgauuuuacgcagaaugccggaacaggccucgugauuaaccaagcugacgucagaaauaaccgguccaucauuaaacagcugaaggauguguucgagcgcgacugguacagccccuaugccaaaacccuucagccuacaaagcagcccaauuguucuucccuguuuaaacucaagccucugagcaacaagaccgccaccgaugacacagggggaaaagaccccagaaaugucuga

SEQ ID NO: 73876 - RNA, 13725 nt, Artificial Sequence
  derived and/or modified sequence opt5 from PLEC__Homo_sapiens__NP_000436
augagcggcgaggacgccgaaguccgggcugucuccgaggauguuucuaacgggagcuccggaucucccagcccuggcgacacccugccguggaaucucgggaagacacagcggucccgcagaucuggaggcggggccggaagcaacggcuccgugcuggaucccgcggaacgggcugugauccgcauugccgacgagagagaucggguccagaagaagacguucaccaaaugggugaauaagcaccuuaucaaagcccagcgccauauuagcgaccuguacgaagaucucagagacggccacaaccugaucucucuucuggagguucucuccggggauagccugccucgggagaagggacgcaugagauuucauaagcugcagaaugugcagauugcucucgacuaucugcggcaccgccaagucaaacuugugaacaucagaaaugaugacaucgccgauggcaaccccaagcugacacucgggcugauuuggaccaucauucuucauuuccagaucucugacauucagguuuccggacagagcgaagacaugacagcuaaagagaagcugcuccuguggucucaacggaugguggaaggcuaccaggggcugcgcugcgauaauuuuaccuccagcuggagagacggacggcucuuuaacgccaucauucacagacacaaaccucugcuuaucgauaugaauaaggucuaucgccagacaaaccuggagaaucucgaccaggcguuuuccguggccgagcgggaucugggcgugaccagacuucuggaccccgaagaugucgacguuccucaaccggaugagaagucuaucauuacguacgugagcucccucuaugacgcuaugccccgcgugccugauguccaggacggcgugcgggccaacgaacugcagcugagauggcaagaguaccgcgaacucguucugcuucugcuccaguggaugcggcaucacaccgcugccuucgaggagagacgcuuucccagcucuuucgaagagaucgaaauucuguggucccaguuucuuaaauucaaggagauggaacugccugcgaaagaggccgacaagaaucggagcaaagggaucuaucagucucucgagggagcugugcaagccggccagcugaaggugcccccgggguaccauccucuggauguggaaaaagaguggggaaagcuccacguugcuauucuggaaagagagaagcagcuucgcagcgaauuugagcggcuggagugucuccagagaaucgugacaaaacugcaaauggaagccggccugugcgaggaacagcuuaaccaggccgacgcucuccugcaguccgauguccggcugcucgcggccgggaaggugccccaacgcgcuggagaggucgagagagaccuggauaaagccgacucuaugauccggcuucuguucaacgaugugcagacccucaaggacggcagacacccucagggcgaacagauguaccgccggguuuauagacugcaugagcgccugguggccauuagaacagaauacaaucuucggcucaaagcuggggucgccgcgcccgcuacccaaguggcccagguuacgcugcagagcgugcaacgcagacccgagcuggaagauuccacacuccgguaucugcaggaccuucuggccugggucgaggagaaccagcaccgcguggauggagcugaauggggcguggaccucccuagcguugaggcccagcuggggucucauagaggacugcaccaauccaucgaagaguuucgggcuaagauugaacgcgccagaagcgaugagggccagcuuucuccggcgaccagaggggcuuaccgcgacugucucggcagacuggaccugcaguaugcuaagcuccucaauuccagcaaagcccggcuuagaucccuggagucucuccauagcuucgucgcugccgcgacaaaggaacugauguggcugaacgagaaagaagaggaagaggugggauucgauugguccgaccgcaauaccaacaugaccgccaagaaagagucuuacagcgcucuuaugcgggaacucgagcugaaggaaaagaaaaucaaggagcugcagaaugccggcgauagacuccugcgcgaggaccaccccgcucggccuacaguggaauccuuucaagccgcccuucagacgcaguggagcuggaugcugcagcucugcuguugcauugaggcucaccugaaagaaaacgcggccuauuuccaauuuuucucugaugucagagaggcugaagggcagcugcagaaacuucaagaggcccugcgccggaaauacuccugugacagaagcgccaccgugacacgccucgaggaucugcuccaggacgcucaggaugaaaaggagcagcugaaugaauacaagggacaucuuucuggccuggccaaacgggcgaaggcuguugugcaacucaaacccagacacccugcccaucccaugcgggggcgccugccgcugcuugccgucugcgacuauaagcaggucgagguuaccgugcacaaaggagaugaaugucagcuggucggcccugcucagcccucccacuggaaggugcucagcucuagcggguccgaggccgcgguuccuagcgugugcuuucuggugcccccucccaaccaagaggcucaggaagccgugacaagacucgaggcccagcaucaggcucuggugacccuuuggcaccaacugcaugucgacaugaaaucucuccuggccuggcagucccugcggcgcgauguucagcuuaucagaagcuggucccuggcuacguuccggacacucaagccggaagaacaaagacaagcccugcacucucucgaacugcauuaccaggcguuucuucgcgacagccaggacgccggcggauucggcccugaggaucggcugauggcugagagagaauauggguccuguucucaccacuaccaacagcugcuccagagccuggagcagggagcccaagaagagucccgcugccagcggugcaucucugagcuuaaggacauuagacugcagcucgaggcuugugagacccgcaccgugcaucggcugagacucccccuggauaaagaacccgcccgcgagugcgcccagagaaucgcugaacaacagaaggcgcaggccgagguggagggccuugggaaaggagucgcucggcugagcgccgaagccgagaaggugcuggcucucccugaaccgucccccgccgcgccuacacugcgcagcgagcuugaacugacccucggcaaacuggagcagguuagaucucucuccgcuauuuaucuggagaaacuuaagacaaucagccuggugauucgggggacgcaaggcgccgaagagguccugcgcgcccacgaagaacagcucaaagaagcucaggccgugcccgcgacccugccugagcuugaggcuacaaaggccucucugaaaaagcucagagcccaagcugaagcccagcagcccaccuuugacgcucugcgggaugagcucagaggagcccaggaaguuggcgagcgccugcaacagcggcauggggagagagacguggaagucgagcgcuggcgggaaagaguggcgcagcuucuggagcgguggcaggccguucuggcucaaacagaugugcgccagagagaacucgagcagcugggacggcagcuucgcuacuauagagaguccgccgacccucugggcgcuuggcuccaagaugcccggcgcagacaggaacagauccaggccaugccccuggcugacagccaagcgguccgggagcagcugcgccaggaacaagcccuccuugaggaaauugagagacacggggagaaaguggaagagugucagcgguucgcuaagcaguacaucaaugccaucaaggauuacgaacugcagcuggugaccuauaaagcccaacucgagccggucgcuucuccugccaagaaacccaagguucaguccggaagcgaauccgugauucaggaguacguggaccugagaacgcauuauagcgagcuuaccacacugaccucucaguacaucaaauuuauuagcgaaacacuccgccggauggaggaagaggagagacuggcggaacaacagcgcgcugaggaacgggagagacuggccgaagucgaggccgcucucgagaagcagcgccagcuugccgaagcgcacgcccaagcuaaggcccaggcugagcgggaagccaaagagcugcagcaaagaaugcaggaagaggugguucgccgggaggaagcugccguggacgcgcagcagcaaaagagauccauccaggaggaacugcagcagcuccgccaaucuagcgaggccgaaauucaggcuaaagcccggcaggcugaggccgccgagagaucccgccugagaaucgaagaggaaauccgggucgugcgccuucagcuggaggcuaccgagagacaacggggcggggcggaaggcgagcuccaggcccugagagcucgggccgaagaggccgaagcucagaagcgccaagcccaggaggaggcggaaagacugcggcgccagguucaggaugagucucaaagaaaacggcaggccgaaguggagcucgcuagccgcgucaaggccgaagcugaggccgcgagagagaaacagcgggcccuucaggcucuggaagaacugcgccuccaagccgaagaggcugaaagacggcugcgccaggccgagguggagagagcucggcagguccagguggcccuugaaacggcgcaacgcuccgccgaggcugaacugcagucuaagagagccagcuucgcugagaagacagcccagcucgagcggucccugcaggaagaacacguugccguggcgcaacugagagaagaggcugaacgccgggcccagcagcaagcugaggccgagagagcccgcgaagaggcugaacgggagcucgaaagauggcagcuuaaagccaacgaggcgcugcgccugcggcuccaggccgaggaagucgcucagcaaaagagccuggcccaggcugaggccgaaaaacagaaggaggaagcggagagagaggcccgccggagaggaaaagcugaggaacaggccgugcgccaacgggaacuugcugagcaggagcuggaaaagcagagacagcucgccgagggcaccgcucaacagcggcuggccgcggaacaggagcugauuagacuccgcgccgaaacagagcaaggggagcagcagcggcagcuucuggaagaggaacuggcuagacuccaacgcgaggccgcugccgccacccagaagagacaggaacuggaggcggagcuugcuaaaguucgggccgaaauggaggugcugcucgccucuaaggcucgcgccgaagaggaauccagaagcaccucugagaaauccaagcagcggcuggaggcugaagccggacgcuuuagagagcuggcggaagaggccgcucggcuccgcgcccuugcugaggaagccaaaagacaacggcagcuggcggaggaagacgccgcucgccagagagccgaggcugaacggguccuggccgagaagcucgcugccaucggcgaggcgacacgccugaagacggaagccgagauugcucuuaaagaaaaggaggccgaaaaugagagacugcggagacucgccgaggaugaggcuuuccagcgccggagacuggaggaacaagccgcgcagcauaaagcugacaucgaggaacgccuggcccagcuccggaaggccagcgauuccgagcuugagagacagaaagggcugguggaagacacccugcgccaacggagacagguggaggaagagauucucgcucugaaggccucuuucgagaaggcugccgcgggaaaagccgaacuugagcuggaacucggccgcauccggagcaacgcugaggauacacugagauccaaggaacaggccgagcuggaggcugcccggcaacgccagcucgcggccgaagaggaaagacggcgcagagaggcugaggaacggguucagaaaagccuugccgcugaggaagaggccgccagacagcgcaaggcugcgcuggaagaggucgaacggcugaaagccaagguggaggaggcuagacgccuccgggaaagagccgagcaagaaucugcccgccagcugcagcuugcucaggaggccgcgcaaaagagacugcaggcugaggaaaaagcccacgccuuugcugugcagcagaaggagcaagaacuccagcagacccugcaacaggagcaguccguccuggaccagcuccggggcgaagccgaggcugcccgcagagcggccgaggaagcugaggaagcccgggugcaagcugagcgcgaagccgcgcagagcagacggcagguugaggaggccgaacgccuuaaacagucugcugaggaacaagcccaggcuagagcccaggcccaggcugcggccgagaagcugcggaaagaagcugagcaagaggccgccagacgcgcucaggccgaacaggcggcucugcggcaaaagcaggccgccgaugcugagauggaaaaacauaagaaguucgccgagcagacacucagacagaaagcucaaguggagcaggaacugaccacgcuucgccugcagcucgaggaaacagaccaccagaagaaucugcuggaugaggaacuccaacggcugaaagccgaggcgaccgaggccgcuagacagcgcagccaggucgaagaggaacucuucuccgugcggguucagauggaggaacugucuaagcucaaagccagaaucgaggcugagaaccgggcccugauucuucgcgacaaggauaacacccaaagauuccugcaggaagaggcggaaaagaugaaacagguggccgaggaagcugcccggcucagcgucgcugcccaggaggccgcucgccugagacaacuggcggaggaagaccucgcccagcagcgggcucuggccgagaagaugcuuaaagaaaagaugcaagccgugcaggaggcuacacgccugaaagccgaggcggaacuccugcagcagcaaaaggagcuugcucaggaacaggccagacggcugcaggaggacaaggaacaaauggcccagcagcucgcugaggagacccagggguuucaaagaacacuggaagccgagcgccagcggcagcuggaaauguccgcugaggccgaaagacucaaacugcgcguugcggagaugucucgggcccaagcuagagccgaggaagaugcucagcgcuuccggaagcaggccgaggaaaucggagagaaacuucacagaacggaacuggcgacccaggagaaggugacacucguccaaacccuggagauucagcgccagcagagcgaccaugaugccgaacggcuuagagaggcuaucgccgaacuggagcgcgagaaagaaaagcuccaacaggaggcuaagcugcugcagcucaaauccgaagagaugcagacagugcaacaggaacagcugcuucaggagacccaagcccugcagcagagcuuucucucugagaaggacucccugcuucaaagagaacgguucauugagcaggaaaaagcgaagcuggagcagcucuuucaggaugaaguggccaaagcucaacagcugcgcgaggagcagcagagacaacagcagcagauggaacaagagcggcagagacuggucgccagcauggaagaggcucgccggagacagcacgaagccgaggagggcguucggcgcaagcaagaagaacuucagcagcuggaacagcaaagacggcagcaggaggagcuucuggccgaagagaaucagcgccucagagaacaacugcagcuucuggaggaacagcaucgggcugcccucgcgcacuccgaggaggugacggcuucucagguggccgccaccaaaacacugccuaacgggcgcgacgcucuggauggacccgccgcggaagcugagccggaacauagcuucgacggccucagacggaaggucuccgcccaacgccugcaggaggccgggauccuuucugcugaggagcugcagagacucgcccagggacacaccacaguggaugagcuggcucggcgcgaagacguuagacacuaucuucaaggccggagcuccaucgccggccugcuccugaaggcgaccaaugagaaacugagcguguacgccgcucuccagagacagcugcuuucuccugggacagcccugauucuccuggaagcucaagccgcguccggauuucuucuggaucccguccgcaaccggagacucaccgugaaugaggccguuaaggaaggcguggucgggccugagcugcaucacaaacugcuuagcgcugagcgcgccgugacgggauauaaggaccccuacacaggccagcagaucucucuguuccaggcuaugcaaaaagggcucauuguccgggaacauggaaucagacugcucgaggcccagauugccaccggcggcgugaucgaucccguucacucccaccgcgugccuguggacgucgcuuaccggagaggguauuuugacgaagagaugaaccgcguucuggccgauccgagcgacgauaccaagggauucuucgaccccaauacacaugagaaccuuaccuaccugcagcugcucgaacggugcguggaggauccugaaacgggccugugucuucugccccucacagacaaggcggcuaaagggggagagcugguguauaccgauucugaagccagagacgucuuugagaaggccacagugagcgcuccuuucggcaaauuucaggggaagaccguuacaauuugggagaucaucaauuccgaauacuucaccgccgagcaacgccgggaucuccugagacaguuucgcacgggacggauuaccguggagaagaucauuaagaucauuaucacagucguggaggaacaggagcagaagggcagacugugcuucgagggccuuagaucucugguccccgcggcugaacuccuggagagccgggugaucgaccgcgaacuuuaucaacagcugcagagaggggagcgguccguucgcgauguggccgaagucgacaccgugagacgggcccuccgcggagcuaacguuauugccggcguguggcuggaggaggcugggcaaaaacucagcaucuacaaugcccugaagaaagaccugcuuccuuccgauauggcggucgcccugcucgaagcucaggccggaacaggccacauuaucgacccggcuaccucugccagacugacgguggaugaggcggugcgggccgggcuuguuggacccgaauuucaugagaagcugcucagcgcugagaaagccgucacaggcuaucgcgacccuuacaccggccaguccgugucucuguuccaggcucugaagaaggggcucauucccagagaacaaggacugcggcuucuggaugcccagcucagcacaggcgggaucguggacccuuccaaaucucaccgcgucccccuggauguugccugugcuagaggaugccuugacgaggaaaccagccgggcccuguccgcgccgcgcgcugaugccaaggccuacagcgacccuucuaccggcgagcccgcuacauauggggaacuccagcagagaugucggcccgaucaacugacgggacugucccuccugccucuuagcgagaaagccgcgagagcucgccaggaggaacuguacucugagcuccaggcccgggaaaccuuugagaagacacccguggaagugccugucggcggcuucaaagggagaaccgugacaguuugggagcugaucuccagcgaguauuuuaccgccgaacagcgccaagagcuucugcggcaguucagaacgggaaaggugacagucgaaaaagugauuaagauccucauuaccaucguugaggaaguggagacccugcgccaggagcggcugucuuucuccggccucagagcuccgguccccgccagcgaacugcuugcuuccggggugcugagccgcgcccaauuugagcagcucaaggacggaaaaacaaccgugaaggaucugucugaacuuggcagcguccggacacugcuccagggguccggaugccuggcgggcauuuaccuggaggacacgaaagagaagguuucuaucuaugaagccaugagacgcggccuccugcgggcuaccacagccgcccuucugcucgaggcccaggcggccaccggguuccugguggacccugugagaaaccaacggcuuuacguccaugaagcugugaaagccggaguugugggccccgagcugcacgaacagcuccugagcgcugagaaggccgucacaggguaucgcgauccuuacuccggaucuaccauuagccuguuucaggccaugcagaagggccucgugcugagacaacacgggauccggcuucuggaggcucagaucgccacgggcggaauuaucgaccccguucauucccacagagugccggucgauguggcguaccagcgcggcuauuucucugaagagaugaaucggguucucgcugacccuagcgaugacaccaaaggguuuuucgaucccaacacacaugaaaaucugaccuacagacagcuucuggagcgcuguguggaagacccugagacaggacucagacugcugccccucaagggcgccgagaaagccgaagucguggagaccacacaagucuauacggaagaggagacccggcgcgcuuuugaagagacacagauugauaucccugggggaggcucccacgggggcagcaccaugucucugugggaagugaugcaguccgaccuuauucccgaggaacagagagcccaacugauggcggauuuccaggcuggacggguuaccaaggagcgcaugaucaucauuaucauugagaucauugagaagacagagaucaucagacagcaaggccucgccagcuacgacuaugugcggcgcagacugacggccgaagaccuguuugaggcucggauuaucucucucgaaaccuacaaccuucugcgcgaggggacaagaucccugcgggaggcccucgaagcugagagcgccuggugcuaucuguacggaaccggcuccgucgcggggguguaccuuccgggaucuagacagacacugagcauuuaucaggcccucaagaagggccugcuguccgcugaaguggcccgccuucuccuggaggcucaggccgcgaccggguuccugcucgauccuguuaaaggcgaacggcugacgguggacgaggccgucagaaagggacuugugggccccgagcugcacgaucgccuccugagcgcugaacgggccguuacaggguacagagaccccuauaccgagcaaaccaucucucuguuucaggcuaugaaaaaggaacuuauuccuacagaggaggcccuccgccugcuggaugcccagcucgcuaccggaggcaucguggacccgcggcugggguuccaucuuccccuggaagucgccuaccagagaggauaucucaacaaagauacacacgaccaacuguccgagccuagcgaagugcgcucuuacgucgaucccagcaccgacgagcggcuguccuauacgcagcuucucagacggugccgcagagaugacggcacaggccagcugcugcucccucugucugaugcgcggaaacuuaccuuucgcgggcugagaaagcagauuacaauggaagaacuggugcggagccaaguuauggacgaggcuaccgcccugcagcugagagaaggacuuacguccaucgaggaagugaccaaaaaucuccagaaguuccuggagggcacaucuuguaucgccggggucuucguggacgcuaccaaagaacgccugagcguuuaccaagccaugaagaaaggaauuauccggcccggcacagcguuugagcuccuggaggcucaggccgccaccggguacgugauugauccuaucaagggacuuaagcugacagucgaagaggcugugagaaugggcauugugggcccggaguucaaagacaagcuccuguccgccgagcgcgcuguuaccggguauaaagaucccuacagcggaaagcugaucucucuuuuucaggccaugaaaaagggccucauccugaaagaccaugggauucggcugcucgaagcgcagaucgccacgggaggcauuaucgauccugaggagucccacagacugcccgucgaaguggcuuauaagcgcgggcuuuucgacgaggaaaugaacgagauucugacagauccuagcgacgauaccaagggauuuuucgaccccaauaccgaggaaaaccucacauaccugcaacugauggagcggugcaucaccgauccgcagacaggccuuugucuccugccucugaaagaaaagaaaagagagcgcaagacguccucuaaaagcuccgugagaaagcggcgcgucgugaucguugaccccgaaaccggcaaggagaugucuguguaugaggccuacagaaaagggcucauugaucaucagacauaucuggaacuuagcgagcaggaaugcgagugggaagagaucaccauuuccagcucugacggagucgugaaguccaugaucauugaccggcgcagcggcagacaauacgauaucgacgaugcuauugccaaaaaucugaucgaccggucugcgcucgaucaguaccgcgccgggacacuguccaucaccgaguuugcugacaugcugagcggaaacgccggcggguucagaucucgguccagcucuguuggaagcuccagcuccuaucccauuucuccugcugugagcagaacgcagcuugccuccuggucugaucccaccgaagagacaggcccugucgccggcauccucgacaccgaaacacuggagaaggugagcauuaccgaagcuaugcaccgcaaucugguugauaacaucacggggcagcggcuccuggaggcccaagcguguacaggaggcauuaucgacccguccaccggggagagauuucccgugacagaugcugucaauaaaggacuuguggacaagaucaugguggaccgcauuaaccuggcccagaaggccuucugcggcuuugaagauccucggaccaaaaccaagaugucugcugcccaggcgcucaaaaagggguggcuguacuaugaggccggacagagauuccuggaaguccaauaccuuacaggcggccucaucgagcccgacacgccugggcggguuccccuggaugaggcucugcagcgcggaaccguggacgccagaacagcucagaaacuccgggaugugggcgccuauagcaaguaccugaccuguccgaagacaaaacuuaagauuuccuauaaagacgcucuggaucgcagcauggucgaagaggggaccggacucagacugcuggaagccgcggcccaaucuacgaagggcuacuacuccccuuauagcgugucuggguccggaagcacagcuggcucucggaccggcucccgcaccgggagcagagccggaucucggagaggcuccuuugacgcuacagggagcggauucagcaugaccuucuccucuagcuccuacucuagcuccggcuaugggcgccgguacgccucuggaagcuccgcgagccuuggcggccccgagucugccguugcuuga

SEQ ID NO: 73877 - RNA, 1062 nt, Artificial Sequence
  derived and/or modified sequence opt5 from PLEK2__Homo_sapiens__NP_057529
auggaggacggcgugcugaaggaaggguuccucgucaaaagaggacacaucguucauaacuggaaggcccggugguuuauucugcgccagaauacccuuguguacuauaaacuggagggcgggagacgggugacacccccuaagggacgcauccuccuggauggcugcacgauuaccuguccgugccuugaauacgagaacagaccccugcucaucaaacugaagacacaaaccagcacagaauauuuccuggaggcuuguucccgggaggaacgcgacgccugggcguuugagauuaccggggcuauccacgccggacagccuggcaagguccagcagcuccauucucugagaaauagcuucaaacuucccccucacaucucccugcaucggauuguggauaagaugcacgacucuaacacaggcauccgcagcucccccaauauggaacaagggucuaccuacaaaaagacguuucucggaagcucccugguugauuggcuuauuagcaacucuuucaccgccuccagacuggaggcugugacacucgccagcaugcugauggaggaaaauuuucugcggccugucggcgugcgcucuaugggggcuaucagauccggagaccucgccgagcaguuccuggaugacagcaccgcgcuuuauacauuugccgaaucuuacaaaaagaagauuuccccgaaagaggaaaucagccuguccaccguugagcucucuggcacgguggucaagcagggguaucuggcuaaacagggacacaagcggaaaaacuggaaggugcgcagauucgugcuucggaaagaucccgccuuucugcauuacuacgacccuagcaaggaggaaaauagacccgucggcggcuucucccuccgcgggagccugguuucugcucuggaggauaacggagugccuacaggcgugaaggggaauguccaaggaaaccucuuuaaagugauuaccaaggacgauacacacuauuacauccaggccuccagcaaagcggaacgggccgaguggaucgaagcuauuaagaaacugaccuga

SEQ ID NO: 73878 - RNA, 1215 nt, Artificial Sequence
  derived and/or modified sequence opt5 from PLEKHA1__Homo_sapiens__NP_001001974
augcccuacguggacagacagaaccggaucugcggcuuccuggauauugaggaaaaugagaacagcgggaaguuucuccgcagauauuucauccuggacacccgggaagauuccuuugucugguacauggacaauccucaaaaccuuccgucuggaagcucccgcguuggcgccauuaaacugacauauaucucuaaggugagcgaugcuacgaaacucagacccaaggccgaguucuguuuugugaugaaugcggggaugcggaaauacuuccugcaggcuaacgaccagcaggaucuugucgaaugggugaauguucugaacaaggccauuaagaucaccgugccuaaacaauccgacucucagcccaauagcgauaaccucucccgccacggagagugcggcaagaaacaggucagcuauagaacagacaucguugggggagugccuauuaucacccccacacagaaggaggaagugaaugaguguggcgaaucuauugaucggaacaaucugaaacgcucccaaagccaucugccuuacuuuaccccgaagcccccucaggacucugccgucaucaaggcuggcuauugcgugaaacagggggccgugaugaagaacuggaaaagacgguacuuccagcucgaugagaauacaauuggauacuuuaaguccgagcuggaaaaagagccccuucgcgucaucccucugaaggaaguucacaaagugcaagaguguaagcagagcgacauuaugaugagagacaaccucuucgaaaucgugaccacgucucggaccuuuuauguccaggcugauucccccgaggagaugcauagcuggaucaaggccguguccggcgcgauuguugcccaacgcgggccgggaagaucugcuagcuccgaacacccucccggcccuagcgagucuaaacaugccuuccggcccacaaacgcugccaccgcgacaucccacagcaccgccucuagaagcaauucccuggugucuacguuuacaauggaaaagcgcggguucuacgagagccuugcuaaagucaagcccggaaacuucaaagugcagaccguuuccccucgggaaccggccagcaaggugacagagcaggcucugcucagaccccagucuaagaauggcccucaagagaaagacugcgaucuggucgaccuggaugacgccucccuccccgugagcgaugucuga

SEQ ID NO: 73879 - RNA, 1278 nt, Artificial Sequence
  derived and/or modified sequence opt5 from PLEKHA2__Homo_sapiens__NP_067636
augcccuacguggacagacagaaccggaucugcggcuuccuggauauugaggaacacgagaauagcgggaaguuucuccgcagauauuucauccuggacacccaagccaacugucuucugugguacauggauaauccucagaaccucgcuaugggagccggcgcggucggggcucugcagcuuacauauauuuccaaaguuucuaucgccacgccgaagcagaaacccaagaccccuuuuugcuucgugauuaaugcccugagccaacgguacuuucuccaggcuaacgaccagaaagauaugaaggacuggguggaagcccugaaucaggcuuccaagaucacaguccccaaaggaggcgggcugccuaugaccacagaggugcucaagucucuggccgcgcccccugcccuugagaaaaagccgcaaguugcuuauaaaaccgaaaucauuggaggcguggucgugcauacacccaucagccagaacggcggggauggacaggagggcuccgaaccugggucucacaccauucugcgcagaagccaguccuacauccccacgagcggaugucgggccucuaccggcccuccccucauuaaguccggguauugcguuaagcaaggaaaugugcgcaaaagcuggaagagacgguucuuugcucuggacgauuucacaaucuguuacuuuaaaugcgagcaggaccgcgaaccgcuuagaaccauuuuccugaaggauguccucaaaacacaugagugucuggugaagucuggcgaccugcucaugcgggauaaccuguuugagaucaucaccuccagccgcacguucuacgugcaggccgacucuccugaagacaugcacuccuggauuaaagagaucggcgcggccguccaagcucuuaagugccaucccagagaaaccagcuuuucccggucuauuagccugacacgcccuggguccagcucucucuccagcggacccaauucuauccuguguagaggccggcccccucuugaggaaaagaaagcccugugcaaggcuccgagcguugccuccucuuggcagcccuggacaccugugccccaggccggggagaaacuccugccucccggagauaccagcgaggacucccuguucaccccgagaccuggcgaagggagcgcucccggagugcucccuucuucccgcauucggcacagaagcgagccccagcacccuaaggaaaaacccuucauguuuaaccuggaugacgagaauauccgcacaucugaugucuga

SEQ ID NO: 73880 - RNA, 3525 nt, Artificial Sequence
  derived and/or modified sequence opt5 from PLEKHA5__Homo_sapiens__NP_001137293
auggccgcugaccugaaccucgaguggaucagccugcccagauccuggaccuacggcauuacacggggaggacgcguguucuuuaucaaugaagaggccaagucuacgaccuggcuucacccugucacaggcgaagcgguugugaccgggcauagacggcagagcacagaucugccgaccggaugggaggaggcuuauacauucgagggcgcccgcuacuauauuaaccacaaugagagaaaagugaccugcaagcaucccgucacggggcaaccuucccaggacaacuguaucuuugugguuaaugaacagaccguggccacaaugaccucugaggagaaaaaggaacggcccauuagcaugaucaacgaggcuuccaauuacaacgucacaucugauuaugccgugcacccuaugagccccguuggacgcaccuccagagcuagcaaaaaggugcauaauuucggcaagcggucuaacuccaucaaacgcaauccuaacgccccggucgugagacggggcuggcucuacaagcaggacagcacggggaugaaacuguggaagaaacgcugguuugugcuuucugaucugugccucuucuauuacagagacgaaaaggaggaagggauucugggcuccauccugcuccccagcuuucaaauugcgcugcuuacaucugaggaucacaucaaucggaaguacgccuucaaagcugcccacccuaacaugcgcaccuauuacuuuuguacagacaccgggaaggaaauggagcuguggaugaaagcuaugcucgaugccgcgcugguccagaccgagcccguuaagagaguggacaaaauuacauccgaaaaugccccuacgaaggagaccaacaacauccccaaucaucgggugcuuauuaaaccggaaauccagaacaaucagaagaacaaggagaugagcaaaaucgaagagaagaaagcucuggaggccgaaaaguauggauuccaaaaagauggccaggacagaccucucacaaagauuaauuccgucaagcugaacucucugcccagcgaguacgaauccgggagcgcuugcccugcccagaccgugcacuaucgccccaucaaucucucuuccagcgagaacaaaauuguuaaugugucucuggccgaucuucggggaggcaacagacccaauacaggcccucuguacaccgaagcugaccgcgucauccagcggacgaacagcaugcaacagcucgagcaguggauuaagauccaaaaagggagaggacaugaggaagagacacgcggcgugaucuccuaucagacccugccgcggaauaugcccucucacagagcgcagauuauggcccgcuacccugaaggguaccggacccuucccagaaacagcaagacacgcccugaguccaucuguagcguuacccccucuacacacgacaaaacgcugggaccgggcgcugaggaaaagcggagauccaugcgggaugacaccauguggcagcucuaugaguggcaacagcgccaguuuuacaauaagcagagcacacugccuagacauucuacccuguccagccccaaaacaauggugaacauuuccgaucaaaccaugcacucuaucccuacgagccccucccaugggucuauugccgccuaucagggauacagcccucagcggaccuauagauccgaagucagcucucccauccagcgcggcgacgugacaaucgaucggagacaccgcgcucaucacccgaagcacgucuacgugccugacagacgguccguucccgccggccucacccugcaaagcgugucuccccagucccuucaggggaaaacaccugaggaacugacccuccugcuuauuaagcugcgcagacagcaagcggagcucagcucuauccgggagcauacgcuggcucagcugaugcagcucaaacuggaagcccacagcccgaagaacgagauucuuucccaucaucugcaacgcaauacaaucuaucucgaucaccagcugagccaggacgaaggaagaggcacccuguacaaguaccggcccgaggaagucgauauugacgccaaacuuucucgccucugcgagcaggauaaggugguucacgcucuggaggaaaaacugcaacagcuccacaaggagaaauauacacuggaacaggcccuucuguccgcuagccaggagaucgaaaugcaugccgacaacccugcggccauucaaaccgugguccuccagagagacgaucugcagaaugggcugcuuuccaccugucgggagcucucucgcgcuacagccgagcuggaaagagcuuggcgggaguacgacaagcuggaauaugaugugacggugaccagaaaccagaugcaagagcagcucgaccaccugggagagguucagacagaaagcgccggcauccaacgcgcgcagauccagaaagagcuuuggcggauucaggaugucauggaagggcuguccaagcauaagcaacagagaggcaccacagagaucggaaugauuggcucuaaacccuucagcaccgugaaguacaaaaaugaagggccugacuaucgccucuacaaguccgagcccgagcugacgacaguggccgaagucgaugagucuaacggagaagagaaaagcgaaccuguguccgagaucgagaccagcguugugaagggcucucacuuucccgucggggugguuccgccucgggcuaagucccccaccccugaaagcucuacaauugccuccuaugugacccugagaaaaacaaagaaaaugauggaccuucgcacggagcggcccagaagcgcugucgaacagcucugccuggccgagucuacccgcccgcggaugacaguggaagaacagauggagagaauccggcgccaccaacaggccugucugagagaaaagaaaaagggacucaauguuaucggcgcuuccgaucagagcccucugcagucccccagcaaccuucgggacaauccuuuccgcaccacacaaaccagacggagagaugacaaggagcuggauacggcgauucgcgaaaacgacgugaaacccgaccaugagacccccgccacagagaucguccagcucaaggaaaccgagccucagaauguggauuucucuaaagaacugaagaaaacagagaacauuagcuacgaaaugcuguuugagccggagcccaauggggugaacuccgucgaaaugauggacaaggagcggaauaaggauaaaaugccugaagacguuaccuucucuccccaggaugagacacaaaccgcuaaccacaagccugaggaacaucccgaggaaaacacgaaaaauagcguggacgagcaggaagagacagugaucuccuacgaaucuaccccugaggucagcagaggcaaccagaccauggccgugaagucccuuucuccgagccccgaguccagcgccucuccuguucccuccacacaaccucagcucaccgaaggaagccacuuuaugugcguguga

SEQ ID NO: 73881 - RNA, 3147 nt, Artificial Sequence
  derived and/or modified sequence opt5 from PLEKHA6__Homo_sapiens__NP_055750
augagcaacaagaccggcgggaaaagacccgccacaaccaauuccgacaucccuaaccacaauauggugucugaggucccgcccgaacggccuagcguucgcgcuacgagaacagcccggaaggcgguggcuuucggaaaacgcucccauucuaugaagagaaaccccaaugccccugugaccaaagccggcuggcuguuuaagcaggcuagcuccggggucaagcaauggaacaaacggugguucgugcucguugaucgcugccuguuuuacuauaaggacgagaaagaagagucuauucuuggaagcaucccccugcucuccuucagaguggccgcuguccagccuagcgauaauauuucucggaagcacacauuuaaagccgaacaugcgggcgugcgcaccuacuucuuuuccgccgagagcccggaggaacaggaggcuuggauccaggccaugggggaagcugccagaguucaaauucccccugcgcagaagucugugccccaggccguccggcacucccaugagaagccugacagcgagaacgugcccccgucuaaacaccaccagcaaccuccccauaauucccugccuaagcccgaacccgaggcuaaaacacgcggagaaggcgauggcagagggugugagaaggccgaacggcgcccugagagaccggaggugaaaaaggaacccccugucaaagcuaacggacuucccgccggcccugagcccgccagcgaaccgggguccccuuaucccgagggaccucggguucccggcgggggagaacagccugcucagcccaauggcuggcaguaccacucuccgagcagaccuggcuccaccgcguuccccagccaagacggggagacgggaggccaucgccggucuuuucccccuagaaccaacccggauaagaucgcccagcgcaaguccagcaugaaucagcugcaacagugggugaaccuccggagaggggugcccccucccgaggaccugcgcucuccuagccgguucuaucccgucuccagacgcgugccugaauacuauggacccuacucuagccaguacccggaugacuaucaguacuauccucccggcguucggccugaguccaucugcagcaugcccgcuuacgauagaauuucuccgccuugggcccuggaagacaaacgccacgccuuucggaaugggggaggccccgcuuaucaacucagagaguggaaggaaccugccuccuacggccggcaggaugcgacaguguggauccccagccccucucgccagccugucuauuacgacgagcuggacgcugccuccagcucccuuagacggcugucucuccagccgagaagccacuccgugccccgcucuccuagccaaggguccuacagccgggccagaauuuauucucccguucgcuccccuagcgcuagauucgagcggcugcccccucgcucugaagauaucuacgccgacccggcugccuaugugaugagacgguccauuagcucucccaaagucccucccuacccugagguguuucgcgauagccuucauaccuauaagcugaacgaacaggacacagauaaacuccugggaaagcugugugagcagaacaaggucgugagagagcaggaccggcucguucaacagcugcgcgcggaaaaagagucccuugaaagcgcccugaugggcacccaccaggagcucgaaauguucgggucucagcccgcuuacccggagaagcugagacauaaaaaggauucccuucaaaaucagcugaucaacauucggguggagcucagccaggccacgacagcucugaccaauuccacaaucgaauaugagcaccuggaaucugaggucagcgcccuccaugacgaucugugggaacaacuuaaccuggacacccagaaugaggugcucaaccgccagauccagaaagagauuuggagaauccaagauguuauggaaggacugcggaagaauaacccuuccagaggcaccgacacagcgaagcaccgcgggggccuuggacccucugccacguacagcuccaauucucccgcuagcccucuguccagcgccucucucaccagcccccugagcccuuucucucugguguccggcagccaggggucuccgacaaaacccggauccaacgagccuaaggcuaauuacgaacagagcaaaaaggacccccaccagacccucccucuggauacaccccgggacauuucccuugucccgaccagacaagagguggaagccgagaaacaggccgcucugaacaaggugggcguugucccuccccgcacgaaguccccuacagaugacgaggugacccccucugcggugguccggagaaaugccagcgggcucaccaacggacuguccucucaggaacgcccuaaaagcgcuguguuucccggcgaggggaagguuaaaauguccguggaagaacagaucgaucggaugagacgccaucaaucuggcagcaugcgggagaagagacggucccugcagcuuccggccucuccugcccccgaccccagcccucgcccggcuuauaaagucgugagacggcaccgcuccauucaugaaguugauaucagcaaucucgaggccgcgcugagagcugaggagcccggaggccacgccuacgaaacaccucgggaggagaucgccagacugcgcaagauggaacucgagccccagcacuaugacguggauauuaacaaagaacugucuaccccugacaagguccuuauccccgagcgguacauugaucuggaaccugacacaccgcucucccccgaggagcugaaggaaaaacaaaagaaaguggagagaaucaagacgcugauugcuaaaagcucuaugcagaacguugugccuaucggggaaggagauuccgucgacgugccccaggacagcgagucccagcuucaagaacaggagaagcgcaucgagauuucuugcgcccucgcgaccgaagcuagccggagaggccgcaugcuguccgugcagugugccacaccuucucccccgaccagcccugccucccccgcucccccugccaauccccugagcucugagagcccuagaggggcugauuccucuuauacaaugcgggucuga

SEQ ID NO: 73882 - RNA, 3366 nt, Artificial Sequence
  derived and/or modified sequence opt5 from PLEKHA7__Homo_sapiens__NP_778228
auggccgcugccaccgugggcagagacacacugcccgagcacuggagcuacggggucugccgggauggacgcguuuucuuuaucaacgaccagcucagauguacgaccuggcugcauccucggacaggcgaaccggucaauuccgggcacaugauucgcucugaucuucccagaggaugggaggaaggcuucaccgaggaaggggcgagcuauuuuaucgaccauaaccaacagacaaccgcuuuccggcacccugugacaggacaguuuucccccgaaaauucugaguucauucugcaggaggagcccaacccccauaugagcaagcaagaucgcaaucagagaccuuccucuauggugagcgaaaccuccacggccggcaccgccagcacacucgaggcuaaaccgggccccaagaucauuaaaucuuccagcaaggugcacucuuuugggaaacgggaccaggccauccgcagaaacccuaauguucccguggucgugcggggauggcugcacaagcaggauuccagcggcaugcgccuuuggaagagacggugguucguucuggcugacuacugccucuuuuauuacaaagauucucgcgaggaagccgugcugggguccaucccucugcccagcuaugucauuuccccgguggcgccugaggacagaaucucucggaaguacagcuucaaagccgugcauaccggaaugagagcucucauuuauaacuccagcacagccggcucucaagcugaacaguccgggaugcgcaccuacuacuuuagcgccgauacgcaggaggacaugaaugcguggguccgggccaugaaccaggcugcccaaguucugucuagaagcucccuuaagcgcgauauggaaaaaguggagcggcaggcugugccccaggccaaucacacagagucuugucaugaaugcggaagagucggcccuggccacacccgcgacuguccccaccgggggcaugacgauaucgugaacuucgagagacaagaacaggagggagaacaguaucgcagccagcgggacccccuggagggcaagagagaucgcuccaaggcccggagcccuuacucuccggcugaggaagacgcgcucuuuauggaucugcccacagggccuagaggacaacaggcccagccccagcgggcugagaaaaauggcaugcuuccugccuccuaugggcccggagaacaaaacggcaccggcggguaccagcgcgccuucccgccuagaaccaaucccgagaagcacagccagcggaaaucuaaccuggcucagguugaacauugggccagagcgcaaaagggagacucccgcagccucccucuggaucagacacugccccggcagggcccugggcagucccucucuuuccccgagaacuaucaaacgcugccgaaaagcaccagacacccuuccggaggcucuagcccucccccucgcaaucuuccguccgacuacaaguaugcucaggauagagccagccaucugaaaaugucuuccgaggaacggcgcgcccacagagacgggacaguguggcagcucuacgaguggcaacagcggcagcaguuucgccacggcagccccaccgcuccuauuugccugggaucucccgaauuuacagaucaaggcagaucccggagcaugcuugaggucccucgcucuaucagcgugcccccuucccccagcgacauuccgccucccgggccucccagaguuuucccgccucggcgcccccauaccccugccgagagagugacggucaagccucccgaccagcggagaucuguggauaucucccugggagacagcccccgccgggcuagaggccacgccgucaagaacuccucucauguggaucgccggagcaugccguccaugggguacaugacacacaccguuucugcgcccagccuccacggaaaauccgccgacgauaccuaucugcagcugaagaaagaccucgaauaccuggaucuuaagaugacaggcagagaccugcucaaagaucgcucucugaagccugugaagaucgcugagagcgacaccgaugucaaacuuuccauuuucugugaacaggaccgggugcugcaagaucucgaggacaagaucagagcccugaaagaaaauaaggaccagcuggagagcguucucgaggugcugcaucgccagauggaacaguaucgggaucaaccccagcaccuugagaaaauugcuuaccagcaaaagcugcuccaggaagaccugguccauaucagagccgagcugucucgggaauccacagagauggagaacgcguggaaugaauaucuuaagcucgagaacgauguggaacagcugaaacagacgcugcaagagcagcaccgcagagccuuuuucuuucaggaaaagagccagauucaaaaagaccucuggcggaucgaggaugugaccgcugggcugucugccaauaaggagaacuuccgcauccuuguugaauccgucaaaaauccugagagaaagacagugccccuguuuccucauccgcccgugccuagccucucuaccuccgaaagcaagcccccuccccagccguccccucccacaagccccguccggaccccucuggaggugagacuguucccccagcuucagacguacguuccuuaucgcccgcaucccccucaacuccggaaagugaccucuccccugcagagcccuacaaaggcuaaacccaaggucgaggacgaagccccgccuagacccccucugcccgagcucuacuccccugaagaucagcccccggccgugccuccccugccccgcgaggcuaccauuauccggcacacaucuguuagaggccuuaaacgccagagcgacgaacggaagagagaucgcgagcugggacaaugcgugaacggcgacuccagagucgagcuccggucuuacgugagcgaaccugagcuggcgacccuguccggggauauggcccagccgucucuuggacucguuggccccgaaagccgcuaucagacgcugccugggagaggacuguccggcagcacaucucggcuccaacaguccagcaccauugcucccuacgugacacugcgcagagggcuuaaugccgagucuuccaaagccaccuuuccucggcccaagagcgcucuggaaagacucuauuccggcgaccaccagcgcggaaagaugucugccgaggagcagcuggaacggaugaaaagacaccaaaaggcgcugguccgcgagcggaaaagaacccuuggccagggggaacggacaggacucccuagcucccgcuaccugagcagaccgcugcccggcgaucucgggucuguguguuga

SEQ ID NO: 73883 - RNA, 627 nt, Artificial Sequence
  derived and/or modified sequence opt5 from PLEKHB1__Homo_sapiens__NP_001123505
augagccccgccgcuccugugccgcccgacuccgcccuggagucuccuuucgaagagauggcgcucgucagaggcggguggcuguggcggcagagcuccauccuucgcagauggaagcggaacugguuugcucuguggcucgauggaacccugggcuacuaucacgacgaaacagcccaagaugaggaagaccgcguucuuauucauuucaaugugagagauaucaaaauugggcccgagugccacgacgugcagccucccgagggacggucucgcgauggccugcucacggucaaccugagagaagggggacggcugcaucucugugccgagaccaaggacgaugcucuggccuggaaaacagcccuucuggaagcuaauagcaccccugugcgcguuuacuccccguaucaggacuacuaugagguggugcccccuaacgcgcacgaggccacauacgucagaucuuauuacgggcccccuuacgcuggccccggcguuacccaugugaucguccgggaagauccgugcuauagcgccggagcuccucucgccaugggcaugcuggcgggggccgcuacaggagccgcucuuggcucccugauguggagccccuguugguuuuga

SEQ ID NO: 73884 - RNA, 1521 nt, Artificial Sequence
  derived and/or modified sequence opt5 from PLEKHD1__Homo_sapiens__NP_001154970
auguucaccagcaaguccaacucugugagccccuccccuucucuggagcaggccgacagcgaugcucucgacaucuccacaaaaguccaacuguacggcguucuuuggaagagaccguuugggcggcccucugccaaauggagccgcagauucuuuauuaucaaggaauccuuccugcucuauuacagcgagucugaaaagaaguccuuugagacgaauaaguauuucaacauucacccuaaaggagugaucccccugggcgggugccuuguggaaccuaaggaggagcccagcaugccuuacgcgaugaaaauuucucaucaggauuuucacggaaauauccugcucgcugccgaauccgaguucgaacagacccaguggcuggagaugcugcaagagagcggcaaggucacauggaaaaacgcccagcucggggaagcuaugaucaagucucuggaggcccagggacuucagcuggcuaaggaaaaacaagaguaucucgacaagcugauggaagagaccgaggaacuuugucugcagcgggagcagcgcgaagaacucgaaagacugaaucaggugcuggaggccgagaaacaacaguuugaagagguugugcaggaacuccggauggagcaagaacagauuaagcgcgagcuggagcuuacagcgagaugccugaaaggcgucgaacaggagaagaaagaacuccggcaucugaccgagucccuucagcaaacacuggaggaacucagcaucgagaagaagaaaacccuggaaaugcuggaggaaaacgagaaucaccuccagacgcuggccaaccaguccgagcagccgcccccuucuggcgggcuucauagcaaucugcgccaaauugaagagaagaugcagcagcuccuggaagagaaacuucuggcugaaaagagaaugaaagagaacgaggaacggucccgcgcccucgaggaagagagagaguucuacagcucucagucccaagcucugcagaauagccugcaggagcucaccgccgagaagcagcaagcggaacgggagcugaaggccgaagugaaaguucgcauggaucuugagagacggcugagagaggcugaaggagcccuccgcucucuggagcagggccugaacagcaaggugcggaauaaagaaaaggaggaaagaaugcgcgcugacgucucccaccuuaaacgguuuuucgaggaguguaucagaaacgccgaacucgaggccaagaugcccgugauuaugaaaaauucuguguauauccacaaagcugcgacacgccggauuaagagcugcagauuucaucgccggagauccagcaccucuuggaacgauaugaaaccuucccagagcuucaugacaucucaacuggacgccaacaauauggaggaacugaaggaagucgcuaaacgccucucccgggaucagagauuccgggagagcaucuaccacaucauggccacccagcccggggccccguccgcucugucucgcggaggcaaguga

SEQ ID NO: 73885 - RNA, 840 nt, Artificial Sequence
  derived and/or modified sequence opt5 from PLEKHF1__Homo_sapiens__NP_077286
augguggaccaccuggccaacaccgagaucaauagccagagaauugcugccgucgaauccugcuucggcgcgucugggcaaccccucgcucugccuggacggguucuucugggcgagggggugcucacaaaggaaugucgcaaaaaggccaaaccgagaaucuuuuuccuguuuaacgauauucuuguguacggaagcaucguccugaauaagcggaaauaucgcucccagcauauuaucccccucgaggaagugacgcuggagcugcucccugagacccugcaggccaagaacagauggaugaucaagacagcuaaaaagucuuucguugugagcgccgcuuccgccaccgaacggcaggaguggauuucucacaucgaagagugcguccgcagacaacuucgggcgacaggcagacccccuagcaccgagcaugccgcucccuggauuccugacaaagccacagauaucuguaugcgcugcacccagacgcgguuuuccgcucugacccgcagacaccauugucggaagugcggguucgugguuugugccgaaugcagccgccagagauuucuccugccgcggcuuucucccaaaccugugagagucuguucccugugcuaccgcgagcucgcggcccagcaacggcaggaagaggcugaggaacagggagccggcagccccggccagccugcucaccuggccagacccauuuguggggccucuuccggagacgaugacgauagcgacgaggauaaggaaggcucucgcgacggggauuggccguccagcguggaguucuaugcuuccggaguggcguggucugccuuucacagcuga

SEQ ID NO: 73886 - RNA, 750 nt, Artificial Sequence
  derived and/or modified sequence opt5 from PLEKHF2__Homo_sapiens__NP_078889
augguggacagacuggccaacagcgaggcuaauacccggcgcaucuccauugucgaaaacugcuucggcgccgcggggcagccccucacaaucccuggaagaguucugauuggcgagggggugcuuacgaagcugugucggaaaaagccgaaagcucgccaauuuuuccucuuuaaugauauccugguguacggaaacauugucauccagaagaaaaaguauaauaagcagcacaucauuccccuugaaaacgugaccaucgacucuauuaaagaugagggcgaccugagaaauggguggcucaucaagacaccuaccaagagcuucgccguuuacgccgcuacagccaccgaaaaauccgaguggaugaaccauauuaauaaaugcgugacagaucugcugucuaagagcggaaagacccccuccaacgagcacgcugccgucugggugccugacucugaagcgacgguuuguaugcggugccagaaagccaaguuuacccccgugaaucgcagacaucacugucggaaaugcggcuucgucguguguggcccuugcagcgagaagcgcuuucuccugccgucccaaagcucuaaacccgugagaaucugugauuucugcuaugaccuucuguccgcuggggauauggccacaugucagccugcucggagcgacucuuacucccagagccucaagucuccccugaacgauauguccgacgaugacgacgaugacgauagcuccgacuga

SEQ ID NO: 73887 - RNA, 4158 nt, Artificial Sequence
  derived and/or modified sequence opt5 from PLEKHG1__Homo_sapiens__NP_001025055
auggagcugagcgacuccgauagacccgugucuuucggcagcaccuccucuagcgccuccucucgggacagccacggguccuuuggaagccgcaugacacucgucucuaacucccauaugggccuguucaaucaggauaaggaaguuggggcuaucaaacuugagcugauuccugccagaccguuuuccucuuccgaacuccaacgggacaaccccgcgacgggacagcagaaugcugaugagggcagcgaacgcccucccagagcccaguggcggguggacucuaacggggccccuaagaccaucgcugauuccgccacaagccccaaacugcuuuacguggaccgcgucgugcaagagauucuggagaccgaaagaacauauguucaggaucucaaguccaucguggaggacuaccuggauugcauucgggaccagaccaaacugccucucggaacagaggagcgcucugcucuguucggcaauauccaggauaucuaucacuuuaacagcgagcuucugcaagaccucgaaaauugugagaacgacccggucgccauugcggaaugcuucguguccaagagcgaggaauuucauaucuacacccaguauuguacgaauuaccccagaucuguugccgugcugaccgagugcaugcggaacaagauucuugcuaaauucuuucgcgagagacaggaaacacugaagcacucccucccucugggcagcuaucugcucaaacccguccagcggauccugaaguaccaucuucugcuccacgagauugaaaaucaccuggauaaagacaccgagggguacgauguggugcuugacgccaucgauacaaugcaacgcgucgcuuggcauauuaacgacaugaagagaaagcacgaacaugccguucggcugcaggagauccagucucuccugaccaauuggaaaggaccugaucugacgagcuauggcgagcucgugcuggaagggacauucagaauccaacgcgcgaagaacgagcggacccuuuuucuguucgacaaacuccugcuuauuacaaagaaaagagaugacaccuuuaccuacaaggcccacauccuguguggaaaucucaugcugguggaagucauucccaaagagccgcuguccuucucuguguuccacuauaagaacccuaagcuccagcauacaguucaggcuaaaagccagcaagauaagcgccugugggugcuucaccugaaacggcucauccuggaaaaccaugccgcuaagauucccgccaaagccaagcaggcuauccuggagauggacgcgauccaccauccuggcuuuugcuacucccccgaagggggaacgaaggcccuuuucggcagcaaagaaggcucugcucccuauagacuccgccggaaguccgagccuagcucuagaucccacaaaguccugaagaccagcgaaacagcccaggacauucagaaagugucccgcgaggaggggucuccgcaacugagcuccgcccggcccucuccugcucagagaaauagccagcccuccagcucuaccaugaucuccguucuccgcgccggaggcgcgcugcggaacauuuggacagaucaccagaucagacaagcucuuuuuccuagccggcgcucuccccaggaaaaugaggacgaugaagacgauuaccagauguucgugccguccuuuagcucuagcgaccugaacuccaccagacucugugaggauagcacgucuucccggccuugcagcuggcauauggggcagauggaauccacagagaccucuagcuccggacacagaauuguccgccgggccucuagcgccggcgaguccaauaccugucccccugaaaucgggacaucugacagaacccgcgagcugcaaaacagccccaagacagaaggacaggaggaaaugacgccuuucggcuccagcaucgagcugaccauugaugacaucgaucauguguaugacaauauuucuuacgaggaucuuaagcucauggucgcuaaaagagaagaggccgaauccacacccagcaagucugcucgggacuccgugcgcccgaaaagcaccccugagcuggccuuuacaaagagacaggcgggccacucuaaagggucccuguacgcccaaaccgacggaacgcucagcggcggggaagcuagcagccagucuacccacgagcugcaggccguugaggaaaacaucuaugauacaauuggacuucccgaucccccuagccugggcuucaagugcuccucucucaagcgggcuaaacgcagcaccuuucuggggcuggaggccgacuucguguguugcgacucccuuagaccguuugucucucaggauagccuccaacuguccgaagacgaggcgcccuaccaucaggccacaccugaucacggcuaucugucucuccuguacgacagccccuccggaaaucuuagcaugccucauaagcccgugucugauaaacuguccgaggaaguugacgagaucuggaacgaucucgaaaauuauauuaagaaaaacgaggacaaggcucgggaucgccugcuggccgcuuucccugugagcaaagacgacguccccgauagacuucacgccgaaucuaccccggagcucucccgggacgugggccgcagcguguccacgcugucucugccugagagccaggcccuccugacacccguuaaguccagagcugggcgggcgagcagagccaauugcccuuuugaagaggaucuuaucucuaaggaaggauccuucaugagccugaaccgccucucucuggcuagcgagaugccccugauggacaauccguacgaucuugccaacuccggccugucucagaccgacccugaaaaccccgaucucgggauggaggccacagacaaaaccaagagccgggucuucaugauggcuagacaauauucccagaaaaucaagaaagccaaucagcugcucaaggugaagucucuggagcuugaacagccucccgcgagccaacaucagaaauccaugcacaaggaucuggcugccauucucgaggagaaaaagcagggaggccccgccaucggggcucgcauugccgaauacagccaacuguacgaccagaucguguuucgggaaucuccucugaaaauucagaaggauggcugggcguccccgcaggagagcucccuucugagaucugucagccccucccaagugcaccauggaucuggcgacuggcuccugcacagcaccuauuccaacggggagcucgcugacuucugucugccucccgaacaggaucuucgcagccgguacccuacauuugagaucaauacgaagucuacccccagacagcuguccgccgccugcagcguuccuucucuccagacauccgacccgcugcccggaagcgugcaacgcuguucugucgugguuagccagccuaacaaagaaaauuggugccaggaucaucuguauaacucccuuggccggaaggggaucucugcuaaaagccagcccuaccacagaucccaaagcuccucuagcgugcugauuaauaaguccauggacucuaucaacuauccuagcgaugucggaaaacagcagcuccugucccuccaucggucuagccgcugugagucccaccaggaccugcuucccgauauugccgacagccaccaacagggcaccgagaagcugucugaucugacacuccaggacucccaaaaggugguuguggucaauagaaaccugccgcuuaaugcucagaucgccacccagaacuacuucagcaauuuuaaagaaacggauggggacgaggaugacuauguggaaauuaagucugaggaagacgaguccgagcuggaacucagccauaaccggcgcagaaaaucugauuccaaguucguggacgcggauuuuagcgacaaugucugcuccggcaacacacugcacagccucaacucuccucggacccccaaaaagcccguuaauagcaaacugggacuuuccccuuaccugacccccuacaacgauucugacaagcugaaugauuaucucuggagaggcccuagcccgaaccagcaaaauaucgugcagucccugcgcgagaaguuccagugucuuucuagcuccucuuuugccuga

SEQ ID NO: 73888 - RNA, 4161 nt, Artificial Sequence
  derived and/or modified sequence opt5 from PLEKHG2__Homo_sapiens__NP_073746
augcccgagggcgcccaggggcugagccucuccaagccuucuccgagccugggaugcggcagacggggagaagugugugacugcggaaccgugugugagacacgcacggcucccgccgcgccuaccauggcuucccccagaggcucugggagcuccacaucucuuagcaccguuggauccgaaggcgauccugcccccggcccuacaccggccugcagcgcuucucggcccgagccucugcccgggccucccauccgccuccaccuguccccgguggggauuccuggcagcgccagacccucucggcuugaacgcguggcuagagagaucgucgagaccgaacgggccuacgugcgcgaccugagauccauuguugaggauuaucucgggccucugcuggacggaggcgugcucgggcugagcgucgaacaagugggaacacuuuucgcgaacaucgaggauauuuacgaguuuucuuccgaacugcucgaggaccuggaaaauagcuccucugccggcggcaucgcugaguguuucguucagcggagcgaagauuuugacaucuauacccuuuacugcaugaacuaucccuccagccuggcccuccugcgcgagcugucucucuccccucccgcugcccuguggcuucaggagagacaggcgcaacugcggcauagccucccgcugcagucuuuccuucugaaacccgugcagcgcauucucaaguaccaucugcugcuccaggaacuggggaaacacugggccgagggaccuggcaccgggggaagagaaauggucgaggaagcuaucgugagcaugaccgccguggcuugguauauuaaugauaugaagcggaaacaagagcacgccgccagacuucaggagguccagcgccggcugggcggguggacaggacccgaacucuccgcuuuuggcgagcugguucuugaaggcgcguucagagggggaggcgggggaggcccucgccugagagggggcgagcggcuccuguuucuguucucucgcaugcuccugguggccaagcggagaggacuugaauacaccuacaagggccauaucuuuuguugcaaccugagcguguccgagagcccccgcgacccgcucggguucaaagucucugaucugacaauuccuaagcaccggcaucugcuucaggcuaaaaaucaagaggaaaagagacucuggauccacugucugcagcgccuguuuuucgagaaccaccccgccuccauuccugccaaagcuaaacaggugcuccuggaaaauagccuucauugcgcccccaagucuaagccuguucuggagccccucaccccgccucugggaagcccccggcccagagacgcgcgguccuuuacgccuggccgcagaaacacagcuccgucccccgggccuucugugauccggagaggacgccggcaaagcgagcccgucaaggauccuuaugugauguucccccagaaugccaaaccuggcuucaagcacgccggguccgaaggcgagcuguaucccccggaaucucagccucccguuagcggauccgcuccucccgaggaccuugaagacgccggcccgccuacccucgaucccagcgggacaucuaucaccgaggagauucuggaacugcucaaccagagaggacugcgcgacccuggccccuccacccacgauauccccaaauuuccuggggacagccaagugccgggagauucugagacacuuacguuccaggcucugcccuccagagacagcucugaagaggaagaggaggaagaggaaggccucgagauggaugaacgggggccuagcccccugcauguccuggagggccuugaguccagcauugccgcggaaaugccuucuauccccugucucaccaagauuccugacgugccgaaucugcccgagaucccuucccgcugcgaaauccccgagggaagcagacugccuucccucucugauauuagcgacgucuuugagaugcccugccugccggccaucccuuccgugcccaacacacccucucuuagcuccaccccuacacugucuugugauagcuggcuccagggcccccugcaggaaccugcugaggccccggcuacccggcgcgaacuguucuccgggagcaaucccggaaaacuuggcgagccucccucugggggaaaggccggcccugaagaggacgaggaagggguuuccuuuacggacuuccaaccccaggaugugacacagcaccagggcuuuccggacgagcucgcguucagaagcugcucugaaauucgguccgccuggcaagcucuggagcagggacagcuggcccgcccuggcuuucccgaaccucuccugauccuugaggauagcgaccucgggggagauucuggcuccgggaaggcuggagcccccagcuccgagagaaccgccagccggguccgcgaacuggcuagacuguacucugagcggauucagcaaaugcagagagcggaaacccgcgccagcgcuaacgccccucggagacgcccccgggugcuggcccagccgcaaccuucccccugucuuccccaggagcaggcugaaccuggccugcucccggccuucggccauguucuggugugcgagcucgcguuuccccugacaugugcucaggagucugucccucuugggcccgccgugugggugcaagccgcuaucccucugagcaaacagggaggcucccccgacgggcagggacuccacguuucuaaucugccuaagcaggaucugccgggcauccaugucagcgccgcgacccuucugcccgaacaagggggauccagacacgugcaggcuccugccgccacaccccucccuaaacaggagggcccccugcaccuccaggugccggcucugacgaccuucucugaccaaggccauccugaaauucagguccccgccacaacgccccuuccugagcaccgcagccauauggugauccccgcuccuuccacagccuuuugcccggagcaggggcacugugcggauauucacguucccaccacgccugcccugcccaaggaaaucugcagcgacuucaccgugucugucacaaccccugugcccaaacaagagggacaucucgauuccgaaagcccgacaaacauuccucugaccaagcagggcgggucucgggacguucagggacccgauccuguguguucccagcccauccaaccucugagcuggcacggcuccucucuugacccccaggggccgggagacacgcugccuccccuccccugccaucugccugaucuccagauuccgggcacaagcccccugccugcucacggcucccaucuugaccacagaauccccgccaacgcuccucugagccugucucaggagcuccccgauacccaagucccugccacaacaccccugccgcuuccucaggugcugaccgacaucuggguucaggcccuccccaccuccccuaagcaggggagccugcccgauauucaaggaccggcugcggccccuccccuccccgaaccuucucugacggacacccaggugcagaaacuuacacccagccuggagcagaagucccugaucgaugcucacgucccugccgccaccccgcuccccgagcgcggcgggucucuggacauucaaggacuuagcccuacacccgugcagaccacgauggugcuguccaaaccuggcgggucucucgcuagccaugucgcccggcuggaauccagcgaucucacacccccucacucuccgcccccuuccagcagacagcugcuuggacccaaugcggcugcccugucccgguaccuggccgcuucuuauaucagccaaucccucgcccgcagacagggcccuggcgggggagcgcccgcugccucucggggcagcugguccagcgccccgaccucucgcgcuuccagcccuccuccccagccccagcccccuccgcccccugccagacggcugucuuacgcuaccacaguuaacauucaugucgggggaggcgggagacuucgccccgccaaggcgcaagugcggcugaaucacccugcccuccuggcuuccacccaggagagcaugggacuccauagagcccagggcgcucccgacgccccguuccacauguga

SEQ ID NO: 73889 - RNA, 4026 nt, Artificial Sequence
  derived and/or modified sequence opt5 from PLEKHG3__Homo_sapiens__XP_011534927
augcccgugagcaccucccugcaccaggacggcucucaagagagaccugucagccucacauccacgaccucuagcuccgggucuagcugcgauucccggagcgccauggaagaaccgucuuccagcgaagcucccgccaagaacggagcgggcucucugcgcuccagacaucuuccuaauagcaacaauaacucuuccagcuggcugaauguuaaagggccccucuccccuuucaacucucgggcugccgccggacccgcucaccauaagcugagcuaccuuggccgcguggugagagagaucgucgaaacagagcggauguaugugcaggaccugcgcuccauuguugaggauuaccuccugaaaaucauugacaccccugggcugcucaagccggaacaggugagcgcccuguuuggaaauaucgagaacauuuaugcucuuaauucucagcugcucagagaucuggacuccuguaacagcgaucccgucgccguggcgucuugcuucguugaacggagccaagaguuugacaucuacacacaguauuguaauaacuacccuaauuccguggccgcucuuaccgagugcaugcgcgauaaacagcaggccaaguucuuuagagaccggcaagaacugcuccagcacucucugccccugggcagcuaucuccugaagccuguccagcgcauccuuaaauaccaucugcuccugcaggagauugcuaagcacuucgaugaagaggaagacggcuuugaggugguggaggaugccaucgacacaaugaccugugucgcgugguacauuaacgacaugaaaagacggcacgaacaugccguucgccuucaagagauccagucccugcucauuaauuggaaggggcccgaucugacgaccuauggagaacuggugcucgagggcacauucagagugcaccgggucagaaacgaacgcaccuuuuuccuguuugacaaaacacuucugaucaccaagaagagaggggaucauuucguguacaaaggaaacauuccgugcagcucucucaugcugaucgaguccacgcgggacagccuuuguuuuacaguuacccacuauaagcacucuaaacagcaauacuccauccaggcuaagacaguggaggaaaaacgcaauuggacccaucacauuaagcggcugauccucgagaaccaucacgccaccauuccucagaaagcuaaggaagccauccuggagauggauagcuauuaccccaauagauaucgcugcuccccugaacggcugaagaaagccuggucuagccaggacgaggucuccacaaacgugagacaaggccgccggcagucugagcccgggcauagccccuacuccagagcuacgcucccuagcggacagcgcggcuucguuaugccgucucugaagggccggagaaaauccgaacccaccaagcaccuucugcggcagcucaaugagaaagcgcgcgccgcugggaugaagcacgccggaagcgccggcacacugcuggauuucgggcaaccuucuagaacccggggacuucagcccgaagcugagggcgccacacaggaggaagaggaagaggaagaggagguggucgaagaggaagaggaagaggaggaagaggaacaggcguuucaagugucccucgaggaccugaccgggcaugaaggaaacgagaagggcgcuggcccugagcccccggggagcgaagaggaagaggaggaacaggaggaaucucuggccgucgccgagcagggaaaaggcagacgcgaaagcgaguccagccggucuuccagacgcccuagcgggagaucccccacgucuacagagaagcggaugagcuucgaauccauuucuagccucccugagguggaacccgauccugaggcuggauccgaacaggagguguuuucugccguugagggccccagcgcugaagagaccccguccgacaccgaaagcccugagguccuggaaacacaacuugaugcccaccaggggcugcucggcauggacccucccggagacaugguggauuucguugcggccgagucuaccgaggaccugaaagcucuguccagcgaagaggaagaggagaugggcggggccgcucaggaacccgagucucuucucccgcccuccgugcuggaucaagccagcgucaucgcggaacgcuuugugucuuccuucagcagacgguccagcguggcccaggaggacucuaagagcuccggauuuggcucuccucgccugguuagcagauccucuagcguccucucccuggaagggucugagaaaggacuugcucggcauggcagcgccacagauucccugagcugucagcucucucccgagguggacaucuccgugggggucgcuacggaagauagcccuucugugaauggcauggagcccccuucccccggaugcccgguugaaccugaccgcagcuccuguaagaagaaagagucugcccugagcaccagagaucggcugcuucucgacaagauuaaauccuacuaugaaaacgccgagcaccacgaugcuggcuucagcgugcgcagacgggagucucuguccuacauccccaaggggcuggucagaaauagcauuucucgcuuuaacagccucccucggcccgacccggaaccugugcccccuguuggauccaaaagacaggugggcucucgccccacaagcugggcgcuguucgagcuucccgggccuucccaagccgucaagggagauccgcccccuaucucugacgcugaauuucggcccagcuccgagauugugaagaucugggaaggcauggagagcucugggggcuccccuggaaaaggccccgggcagggacaggccaauggcuucgaccugcaugagccucucuuuauccuggaggagcacgaacugggggccauuaccgaggagagcgcuacagccuccccggaaucuagcucccccaccgagggaagaucuccugcgcaucuugcucgcgaacucaaggagcugguuaaagaacugagcuccagcacgcagggcgagcucguggcuccccugcacccucggaucguccaacuuucucaugugauggauucccacgugagcgagagagucaagaacaaaguuuaucagcuggcccgccaguacucucuccggauuaaguccaauaaacccgugauggccagaccgccucugcagugggaaaagguggcccccgagcgggacggcaagagccccaccgucccuugccugcaagaagaggcgggggaaccccuuggaggcaaagggaagcgcaaaccugugcugucucucuucgauuaugagcagcugauggcucaggagcacagcccgcccaagccuuccucugccggagaaaugagcccccaaagauucuuuuucaacccuuccgccguuagccagcggacaaccucccccggcgggcgcccgucugcuagaagcccucucucccccacagagaccuuuucuuggccugacgugcgggaacugugcagcaaauacgccuccagagaugaggcucgccgggccggaggcggcagaccccgcgggccucccgucaaucggucucauagcgugccggaaaacaugguugagccuccccuuuccggaagagugggccgcugucggagccugucuacgaagagagggcgcggaggcggggaggcggcccagucccccggaccucucccgcagagcaagcccgacggcggcgaaacacuguaugucaccgcugaucugacacuugaggacaacagacgggugaucguuauggaaaaagggccucugcccucuccuaccgccggacucgaggaguccagcggccaagggcccucuuccccuguggcucugcucggacagguccaggauuuccagcaaagcgccgaaugccagccgaaggaggaaggcucccgcgaccccgccgauccuagccagcaggggagagugcggaaucugcgcgagaaauuucaagcucuuaacucugugggauga

SEQ ID NO: 73890 - RNA, 3576 nt, Artificial Sequence
  derived and/or modified sequence opt5 from PLEKHG4__Homo_sapiens__NP_001123201
auggagagaccccuggaaaacggcgacgagagcccugauucccaggggcacgccaccgacuggcgguucgcugugugcucuuuucgcgaugccugggaagaggaggagccggcgagccaaaugcaugucaaggaccccggaccucccagaccucccgcuggcgccacacaggaugaggaacuccagggguccccucugucucggaaauuccagcuuccgcccgccgcugacgagagcggagaugcccaacgcggcacgguugaauccucuagcgugcuguccgaggggccuggacccagcggcguggagucucuccuguguccuauguccagccaccuuucucuggcucagggcgaauccgacacccccggggucggacucgugggcgauccggggccuagcagagccaugcccucuggacuguccccuggcgcgcuggacagcgaucccguugggcucggagacccccuguccgagaucucuaaacuucuggaagccgcuccuagcggcuccggccucccgaaacccgccgauugccugcuugcucaggaccuguguugggagcuccuggccagcgggauggcgacacugccuggaacccgggacgugcagggccgcgccguccuccugcuuugcgcucauucucccgccuggcugcaauccgaauguagcucucaggagcucauuagacugcuucuguaccuccggagcaucccucgccccgaggugcaggcucuggggcugacaguucucguggaugccagaauuugcgccccguccucuagccuguuuuccggacuuagccagcugcaagaagcugcgccuggcgccgucuaucaggugcuccugguggggucuacccuucugaaggagguccccuccggacuccagcuggaacaacugccuagccagucucuccugacacacauccccaccgcuggccuuccuacgucccugggcgggggacuccccuacugucaucaggccuggcuggacuuccggcgcagacuggaggcccuucuccagaauugccaagcugccugugcgcugcugcagggcgcuauugaaagcguuaaagccgugccgcagccuauggagcccggggaggugggacagcuccugcaacagaccgaaguccuuaugcaacaggugcuggauucccccuggcucgccuggcugcagugccagggcgggcgggagcugacauggcuuaagcaggaaguuccugaggugacccucucuccggacuaucgcacagcuauggauaaggccgacgaacuguacgauagagucgacggccugcuccaccagcugacccuucaaagcaaccagcggauccaggcucuggagcucgugcaaacgcuggaggccagagaauccggacugcaccagaucgagguuuggcuucaacaggugggcuggcccgcgcucgaagaggccggggagccuucucuggauaugcugcuccaggcucagggcagcuuucaggaacuguaucaggucgcccaagaacaggugcgccagggagaaaaauuccuucagccccugacagggugggaggcugccgaacucgacccucccggagcgcgguuucuggcccugagagcucaacuuaccgaguucucccgcgcccucgcucagcggugucagagacuggccgaugccgagcgccuguuucaacucuuccgggaagcucugacaugggcggaggaaggccagagaguccuugccgagcuggaacaggagcgcccuggggugguucuccagcaacugcagcugcauuggacccggcaccccgaccuuccgccugcucauuuuagaaagaugugggcccuggccaccggccucggaagcgaggcuauucgccaggaaugccggugggccugggcgagaugccaggacacauggcuggcucucgaucaaaaacuggaggccucucuuaagcugcccccugugggcuccacggccagccucugugucucucaggugcccgcugccccggcgcacccuccccugcggaaggcuuacuccuucgaccgcaaucuggggcagagccuuucugaaccugccugccacugucaucacgccgcuaccaucgccgcuugcagacggcccgaggccggaggcggggcgcugccccaggccagcccuacaguuccgcccccuggauccagcgaucccagaucucucaaccgccugcaacucgugcuggcugaaauggucgccaccgagcgggaguaugugagagcucuugaauacacaauggagaauuacuuuccugaacuggaccgccccgaugugccucagggccucagagggcagcgggcccaucuguucggcaaccuggagaaacuucgcgacuuccacugucacuuuuuccugagagagcucgaagccugcacccggcacccgccccgcguugcuuaugcguuucugagacaccggguccaguucggaauguacgcccucuauuccaagaauaagccucgcagcgaugcucugauguccucuuacggccauacguuuuucaaggacaaacaacaggcccuuggggaucaccuggaccuggccagcuaucuccugaagcccauucagagaaugggaaaauacgcccuucugcuccaagagcuggcucgggcguguggcgggccuacacaggaacucuccgcucugcgcgaggcccagucucuugugcauuuucagcugagacacggaaacgaucugcucgccauggacgcuauccaaggcugcgaugugaaucugaaggaacaggggcagcuuguccggcaggacgaguucgugguuagaaccggccgccacaaaagcgugcggagaauuuuucuguucgaggaacuccugcucuuuuccaagccccgccauggaccgaccggcgucgacacauucgccuauaagcggucuuuuaaaauggcggaucuggggcuuaccgaguguugcggaaacagcaaucugagauucgaaaucugguuccgccggagaaaggcucgcgacacauuugugcugcaagccuccagccucgccauuaaacaggcuuggacggccgauaucucucaucugcuuuggcggcaggcuguucauaacaaggaggugagaauggccgaaauggucuccaugggcguggggaauaaagcguuccgggacaucgccccuagcgaggaggcuauuaacgaucgcaccguuaauuacgugcugaaguguagagaaguccggucucgcgccuccaucgcuguggcccccuuugaccacgauagccucuaccugggagccucuaacucccuccccggcgacccugcuagcugcuccgugcugggcagccuuaaccugcaucuguauagagaucccgcgcuccuggggcuucggugcccucuguacccgucuuuccccgaggaagccgcucucgaggccgaagccgagcugggaggccagccuagccugacagcugaggacuccgaaauuucuagccaaugucccuccgccucugggagcuccggaucugauagcuccugcgucagcggccaggcgcucgggagaggacuugaggaccugccuuguguuuga

SEQ ID NO: 73891 - RNA, 2373 nt, Artificial Sequence
  derived and/or modified sequence opt5 from PLEKHG6__Homo_sapiens__NP_001138328
augaaggccuucgggcccccucacgagggcccgcugcagggacucguggcuagcagaaucgaaaccuacggcgggcggcaucgcgccuccgcgcaaucuacagcuggaagacuguauccccggggcuacccuguccuugaccccagccgcagacggcugcagcaguauguuccuuuugcccgcggguccggacaggccagaggccucucucccaugcggcugcgcgauccugagccggaaaagagacacggcgggcaugugggagcuggccuucugcacagccccaagcucaaagagcugacgaaggcccaugaacuggaggugcggcuccacaccuucuccauguuugggaugccucgccugcccccugaggacagacggcacugggaaauuggagagggcggggauucuggacuuacaaucgagaaaagcuggcgcgagcugguccccggccauaaggagaugucccaagaacucugccaccagcaggaggcucugugggaacuucugaccacagagcucauuuacgugagaaagcugaaaaucaugaccgaccugcucgccgcgggccugcuuaaccugcagcggguugggcuccugauggaagugagcgccgagacacuuuucggaaaugucccgucucugauuagaacccaucgcuccuuuugggaugaggugcucggcccuacgcuggaagagacccgggcuagcgggcaaccccuggacccuaucggacuccagucuggcuuccugacauuugggcagagauuccaccccuauguucaguacugucuucgcgugaagcaaaccauggccuaugcucgggaacagcaggagacaaacccccuguuucacgccuucguccaauggugcgaaaaacauaagagauccggacgccagaugcucugugaucugcuuaucaaaccucaccagcggauuaccaaguacccgcugcuccugcaugcggugcugaagagaagccccgaggcccgcgcucaggaggcccucaaugcuaugaucgaagccguggagucuuuucugcggcacauuaacggccaagucagacagggcgaagaacaggaaucccuugccgcugcggcccagcgcaucgggccuuacgagguucuggagcccccuagcgacgaaguggagaaaaaucuccggcccuucuccacgcuggaucugacaucuccgaugcuuggaguggcuagcgaacauaccagacaacuccugcuggagggcccuguccgggugaaggaggggcgcgaaggaaaacucgacguuuaucuguuucuuuucuccgaugugcugcucgucacaaagccccagagaaaagccgacaaggccaaagugauucggccuccccugaugcuggagaaacuuguuugccagccucucagagaucccaacagcuuccugcugauccaccucaccgaauuucagugugugucuuccgcucugcuuguccacugcccgagcccuaccgaccgcgcccaauggcuggagaagacacagcaggcgcaggcugcccuccaaaaacugaaggccgaagaguacgugcagcagaaacgggagcugcuuacgcucuauagagaccaagaucgcgaaucucccagcaccagacccuccacaccuucucuggagggcagccaguccagcgcugaagggcggaccccggaguucucuacaauuaucccccaucuggucgugaccgaagacacggaugaggacgccccucucguucccgaugacacauccgauagcggcuacggaacccugaucccuggcacccccacagggucucgcuccccucuuagcagacugcggcagcgcgcucucagacgggacccccgccugaccuuuuccacacuggagcuuagagauauuccgcuccggccucaucccccugacccccaggccccgcaacgcagaucugcgccugaacugcccgagggaauccugaagggcgggagccucccucaggaagauccucccacgugguccgaggaagaggacggagccucugagcggggcaauguggucguggaaacccugcacagagcucgccuucgggggcagcugcccagcuccccgacacacgccgacagcgcuggcgagucucccugggaauccagcggagaggaggaagaggaaggcccucucuuccugaaagccgggcacaccucucugagacccaugcgcgcggaggauaugcuucgggaaauuagagaggagcuggccucccagcgcaucgaaggagcugaggaaccucgggacagcagaccccgcaagcucacacgggcccaacugcagagaaugcggggcccucauauuauccagcucgauaccccgcugucugcuagcgagguuuga

SEQ ID NO: 73892 - RNA, 4482 nt, Artificial Sequence
  derived and/or modified sequence opt5 from PLEKHH2__Homo_sapiens__NP_742066
auggccgagcugagcgaacccgagggcccuguggacuggaaggaaagaugcgucgcucucgagucccagcugaugaaauuccggguucaagccucuaagauccgcgaacuucuggcggagaaaaugcagcagcucgagagacaggugauugaugcugaacggcaagccgagaaggccuuucaacaggugcaggucauggaagacaaacugaaggcugccaacauccagaccagcgaguccgagacacgccuuuacaauaagugucaggaucuggaaucucucauucaggagaaagacgaugugauccagaaccuggaacugcaacucgaggaacagaagcagauuagaauccaagaggcuaaaaucauugaggaaaaggccgcgaaaaucaaggaguggguuacggugaagcugaaugaacuugagcuggaaaaccagaaucuccggcugauuaaccagaaucagaccgaggagauccgcacaaugcaaagcaaacuucaggaaguccaggggaagaaauccucuaccgugagcacacugaagcucuccgagggacagagacugagcucucugaccuucggcugcuuucucucccgggcccgcagcccgccccaaguugugaaaucugaagagauguccaagauuagcucuaaagaaccugaguucacagaggggaaggacauggaagagauggaaauccccgagaaguccgucgauaaccaggugcuggagaauaacagaggacagcggacccuucaccagacgccuuguggcagcgaacaaaaucgcaaaaccagaacauccuuugcuaccgacgggggaauuucucagaacagcggcgcccccguguccgauuggagcucugacgaggaagauggcuccaaggggcggagcaaaucucgcugcacaagcacccuguccucucauacgagcgaggaaggaguccaguguuccagaaugggcagcgagauguaucucacagcuucugacgauuccagcucuaucuucgaggaagagaccuuugggaucaagcggccugaacacaaaaagcuguacuccuggcagcaagaggcccaguggaaggcgcuuaauagcccgcugggaaaaggcaacuccgaacucucuaagaaagagcaggacagcuccucugacgagcugaauaagaaauuccaaagccagagacuggauuauuccuccucuuccagcgaagccaacacacccucuccuauucucacccccgcucugaugccuaagcaucccaacucccuuagcgggaagggaacccagcugguuccgucuagccaccucccucccccuaaacugcgcauccccaauguguuuuccauuagcguggcccuugcuaagcggcaucugucucagccccaacucuccagcgacagaauguucggcacaaaccgcaaugccaucuccaugauucggccucugagaccgcaggagacggaucuggaccucgucgauggcgacucuaccgaagugcuggagaacauggauacaagcugcgacgaugggcuuuuuagcuacgacucucuggauagccccaauuccgacgaccaggaacacugugauucugccaaaaagguugcuuauagcaaaccucccaccccuccccuccaccgcuucccguccugggagagccggaucuacgcgguggccaagucuggaaucagaauguccgaggcuuuuaacauggaaagcgucaauaagaacucugccgccacacuguccuauaccacgagcggccuguacacaucucuuauuuacaaaaauaugaccaccccuguguauacaacccucaaggggaaagcuacacagaucuccagcucccccuuccuggacgauagcucuggaagcgaggaagaggacuccucucgcagcuccucucggacgagcgaguccgauucuagaagccgcuccggcccugggagcccccgggccaugaagagaggaguuucucuguccagcguggcgucugaauccgacuacgcuauuccucccgaugccuauagcaccgacacagaguacucccaaccggaacagaaacucccuaagaccugcucuagcuccagcgauaacggcaaaaaugagccccuggaaaagucuggcuaucuucugaagauguccgggaaagucaagagcuggaaacggcgcugguucgugcucaagggaggcgagcugcuguacuauaaaucucccagcgacgucaucagaaagccucaggggcauauugagcuuuccgccucuuguagcauccuccggggagauaacaagcagacagugcaacugaccacggaaaaacacaccuacuaccugacagcugacuccccgaauauccucgaggaauggauuaagguucugcagaacgugcuuagaguccaggccgcuaauccccugucucuccaaccugagggcaaacccaccaugaaggggcugcugacaaaagugaagcauggcuauagcaagcgcguuuggugcacccuuaucggaaaaacgcucuacuauuuucggucccaggaagauaaguucccucugggccagauuaaacugugggaggccaagguggaggaagucgacagaagcugugacucugaugaggacuacgaagcguccgggcgcagccuccuguccacacacuauaccaucgugauucaccccaaagaucagggaccuacauaccuucugaucggcucuaagcaugagaaggacaccuggcucuaucaccugaccguggccgcugggagcaacaacguuaaugucggauccgaauuugagcaacuggugugcaaacuucucaacauugauggcgagcccucuagccagaucuggagacauccgacacugugccacuccaaggaagggaucauuagcccucugacgacccuccccucugaggcccugcagacagaagcuaucaaacuuuucaagaccugucagcuguuuauuaaugccgcgguggacuccccugccaucgauuaccauauuagccucgcucaaucugcccugcagaucugccugacacaccccgagcuucagaacgagaucuguugccagcugauuaaacaaacccggcgcagacagccgcagaaucagccuggcccccuccaaggauggcagcugcucgcucugugugucggccuuuuccugccucaccaucccuuucucuggcugcugcggcuucaccugaagcgcaacgccgacuccagaacggaauuugggaaauacgccaucuauugccagcgguguguggagcgcacacaacagaauggagauagagaagcucggcccagccgcauggagauucucucuacccugcucagaaacccuuaccaucacagccugccguuuuccauccccguucacuucaugaauggcauuuaucagguggucggguuugacgcgucuaccacaguggaagaguuccuuaacacccugaaucaggauacaggaaugcggaagccugcccaaagcggcuuugcucucuucacggacgaucccuccgggagagaccuggagcauugccugcagggcaacaucaagaucugugacauuaucagcaaaugggaacaggccuccaaggagcagcaaccuggaaaaugcgaaggcacccgcacaguucggcuuaccuacaagaauagacuguauuucucugugcaggcccgcggggagacagaucgggaaaaacuccugcucauguaccagaccaacgaccagauuaucaauggacuguuuccccuuaacaaggaucuggcucuggagauggccgcgcuccugagccaagucgagauuggcgacuucgaaagaccuuuuuccacgccggcugggcacgugaccaaccaguguaagguuaaucagacacuuaaacaagugaucgagaaguucuaucccaaacgcuaccgggauggaugcucugaggaacagcugagacagcucugccagcgccugagcacccgguggauggcccucagaggccauuccgccgcugacuguguccggaucuaccugacaguggcccgcaaguggccuuucuucggggcgaaacuuuuucuggcuaagcccauuaccccuucuagccugggcuccacauuccucuggcuggccgugcacgaagauggacuuagccugcucgaguauaacucuaugagacugaucgucuccuacguuuauaagagccucaugaccuuuggcggguaccaagacgauuucaugguggugauuaauaacacgcauucuaaagacaagcccacagagaaacugcuuuuugccauggcuaagccgaaaauccuggaaauuacccugcucaucgccuccuauauuaauaacuuccaccagcagaaggcugccuuucaccaucugagcgcgccugcccuucugucugcucagacccggggaccccaagcccgcaugaugggcucccagccccuccugagcuccagcagaccuacaaaggggcccacccuccuguga

SEQ ID NO: 73893 - RNA, 3171 nt, Artificial Sequence
  derived and/or modified sequence opt5 from PLEKHM1__Homo_sapiens__NP_055613
augcugagcguggucgagaacggccucgacccccaggccgcuaucccuguuauuaagaaaaagcuggugggguccgugaaagcccuucaaaagcaguacgucucucuggauaccgugguuacaagcgaagacggagaugcgaauacgaugugcuccgcucucgaggccguguucauccacggccugcaugccaaacacauuagagcugaagccgggggaaagcggaagaaaucugcucaucagaagccgcuuccccagccugucuuuuggccccugcucaaagccgugacccacaagcauaucauuagcgagcuggaacaccugacauucguuaacaccgacgugggccgcuguagagcguggcuccggcuggcccuuaaugaugggcugauggagugcuaucucaaacugcuucugcaagagcaggcucgccuccacgaauacuaucagccuacagcccugcugagagacgcugaggaaggagaguuucuccuguccuuccuucagggccugaccucucucagcuuugagcuguccuacaagagcgccauccuuaacgaauggacacugacgccccucgcgcugucuggccuguguccucucuccgagcuggauccgcuuagcaccucuggggccgaacugcaacggaaggagucccucgacagcaucucucauuccagcggauccgaagauauugagguccaccauucuggccacaaaauccgcagaaaucagaagcugaccgcuagcucccuuagccuggacacagccucuuccagccagcucucuugcagccugaacuccgauucuugucugcuccaggagaaugggagcaaaucccccgaccacugcgaagaaccuaugagcugugauucugaccugggaaccgcuaacgccgaagacuccgaucggagccuucaagaggugcugcucgaguucucuaaggcccaggucaauuccgugcccacaaacggccugagccaggagaccgagauuccuacgccccaggcuucccugucucuucaugggcucaauacaagcaccuaucugcacugcgaagcgccggccgagccucugcccgcucaagccgccuccggaacacaggacggcguucaugugcaggaaccucgcccccaagcucccucuccucucgaucugcagcagccgguggagagcaccuccggccagcaacccagcucuaccgucuccgaaacagccagagagguggggcagggaaacggccuucagaaagcgcaggcucacgacggggccggacugaagcucguugugagcucuccuacgucccccaaaaauaagagcuggaucucugaggaugacuuuuaccggccuagccgcgaacaaccccuggaguccgccagcgaucauccgauugcuucuuauagaggcaccccugggucccggcccggacugcaccgccacuucagccaggaaccuagaaagaacuguucccuuggcgcccucgaccaggcuugcguccccucuccuggccggagacaggcccaagcggcccccagccaggggcauaaauccuuucgcgugguucaccggagacagaugggacugucuaauccguuccgcggccugaugaagcucgggacaguggagcggagaggagcuaugggcaucuggaaagagcuguuuugugaacuuagcccucuggaguuccgccucuaccuguccaacgaggaacauaccugcgucgaaaacugcucucugcuucggugugagagcguggggcccgcccacuccgauggcagauuugagcucgucuucagcggaaagaaacuggcucugcgcgccucuucccaagacgaagcggaggauuggcucgaccgggugagagaagcccugcagaagguucgcccccagcaggaggacgaaugggugaauguccaauacccugaucagccggaggagcccccugaagcuccccagggcugccuuagcccuucugaccugcucuccgagcccgccgcucugcaggggacacaauucgauuggagcucugcccaggugccugaacccgacgccauuaaggagucccugcuuuaucucuacauggaucggaccuggaugccguauaucuuuagccugucccuggaagcucucaaauguuucagaauccggaacaaugagaagaugcugagcgacucucacggaguugagacgauucgcgauauccuuccugacacaagccugggcgggcccuccuuuuucaaaauuaucaccgcgaaggccgugcucaaacugcaggcuggaaacgccgaagaggccgcucuguggagagaucuuguccggaaggugcuggccucuuaccucgaaaccgcggaggaggcugugacacugggcgggagccucgacgaaaauugccaggagguucugaaguuugccaccagagaaaacggcuuccuucugcaauaucucgucgccauuccuauggagaaaggacuggauucccagggcuguuuuugcgcuggguguucucgccagaucggauucagcuuugugcggcccaagcugugcgccuucuccggccuuuacuauugugacaucugccaucaagaugacgcgucugugauuccggcuagaaucauucacaauugggaccugacaaaacgcccuaucuguagacaggcccucaaguuucugacgcagauucgggcccagccccucaucaaccugcaaauggucaaugcuagccuuuacgaacauguggagcgcaugcaccugaucgggagacggcgcgagcagcucaaacugcugggagauuaccuuggccugugcagauccggggcccucaaggaacugagcaagcggcucaaccaucgcaauuaucugcuugagucuccucacagauucuccguugcugaccugcagcagauugccgauggcguguacgaaggauuucugaaagcgcucaucgaguucgccagccaacacgucuaucauugcgaccuguguacccagcggggcuucauuugccagaucugucagcaccaugauauuaucuuucccuucgaauuugacacaaccgugcgcugcgcugaguguaagacaguuuuccaccaaucuugccaggccguggucaaaaaggggugucccagaugcgcucggagacgcaaauaccaggagcagaacauuuuugccuga

SEQ ID NO: 73894 - RNA, 681 nt, Artificial Sequence
  derived and/or modified sequence opt5 from PLEKHO1__Homo_sapiens__NP_001291653
augcugacccucgaccugauccaggaggaagaucccagcccugaggaaccgacauccugcgccgagucuuucagaguggaccuugauaagagcgucgcucaacuggccggcucccggcgcagagcggacucugaucggauucagcccagcgcugaccgcgccuccucucucagcagaccuugggaaaagacggauaagggggccaccuacacaccccaggcuccuaaaaagcugacccccacagagaaaggacggugugccucccuugaggaaauccugagccagcgcgacgcugccucugcgagaacccuccaacugcgggccgaggaaccuccgacacccgcucugccuaaccccggccagcucucccgcauucaggaucugguugccagaaaacuugaggagacccaggaacugcucgcugaggugcaagggcugggagacggcaagcggaaagccaaggauccuccccgcagcccgccugacucugaauccgagcagcuucugcucgaaacggagagacugcugggggaggcgagcucuaauuggucccaggccaaacgggugcuccaggaaguccgcgagcugagagaucuuuaucggcaaauggaccugcagacccccgacagccaccucagacagacaaccccucauucccaauaccgcaagucucugauguga

SEQ ID NO: 73895 - RNA, 1473 nt, Artificial Sequence
  derived and/or modified sequence opt5 from PLEKHO2__Homo_sapiens__NP_079477
auggaggaagagggcgugaaggaagccggggagaaacccagaggagcucagauggucgacaaggccggcuggaucaaaaagagcuccgggggacugcucggcuucuggaaagaucgguaccugcuucugugccaagcgcagcuccugguuuaugaaaacgaggacgaucagaaguguguggagaccguggaacuugggucuuacgagaagugccaggaccugcgcgcucuccugaaaagaaagcaccgguuuauucugcuccgcagcccuggaaauaaagucuccgauaucaaguuccaagccccgacaggcgaagagaaagagucuuggauuaaggcccugaacgaaggcaucaauagagggaagaacaaggcuuuugacgaggugaaaguugauaaaagcugugcccuugaacaugugacgcgggaccgcgucagaggaggccagcggcgcagacccccuacccgggugcaccugaaggagguugcuuccgccgcgucugaugggcuccugcgccuugaccuggaugugcccgacagcggaccucccgucuucgccccuuccaaucaugugagcgaagcucagccgagagagacaccccggccucucaugcccccuaccaaacccuuucuggccccggagacaaccucuccuggcgaucgcguggaaacacccgucggggagagagcuccuacccccguuuccgccagcucugaagugucccccgagagccaggaagacucugagacgccugcggaggaagacuccggaagcgagcaaccgcccaacuccgugcugccugauaagcucaaagucucuugggaaaaucccagcccucaggaggcccccgcugccgaauccgcugagccgagccaggccccuugcucugagaccuccgaagccgcuccccgggagggcggcaagccucccacaccucccccgaagauucugagcgaaaaacuuaaggcgucuaugggggagaugcaggccagcggaccucccgcucccggcaccgugcaaguuuccgugaacgggauggacgauucuccugagccggccaaacccagccaggccgaaggaacaccuggcacgcccccuaaggacgcuaccacauccaccgcccugcccccuugggaucugcccccgcaguuccacccuagauguagcucucucggggaccuucugggagagggcccccgccauccucuccaaccccgggaaagacuguaucgcgcgcagcuggaggucaaaguggcuuccgaacagacagagaagcuccugaauaagguucuuggcagcgagccggccccugugucugccgaaacccugcucucccaggcugucgagcaacugcggcaggccacccaggugcuucaggaaaugagagaucugggggagcucagccaagaagcucccggacugcgcgagaaacggaaggagcuggucacacucuacagacgcuccgccccuuga

SEQ ID NO: 73896 - RNA, 1053 nt, Artificial Sequence
  derived and/or modified sequence opt5 from PLEK__Homo_sapiens__NP_002655
auggagcccaagagaauccgggaaggcuaccuggugaaaaaggggagcgucuucaacaccuggaaaccuauguggguugugcuccuggaggacggaauugaauuuuauaagaaaaaguccgauaauucuccgaagggcaugaucccccuuaaagggagcacacugacguccccuugccaggacuucggaaagcgcauguuuguguucaaaauuaccacaaccaagcaacaggaucacuuuuuccaggccgcuuuucucgaggaaagagacgccuggguccgggauaucaaaaaggcgauuaaguguaucgagggcgggcagaaauucgcucgcaagucuacaagacggagcauccgccugcccgagaccauugaccuuggagcccuguaccucuccaugaaagauacagaaaagggcaucaaagagcugaaccuggaaaaggacaaaaagauuuuuaaucauugcuucaccggcaacugugugaucgauuggcucguuucuaaucaaagcgugagaaaccggcaggaggggcugaugauugccuccagccuucugaaugagggauaucuccagccugcuggcgacaugucuaaguccgccgucgaugggacggcugaaaaccccuuucuggacaauccugaugccuucuacuauuuuccggacagcggauucuucugcgaggaaaacucuuccgacgaugacgugauccuuaaagaggaauuucgcggcguuauuaucaagcaggggugucugcucaaacaaggacacagacggaagaauuggaaagugcgcaaguucauccugagagaggaucccgcguaccugcauuauuacgacccugccggcgcugaggauccccucggcgccauucaucugcgggggugcgucgugaccagcguggaaucuaacuccaauggacgcaagagcgaggaagagaaccuuuuugaaaucauuacagcugacgagguccacuacuuccugcaggccgcgaccccuaaagagagaacagaauggauccgggccauucagauggcuuccagaaccggcaaguga

SEQ ID NO: 73897 - RNA, 2433 nt, Artificial Sequence
  derived and/or modified sequence opt5 from PLG__Homo_sapiens__NP_000292
auggagcacaaggaagugguccugcuccugcuucuguuccucaaaagcggccagggggagccccuggacgauuacguuaacacccaaggagccucccucuuuucugugacaaagaaacagcugggcgcugggagcaucgaagagugcgccgcgaagugugaagaggacgaggaguucacgugcagagcuuuucaguaucauuccaaagagcagcaaugugugauuauggccgaaaaucggaagucuagcaucauuauccgcaugagagaugucgugcuuuucgagaagaaaguuuaccuguccgagugcaagaccggaaacggcaaaaauuaucgggggacaaugucuaagaccaaaaacggaauuacaugucagaaguggagcuccaccagcccucaccgcccgagauuuucucccgccacacauccuuccgaaggccuggaggaaaauuacugccggaaccccgacaaugauccucagggccccugguguuauaccacggacccugagaagcgcuacgauuauugcgacauccucgaaugugaggaggaaugcaugcacuguagcggggagaacuacgauggaaaaaucucuaagaccauguccggccuggaaugccaggcuugggacagccaaucuccgcaugcccacggguacauucccuccaaauucccuaauaagaaccuuaaaaagaauuauugcagaaaccccgaucgggagcugcgcccuugguguuuuacaaccgaccccaauaaaagaugggaacucugcgauaucccgcgguguacaaccccucccccuagcuccggacccacguaccagugccugaagggcacaggggagaacuaucgcggaaauguggcugucaccgugucuggccacacaugucagcauuggagcgcccagacaccccacacccauaacagaaccccugagaacuucccgugcaagaaucuugacgaaaacuacugucggaaucccgacggcaaacgcgcgccuuggugccacacgaccaacucccaaguuagaugggaguauuguaagauucccagcugcgauucuuccccugugagcacagaacagcuggcccccaccgcuccgccugagcucacacccgucgugcaggacuguuaccacggggauggacaaucuuaucggggcaccagcuccacgacaaccaccgggaaaaagugccagucuuggagcuccaugacaccucauagacaccagaaaacccccgaaaauuacccuaacgccggacugacaaugaauuacugccgcaaccccgacgcugauaagggcccgugguguuuuacgaccgacccuagcgugcggugggaguauugcaaucugaagaaauguucugggacagaggccuccgucguugcgcccccucccguggugcuccugccggaugucgaaacccccagcgaggaagacugcauguucggaaacggcaagggcuacagagggaaacgcgccacaaccgugacgggaaccccuugucaggauugggcugcccaagagccccaucggcacucuaucuuuacaccugagaccaaucccagagcuggccuugaaaagaacuauugccgcaauccugacggggauguuggaggccccugguguuacacaaccaacccgcggaaacuguaugacuacugcgacgugccucagugugccgcccccuccuucgauugcgggaagccucaggucgagcccaagaaauguccgggcagagugguuggaggcugcguggcucauccucacagcuggcccuggcaggucucccuccgcacgcgguuugggaugcacuucugcggaggcacacugauuucuccugaaugggugcuuaccgcggcccauugucuggaaaagagccccagacccuccucuuauaaagucauccucggggcucaccaagaagugaaucuggagccucauguucaggagauugaagugagccgccuguuccucgagccgacacggaaggacaucgcccugcuuaaacuguccagccccgccgucaucaccgauaaggugauuccugcuugccuccccucuccuaacuacguuguggccgacagaaccgaauguuuuaucacaggauggggcgagacgcaggggaccuucggcgcgggacugcuuaaggaagcucagcugcccgucauugagaacaaagugugcaaucgguacgaguuucucaacggccgcgugcaauccacagaacugugugccgggcaccuggccggaggcaccgauagcugccagggggacucuggaggcccucucguuuguuucgagaaggauaaauauauccugcagggggucacauccuggggccuuggaugcgcuagaccgaauaagcccggcguguacgugcgggucagcagauuugugaccuggauugaagggguuaugcgcaacaauuga

SEQ ID NO: 73898 - RNA, 291 nt, Artificial Sequence
  derived and/or modified sequence opt5 from PLGLB2__Homo_sapiens__NP_002656
auggagcacaaggaagugguccugcuccugcuucuguuccucaaaagcggccagggggagccccuggacgauuacguuaacacccaaggaccuucccuguuuucugugacaaagaaacagcuuggcgccgggagcagagaagagugcgcugccaagugugaagaggacaaagaguucacgugccgggcguuucaguaucauuccaaggaacagcaaugugugaucauggcugagaaucgcaagucuagcauuaucauuagaaugcgggaugccguccucuucgaaaaauga

SEQ ID NO: 73899 - RNA, 1569 nt, Artificial Sequence
  derived and/or modified sequence opt5 from PLIN1__Homo_sapiens__XP_005254991
auggccgugaacaagggccugacccuccuggacggggaucuucccgagcaggaaaauguccugcaaagaguucuccagcugccuguggugagcggaacaugcgaguguuuccagaaaacguacaccuccacaaaggaagcucacccgcuugucgccucugugugcaacgcguaugagaaaggcguucagagcgcuuccucucuggccgccuggagcauggaacccgugguccggcgccucuccacccaauuuacagcugccaaugagcuggcuuguagagggcuggaccaucucgaggaaaagaucccugcccugcaguacccuccugagaaaauugcgucugaacuuaaggauaccaucagcacacggcugcgcuccgccagaaacagcauuucugugcccaucgcuuccaccagcgacaagguucucggagccgcucuggccggcugcgagcuugcguggggaguggcccgggauacggcugaguucgccgcuaauacccgcgccgggagacuggccucuggcggcgcugaccucgcgcugggguccauugaaaaagucguggaguaucugcucccuccggauaaggaagagagcgcccccgcuccuggacaccagcaggcccaaaaaucucccaaggccaaaccuucccugcuuagccgggugggcgcucugacaaacacccucucccgcuacacaguccagaccauggccagagcgcuggaacaggggcauacgguugcuauguggauccccggaguggugccgcuuucuagccuggcccaguggggcgccuccgucgcuaugcaagccgugagccggcgcagaucugagguucgggugccuuggcuccacucccuggcugccgcgcaggaggaagaccaugaggaucagacagacaccgaaggggaggauacagaagaggaggaggaacuggaaaccgaggaaaauaaguuuagcgaggucgccgcucuccccggaccucgcggccugcuuggcgggguggcccacacccugcaaaagacacuccagacgaccaucucugcuguuacaugggcccccgcggccgugcugggaauggcuggcagaguccuucaccugacccccgccccugcugugagcuccacaaaagggcgggccaugucucucagcgacgcccugaagggagucaccgauaacgugguugacacggugguccauuaugugccgcugcccagacucucccugauggagccugaaagcgaguuccgcgacauugauaaucccccugcugaaguugagcggagagaggcggaacgccgggccucuggcgcucccuccgccgggccggagccugcccccagacuugcucagccucgccggagccugagaucugcccagucccccggagcgccucccggcccgggccucgaagacgagguggcuacacccgccgcuccccgccccggguuuccugccgucccgcgggaaaaacccaagagacgcgugagcgauuccuucuuucggccuucugugauggagcccauccugggaagaacccacuacagccaacugcggaaaaaguccuga

SEQ ID NO: 73900 - RNA, 1314 nt, Artificial Sequence
  derived and/or modified sequence opt5 from PLIN2__Homo_sapiens__NP_001113
auggccagcguggcugucgacccccagccuuccguugugaccagaguggucaaccugccgcucgugucuagcacauacgaucugauguccucugccuaucuuagcacgaaggaccaauaccccuaucugaaauccguuugcgagauggcggaaaauggcgugaagaccaucacaucugucgcuaugaccagcgcccucccuauuauccagaaacuggagccccagauugccguggcuaacacauacgccuguaaggggcuugaucggaucgaagaacgccugccuauucucaaucagcccuccacccaaaucguugcuaacgccaaaggagcggugacaggcgccaaggacgcugucaccacgaccgugacaggggccaaggauagcguggcuucuaccaucacaggagucauggacaaaaccaagggcgccguuacgggguccguggaaaagacaaagagcguggucucuggauccauuaauaccgugcugggcagcagaaugaugcagcugguuucuuccggcguggagaacgcgcucacaaaaagcgagcugcuugucgaacaguaucugccucucaccgaggaggagcuggagaaggaagccaagaaaguggagggguucgaucuuguucagaagccguccuacuaugugcggcugggaucucucagcaccaaacugcacucccgcgcuuaccaacaggcccugagcagagucaaggaagcuaaacagaagucucagcaaacaaucucccagcuccauagcacggugcaccugauugaguuugcccggaaaaaugucuacucugccaaccagaagauccaagacgcucaggauaaacuuuaucugagcuggguggaauggaaacgcuccauuggcuacgacgauaccgacgagucucauugcgcggagcacaucgaaagcagaacacucgccauugcucggaaucugacccagcagcuucaaacaaccugucauacgcugcucuccaacauccaggggguuccccagaauauccaggaucaagccaagcacaugggagugauggccggcgacauuuauagcgucuuccgcaacgcugccucuuuuaaagagguguccgacagccugcugacaucuuccaaggggcagcuccagaaaaugaaggaaagccuggaugacguuauggauuaccuugugaauaacaccccucugaauuggcucgucggacccuucuauccucagcugaccgagucccaaaacgcgcaggaccagggcgcugaaauggauaagucuagccaggagacacaaagauccgagcacaaaacccauuga

SEQ ID NO: 73901 - RNA, 1269 nt, Artificial Sequence
  derived and/or modified sequence opt5 from PLIN3__Homo_sapiens__NP_001157666
augagcgccgacggcgcugaggccgauggguccacccaggugacagucgaggaacccguucaacagccuucugugguggacagagucgcgagcaugccgcugaucuccucuacgugcgauauggugagcgcugccuacgccuccaccaaggaaucuuauccccacauuaaaacaguuugugacgcugccgagaagggagugcggacccucacagcugccgcggucagcggcgcccagccuauccuguccaaacuugaaccccagauugcuagcgccucugaguacgcucaucgcgggcuggauaagcucgaggaaaaccugccuauccuucaacagcccaccgagaaaguguccggagcccaggaaaugguuagcucugcgaaggacacaguggccacccagcuguccgaggcugucgaugccacgagaggcgcugugcaaagcgggguggacaagaccaaaucugucguuacaggaggcgugcaguccgugaugggcagccggcucgggcagaugguccuguccggaguggauaccguucugggcaagucugaggaaugggccgacaaucaccucccucugacagaugccgagcuugcucgcauugcgaccagccuggacggguucgauguggccuccguccagcaacagagacaggaacaaagcuauuuugugcggcucggaucucuguccgagcgccuuagacagcaugcuuacgaacacagccugggcaaacuccgggccacgaagcagcgcgcccaggaggcucugcugcaacucucucagguucugagccuuauggagacagugaaacagggggucgaccagaagcugguggaaggacaagagaagcuccaucagauguggcuguccuggaaccagaaacagcuucaaggcccggaaaaggagcccccuaaacccgaacaggucgagucuagagcccugaccauguuccgggacaucgcgcagcagcuccaagcuacaugcaccagccugggcuccagcauccaggggcugccuaccaaugugaaggaucagguucaacaggcccgcagacagguggaggaccuccaggccacauuuucuuccauucacagcuuccaagaucugucuuccagcauccuugcucagucccgggaacgcgucgccucugcuagagaggcccuggaccacaugguggaauauguugcgcagaacacgcccgugaccuggcucgucggaccguuugccccuggcauuacagagaaagcucccgaagagaagaaauga

SEQ ID NO: 73902 - RNA, 4074 nt, Artificial Sequence
  derived and/or modified sequence opt5 from PLIN4__Homo_sapiens__NP_001073869
augcagacccugggcagcuucuuugggucccuccccggauucucuagcgccagaaaccugguggcuaaugcccacuccucugcgcgggcucgcccugccgccgacccgacaggcgcucccgccgcugaggccgcgcaaccucaggcccaggucgcugcccaucccgaacagacggcuccuuggaccgagaaggaacuucaacccagcgagaaacagaugguuuccggggccaaggaucuggugugcucuaaaaugagcagagcgaaggacgccguguccagcggagucgcuucugugguugauguggccaaaggcgucgugcaagggggacucgacacaacccgguccgcucugacaggcaccaaggaaguugugagcucuggcgucacaggggccauggauauggccaagggagcugugcagggcgggcuugacaccuccaaagcggugcugacgggaaccaaggauacagucagcaccggccucacaggggccguuaacguggcuaaaggaaccgugcaggccggcgucgacacgacaaagaccgugcugacaggcaccaaagauaccguuacaacgggggugaugggagccgucaaucuggcuaagggcaccgugcagacagggguugagaccucuaaggccgugcucacaggaaccaaagacgcggucuccacgggccugacaggggcugugaacgucgcccgcggaagcauccagaccggcguggauaccuccaagacaguucuuaccggcacaaaagacacgguguguucuggggucaccggagccaugaauguggcuaagggcacaauucagaccgggguugauacaagcaaaaccgugcugacgggaaccaaggacacagucugcuccggcgugaccggggccaugaacguggcuaaaggcacaauccaaaccggaguugacacgagcaagacaguccucaccggcacaaaggauaccguguguucuggggugaccggagccaugaaugucgcgaaaggcacaauucagacggggguggacaccacaaagaccguucugacaggaaccaaaaacacggugugcuccggcgucacaggggccgugaaucuugcuaaggaggccauccagggcggacuggauaccaccaaaagcaugguuaugggcacaaaggacaccaugucuacagggcucacgggagcugccaacguggcgaagggcgccaugcaaaccgggcugaauacaacccagaacauugcuacaggaaccaaagauacggucuguagcggcgugaccggggccaugaaucuggcuagaggcacaauccagaccggaguugacacaaccaagaucgugcucacaggcaccaaagauacggucugcuccggggugacaggagccgccaacguggcuaagggcgcgguccaagggggacuggacaccaccaaaucuguucuuacaggcaccaaggaugccgugagcacggggcugacaggcgcugugaaugucgccaagggaaccgugcagacaggcguugacaccacaaaaaccgugcucacggggaccaaggauacagucuguuccggagugaccagcgccguuaacguggcuaaaggcgccguccaagggggacuggacacaaccaagucugugguuauuggcacgaaagacacaauguccaccggccuuacaggggcggcuaacguggccaagggagccguccagaccggcguggauaccgcuaagacagugcugacggggaccaaagacacagucaccacaggacucguuggcgccgugaauguggcgaaggggaccguccagacgggaauggauacaaccaaaaccgugcugacaggcaccaaggacacaaucuacagcggcguuacgucugcugugaacgucgccaaaggggccgugcagaccggacugaagacaacccagaauauugcuacaggcaccaaaaacacguuuggguccggaguuaccagcgccgugaaugucgcuaagggcgccgcgcagacagggguggauaccgccaagacaguccucaccggaacaaaagacacggugaccacaggccugaugggcgcuguuaacguggccaaggggaccguccagaccuccguggauacaacgaaaaccguucuuacaggaaccaaggacacagugugcucuggcgucaccggggcugccaauguggccaaaggagcuauccaaggcgggcuggauacgacaaagagcgugcucaccggaaccaaggacgcgguuuccacaggccugaccggcgccgucaaacuugcuaaggggacagugcagaccggaauggauacgacaaaaaccgugcugacaggcaccaaggacgccgucuguucuggggugacgggagccgcuaacguugccaaaggcgcggugcagaugggggucgauaccgcuaagacagugcucaccggaacaaaggacaccguuugcagcggcgugacaggcgccgccaaugucgcuaaaggggccgugcagaccggacugaagacgacacaaaacauugcgaccggcaccaaaaauacacugggguccggaguuaccggcgcugccaagguggccaaaggggcuguccagggaggccucgacacaaccaagagcgugcugacgggcacaaaggaugccgugucuaccgggcuuacaggagcugucaaccuggccaaaggcaccguucagacggggguggacaccuccaagacagugcucaccggaacaaaagauaccgucuguagcggcgugacgggggcgguuaauguggccaagggaacaguccaaaccggcguggacacagcuaaaaccguucugucuggcgccaaggaugcugugaccacaggggucacgggagccgugaacgucgccaaaggcaccgugcagacagggguugacgcuuccaaggcggugcugaugggaaccaaggauacaguguucagcggcgucaccggggccaugucuauggcuaaaggcgccguucagggaggccuugacacgacaaagaccgugcucaccgggacaaaagaugccgugagcgcuggacugaugggcuccgggaaugucgccaccggagcgacacacacgggccugagcaccuuucagaacuggcucccuucuacaccggcuaccuccuggggcgggcugacaagcucccggaccacggacaacggaggcgaacaaaccgcccuuucuccccaggaggccccuuucagcgggaucuccacacccccugaugugcugucuguuggacccgaaccggcuugggaggccgcggccaccacaaagggccucgcuaccgacguggccacauuuacccagggggcugccccuggacgcgaggauacgggccugcuggcuacaacccaugggcccgaagaggccccuagacuugcgaugcuccagaaugaacuggagggccugggagacauuuuccaccccaugaacgccgaagaacaagcucagcucgccgcuagccagcccggcccuaaaguccuguccgccgagcaggggucuuauuuugugcggcuuggagaccugggcccgagcuuccgccaaagagccuuugaacaugcugucucccaccuccagcacgggcaguuccaagcgcgggauacccuggcccagcugcaggacugcuuucgccuuaucgagaaggcucagcaagcccccgaaggacagccuagacucgaucagggcagcggcgccucugcugaggacgccgcggugcaggaggagcgggaugccgggguucugucccgcgugugcggacugcucagacaacugcauacagcuuacagcggccuugucucuucccugcaggggcuccccgccgagcugcagcagccugugggacgggcuagacacagccugugugaacuuuauggcaucguugccucugcgggguccguggaggaacuccccgccgagcgccugguccaaagccgggaaggagugcaucaggcuuggcagggccuggagcagcuccuggagggccuucaacacaauccgccucuguccuggcucguggggcccuucgcccugccugcuggaggccaguga

SEQ ID NO: 73903 - RNA, 1392 nt, Artificial Sequence
  derived and/or modified sequence opt5 from PLIN5__Homo_sapiens__NP_001013728
augagcgaggaagaggccgcucagauccccagauccucugugugggaacaagaccagcagaacgucguucagcgggugguggcccugccucucguccgcgcgaccugcacagcugugugugauguuuacagcgccgccaaggacagacacccgcugcuuggcuccgcuugccggcuggccgagaauugugugugcgggcucacgacccgcgcucuggaucaugcccaaccccuucuggaacaccuccagccucagcuggcgacaaugaacucucuggccuguagaggacucgacaaacuggaggagaaacuucccuuccugcagcaaccuagcgaaaccgucgugacauccgcuaaggauguuguggccucuagcgucaccggcgugguggaccucgcucggcgcgggagacggugguccgucgagcugaagcgcagcguuucucaugccguggaugugguccuugaaaaauccgaggagcugguggaccacuuucuccccaugacagaagaggaacuggcggcccuggcugccgaggcugaaggaccugagguuggcagcguggaggaucagagacggcagcagggguauuucguccgccucggaucucuguccgcccggauuagacaucuugccuacgaacacagcgugggcaagcugcgccaaucuaagcacagagcucaggacacccucgcgcagcugcaagagacgcuugaacugaucgaucauaugcagugcggcguuaccccgacagcccccgcuuguccugggaaagugcacgagcucuggggagaauggggccagcggcccccugaguccagacgccggagccaggccgagcuggaaacccugguccucuccagaucucugacacaagagcuucaggggaccguggaagcccuggagagcuccguccgcggacuccccgcuggcgcccaggaaaagguggcggagguucggagaagcguggacgcucugcagacggccuuugccgaugcucgcugcuuccgggacgucccggccgcugcccuugcggaggggagaggacgcguggcccaugcucacgccuguguugacgaacugcucgagcuggugguccaagcugugccucugcccuggcucgugggcccuuuugcccccauucugguugaacggcccgagccucuuccggaucuggcggaccucgucgaugaggugaucggcgggcccgacccuagaugggcccaccuggauuggcccgcucagcagcgcgccugggaagcugagcaucgggacggaucuggcaauggggauggagacagaaugggcguggccggggauauuugcgaacaggagccugaaacacccuccuguccggucaaacacacccugaugccugagcuugacuucuga

SEQ ID NO: 73904 - RNA, 1812 nt, Artificial Sequence
  derived and/or modified sequence opt5 from PLK1__Homo_sapiens__NP_005021
augagcgccgcugugaccgccggcaagcuggcgagagcucccgccgacccugggaaagccggagucccgggcguugcugcccccggggcuccugccgcggccccgccugcuaaggagauccccgaagugcucguggauccucggucccgcagacgguacguccgcggaagauuccugggcaaagggggauuugccaagugcuucgagauuucugacgcugauacaaaagaaguguuugccggcaagaucguucccaagagccuucugcucaaaccccaccagcgggagaagauguccauggaaauuucuauccaucgcagccuggcgcaccaacauguggucggcuuccacggguuuuucgaggacaacgauuuuguguucguugugcuugagcuguguagacggcgcucccuccuggaacugcauaaaagacggaaggcccucacggagccugaagcucgcuauuaccugagacagauuguccuuggaugccaguaucugcaccggaaucgcgugauccacagagaccucaaacugggcaaccuuuuucugaaugaggaucucgaggugaagaucggggacuucggacuggccaccaaggucgaauacgauggcgagcggaaaaagacacugugugggacccccaacuauauugcuccugaaguucucucuaaaaagggacauagcuuugagguggacgugugguccaucggcugcauuauguacacacugcuugucggcaaacccccguucgaaaccagcugucugaaggagacauaucucagaaucaaaaagaaugaguacucuauuccuaagcacaucaaccccguggccgccucccugauucagaaaaugcuucaaaccgauccuacggcucgccccaccaucaaugaacugcucaacgacgaguuuuucacaagcggguacauccccgcgcggcugccuauuaccugccugacaaucccgcccagauucucuauugccccuuccagccucgaucccucuaaucgcaagccucugaccguucuuaacaaaggacuggaaaauccccucccggagcggccuagagaaaaggaggagcccgugguccgcgaaacgggcgaggugguugacugucaucuguccgacaugcuucagcagcugcacagcgugaacgcuuccaaaccuucugaacgggggcucgucagacaggaggaagccgaggaucccgccugcaucccuaucuuuugggugagcaagugggucgacuauuccgauaaguacggacugggcuaucaacugugugacaauagcguggggguucucuucaacgauucuacacgccugauucuuuacaaugacggagauucccugcaguauaucgagcgggacggcaccgaaagcuaccucacagugucuagccaccccaacucccugaugaaaaagauuacccugcuuaaauauuuuagaaacuacaugucugagcaucuccugaaggcuggcgccaauaucaccccgcgcgaaggggaugagcuggcgcggcucccuuaccugagaacaugguuccggacgcgcagcgcuauuauccuucaccuguccaacggaagcguccagauuaacuuuuuccaggaccauaccaaacucauccugugcccccugauggccgccgugacauauaucgaugagaagagagacuuucggaccuacagacuuucucuccuggaagaguauggcuguugcaaggaacuggcuucccgccuccgguacgccagaacaaugguugacaaacugcuuagcucucgcuccgcuagcaauagacugaaggccuccuga

SEQ ID NO: 73905 - RNA, 2016 nt, Artificial Sequence
  derived and/or modified sequence opt5 from PLK2__Homo_sapiens__NP_001239155
auggagcugcucagaaccaucacauaccagcccgccgcuagcacgaagaugugcgaacaagcccugggcaaaggguguggagcggacuccaagaaaaagcggccuccgcagcccccugaggaaucucagcccccucagagccaagcucaggugcccccugccauuucccgcaucauugucgauccgaccacaggcaaaagauauugccgggggaagguucuuggaaagggcggguucgccaaauguuacgagaugaccgaccugacaaacaauaagguguaugcugccaaaaucauuccccacucucgcguggcuaagccucaucagagagagaaaaucgauaaggagaucgagcuccaccggauucugcaucacaagcaugucgugcaguuuuaccacuauuucgaagacaaagagaacaucuacauucuucuggaauauugcagccgcagauccauggcccacauccucaaggcgcggaaaguucugaccgagcccgaggugcgcuacuaccugagacaaauugucucuggacucaaguaucugcaugaacaggagauccuucaccgggaucugaaacucggcaacuuuuucauuaaugaagccauggagcugaaggugggcgacuuugggcuugcugcccgccuggaaccucucgagcauagacggcgcacaaucuguggaacccccaauuaccugagcccggagguucugaacaaacagggccacgggugcgaauccgauaucugggcucucggaugugugauguauacgaugcugcuuggcagaccucccuucgagaccacaaaucugaaggaaaccuaccggugcauuagagaggcccgcuauacaaugccuagcucucuccuggcgcccgccaagcaccuuaucgcuuccaugcugagcaaaaaccccgaagaccggccuucucucgaugacauuaucagacaugacuuuuuccugcagggguuuaccccggaucgccuguccagcucuuguugccacacgguccccgauuuccaucucuccagcccugccaagaacuuuuucaaaaaggcugccgccgcucuguuuggaggcaaaaaggacaaggcgcgguacauugacacacacaauagaguguccaaagaggaugaggacaucuauaagcugcgccaugaucugaaaaagaccucuaucacacaacagcccagcaaacaccggaccgacgaagaacuccagccucccaccacaacgguggccagauccggcaccccggcugucgaaaauaagcaacagauuggggaugccauccgcaugauuguucggggaacacugggcagcuguucuuccagcucugagugccuugaagacagcaccaugggguccguggccgauacaguggcuagaguccugcgcggaugccucgagaacaugccugaggccgacuguauccccaaggaacagcugucuaccagcuuccagugggugacgaaauggguugauuacuccaauaaguacggcuucggguaucaacugagcgaccacacagugggaguccucuuuaacaauggcgcgcauaugucucugcuuccugauaaaaagaccgugcacuacuaugcugagcugggccagugcuccguuuuccccgccaccgacgccccugaacaguuuauuagccaggugacaguccucaaauacuucucucauuauauggaggagaaccugauggacgggggagaucugcccuccgugaccgacauccggagaccgcggcuuuaccuccugcaauggcuuaagagcgauaaggcucucaugaugcuguuuaacgacggcacauuccaggucaauuuuuaucacgaucacacgaaaaucauuaucuguucccagaacgaagaguaccuucugaccuacauuaaugaagaccgcaucucuacaaccuucagacucacaacccugcugaugagcgggugcuccucugagcuuaagaaccggauggaauaugcccucaauaugcugcugcagagauguaacuga

SEQ ID NO: 73906 - RNA, 2817 nt, Artificial Sequence
  derived and/or modified sequence opt5 from PLK4__Homo_sapiens__NP_001177728
auggcuaccugcaucggcgagaagauugaagacuucaaaguggggaaccugcucggaaagggcagcuuugccggggucuacagagccgaguccauccacacaggacuggaaguugcgauuaaaaugcuuuauaauuacuucgaggauucuaacuauguguaccuggugcucgaaaugugucauaauggcgagaugaaccgguaucugaagaaucgcgucaaacccuuuagcgagaacgaagcuagacacuucaugcaucagaucauuacggggaugcuuuaccugcacucccauggaauccuccaccgggaccugacccugucuaaucuccugcuuacacgcaacaugaauaucaagauugccgauuuuggccuggccacccaacucaagaugccucacgagaaacauuauacacugugcggcaccccgaacuacaucagccccgaaauugcuacaagauccgcccacgggcuugagucugacguguggagccugggauguauguucuacacccuccugaucggccggccucccuuugauacggacaccguuaagaauacacugaacaaagugguccucgcugauuaugagaugccuuccuuccugagcauugaagccaaggaccuuauccaucagcugcuccgcagaaaucccgcggaucggcugucucuuuccagcgugcuggaccacccuuuuaugucucgcaacuccagcaccaaaucuaaggaucucgggacaguugaggacuccauugauagcggacacgccaccaucuccacggcuaucacagccucuagcuccaccagcauuucuggcucccuguucgacaagagacggcugcucaucgggcagccgcugcccaauaaaaugacaguguuuccuaagaacaaaagcucuaccgacuucagcuccucuggagauggcaacagcuuuuacacccaguggggcaaucaagaaacauccaacagcgggcgcggaagagucauucaggacgcugaggaacggccccauucucgcuaucuuagacgggccuacuccagcgauagaucuggcacguccaauagccagucccaggcgaagaccuauacaauggagcgcugccacucugccgagaugcugagcguguccaaacggucugggggaggcgaaaacgaggaaagauacagcccuaccgacaauaacgcuaauaucuucaacuucuuuaaggagaaaacauccucuucuuccgggagcuucgaacgccccgauaauaaccaagcccucucuaaucaucuguguccgggaaagaccccuuuucccuucgcugacccuacgccccagacagagaccgugcagcagugguuuggcaaccuucaaauuaaugcccaucugcggaagaccacagaguaugauuccaucagccccaacagagacuuccagggccacccugaucuccagaaagacaccucuaagaaugccuggacagauacgaaagucaagaaaaacagcgacgcuuccgacaacgcgcacagcguuaagcaacagaauaccaugaaguacaugacagcccugcacucuaaaccggaaaucauucagcaggagugcguguuuggguccgauccccugagcgaacaauccaagacccgcggaauggagccucccuggggcuaccagaaccggacacucagaucuaucaccagcccucugguggcucaucgccuuaaacccauucggcagaagacgaaaaaggccgucguguccauccuggacucugaagagguuuguguggagcucgucaaggaauaugccagccaggaguacgugaaagaaguucugcaaauuuccucugaugggaauaccaucacaaucuauuacccgaacggaggcagaggguucccucuggcugaccggcccccuagccccaccgauaauauuucccgcuauagcuuugacaaccuuccugagaaguacuggagaaaauaucaguacgccucucgguucgugcagcucguccgcuccaagagccccaaaaucacauacuuuaccagauaugcgaagugcauucugauggagaauagcccgggcgcugauuucgaagugugguuuuacgacggagucaagauccacaaaacggaggauuucauucaggugaucgaaaagacaggcaaauccuauacccucaagagcgagucugaaguuaacucccugaaagaggagauuaagauguacauggaccaugccaaugaagggcaccggaucugucuggcccuugagagcaucauuuccgaagaggaaagaaaaacacgcagcgcuccuuucuuucccaucauuaucggacggaagcccggcucuaccagcuccccuaaggcccugucuccgcccccuagcguggauuccaacuaucccaccagagagcgcgcuucuuucaauagaauggucaugcacagcgccgcguccccuacacaagcccccauucucaacccuucuauggugacgaaugaggggcugggacugaccacaaccgcuagcggcacagacaucuccagcaacucucuuaaagauugccuccccaaguccgcccagcugcugaaaagcguuuuugugaagaaugucgggugggcuacccagcucacgucuggcgccgugugggugcaguucaacgacggaucccaacugguuguccaggcgggcgugagcuccaucucuuacacaagcccgaacgggcagaccacccgguauggagaaaaugagaaacuuccugacuacauuaagcaaaagcugcagugucucuccagcauccugcugauguuuucuaaccccacaccuaauuuccauuga

SEQ ID NO: 73907 - RNA, 1011 nt, Artificial Sequence
  derived and/or modified sequence opt5 from PLK5__Homo_sapiens__NP_001230008
auguacaccgugcugacaggcacgcccccuuucauggccagcccgcucuccgagauguaucagaacaucagagaagggcacuaccccgagccugcucaucugucugccaaugcgcggcgccuuauuguccaccuucucgcucccaacccugccgaaagacccagccuggaccaucuucugcaagaugacuuuuucacccagggauuuacaccugaucggcucccggcccacuccugccauucucccccuaucuucgcuauucccccuccccugggccgcaucuuuagaaagguugggcagcggcugcucacccagugucgcccgccuugccccuucacaccuaaagaggccagcggacccggcgaagggggacccgacccugauuccauggagugggacggcgagucuagccuguccgcuaaggaagugccgugucuugagggccccauucaccugguggcccaagggacccuccagagcgaucuggcgggaccugaaggcucuagacggcccgaggucgaggccgcucugcgccaucugcagcucugccuggacguggggccucccgccacacaggauccgcugggagaacaacagccuauccucugggcucccaaauggguugacuauuccagcaaguacggcuuuggguaucagcugcuugauggaggcagaaccggccggcacccucacgggcccgccacgccucgcagagagggaacccugcccacaccggugccucccgcgggccccgggcucugucugcuucgguuccuggccucugaacaugcucuccugcugcucuuuuccaauggaaugguccaggugagcuucucuggcguuccugcccaacuggugcuuuccggggagggagaaggccugcagcucacccugugggagcagggcagcccggggacauccuacucucuugacgucccccgcagccacggaugcgcuccuaccacgggccaacaucugcaccacgcccucagaaugcugcaguccaucuga

SEQ ID NO: 73908 - RNA, 549 nt, Artificial Sequence
  derived and/or modified sequence opt5 from PLLP__Homo_sapiens__NP_057077
auggccgaguuccccagcaagguguccacccggacaucuagcccugcucagggcgccgaagcguccgucucugcucugcggccggaccucggguuuguucgcagcagacugggagcccuuaugcugcuccaacuggugcuuggccugcucgugugggcccugaucgcugauacgcccuaccaccuguauccugccuacgggugggucauguucguggcuguuuuucucuggcuggugaccauuguccuuuucaaccuguaucucuuucagcugcauaugaaacuuuacauggugcccuggccucugguucucaugaucuucaauauuuccgccacagugcuguauaucaccgcguuuauugccugcucugcugccgucgaccugacaagccuccggggaacccgccccuacaaccagagagcugccgcguccuucuuugccugucuggugaugaucgcuuauggcgugagcgccuucuuuucuuaccaggcuuggagaggggucggauccaaugccgccacaagccaaauggcuggcggcuacgcguga

SEQ ID NO: 73909 - RNA, 159 nt, Artificial Sequence
  derived and/or modified sequence opt5 from PLN__Homo_sapiens__NP_002658
auggagaaggugcaguaccugaccagaagcgccauccggcgcgcuuccacaauugaaaugccccaacaggccagacagaaacuccagaaccuguucaucaauuuuugccuuauucugaucugucuccugcuuauuugcaucaucgucaugcugcucuga

SEQ ID NO: 73910 - RNA, 2214 nt, Artificial Sequence
  derived and/or modified sequence opt5 from PLOD2__Homo_sapiens__NP_000926
augggcgggugcaccgugaagccccagcugcuccugcuugcccugguccuccacccuuggaacccgugucugggagcugacagcgagaaacccuccucuaucccuacagauaaacuucugguuauuacgguggccaccaaggaaagcgacggcuuccauagauuuaugcaguccgcgaaguacuucaauuauacagugaaaguccucgggcagggagaggaauggcggggcggggauggaaucaacucuauuggcggcgggcagaaggugcgccugaugaaggagguuauggaacacuacgcugaccaggaugaccugguggucauguuuaccgagugcuucgaugugaucuuugccggaggccccgaggaaguucucaaaaaguuccaaaaagccaaucauaagguggucuuugcugccgacgggauucuguggccugauaaaagacuugcugacaaguaucccguggugcacaucggaaagcgguaccugaacagcggcggguucaucggauaugccccuuacgucaaucgcauuguucagcaguggaaccuccaggauaaugacgaugaccaacuguuuuauacaaaaguguacaucgacccgcuuaagagagaggcgauuaacaucacccuggaucauaaauguaagauuuuccagacacucaauggcgccguggacgaagucgugcugaaauuugagaacggcaaggcucgggccaaaaauaccuucuacgagacgcugcccguugcuaucaacgggaauggaccuaccaagauucuccugaacuauuuuggcaauuacgugcccaacuccuggacacaggauaacgggugcacccuuugugaguucgacacagucgaucugucugccguggacguucacccuaaugugagcaucggagucuucaucgaacagcccaccccguuucucccucgcuuccuggauauucuucugacgcucgacuaucccaaggaagcgcugaaacuguuuauccacaacaaggagguguaccaugaaaaagauauuaaggucuucuuugacaaagccaagcacgagaucaagacaauuaaaaucgugggcccugaggaaaaucucucccaagcugaggccagaaacauggggauggauuucugccggcaggacgaaaagugugacuauuacuuuagcguugaugcugacgugguccugaccaauccccgcacacuuaaaauccugauugagcagaacagaaagaucauugcuccccucgugacccggcauggaaaacuguggucuaauuucuggggcgcccuuuccccugauggcuauuacgcccgcagcgaagacuacguugauaucgugcaagggaacagagucggaguguggaaugugccguauauggcgaacguuuaccugauuaagggcaagacccuccggucugagaugaaugagcgcaacuauuuugucagagacaaacuggaucccgacauggcccugugccggaaugcuagagaaauggggguguucauguacaucuccaaccgccacgaguuuggacggcuccugagcacagccaauuauaacacgucucacuacaacaaugaucuuuggcagaucuucgaaaacccuguggacuggaaggagaaauauauuaauagagauuacuccaagaucuuuaccgaaaacauugucgagcagcccuguccugacguguucugguuccccaucuuuagcgagaaagccugcgaugaacugguugaggaaauggagcauuacggcaagugguccgggggcaagcaccaugacucucgcauuagcggaggcuaugagaaugugccgacagacgauauccacaugaaacaggucgaccucgaaaacguguggcugcauuucauucgggaguuuaucgcuccuguuacccugaagguguucgccggguacuauacaaaaggauuugcgcuucucaauuucgucgugaaguacucccccgaaagacaacgcagccugcggccucaccacgaugcuucuaccuuuacgaucaacauugcccugaauaacguuggcgaggacuuccaagggggaggcuguaaauuucucagauauaauugcuccaucgaaagcccccgcaagggguggucuuucaugcauccuggccggcugacacaccuucaugagggacugcccgugaaaaacggcaccagauacauugccgucagcuuuaucgauccguga

SEQ ID NO: 73911 - RNA, 834 nt, Artificial Sequence
  derived and/or modified sequence opt5 from PLP1__Homo_sapiens__NP_000524
augggccugcucgagugcugugccagaugccuggugggggcucccuucgccagccuugucgcgaccggacugugcuuuuucggcguugcucucuuuuguggguguggacacgaagcccugacaggcacggagaaacuuaucgaaaccuacuucuccaagaacuaucaggacuacgaguaucugauuaaugugauccaugccuuucaauacgugauuuaugggacagcuucuuucuuuuuccucuacggagcccugcugcucgcugaaggcuuuuauaccacaggcgccguccggcagaucuucggggauuacaagaccacaauuugcggaaaaggccugagcgcgaccgugaccgggggacagaagggccgcggguccagaggacagcaccaagcccauucucuugagcggguuugucacugccugggcaaauggcucggccauccugacaaguuuguggggaucacguacgcucugacagucguguggcuucugguuuucgccuguagcgcugugccggucuauaucuacuuuaacaccuggacaaccugccaguccauugccuuccccucuaagacgagcgcguccaucggaagccucugugccgaugcucgcauguauggcgugcugccuuggaaugccuuccccgggaaagugugcggaucuaaccugcucuccauuugcaagacagcugaguuucagaugaccuuccaccuguuuaucgccgccuucgucggcgcugcggccacacuuguuagccugcucaccuuuaugauugcugccaccuacaauuucgccgugcugaaacuuauggggagaggaacaaaguuuuga

SEQ ID NO: 73912 - RNA, 459 nt, Artificial Sequence
  derived and/or modified sequence opt5 from PLP2__Homo_sapiens__NP_002659
auggccgacagcgagagacuguccgcucccggcugcugggccgcguguaccaacuucucucggacacgcaaggggauccuccuguuugcugaaauuauccuuugccuggugauucucaucuguuucagcgccuccacgccuggauacucuagccuguccgucauugagaugauccuugccgcuaucuuuuucguuguguauaugugcgaucugcacaccaaaauuccguuuaucaauuggcccuggucugacuucuuuagaacacucauugccgcuauccuguaccugauuaccagcaucgugguccucguggaacggggcaaccauuccaagauuguugccggggugcugggacuuaucgcgacaugucuguucggcuaugaugccuacgucaccuuuccugugcgccagcccagacacacagcugccccuaccgaccccgcugaugggccuguuuga

SEQ ID NO: 73913 - RNA, 1518 nt, Artificial Sequence
  derived and/or modified sequence opt5 from PLRG1__Homo_sapiens__NP_001188493
augguggaggaaguccagaagcacagcguucauacccugguguucagaucccucaaacggacacacgacauguuuguggccgauaacggcaagcccgucccucuggacgaggaaucucauaaacgcaagauggcuaucaaacuuagaaaugaguacgggccggugcugcacaugcccacgagcaaggaaaaccucaaggagaaaggaccucaaaaugccaccgauuccuauguucauaagcaguaccccgcgaaccagggccaggagguggaauauuucgucgcugggguggcccugacagccgacaccaaaauucaacggaugccuucugagagcgcugcccagucccuugcuguugcccugccccuccagacaaaggcggaugccaaucgcaccgcuccuucuggaagcgaauacagacacccgggcgccuccgaccggccccagccuacagcuaugaacagcaucgugauggagaccgggaauacgaaaaacucugcccugauggcgaagaaggcccccaccaugccuaaaccccaauggcacccgccuuggaagcuguaucgcgucauuuccggacaucucggcugggugagaugcaucgcuguggagcccggcaaucagugguuugucacagggagcgccgaucggaccauuaaaaucugggaccuggcuucuggaaaacuuaagcugucccucacaggccacaucagcaccguucgcggggugauugugucuacgagauccccuuaccuguucagcuguggagaagauaagcaggucaaaugcugggaccuugaguauaacaaggugauccggcauuaccacggccaccuguccgccguuuacgggcucgaucugcaucccacaauugacgugcuggucaccuguucucgcgauagcacagccagaaucugggacgugcggaccaaggcuuccguucacacccucagcggacauacaaaugcgguggccacgguccgcugccaggcugccgaaccccaaauuaucaccggcucucacgacacaaccauuagacugugggaucuuguggccggcaaaacacgggucacccugacgaaccauaagaaauccgugagagcuguugugcuccacccucgccacuauacauuugccagcgggucuccggacaauaucaagcaguggaaauuccccgauggcagcuuuauccagaaccuguccggacauaaugcgauuaucaacacccuuaccgucaacucugacggggugcugguuagcggagcugauaauggcacaaugcaccucugggacuggcggaccggguacaacuuccaaagagugcaugccgccguccagccuggaucccuggauagcgagucuggcauuuuugcuugugccuucgaccaguccgaaagccgccugcucacagcugaggccgauaagacgaucaagguguaucgggaggacgauaccgcgacagaagagacccaccccgugucuuggaaaccugaaauuaucaagagaaaacgcuuuuga

SEQ ID NO: 73914 - RNA, 1890 nt, Artificial Sequence
  derived and/or modified sequence opt5 from PLS1__Homo_sapiens__NP_001138791
auggagaacagcaccacaacgaucuccagagaagaacuggaggagcuccaggaagccuucaauaagauugacaucgauaacucuggcuacgugagcgacuaugagcugcaagaucuuuuuaaagaggcuucccugccccucccuggguacaagguccgggaaauuguugagaaaauccugucuguggccgacagcaauaaggauggaaaaauuuccuucgaagaguuugugucucuuaugcaggagcucaagagcaaggacaucuccaaaaccuuccgcaagaucauuaacaaaagagaaggcaucacagcgauugggggaaccagcacaaucucuuccgagggcacccagcacagcuauucugaagaggaaaaggucgcuuuugugaauuggauuaacaaagcccuggagaaugauccggacugcaagcaucugauccccaugaacccuaaugaugacucccuguucaagagccucgccgaugggauucugcuuuguaaaaugaucaaccugucugagcccgacacaaucgaugaacgggcuauuaauaagaaaaagcucaccccuuuuacgaucuccgagaaccugaaucuugcccugaacagcgcuuccgccauuggaugcaccguugugaauaucggcgcgucugaccucaaagaaggcaagccccaccugguccuggggcuccuguggcagauuaucaaagugggacuuuucgccgacaucgagauuagccgcaacgaagcucugaucgcccuccugaacgagggcgaggaacuugaggaacugaugaagcucuccccugaggaacugcugcucagauggguuaauuaccaucugacaaacgcuggguggcacaccauuagcaauuuuucucaagauaucaaggacucccgggccuauuuccaucuucugaaccagauugcgccgaaaggaggcgaggaugggcccgccaucgcuaucgaccucagcggaauuaaugagacaaacgaucugaagcgcgccggccuuaugcugcaggaagcugacaaacucggcuguaagcaguuugugaccccugccgaugucgugucugggaaucccaaacugaaccuggccuucguggcuaaucucuuuaacacguacccuugccugcacaagcccaauaacaaugacaucgauaugaaccuucuggagggagaaagcaaggaggagagaacauuccggaauuggaugaacucccucggcgucaacccguauauuaaucaccuguacucugaccuggcggaugcccuuguuaucuuccaacucuacgaaaugauucgcgugccugugaacuggagccaugucaauaaacccccuuaucccgcucucgggggaaacaugaagaaaaucgagaauuguaacuacgccguggaacugggcaagaauaaagccaaguuuucccugguugggauugcuggacaggaccugaacgagggcaauagcacccuuacacuggcccucguguggcagcugaugagacgguauacccugaacguccuuucugaccucggcgaaggggagaaggugaaugaugagaucaucauuaaauggguuaaccagacccugaaguccgcgaauaaaaagacaagcaucucuuccuucaaagacaagagcauuuccacgucucugcccgugcucgaucugaucgacgcuauugccccuaacgccguccgccaagaaaugaucagacgggagaaucuuagcgaugaagacaagcugaacaacgcuaaauacgccaucuccguggcucgcaagauuggagccagaaucuaugcgcucccggaugaccuggucgaggugaaacccaagaugguuaugaccguguuugccugccugaugggcaaagggcuuaaucggauuaaguga

SEQ ID NO: 73915 - RNA, 1854 nt, Artificial Sequence
  derived and/or modified sequence opt5 from PLS3__Homo_sapiens__NP_001269266
auggaggaccugaacagcaauggcuucaucugcgauuacgaacuccacgagcuguuuaaggaagccaacaugccccuuccuggguauaaagugagagagauuauccagaagcugaugcucgacggagaucggaauaaagacggcaagauuuccuucgaugaauuugucuacaucuuccaagagguuaaaucuagcgacauugcuaagaccuuucgcaaggccaucaacagaaaagaggggaucugugcgcugggaggcacauccgaacuuucuagcgaggggacgcagcauuccuauucugaagaggagaaguacgcuuucgugaauuggauuaacaaagcccuggaaaaugauccggacugccggcacgugauccccaugaacccuaauaccgaugaccucuuuaaggccgucggagauggcauugugcuguguaaaaugaucaaccugagcguucccgacacaauugaugagcgcgcuaucaauaagaagaaacucaccccuuucauuauccaggaaaaccugaaucuugcccugaacuccgcuagcgccaucggcugccauguggucaauauuggggcggaggaccucagagccggaaagccccaccuggugcuuggccugcucuggcagaucauuaaaaucgggcuguuugcugacauugaacugucucggaacgaggcccucgcugcccugcuucgcgauggagagacacuggaagaacucaugaagcuguccccugaggagcuucugcucagaugggcgaacuuccaucuggaaaauagcggcuggcagaaaaucaacaauuuuucugccgacaucaagcugauugauuucuccaacagcguuaaagacucuaaggcuuauuuucaccuccugaaucaaaucgccccgaaggggcagaaagagggagagccccggauugauaucaacauguccggcuucaaugaaaccgacgaucuuaagcgcgcugagagcaugcugcagcaagccgacaaacucggcuguagacaguucgugaccccugccgaugucguguccgggaaccccaagcugaaucuugcuuuuguggcgaaccuguucaauaaauacccugcccucacaaagcccgaaaaccaggacauugauuggacgcugcuggagggagaaacccgggaggagcgcacauuuagaaauuggaugaacucucucggcgucaauccgcacguuaaccaucuguaugcugaccuucaggacgcccuggugauccuccaacuguacgaacggaucaaggugccugucgauuggagcaaagugaacaagcccccuuaccccaaacugggggccaauaugaagaaacuugagaacugcaauuaugcuguugaacucggaaagcaccccgccaaguucucccuggugggcauugggggacaggaccugaacgauggcaaucagacccucacacuggcgcuugucuggcaacugaugcgcagauacacccucaacgugcuggaggaccugggcgaugggcagaaagcuaaugacgauaucauuguuaacugggugaaucggacgcuuagcgaggccggaaagucuacauccauccagagcuuuaaagacaagaccauuucuagcucccucgccgucguggaucugaucgacgcuauucagccuggcuguaucaacuaugaucuggucaaaucugggaaucucacagaagacgauaagcauaacaaugccaaguacgcugugagcauggccagacgcaucggagcgcggguuuaugcccugccggaggaccuuguggaagucaaacccaagauggugaugaccguuuucgcuugccugaugggcagagggaugaaacgcguguga

SEQ ID NO: 73916 - RNA, 957 nt, Artificial Sequence
  derived and/or modified sequence opt5 from PLSCR1__Homo_sapiens__NP_066928
auggacaagcagaacagccaaaugaaugccucccaccccgagaccaaccugccugugggcuacccgccccaguauccucccacagcuuuccaggggccucccggauacucuggcuauccugggccgcaggucagcuaucccccucccccugccggacauuccggccccgggccggcgggauuuccuguucccaaucaaccuguguacaaccagcccguguacaaucagcccgucggcgcugccggcgugccuuggaugccggcuccccagccuccccucaacugcccucccgggcuggaauaucuuucucaaaucgaucagauucugauccaccagcagauugagcuccuggaaguucuuacgggauucgagaccaauaacaaauacgaaaucaagaauagcuuuggccaaagaguguacuucgccgccgaggacacagauuguugcacccggaacuguugcgggccgucccgcccuuuuacacugagaauuaucgacaauaugggacaggaggucaucacccucgaacggccccugcgcuguucuagcugcuguugcccuuguugccugcaggagauugaaauccaagcucccccuggcgugcccauuggguauguuauccagacauggcauccgugucucccuaaauucaccauucagaacgagaagagagaggaugugcugaaaaucuccggacccugcgucgugugcagcuguugcggcgacguggauuuugaaauuaagucucuugacgagcagugugucguuggcaagaucuccaaacacuggacggggauccugcgggaagccuucaccgaugcggacaauuuuggcauucaauucccccucgaucuggacgugaagaugaaagccgugaugaucggagcuugcuuucuuauugauuucauguuuuucgagagcacagggucucaggaacagaaguccggagucugguga

SEQ ID NO: 73917 - RNA, 888 nt, Artificial Sequence
  derived and/or modified sequence opt5 from PLSCR3__Homo_sapiens__NP_065093
auggccggcuaccugcccccuaagggguaugcuccgagcccuccucccccuuaccccgugaccccuggauauccggagcccgcccuccacccuggccccgggcaggcgccuguccccgcucaaguuccggccccugcccccggauucgcucuguuuccuucccccggccccguggcccuugggucugcugccccuuuccugccgcuccccggagugccuagcggccuggaauuucuuguccagaucgaccagauucugauccaucagaaagcggagagaguggaaacauuccucggcugggagacgugcaaccgguacgaacugcgcuccggggccggacaaccccugggccaggcugccgaggagucuaauuguugcgcuagacucuguugcggggcccggcgcccucugagaguucggcuugcggaucccggagaccgcgaagugcugagacuccugcggccgcuucacuguggcugcagcuguugcccuugugggcugcaggagauggaaguccaggccccucccggaaccacaauuggccaugugcuccaaaccuggcaccccuuucugcccaaguucuccauccaggaugcugaccgccagacaguucugagaguggucggccccugcuggaccugugggugcggaacagauaccaacuuugaggugaaaacgcgggacgagucucgcagcgugggcagaauuuccaagcaguggggagggcucguccgggaagcccugaccgaugcugacgauuucggccuucaauuuccgcuggaccucgauguucgcgugaaagccgugcugcuuggggccacauuccugaucgacuauauguuuuucgagaagagaggaggcgcuggcccuagcgcggucaccucuuga

SEQ ID NO: 73918 - RNA, 720 nt, Artificial Sequence
  derived and/or modified sequence opt5 from PLSCR4__Homo_sapiens__NP_001121778
augagcggcguggugcccaccgccccugagcagccggcuggggaaauggagaaccaaacaaagcccccugaccccagaccugaugcgcccccugaauacaauucccacuuccugccgggacccccuggcacggccguucccccucccaccggguauccgggaggccucccuaugggguacuauucuccccagcagccuagcacauuuccccuguaccagcccgugggaggcauccauccugugcgguaucaaccgggcaaauaccccaugccuaaccaguccguccccauuaccuggaugccugggcccacaccgauggcuaauugcccucccggacuugaguaucuggugcagcucgaaguucaguguccucccggcgugaccaucggguucgucgccgagcacuggaaccugugccgcgccguguacucuauucaaaaugagaagaaagaaaacguuaugagagugcggggaccuuguagcacauacggcugcggguccgacucugucuuugaggucaagagccuugauggaaucuccaauauuggcagcaucauccgcaaauggaacggccugcucucugcuauggccgacgcugaucauuucgacauucacuuuccccuggaucuggacgugaagaugaaggccaugaucuucggggcguguuuucucauugauuucauguauuuugaaagauccccgccucagcggagccgcuga

SEQ ID NO: 73919 - RNA, 816 nt, Artificial Sequence
  derived and/or modified sequence opt5 from PLSCR5__Homo_sapiens__NP_001078889
auggccagcaaggacgcucagaaccaaagacggggccugcccggguuccucccuggagccccggaucccgaccagucccugccugcgucuagcaaucccggcaaccaggcuuggcagcuuucccugccucuccccucuagcuuucugccuaccgugucccuuccgcccgggcuggaguaccucucucaacuggaucugaucauuauccaccagcaggucgaacuccugggaaugauucuuggcacagagacgagcaauaaauaugaaaucaagaacucccuggggcagcgcauuuacuucgccguugaggaaagcaucugcuuuaauagaaccuucuguucuacacuccgguccugcacccugcgcaucacagacaacagcggaagagaggugauuaccgugaaucggccucuucgcuguaacucuugcuggugucccugcuaucugcaagagcucgaaauccaggccccucccggcacaauugucggcuacgugacccagaaaugggauccguuucugccuaaguucacgauccagaaugcuaacaaagaggacauucugaagaucguugggcccugugugaccugcggauguuuuggcgaugucgacuucgaagugaagacaauuaaugagaaacucaccaucgggaagaucuccaaauauuggagcggauuuguuaacgauguguucacaaaugccgacaacuuuggcauucaugucccugcugaucuggacgugaccgugaaggccgcgaugaucggggccugcuuccuuuuugauuucauguucuuugagcacucucuggcuggacucuga

SEQ ID NO: 73920 - RNA, 1197 nt, Artificial Sequence
  derived and/or modified sequence opt5 from PLTP__Homo_sapiens__NP_001229849
auggcccuguucggcgcucucuuucuggcccuucuggcgggggcucacgccgaguuccccggaugcaagaucagagugaccagcaaagcccucgaacuggucaagcaggagggccuucgguuucuggaacaagagcucgaaacaauuacgaucccugaccugcgcgggaaagagggacauuucuacuauaacauuuccgagaagguuuacgauuuucugucuaccuucaucacaagcggcaugagauuucuccugaaucagcagauuuguccggugcuuuaucacgcugggaccgugcugcucaacucccugcuugacacaguccccgugcggucuagcguugaugaacuggugggaaucgacuacucccucaugaaagauccugucgccucuaccagcaaucuggacauggauuuccgcggcgccuuuuucccccugacagagagaaacuggucccucccuaaucgggcuguggaaccccagcugcaagaggaggaacgcaugguuuauguggcguuuagcgaguucuuuuucgacucugccauggaauccuacuucagagcuggcgcccuucagcugcuccuggucggggauaaggugccucaugaccuugauaugcugcuccgggcuaccuauuuuggaagcaucgugcugcugucuccggccgucauugacagcccccucaagcuggagcuucgcguucuggcgccucccagaugcacgaucaaaccuuccggcaccacaauuucugugaccgccuccgugacaaucgcucucgugcccccggaucagccugaaguccagcugagcuccaugaccauggacgcccggcuuucugcuaagauggcccugcgcgggaaagcccucagaacgcaacuggaccugcggcgcuucagaauuuacagcaaccacuccgcucucgagagccuggcgcuuaucccccugcaggccccucucaagacaaugcugcagauuggaguuaugcccaugcugaaugagcggaccuggagaggcgugcagaucccccuuccugaagggaucaacuuuguccaugaggugguuacaaaucacgcuggauuccucaccauuggcgccgaucugcacuuugccaaaggccugcgcgaagugaucgagaagaaccggccggcugacgucagagccucuaccgcgcccacaccuuccacggcugccguguga

SEQ ID NO: 73921 - RNA, 1329 nt, Artificial Sequence
  derived and/or modified sequence opt5 from PLVAP__Homo_sapiens__NP_112600
augggccuggccauggagcacgggggaagcuacgcuagagccggcggguccucucggggaugcugguauuaccuccgcuauuucuuucuguucgugagccuuauccaguuucugauuauccucggccugguccuuuucaugguuuacgggaacgugcauguguccaccgaaucuaaucugcaagcgacagagagacgggcugaaggacucuauagccagcugcugggccucacggccucccagucuaaccugaccaaggagcuuaauuuuacaacccgcgccaaagacgcuauuaugcagauguggcugaacgccagacgggaucucgaccgcaucaaugcuagcuucagacaaugucagggcgaucgggucauuuacacaaacaaucagcgcuauauggccgcgaucauccuguccgaaaagcagugcagagaccaauuuaaagauaugaacaagagcugugacgcccuucuguucaugcucaaucagaaagugaagacccuggagguugagauugcuaaggagaaaacaaucugcaccaaggauaaagagucugugcugcucaacaagcgggucgccgaagaacagcugguggaguguguuaaaacgcgcgaacuucagcaccaagagagacagcuggcuaaggaacagcuccaaaaggugcaggcccugugccuuccccuggacaaagauaaguuugagauggaccuccggaaucuguggcgcgauuccauuaucccuagaagccuggacaaccucggguacaaucuguaccauccgcuuggaucugaacuggcguccauucggagagccugugaucacaugcccagccucaugucuuccaaagucgaggagcuggcucgcagccuucgggccgacaucgaaagaguggcucgcgagaacuccgaccugcagcggcagaagcucgaagcccaacagggccugagagccucucaggaggcuaaacagaagguggaaaaagaggcgcaagcccgcgaggcuaagcugcaggccgaaugcagccggcagacccagcucgcccuggaggaaaaggcuguccuuagaaaagagcgcgauaaucuggccaaggaacucgaggagaaaaagcgggaagcggagcaacugagaauggaacuggcuauucgcaacuccgcccuugacacauguaucaaaaccaagagccagccuaugaugcccguuucucggccuauggggcccgugccuaacccgcagcccaucgauccugccucccucgaggaguucaagagaaaaauucuggaaagccagcggcccccugcuggaauccccguggccccgucuagcggcuga

SEQ ID NO: 73922 - RNA, 1503 nt, Artificial Sequence
  derived and/or modified sequence opt5 from PLXDC1__Homo_sapiens__NP_065138
augagaggcgagcuguggcuccuggugcuuguccugcgggaagccgcucgcgcccucagcccccagccuggggcgggacacgacgagggcccgggguccggaugggcugccaagggcaccguuagaggguggaaccggcgcgccagagaaucucccggacaugugagcgagccugaucggacacaacugucccaggaccuuggcggcgggacgcuggcuauggauacccuccccgacaaucgcacaagaguggucgaagauaaccacucuuacuaugugagccggcuguacggaccuuccgagccccauucucgcgagcuguggguugacguggccgaagcuaauagaagccaggucaaaauccacaccauucucuccaacacacaucggcaggccagccgcgugguucugucuuucgauuuuccuuucuauggccacccgcuuagacaaaucaccauugcgacagggggauuuaucuucaugggcgacgugauucaccggaugcugaccgccacgcaguacgucgcuccccucauggccaauuuuaacccuggguauuccgauaauagcaccgugguguacuucgacaacggaacagucuuuguugugcagugggaucauguguaucugcagggcugggaggacaagggcucuuucaccuuucaagcugcccuucaccaugaugggcgcaucgucuucgcguacaaagaaauccccauguccgugccugagauuagcagcucccagcaccccguuaagacaggacugagcgacgccuuuaugauccucaauccguccccugacgugcccgagucuagacggagaagcauuuucgaauaccaccgcaucgagcuggauccuuccaaagucaccagcaugucugcuguggaauuuacgccccugcccacaugccuccagcaucgguccugugacgccugcaugagcucugaucugaccuucaacuguagcuggugccacguucuucagagauguuccucuggcuucgaccgcuaucggcaagaguggauggauuacgggugcgcucaggaagccgagggaagaaugugugaggacuuucaggaugaagaccaugauagcgccuccccugacacaucuuucucuccguaugauggcgaccugaccaccacauccagcucucucuuuauugacucccugacgaccgaggaugacacaaaacuuaaucccuacgcugggggagauggccugcaaaacaaucucagcccuaagaccaagggcacacccgugcaccuggggaccaucgucggaauugugcuggcgguccuccugguggccgcuaucauccuugccggcauuuauaucaacgggcauccuacguccaaugccgcucuguucuuuauugaacgccggccccaccacuggccggccaugaaguucagaucucauccugaccacagcacauacgcggagguugaacccuccggacaugagaaagagggcuuuauggaagcugagcagugcuga

SEQ ID NO: 73923 - RNA, 1443 nt, Artificial Sequence
  derived and/or modified sequence opt5 from PLXDC2__Homo_sapiens__NP_001269665
auggccagauuccccaaggcugaccuggccgcggcuggcgugaugcuccugugccacuuuuucaccgaucaguuucaauucgccgacgggaaaccuggagaucagauccuugacuggcaguacggcgucacacaggccuuuccgcauacggaggaagagguugaaguggauagccacgcuuauucccaucgguggaagcgcaaccuggacuuccucaaagccguggauaccaauagagcuucugucgggcaagacagccccgagccucgguccuuuacagaucugcuucuggacgauggacaggacaacaauacccagauugaacgcgugaaccucucuuucgauuuucccuucuacggccacuuucugagagagaucacaguugccaccgggggauucauuuauacaggcgaggugguccaucggaugcugaccgcgacgcaguacaucgccccucucauggcuaauuuugaccccagcgugucccgcaacucuaccguuagauauuucgacaauggcacagcccuggugguccaaugggaucacgugcaccuucaggacaacuacaaucuggggagcuucaccuuucaggcuacacuccugauggauggacggauuaucuucggcuauaaggaaaucccugugcuugucacccagauuuccagcacgaaccauccgguuaaaguggggcugucugacgccuuuguggucgugcaccgcauccaacagauucccaauguuagacggcgcacaaucuacgaguaccauagaguggaacuccagauguccaagauuaccaacaucagcgcggucgagaugacaccucugcccaccugucugcaauucaaucggugcggaccuugugugucuucccagauuggcuuuaacugcagcugguguucuaagcuccagcgcugcuccagcggguucgauagacaccggcaggacuggguugauuccggaugucccgaggaaucuaaagagaagaugugcgaaaauaccgagccgguggaaacaagcuccagaacgaccacaaccgucggcgccacaaccacgcaauuucgcgugcugacaaccacccggagagcugucacaagccaguucccuaccucucuucccacagaggacgauacgaaaaucgcccugcaccucaaggacaacggcgcuuccaccgaugacagcgccgccgagaaaaagggagggacacugcaugcuggccuuaucauugggauccugauucucgugcugaucguugcgaccgccauucuggugacagucuauauguaccaccauccuaccucugcugccagcaucuuuuucaucgaacgccggcccuccagauggcccgccaugaaguuucgccggggaucuggccacccugcuuaugccgagguggaaccgguuggggagaaagaaggauucauugugagcgagcaguguuga

SEQ ID NO: 73924 - RNA, 5691 nt, Artificial Sequence
  derived and/or modified sequence opt5 from PLXNA1__Homo_sapiens__NP_115618
augccccugccucccagaucccuucaggugcugcugcugcuccugcuucugcuccugcugcuccccggcaugugggcugaagcugggcugccucgggccggaggcgggucccagcccccuuuccgcaccuuuucugcguccgacuggggacuuacccaccuggucguucaugaacagacgggcgagguguacgugggggcugucaacagaaucuauaagcucuccggaaaucugacccuucugcgggcccacgugacaggccccguugaagauaacgaaaaaugcuacccuccgcccucugugcagagcuguccucauggccucggguccaccgacaaugucaacaagcugcugcuccuggauuaugccgcuaaucgccuucuggccugcggaucugcuagccagggcauuugucaauuccucagacuggacgaucuuuuuaaacugggggaaccccaccaucggaaggagcacuaccucuccagcgugcaggaggccggaucuauggcgggcguucugaucgccgggccucccggacagggccaggcuaaacuguucgugggcacaccgauugacgggaaguccgaauauuuuccuacccucagcucucgcagacugauggccaacgaggaagaugcugacauguucggauuugucuaccaagaugaguucguguccagccagcuuaagauccccucugacacacuguccaaauuuccugccuucgauauuuauuacguguacagcuuucgguccgagcaguucgucuauuaccucacccugcagcuugacacgcaacugaccucucccgaugcggccggcgaacacuuuuucacaagcaagaucguucgccucugcguggacgaccccaaauucuauuccuacguggaguuuccuaucgggugugaacaggcuggagucgaguauagacuggugcaggaugccuaccugagccggccgggccgcgcucucgcccaucaacuggggcuugccgaagacgaggauguucuguucaccguguuugcucagggacagaagaauagagucaaacccccuaaggagucugcgcucugccuguucacacugcgggccauuaaggagaagaucaaggagcgcauucaguccuguuauagaggcgaaggcaaacuuagccuccccuggcugcugaacaaggagcucgggugcaucaauucuccucugcaaauugacgaugacuuuuguggacaggauuucaaccagccccuuggcgggaccgugacgaucgaaggaacaccgcuguuuguugacaaagaugacggccucaccgcuguggccgccuacgauuaccgggggagaacagucguguucgcuggcacccgcagcggacggauuagaaagauccuggucgaccuguccaauccuggcgggcgccccgcccuugcguaugagucugugguugcucaggagggaagcccuauccuccgggaccuggugcugucccccaaccaccaauaccucuaugccaugaccgaaaaacaggucacaagagugccuguugagagcugcgugcaguacacgucuugugaacugugccuuggcucccgcgauccccauugcgggugguguguccugcacagcauuugcucucggagagacgccugugagcgcgcugaugaaccgcagcgguuugccgcugaccuccugcaaugcgugcagcugaccgugcagccuagaaauguuuccgucacaaugagccaggugccccuugugcuccaagccuggaacguccccgaucuguccgcgggagugaauuguucuuucgaggacuuuaccgagagcgaauccguucuggaggauggccgcauccacugccggucuccuagcgccagagaaguggcuccgauuacacgggggcagggcgaccagcgcgucgugaagcucuaucugaaguccaaagagaccggaaagaaauucgccagcguugauuuuguguucuacaacuguucuguccaucaauccugccuuagcugugugaacggcucuuuccccugccacugguguaaguauagacauguuugcacgcacaauguggcugacugcgccuuucuggaggggcgggucaacguguccgaagauuguccucagauccuccccagcacacagauuuacgugccugucggaguugugaaacccaucacccuggcggccagaaaucugccucagccccaaucuggccagcgcggguacgagugccuuuuccauaucccgggaagcccugcucgggugaccgcccucagauuuaacuccagcucucugcagugucaaaauuccagcuauuccuacgaaggcaacgacgucucugaucugcccgugaaucucagcguuguguggaacgggaauuucgucauugacaacccucaaaauauccaggcucaccuguauaagugccccgcccuucgcgaguccuguggccugugccucaaggccgacccgagauuugaauguggauggugcguggcugagcggcgcuguucucugagacaccauugcgcggccgauaccccugcuagcuggaugcacgcccggcauggcuccucucgcuguacagaccccaaaauucugaaacuuagcccugagacagggcccagacagggaggcacgcggcugaccaucacaggggaaaaccucggacugcgcuucgaggauguuagacucggcgugcgggucgggaaagugcugugcucccccguugaaagcgaguacauuucugccgaacagaucgugugcgagaucggcgacgcuuccagcguccgcgcccacgaugcgcuuguggaggugugugucagagacugcucuccucacuaucgggcucuguccccgaagagauuuaccuucguuacacccaccuuuuaccgcgugagcccuucucggggaccccucuccggcgggacguggauuggaaucgaaggcagccaucugaaugccggguccgauguggccgucagcgugggaggcagaccuuguucuuucagcuggcgcaacucccgggagauuagaugccugacacccccuggccaaucuccggggagcgcucccaucauuaucaauauuaaccgcgcccagcuuacaaacccugaaguuaaauauaauuacaccgaggaccccacaauccugcggaucgauccugaaugguccauuaacucuggaggcacccuccugacggugacagggaccaaucucgcgacagucagagagccccgcauccgggcuaaguacggaggcauugagagagaaaacgggugucugguguauaaugacaccaccaugguuugccgggccccgagcguggccaacccuguccgcagcccgcccgagcuuggagaaagaccugaugagcugggcuuugugauggacaauguccggucucuccuggugcugaacagcacauccuuccuuuacuaucccgauccuguucuggagccgcucagccccacgggccugcucgaacugaagccuucuagcccccuuauccugaaagggcgcaaucugcucccucccgcuccgggaaacagcagacugaauuacaccgugcuuauuggcucuacaccuuguacccugacagucuccgagacccagcuccugugcgaagcccccaaccucacggggcaacacaaggugacaguucgggcuggaggcuuugaguucagcccugggacccuccagguguauuccgacucucuucugacccugcccgccaucgucggaaucggcggcgggggaggccuccugcuucuggugauuguggcgguucucaucgccuacaaaagaaagagccgcgacgcugaucggacacugaaaagacuccagcugcagauggacaaucuugaaucccgcgucgcccuggaguguaaggaggcuuucgccgaacugcaaaccgauauucaugagcucacaaacgaccuggauggggccggaaucccuuuucuugacuaucggacguacgcuaugagagugcuguuccccggcauugaagaucacccggugcucaaggagauggaaguccaggcgaauguggagaaaagccugacccucuuugggcagcugcuuacaaagaaacauuuccugcugaccuuuauccgcacacucgaggcccagcggucuuucuccaugagagaccgcggaaacguugcuagccugaucaugaccgcccuucaaggcgaaauggaguacgccacgggcgugcugaagcagcuccugucugaucugauugagaagaaccucgagagcaagaaucacccuaaacuucugcugagacggaccgaauccgucgcugagaagaugcucacaaacugguuuaccuuccugcuuuauaaguuucugaaagagugcgccggggaaccccucuucaugcuguacugugcgaucaagcagcagauggagaaaggacccauugacgcuaucacaggcgaagcccgcuauucucugagcgaggauaagcucauuagacaacagaucgacuacaaaacccuuacacugaauugcgugaacccugagaaugaaaacgccccggagguucccgugaaggggcuggacugcgauaccgucacgcaggcuaaggaaaaacuccuggacgccgcguauaagggagugccuuacucccagcggcccaaagcugccgauauggaccuugaguggcgccaaggcagaauggcccggaucauucugcaggaugaagacguuacaaccaagaucgauaaugacuggaaaagacucaacacccuggcucacuaucaggugacagaugggucuagcgucgcccuggugccuaagcaaaccuccgcuuacaauauuagcaacucuuccacguuuacaaagagccucucccgcuacgagucuaugcuucggaccgccagcucccccgacucucugagaagccgcacaccuaugaucaccccggaucuggaguccggaacaaaacucuggcaucuggugaagaaucacgaccaucuugaucagcgggaaggcgacagaggcagcaaaauggucucugagauuuaucugacccggcuccuggcgacgaaggggacccugcagaaauucguugacgaucucuucgaaacaaucuuuuccaccgcccaccgcggaagcgcccuuccccuggccauuaaguacauguucgacuuucuggaugagcaggcugacaagcaucaaauccacgaugccgacgugagacacacauggaaaucuaacugucucccucugcgguucugggugaaugucaucaagaacccccaguuuguguucgauauucauaaaaauuccaucaccgacgccugccuuagcguuguggcucagacguuuauggauucuuguagcacauccgaacacaagcugggcaaagacucuccuagcaacaagcuccuguaugcgaaagauauucccaacuacaaguccugggucgagcgcuauuacgccgacaucgcuaagaugccggccauuagcgaucaggacauguccgccuaucuggcugagcaaucuagacuccaucuuagccaguucaauuccaugucugcccugcacgaaaucuacagcuacaucaccaaauauaaggacgagauucuggcggcucucgaaaaagaugagcaggcccggcgccagagacugcgguccaaacuugaacaagugguugacacaauggcccugucuagcuga

SEQ ID NO: 73925 - RNA, 5685 nt, Artificial Sequence
  derived and/or modified sequence opt5 from PLXNA2__Homo_sapiens__NP_079455
auggagcaaagacggcccuggccucgcgcccuggaaguggacagcagauccgucguucuccugucugugguguggguccuucuggcuccucccgccgcgggaaugccccaauucagcaccuuucacuccgagaaccgggauuggacauucaaucaucucacggugcaccaggggaccggagcuguuuacgugggcgccaucaaccgcgucuauaagcugacagggaaucuuaccauucagguggcccauaagacaggacccgaagaggacaacaagucuugcuacccuccccugaucguucagccuuguagcgaagugcucacccugacaaauaacgucaauaaacugcucauuaucgauuauuccgagaacagacugcuugcuugcggcucucuguaccaagggguguguaagcuccugcggcuugacgaucuguuuauucucguggagccgagccacaaaaaggaacauuaucuguccagcgucaauaagaccggaacgauguacggcguuaucgugcgcucugagggcgaagacgggaaacuguucaucggaaccgccguggauggcaagcaggacuauuuucccacacucuccagcagaaaacugccucgggaucccgagucuuccgcuaugcuugacuacgagcugcacagcgauuucgucucuucccucauuaagaucccuagcgacacccuggcccuugugucccacuuugauauuuucuacaucuauggguuugcgucuggaggcuucguuuacuuucugacagugcagcccgaaaccccggagggggucgccauuaacagcgcuggagaccucuucuauacgucccgcaucgugagacugugcaaagacgauccuaaguuucauagcuacguuucucugcccuucggcuguacacgggccggcguggaauaucgccuccugcaggcugccuaccuugcgaagccuggggacucccuggcccaggcuuucaauauuaccagccaggaugacguccucuuugccaucuucucuaaaggacagaagcaguaucaccauccgcccgaugacagcgcucugugcgccuuuccuaucagagccauuaaccuucaaaucaaagagcggcugcaguccuguuaccagggcgaagggaaucucgagcugaacuggcugcucggaaaggaugugcaaugcacaaaagcuccgguccccauugacgauaauuucuguggccuggacaucaaccagccucuugggggaucuacccccguggagggccugacccucuacacaacgagccgcgauagaaugaccuccguugcgagcuauguguacaacggcuauucugucguguuuguugggacaaaguccggaaaacugaagaagauucgggccgacggcccuccccacgggggagugcaguacgaaauggucagcgugcugaaagacggcucuccgauccuuagagauauggcuuucuccaucgaccagcgcuaucucuacgugaugagcgagcggcaaguuaccagagucccuguggaauccugcgagcaguauacaaccuguggggaaugccugucuagcggcgauccccacugcggauggugugcccugcauaauaugugcucccgccgggacaagugucagcaggccugggagccuaacagauuugcugccucuauuagccaaugcgugucccucgcgguccaccccagcucuaucuccgugagcgagcauucucgccugcuuucccugguugugagcgaugcuccugaccucucugccggcauugccugugcuuucgggaaucugacggaagucgagggacaggugagcggcucccagguuaucugcauuagccccgggccgaaagaugugccugucaucccccuggaccaggauugguuuggacuugaacuccaacugcggucuaaggagacaggcaaaaucuucguguccaccgaauuuaaguucuacaacuguagcgcccaccagcugugccucuccuguguuaauucugcuuuuagaugccauugguguaaguaccgcaaccugugcacccacgaccccacaaccugcagcuuccaggaggggcggauuaauaucuccgaggauuguccucagcuugugccgacagaagagauucugauccccgucggcgaagugaaaccuauuacgcucaaggccagaaaccugccccaaccucagucuggacagcgcggcuaugagugcgugcugaauauccaaggggcgauucaccggguccccgcccuuagauucaacagcuccucuguucagugucagaauagcuccuaccaguaugacggaauggauaucagcaaccucgcuguggacuuugccguggucuggaauggcaacuucaucauugacaauccucaagaucugaaagugcaucuguacaagugcgcugcccagcgggagucuugugggcucugccugaaagcggaccgcaaguuugaauguggauggugcuccggcgagagacgguguacccuucaccagcauugcacaagccccucuuccccguggcuggauuggagcucucacaacguuaaguguuccaacccucagaucaccgaaauucucacagugagcgggcccccugagggcggaaccagagucacgauccacggcgugaaucuggggcuggacuucuccgaaauugcccaucacguucaaguggcuggaguccccugcaccccgcuuccuggcgaguauaucaucgccgagcagauugugugcgaaauggggcaugcucucguuggaacaaccagcggccccgugcgccuguguaucggggagugcaaaccugaauuuaugacaaagucucaccagcaguacaccuucgucaaccccagcgugcugucccucaaucccauucggggcccugagucuggaggcacgauggugacaaucaccgggcauuaucugggagccggcagcuccgucgccguuuaccuugggaaccaaacaugugaauuuuacggaagaucuaugagcgagauugugugcguguccccgcccucuagcaauggccugggcccuguccccguguccguuagcguggaucgcgcucacgucgacucuaaccuccaguucgaguauaucgaugacccuagagugcagcggaucgaacccgagugguccauugcgagcgggcacaccccucugaccaucacaggauuuaaucuggauguuauucaagaaccgcgcaucagagugaaauucaacggcaaggagucugucaauguguguaaagucgugaacacgaccacacuuaccugccuggcccccucccucacaaccgacuaccggccugggcuggauacgguugaacgccccgacgaguuuggauucguguuuaauaacguccagagccuccugauuuauaaugauacaaaguucaucuacuauccuaaccccaccuucgagcuucuguccccgaccggcgugcucgaccagaagccugggucucccaucauucugaaaggaaagaaucugugucccccugcuagcggcggcgccaaacuuaacuacacaguucugaucggggaaacccccugcgccgugacagucuccgagacgcagcuccugugugaaccuccgaaccucaccggacaacauaaggugauggugcacguuggcgggauggucuuuagccccggaucuguguccgugauuagcgacucucugcuuacacugccugcuaucgucagcauugccgcgggcgggucccuccugcugaucauugugaucaucguucuuauugcuuauaaaagaaagucucgggagaaugaucugacccucaaacgccugcagaugcagauggacaaccucgagagcagaguggcccuggaaugcaaggaggccuucgcugaacuucagacagauaucaaugagcugaccuccgaccuggaucggucuggcauucccuaccucgacuaccgcacguaugccaugagaguccuguuuccuggcaucgaagaucaucccgugcuucgggagcuggagguucaaggcaacgggcagcagcacguggaaaaggcgcucaaacuguucgcucagcucauuaauaacaaggucuuucugcuuaccuucaucagaacacuggagcugcaacgcagcuuuuccaugcgggacagaggaaauguggccagccucaucaugaccggccugcaggggcgccuugaauacgccacagauguucugaaacagcuccugucugaccucauugauaagaaccuggagaauaaaaaccauccgaaacuucugcugcggagaaccgaauccguggcugagaagaugcucacaaauugguucgccuuucugcuucacaaauuccugaaggagugugcuggagaaccucucuuuaugcuguauugcgccaucaaacagcaaauggagaagggccccauugacgcgaucaccggggaagcccgcuacagccucuccgaggacaaacugauucggcagcagaucgaauauaagacgcuuauccugaacugcgucaauccugauaacgaaaauucucccgagauuccugugaaggugcugaacugugacacaaucacccaagucaaagaaaagauucucgaugcuguuuacaaaaacgugcccuauagccagagaccgcgcgccguggacauggaucuggaguggcggcagggaagaaucgcucgggucgugcuucaggacgaagauauuaccacaaagaucgagggcgacuggaaacgccugaauacccucaugcacuaccaaguuuccgauagaucuguggucgcccuggugccuaagcagacgagcuccuacaacauucccgccagcgcuucuaucucccggacaagcaucucucgcuaugacuccagcuucagauacaccggcucucccgauagccugcgguccagagcgccuaugauuacaccggaccucgagucugggguuaagguguggcaucuugucaaaaaucacgaucauggagaccagaaggaaggcgaccgcgggagcaaaaugguguccgagaucuaucugacccggcugcucgccacaaagggaacccugcagaaauucgucgaugaccuuuuugaaacgcuguucagcaccgugcacagaggcuccgcucucccccuggccauuaaguacauguuugauuuccuggacgagcaagccgaucgccacucuauccaugacacagauguucggcacaccuggaaaagcaacugccucccucuuagauuuugggugaaugugauuaagaacccccaguucgucuuugacauccauaagggguccaucacagaugcuugucugucuguuguggcccagaccuucauggacagcugcuccacgucugaacaccgccugggaaaagauagcccuuccaauaagcuccuguaugcgaaagacauucccagcuacaagucuuggguggagcgguauuacgcugauaucgccaaacuuccugccauuuccgaccaggacaugaacgcuuaccuggccgagcaaagcagacuccaugcggucgaauuuaauaugcugucugcucugaacgagaucuauuccuacgugagcaaguauucugaggagcucauuggcgcccuugaacaggaugagcaggcccgcagacaacggcuggcuuacaagguugagcagcugaucaaugccauguccaucgaaagcuga

SEQ ID NO: 73926 - RNA, 5616 nt, Artificial Sequence
  derived and/or modified sequence opt5 from PLXNA3__Homo_sapiens__NP_059984
augcccuccgugugccugcuccugcuucuguuccucgccgucggcggggcucugggaaacagaccuuuucgggccuucguugugaccgacacaacgcuuacccaccuggcggugcaucgcgucacaggcgaaguguuuguuggggcugugaauagagucuucaagcucgccccgaaccugaccgaacugcgggcccacgugacaggacccguugaggauaaugcucgcuguuacccucccccuuccaugagagugugcgcccaucggcucgcucccgucgacaacaucaauaagcugcuucugauugauuaugccgcgcgcagacucguggccuguggcucuaucuggcaggggauuugccaauuucugcggcuugacgaucuguucaagcucggagaaccucaccaucgcaaagagcacuaccugagcggcgcucaggaaccggacuccauggccggcgugaucgucgagcaggggcagggacccucuaagcuguuuguuggcaccgcuguggaugggaaaagcgaguauuucccuacacucuccucuagaaagcugauuagcgacgaagauuccgccgacauguuuagccuuguguaccaagaugaguucgucucuucccagaucaagauccccagcgacacccugucucucuauccugcguuugauauuuacuauaucuacggauucguguccgccagcuuuguuuacuuccugacgcuucagcuggacacccagcaaacacuccuggacaccgcuggcgaaaaauucuuuacaucuaagauugugcggaugugugccggggauuccgaguucuauagcuacgucgaguuucccaucggaugcuccuggcgcggcguggaauauagacugguucagucugcucaccucgccaaaccgggccugcuucuggcccaggcucucggggugccugcggacgaggauguccuguucaccauuuuuagccagggacaaaagaaccgggccucucccccucgccagacgauccuuugucuguucacacucagcaauauuaacgcucauaucagacggagaauccagagcugcuaccgcggcgaagggacccuggcccugcccuggcuccugaauaaagagcuucccuguauuaacacaccuaugcaaaucaauggaaacuuuugcggccuggugcucaaucagccgcucgggggccugcacgucauugaaggccuuccccuccuggccgacuccaccgauggcauggcuagcguggccgcguauaccuaccggcagcauucuguuguguucaucgggacaagaagcggaucccugaagaagguccgcguggacggcuuucaggaugcucaccucuaugagacgguuccuguggucgacgggucucccauucugcgggaucuucuguucagcccugaccacagacauaucuaccuccuguccgagaaacaagugagccagcugcccguggaaaccugugagcaguaccagucuugcgccgccugccuuggauccggcgauccgcacuguggguggugcguucuccgccaucgguguugcagagaaggcgcuugucugggagccagcgcuccucacggcuuugccgaggaacugucuaagugcguccaagugcgcgugcggcccaacaaugucuccgugacaagcccugggguucagcucaccgugacacugcauaacguccccgaccuuuccgcgggagugucuugugccuucgaggcugccgcugagaacgaagccguucugcucccuagcggcgagcugcugugccccuccccgucucuucaggaacucagagcgcugacccgcgggcacggagccacgcggacagugagacugcagcuccugagcaaagagaccggcguccgguuugcuggggccgacuucguguucuauaauuguuccguucuucaaagcugcaugucuugugugggcuccccuuaccccugccacuggugcaaguaucgccauaccuguacaagcagaccccacgaaugcucuuuucaggagggacggguccauuccccugagggcuguccggaaauccugcccagcggggaucuccugauuccugugggagugaugcagccccugacccuuagagcuaaaaaccucccucagccccaaucuggccagaagaauuacgagugcgucguucgcgugcaggggcggcaacagagagugccugccguccgcuucaacagcuccagcgugcagugucagaaugccucuuauuccuacgaaggagacgagcacggcgauacagagcuggacuuuagcguugugugggauggggacuuccccaucgauaaaccgccuuccuuuagagcucugcucuauaagugcugggcgcaacggcccucuuguggccugugccuuaaggccgacccucgcuucaacuguggauggugcauuagcgaacacagaugucagcugcggacgcauugccccgcuccgaaaaccaauuggaugcaccucucccagaagggcacacgcugcucucauccuagaaucacccagauucacccccuggucgggccuaaagagggaggcacacgggugaccaucguuggggaaaaccugggacuucugagccgcgaggugggccucagagucgccggggugcgguguaauuccauccccgccgaauacauuucugcugagcgcaucguuugcgagauggaagagagccuggugcccuccccuccgcccggcccugucgaacucugugugggagauugcagcgccgacuuuagaacgcaaucugaacagguguacuccuucgucacccccacauuugaucagguuagcccuucucggggccccgcguccgggggaaccagacugacaauuagcggaucuucccuugacgcugggagccgcgugaccgugacgguccgggauuccgaaugucaguucgugagacgcgacgccaaggccaucguuugcauuagcccucugucuacacucggaccgagccaagcucccaucacccuggccauugaccgggcgaacaucuccucuccuggccugaucuauacauacacccaggaucccaccgugacaagacuugagccuacguggagcauuaucaauggcuccaccgcuauuacagucucugggacccaucugcucacagugcaggagccccgcguucgggccaaauauagaggaaucgaaaccacgaacacaugucaagugauuaaugacaccgccaugcugugcaaggcuccgggcaucuuucucgggcgcccucagccccgggcccagggagagcaccccgaugaguucggcuuucugcuugaccacguccagaccgcuagaagccugaaccgguccucuuucacauacuauccugaucccagcuucgagccucucgggccguccggagugcuggacgucaagcccggcagccaugugguucugaaaggcaagaaucuuaucccugccgcggccgggucuucccgccugaacuacaccgugcucauuggaggccaacccuguagccugacagucucugauacgcagcuccugugcgacuccccuagccagaccgggagacagcccgugaugguucuugugggaggccuggaauuuuggcuggggacacuccacaucuccgcugagcgggcccugacccuuccggcuaugaugggacuggccgccggcggcgggcuccugcuccuggcuauuacagcgguccuuguggccuauaaacgcaagacccaagaugcugacagaacgcugaaacggcugcagcuccagauggauaaccuggagucuagaguggcccuugaauguaaggaggccuucgcugaacugcagaccgacaucaaugagcucacaaaccauauggaugagguucaaauuccuuuucuggacuaccgcaccuacgccguccgggugcuguuccccggaaucgaagcgcacccugugcugaaggagcuugacacacccccuaaugucgaaaaagcucugagacuguuuggccagcuccugcauagccgcgccuucgugcuuaccuuuauccacacacuggaggcccaguccagcuucucuaugcgggauagagggaccguugcuucccucacgaugguggcccugcagagccgccucgacuaugcgacaggacugcuuaagcaacugcuggcugaucucauugagaagaaccuggagucuaagaaucaccccaaacuucugcuccggagaaccgagagcgucgccgaaaagaugcugaccaacugguuuacauuccugcuccauaaguuucuuaaagagugcgccggcgaaccgcuguuccugcucuacugcgcuaucaagcagcagauggagaaagggccuauugacgccaucaccggagaagcucgcuauucccugucugaggauaaacuuauuagacaacagaucgacuacaaaacgcugacacuccacugugugugccccgagaaugaaggcagcgcccagguucccgugaagguccugaacugugauuccaucacccaggcgaaagacaagcugcucgauacaguguauaagggcauuccuuacucucaacggccgaaagccgaggacauggaucuugaauggcgccaggggagaaugacccggaucauucugcaggacgaggacguuacaaccaagaucgaaugcgauuggaaacgccugaauagccucgcucauuaucaggugacggacggaucccuggucgcccuugugcccaagcaagugagcgcuuacaacauggccaauucuuucaccuuuacaagaucccugagccgguacgagucccuccugagaaccgccucuagcccugauucccugcgcucucgggcucccaugauuacaccugaccaggagaccggcacgaaacucuggcaccuugucaagaaccacgaucaugcggaccacagagaaggggaucgcggaagcaagaugguuuccgagaucuaucugacacggcugcucgccaccaaaggcacacugcagaaguucguggacgaucuuuuugaaaccguguucagcaccgcucauagagggucugcccugccccucgccauuaaauacauguuugacuuccuggaugagcaggcugaccaacggcagaucuccgauccugacguccgccacacauggaaaagcaauugucugccgcucagauuuugggugaacguuaucaagaauccccaguucguguuugacauucauaagaacucuaucacggaugccugccuuuccgucguggcgcaaaccuucauggacagcuguucuacaagcgagcaccggcugggaaaggauuccccuucuaacaaacugcucuaugcuaaggacauucccaauuacaaaagcuggguugaacgcuauuacagagauaucgccaagauggccuccauuagcgaccaggauauggacgcuuaucugguggagcagucccggcuucacgccucugauuuuagcguccuguccgcgcucaacgaacuguacuucuacgugaccaaauaucgccaggagauccugacagcccucgacagagaugcuucuugccggaagcauaaacuucgccaaaaacuggaacagaucauuagccuggucuccucugacagcuga

SEQ ID NO: 73927 - RNA, 1479 nt, Artificial Sequence
  derived and/or modified sequence opt5 from PLXNA4__Homo_sapiens__NP_001099013
augaaggccaugcccuggaacuggaccugccugcucagccaccuucuuauggugggcaugggguccucuacacugcucacgagacagccugcuccgcugagccaaaaacagcgguccuucgucaccuuucgcggagagcccgccgaaggcuucaaucaucuuguuguggacgagagaacagggcacaucuaccugggagcggugaaccggauuuauaagcucucuagcgaucugaaaguccuggugacccaugaaacaggcccugacgaggauaaucccaaguguuacccuccccgcaucguucagaccugcaacgaaccucucacaaccacgaauaacgugaauaaaaugcugcuuauugacuauaaggagaacagacugaucgcuugugggucccucuaccagggaauuugcaagcugcuucggcuggaggaucucuuuaaacugggcgaaccguaucacaagaaagagcauuaccugucuggcgucaaugaaagcggguccguguucggaguuaucgugagcuauucuaaccucgacgauaagcuguuuaucgccaccgccgucgacggcaaacccgaguacuucccuacaauuuccagccgcaagcugaccaaaaauucugaggcugaugggauguuugccuacguguuccacgacgaauuuguggcuuccaugaucaagauucccagcgauacauucaccaucauuccugacuuugauaucuauuacgucuauggauucucuuccggcaacuuuguuuacuuccugacgcuccaacccgagauggugagcccgccuggguccacaaccaaggaacagguguauacaucuaaacuggucagacuuuguaaggaggacaccgccuucaauagcuacguggaaguucccauuggaugcgagcgguccggcguggaguaucgccugcuccaggcggccuaccugagcaaagcuggcgccguccuggggagaacccucggagugcacccugacgaugaccugcuuuuuacaguuuucucuaagggccagaaacggaagaugaagucccuggaugaaagcgcucucuguaucuuuauccugaaacaaauuaacgaccgcaucaaggagagacuucagucuugcuaccggggagaaggaacgcuggaucucgccuggcugaaagugaaggacauucccuguagcuccgcgcugcucaccaucgaugacaauuucugcggccuggauaugaacgcuccccuuggggucucugacauggugcgcgggauuccugucuuuacagaggauagagaccggaugaccagcgugaucgccuauguuuacaaaaaccauucccuggccuucgugggcacaaagagcggcaagcucaaaaagaugccggggaccucucugugucccacgcuggaacuucagacaggaccuagaucccaccgcgcuaccgucacccucgagcugcuguuuagcucuugcuccagcaauuga

SEQ ID NO: 73928 - RNA, 6408 nt, Artificial Sequence
  derived and/or modified sequence opt5 from PLXNB1__Homo_sapiens__NP_001123554
augcccgcccugggcccugcucuccugcaggcccuuugggcggggugggugcugacccuccaaccgcugcccccuacagcuuucacgcccaacggaaccuaccuucagcaccuggccagagacccuacaagcggcacccucuaucugggggccacaaauuuucuguuccagcucucccccggacugcagcuugaagcuaccgucucuacaggcccuguucuggauagccgggacugccucccgcccgugaugccugaugaauguccccaagcccagccuaccaacaaucccaaccagcugcuucugguguccccgggggcucucgucgugugcggaucuguucaucagggcgugugugagcaacgcagacugggccagcuggaacagcuccugcuucggccugagcgccccggggacacgcaguacgucgccgcgaaugauccugccgugagcaccguuggacugguggcucaaggccucgccggggaaccccugcuuuuugucggaagaggcuauacauccagaggggugggaggcggcauucccccuauuaccacacgcgcucuguggccgcccgacccucaggccgcguucucuuacgaggagaccgccaagcucgcuguggggagacugagcgaauauucccaccauuuugucagcgccuucgcucggggagccucugccuacuuucuguuccuccgcagagaucugcaggcucaaucccgggcguuucgcgccuauguuagcagagugugccuucgggaccagcacuacuacucuuauguggagcugccccucgcuugugaaggcgggcgcuacggacugauccaggccgccgcugucgccacguccagagagguggcgcauggcgagguucuuuucgcugccuuuagcucugccgcuccucccacaguggggcggccgccuuccgccgcugccggagcgagcggcgccuccgcucugugcgccuucccccucgaugaagucgacagacuggcuaaccgcacccgggaugccuguuauacaagagagggccgcgcggaagacgggaccgagguggccuacauugaauaugauguuaauucugacugcgcucagcugccuguggacacccucgaugccuaccccuguggaagcgaccacacaccuucccccauggcuagccgggucccgcuggaggccacgccuauccuugaguggcccggcauucaacugaccgccguggcugucacaauggaagaugggcacaccaucgcguuucucggagacucucagggccagcugcauagaguguaucuggggcccggcuccgauggacacccuuacagcacacagucuauccaacagggcagcgccguuucccgcgaccuuaccuucgaugggacguucgagcaucucuacgugaugacacagucuacccugcugaaagucccgguggcuagcugcgcccagcaccucgacugugccuccugccuggcucaccgggaucccuauugcggaugguguguucuucugggcagaugcagccgccggucugaauguuccagagggcaaggaccugagcaguggcucuggagcuuucagcccgaacugggcugccuccagguggccgcgaugucuccugcuaacauuucccgcgaggagacccgggaagucuuccuuagcgugcccgaccucccuccccuguggccgggggaguccuacucuugucauuuuggcgaacaccaaagcccugcccugcucacaggauccggcgugaugugccccucuccugaucccagcgaggccccgguucugccuagaggggcugacuaugucuccgugagcguggaacuucgguucggagccgucgugaucgcgaagaccucucuguccuuuuacgacuguguugcugugacagagcuccgccccagcgcccagugccaggccugugucucuuccagauggggcugcaauugguguguguggcaacaucugugcacgcacaaagcuagcugcgaugccgggccuaugguugcuucucaucagagcccccuggugucccccgacccuccggcccggggaggccccagcccuucucccccuaccgcgcccaaggcccuugcuaccccugccccggauacccuccccgucgagccuggggcucccuccacagccaccgccagcgacauuuccccuggcgcuucucccagccugcuguccccguggggaccuugggcgggcucugggagcaucuccucucccggaagcacgggcagcccccugcacgaagaaccuucucccccuuccccgcagaacgggcccggaaccgccgugccugcucccacagauuucagaccuuccgccacccccgaagaccugcuugccagcccgcugucuccuuccgagguugcugccgugcccccugcggaucccggcccugaggcucuccaccccacagucccgcuggaccugccucccgccaccgugcccgccacgacauuuccuggggcuaugggcagcgugaaaccggcccuugauuggcucacccgcgaaggaggcgagcugcccgaagcggacgaguggacagggggagaugcuccugccuucucuaccuccacccugcucagcggcgacggggauuccgccgaacuggagggacccccugcuccccuuauucugccuagcucucucgacuaucaguacgacacaccgggccugugggagcuggaagaggccacgcuuggcgcuagcuccugucccugcgucgaaucuguucaagggagcacccugaugccugugcauguggagcgggaaaucagacuccugggacgcaaucuccaccuguuucaggauggccccggggacaacgagugugucauggagcuugaaggacuggaggugguuguggaagccagagucgagugcgaaccucccccggauacacagugucaugugaccugccagcaacaccagcucuccuaugaggcgcugcagccugagcugcggguuggccuuuuccugcgcagagccgggcggcuccgcguggacucugcugaaggacugcacgucgugcucuacgauuguagcguuggccauggcgacugcuccagaugucagacagccaugccccaauacgggugcguguggugugagggagaacggccccgcugcgucaccagagaggcuugcggcgaggccgaagccguggcuacgcaguguccugcgccccugauucacucuguggagccucuuacagggccggucgauggaggcacccggguuaccauccgcgggagcaaucugggacagcaugugcaagacgugcucggcauggucacaguggccggcguucccugcgcuguggaugcccaggaauaugaggucuccagcucucugguguguaucaccggggccuccggagaagagguugcuggcgccacagcgguggaggucccugggagaggacggggcgugagcgaacacgacuuugcuuaccaggaucccaagguccauucuauuuucccugccagagggccccgcgccggaggcacgcggcugacccuuaacggcuccaagcugcucacagggagacuggaggacauccgcgugguugugggagaucagccgugccaccuccugccugaacaacagagcgagcagcuucggugugaaaccucccccagaccuacacccgcuacccugccugucgccgugugguuuggcgcgacggagcgccggcugcagagagggcaauucaaauauacccucgaccccaauauuacaucugccggaccgaccaagagcuuccuguccggcgggcgcgagaucugcguucggggacagaaccuugacgugguccagacaccucggauccgggugaccgugguuagccgcaugcugcagcccucucaaggccucggcagacggcgcagagucgugcccgaaacagcuuguucccuggggccuagcugcucuagccagcaguuugaggaaccgugucacgugaacuccucucagcucaucacaugccggacgcccgcccugccuggacuucccgaggauccuugggucagaguggaguucauccuggacaaucugguuuuugauuucgcuacacucaaccccaccccuuuuagcuacgaggccgaccccacccugcaaccgcuuaauccugaggaucccacaaugccuuuccgccauaaacccggcuccguguuuucugucgaaggggagaaccuggaccucgcuaugagcaaggaagaggugguugccaugauuggagauggcccguguguggucaaaacccugacgcggcaccaucucuauugcgagccucccguggaacagccccugccuagacaccaugcgcuucgcgaggcccccgacucccugccugaguucacaguucagauggggaaucugcgguuuagccucggacacgugcaauacgauggcgagucuccgggcgcuuuccccgucgccgcucagguggggcugggagugggcaccucccuucuggcccucggggucaucauuaucguucugauguauagacgcaagagcaagcaggcccuccgggacuacaaaaaggugcagauucaacuggaaaaccuugaguccucugugagagaucgcugcaaaaaggaguuuacagaccugaugaccgaaaugacagaccugaccagcgaucuccugggauccggcaucccuuuccuugacuacaaagucuaugcugagagaaucuuuuuccccgggcaccgggaaucuccucugcaucgcgaucucggagugcccgagagcagacggccuacgguugaacagggccugggccagcuguccaaucuccuuaacagcaagcuguuccugaccaaauuuauucacacacucgagucucagcgcaccuucuccgcgagagaccgggccuacguggcuagccugcuuacagucgcccugcaugggaagcucgaguauuuuaccgauauccugagaacgcugcucucugaccuuguggcccaauacguugcuaagaauccgaaacugaugcugcgccggacagaaaccguggucgagaagcuccugacaaacuggauguccauuugucuuuauaccuucgugagagauagcgucggagaaccccuguacaugcucuuucgcggcaucaaacaccagguggacaaggggccuguugauucugugaccggaaaagccaaguauacacugaaugacaaccggcugcucagagaggauguggaauaccggccccuuacgcugaaugcgcugcucgccgucggcccuggggcuggcgaggcccagggaguucccgugaaggugcuggacugcgauaccauuagccaggcuaaagagaagaugcuugaccaacuguacaaaggcgucccgcucacacagcgcccugaccccagaacccuggauguggaauggcgguccgggguugccggacaccugauccucucugacgaggaugugacaagcgaaguccagggccuuuggcgcagacugaacacccugcaacauuauaaggugcccgacggggcgacggucgcccucgugccuugucugacaaaacacguucuucgggagaaucaggauuacgugcccggagagcgcaccccuaugcuggaagacgucgaugagggcgggauuagaccguggcaucucgugaagcccuccgacgaaccugagcccccucggccccgcagaggcagccugcggggaggcgaaagagagcgcgcuaaggccaucccggagaucuaucugacccggcuccuuuccaugaaagggacacugcagaaguucguugaugaccuguuucaggugauucucucuaccagcagaccugucccccuggcugugaaauacuucuuugaucuucuggacgaacaagcccagcagcacggaaucuccgaucaggacacaauucauaucuggaagacgaacucucucccucugcgcuucuggauuaacaucaucaaaaauccccaauuuguguucgacguucagaccagcgauaacauggacgcuguccugcucgugauugcccagacauucauggaugcgugcacccuugccgaccacaagcugggccgggauuccccgaucaauaagcugcucuaugcuagagacauuccucgcuacaaacggaugguggagagauauuacgccgauauccgccagacaguccccgcuucugaccaagaaaugaacagcguucuggccgagcuuuccuggaauuacagcggggaucugggagcccggguggcgcuccacgaacuguauaaguacauuaacaaauauuacgaccagaucaucaccgcucuggaggaggauggcacggcccagaagaugcagcucggguauagacuucaacagauugcugccgccguggaaaauaaagucaccgaccuguga

SEQ ID NO: 73929 - RNA, 5799 nt, Artificial Sequence
  derived and/or modified sequence opt5 from PLXNB3__Homo_sapiens__NP_001156729
auggagcugacccccgcuagcucccucacaugcucucugcuuagcccuagacugccgggcuccuucccccagcuccggcgcgugccucccuguucuagaccuuggcugcccaaggcuccugucauggcucgguggccgcccuuugggcuuugccugcuccugcugcuccugagcccucccccucuuccccugacgggagcccaccgcuucuccgcuccgaacaccacacucaaccaucuggcccuugccccuggcagagggacccuguacguuggagcugugaaccggcucuuucaacugucucccgaacugcagcucgaggccguggcugucacaggcccugugaucgacagccccgauuguguucccuuccgcgacccugccgaaugcccgcaggcgcagcugaccgauaaugccaaccaacuucugcucguguccagcagagcucaggagcuggucgccugugggcagguccggcagggaguuugcgaaacacgcagacuuggcgacguggcugagguccuguaucaagccgaggaucccggcgacgggcaguuuguggcggccaauaccccuggaguggcuacggucggccucguugugccccugccugggcgggaucugcuccugguggcccgcggacuugcuggcaaacugucugccggggugcccccgcucgccauuagacagcuggcuggaucccagccuuucagcucugaaggccuuggccggcuggugguuggggacuuuuccgauuacaacaauagcuaugugggagcguucgccgacgcucgcucugccuacuuugucuucagacggagaggcgcccgcgcucaagccgaguaucgguccuacguggcgagaguuugucucggggauaccaaccuguauagcuacguggaagucccccuggcuugccagggacagggccucauccaagccgccuuucuggcuccugggacacuucugggaguguucgccgcuggcccccgcggcacccaggccgcgcucugugccuuuccuauggucgagcugggggcuuccauggagcaggcccggagacugugcuacacagcuggaggccgcgggcccucuggagccgaagaggcgaccguggaauauggcguuacgagccggugugugacacuuccgcucgacuccccugagagcuaccccugcggggaugaacacacccccucuccuauugccggcagacagccgcuggagguccaaccccugcucaagcugggacagccuguguccgcuguugccgcccuucaggccgacggccauaugaucgccuuccugggggacacacagggacaacucuauaaaguguuccugcacggcagccaggggcaggucuaccauucucagcaagugggacccccuggcagcgcuauuucccccgaucugcuucucgacucuagcgggucccaccuguaugugcugaccgcgcaccagguugaucgcaucccugucgccgcuugcccccaguuuccggacugugccagcugccuccaggcccaagauccucuguguggcuggugcgugcuucagggacgguguaccagaaagggccagugcgggcgcgcuggacaacugaaucaguggcucuggucuuacgaggaagacucccauugucugcacauccagagccugcuucccggccaucacccucggcaggagcaaggacaggugacacucucuguccccagacugccgauucuggaugccgacgaauauuuccacugcgcguuuggagauuacgacucccucgcucauguggagggcccucacguugccugugugacgcccccucaggaucaggucccccugaaucccccugggaccgaccaugugacaguuccgcuugcccugauguucgaagacgugaccgucgcugccacaaauuuuagcuucuacgauugcuccgcggugcaagcucucgaggccgccgcucccugucgggccugcguuggcucuaucuggcgcugccacugguguccucagagcucccauugcguguauggagagcacugucccgaaggcgagagaaccauuuacucugcucaggaagucgacauccaggugcgggggccuggagccugcccccaaguggagggccuggcggggccucaccuggucccgguuggaugggaaagccaucuugcccucagagugcgcaaccugcagcacuuucggggccugcccgcuuccuuccauuguuggcucgagcugccuggggagcuuagaggccugcccgccacgcucgaagagacagcuggagauagcggccugauucacugccaggcccaccaauuuuauccuucuaugucccagcgcgaacugcccgugccgaucuacgucacccagggggaggcccagagacuugacaauacccaugcucuguaugugauucucuacgauugugcgaugggacacccugacugcagccauugucaagccgcuaaccggucucugggcugccucuggugugccgaugggcagcccgccugccgcuauggaccccugugcccucccggcgcuguugagcuucuguguccugccccguccaucgacgcgguggaaccccucacaggcccucccgaaggcgggcuggcucugaccauccuugggagcaaucuggggagagccuucgccgauguccaguacgcugugucuguugccagccggccuugcaaccccgaaccgucccucuaccgcacaagcgcgagaauugugugugucacgucuccugcucccaacggaaccacaggcccugugcggguugccaucaaaucccagcccccugggauuagcucccaacacuuuaccuaucaggaccccgugcugcucucucugagcccgcgcuggggaccucaggccggcggcacacagcuuaccaucagagggcaacaucugcagacgggaggcaauaccuccgcuuucgucgggggacagcccugccccauucucgagccuguguguccggaagccaucgugugccggacacgcccccaggcugccccuggcgaggcggccguccugguuguguuugggcacgcucaaagaacccugcuugccucucccuuccgguacacagcuaacccucagcugguggccgccgagcccagcgcuuccuucagaggaggcggccgccucauccgggucagagggaccggacuggaugugguucagcgcccucuccugucuguguggcuugaagcggacgccgagguccaagcuagccgggcccagccgcaggauccccagccuagacgcuccuguggcgcccccgcugccgacccucaagcgugcauucagcucgggggaggccugcuccaguguagcacggugugcucuguuaauuccagcucucugcuucugugucggucccccgcugugccggacagagcccacccucagcgcgucuuuuucacacucgauaacgugcaagucgacuuugccagcgcuucugggggacagggcuuccuguaucagcccaauccccggcucgccccucuguccagagaaggccccgcgcggccuuaccgccuuaagccggggcaugugcuggauguugagggagaaggccugaaccucgggaucagcaaggaggaggugagaguccacauuggacggggcgaaugccuggugaaaacccuuacacgcacccaucuguauugcgagcccccugcccacgcuccccagccugccaauggguccggacucccccaauuuguugugcagaugggcaacguccagcuggcucucggcccggugcaauacgaagccgagccuccccugagcgcuuucccuguggaagcccaggcggggguuggaaugggcgccgcuguccuuaucgccgcugugcugcugcucacccugauguauagacauaagucuaaacaggcccuucgggacuaccagaaggugcugguccaacucgagagccuggagacaggggugggagaucaguguagaaaagaauuuacggaccucaugaccgagaugacagaucuguccucugaccuugaaggcagcgggauucccuuccuggauuaccgcaccuaugccgagcgggccuuuuucccuggacacggcggcugcccccugcagccgaagccugaggggcccggagaagacggccacugugcgacaguuagacaggggcucacccaacuguccaaucuucugaacucuaagcucuuucugcugacgcucauccauacacuugaggaacagcccagcuucucccagcgcgaucggugccacguggccucucugcugagccucgcucugcauggaaaacuugaguaccugaccgacaucaugagaacccuccugggcgaucuggccgcccacuauguccaccgcaauccuaagcucaugcuucggagaacagaaaccaugguggagaaacugcugacaaacuggcucuccauuugucuguacgcuuuucuucgcgagguugccggggaaccgcuguauaugcuguucagagcgauccaguaccaaguggacaagggacccgucgacgccgugacgggcaaagcuaagcggacccugaaugauagccgccugcucagagaggacguugaguuccagccucuuacacugauggugcuggucggccccggggccggaggcgcugccgggucuuccgagaugcagcgggugccugcgcgcgugcucgauaccgacacaauuacccaggucaaagaaaagguucuggaucaaguguauaagggaacgcccuuuagccagagaccuucugugcaugcccuugaccuggaguggcgguccggccucgcugggcaccugacccugagcgaugaggaccucacauccgucacccagaaccauuggaaaagacuuaauacacugcaacacuacaaggugcccgauggcgccaccguuggacuggugccgcagcuccaucgcggcucuacaaucagccagucccuggcucagcggugcccucuuggggaaaacauucccacccuggaggacggagaagagggcggggucugucucuggcaccuggugaaagccacggaggaaccugagggagcuaagguuagaugcagcucucugcgcgaacgggagcccgccagagcgaaagccaucccggaaauuuaccucacacggcuucuguccaugaagggcacccugcaaaaguucguggaugacaccuuucaggcuauccucagcgucaaccgcccuauccccauugccgugaaauaucuguucgaccuucuggaugagcucgcugagaagcacgggaucgaagaccccggcacacugcauauuuggaaaaccaauucucugcuccuuagauuuugggucaacgcccugaagaauccucagcugaucuucgaugugcggguuagcgacaacguggaugccauucucgcggugaucgcucagacguuuaucgacuccuguacaaccucugagcacaaagucggacgcgauagccccguuaauaagcugcuuuacgccagagaaauuccucgguauaagcaaaugguggagcgcuacuaugcugacaucagacaguccucuccggccagcuaccaggaaaugaacuccgcccuggcugagcucagcggcaauuauacaucugcgccccauugccuggaggcgcugcaggaacucuacaaccacauucaccgguacuaugaucaaaucauuuccgcccuugaggaagacccuguggggcagaaacugcagcuggcuugucgccuccaacaggucgccgcucugguggagaauaagguuaccgaucuuuga

SEQ ID NO: 73930 - RNA, 4707 nt, Artificial Sequence
  derived and/or modified sequence opt5 from PLXNC1__Homo_sapiens__NP_005752
auggaggugagcagacggaaggcucccccucgcccgcccagaccugccgcgccccugccucuccuggccuaccuucuggcucucgccgcccccggccgcggggcugacgaaccugucuggcgguccgagcaggccaucggagcuauugccgcgucucaagaagauggcguuuucguggccagcggguccugccuggaccagcuugauuauucucuggagcacagccucuccagacuguaccgggaccaggcuggaaacuguaccgaaccggugucucuggcucccccugcccgccccagaccuggcagcuccuuuagcaaacuccugcuucccuaucgggagggggccgcgggacugggcggccuccugcuuacaggguggacguucgaucgcggagccugcgaggucagaccgcugggcaaucucucucggaacucccugcgcaaugggaccgaagugguuagcugucauccucagggaucuacagcuggcguggucuacagagccgggcggaacaaucgcugguaucuggcuguggccgccaccuacguucuccccgagccugaaacagcuuccagaugcaaccccgcggccagcgaccacgauaccgcuaucgcccugaaggacacagagggacggucucuugccacccaagagcugggcagacucaaacugugugaaggcgcugggucccuucauuuuguggaugccuuccuguggaauggaagcauuuauuuucccuacuacccuuauaacuacacguccggcgcggcuaccggguggccgucuauggcccgcaucgcccagagcacagagguccucuuccagggacaggcuucccuggacugcggccacgggcaucccgauggacggagacugcuccugagcuccucccuuguggaagcccuggacgugugggcuggcgucuuuagcgccgcggccggcgaggggcaagaacgccggucuccuaccacaaccgcucucugucuguucagaaugagcgagauucaggcccgcgcuaagcggguuuccugggauuuuaaaacggccgagucucacugcaaggaaggagaccagcccgagagagugcagccuaucgcgagcuccacacuuauccacagcgaccugaccucuguguauggcacagucgugaugaaucgcaccguucucuuccuggggaccggagauggccaacugcucaaggugauucugggggaaaaccuuacauccaauugucccgaggucaucuacgaaauuaaagaggagacgccgguguuuuauaagcugguuccugaccccgugaaaaacaucuacauuuaucucaccgccggcaaggaaguccggagaauccgcguggcuaauugcaacaaacauaagagcuguucugagugccugacagccaccgauccucacugcggauggugucauucccugcagcggugcacauuccagggcgacuguguccacagcgaaaaucuugagaacuggcucgauauuuccucuggggcuaagaaaugccccaagauccaaaucauuagaagcuccaaagaaaagaccacggugacaaugguuggaucuuuuagcccucggcacuccaaauguauggugaagaacgucgacagcucucgcgagcugugccagaauaaaucccagcccaacagaaccuguaccugcagcaucccgacacgggccaccuacaaggaugugucuguugugaaugucauguucuccuucggcagcuggaaccugucugacagauuuaauuucacaaacuguagcucccucaaggagugcccugccuguguggaaacggggugcgcuuggugcaaaagcgcgcgccgguguauucaucccuuuaccgccugcgaucccucugacuacgagagaaaucaggaacaauguccuguggcuguugagaagacauccggaggcgggcgcccgaaagagaacaagggcaauagaaccaaccaggcccugcaggucuucuauaucaaaagcauugaaccccagaagguguccacacuuggaaagucuaaugugaucgucaccggcgccaacuuuacgcgggcuagcaauaucaccaugauucugaaagggacaucuaccugcgauaaggacgugauccaaguuucucacgugcucaacgacacacauaugaaauucagccugccuuccucucgcaaggagaugaaagaugucuguauucaguuugacggaggcaauugcagcuccguggggagccugucuuacaucgcccuuccccacuguucccucauuuucccugcgaccacguggaucagcggaggccagaacaucacaaugauggggagaaacuuugauguuauugacaaucugaucauuucucaugaacugaagggcaacaucaauguguccgaguauugcgucgcuaccuacuguggauuccucgcccccagccugaagucuuccaaagugcggacaaacguuaccgugaaacuucgcguccaggauaccuaucuggacugcggcacacuccaauacagagaagauccucgguuuacgggguaucgcguggagagcgagguggacaccgaacuggaggucaagauucagaaggaaaaugauaacuucaauaucuccaaaaaggacauugagaucacacuguuucacggagaaaacggccagcuuaauuguagcuucgagaacaucaccagaaaucaggaucucacaaccauucugugcaagaucaaagggauuaagacggccucuacaaucgcuaacagcuccaaaaagguucgggugaaacugggaaaucucgagcuguacguggaacaagagucuguccccagcaccugguacuuccuuauugugcugccgguucuccuggugaucgucaucuuugccgcggugggcguuacccgccacaaguccaaagaacugucuagaaagcagagccagcaacuugagcuccuggaauccgagcugcggaaggagauuagagacggguucgcugaacuccagauggauaaacuggacguggucgacucuuuuggcacagugccuuuccuugauuauaagcauuuugcccugcgcaccuucuuucccgagagcggaggcuucacacacaucuuuacggaagacaugcauaaccgggaugccaaugacaaaaacgagucccucaccgcucuggaugcccugauuugcaacaagagcuuccuuguuacagugauccacacccuggagaaacagaagaauuuuucugucaaggacagaugucucuucgcuuccuuucugacaauugcccuccagaccaaacugguguaccuuacgagcauccuggaagugcucacccgcgaucugauggagcaaugcucuaacaugcagccuaagcugaugcuucggagaacagaauccgucguugagaaacugcucaccaauuggaugagcgugugucuguccggguuccuccgcgaaacagugggagagcccuucuaucugcuugucaccacacugaaccagaagaucaauaaaggcccgguggacguuauuaccugcaaggcgcucuacacgcugaacgaggauuggcugcuuuggcaagugccugaauuuucuacagucgcccugaaugugguuuucgagaagauccccgaaaacgagagcgcugacgugugucggaauauuuccgucaacgugcucgauugcgacaccaucgggcaggccaaagaaaagauuuuucaggcuuuccugagcaaaaauggaucuccuuauggccuccagcugaacgagaucggccuugagcugcagauggggaccagacaaaaggaacugcucgauaucgacuccagcucugucauucuggaggacggaaucacaaaacuuaauaccauuggccacuacgaaaucagcaacggguccacgauuaagguguuuaagaaaaucgccaauuucacaucugauguugaguauagcgacgaucauugucaccugauucuccccgacuccgaagccuuucaggaugugcagggaaagcgccaucggggcaaacacaaguucaaagucaaggagauguaccugaccaaacuccugucuacaaagguggcuauccauagcguucuugagaagcuguuuagauccaucuggagccugcccaacucucgggcgccuuucgccauuaaauacuuuuucgacuuccucgaugcucaagccgaaaacaagaaaaucaccgacccggaugugguccacauuuggaagacaaauucccugccccuucgcuuuugggugaacauccugaaaaauccucaguucguguuugacauuaagaagacgccccacaucgaugggugccucagcguuaucgcccaggcuuucauggacgccuuuucccugaccgagcagcaacucggaaaagaagcgccuaccaacaagcugcuuuaugcuaaagacauucccacauacaaggaggaggucaaaucuuauuacaaggccaucagagaucugccuccgcugagcuccucugaaauggaggaguuccucacccaggaaagcaagaaacaugaaaaugaguuuaacgaggaaguggcccugacagagauuuauaaguacaucgugaaauauuucgacgaaauucuuaauaagcuggagcgggaacgcggccucgaggaggcucagaaacagcugcuccacgucaaggugcuguuugaugaaaagaaaaaguguaaauggauguga

SEQ ID NO: 73931 - RNA, 5778 nt, Artificial Sequence
  derived and/or modified sequence opt5 from PLXND1__Homo_sapiens__NP_055918
auggcccccagagcugccggcggggcgccucugagcgcucgggccgccgcugccucucccccucccuuccagacacccccucgcugccccgugccucuccugcuucugcuccugcuuggagcugccagagcgggcgcccuggagauccaacggcgcuucccgucccccacaccuacgaacaauuucgcucucgacggggccgcuggaaccgucuaccuggccgcgguuaacagacuguaucagcucagcggcgccaaucugucccuugaagcugaggccgcuguggggcccgugccugacucuccccugugucacgccccgcagcucccucaggccagcugcgaacacccccggcgccugaccgacaacuacaauaagauucuucaacuggauccuggacagggccucgucgugguuuguggcuccaucuaucagggguuuugccagcugagacggcgcggaaacauuucugcuguggcggucagauuuccgcccgccgcuccuccggccgagcccgugaccguuuuuccuagcaugcugaauguggccgcuaaccaccccaaugccuccacagucggccucgugcugccucccgcggcuggggccggaggcagccggcuucuggugggggccaccuacacaggauauggaucuagcuucuuuccgcgcaacagaagccucgaagaccaucgguucgagaauaccccugagaucgcuauucgcucucuggauacgagaggcgaccuugccaagcuguuuaccuucgaucucaaccccuccgacgauaauauccugaagaucaaacaaggggcuaaggaacagcacaaacugggauuugucagcgccuuccuccauccuucugaucccccucccggcgcgcaguccuacgccuaucuggcucuuaacagcgaggcccgggcuggggauaaggaaucccaggccagaucucugcucgcgcgcauuugucugccgcacggagccggcggggacgcuaagaaacuuacagagagcuacauccaacugggacuccagugcgccggcggcgcugggcggggagaucuguacuccagacugguuagcguguuuccugcccgcgagcggcuguucgccguguucgaaagaccccagggcucucccgcugcgcgcgccgcuccugccgcccugugugcuuuucgguucgccgacgucagagcggcuauucgcgccgcccggaccgcuugcuuuguggagccggcccccgacguuguggcgguccuugauuccgugguucaagggacaggaccugcuugugaaagaaagcugaauauccagcuccagcccgagcagcuggacugcggcgccgcccaucugcagcauccucuuagcauucuccagccccugaaagcuaccccuguguuccgcgcccccgggcugacgucugucgcuguggccagcgucaacaacuauacagcgguguuucucggcaccguuaauggacggcugcuuaagaucaaccugaaugaauccaugcaaguggucucuagacgggugguuacaguggccuacggcgagccgguccaccaugugaugcaguucgauccugcugacagcggguaucucuaccugaugaccucccaccaaauggcccgcgugaaaguugcugccuguaacguccacucuaccugcggagauugcgugggcgccgcugacgcguauuguggguggugcgcccuggagacaagauguacgcuucagcaggauugcaccaauuccucccagcaacauuuuuggacaagcgcuucugaaggacccucccgguguccugccaugaccgugcuccccagcgagauugacgucagacaggaauacccgggcaugauccugcagaucuccgggucucugccuagccucuccggcauggagauggccugcgauuauggaaacaauauucgcacaguggcucggguucccggcccugccuucgggcaccagaucgcguacuguaaccugcuucccagagaccaauuucccccuuucccgcccaaucaggaucaugugaccgucgaaaugucugugcgcguuaacggaagaaauauugugaaggcuaacuuuacgaucuacgacugcagccggacagcccaggucuauccucacaccgccuguaccuccugccugagcgcucaauggcccuguuucuggugcucucagcagcauuccugcgugagcaaucagucucgcugugaggccuccccuaaccccacaagcccucaagacugcccgagaacccuccugucuccccuggcgccuguucccacaggcgggagccagaauauucuugugccucucgcuaacacggccuuuuuccagggagccgcucuggaguguuccuucggccuggaagagaucuuugaagccgucugggugaacgagagcgugguccggugcgaucagguugugcuccacaccacacgcaagucucaaguguucccccugucccuucagcugaaagggagaccggcucgguuucucgacagcccugaacccaugaccgucaugguguacaauugugccaugggcucccccgauugcucucagugucugggacgcgaggaccugggccaccuuugcauguggagcgauggguguagacuccggggaccucugcagcccauggcgggcacaugcccugccccggagauccgcgcuauugaaccccuguccgggccucucgacggaggcacccugcuuacgaucagagggcggaaccugggcagacgccucucugauguugcccauggaguguggauuggcggggucgcuugugagccccugccugaccgguauaccgugagcgaagagaucguuugcgugacaggacccgccccgggcccucuguccggggucgugaccguuaaugccucuaaggagggaaaaagcagagaucgcuucuccuacgugcuuccccugguccacagccucgaaccuacaaugggccccaaggcuggcgggacccggauuacgauccauggaaacgaccugcacgugggcucugagcuccaagugcuggucaaugauacagacccuugcaccgaacuuaugagaacagauaccuccaucgcguguaccaugcccgagggggcccugccggcuccuguucccgugugcgugcgcuuugaacggagaggauguguccacggcaaccucacauucugguauaugcagaaucccgugauuacggccaucagcccucgccggucuccgguuuccgggggaagaaccauuacaguggccggcgagcgguuucauaugguccagaacgugagcauggcuguucaccauaucggccgcgagcccacccugugcaaagugcucaauucuacacuuauuaccuguccuucccccggggcccugagcaacgcguccgcuccugucgacuucuuuaucaauggcagagccuacgccgacgaaguggcugucgccgaggaacuccuggaucccgaggaagcgcaacggggcagccgcuucagacucgacuaucugccuaacccgcaguuuucuacggccaagcgggagaaauggauuaagcaccaucccggggagccucuuacacuggugauccacaaggaacaggauagccucggacugcagucccacgaguacagaguuaaaaucggccaagugucuugcgacauucagaucgucagcgaucgcauuauccauuguuccgugaaugaaucucugggggcugccguuggacagcuucccauuaccauccaggugggcaacuucaaucaaaccaucgcuacacugcagcucggcgggagcgagaccgccauuaucgucuccauugugaucugcucugugcugcuccugcuuagcguugucgcucuguuuguguucuguacaaagucccggagagccgaacgcuacuggcagaaaacgcugcuccagauggaggagauggaaagccaaauucgggaggaaaucagaaagggauucgcggagcugcagaccgacaugacagaucuuaccaaagagcugaaccgcucucagggcaucccuuuucucgaauauaagcacuucgugacacggaccuuuuuccccaagugcuccagccuguacgaggaaagauauguccucccgucucagacgcugaacucccaagggagcucccaggcccaggagacccauccucuucugggagaauggaaaauucccgagucuugucgccccaauauggaggaaggcaucagccuguuuuccagccuccugaacaauaagcacuuccuuauuguguuuguucaugcucuggagcaacagaaagacuucgccgugagagaucggugcucucucgcuucccugcucacaaucgcccugcacgggaaacuugaauacuauaccagcauuaugaaagagcugcuggucgaccucaucgaugccucugcugcgaagaacccuaagcugaugcuucgcagaacagaaagcgugguugagaaaaugcugaccaauuggauguccaucugcauguacucuugucuccgggagacagugggagaacccuuuuuccugcuccugugcgccauuaagcagcagaucaacaaaggcagcauugacgcuaucaccggcaaggcccgcuauacgcuuaaugaggaauggcugcugagagagaacauugaagccaaaccucggaaucucaacgucuccuuucaaggguguggaauggauucucugagcgugagagcuauggacacagacacccuuacccagguuaaggagaagauccuggaggccuucugcaaaaaugugccguacucccaguggccccgcgcggaagaugucgaccucgagugguucgccagcucuacacaguccuacauucugcgggaucuggacgauaccagcgugguggaagacggcagaaagaaacucaacacgcuugcucacuauaagaucccugagggggccucccuggcuaugucucugaucgauaaaaaggacaauacacucggacgcgucaaagaucuggacaccgagaaguacuuucaucuuguucugcccacagaugaacucgccgagccuaagaaaagccaccggcaaucccauagaaagaaagugcugcccgaaauuuaucugacccggcuccuuucuacaaagggcacccugcagaaauuccuggacgaccucuuuaaggcgauccugagcauucgcgaggauaagccgccucuugccgugaaauacuucuuugacuuccuggaggaacaggcugagaagagagggaucuccgaucccgacacgcuccacauuuggaaaaccaacagccugccucugcgguuuugggucaauauccucaagaacccccaguucguguuugauaucgacaaaacagaucacauugacgccugucuuucuguuaucgcucaagccuucauugaugcuugcuccaucagcgaccugcagcugggaaaggauucuccuaccaacaagcuccuguaugccaaagaaauucccgaguaccgcaagaucgugcagagauauuacaaacaaauccaggacaugacaccgcuuuccgaacaggagaugaaugcgcaucuggccgaagagagccggaaguaccagaacgaguuuaauaccaacgucgcuauggccgaaauuuauaaauacgcuaagcgcuauagaccucaaaucauggccgcccucgaggcgaaucccacggcucggcgcacacagcugcagcacaaguucgaacaggugguugcccugauggaggauaacauuuacgaauguuauucugaggcuuga

SEQ ID NO: 73932 - RNA, 1509 nt, Artificial Sequence
  derived and/or modified sequence opt5 from PM20D1__Homo_sapiens__NP_689704
auggcccagagaugcguguguguccuggcucucguugccaugcugcuucugguguuccccaccgugagccgguccaugggcccucgcucuggggagcaccaaagagcgagccggaucccgucccaguuuucuaaggaggagcgcgucgcuaugaaagaagcccucaagggagccauucagauccccacagugacguucagcuccgagaaaucuaacaccacagcucuggccgaauuuggcaaguacauucauaaaguuuucccuaccguggucagcacauccuuuauccagcacgaggugguugaggaauauagccaucuuuucaccauucaagggucugaccccucccugcagccuuaccuccugauggcucacuuugaugugguccccgccccugaggaaggaugggaggugccgcccuucagcggccuggagagagacgggaucaucuauggacggggcacacucgaugacaaaaauucugugauggcgcugcuucaggcccuggaacuccugcuuauucgcaaguacaucccuagacgguccuuuuucauuagccugggccaugaugaggaaucuuccgggaccggagcucagcgcaucagcgcccuccugcaauccagaggcguccagcuggcuuuuauuguugacgaagggggauucauccucgaugacuuuauucccaacuucaaaaagccuaucgcccugaucgcggugucugaaaaaggcagcaugaaucuuaugcuccaggugaacaugacguccgggcacagcucugcucccccgaaggagaccuccauuggaauccuggccgccgcugucagccggcuggagcagacaccuaugcccauuaucuucggcucuggcaccgugguuacagugcuucaacagcuggccaaugaauuuccuuuccccgucaacauuauccucagcaaucccuggcuguuugagccucugaucucccgcuucauggaaagaaacccgcucaccaaugccauuauccggacgacaaccgcucugacaauuuuuaaagcgggggugaaguucaacguuauucccccuguggcccaggcuaccgucaauuuucgcauccaccccggacaaaccgugcaggagguccuugaacugacaaagaacaucguggccgauaauagaguucaguuccaugugcucucugccuuugacccucugcccgucagcccguccgaugacaaagcucuuggcuaucagcugcuccggcaaacggugcagagcguuuucccugaggugaacaucaccgcccccgucacaucuauugggaauaccgauuccagauuuuucacaaaccugaccacgggaaucuaccgcuuuuauccuauuuacauccagcccgaggacuucaagcggauucacggcgugaacgaaaagaucagcgugcaggcguacgagacacaaguuaaguucauuuuugaacugauccagaaugcugacaccgaucaggagccugucucucaucuccacaaacuguga

SEQ ID NO: 73933 - RNA, 165 nt, Artificial Sequence
  derived and/or modified sequence opt5 from PMAIP1__Homo_sapiens__NP_066950
augcccggcaagaaagccagaaagaacgcucagccuagcccggcccgggcgcccgcugagcuggaaguggagugcgccacccaacuccgcagauucggggacaaacugaauuuucggcagaaacuucugaaccucaucuccaagcuguucuguucuggaacauga

SEQ ID NO: 73934 - RNA, 498 nt, Artificial Sequence
  derived and/or modified sequence opt5 from PMCH__Homo_sapiens__NP_002665
auggccaagaugaaccugagcuccuacauccucauucugaccuucucucuuuuuagccagggcauccugcucuccgcuucuaaaagcauuagaaaucuggacgaugacaugguguucaacacauuucggcuugggaagggauuccaaaaagaggauacggccgaaaaguccgucaucgcgcccucucuggagcaguauaaaaaugacgaaagcuccuuuaugaacgaggaagagaauaagguuagcaagaacaccggcucuaaacacaauuuccucaaccaugggcugccucugaaucucgcuauuaagccguaccuggcccuuaaaggauccguggccuuucccgcugagaacggcgugcagaauacagaaagcacccaggagaagcgcgaaaucggggaugaggagaacucugccaaauucccuaucggaagacgggacuuugauaugcugcgcugcaugcucggcagagucuaucggcccuguuggcaaguguga

SEQ ID NO: 73935 - RNA, 1728 nt, Artificial Sequence
  derived and/or modified sequence opt5 from PMEL__Homo_sapiens__NP_001186982
auggaccuggugcucaagagaugccugcuucaccuggccgucaucggcgcucuccuggccguuggggcgaccaaaggaagccagguguggggcgggcaacccguguacccucaggagacagaugacgcuuguauuuucccggauggaggccccugcccuuccgggucuuggagccagaagcgguccuuugucuauguguggaaaacguggggacaguacuggcaaguucuuggcggccccgugucugggcugagcaucggaaccggccgcgccaugcucgggacacauaccauggaagucacaguguaucacagacggggaucccgcucuuacguuccucuggcccauagcuccagcgcuuucaccauuacagaccaggugcccuuuucugucuccgugagccagcugagagcccucgauggcgggaacaagcacuuccugcggaaucagccucuuaccuuugcucugcaacuccaugacccgucuggauaucuggccgaggcggaucuuuccuacacgugggacuucggcgauagcucuggcacccugaucucccgcgcccucguggucacacacaccuaucuggaacccgggccuguuacagcucagguggugcugcaggccgcuauuccccucaccagcuguggauccucuccuguccccggcacgacagacgggcacagaccgaccgccgaggcgccuaacacaaccgccggacaggugcccaccacagaaguugugggcacgaccccugggcaagcucccacagccgagcccagcggaaccacauccguccaggugccuaccacggagguuaucagcacagcuccggugcagaugcccaccgccgaaucuaccggcaugacaccugagaaaguccccguguccgaagucaugggcaccacacuggccgagaugagcacgccugaggcuaccgggaugacacccgcggaagugucuaucguugugcuuagcggaaccacagccgcucaagucaccacgaccgaguggguggaaacaaccgcccgggagcugccgauuccugaacccgagggcccugaugccuccucuaucaugagcacagaguccauuaccgggagccucggaccccugcuugacggcacggcuacacugcgccucguuaagagacaggugccucuggauugcguccuguaccgguacgggucuuuuuccgugacccucgacaucgugcagggcauugaaagcgccgagauccugcaggcgguucccucuggagaaggcgacgcuuucgagcuuacagucuccugucaagggggacugccgaaggaagccugcauggagauuagcuccccuggcugucagccucccgcccagcgccucugccagcccgugcugccgucucccgcuugucaacuugugcugcaucagauccucaaagggggaagcggcaccuauugccugaaugucucccuggccgauaccaacucucucgcugugguuagcacacagcugaucaugccugggcaggaggccggccuuggacaagugccccugauugucggcauccuccuggugcugauggcgguugugcuugccucccucauuuacagacggcgccugaugaagcaggacuuuagcgucccucagcugccccacucuuccagccauuggcucagacugccucggaucuucuguucuugccccauuggggaaaauuccccgcuucugagcggacagcaaguguga

SEQ ID NO: 73936 - RNA, 780 nt, Artificial Sequence
  derived and/or modified sequence opt5 from PMEPA1__Homo_sapiens__NP_001242905
augcccgccaucccugcucacggcgccgagcuggaguucgugcagauuaucauuaucgucguugugaugauggugauggucgugguuauuaccugccuccugagccauuacaagcuguccgcgagaucuuuuaucagccggcacucccaagggcgcagacgggaggacgcucugucuagcgaaggaugucucuggccguccgagucuacagugagcggcaacgggauccccgaaccucaggucuaugcucccccucgccccacggauagacuggccgugccuccguucgcccagcgggagcgcuuucauagauuccagcccaccuacccuuaucuucaacacgagauugaccugcccccuacaaucucccucagcgauggagaagaacccccgccuuaccagggccccugcacccugcagcugcgggacccugaacagcaacucgagcugaaucgcgagucuguuagagccccucccaaccggacaauuuuugauuccgaccuuauggauagcgcucgccuugggggacccuguccgcccucuuccaauagcggcaucucugccacaugcuauggcuccgggggaagaauggaaggcccucccccuaccuacagcgaggugauugggcauuaucccggauccucuuuccagcaccagcagagcuccggcccgccuagccuccuggaagggacccggcuucaccauacgcacaucgcgccccuggagucugccgcuauuugguccaaagaaaaggacaaacaaaagggacauccucucuga

SEQ ID NO: 73937 - RNA, 663 nt, Artificial Sequence
  derived and/or modified sequence opt5 from PMF1-BGLAP__Homo_sapiens__NP_001186590
auggccgaggcuagcuccgccaaccugggcucugggugcgaagagaagagacacgaaggaagcuccucugagagcgugcccccuggcaccacaaucucccgggucaaacuccuggacacgaugguugauaccuuccuucagaagcugguggcggcugggucuuaccaacgcuuuacagacuguuauaaaugcuucuaccagcuccagccggccaugacccagcaaauuuaugauaaguuuaucgcccagcugcagacaagcauuagagaagagaucuccgacauuaaagaggaaggaaaucuugaggcugugcugaacgcccucgauaagaucgucgaagagggcaaggugcggaaagagcccgcuuguaaugggaccccuugcggagccaugugucgcaacagacggccccgcacaagcucuuggcagaugccuuccuggcaaggcggcgggagauggcggagcugcucuuaccgcuccagacccagcucucggccuggacgcugugaagcgcagagaugccggguucagcagcgcuguucccugugcgugcaagccggcgggcagagaggaagcgaggaaacccaggcucugccggucuccauggccggcucucccagcccucuccccggguccccuggagcucaagagggcggcguguga

SEQ ID NO: 73938 - RNA, 543 nt, Artificial Sequence
  derived and/or modified sequence opt5 from PMF1__Homo_sapiens__NP_001186582
auggccgaggcuagcuccgccaaccugggcucugggugcgaagagaagagacacgaaggaagcuccucugagagcgugcccccuggcaccacaaucucccgggucaaacuccuggacacgaugguugauaccuuccuucagaagcugguggcggcugggucuuaccaacgcuuuacagacuguuauaaaugcuucuaccagcuccagccggccaugacccagcaaauuuaugauaaguuuaucgcccagcugcagacaagcauuagagaagagaucuccgacauuaaagaggaaggaaaucuugaggcugugcugaacgcccucgauaagaucgucgaagagggcaaggugcggaaagagcccgcuuguaaugggaccccuugcggagccaugugucgcaacagacggccccgcacaagcucuuggcagaugccuuccuggcaaggcggcgggagauggcggagcugcucuuaccgcuccagacccagcucucggccuggacgccuguauaccgaaaauagaggcuccuggcugcucuguuga

SEQ ID NO: 73939 - RNA, 1902 nt, Artificial Sequence
  derived and/or modified sequence opt5 from PML__Homo_sapiens__NP_002666
auggagcccgccccugcuagaagcccgcggccccagcaagacccugcccgcccccaggaaccuaccaugcccccuccggagacacccuccgaaggcagacagccuucucccagcccuucccccacggagcgggcgccggcuucugaagaggaguuccaguuucugcgcugccaacagugucaggccgaagccaagugcccuaaacuccugcccugucuucacacccugugcagcgggugucucgaggcuuccggaaugcagugcccuaucugucaagcccccuggccccugggcgcugauaccccugcccuugacaacguguucuuugaaucucugcagagacggcucagcgucuaccgccagauuguugaugcgcaggccgugugcacaagauguaaggaguccgcugacuucuggugcuuugagugugaacaacugcugugcgccaaaugcuucgaggcucaucagugguuucucaagcacgaagcccggccgcuggcggagcuucgcaaucagagcgugagagaauuucuggaugggacacggaaaaccaacaauaucuuuuguucuaaccccaaucaucgcacaccuacccucacguccauuuauugcagaggauguagcaagccccugugcuguucuugcgcccuucuggacuccagccacucugagcucaagugugauaucuccgcugagauucaacagcggcaggaggagcuggacgccaugacccaggcucugcaagaacaggauagcgccuucggcgccguccaugcucagaugcacgcggccguggggcagcucggacgcgcuagagccgagacagaggaacugauccgggagagaguucgccaaguggucgcccacgugcgggcucaggaaagagagcuucuggaagccguugacgcgcgcuaccagcgggauuaugaggaaauggcuuccagacucggccgccuggacgccgugcuucagcggaucagaaccggcucugcccugguccaacgcaugaaaugcuacgcuagcgaucaggaggugcucgacaugcauggguuucugcggcaggcccuguguagacuccgccaggaggaaccucaaucccugcaggcugccgugcggacagacggauucgaugaguuuaaggucagacuucaggaccugagcucuugcauuacccaaggcaaagaugcggccguuuccaagaaagcuagccccgaagccgcuucuacgccgcgggacccuaucgauguggaccuccccgaggaggccgaacgcgugaaggcgcagguccaggcccuggggcuugcugaggcccagccuauggcugugguucaaagcgugcccggagcccacccuguccccguguaugccuucuccauuaagggcccgucuuacggggaagauguuagcaacacaaccacagcucagaaaagaaaguguucccagacccagugcccucggaaagugaucaagauggagagcgaagagggaaaagaggcgagacuggcccggucuucccccgaacaaccccgcccuagcaccucuaaggcugucuccccgccccaucucgacggcccucccagcccuagaucccccgugauuggcucugaggucuuccugccuaauagcaaccacguggccuccggggccggagaagcugaggaacgcguuguggucaucucuagcuccgaggauagcgacgccgaaaauucuuccagcagagaacuggaugacucuuccagcgagucuagcgaccuccagcuggaaggccccuccacacuucgggugcuggaugagaaccucgcggacccgcaggcugaagaucgcccucugguuuucuucgaccugaaaauugauaaugagagcggguuuucuuggggauauccccacccuuuccuuaucuga

SEQ ID NO: 73940 - RNA, 789 nt, Artificial Sequence
  derived and/or modified sequence opt5 from PMM1__Homo_sapiens__NP_002667
auggccgugaccgcucaggccgcgagacggaaggagcgcguccugugccucuucgacguugauggcacacugacgcccgcuagacagaaaaucgacccugaaguggccgccuuucuucaaaagcugcggucccgcgugcagauuggggucgugggaggcuccgauuacuguaaaaucgcugagcagcucggggacggagaugaaguuauugagaaguucgacuauguguuugccgaaaacggcaccguccaauacaaacacgggagacugcuuucuaagcagacaauccagaaucaucugggagaggagcuccugcaggaucugauuaacuucugccucagcuauauggcucugcuucggcugccgaagaaacgcggcaccuuuaucgaauuuagaaauggcaugcucaacaucucccccauugggcggucuuguacacuggaggaacgcaucgaguuuagcgagcuugacaagaaagaaaagauuagagagaaauucguggaagcccugaagaccgaguuugcgggaaagggccuccgguucucccgcgggggaaugaucucuuuugauguuuucccugaaggcugggacaaaagauacugccuggauagccuggaccaagauuccuuugacacaauucacuucuucgggaaugagaccagccccggaggcaacgacuuugagaucuucgccgauccucggacggugggccauucugucgugagcccccaggacaccgugcagcgcuguagagaaauuuucuucccugagacagcucacgaagccuga

SEQ ID NO: 73941 - RNA, 741 nt, Artificial Sequence
  derived and/or modified sequence opt5 from PMM2__Homo_sapiens__NP_000294
auggccgcucccggcccugcccugugccucuucgacguggaugggacccugacagcgccgagacagaagaucacgaaagagauggacgauuuucuucaaaagcugcggcagaaaauuaagaucggagucguuggcgggagcgacuucgaaaaagugcaggagcagcucggaaacgauguggucgaaaaguacgacuauguguuucccgagaauggccugguugcuuacaaggaugggaaacuucugugucgccaaaacauucagucccaccucggagaagcccugauccaggaccugauuaauuauugccucucuuacaucgccaagaucaaacugccuaagaaaagaggcaccuucauugaguuucggaacggcaugcuuaaugugagccccaucgggcgcuccuguucucaggaggaaagaauugaguucuaugaacuggauaagaaggagaacauccggcaaaaauuugucgcugaccuccgcaaggaguucgccggaaaaggccugacauuuagcauugggggacagaucuccuucgauguguuuccugacggcugggauaagagauacugccuucggcauguugaaaaugacggguauaaaaccauuuacuucuuuggagacaagacaaugcccggcggcaacgaucacgagaucuucaccgacccucgcacaaugggguacucugugaccgcuccggaagauacgagacggaucugugagcuccuguucagcuga

SEQ ID NO: 73942 - RNA, 483 nt, Artificial Sequence
  derived and/or modified sequence opt5 from PMP22__Homo_sapiens__NP_000295
augcugcuccugcuucugagcaucauugugcuccacgucgccguucuggugcuucuguucguguccaccaucgucucucaguggauugugggcaacgggcaugcuacagaccucuggcaaaauugcagcacguccucuagcggaaacguucaccauuguuuuuccucuagccccaaugaguggcugcaguccgugcaggccaccaugauccugagcauuaucuucucuauccucucccuguuucuuuucuuuugccagcuguucacacucaccaagggcgggagauuuuacauuacaggaaucuuccaaauucuggcgggccuuugugucaugagcgcugccgccaucuauaccgugcggcacccugaauggcaucugaacucugauuacuccuauggguuugcuuacauucucgccuggguugcuuucccgcuggcccugcucagcggagugaucuaugucauucugcgcaaaagagaguga

SEQ ID NO: 73943 - RNA, 1185 nt, Artificial Sequence
  derived and/or modified sequence opt5 from PMPCA__Homo_sapiens__NP_001269873
augaagagaaacacccugguggagcuccugacauucuggaaaaauuggcacuuucggcuucugcucgaccugacggccaagaugaaauucugccuucgcuggaaaagcaugggcgucuccguuaccgcuagacaucaggaugaagagguggaaaugacacggauggccgugcaauuugagcuggaagaccucaaccugcgccccgauccugagccgcugcucaccgagaugauccacgaagcggcuuacagagagaauacagucgggcugcaucgguucugucccaccgaaaacguggccaagauuaaucgcgagguucuucacucuuaucugagaaacuacuauacaccugaccggauggugcucgccggagucggcguggagcaugaacaccugguugauugcgcucgcaaguaccuucugggggugcagcccgccuggggaagcgcugaggccgucgacaucgauagauccguggcgcaguauaccggcgggauugccaagcucgaacgggacaugucuaaugugagccugggaccuacgcccaucccugagcugacccacauuauggucggccucgaauccuguucuuuucuggaggaggauuucaucccguuugcuguucuuaacaugaugaugggcgggggaggcagcuucuccgccgggggacccggcaaagggauguuuagccgccuguaccucaaugugcugaacagacaucacuggauguauaaugcuacaucuuaccaucacuccuacgaagacaccggacuucugugcauccacgccagcgcggauccucgccaggugcgggagauggucgaaauuaucacaaaggaguucauucucaugggcggcaccguggacacgguugaacuggagagagccaaaacacaacugaccucuaugcucaugaugaaccuggagucccggcccgugaucuuugaagaugucgggagacaggugcuugcuacacgcagccggaagcugccucaugagcucuguacccugauuagaaauguuaaacccgaagacgugaagcgcgucgccucuaagaugcuucggggaaaaccggcuguggccgcccugggcgaccucaccgaucugccuacauaugagcacauccagacggcucuguccagcaaggacgggagacucccccgcaccuaccggcuguucagauga

SEQ ID NO: 73944 - RNA, 1470 nt, Artificial Sequence
  derived and/or modified sequence opt5 from PMPCB__Homo_sapiens__NP_004270
auggccgcugccgcggcuagagugguccugagcuccgccgcccggcgcagacucuggggcuucucugagagccugcuuauccgcggggcugccggacggucccuguacuuuggcgaaaacagacuccggucuacccaggcugccacacaaguugugcugaaugugcccgagacgcgcgugaccugccuugaaagcgggcugagagucgcguccgaggacucuggacucagcacauguaccguuggccuguggauugaugccgggucccgguaugaaaacgagaagaauaacggaacagcucacuuccuggagcauauggccuuuaaaggcaccaagaaacgcagccagcucgaccuggaacuugagaucgaaaauaugggcgcucaccugaacgccuacacaucuagagagcagaccguguauuacgcgaaggccuucuccaaagaucucccucgggcugucgagauucuggccgacaucauucagaauagcacgcuuggggaagcugagaucgaacgcgagagaggagugauccugcgggaaaugcaagagguugagaccaaccuccaggaaguggucuuugauuaucugcaugccacagccuaccagaauaccgcucugggccgcacaauucucgggccgaccgagaacaucaagucuauuuccagaaaggaccugguggauuauaucacgacacacuacaaaggaccccggauugugcuugcggccgcuggcggggucagccaugacgaacugcucgaucuggccaaguuccacuuuggagacucucuuugcacccacaaaggcgagaucccugcccugcccccuuguaaguucacaggcuccgaaauuagaguucgcgaugacaaaaugccccucgcucaucuggccaucgcgguggaggcuguggggugggcccacccugauaccaucugccugauggucgccaauacccucauuggaaacugggaccggagcuuuggcgggggaaugaaucuguccucuaaacuugcucagcugacaugucauggcaaccucugccacagcuuccaauccuuuaauacgagcuacaccgacacagggcuguggggacuuuauauggugugugagucuuccaccguugccgauaugcugcacgugguccagaaggaauggaugagacucugcacaagcgugaccgagucugaaguugcucgcgcccggaaccugcugaagacgaacaugcuccugcagcuugacggcagcacaccgaucugugaggauauuggcagacagaugcugugcuacaaucgccggauccccauuccugaacucgaggcgagaaucgacgccgugaacgcugagaccauccgcgaagucuguaccaaguauauuuacaaucggucccccgccaucgcugccguggggccuauuaaacaacugcccgauuucaagcagaucagaucuaacaugugcuggcugcgcgacuga

SEQ ID NO: 73945 - RNA, 2799 nt, Artificial Sequence
  derived and/or modified sequence opt5 from PMS1__Homo_sapiens__NP_000525
augaagcagcugcccgccgcuaccgugagacuccugagcuccucucaaaucauuacaagcgucguuuccguggugaaagagcuuaucgaaaacucucuggacgccggcgcgacgagcgucgaugugaagcucgagaauuacggguucgacaaaauugaaguucgggauaacggagagggcaucaaggcuguggacgccccugucauggccaugaaauauuacaccuccaagauuaauucucacgaagaucuggagaaccuuacaaccuauggguuucgcggagaggcucugggcagcaucugcuguaucgccgaagugcucauuacaaccagaacagcugccgacaauuucuccacccaguacguucuggaugggagcggacauauccugucucagaagccgucccaccucggccagggcacgaccgugacagcgcugcggcuuuuuaaaaaccugcccguccgcaagcaauucuauagcaccgccaaaaagugcaaagacgagauuaagaagauccaggaucuccugaugucuuuugggauucuuaaaccugaccugagaaucguguucgugcauaauaaggcugucauuuggcagaaaucccggguuagcgaucacaagauggcccucaugucugugcugggaacagcugugaugaacaauauggaauccuuucaguaccauagcgaggagucccaaaucuaucugucuggcuuccuccccaaaugugacgccgaucacagcuuuaccucccugagcacgccugaacgcucuuucaucuuuauuaacuccagacccguccaccagaaggacauccuuaaacugauucggcaucacuacaaucucaagugccugaaggagagcacacgccuuuacccuguguucuuucugaaaaucgacguuccgaccgcggauguggacgucaaccucacacccgauaagucucaggugcugcugcagaauaaagaaagcguucucauugcccuggagaaccuuaugaccaccuguuaugggccucugcccuccacaaauucuuacgaaaacaacaagacggacgugagcgcugccgauaucguccucuccaaaaccgcugagacagacgugcuguucaauaaggucgagagcucuggaaagaacuauuccaauguggauaccagcguuaucccuuuccaaaacgacaugcauaaugaugaaucuggcaaaaacacagacgauugccuuaaucaccagauuuccaucggggacuuuggauacggccacuguagcuccgagauuucuaacaucgacaagaauaccaaaaacgccuuccaggauauuagcauguccaaugugucuugggaaaacagccaaacggaguauuccaagacaugcuuuaucagcucugucaaacauacccaguccgaaaauggcaacaaggaccacaucgaugagagcggggagaaugaagaggaagccggacuggagaacucuuccgaaauuagcgcugacgaguggucuagaggcaacauccucaagaauagcgugggggagaacauugaacccguuaaaauccuggugccggagaagucccugccuuguaaagucagcaauaacaauuaccccauuccugaacagaugaaccucaaugaggauucuugcaacaagaaauccaaugugaucgacaacaagagcggaaaggugaccgcguaugaucugcuuuccaaucggguuauuaaaaagcccaugucugccagcgcucuguucguccaggaccaucgcccccaauuucucaucgagaacccuaaaacaucccuggaagaugccacccugcagaucgaggaacuuuggaagacacucucugaggaagagaaacugaaguacgaggaaaaagccacgaaggaccuggagagauacaauagccagaugaagcgggcuauugaacaggagucccaaaugucucucaaagauggccgcaagaaaaucaagccgaccagcgccuggaaccuggcgcagaaacacaaacuuaagacaucccugagcaaucagcccaagcucgacgaacugcugcagucucaaauugagaagagacggucccagaacaucaaaauggugcagauuccuuucagcaugaagaaccuuaaaaucaauuuuaagaagcagaacaaaguggaucucgaggaaaaggacgagcccugucugauccauaaucugagauucccugacgcuuggcucaugaccucuaaaacagaagucaugcugcuuaaccccuaucgcguggaggaagcccugcucuuuaagcggcugcuggagaaucacaaacuuccggccgagccucucgaaaagcccauuaugcugaccgagucccuguucaacgggagccacuaccucgauguucuguauaagaugacggcugacgaucaaagauacucuggauccaccuaucuuagcgacccucgccugacagccaauggcuuuaaaaucaagcucauucccggcguguccaucaccgaaaacuaccuggagauugaggggauggcuaauugccugccuuucuauggagucgccgaucuuaaagaaauccucaacgcgauccugaaucggaacgccaaggagguguacgaaugcagaccccgcaaaguuauuagcuaccuggagggcgaagcugugcggcucucuagacagcugccgauguaucuuagcaaggaggacauccaggauauuaucuaccgcaugaaacaucaauuugggaaugagauuaaggaauguguccacggacggccuuucuuccaucaccugacauaucuccccgagaccacguga

SEQ ID NO: 73946 - RNA, 2589 nt, Artificial Sequence
  derived and/or modified sequence opt5 from PMS2__Homo_sapiens__NP_000526
auggagagagccgaaagcuccucuaccgagcccgcuaaggccaucaaaccuauugaccggaaaagcgugcaccagaucugcuccggccaagucguucugucucucagcacagcggugaaggaacugguggagaacucccuugaugcuggggccacgaauauugaccugaagcucaaagauuacggagucgaccugaucgaagugucugauaacggcugugggguugaggaggaaaauuucgagggacuuacccugaagcaucacacaagcaagauucaggaauuugccgaccucacccagguggagacauucggcuuucgcggggaggcucuguccagccugugcgcccucucugaugucaccaucuccacaugucaugcuagcgccaaagugggaaccagacugauguucgaccacaacggcaagaucauucagaaaacgccguauccccggccucgcggcaccacaguuucugugcaacagcuuuucuccacccugcccgucagacauaaggaauuucagcggaauaucaaaaaggaguacgcgaagaugguccaggugcuccacgccuauugcauuaucagcgcugggauucgcgugucuuguacaaaccaacugggacagggcaaaagacagccuguugugugcaccgggggaucccccagcaucaaggaaaauauuggcuccguguuugggcagaaacaacuucagucucugaucccuuucguccagcucccgcccagcgauuccgugugugaggaauacggacugagcugcucugacgcccugcacaaccucuuuuauaucuccggcuucauuagccaauguacgcauggcguugggcggucuagcacagaucgccaguuuuucuuuaucaauagacggccuugcgaccccgcuaaggugugucgccuggucaacgagguguaccacauguauaauagacaucaguacccuuucguugugcuuaacauuuccgucgauucugagugcguggacaucaaugucacccccgacaaacggcagauucugcuccaagaagagaagcugcuucuggccgugcucaaaacaagccugaucggaauguucgauuccgacguuaacaagcugaaugugagccagcagccgcuccuggaugucgaaggcaaccuuaucaagaugcacgcggccgaccuggagaaaccuaugguggaaaagcaggaucaaucucccucccuccgcaccggggaggagaaaaaggacguuagcauuucuagacugcgggaggcuuuuucccuuagacacaccacagaaaacaaaccucauagccccaagacgcccgaaccucgccgguccccgcugggacagaagagaggcaugcucucuagcuccaccucuggggccaucagcgauaaaggagugcugcgcccccagaaggaggcugucuccagcucucacggcccuuccgaccccacagaucgggccgaaguggagaaagacagcggccaugggucuaccuccguggauagcgagggauucucuauuccugacacaggcagccacugcuccagcgaauacgccgcuucuucccccggggacagaggaagccaggagcauguugauucccaagaaaaggcgccgaaaaccgacgauucuuuuagcgacgucgauugucacuccaaucaggaggacacgggcugcaaguuccgcgugcugccucagcccacaaaccucgccaccccuaauaccaagcgguuuaaaaaggaggaaauccugucuagcuccgauauuugucagaaacuugugaacacacaagacaugucugcuagccaggucgauguggccguuaagaucaauaaaaagguggucccccuggacuucuccaugagcucucucgccaagagaaucaaacagcugcaccaugaggcucaacaguccgaaggggagcagaacuaucgcaaguuucgggccaaaauuugcccuggcgaaaaucaggcggcugaggaugagcugagaaaggaaaucagcaaaaccauguucgccgagauggaaauuaucggacaauuuaaccuuggcuucauuaucacaaagcucaaugaggacauuuuuaucguggaucagcacgccacggacgaaaaauacaacuucgagaugcugcagcagcauaccguucugcaagggcagcgccucaucgcuccccagacacugaaucuuaccgccgugaacgaggcuguccugauugaaaaucucgagaucuuucggaagaacggauucgacuucgugauugaugaaaaugccccgguuacagagagagcgaagcugaucucucugccuaccuccaaaaacuggacguuuggcccccaggacguggaugaacuuauuuucaugcucagcgacucucccggggucaugugucggccuucccgcgugaagcaaauguuugccagcagagcuugccggaaauccgugaugaucggaaccgcccugaacacaagcgagaugaagaaacugaucacccacaugggcgagauggaucacccguggaauuguccccaugggagaccuacaaugcgccacauugcuaaccucggcgucaucucucagaauuga

SEQ ID NO: 73947 - RNA, 579 nt, Artificial Sequence
  derived and/or modified sequence opt5 from PMVK__Homo_sapiens__NP_006547
auggcuccccugggcggggccccuagacucgugcugcuuuucagcggaaagcggaaauccggcaaggacuuugucaccgaggcccugcagucucgccucggggcggauguuugcgcugugcugagacuuagcggaccgcugaaagaacaauacgcccaggagcacggccucaacuuccagcggcugcuggacacauccacguauaaggaagccuuucgcaaagauaugaucagauggggagaggaaaagcggcaggcugaccccggguucuuuugucgcaagauuguggagggcaucucucaaccuauuuggcucgucagcgauaccagacggguguccgacauccagugguuccgcgaggccuacggcgcuguuacacagaccgugagagucguggcccuggaacagucucggcaacagcgcggguggguuuuuacacccggaguggaugacgcggagagcgaaugcggccuugauaauuucggggacuuugauugggucauugagaaccauggaguggagcagagacuggaggaacagcucgaaaaucugaucgaguucauccggucccgccuuuga

SEQ ID NO: 73948 - RNA, 1281 nt, Artificial Sequence
  derived and/or modified sequence opt5 from PNCK__Homo_sapiens__NP_001034671
auggaggccgcuuucggccagguggccgggagcgcgugccccagacggggaggcgaagggcgcgacuggaaggcugagucccuggccgaucucuggccuaaaucuagcccgggagacucccacagaugguguaagggccccggggccggaccugcuggcccccaacugcgggaagccgcucgcgccucuagcggccuugggggaggcgggagacauccuucccggauccccgcgauugcccugcaggauaugcuccugcuuaaaaagcacaccgaggacaucucuagcgucuacgaaauucgcgagagacugggauccggcgcuuuuagcgagguugugcucgcccaggaacgggggucugcucaucugguggcccugaaaugcaucccuaagaaggcgcuccgcggaaaagaggcccuggucgaaaacgagauugcugugcuuagacggaucucccacccgaauaucguugcccuggaggaugugcaugaaagccccucucaccucuaucuggcuauggagcuugucacaggcggcgaacuguucgaccgcauuauggagagaggguccuacacggaaaaggaugccagccaccucgugggacagguucugggcgccgugucuuaucugcauucccucgggaucguccaccgggaccugaaaccugagaaccuucuguacgcuacccccuuugaggauagcaagauuaugguguccgacuucggacucucuaaaauccaagcgggcaauaugcuggggacagccuguggaaccccuggcuauguggcucccgaacuucuggagcagaagccguacggcaaggccgucgauguuugggcccucggggugauuagcuauauccugcugugcggauacccucccuuuuacgacgaauccgauccugaacucuucagccagauucugcgcgcuucuuaugaguuugacucccccuucugggacgauaucagcgagucugccaaagacuuuaucagacaucuucuggagcgggauccccagaagagauucacaugucaacaggcgcuccgccaccuguggauuagcggcgacaccgcuuuugaucgggacauccuuggguccgugucugaacagauucgcaaaaacuucgccagaacacacuggaagcgggccuuuaaugcuaccagcuuccugagacauauccgcaaacucggacagauuccugagggcgaaggggccuccgagcaaggcauggcucggcacagccauucuggacugagagccggccagccgcccaagugguga

SEQ ID NO: 73949 - RNA, 429 nt, Artificial Sequence
  derived and/or modified sequence opt5 from PNKD__Homo_sapiens__NP_001070867
auggccgcuguggucgccgcgaccgcucugaagggcagaggggcccggaacgcccgcguucucagaggaauccuggcuggcgccacagcuaauaaagccagccacaaccggacgcgcgcgcuucagucccauucuagccccgaggggaaggaggaaccugaaccgcugucccccgagcucgaauacauuccuagaaaacggggaaagaaucccaugaaagccgugggccuggcuugggccaucggguucccuugcggcauucuucuguuuauccucaccaagcgcgagguggacaaggauagagucaaacaaaugaaggcucggcagaacaugcgccugucuaauacaggagaguaugaaagccagagauuccgggccuccucucagagcgcgcccuccccugacgugggcagcgggguucaaaccuga

SEQ ID NO: 73950 - RNA, 1566 nt, Artificial Sequence
  derived and/or modified sequence opt5 from PNKP__Homo_sapiens__NP_009185
augggcgagguggaagcccccgggagacuguggcucgagagcccuccgggaggcgcucccccuaucuuccugcccuccgacgggcaggcccuuguccugggacggggcccucucacccaaguuacagaucgcaagugcucuagaacccagguggaacugguggcggaccccgagacgcggacagucgcugugaaacagcuugggguuaacccuagcaccacaggaacccaggaacugaagccgggccucgagggcucccugggggugggagauacacuguaccucgucaauggccugcacccccuuacccugcgcugggaggaaacgagaaccccugagucucaacccgacacaccucccgggaccccgcucgugagccaggaugaaaaacgggacgccgagcugccuaagaaacgcaugagaaaguccaaccccggaugggagaaucuugaaaagcugcucguuuuuacagccgcuggcgugaaaccucaggggaaggucgccggauucgaucuggacggcacccugauuacgacacggucuggcaaaguguuucccaccgggcccagcgauuggcgcauccucuauccugagauuccgagaaagcugcgggaacuugaggcugaaggauacaaacuggugaucuucacaaaccagauguccauuggccgcgggaagcuccccgccgaggaguuuaaggcgaaagucgaagccguuguggagaagcugggagugccuuuccaaguccuuguggcuacccaugccggccuguauagaaaacccguuaccgggaugugggaccaccuccaggaacaggcuaaugauggaacaccuaucagcaucggcgacucuauuuuugugggcgaugccgcggggcggcccgccaacugggcuccgggacgcaagaaaaaggacuucuccugugccgacagacuguuugcucugaaucucggccugccuuucgccacgcccgaggaauuuuuccuuaaauggccugccgcuggguuugagcugcccgcguucgauccucggaccgucagcagaucuggaccccucugccugccggagucccgcgcccuucugagcgcuucuccugaagugguuguggccgucggcuuccccggggccggcaaguccacauuucucaagaaacaucuggugagcgcuggauacguccacgugaaccgggacacccugggcuccuggcagagauguguuacaaccugcgagacggcccucaagcaagggaaacgcguggcgaucgauaauacaaaccccgacgcugccucucgggccagauauguccagugugcucgcgccgcuggagugccuugccgguguuuccuguuuaccgccacccuugaacaggcgagacauaauaaccgcuuccgggagaugacagauagcucccacauuccgguuagcgacauggugauguacggcuauagaaagcaauuugaagcccccacccuggcugagggguucucugccauccucgagauuccuuuucgccugugggucgaaccccggcugggaagacuuuacugccaguucuccgagggcuga

SEQ ID NO: 73951 - RNA, 1596 nt, Artificial Sequence
  derived and/or modified sequence opt5 from PNLDC1__Homo_sapiens__NP_001258791
auggacgugggcgccgaugaguucgaagagagccugccccuccugcaggaacuuguccaagaggcugacuuuguugggcuggauaucgaguucaccggacucagauccaaccugucuggcccucagcagauuagccuuuuugaccugccguccgagugguaccucaagacacggcagucugugcaacaguucacggugugccagaucgggcugagcgucuuuuccgccauugagggagaagcgaauaaauauaucgcucacucuuguaacuucuaccuguuucccaccacauucggcauucucgauagcgaguuuuccuuccaggccagcucugugcaauuucugaaucaguauggguucaacuacaauaaguuucuuaaaaacggaaucccuuauaugaaugaagaacaggagaagaaaauccgccaugacauucugaccggcaacuggagaguucgguccagccccgauaaggaccagaucaagguggucauugaugaagugacacgcuggcucgagcuggccaaagaaggcgacuggaugacccuuccugggaucacaggauuccaggcuuucgagguucagcuggugcucagacaggcccugcccaauauuuggaccguccugaaggaugaaggcgugguggucaaaaagguuucuaaacaacaccggugguaccuccagaacacguccugcgaccgcgagagcuguuggaaggagaauauccugcuuucugcuagaggguuuuccguguucuuucagaugcuggugaaggcccagaaaccucucgucggacauaacaugaugauggaucugcuucaucugcacgaaaaguucuuucggccgcuccccgagagcuaugaccaauucaaacagaauauucacucccuguuuccugugcugaucgacaccaagucuguuacaaaagauaucuggaaggaaaugaacuucccccgcgugagcaaucucuccgaggucuacgaagugcugaacagcgaccuuaacccuaccaaaaauucuggccccgagauuguucacgcguccagaugcgagaaguacguggaaacaaaguguccgcaugaggccgcuuaugaugccuuucugugcgggagcguccuccugaaaguggcucaccuucugcuccagaagaucuaccauauugacccuguccccgaaucuagcuucccucaguaucuggaugugcuggcccccuacguuaaccaagugaaucucauccgggcgggaguccccaaaauuaacuuuuccggcccugacuauccgucuaucagacccccuauccugauucuuagcgugaagcgcuggcccggcguuuccgagcaacagguguaccacaaauuccagaaucuguguaaguuugauguccggcgccucaccagaagccaauuccugcugcuuacgaacaaguucaaagacgcccggaauauccucaaggaauauagagaucacccuacacugugcauuucucuguaccgcuacuggcggcauucccccaacgugaauugucuccuucaggugugcgggaucguuaccgcuugggcccugcuggcuuuuauucucggaagaagcggcacauga

SEQ ID NO: 73952 - RNA, 1398 nt, Artificial Sequence
  derived and/or modified sequence opt5 from PNLIP__Homo_sapiens__NP_000927
augcugccccucuggacccugagccuucugcucggcgccguggcugggaaggaggucugcuacgaaagacugggauguuucuccgacgauucuccuuggagcggcaucacagagcggccgcuucacauucugcccugguccccuaaagacguuaacacgcgcuuucuccuguauaccaaugaaaaccccaauaacuuccaggagguggccgcggauucuagcuccaucucugggagcaauuuuaagacaaacagaaaaacccgguucauuauccauggauuuauugacaagggcgaagagaauuggcuggcuaacgugugcaaaaaucucuucaaggucgaguccgugaacuguaucugcguugauuggaaagggggaagccgcacaggcuacacccaagccucucagaauaucagaauugugggcgccgaagucgcuuauuuuguggaguuccugcaguccgccuuuggguacagcccuucuaacguucacgugaucggacauucccuuggcgcucacgccgcgggggaagccggacggcgcacaaauggcaccauugggagaaucacgggacuggaccccgcugagccuuguuuccagggcaccccggagcucguccggcuggaucccagcgacgccaaguuuguggaugugauucauacagacggcgcuccuaucguccccaaccuuggguucggaaugucucaaguugugggccaccuggacuuuuucccuaaugggggaguggaaaugcccggcugcaagaaaaacauucucucccagaucgucgauaucgaugggauuugggagggaacccgcgacuucgccgcguguaaccaccugagaagcuauaaguacuauacagacuccaucgugaauccggauggcuuugccggcuucccuugcgcuucuuacaacguuuuuaccgccaauaaauguuuccccugcccuagcgggggauguccccagaugggccauuacgcugaccgguaucccgggaagacgaacgaugugggacagaaguuuuaccuggacacaggcgaugccuccaauuucgcccgcuggagauauaaagucagcgugacccucucugggaagaaaguuacaggccacauucuggugucccuuuuuggaaacaagggcaauagcaaacaauacgaaaucuucaaggggacccugaaaccugacucuacccauagcaacgaguuugauuccgacgucgaugugggagaccuccagauggucaaguucauuugguauaauaacgugaucaauccgacacugccccggguuggcgcuucuaagaucauuguggaaacgaacgucgggaaacaguuuaauuucugcagcccugagaccgugcgcgaggaaguucuucugacacucacccccugcuga

SEQ ID NO: 73953 - RNA, 1413 nt, Artificial Sequence
  derived and/or modified sequence opt5 from PNLIPRP2__Homo_sapiens__NP_005387
augaugcugcccccuuggacccucggccugcuucugcucgccacagugagagggaaggaggucugcuacggacagcugggcuguuucagcgacgaaaaaccgugggcugggacgcuucaacggcccguuaagcugcucccuuggucccccgaggauaucgacacccgcuuucugcuguauacaaacgaaaauccuaacaauuuccagcucauuaccggaacagagcccgauaccaucgaagccucuaacuuucagcuggacagaaaaacacgguucauuauccacggcuuucuugauaaggcggaggacagcuggccuuccgauaugugcaaaaagauguucgagguggaaaaggugaauuguauuugcgucgacuggcgccaugggucuagagcuauguacacccaggccgugcaaaacauccggguugugggagccgagacggcuuuucugauccaggcccucagcacccagcugggcuauucccuugaagauguccacgugauuggccauucucugggggcucacacagccgcggaggccggacgcagacucggcgggcggguuggacgcaucaccggccuggacccggcugggcccuguuuccaggaugagccugaagaggugagacuggaccccagcgaugccgucuuuguggacgugauucauacagacuccagcccuaucguccccucucucggauucggcaugucccaaaaaguuggccaccuggacuuuuucccgaaugggggaaaggaaaugccuggcugcaaaaagaacgugcuuagcaccauuacggauaucgaugggauuugggagggaaucggcggguuugugucuuguaaucaucugcgguccuucgaauacuauucuagcuccguccucaaccccgacggauuccugggcuacccuugcgcuagcuaugaugaguuucaggaguccaaauguuuccccugccccgccgaaggcuguccuaagauggggcacuacgcggaccaguuuaagggaaaaacaucugccguggagcagaccuucuuucuuaauacaggcgaaagcgggaacuucaccuccuggcgcuacaagguuagcgugacccugucuggaaaagagaaggucaauggcuauaucagaauugcucucuacggguccaacgaaaauagcaaacaauaugagaucuuuaagggcucucugaaaccggaugccagccacacaugcgcuauugacguggauuucaacguuggaaagauccagaaggugaaauuucuguggaacaagcggggcauuaaucucuccgagcccaaacugggggccucucagaucacgguccaaagcggagaagacggcaccgaguacaacuucugcuccagcgauacaguggaagagaauguccuucagucucuguauccuuguuga

SEQ ID NO: 73954 - RNA, 1062 nt, Artificial Sequence
  derived and/or modified sequence opt5 from PNMA1__Homo_sapiens__NP_006020
auggccaugacccugcucgaggacuggugcagaggcauggaugugaacagccagcgggcucugcuugucugggggauccccguuaauugugacgaagccgagauugaagagacacugcaagcggcuaugccucagguguccuaccgcaugcucggaagaauguucuggcgggaagagaacgccaaggccgcucugcuugagcugacgggcgccguggauuaugcugccaucccgcgcgaaaugcccgggaaaggaggcgucuggaaggugcucuuuaaaccucccaccucugacgcggaguuccuggaaagacugcaccucuuucuggcccgggagggguggacaguucaggauguggcucgcguccuuggauuccagaauccuacccccacaccuggcccggagaugcccgccgaaaugcugaacuacauucucgacaaugugauccaaccucugguugagagcauuugguauaagagacuuacccuguuuuccggccgggauauccccgggccuggagaagagacauucgaccccuggcucgaacauaccaacgaggugcuggaggaauggcaggucucugauguggagaaacgcagacggcugauggaaagccuccgcggcccggcugccgacgugauccggauucugaaguccaauaacccugcgaucacgaccgccgagugccuuaaggcucuggaacaggucuuugggucuguugagagcuccagagaugcccagauuaaauuccucaauacauaccaaaaccccggagagaagcugagcgcuuaugugauccgccuugaaccucugcuccagaaaguggucgagaagggcgccauugacaaagauaaugugaaccaggccagacuggaacagguuaucgcuggggcgaaucacucuggagccauucggagacaacuguggcucaccggcgcuggcgaggggcccgcccccaaccuguuucagcuucuggugcagauccgcgaagaggaggccaaggaagaggaagaggaggcugaagccacacuccugcaacuuggacuggagggccauuucuga

SEQ ID NO: 73955 - RNA, 1095 nt, Artificial Sequence
  derived and/or modified sequence opt5 from PNMA2__Homo_sapiens__NP_009188
auggcccuggcucuccuggaggacuggugcagaaucaugagcguggaugaacagaagucccuuauggucaccggcauucccgccgacuucgaggaagcggagauccaagaaguucugcaggagacacucaaaucucuggggcgguaccgccuucugggaaagauuuuuagaaaacaggagaacgcuaaugccgugcuccuggaacugcucgaggauacggacgugagcgccaucccuuccgaaguccagggcaaagggggaguguggaagguuauuuucaagaccccgaaccaagauacagaguuucuggagcggcuuaaucuguuccucgaaaaggagggccagaccgugucugggauguuucgcgcucugggacaggaaggcgucagccccgccacagugccuuguaucucccccgagcuucuggcucaccuccugggccaggccauggcgcaugccccucaaccccugcucccuaugagauaucggaaacugcgcguuuucucugggagcgcugugccggcccccgaagaggaguccuuugaagucuggcuugagcaggcuaccgaaaucgugaaggaguggccugugacagaagccgagaaaaagagauggcuggcggagagccuccggggacccgcccuggaccuuaugcacauuguccaggcugauaacccuucuaucuccguugaagagugccuggaagccuucaaacagguguuuggcagccucgagucucgcagaaccgcucaagugcgguaccugaagacguaucaggaagagggggagaaggucuccgccuacgugcugcgccucgaaacccugcuuagacgggccguugagaaacgcgcuauucccagacggaucgcggaccaggugagacuggaacaagucauggccggagcuacacucaaucagaugcuguggugucgccuucgggagcugaaggaucagggcccgccucccagcuuccucgagcugaugaaagugauuagagaagaggaagaggaagaggccucuuuugagaacgaauccaucgaggaaccugaggaacgcgacggguauggacgguggaaucaugagggcgaugacuga

SEQ ID NO: 73956 - RNA, 849 nt, Artificial Sequence
  derived and/or modified sequence opt5 from PNMT__Homo_sapiens__NP_002677
augagcggcgccgacagaucccccaacgcuggggccgcgccugauucugcuccgggacaggccgccguggcuagcgccuaccaacgguucgagccccgcgcuuaucugagaaauaacuacgccccuccccggggcgaccucugcaauccuaacggggucggacccuggaagcugcgcugucuugcgcagaccuuugccacaggcgaaguuuccgggagaacgcugaucgauauuggaucuggcccuaccguguaucagcuccugagcgcuugcucccacuucgaggacaucacaaugaccgauuuucuugaagugaaucggcaggagcugggccgcuggcuccaagaggaaccgggggccuucaacuggucuauguacagccagcaugcuugucugauugagggaaaaggcgaaugcuggcaggacaaggagagacagcugcgggcccgcgucaaaagagugcuccccaucgauguucaccaaccucagccccugggggcgggauccccugcuccccuuccggccgacgcccuggugagcgcuuuuugucucgaagccgucucuccugaucuggccuccuuccagcgggcucuugaccauauuacaacccugcuccgccccggcgggcaucugcugcucaucggagcgcuggaggagagcugguaucuugccggcgaagcuagacugacagugguuccugugucugaggaagagguccgggaagcccucgugcgcuccggcuacaaggugagagaucugcggaccuauaucaugcccgcccaccuucagacgggggucgacgauguuaaaggaguguuuuucgcuugggcccaaaaggugggccuguga

SEQ ID NO: 73957 - RNA, 2154 nt, Artificial Sequence
  derived and/or modified sequence opt5 from PNN__Homo_sapiens__NP_002678
auggccguggcugucagaacccugcaggagcaacucgaaaaggccaaagagagccugaagaacguugacgaaaauauccggaaacuuacaggccgcgaucccaacgacgugagaccuauucaggcgcggcugcucgcucuguccgggccgggaggcgggcgcggaagaggcucucuucugcuccggcgcggguucagcgauuccggaggcgggcccccugccaagcagagagaccuggagggcgccgugucucggcugggaggcgaacgcagaacgcggcgcgagagcagacaggaguccgaucccgaagacgaugacgucaaaaagccugcucuccaaucuagcgugguugccaccuccaaggagcggacacgcagagaucugauccaggaccagaauauggaugaaaaagggaagcagcggaacagacgcauuuuuggacuucugaugggcacccuccaaaaauucaagcaggagagcacaguggcuaccgagcggcagaaaagacgccaggaaaucgagcaaaagcuggaaguccaggccgaggaggaacggaaacagguggagaaugaaagacgcgagcuuuuugaggaacggagagcgaagcaaacagaacugcgccuccuggagcagaagguugagcuggcccagcuccaggaagaguggaacgaacacaaugcuaaaauuaucaaguacauccggaccaaaacgaagccccaucuguucuauauuccugggagaaugugcccggccacccaaaaacuuaucgaggaaucucagcgcaagaugaacgcucuguuugagggacggagaauugaguucgccgaacagaucaauaagauggaggcgcggccccgcagacaguccaugaaagaaaaggagcaccaagugguccggaacgaggaacagaaagccgagcaggaagagggcaagguggcucagagagaagaggagcucgaagagacaggcaaucaacauaacgacguggaaauugaggaagccggggaggaggaagagaaagaaaucgcuauuguccacagcgaugccgagaaggaacaggaggaggaggaacagaagcaggaaauggagguuaaaauggaggaagagaccgaagugcgcgagucugaaaagcaacaggacucccagccugaggaggugauggacguccuggaaaugguggagaauguuaaacaugugaucgccgaucaagaagucauggagacaaaccggguggaaagcguugagcccucugagaaugaagcuagcaaggagcuugaaccugagauggaauuugagaucgagcccgacaaagaauguaagagccuguccccgggaaaggagaacgugucugcgcucgauauggaaaaagagagcgaggaaaaggaggaaaaagaguccgaaccucagcccgagccugucgcccagccccagccccaaagccagccucagcugcagcugcaaucucagucccagccggugcuccagagccaacccccuucucagcccgaggaccugagccuugcuguccugcagccuacgccccaagugacccaggaacagggccaccuccugccggagagaaaggauuucccuguugaauccgugaaacuuacagagguccccguggaaccuguucugaccgugcaccccgagucuaagagcaagacaaaaacccgcuccagaagccgggggcgcgccagaaacaagaccucuaaaucccggagccgcagcuccagcuccucuagcuccucuagcuccagcacaucuuccagcucuggauccagcucuagcuccggcuccucuuccagcagauccucuagcuccucuagcuccucuacgagcggguccagcucucgggacuccucuucuuccaccucuagcuccagcgagucccgcagcagaucucggggacgcggccauaauagagaucggaagcacagacgcagcgucgaccggaaaagacgcgauacauccggccucgaacggucucauaagagcuccaaagggggaucuagcagagacaccaagggcuccaaggauaaaaacucucgcagcgaccggaagagauccauuagcgagucuucccgcagcgggaaacggucuuccagaagcgaacgggaccgcaaguccgauagaaaagacaagcggcgcuga

SEQ ID NO: 73958 - RNA, 759 nt, Artificial Sequence
  derived and/or modified sequence opt5 from PNO1__Homo_sapiens__NP_064528
auggagagcgaaauggagacccaguccgccagagcugaagagggcuucacacaagugacgcggaaagggggacgcagagccaaaaagcggcaggcggaacagcugucugcugccggcgaagggggagacgccggccgcauggauaccgaggaggcuagacccgccaaacggccugucuuuccgccccucugcggggacggacugcuuagcggcaaggaggaaacacgcaaaaucccuguucccgcuaacagauacaccccucugaaggagaauuggaugaagauuuucacacccaucguggagcaccucggccugcagauucgguuuaaccuuaaaucccgcaauguggaaaucagaaccuguaaggagacaaaagaugucucugcccugaccaaggcggccgacuucgugaaggcuuuuauucucggguuccaaguugaagaugcccuggcucugauccggcucgacgaucuguuucuugagagcuucgaaaucacggacgugaagccucugaagggagaucaucucucccgcgccauuggcagaaucgcggggaaaggaggcaagaccaaauuuacaauugagaacgucacccggacacgcaucgugcuggccgacguuaaggugcacauucuugggucuuuccagaauaucaaaauggcuagaaccgccauuugcaaccugauccucggaaauccgcccagcaaggucuauggcaacauccgggcuguggccuccagaagcgccgaucgcuuuuga

SEQ ID NO: 73959 - RNA, 531 nt, Artificial Sequence
  derived and/or modified sequence opt5 from PNOC__Homo_sapiens__NP_006219
augaaggugcugcucugcgaccugcuucugcucagccuguucuccucugucuuuagcuccugucagagagauugccuuaccugucaagagaaacugcaccccgcccucgacucuuucgaucuggaaguuugcauccuggagugugaagagaagguguuuccuagcccgcucuggacacccugcacgaaagugauggcucgguccucuuggcagcugagcccugccgcgcccgaacaugucgcugccgcccuuuaccagccucgcgcuuccgagaugcagcaccugagacggaugccccgcgugagaagccucuuccaagagcaggaagaaccugaaccgggcauggaggaggccggggaaauggagcagaagcagcugcaaaaacgguuuggaggcuucaccggggcucgcaagucugccagaaaacuugcgaaccagaagcgguuuuccgaguucaugcgccaguaucugguucucagcaugcagucuucccaaagacggcgcacacugcaucagaauggaaacguguga

SEQ ID NO: 73960 - RNA, 870 nt, Artificial Sequence
  derived and/or modified sequence opt5 from PNP__Homo_sapiens__NP_000261
auggagaacggcuacaccuaugaagacuacaagaauacagccgaguggcugcucagccacacgaaacauagaccccagguggcuaucauuugcggguccggacugggcgggcuuaccgauaagcugacacaagcccagaucuucgacuauggagaaauuccuaacuuuccgcggucuaccguccccggccacgcggggcgccucguuuucggauuucugaauggcagagcuugugugaugaugcagggccgguuccauauguacgagggguauccucuuuggaaagugacauuucccguccgcguguuccaccuucucggaguugauacccugguggucacaaacgccgccggcgggcugaauccuaaguuugaagugggagacaucaugcucauuagagaucauaucaaccugcccggcuucagcgggcagaauccucuucggggaccgaacgacgagcgcuuuggcgauagauuccccgcuauguccgacgccuacgaucggaccaugcgccaaagagcucugucuacguggaaacagaugggcgagcagcgggaacuccaggaggggaccuauguuaugguggccggaccuagcuuugaaacagucgcggagugccgcgugcugcaaaagcugggcgccgacgcuguggggauguccaccguccccgagguuaucguggccagacacuguggacugcggguguucggcuuuucucucauuacaaauaaggucaucauggauuacgaaagccuggagaaagcuaaccacgaagaggugcuggccgcggggaagcaggccgcucagaaacucgaacaguucguuuccauucugauggccagcaucccucuucccgacaaggcuucuuga

SEQ ID NO: 73961 - RNA, 1341 nt, Artificial Sequence
  derived and/or modified sequence opt5 from PNPLA1__Homo_sapiens__NP_001139188
auggugcagaugaugagacaauuccuguaccggguccuccccgaggacagcuauaagguuaccacaggcaaacugcacgugucccuuacgcgccugaccgauggggaaaacguggucgugucugaguuuacaagcaaggaagaacucaucgaagcccuguacugcuccuguuucguuccuguguauugcggacuuauuccgcccaccuacagaggcgucugggcuuuucugacacucccuccccagcgguauaucgacgggggauucaccggcaugcagccuugugccuuuuggacagaugcgauuaccaucucuacguucagcgggcagcaagacauuugcccccgcgauuguccugcuaucuuucaugacuucagaauguuuaauugcuccuuccaguuuucucuggagaacaucgcccggaugacccacgcccuguucccgcccgaucucgugauucugcaugacuacuauuaccgcggauacgaggaugcuguucuuuaucugagacggcucaaugccguguaccugaacagcuccagcaaacgcgucaucuuuccuagaguggaaguguauugucagauugagcuugcucugggcaaugaaugccccgagcggucucagccuucccuccgcgccagacaagcgagccuggagggcgccacacagccccacaaggaaugggucccgaaaggggacggacggggcucucaugggccucccguuucccagccugugcagacccuggaguucacaugugaaagccccgugucugcucccgucuccccucucgagcaaccgcccgcccagccucuggcuagcuccacgccccuuucucugagcggaaugccucccguguccuucccggccguucacaagccucccagcucuaccccuggcuccagccuccccacaccucccccggggcugucuccucuuagcccccagcaacaggugcagcccuccggaucuccugcgcgcagccugcacucccaggccccgaccagccccagaccuucucucggccccuccacagucggcgcuccucaaacccugccccggagcucucuguccgccuuuccugcucagcccccgguggaggagcucgggcaggagcagccucaagccguugcccugcuugugagcuccaagcccaaaucugcugucccucuggugcaugucaaggaaaccgugagcaaacccuacguuacagaguccccggcggaagauucuaacugggugaauaaggucuucaaaaagaacaagcagaaaacgagcggaaccagaaagggcuuuccucgccacuccgggagcaaaaagcccucuuccaaagugcaguga

SEQ ID NO: 73962 - RNA, 1515 nt, Artificial Sequence
  derived and/or modified sequence opt5 from PNPLA2__Homo_sapiens__NP_065109
auguuccccagagagaagaccuggaacaucagcuuugccggcugcggguuccugggaguguacuaugucggcguugcuuccugucuccgggaacacgccccuuuucugguggcgaaugcuacacauauuuacggggccucugccggagcucuuacggccaccgcucuggugacaggcgucugccucggggaggccggagcgaaguucaucgaagugagcaaggaggcccgcaaaagauuucugggcccgcuucaccccuccuucaaccugguuaagauuauccggucuuuucuccugaaagugcugccugcugacagccaugaacacgccuccggccgccucgggauuucucugaccagagucagcgauggagagaaugugaucaucucccauuucaacagcaaggacgagcuuauucaggcuaauguuuguucuggcuuuauccccguguauugcgggcugauuccucccucccuccaaggaguccgguacguggauggcgggaucagcgacaaccugccucuuuaugaacugaagaauacaauuaccgugucuccguucuccggagagagcgauaucuguccccaggacucuuccacaaacauucacgaacuccgcgucaccaauacgagcauccaguuuaaccugagaaaucuguaccggcucuccaaagcccuguucccucccgagccucuuguucugcgcgagaugugcaagcagggcuauagagauggccuccgguuucugcaacgcaacgggcuucugaauagacccaacccgcuccuggcgcugccucccgcccggccucacggacccgaagacaaagaucaggcuguggagucugcccaggcugaagacuacagccagcuccccggcgaggaucauauccuggaacaccuuccugcccgccugaaugaggcccuccuggaggcuuguguggaaccgaccgaccuucugacaacccucuccaacaugcugcccgucagacuggcgacagccaugauggugccuuacacccucccccuggagagcgcucuuucuuucacgauucggcugcucgaauggcugccugauguucccgaggacaucagauggaugaaggaacaaacaggguccauuugccaguaucuggugaugcgcgccaaacggaaacuuggaagacaucucccgagccgccugccugagcaggucgagcugcggagagugcagucucuccccagcguuccucuguccugugccgcuuaccgcgaagcccuucccggcuggaugcggaacaaucugucucucggggacgcgcuggcuaagugggaggaaugccaaagacagcugcuucucggacuguucuguaccaacguggccuuuccucccgaggcccugcgcaugcgggcuccggccgauccugcucccgcccccgcggacccugccagcccgcagcaccaacucgcuggccccgccccucugcuuuccacacccgcuccugaagccagacccgucaucggcgcgcuggggcucuga

SEQ ID NO: 73963 - RNA, 1446 nt, Artificial Sequence
  derived and/or modified sequence opt5 from PNPLA3__Homo_sapiens__NP_079501
auguacgacgccgagagaggcuggagccuguccuucgcugggugcggauuucucggcuucuaucacgugggggccacccggugucugucugaacaugcgccccaccuucugcgcgaugcuagaaugcucuuuggagccagcgccggcgcucugcauugcgucgggguucuuuccggaaucccucuggagcagacacuccaagugcugucugaccuggugcggaaggcccgcagcagaaacauuggcaucuuccacccguccuuuaaucucucuaaauuccugcggcagggccuuuguaagugccugcccgcuaacguccaucagcucauuagcgggaaaaucggaauuucccugacgcgcgugagcgauggcgaaaauguucuugugucugacuuuagauccaaggaugaggucguggacgcccugguuuguagcugcuucaucccuuuuuacucugggcucauucccccuuccuuccggggagugcgcuaugucgauggcggggugagcgacaacgugcccuuuaucgaugcgaaaaccacaaucaccgucucuccuuucuacggagaauaugacauuuguccgaagguuaaguccacaaauuuucugcacguggauaucaccaaacugagccucagacugugcacaggcaaccuuuaccugcucucccgggccuucgugcccccugaccugaagguccuuggcgagauuugucugcgcggguaucucgaugcuuucagauuucuggaggaaaaaggaaucugcaaucggccccagccuggccugaagucuagcuccgaggggauggaccccgaaguggccaugccgagcugggcuaacaugucucucgacuccagcccugagucugccgcgcuggccguucgccuugagggagaugaacugcucgaccaccugagacuuagcauucugcccugggaugaguccauccucgacacccugucuccucggcuggcuacggcccucagcgaagagaugaaagauaagggcggguacauguccaagaucuguaaucugcuucccauuagaaucaugagcuacgugaugcugcccugcacccucccugucgaaucugcuauugccaucgugcaacgccugguuacauggcugccggacaugcccgaugacgugcuuuggcuccagugggucaccucccagguguucacacggguccugaugugccugcucccugccagcagaucucagaugcccguguccagccaacaggcuuccccuuguacccccgagcaggauuggccgugcuggacgccuuguucucccaaaggaugcccugcggagacaaaggccgaagcuacaccccgcagcauucugcgguccucucuuaacuuuuuccugggcaauaaaguuccugccggcgccgaggggcucagcaccuuucccuccuucagccuggaaaagucucuguga

SEQ ID NO: 73964 - RNA, 501 nt, Artificial Sequence
  derived and/or modified sequence opt5 from PNPLA4__Homo_sapiens__NP_001166143
auggccagacugcggagcggcauggaguccauccugcccccuucugcucacgaacucgcccagaaccgccuucaugugagcauuaccaaugcgaagacaagagagaaccaccuggucuccacguucucuagccgggaagaccucaucaaaguucugcuugcuuccucuuuugugccgauuuacgccgggcugaagcucguggaguauaaaggacaaaagugggucgauggcgggcugaccaaugcccugcccauccucccugugggacgcacaguuaccauuagccccuucuccggcagacuggacaucagcccucaggauaaagggcagcuugaccuguacgugaacaucgcuaagcaggauauuaugcucucucuggccaaucuuguccggcugaaccaagcucucuuucccccuuccaagcgcaaaauggaaagccuguaucagugcggauucgacgauacagugaaguuucugcucaaagagaauugguucgaguga

SEQ ID NO: 73965 - RNA, 948 nt, Artificial Sequence
  derived and/or modified sequence opt5 from PNPLA5__Homo_sapiens__NP_001171146
augggcuuccuggaggaagaggggagauggaaccucagcuuuuccggagccggcuaccugggggcucaccaugugggagccaccgaaugccuucggcagcgcgcgcccagacugcuccaaggcgcucggcgcaucuaugggucuagcuccggagcccugaaugccgucucuauuguuuguggcaagagcguggacugcccuuccacaaucacggugucuccguuccacggcaccgucgauauuuguccccagagcacauccccuaaccuucaugagcugaauguguuuaacuucagcuuucagaucucuaccgaaaauuucuuucucgggcugauuugccugauucccccuucccucgagguuguggcugacaacuguagacagggauaccuggaugcccuucgguuccuggagcgcagaggccucacaaaagaacccguccuguggacccuugugagcaaggagccuccggcucccgccgacgggaauugggaugcgggaugcgaccaacgguggaaaggcgggcugucucucaacuggaagguuccucacgugcaggucaaagaugugcccaauuuugaacagcuguccccugagcuggaggccgcucucaagaaggccuguacacgcgaccccagcagaugggcucgguucuggcauucuggaccgggccaggugcugaccuaucuucugcucccuugcacgcugcccuuugaauacaucuauuuccgcuccagacggcuugucguuuggcugccugaugugcccgccgaccucugguggaugcaaggccugcugcgcaacauggcgcucgagguguuuagcagaaccaaagcccagcugcuugggcccaucuccccuccggcuacacggguccuggaaaccucuccccuccagccucagaucgcuccccacagagaggaacugggaccuacacaccaagccuga

SEQ ID NO: 73966 - RNA, 4128 nt, Artificial Sequence
  derived and/or modified sequence opt5 from PNPLA6__Homo_sapiens__NP_001159583
auggaggcuccccugcagaccggcaugauggggacaagcucccacggacucgcuacgaacucuagcggcgccaagguggcggaaagagacggguuccaagauguccuggcuccuggagagggcuccgccgggcggaucugcggagcccagccgguucccuuugugccucaggugcuuggcgucaugauuggcgcugggguggccguuguggucaccgcugugcugauccuccugguugugcgcagacuucggguccccaaaaccccugcccccgacggaccucgcuacagauuccggaagcgcgauaaagugcuguuuuauggcagaaagauuaugcggaaagugucucagagcacauccucucucgucgacacaagcguuuccgcgaccagccgcccgagaaugcggaagaagcugaaaaugcugaauaucgccaagaaaauucuccgcauccaaaaggaaacacccacccugcagagaaaagagccucccccugcugugcuugaagccgaucugacggagggggaccucgcuaacucucaucugcccuccgaggugcuuuacaugcugaagaauguccgggugcucggacacuucgaaaagccgcuguuucuggagcucugucgccauaugguuuuccagagacugggccagggggauuauguguuucggccuggacaacccgacgccagcaucuacgucgugcaggauggccuucuggaacucugccugccuggccccgacgggaaagaguguguugugaaggaggucgugcccggagauucugucaacucccuucugagcauucucgacgugaucaccggccaccagcauccucagagaacaguuucugcgcgcgccgcucgggauuccaccgugcugagacugccggucgaagccuucagcgcuguguuuacaaaauaucccgagucccucguucgcgugguccaaauuaucauggugcggcugcagagagugaccuuccuugcccugcacaauuaccucgggcugacgaacgaacuguuuucucacgagauucagccucugcgccucuuccccagcccuggacugcccacacggaccuccccgguuagaggcagcaagcgcauggucucuacauccgccaccgacgaaccucgggagacccccgggagaccucccgacccuacaggagcuccccugccgggcccuacgggcgaucccgugaaacccaccagccucgagacaccuucugcgccgcugcuuagccgcugcguguccaugcccggggacaucucuggacugcaaggcgggccucggagcgauuuugacauggccuaugaaagaggacggauuuccgucagccuccaggaggaagccucuggcgggucccuggccgcccccgcucgcaccccuacacaggagcccagagaacagccugccggcgcgugugaguacagcuacugcgaggaugaaucugcuaccggaggcugucccuucgggccguaucaaggacggcagacguccagcaucuucgaggccgccaagcaggaacuggcuaaacuuaugagaaucgaggacccuucccuccuuaauucucgcgugcugcuccaucacgccaaggcuggcacaauuaucgcccggcagggggaucaagacguuagccugcauuuugugcuuuggggaugccugcacgucuaccagagaaugauugauaaggcggaagacgugugucucuucguugcccagcccggcgagcugguggggcagcuggcuguccuuaccggcgagccucucaucuuuacccugcgcgcccaaagagauugcacauuccugcggauuuccaaaucugacuuuuaugaaaucaugcgcgcucagcccagcgugguucucuccgccgcgcacaccguggccgcuagaaugagcccguucguccggcagauggacuuugccaucgauuggacagcuguggaggccggacgcgcccuguacagacagggcgaccggucugauuguacguauauugugcuuaacgggcgccugagauccgucauccaacggggaagcggcaagaaagaacucguuggggaguacggacgcggcgaccugauuggggugguggaggcucugaccagacagccucgggcgacaaccguccaugccgugagagauacagaacuugcuaagcuccccgagggcacccugggacacaucaaacgccgguauccucagguugugacgagacugauucaucuccugucucaaaagauccuuggcaaucugcagcagcuccaggggcccuuccccgccggauccggccugggggucccuccgcacagcgaacugaccaaccccgccucuaaucuugcuacaguggccauccucccuguuugcgcggaggugcccauggucgcuuuuacccuggaacugcaacaugcccuccaggccauuggaccuacacugcuucugaacagcgacaucauucgcgcucggcucggcgccuccgcgcuggauagcauccaggaguucagacugucuggguggcuugcucagcaagaggacgcccaccgcauugugcuguaccagaccgaugccucccucacgcccuggacaguucggugccugagacaggcugacuguauccucauugugggccugggagaucaggaaccuacccuuggccaacuggagcagaugcucgaaaauacagccguccgcgcucugaagcagcuggugcuucugcaccgggaggaaggggccggaccgaccagaaccguggaguggcucaacaugcggagcuggugcuccggccaucugcaccuccgcugucccagacggcuguuuucucgcagaagcccugcgaaacuucaugagcuguacgaaaaggucuucucccggagagccgaccgccacucugauuuuagccggcucgcuagaguucugacagggaauacgaucgcccuggugcuuggaggcggcggggcucgcggaugcucccacaucggcgugcugaaagcccucgaggaagccgggguccccguggaccugguuggaggcaccucuauugggagcuucaucggagcucucuaugcggaggaacgguccgccagcagaacaaagcaacgcgcucgggagugggccaaaucuaugaccuccgugcuggagccuguccuugaccugacauaccccgugaccagcauguucacgggcucugccuuuaacagauccauucaucgcguuuuccaggauaagcagaucgaagaccuguggcucccguauuuuaacgugacaaccgauauuaccgcuagcgccaugagaguccacaaggacggcucucuguggcgguacgugcgcgcguccaugacacuuagcggguaucugccuccccucugugaucccaaagacggacaucugcucauggauggcggguacaucaauaaccugccugcugacaucgccagauccaugggagccaagaccgucauugcuaucgaugugggcagccaggacgagacagaucuuucuacguauggggacagccuguccggaugguggcugcucuggaaacggcugaaucccugggccgauaagguuaaagugccugacauggcggaaauucaaucucgccuugcuuacgucagcugcgugagacagcuggagguugugaaguccucuagcuacugugaguaucuccggccgcccaucgacugcuucaagaccauggauuuuggcaaauucgaccagauuuacgaugucggcuaucaguacgggaaggccguguuuggaggcugguccagagggaacgugaucgagaaaaugcugacagaccgccggucuaccgaucucaaugaaagcagacgcgccgacguucuggcuuucccuuccagcggauuuacagaucuugccgaaaucgucucucggauugagcccccuaccuccuaugugagcgacggcugugcugauggggaagagucugacugccugacggaguacgaagaggaugccggacccgacuguuccagagacgaaggcggcagcccggagggggcguccccuucuaccgccagcgaaauggaggaggaaaaguccauccugcggcaacgcagaugccucccccaggagccucccggaagcgcuacagaugccuga

SEQ ID NO: 73967 - RNA, 2349 nt, Artificial Sequence
  derived and/or modified sequence opt5 from PNPLA8__Homo_sapiens__NP_001242937
augagcaucaaccugaccguggacauuuacaucuaucuccuguccaaugccagaucugucugcggcaagcagcggagcaaacaacuuuacuuccuguuuuccccuaagcacuauuggcgcauuucucauaucagccuccagagaggguuccacacaaacauuauccgguguaaauggacgaaguccgaggcucauucuugcagcaaacacuguuacuccccuagcaaucauggacugcacaucggcauucuuaagcugucuaccuccgccccgaaggggcucacaaaaguuaacaucugcaugagccgcauuaagucuacccuuaauuccgugagcaaagcgguguuuggaaaccagaaugaaaugaucucuagacuggcucaguucaagcccuccagccaaauucuccggaaagucuccgauucuggcuggcugaagcagaagaacaucaaacaggccauuaagagccuuaaaaaguauuccgacaaaagcgccgagaagucuccuuuucccgaagagaaaucccacaucaucgauaaggaagaggacauugggaagcgcagccuguuccauuacacaucuagcaucaccacaaaauuuggagauuccuucuauuuucucucuaaucacauuaacagcuacuucaagagaaaagagaagaugucccagcaaaaagaaaaugagcauuuucgggacaagagcgaacuggaggauaagaaaguggaggaaggcaagcugcgcucuccugaccccggcauccuggcuuacaaaccuggguccgagagcguucacaccguggauaagccgacgucucccuccgccauuccugacguccuccaggugagcaccaaacaguccaucgcuaacuuccugucuagacccacagaaggaguucaggcccuggugggcggguauaucggaggccucgucccuaagcugaaguacgauagcaaaucccaaucugaggaacaggaggagcccgcgaagaccgaccaggccgugagcaaagaucggaaugcugaagagaagaaacgccuuucccugcaaagagaaaagauuaucgcccgggugagcauugacaaccgcacaagagcucucguccaggcccugcggagaaccacggacccgaaacuuuguaucacacgcguugaggaacugaccuuucaccuccuggaguucccugaggggaagggaguggcggugaaggaacggauuauccccuaucugcucagacugcgccagaucaaagaugagacacuucaggccgcuguccgggaaauucuggcccucaucggcuacguggacccuguuaagggcagagggauucgcauccugucuauugauggaggcgggacccggggaguggucgcccuucaaacccugagaaaacucguggagcugacacagaagcccguucaucagcuguucgacuauaucugcggcguguccacgggggcuauucucgccuuuaugcugggacuuuuccacaugccccuggaugaaugugaggagcucuaccgcaaacugggcagcgacgucuuuucucagaaugugaucgucggcaccgugaagauguccuggagccaugcuuucuaugauucucaaacaugggaaaacauccugaaggaccggauggggagcgcgcuuaugauugagaccgccagaaacccuacaugcccgaaaguugcugccguguccaccaucgucaaucgcggaauuacgcccaaggccuuuguguuccggaacuacggccacuuuccugggaucaauagccauuaccucggaggcugucaguauaaaauguggcaggcuauuagagccucuuccgcggcucccggguacuucgccgaauaugcccugggcaacgaucugcaccaggacggaggccuccugcuuaauaacccuagcgcucuggccaugcacgagugcaagugucucuggcccgauguuccgcuggagugcaucgugucccuggggacaggacgguacgaaucugacguccgcaauaccgugaccuauacaagccuuaaaaccaagcucuccaacgugaucaauucugcuacagacacggaggaaguucauauuaugcuggauggccugcucccucccgacaccuacuuuagauucaacccugucaugugcgagaauaucccccuggaugaaagccggaacgagaaacuugaccaacugcagcucgaggggcugaaguauauugaaagaaaugagcagaagaugaaaaagguggccaaaauccugucccaggaaaagacaacccuucaaaagauuaacgauuggaucaaacucaagacagacauguacgagggacugcccuuuuucucuaaacuguga

SEQ ID NO: 73968 - RNA, 786 nt, Artificial Sequence
  derived and/or modified sequence opt5 from PNPO__Homo_sapiens__NP_060599
augaccugcuggcugagaggcgugacagccacguucgggcggcccgcugaguggccuggauaccucagccaccuguguggccgcuccgccgcgauggaccuugggccgaugagaaagucuuaucggggagaucgcgaagccuuugaggaaacccaucugacaagccucgaccccgucaaacaguucgccgccugguuugaggaagcuguucaaugcccugauaucggcgaggccaacgcuaugugucuggcuaccugcacaagagacgggaagcccuccgcgcggaugcuucugcucaaaggauucggcaaggauggcuuucgcuucuuuaccaauuucgagucuagaaaagggaaggaacuggacagcaacccuuuugccucccugguguucuacugggagccccucaaucgccaggugcgggucgaaggaccugugaagaaacugccggaggaggaagcugaguguuauuuucacucuagacccaagagcucccagauuggcgccguugugagccaucagucuuccgucaucccugaucgggaauaccuucgcaaaaagaacgaggaacuggagcaacucuaucaggaccaggaggugcccaaaccuaagagcuggggaggguacguucuguauccccaggugauggaguucuggcaaggccagacaaauagacuucacgaucggauugucuuucgcagagggcugccgaccggagacucuccucucggccccaugacgcaucggggcgaagaagauuggcuguacgagagacuggcuccuuga

SEQ ID NO: 73969 - RNA, 2352 nt, Artificial Sequence
  derived and/or modified sequence opt5 from PNPT1__Homo_sapiens__NP_149100
auggccgcuugcagauacuguugcagcugucugcggcuccgcccccuguccgacggcccuuuccuucugccgagacgggaucgcgcccucacccagcugcaagugagagcgcuuuggucuagcgcugggucccgggccgucgccguugaccugggaaaccgcaagcucgagaucucuagcggcaaacuggcuagauuugccgauggguccgcuguggugcagucuggagacacagccgucauggugacggcgguuagcaagaccaaacccuccccuagccaguucaugccccugguggucgauuaucggcagaaggccgcugccgcuggccgcauuccuacaaauuaccucagacgggaaaucgggaccucugacaaagagauucugacaucccgcaucauugauagaagcauccggccccuuuuuccugccggauauuucuacgacacccaagugcugugcaaccuccuggcgguugauggcgugaaugaaccggacguccuugccaucaacggcgcuucuguggcccugucccucagcgauauucccuggaaugggccugugggagcuguccgcaucggcauuaucgacggggaguauguugugaaccccacaagaaaggaaaugucuuccagcacccugaaucugguggucgccggagccccuaagucccagauugugaugcucgaggcuucugcggagaacauccugcagcaggauuuuugucacgccauuaaaguuggcgugaaguacacgcaacagaucauccaggggauucagcaacuugucaaagaaaccggagugacaaagcggacaccccagaaacuguucaccccgagcccugagaucguuaaguauacccauaagcucgcuauggaaagacuguacgccguguuuacggacuacgagcacgacaaagucucccgcgaugaggccgugaauaagauucggcuugacacagaagaacagcugaaagaaaaguuccccgaggcugauccuuaugaaaucauugagagcuuuaacgucguggccaaagagguuuucagaucuaucgugcucaaugaauacaagcgcugcgacggccgggaucugaccucccugagaaacgucagcugugagguggacauguuuaaaacacuccauggcucugcgcuguuccaacgcgggcagacccagguucuuugcaccgugacauuugauagccuggaauccggaaucaagucugaccaggucauuacggcuaucaauggcauuaaggauaaaaacuucaugcuccacuaugaguucccucccuacgccaccaaugaaaucgggaaggugacaggacugaaccggagagagcuuggccauggggcccuggcugagaaagcccucuaucccgugauuccgcgcgacuuucccuucaccauccggguuacaagcgaaguccuggaguccaacggaucuagcuccauggcuagcgccuguggcggcucucuggcgcucauggauuccggggugccuaucagcuccgccguggcuggagucgccauuggccuggugaccaagacggaccccgaaaaaggggagaucgaagacuacagacuucugacagauauucucggaaucgaggacuauaauggcgauauggacuuuaagauugcugggaccaacaagggcaucaccgcccugcaagcggauauuaaacugccuggaauccccaucaagauuguuauggaggccauccagcaggcuucuguggccaaaaaggaaauucuucagaucaugaauaaaacaauuagcaagccgcgcgcuucccggaaggagaacggcccugucguggaaaccguucaagugccccucucuaaaagagccaaguucgucgggccuggaggcuacaaucugaaaaagcugcaggccgagacaggggugacgaucagccagguugacgaggaaaccuuuuccguguucgcucccacaccuagcgcgaugcacgaggcccgggauuuuaucaccgaaauuugcaaagacgaucaggagcaacagcucgaguucggagcugucuacacagccaccaucacggagauucgcgacaccggcgugauggugaagcuguaucccaacaugacagccguccuucugcacaauacccagcucgaucagagaaagaucaaacauccgacagcucuggggcuggagguuggccaagaaauucaggugaaguacuuuggacgggacccugccgauggcagaaugcgccuuucucggaaagugcuccagucccccgcgaccacggucgugagaacacugaacgaccgcagcucuaucguuaugggggagcccaucucccaaagcucuagcaauucccaguga

SEQ ID NO: 73970 - RNA, 984 nt, Artificial Sequence
  derived and/or modified sequence opt5 from PNRC1__Homo_sapiens__NP_006804
augaccguggucagcguuccccagagagagccucuggugcucggcgggcggcuggccccgcuuggauucuccucucgcggcuacuuuggggcucugcccauggugacaacggccccucccccucuccccagaaucccugacccgcgggcgcugcccccuacccuuuuccugccccacuuucucggaggcgaugggccuugccugacaccccaaccgcgcgcuccugccgcccugcccaacagaagccucgcugucgccggaggcaccccucgggcugcccccaagaaacgcagaaagaaaaaggugcgggcgucccccgccggccagcugccuucucgcuuccaucaguaucagcaacacagaccgagccuugaagggggacggucccccgcuacaggcccuucuggggcccaggagguucccggaccugcugccgcgcuggcccccagcccggcugccgcugccggcaccgaaggggccuccccugaccucgcuccccugcgcccugcggcccccggacagacaccucuuagaaaagaggugcucaagagcaagaugggcaaaucugaaaagauugcucugccccauggccagcugguccacgggauccaucuguacgagcaaccgaaaauuaaucggcagaaguccaaauauaaccucccucugaccaagaucacgagcgccaagcgcaaugagaacaauuuuuggcaggauucuguguccagcgaccggauucagaaacaagaaaagaaacccuucaagaacaccgagaauaucaaaaacucucaccuuaagaaauccgccuuucugacagaaguuagccagaaggagaauuacgcuggagccaaguucuccgaucccccuucuccgagcgugcuccccaaaccucccucccacuggaugggcagcaccgucgagaacucuaaucagaacagagaacugauggcggugcaucuuaagacacugcucaaagugcaaaccuga

SEQ ID NO: 73971 - RNA, 1080 nt, Artificial Sequence
  derived and/or modified sequence opt5 from POC1A__Homo_sapiens__NP_001155052
auggccgcucccugcgccgaggacccuagccuggaaagacacuucaagggccaucgggaugcggugaccugugucgacuuuuccaucaacacaaaacagcucgcuucugggagcauggauuccugccugaugguuuggcacaugaagccgcaaucucgcgccuacagauucacgggacauaaagacgccgugaccugugugaauuuuagccccuccggccaccuucuggcuucugggagccgggauaagacaguccgcauuugggugccuaacguuaaaggagaguccaccguguucagagcccauacagcuaccguccggagcgugcacuuuugcucugacggccaguccuucguuacagccagcgaugacaagaccgugaaggucugggcgacgcaccgccagaaauuucucuucucucugucccagcauaucaauugggugagaugugccaaguuuagccccgaugggcggcuuauugugucugcuuccgacgauaaaaccgucaagcugugggacaaaagcucccgcgaaugcguucacucuuauugugagcauggaggcuucgugacauacguggauuuucacccuagcgggaccugcaucgccgcugccggcauggacaacacagucaaggugugggacguuagaacccaccggcuccugcaacauuaucagcugcacuccgcggccgugaauggacucagcuuccaucccucuggcaacuaccugauuacggcuuccagcgauucuacacuuaagauccuggaccucauggaagggcgccugcuuuauacccugcacggacaucagggcccugccacaaccgucgcuuuuagcagaaccggggaguacuucgccuccggaggcucugaugaacaggugaugguuuggaaaagcaauuucgacaucguggaucacggcgaggucacaaaggugccgcggcccccugccacgcucgcuuccagcauggggaaccugaccgucucuauucuggagcaacgccucacacugaccgaagacaaacuuaagcagugucuggagaaucagcagcucaucaugcaaagagcgacacccuga

SEQ ID NO: 73972 - RNA, 1311 nt, Artificial Sequence
  derived and/or modified sequence opt5 from POC1B__Homo_sapiens__NP_001186706
augcuguggaacuucaagccccacgccagagcuuaccgguaugugggccauaaagacgucguuaccagcgugcaguuuuccccucacgggaaucuccuggccucugcgagccgcgauagaacagugcggcuuuggaucccggacaagcgcggaaaauucuccgaguuuaaggcucauacggcccccgucagaucuguggauuucagcgccgacggccaauuucuggcuaccgccuccgaagauaaaucuauuaagguuuggagcauguaccggcagcgcuuccucuauucccuguacagacacacacauugggugcggugcgcuaaguuuagcccugacgggcgccuuaucgucucuuguuccgaggauaaaaccauuaagaucugggacacaaccaacaaacagugcgugaauaacuucagcgauucuguuggauuugccaauuucguggacuuuaaccccuccggcacauguauugcgagcgccgggucugaucagaccgucaaggugugggacgugagagucaauaaacugcuccaacacuaucagguucacuccggaggcgugaacugcaucagcuuccauccuuccggcaauuaccugaucacggcuucuagcgaugggacccugaagauucucgaccugcuugaaggacggcugaucuauacacuccagggccacaccgggcccguguuuacagucuccuucagcaagggaggcgagcuguucgccucugggggagcugacacccaggugcuucuguggcgcacgaacuuugaugaacuccauuguaaaggccugacaaagagaaaucugaaacggcuccacuucgacuccccuccgcaucugcuugauauuuacccccgcaccccucacccccacgaggagaagguugaaacaguggagaucaacccuaaacuggaagucauugaccuccaaaucagcacacccccggugauggauauucugucuuuugacagcaccaccacgaccgagacauccggcagaacccuuccugauaagggggaggaagccugcggauacuuccugaaucccucucucaugagcccugagugucugcccacaaccacgaaaaagaagacagaagacauguccgaucugcccugcgagagccagcggucuaucccucucgcgguuaccgacgcccuggaacauaucauggagcagcuuaacgugcugacccagacagucuccauucucgagcaaagacugacccuuacagaagauaaacugaaggacugucucgagaaucagcagaaacuguuuagcgcugugcaacagaagucuuga

SEQ ID NO: 73973 - RNA, 1728 nt, Artificial Sequence
  derived and/or modified sequence opt5 from POC5__Homo_sapiens__NP_001092741
augagcuccgacgaggaaaaguacucucugcccgugguccagaacgauagcuccagaggcucuagcguuuccucuaaucuccaagaggaauaugaggaacugcuucacuacgccaucgugaccccuaacauugagccgugcgcuagccaguccagccaucccaaaggggagcuggugccugacguccggaucucuacaauucacgauauccuccauucccagggaaauaacagcgaagugcgcgagacggccauugaaguuggcaaggggugugacuuccacaucucuucccauagcaaaaccgaugagucuucccccgugcugagcccuagaaagcccucccacccugucauggacuuuuucucuagccaccuucuggcggauuccagcucuccggcuacaaauuccagccauaccgacgcccacgagauccucgugucugauuuucugguuagcgacgaaaaccugcagaaaauggagaaugugcucgaucugugguccucuggacuuaagacaaacauuaucagcgaacuguccaaguggcggcucaauuucauugacuggcaucgcauggagaugagaaaagaaaaggagaaacacgccgcucaccugaagcaacuuugcaaccagaucaaugagcugaaagaacuccagaagaccuuugagauuagcaucggccggaaggaugaagucauuucuucccugagccaugccaucgggaaacagaaggagaaaaucgaacugaugcgcacauucuuucacuggagaauuggacaugugcgggcucgccaagacguguaugagggcaagcucgccgaccaguacuaucagagaacccugcuuaaaaaggucuggaaaguuuggcggucuguggugcagaagcaauggaaggaugucguggagcgcgcgugucaggccagagcugaagagguuugcauccagauuuccaacgacuacgaagccaaaguggcuaugcugagcggcgcccucgagaaugcgaaggccgaaauccaacggaugcagcacgagaaagagcauuucgaagauuccaugaagaaggcuuuuaugcgcggggucugugcccugaaccuugaggcuaugacgauuuuccagaauagaaacgacgccggaaucgauucuaccaacaauaaaaaggaagaguauggccccggggugcagggaaaagagcacagcgcccaccuggacccuuccgcucccccuaugccccucccgguuacaucuccucugcugcccagcccucccgcggccgugggcggggcuuccgccaccgccguccccagcgcugccucuaugacauccacccgggcggcuagcgccucuuccgugcaugucccugugagcgcccucggagcuggcucugccgcuacggccgcgagcgaagagauguacguuccgagaguggucacauccgcccaacagaaggcuggccgcaccaucacagcccggauuaccgggagaugcgauuuugcuagcaaaaaccgcaucucuuccagccuggccauuaugggagugucucccccuauguccagcguuguggucgaaaagcaccaucccgugaccgugcagacaaucccucaggcgacggccgcuaaauacccccggaccauucacccggaguccucuacaagcgccuccagaucucuuggcacccgcagcgcucacacacaaucccugaccagcguucauucuaucaaggucguggacuga

SEQ ID NO: 73974 - RNA, 1677 nt, Artificial Sequence
  derived and/or modified sequence opt5 from PODXL__Homo_sapiens__NP_001018121
augagaugcgcccuggcucucagcgcccugcuucugcuccuguccacacccccucuucugccgucuagccccuccccuucucccagcccuucccagaacgcgacacaaacgaccacagacucuagcaauaagaccgcucccaccccugccuccagcgugaccaucauggccacagauaccgcucagcagucuacggucccgaccuccaaagccaacgagauucucgcuagcguuaaggccacaacccugggcgugucuuccgacagccccgggacaaccacgcuggcgcagcaagugucuggaccugucaauacaaccguggcccggggcgggggauccggcaaccccacaaccaccaucgaaagcccuaaauccacaaagucugcugauacgaccacaguugccaccagcacagcuaccgccaaacccaauacgacauccagccagaacggggcggaggacaccaccaauucuggaggcaaguccagccacucugugacaaccgaucucacaagcacgaaggccgaacaucugaccacaccgcacccuaccagcccccuuucuccucgccagcccacaagcacccaucccgucgcuacgccuaccuccagcggccacgaccaucugaugaaaauuucuuccuccucuuccacaguggccaucccgggguacaccuucacaagccccggaaugaccacgacacuccuggagaccguuuuucaccacgugucccaggcuggccuugaacugcucacaucuggggaucugccuacccuggccagccaauccgccggaauuaccgcuucuagcgucaucucccagagaacacagcagacgagcucucaaaugcccgcguccagcaccgccccuucuucccaggagacagugcagcccaccagcccggcuacagcccuccggaccccuacgcugcccgagacaaugucuagcuccccuaccgccgcuagcaccacacaucgcuaucccaagaccccuucucccacaguggcccacgaauccaacugggcgaaaugugaggaccuugaaacgcaaacccagagcgagaagcagcugguccucaaucugacaggcaacacccuuugcgcugggggagccuccgaugagaaacugaucucucucauuuguagagccguuaaggcuacauucaauccggcccaggacaagugcggcauccggcuggcuagcgugccuggcucccaaaccguggucgugaaagaaauuacgauccauaccaagcugcccgccaaagauguuuacgagcgccucaaggacaaaugggaugaacugaaggaggcgggggugucugacaugaaacuuggagaccaggggcccccugaagaggccgaggauagauuuagcaugccgcugauuaucacaauugucuguauggcuuccuuccuccugcuuguggccgcucuguauggcugcugucaccagcggcucucucagcgcaaggaccaacagagacugaccgaggaacugcagacaguugaaaacggauaccacgauaaucccacccucgaggugauggaaacaagcuccgagaugcaggagaagaaagucgugagccugaacggcgaacuuggggacucuuggaucgucccucuggauaaucucaccaaggacgaucuggacgaggaagaggauacgcaucuguga

SEQ ID NO: 73975 - RNA, 1770 nt, Artificial Sequence
  derived and/or modified sequence opt5 from POF1B__Homo_sapiens__NP_079197
augagcuccucuuacuggagcgagaccuccucuagcuccugcggcacacagcaacugcccgaagugcuccagugucagccucagcacuaucauugcuaccaccaaucuagccaggcccagcagccgcccgagaagaacgucguuuaugaaagagugcggacguacuccgggccuaugaauaaagugguccaagcucuggaccccuucaacagccgcgaggugcuuucuccucugaagaccacauccagcuaucagaaucucguuuggucugaucauucccaggaacugcacagccccacccuuaaaaucucuacaugugccccuuccacccugcauauuacacagaacaccgagcaagagcuccacagcccgacggugaagcugaccacauacccccagaccacaaucagaaaauaugucgugcagaauccugaacaagagccccugucccaguuucuccggggaucucacuucuuuccuggcaacaauguuauuuacgaaaagaccauccgcaagguggagaaacugaacacggaccaggggugccauccccaggcgcaaugucaccaucacauuauccagcagccgcaggucauccacagcgcucauuggcaacagccugauuccagccagcagauucaagccaucacaggaaauaaccccauuucuacccacaucggcaaugagcuuugccauuccgggagcucucagauuugugaacaggugaucauucaggacgauggaccugagaagcuggaccccagauacuucggcgaacuccuggccgaucuuagccggaaaaacacagaccuguaucacugccuccuggagcaucugcaacgcaucggcggguccaagcaggauuuugaaucuaccgacgagagcgaggauaucgaaucccucauucccaaaggacugagcgaguucaccaagcagcaaaucagauacauucuucagaugcggggcaugucugacaagucccugcgccucgugcugagcacauuuucuaauaucagagaagaacuugggcaucugcagaacgauaugacgucccucgaaaaugacaaaaugcggcuggagaaggaccugagcuucaaagauacccagcucaaggaguaugaggagcugcuugcuuccguccgcgccaacaaccaccaacagcagcagggacugcaagacucuagcuccaaaugucaggcucucgaagagaauaaccugucucuuagacacacacugagcgauauggaauaccggcucaaggagcuggaguauugcaaacgcaaucuggaacaggagaaccagaaucucagaaugcaaguuuccgaaaccuguacaggcccuaugcugcaggccaagauggacgagauugggaaccacuacaccgagauggugaagaaucuucggauggaaaaagauagagagaucugccgccugcggagccagcucaaccaauaucauaaggacgugucuaaaagagaaggauccugcagcgauuuucaguucaagcugcacgagcugacgucucuucucgaagagaaagacucccugaucaagcgccagagcgaggaacugucuaagcuccggcaggagauuuacagcucccacaaucaaccgagcacaggcggcagaaccaccaucacaaccaaaaaguaccgcacacaguaucccauucuggggcuucuguacgaugacuaugaauacaucccucccggaucugagacgcagaccauugucaucgagaaaacagaagauaaguauaccuguccuuga

SEQ ID NO: 73976 - RNA, 1167 nt, Artificial Sequence
  derived and/or modified sequence opt5 from POFUT1__Homo_sapiens__NP_056167
augggcgccgcugccugggcgagaccccugagcguguccuuccuccugcuucugcucccucugccggggaugcccgcuggaucuugggacccugccggcuaccuucuguauugccccuguauggggcgguuuggaaaccaggccgaucacuuccucggcagccuggcuuuugccaagcugcucaaucgcacccuggcugucccucccuggaucgaguaccaacaucacaaaccuccguucacaaaccuucauguuuccuaucagaaguacuuuaaacuggaaccccuccaggccuaucacagagugauuucucuggaggacuucauggaaaaacuugcgccuacgcauuggcccccugagaagcggguggccuacugcuuugaagucgcugcccagcgcagccccgauaagaagaccuguccgaugaaagaggggaauccuuucggacccuuuugggaccaauuccacguguccuuuaacaagucugagcuguucacaggcaucagcuuuuccgcuagcuauagagaacaguggucucagcgguucuccccuaaagagcaccccguucucgcccugcccggcgcgccugcccaguucccggugcuggaggaacaucgcccccuccaaaaguacauggucuggagcgaugagauggugaaaaccggggaagcucagauucacgcccaucugguuagaccuuacgugggaauccaccuucggauuggcucugacuggaagaaugcuugcgccaugcugaaggaugggacagccggaucccacuuuauggcuagcccccagugugucggcuauucucgcuccaccgcggccccucucacaaugaccaugugccugcccgaccuuaaagagauccagagagcugugaagcugugggugcggagccucgaugcccaauccgucuacguugccacggacucugaaagcuaugugccggagcugcagcagcuguucaaagggaaggugaaagucgugucccucaagccugaaguugcucaaguggaucuguacauccuuggacaggccgaccauuuuauuggcaacugugucagcucuuucaccgcguuugugaaacgcgagagagaucugcagggccggcccuccagcuucuuugggauggaccgcccucccaagcucagagacgaguucuga

SEQ ID NO: 73977 - RNA, 1275 nt, Artificial Sequence
  derived and/or modified sequence opt5 from POFUT2__Homo_sapiens__NP_056042
auggccacccugagcuucguguuucuccugcuuggcgcugucuccuggcccccugccucugcgagcgggcaggaguucuggccgggacaauccgcugccgacauccugucuggcgccgcuagcagacggcgcuaccuccuguaugauguuaaucccccugaaggguuuaaccuuagacgggacguguacauucgcaucgccucccugcucaagacacugcugaaaacggaggaaugggugcucguccugcccccuuggggaagacuuuaucacuggcagucucccgauauucaucaggugcggaucccuuggagcgaguucuuugaccugccgucccucaacaagaauauucccguuaucgaauacgagcaguucaucgcugagagcggcgggccuuuuauugaucaaguguauguccugcagucuuacgccgaaggauggaaagagggcaccugggaagagaagguggacgagcgccccugcaucgaucagcuucuguauucccaggacaaacacgaauacuacagaggcugguucuggggguaugaggaaacacggggacucaacguuagcugucugucugugcaaggcuccgcgagcauugucgccccucugcuccugcgcaauaccucugcuagauccgugaugcuugaucgggccgagaaccugcuccaugaccacuacgggggaaaggaauauugggauacacgcagaagcaugguguuugcucggcaucugcgcgaggucggcgacgaguucagaucccggcaccuuaauucuaccgaugacgccgacagaauccccuuucaggaagauuggaugaagaugaaaguuaagcuggggagcgcgcucggaggcccguaccugggcgugcaucugcgccggaaagacuucauuugggggcacagacaggaugugccuucccucgagggagccguccgcaagauccggagccugaugaaaacacacagacuugacaagguguuuguugcuaccgaugccgugcgcaaggaauaugaggaacugaaaaagcuccugcccgagaugguccgguucgagccuacgugggaggaacuugaacuguacaaagacggcgggguggcuauuaucgaucaguggaucugcgcccaugccagaugucuccccaccucucuguccgcugagagcggaucuggcggguuccaacgcuuuuucugccccaaguauagcguuuccgaacagaugguggcguguguccacucuggacacuuucauacagugugccugcucgucuga

SEQ ID NO: 73978 - RNA, 1830 nt, Artificial Sequence
  derived and/or modified sequence opt5 from POGK__Homo_sapiens__NP_060012
auggagagcaccgccuacccccugaaccucucccugaaggaagaggaagaggaagaggagauccagucuagagaacuugaggacggcccugcugauaugcaaaaagugcggauuugcagcgaagggggaugggucccggcccuguucgacgagguugcgaucuauuuuuccgaugaggaaugggaggugcucacagaacagcagaaggcucuguaccgcgaggugaugagaaugaauuaugaaacgguccuuucucuggaguuccccuuuccuaaacccgacaugauuacccggcucgagggcgaagaggaaagccagaacuccgaugaguggcaacugcaagggggaacaucugccgaaaaugaggagagcgacgugaagccucccgauuggccuaacccgaugaaugccaccucccaguucccccagccucagcacuuugacagcuucggccugcgccuccccagagauaucacagaacugccugaguggucugaaggguaccccuuuuauauggcuaugggauucccgggcuacgaccuuuccgccgaugacauugcuggcaaauuucaguucagccgggggaugcgcagaucuuaugaugccggauuuaagcugaugguuguggaguacgcggaauccaccaacaauugucaggccgcuaagcaguucggcguccucgagaaaaacgugcgggacuggcgcaagguuaaaccucaacugcagaaugcccaugcuaugagacgggccuuucgcgggcccaagaacggaagauucgcgcuuguggaccagcgggucgccgaguacgugcgcuauaugcaagcuaaaggcgauccuaucacaagagaagccaugcagcugaaggcucucgagaucgcccaggaaaugaauauucccgagaagggguucaaagccagccugggauggugccggagaaugaugcgccgguacgaccugucucucagacacaaggugcccgucccucagcaucugccggaggaucuuaccgaaaaacugguuacguaucaacgcuccgugcucgcucugcggagagcgcacgacuacgagguggcccagaugggcaacgcugaugaaacccccaucugucuugaggucccuagccgcgugacaguugacaaucagggcgaaaagcccgugcuggucaaaaccccugggcgggagaagcucaaaauuacagccaugcugggagugcuggccgauggcagaaagcugcccccguauaucauucugcgcgggaccuacaucccucccggaaaguuuccuuccggcauggagauucggugccauagauauggguggaugacggaagaccuuaugcaggauuggcuggagguuguguggcgccggagaacaggagcuguccccaaacaacggggcaugcucauccugaacggcuuccgcgggcacgccaccgacucugugaagaauagcauggaauccaugaacacagauauggucaucauuccuggaggccuuaccagccagcuccaggugcucgacguuguggucuacaaaccccugaacgacucugugagagcgcaguacuccaauuggcugcucgcugggaaccuggcccuuagcccgaccggaaaugccaagaaaccuccccugggccucuuucuggaguggguuaugguggcuuggaacucuaucagcuccgaaucuauuguccaaggguucaagaagugucacaucagcuccaaucuggaggaggaagaugacgugcuuugggagauugaaagcgagcuccccggcggaggcgaaccuccgaaagauugcgacacagagucuauggccgaguccaacuga

SEQ ID NO: 73979 - RNA, 1179 nt, Artificial Sequence
  derived and/or modified sequence opt5 from POGLUT1__Homo_sapiens__NP_689518
auggaguggugggccagcagcccccugagacucuggcugcuucuguuccuccugccuucugcucagggccggcaaaaggaaagcggguccaaauggaagguguuuaucgaccagauuaaccgcucucuugagaauuacgaaccgugcagcucccagaacuguucuugcuaucacggagucaucgaggaagaucugacccccuucagaggcgggauuagccggaaaaugauggccgagguugugcgcagaaagcucggaacacauuaccagaucacgaaaaaucggcuguaucgcgagaacgacuguauguuuccuuccagaugcagcggcguggaacacuucauucuggaggucaucgggcggcuccccgauauggaaauggugaucaauguucgcgacuacccucaagugcccaaguggauggagccugcgauuccggucuuuucuuucuccaagaccagcgaguaucaugauaucauguaccccgcuuggacauuuugggaaggaggcccugccguguggcccauuuauccuaccggccuggggagaugggaccuuuuccgggaggaucugguucgcucugccgcucaguggcccuggaaaaagaaaaacuccacagccuacuuuagaggaagccggaccucuccggaacgcgacccucucauccugcuuuccagaaagaaucccaaacugguggaugcugaguacacaaagaaccaggccuggaaguccaugaaagacacccucggcaagccugcggccaaagauguccaccugguggaccauuguaaguauaaauaccuguucaauuuuagagggguggcugccuccuuccgguuuaagcaccucuuccugugcggaucucuugucuuccacguuggcgaugaauggcuggaguuuuucuauccccagcucaaacccugggugcauuacauuccugugaagacggaccugagcaacguccaagagcuucugcaguuugugaaggcuaaugacgauguugcccaggaaaucgcggagcgcgggucccaguucauucggaaccaccuccaaauggacgauaucaccuguuauugggaaaaucugcugagcgaguacucuaaauuucucuccuauaacgugacaagacgcaagggauacgaccagaucauuccgaaaaugcugaagaccgaacuuuga

SEQ ID NO: 73980 - RNA, 4389 nt, Artificial Sequence
  derived and/or modified sequence opt5 from POLA1__Homo_sapiens__NP_058633
auggcccccgugcacggcgacgauagccuguccgacucugggagcuucgucuccucuagagcucggcgcgagaagaaaagcaagaaaggaagacaggaagcccucgagcggcugaagaaagcgaaggcuggcgaaaaguacaaauaugagguugaagauuuuaccgggguguacgaggagguggacgaggagcaauauuccaaacuuguccaggcccgccaggaugacgauuggaucguggacgaugacggaauuggcuacguugaagaugggagagagaucuucgacgaugaccuggaggacgaugcccucgacgcugaugaaaagggaaaggacggcaaagcccggaacaaggauaagcgcaaugugaaaaagcuggcugucacaaaaccuaacaauauuaagucuauguuuaucgccugcgcgggcaaaaagacggccgacaaagcuguggaucuuagcaaggacgggcugcucggagauauucugcaggaccugaacaccgagacaccgcaaaucacgcccccucccguuaugauccucaagaaaaagagauccauuggcgccagcccuaaucccuucucugugcauacagcuaccgccgucccuuccgggaaaaucgcgagcccggugucucggaaggaacccccucugacacccgugccucuuaaacgcgccgaguuugcuggagaugacguccagguugaauccaccgaggaggaacaggagagcggcgccauggaguucgaagacggggauuuugacgaacccauggagguggaggaaguggaucuggagccgauggcugccaaggccugggacaaggaaucugagccugcugaagaggucaaacaggaggcggauuccggaaagggcacggugagcuaucucggcuccuuccugcccgacguuucuuguugggauauugaccaagaaggggauagcuccuuuagcgugcaggagguccagguggacucuucccaccuuccucugguuaaaggagccgaugaagaacagguguuccauuuuuacuggcucgacgcuuaugaggaucaauacaaccagcccggcgucguguuccuguuugggaaggucuggaucgaaagcgccgagacccacgugucuugcuguguuauggugaaaaauauugaaagaacacuguacuuccucccccgggagaugaagaucgaccugaacaccggaaaggaaacaggcaccccuauuagcaugaaagacgucuaugaggaguucgaugaaaagaucgccacgaaauacaagaucaugaaauuuaaguccaagccgguggagaaaaauuaugcuuucgaaauucccgacguuccugagaagucugaauaccuugaggugaaauauagcgccgagaugccccagcugccucaagaucucaagggggaaacauuuucccaugucuucggaaccaacacaagcucucuggagcuuuuucugaugaaucgcaaaaucaagggccccugcuggcucgaagugaaauccccgcagcugcugaaccagccugugagcugguguaagguugaggcgauggcucucaagcccgaccuggucaaugugauuaaagaugugucuccucccccucuugucgugauggccuucuccaugaagaccaugcagaacgccaaaaaucaccaaaacgaaaucauugcuauggccgcucugguucaccauagcuuugcccucgacaaggcggcccccaaaccgccuuuccagucccacuuuugcguggucucuaagcccaaggauuguaucuuccccuacgcuuuuaaagaggugaucgagaagaaaaacguuaagguggaagucgccgcuaccgagagaacacugcuuggcuucuuucuggccaaagugcauaagauugacccugauaucauuguugggcacaauaucuauggauucgaacucgaggugcugcugcagcggauuaacgucugcaaggcgccgcacuggagcaaaaucggccgccucaagagauccaauaugcccaaacugggaggacggucuggcuucggggagagaaacgccacguguggccgcaugaucugcgacguggaaauuagcgcuaaggagcuuauccgguguaaauccuaccaucugagcgaacucgugcagcaaauucugaagaccgagagagucguuaucccuauggaaaauauucagaacauguacucugaguccagccagcugcuuuaucuccuggagcacacauggaaggaugccaaauuuauccugcagauuaugugcgaacucaaugugcugccccuugcucugcaaaucaccaacaucgccggaaauauuaugucucgcacacucaugggcgggcgguccgagagaaacgaguuccugcugcuucaugccuuuuacgaaaauaacuauaucgugccugacaagcagauuuuccgcaaaccccagcagaagcucggagaugaagacgaggagaucgacggcgauaccaauaaauacaagaaagggcggaagaaggcugcguaugccggaggccugguccuggacccuaaagugggguuuuacgauaaguucauucuccugcuugacuuuaacagccuguaucccucuaucauccaagaguucaauauuugcuuuacgacaguucagagaguggcuagcgaagcccagaaagucaccgaagauggcgagcaagaacagaucccggagcucccugaccccucccuggagauggggauucugccucgcgaaauccggaaacuuguggagagacgcaagcagguuaagcagcucaugaagcaacaggaucugaaccccgaccugauucuccaguacgauauccggcagaaagcccugaaacuuaccgcuaacagcauguacggcugucugggguucucuuauuccagauuuuacgccaagccgcucgcggcucuggugacauauaagggacgggaaauccugaugcacaccaaagagaugguccaaaagaugaaucuugaggugauuuacggcgacacagauagcaucaugauuaacaccaauuccaccaaccucgaagagguuuucaagcuggggaauaaagugaagucugaagucaacaaacuguauaagcuccuggagaucgacauugacggaguguuuaaaagccuucugcuccugaagaagaaaaaguacgccgcccugguggucgaaccuacauccgauggcaauuauguuaccaaacaggagcuuaaggggcuggacaucgugcgcagagauuggugcgaccucgcuaaagauacaggcaacuucgugaucggacagauucugucugaccagagccgggauaccaucgucgagaauauucaaaagagacucaucgaaauuggcgagaacgugcugaauggguccguucccgugucucaguucgaaaucaacaaggcccuuacgaaagacccucaggauuaccccgacaagaaaagccugccccauguccacguggcgcucuggauuaauucccaaggaggccgcaagguuaaagcuggggauaccgugagcuacgucaucugucaggacggaucuaaccugacagccucccagcgggccuaugcuccugagcagcugcaaaagcaggauaaucuuaccaucgacacacaguacuaucuggcccagcaaauucacccgguggucgcuagaaucugcgaacccauugacggcaucgaugccgugcucauugcgaccuggcuggggcucgacccuacgcaguuucgcguucaucacuaccauaaagaugaggagaacgacgcccugcuuggcggacccgcucagcugacagaugaagagaaguauagagacugugaacgguucaagugcccuuguccuaccugcggcacagagaacaucuacgauaauguguuugacgggagcggaaccgauauggaacccucucucuaucgcuguuccaacaucgacugcaaagccagcccgcugaccuucacaguccagcugucuaauaaacuuauuauggauaucagacgguuuauuaagaaguacuacgacggcuggcugaucugugaggagcccacgugccgcaacagaacccggcaccucccucugcaauucucccgcacagggccccucugcccugcuuguaugaaagccacccugcagcccgaauauagcgauaagucccuuuacacacagcugugcuuuuauagauacauuuucgacgccgagugugcucuggaaaagcucaccacggaccacgagaaagauaagcugaaaaagcaguuuuucacaccgaaagugcuucaagacuaucggaagcugaagaauaccgcggagcaguuucucagccgcucuggauacagcgaaguuaaccuguccaaacucuucgccggcugcgcugugaagucuuga

SEQ ID NO: 73981 - RNA, 1797 nt, Artificial Sequence
  derived and/or modified sequence opt5 from POLA2__Homo_sapiens__NP_002680
augagcgccuccgcucagcaacuggccgaggaacuccagaucuucggccuggacugcgaggaagcgcuuauugagaagcugguggaacucuguguccaguacgggcagaacgaggagggaaugguuggcgaacugaucgcuuuuugcaccucuacacacaaaguggggcuuacgagcgagauucucaauuccuucgaacaugaguuucugucuaagagacugagcaaagcccggcacuccaccuguaaggauucuggacaugccggcgcucgcgacaucgugagcauucaagagcugaucgaagucgaggaagaggaagagauccuccugaacuccuauacaacccccagcaaagggucucagaagagagccauuuccacaccugagaccccgcuuacaaagcggagcgugucuacccgcagcccccaccagcugcucuccccuucuuccuucagccccuccgcuacgccuucucagaaauacaauagcagauccaaccggggagaaguugugaccagcuuuggccuggcccaaggcgucucuugguccgggcgcggaggcgcggggaauaucagccuuaaggugcugggaugccccgaggcccucacaggcucuuauaaaagcauguuccagaagcugccugauauuagagaaguucugaccuguaaaaucgaggaacucggguccgagcugaaggagcauuacaagauugaggcuuuuacaccgcuucuggcccccgcucaggagccugugacccuccugggacagaucggcugcgacucuaacggcaaacuuaauaacaagagcgucauucuggaaggggaucgggagcacuccagcggagcccaaauccccguggaccucucugaacugaaagaguauucccuguucccuggccagguggucaucauggaggggauuaauacgacaggacgcaagcucguugcgaccaaacuguacgaaggcgugccccuuccguuuuaucagccuacagaggaagaugccgacuucgagcaaagcauggugcuggucgcuugugggcccuacaccaccucugauuccaucacauacgacccucuccuggaucuuauugccgugaucaaccacgacagacccgauguuugcauucuguuuggacccuuccucgacgcuaagcaugaacagguggaaaauugucugcugacgagcccuuuugaggacaucuucaaacagugccuccggaccaucauugaaggcacacgcuccucuggcagccaccuggucuucgugccgucccuuagagauguucaucacgagcccguguauccucagcccccuuuuucuuacagcgaccugucccgggaagauaagaagcaaguccaguucgugagcgagcccuguucucucuccaucaacggggucauuuuuggacugaccagcacagaccugcuuuuccaccucggcgccgaggaaaucucuuccagcucugggaccagcgaucgcuuuucccggauucugaaacauauccugacgcagagaagcuauuacccgcucuauccuccccaggaggacauggccaucgauuacgaaucuuucuauguguacgcucaacugccuguuacacccgacgugcuuauuaucccuuccgagcugagauacuuugucaaggaugugcucggaugcguuugcgugaaucccggccgccugaccaaagggcaggucggcggaaccuucgcgcggcuguaucuuagacgcccggccgcugacggcgccgaacggcagagcccuuguauugccguucagguggugagaaucuga

SEQ ID NO: 73982 - RNA, 1008 nt, Artificial Sequence
  derived and/or modified sequence opt5 from POLB__Homo_sapiens__NP_002681
augagcaagagaaaagcuccccaggagacccugaacggcgggaucacagacaugcucacggaacuggccaauuucgagaagaacgugucccaagccauucacaaauacaaugcguaucggaaggcugccucugucaucgccaaauacccucauaagauuaagagcggagcugaagccaaaaagcugccgggcguugggaccaaaaucgcugagaagauugaugaauuucuugccacaggaaaacuccgcaagcuggagaagaucagacaggacgauaccuccucuagcaucaacuuccuuacacggguguccggcauugggcccucugcggcccgcaaauuuguggacgagggaaucaagacccuggaagaucuccggaaaaaugaggacaagcugaaccaccaucagagaauuggccugaaauauuucggcgauuuugaaaagcgcaucccuagagaggagaugcuccagaugcaagacauuguccugaaugaagugaaaaagguugauagcgaguacaucgcuacagugugcggguccuuccggcgcggagccgaaagcucuggcgacauggauguccuucugacccaccccuccuuuacgagcgagucuaccaagcagccuaaacuccugcaucaggugguugaacagcuucaaaaggugcacuucauuacagacacccuguccaaaggggagacaaaguuuaugggagucugucagcuccccagcaaaaacgaugagaaggaauauccucacagacggaucgacauccgccugauuccgaaggaccaguacuauugcggcgugcuguacuucaccgggucugauaucuuuaauaaaaacaugagagcucaugcccucgagaagggauucacgauuaaugaauacacaauccggccccugggcgugaccggcgucgcgggggagccucuucccguugacuccgaaaaagauauuuuugacuauauccaguggaaguaccgcgagccuaaagauagaagcgaguga

SEQ ID NO: 73983 - RNA, 3324 nt, Artificial Sequence
  derived and/or modified sequence opt5 from POLD1__Homo_sapiens__NP_001243778
auggacggcaagagacggcccgggccuggaccgggcgugcccccuaaacgcgccagagggggacugugggaugacgaugacgcuccccggccuagccaguucgaggaagaucucgcccugauggaggaaauggaggcggaacaccgccuucaagagcaggaggaagaggaacugcaguccguccucgagggcguugcugacggacaggugcccccuucugccaucgauccgagauggcugcggcccaccccucccgcccuugacccucaaacagagccccugauuuuucagcagcucgaaaucgaucauuacguggggccggcucagccuguccccggcggcccuccucccagccgcggguccgugcccguucugagagccuucggagugacggacgagggcuuuucugucugcugucacauucauggguucgcuccguauuuuuacacccccgccccucccggauucggcccugaacacaugggggaucugcaacgggagcucaaccuggcgaucagccgcgacuccagaggaggccgggaacuuacaggccccgccgugcuggcuguugagcucugcucucgcgagagcauguuuggguaucauggacacggcccguccccuuuccugagaauuaccguggcccuuccccggcuggucgcuccugcccgcagacuccuggaacaggggauccggguggcgggacugggcacacccagcuuugccccuuacgaggcuaauguggauuucgaaaucagauuuauggucgacaccgacauuguuggguguaacuggcucgagcugcccgccggaaaguaugcccuucgccugaaagaaaaggcuacacagugccagcucgaggccgaugugcuguggucugacguggucucccacccgccugagggccccuggcaacggaucgcuccccuuagagugcugagcuucgauauugaaugugcgggccgcaaagggaucuuuccugagccggaacgggaccccguuauucagaucugcucucucggacugagauggggcgagccugaacccuuccugcgccucgcccugacccuucggccuugugcucccauucugggggccaaggugcaguccuacgagaaggaggaagaucuccugcaagccuggagcacguucaucagaaucauggacccugaugucauuaccggauauaauauccagaacuuugaccuucccuaccugauuucucgcgcucagacacucaaagugcagaccuucccguuucugggccggguugccgggcugugcuccaauaucagagauagcuccuuccaaucuaagcagacaggccgccgggacaccaaaguggucagcauggugggaagaguccagauggauaugcuccaggugcugcuucgggaguacaagcugcgcuccuauacgcucaacgcgguuagcuuucauuuccugggcgaacaaaaagaggacgugcagcacucuauuaucacagaccugcagaaugggaacgaucagaccagacggagacuugcugucuacugucucaaggacgccuaucugccucugcgccuccuggagcggcuuauggugcugguuaaugccguggaaauggcuagagucacaggagugccccucuccuaccugcugagccgcggccaacaggugaagguugucucucagcuucucagacaggccaugcaugaggggcugcugaugccuguggugaaaagcgaaggaggcgaggauuauaccggggcuaccgucaucgaaccccucaagggcuacuaugacgugccgauugccacacuggauuuuuccucucuuuacccuagcaucaugauggcgcacaaccugugcuacacgacccuccugcggcccggaacagcccaaaaacugggccuuaccgaggaccaguucauucgcacaccuaccggggaugaguuuguuaagacguccgugagaaaaggacuccugccccagauccuggaaaaucuccugagcgcucggaagcgcgccaaagcugagcuugccaaggaaacagacccccugagacggcaaguccucgauggccgccagcuggcgcugaaggugucugccaacuccguuuauggguucaccggagcucaggugggcaaacuuccuugucucgagauuagccagucugucaccggguuuggcagacaaaugaucgaaaagacaaaacagcugguggaguccaaguacaccguugagaauggauauagcacauccgccaaaguggucuacggcgacacggauucugugaugugccgguucggggugagcuccgucgcugaagccauggcccugggacgcgaggcugcggacuggguuucuggccacuuuccgagccccaucagacucgaauuugagaagguguauuucccuuaccugcuuauuuccaagaaacgguaugccgggcugcucuuuagcucuagacccgaugcucaugaccgcauggacugcaagggacuggaagccgugcggagagauaacuguccucuggucgccaaucuugugaccgcuucccugcgccggcuccugaucgacagagaucccgagggcgccguugcgcacgcucaggacgugauuagcgaucuccugugcaaccgcaucgacauuucucagcuugucaucacaaaagagcugacccgggccgccuccgauuacgcugggaagcaagcccauguggaacucgcggagagaaugcgcaaacgggacccuggcagcgcuccgucucugggagauagaguucccuacgugauuaucagcgccgccaagggcgucgcugccuauaugaaguccgaagacccucuguucgugcuugagcacagccugcccaucgauacacaguacuaucucgagcagcagcuggcuaaaccucuccugcggauuuuugaacccauccuuggggagggacgcgccgaagcgguucugcucagaggcgaccauacccgguguaagacggugcugaccgggaaagucggaggccugcuugccuucgcuaagcgcagaaacugcuguauuggcugccggacagugcugucucaccaaggggccgugugugaguuuugccagccgagagaauccgagcucuaccagaaagaggucagccaccugaaugcucucgaggaacgcuucucccggcuguggacccaaugucagagaugccagggaucucuucaugaagauguuaucuguacaagccgcgacugcccuauuuucuauaugcggaagaaggugagaaaagaccuggaggaucaggaacaacugcuccgccgguucggcccucccgggcccgaggccugguga

SEQ ID NO: 73984 - RNA, 1410 nt, Artificial Sequence
  derived and/or modified sequence opt5 from POLD2__Homo_sapiens__NP_001243808
auguucagcgagcaggccgcucaaagagcccacacccugcucucucccccuuccgcgaacaaugcuacauuugcccgggugccggucgccacguacaccaacagcucccagcccuuccgccugggcgaaagaucuuuuagccggcaguaugcucauaucuacgccacacgccuuauucagaugagaccuuuccuggagaaucgggcucaacagcacuggggguccggaguuggcgugaagaaacucugcgaacugcagcccgaggaaaaguguugcguggucgggacccuuuuuaaagccaugccucugcagcccucuauccuccgcgaggugagcgaggaacauaaccugcugccucaaccgcccagauccaaguauauucacccugacgaugagcucguucuggaagacgagcuucagcggaucaaacugaagggaacaauugaugugagcaagcucgucaccggcacagugcuggcgguuuucgggucugugcgcgacgauggaaaauuucuugucgaggacuacuguuucgccgaucuggcuccccagaagccugcucccccgcucgacaccgauagauuugugcugcugguguccggccucggccuugggggaggcgggggagaaagccugcugggcacgcagcuccuggucgacguugugaccgggcaacuuggagaugagggcgaacagugcucugccgcccaugugucccgggucauccuggcgggcaaucuccugagccacucuacacagucccgcgacagcaucaacaaagccaaguaucugaccaaaaagacacaagcugccuccguggaggcuguuaagaugcucgaugaaauucugcuucagcugucugccagcgugccugucgacgugaugcccggggaguucgacccuaccaauuacacgcucccccagcagccccugcacccuuguauguuuccgcuugccacagcuuauuccacccugcaacucguuacaaaccccuaccaggcgaccaucgauggagugagauuccugggcaccagcgggcagaaugucucugacauuuuucgguacuccagcauggaggaucaucuggaaauccucgaguggacacugcgcgugagacacauuucuccuacggcccccgacacccuuggaugcuauccuuucuacaaaacagaucccuucaucuuuccggaauguccucaugucuauuucugcggcaacacccccagcuuuggguccaagauuauccggggaccugaggaccagacagugcugcucguuaccgugcccgauuucucugcuacgcaaacagccugucuggucaaucugagaagccuugccugccagccuaucuccuuuagcggcuucggcgcugaagacgaugaccucgggggacugggccuggggcccuga

SEQ ID NO: 73985 - RNA, 1401 nt, Artificial Sequence
  derived and/or modified sequence opt5 from POLD3__Homo_sapiens__NP_006582
auggccgaccagcuguaccucgagaacaucgaugaauuugugaccgaccaaaauaagauugucacauauaaauggcugagcuacacgcuuggcguucacgugaaccaggcuaagcagaugcuguaugauuacguggagagaaaacggaaggaaaauuccggggcccagcuccaugucaccuaucuggugucuggaagccuuauccaaaacggccacuccugccauaaaguugcggugguccgcgaggacaagcuggaagcugugaagucuaaacucgccguuacagccagcauucacguguacuccauccagaaggcuaugcugaaagauucugggccccuguuuaauaccgacuaugauauucucaagagcaaccugcagaauuguuccaaauucagcgccauccagugcgcugccgcggucccuagagccccggcugagucuuccagcagcuccaagaaguuugagcaaagccaucuucacaugucuuccgaaacacaggccaacaaugagcugaccacaaacggacacgggcccccugcuagcaaacaggugucccagcaacccaagggcaucaugggaauguucgccucuaaagcggccgcuaagacccaggaaacgaauaaagagaccaagacagaggccaaagaagugaccaacgcuagcgccgccggcaauaaggcuccuggcaaggggaacaugauguccaauuucuucggaaaagcggccaugaacaaguuuaaagucaaccucgacagcgagcaggcuguuaaggaagagaaaauuguggaacaacccacagugucugucaccgagccuaagcuggccacgccggccggccuuaagaaauccagcaagaaagcugagcccgugaagguucugcagaaagaaaagaagcgggggaaacgcguggcccucucugaugacgagacaaaggaaaccgagaauaugcggaaaaagagacgcagaaucaaacugccugaaagcgauuccucugaggacgaggucuuccccgauagcccuggagcguacgaagcugagucccccagcccgccucccccucccucucccccucuggaaccggugcccaagacagagccugaacccccuuccguuaagucuucuuccggcgagaacaaacggaagcgcaaaagagugcucaagagcaaaaccuaccuggacggggagggauguauugucaccgaaaagguguaugaguccgaaucuugcacagacagcgaggaggaacuuaauaugaaaacguccucuguccaucggcccccggccaugaccgugaagaaggagccucgcgaagagagaaaaggccccaagaaaggcacagccgcucuggggaaggccaaccggcagguuagcaucaccggauuuuuccagcgcaaauga

SEQ ID NO: 73986 - RNA, 240 nt, Artificial Sequence
  derived and/or modified sequence opt5 from POLD4__Homo_sapiens__NP_001243799
augggcagaaagcggcugaucaccgacagcuaccccguggucaaacgcagagaggggccugccggacacuccaagggcgaacucgcuccggagcugggggaggaaccccagccucgggaugaagaggaggccgaacuugagcugcuccgccaauucgaccuggcguggcaguauggacccugcacaguuucuggcauuagcaucccuuacgaagcucccagaaaaacguccuguccuuga

SEQ ID NO: 73987 - RNA, 1317 nt, Artificial Sequence
  derived and/or modified sequence opt5 from POLDIP3__Homo_sapiens__NP_001265586
auggccgacaucagccuggaugagcucauuagaaagcggggcgcugccgcgaaagggcgccugaacgcuagacccggagugggcgggguccggucccgcguuggaauccagcaaggccuucugucucagagcaccagaacagccacguuccagcagcgguuugacgcccgccaaaagauugggcucuccgaugcuagacugaaacuuggagugaaggacgcccgggaaaaacugcuccagaaggaugcucgcuucagaaucaagggcaaagugcaggacgcccgggagaugcugaauagccgcaagcagcaaaccacagucccucagaaaccgagacagguggcggaugcccgggaaaagauuagccugaaacgcuccucucccgcugccuuuaucaacccucccaucggcaccguuacacccgcucucaagcugaccaagacaauucagagaaugcacguggaccccgucggguggauccuuaccacggagugcuuccaagugccucagcagaaagccauggcgccgcugcauccccacccugccggaaugcggauuaauguugugaacaaucaucaagcuaagcagaaccucuacgaucuggacgaagaugacgauggcaucgccagcguccccaccaaacagaugaaguuugcugccuccgggggauuccuucaccauauggccggccugucuucuuccaaacucagcaugucuaaggcucugccucugacaaaaguggugcagaaugacgcguauaccgcccccgcucucccguccagcauuagaacaaaggcccugaccaacaugucucgcacgcuugucaauaaggaggagccucccaaagaacugccugccgcugagcccguucucuccccucuggaagggacaaagaugaccgugaacaaucuucacccucgggugacagaggaggacaucgucgaacuguuuugugugugcggagcccucaaaagagcgcgccugguucacccgggcguggcugaggucguguucguuaagaaagaugacgccauuaccgccuacaagaaguauaacaaucggugucuggauggccaacccaugaaaugcaaccuccauaugaaugggaacgugaucaccagcgaccagccuauccugcuuagacuguccgauucucccagcaugaagaaagaauccgagcucccucgccgggucaacagcgcuucuuccagcaaucccccggccgaaguggacccugauacaauucugaaggcucuuuuuaaaucuagcggagccuccgucacgacccagcccacagaguucaagaucaagcuguga

SEQ ID NO: 73988 - RNA, 1506 nt, Artificial Sequence
  derived and/or modified sequence opt5 from POLE2__Homo_sapiens__NP_001184259
auggcccccgagagacugcggagccgcgcucucuccgccuucaagcugagaggccuucugcuccggggagaagcgaucaaauaccugaccgaggcccuucagucuauuagcgaacuggagcucgaagacaagcuggagaaaaucauuaacgcuguggagaagcaaccucuguccucuaauaugaucgaacgcagcgucguugaggccgcugugcaggaaugcucccagucuguggaugagacaauucuccugaugacgaaccacccggcccccaaucuuuuuggaaccccuagagacaaagcugagauguuccgggaacgcuauacaauccugcaucagagaacccaccggcaugagcucuuuacacccccugucaucggcagccaccccgaugaauccgggagcaaguuccaacugaagaccauugagacacuucugggaucuaccacgaaaaucggcgacgccauugugcucgggaugaucacccagcugaaggaaggaaaauuuuuccuggaggauccuacaggcaccguucagcucgaccuguccaaggcgcaguuucauagcggccuuuacacagaggccuguuucgugcuggcugaagggugguuugaggaucaagucuuccacgugaacgccuuuggauucccgcccaccgaaccuucuuccacgacacgcgcuuauuacggcaauauuaacuuuuucgggggacccagcaauaccucuguuaaaacauccgccaagcucaagcagcuggaggaagagaacaaagacgcgauguucguguuucuuagcgaugucuggcuggaccagguggaggugcucgaaaagcugagaaucauguucgccggcuauuccccugcucccccgaccugcuuuauucugugugggaauuucucuagcgccccuuacgggaaaaaccagguccaagcucucaaggauucccugaaaacccuugccgacaucaucugcgaguaucccgauauucaccagagcucucgguuuguuuucgugccuggccccgaagaccccggcuuuggguccauccugccucgcccgccccucgccgagagcauuacaaaugaguucagacagcgggugccuuuuucugucuucacgaccaaccccugucgcauccaauacugcacacaggaaauuaccguguuuagagaggaccugguuaauaagaugugucggaacugcgugagauucccuagcuccaaucuugcuauccccaaccauuuugucaaaacaauccugucucagggacaccucaccccgcugccucuguacgugugucccguuuauugggcguacgauuaugcccuccgcguguacccuguccccgaccugcuugugauugcugauaaguaugacccuuucacgacaaccaacaccgaaugccuguguaucaaucccggcagcuucccgcgguccggguuuagcuucaaggucuuuuacccuucuaacaaaacaguggaggauuccaagcuccagggauucuga

SEQ ID NO: 73989 - RNA, 444 nt, Artificial Sequence
  derived and/or modified sequence opt5 from POLE3__Homo_sapiens__NP_059139
auggccgagagacccgaagaccugaaccucccuaaugcugugaucacccggauuaucaaggaggcccugccggauggcgucaacauuagcaaagaagcgcgcuccgcuaucucuagagccgccagcguuuucgugcuuuacgcuacauccugcgccaauaacuuugcuaugaaggggaaacggaagacgcugaaugccucugacgugcucagcgcgauggaggaaauggaguuccagcgcuuugucacaccccugaaagaggcccuugaggcuuauagacgggagcaaaagggaaagaaagaagccuccgagcagaagaaaaaggauaaagacaagaagaccgauucugaggaacaggacaaaagccgcgaugaggacaacgaugaagacgaggaaagacuggaggaggaagaacagaaugaagaggaagagguggauaacuga

SEQ ID NO: 73990 - RNA, 354 nt, Artificial Sequence
  derived and/or modified sequence opt5 from POLE4__Homo_sapiens__NP_063949
auggccgcugccgcggcugccggcagcgggacccccagagaggaagagggaccugccggcgaagcugccgcuucccagccgcaagcccccacaucugugccuggggcgcggcugagccgccucccccuggccagagucaaggcucuuguuaaagccgacccugaugugacgcuggcuggacaggaggccaucuucauucucgcgcgggccgcugaacuguuuguggagaccaucgccaaggacgcuuacugcugugcccagcagggcaaacgcaagacacuucaaagacgggaucuggacaacgccauugaggcugucgaugaguucgcguuucucgaagggacccuggacuga

SEQ ID NO: 73991 - RNA, 6861 nt, Artificial Sequence
  derived and/or modified sequence opt5 from POLE__Homo_sapiens__NP_006222
augagccugagauccggcgggcggcgcagagccgaccccggagcugauggcgaagccucucgggacgauggggcgaccagcuccgugucugcucucaagcgccuggaaagaagccaauggacagacaaaauggaucuucgguucggauuugaacgccugaaggaaccuggcgagaaaacgggguggcucaucaacaugcacccgaccgaaauucuggacgaggauaagagacuuggauccgccgucgacuacuauuucauccaagaugacggcucucgguuuaaaguugcccugcccuacaagccuuauuucuacauugcuacacgcaagggcugcgagagagaagugagcuccuuucucagcaaaaaguuccaggggaaaaucgccaagguggagaccguccccaaagaagaucuggaccugccuaaucaucucgugggacugaagcggaacuauauucgccuuucuuuucacacaguugaggaucuggugaaggucagaaaagagaucucccccgcugugaagaaaaaucgggaacaggaccaugccagcgacgcguacaccgcccuccugucuuccguucuucagcgcggcggggugaucacagaugaggaagagaccagcaagaaaauugcugaccaacuggauaacaucgucgacaugagagaauaugaugugccuuaccacauucggcucucuaucgaccugaagauucauguggcccacugguacaaugucagauaucgcggaaacgcuuucccgguugagaucacgcggagagaugaccugguggagcgccccgauccugugguccucgccuuugacauugaaaccacaaaacugccccuuaaguucccugaugcggagaccgaccagaucaugaugaucuccuacaugauugacggccagggguaucugaucacaaaucgggaaauugugagcgaggauaucgaagacuuugaguucacccccaagccggaguacgaaggaccuuuuuguguuuucaacgagcccgaugaagcccaccucauucagagaugguucgagcaugugcaagaaacgaaaccuacaaucauggucaccuauaauggcgacuuuuucgauuggcccuuuguggaggcucgcgccgcuguucacggccuguccaugcagcaggagaucggguuccagaaggacucucaaggagaauacaaagcuccccaaugcauucauauggauugucuucggugggugaagagagacagcuaucugccugucggcucccacaaccucaaagccgcugcgaaggccaagcugggguacgauccgguggagcuggaccccgaagauaugugccgcauggcuacagagcagccucaaacccucgccaccuacagcgucucugacgccguggcuacauauuaccuguauaugaaauacguucaccccuuuaucuucgcccuuuguacgauuaucccuauggagcccgaugaagugcugcggaagggauccggcacccucugcgaggcgcugcuuaugguccaggcuuuucaugccaauauuaucuucccgaacaaacaggaacaggaguuuaauaagcugacagacgacgggcacgugcucgauagcgaaaccuauguuggaggccauguggaggcccuggagucuggcgucuucagaagcgacaucccuugucgcuuucggaugaaccccgcugccuucgauuuucugcuccaaagaguggagaagacacugcggcacgcucuugaggaagaggaaaaggugccuguugagcaggucaccaauuucgaggaagugugcgacgagauuaaguccaaacuggccucucucaaggaugugcccagccgcaucgaauguccucugauuuaccaucuggacgucggggcgauguaucccaacaucauucuuacgaacagacuccagccguccgccaugguggaugaggcuacaugcgccgcuugugacuucaauaaaccuggagccaacugccagcggaagauggcguggcaauggagaggcgaauuuaugcccgccagccgcucugaguaccaccggauccagcaccagcuggaguccgaaaaauuucccccucuguuuccggaggggcccgcuagagccuuccaugaacucagccgcgaggagcaggcuaaguacgaaaagagacggcuggccgauuauugccgcaaagccuacaagaaaauucacaucaccaagguugaggaaagacuuaccacaaucugucaacgggaaaauucuuuuuauguggacaccguccgcgcuuucagagaucggcgcuacgaauuuaaaggacugcauaagguguggaaaaagaagcucuccgcggccguugaggugggcgacgcugccgaggucaaaagaugcaagaacauggaagugcuguaugauagccugcagcuugcccacaaauguauucucaauuccuucuacggguauguuaugcggaagggcgcucgcugguacucuauggagauggccggaaucgugugcuuuacaggcgcgaacauuaucacgcaggcuagagaacugauugagcagaucgggcggccucuggaacucgacaccgacggaaucugguguguccugcccaauagcuucccugagaacuuuguguucaaaacaaccaaugugaagaagcccaaagucacaauuuccuacccuggcgccaugcuuaacaucaugguuaaggagggguuuaccaaugaucaauaucaggaacuggccgagcccucuagccucacguacgugaccagauccgaaaacagcauuuucuucgagguggacggaccguaucuggcuaugauccugccugccucuaaagaagagggcaagaaacuuaagaagcgcuacgcggucuuuaaugaggaugggucccucgcugaacugaaaggcuucgaggugaagcggagaggagaacugcagcucauuaaaaucuuucaaagcucuguuuucgaggccuuucugaagggcuccacacuugaggaaguguaugggagcgucgccaaaguggcugacuacuggcuggauguucucuauucuaaggccgcuaacaugcccgacagcgagcuguucgaacugaucuccgagaaucgcagcaugucucggaaacuugaagauuacggagagcagaaauccaccagcauuuccacagccaagagacucgcggaguuucugggcgaccagauggugaaagaugccgggcugucuugccgcuacaucauuagccggaagccugaaggaucccccgucaccgagagagcuaucccgcucgccauuuuccaggcugaaccuacggugcgcaaacacuuucugcggaaguggcuuaaaucuagcucccugcaagacuucgauaucagagccauccucgacugggacuauuacauugagcggcugggcucugccauccagaagauuaucacaauucccgcugcgcugcagcagguuaagaacccugugccccgcgucaaacaucccgauuggcuucacaagaaacugcucgaaaagaacgacguguauaaacaaaagaagaucagcgagcuguuuacccucgaggggagacgccaggugacaauggccgaagccuccgaggauagcccucggccgucugcccccgacauggaagauuucggccuggucaaacuuccucaucccgccgcuccuguuaccgugaagagaaaacgggugcugugggagucccaggaagagagccaggaccucacccccacagucccuuggcaagagauucugggacagccgcccgcccugggcacgucucaggaagaguggcuuguguggcugagauuccacaagaaaaaguggcaacuccaggcgcgccagcggcuggcuagacgcaagcggcagagacucgaauccgccgaggggguucugcgcccuggagccauccgggauggccccgcuaccgggcuuggcagcuuccugagacgcacagccagaucuauccucgaccugccuuggcaaauugugcagaucuccgagaccagccaggcgggacuguuccggcuuugggcucuggucggguccgaucuccauuguauucgccugagcauccccagaguguuuuacguuaaucagcggguggccaaagccgaagagggcgcuucuuaucgcaaggucaacagagugcucccgcggagcaauauggucuacaaccuguaugaauacuccgugccugaggacauguaccaagaacacauuaaugagaucaacgccgagcuuucugcucccgauaucgaaggaguuuaugagacacaggugccccugcuguucagagcccucguccaccugggcugcguguguguugugaauaaacagcuuguccgccaucugagcgggugggaagcggagaccuuugcccucgaacaccuggagaugcggucccucgcucaguucucuuaccuggagccuggaagcauuagacauaucuaucuuuaccaccaugcccaagcucacaaggcccuguuuggcauuuucauccccucccagcgccgggccucuguguuugugcuggacacgguuagaagcaaccagaugccuucccucggggcucuguauagcgcggaacacggacuucugcucgagaaagucggcccggaacugcugcccccucccaagcauacauucgaggugcgggccgaaaccgaucugaagaccauuugccgcgcuauccagagauuucuucuggccuacaaagaggagcggcgcggcccuacacugaucgccgugcaaucuuccugggaacucaagagacuggcuagcgagauucccguccuugaagaguucccgcuggugccuaucuguguugccgacaaaauuaauuauggggugcucgacuggcagcggcacggagcgcgcagaaugauccggcauuaccugaaccucgauaccugccugucucaggcuuuugagaugucccgcuacuuccacauucccaucggcaaucuuccugaagacauuagcacauucggguccgaucuguuuuucgccagacaccuccaacggcauaaccaccuccuguggcuuucucccacggccagaccugaccugggaggcaaggaggcugaugacaauugccucgucauggaauuugaugaccaggccaccguggagaucaacagcuccggguguuauagcacaguuugcguggaacuggaucugcagaaucucgcggucaacaccauccuucagucucaucacgugaacgacauggagggagccgauuccaugggcauuagcuucgacguuauccaacaggcuucucuggaggauaugauuacaggcgggcaggccgcuagcgcccccgcuuccuacgacgaaaccgcccuguguucuaauacguuucgcauccucaaaagcaugguggucggaugggugaaggagauuacccaguaucauaacaucuacgcggacaaucaagugaugcacuucuaucgguggcugagauccccgucuagccuucugcacgauccugcccuccaucgcacacugcacaacaugaugaagaaacuguuucuccagcuuaucgcugaguucaagcggcugggcuccagcgucauuuacgccaauuuuaacagaaucauucugugcaccaaaaagcgccggguugaggacgcuaucgccuauguggaauacauuacaucuuccauccauagcaaagagaccuuccacucccucacaaucucuuuuagcagauguugggaguuccugcuuuggauggaucccuccaauuacgggggaauuaagggcaaagugucuagccgcauccacugcgggcugcaggacucccagaaggccggaggcgcugaagaugagcaagaaaacgaggacgaugaagaggagcgggacggcgaagaggaagaggaggcggaagagagcaaugucgaagaucuccuggagaacaauuggaacauucugcaguuucucccccaggccgcuucuugucaaaauuauuuccuuaugaucguguccgccuacauuguugccguguaucauugcaugaaggacgggcugagacgcagcgcuccuggaucuaccccgguccggagacgcggcgccucccagcugagccaggaagcggagggggccgugggagcucuccccggcaugaucacguucucucaggauuacguugccaacgagcugacacagagcuuuuucaccauuacccagaaaauccagaagaaagugacaggguccagaaauucuaccgaacuuagcgagauguuuccuguccugcccggaucccaccuccugcugaacaacccugcucucgaguucaucaaguauguguguaaaguccuuagccuggacacgaauauuacaaaccaggugaauaagcugaaccgggaccuccugcgccuuguugaugugggcgaguuuuccgaagaggcccaauucagagaccccugccggucuuacgugcugccugaggucaucuguagaagcugcaauuuuugccgggaucucgaccuguguaaggauuccucuuucagcgaagacggcgcgguucugccgcaguggcucugcuccaacugucaggcccccuaugauucuagcgcuauugagaugacccuuguggaagugcugcagaaaaagcugauggccuuuacacuccaagaccuggucugccuuaaaugucgcggggugaaggagaccuccaugccuguuuacugcagcugugcuggagauuucgcccugacaauccauacccagguguuuauggaacagauuggcaucuucagaaauaucgcucagcacuacgggaugucuuaucuccuggagacgcuggaguggcuccuucagaaaaacccccagcugggacauuga

SEQ ID NO: 73992 - RNA, 1458 nt, Artificial Sequence
  derived and/or modified sequence opt5 from POLG2__Homo_sapiens__NP_009146
augagaagccggguggccguccgcgcuugccacaagguuuguagaugccugcucuccggcuucgggggacggguggacgccggccagcccgagcugcuuaccgaacgcucuagcccuaaagggggacaugugaagucccacgcggagcuggaaggcaacggggagcauccggaagcucccggaucuggcgagggcagcgaggcccuccuggaaaucugucaaagacggcacuuucuuuccgggucuaaacagcagcugagccgcgauucccuccugagcggaugccauccuggcuucgggccccugggagucgagcucagaaagaaucuggccgcugaaugguggacaucugugguuguguuucgggagcaggucuucccuguggacgcccuucaccacaaacccggcccucugcucccgggggauuccgcuuuucgccugguuagcgccgagacgcuuagagaaauucugcaagacaaggagcucucuaaggaacagcugguggcguuccuggagaacguccucaaaaccuccggaaagcugcgggaaaaucuucugcauggcgcccucgagcacuacgugaacugucuggaucuugugaauaaacgccugcccuauggccucgcucagaucggggucugcuuucauccuguuuucgacacaaagcagauuagaaacggagugaaaagcaucggcgagaagaccgaagccucucuggugugguuuacacccccucggaccuccaaucaauggcuggauuucuggcuccgccacagacugcagugguggcggaaguuugcuaugagccccuccaacuucucuagcuccgacugucaggaugaggaagggagaaaaggaaauaaacuuuacuauaacuuuccguggggcaaggagcugauugaaacacucuggaaucugggggaccacgagcuucugcauauguacccuggaaacgucagcaagcuccacggccgcgauggccggaaaaaugugguucccugcgugcugucugucaacggggaccuggauagaggaaugcucgccuaucuguacgacuccuuccagcuuaccgagaauagcuucacgcgcaagaaaaaccugcaucggaaggugcucaagcugcacccuugucuggcgcccaucaaaguugcccuugacgugggcagagggcccacccucgaacugcgccaagucugccagggacuguuuaacgagcuccuggaaaauggcaucucuguguggccuggguaucuugagacaaugcagagcucccuggaacaacucuacucuaaguacgaugagaugagcauucuguucaccguccuggugacagagaccacgcuugaaaacggccucauccaucugcgguccagagacacaaccaugaaagagaugaugcacauuagcaagcugaaagauuuucucaucaaguauauuucuuccgcuaagaauguuuga

SEQ ID NO: 73993 - RNA, 3720 nt, Artificial Sequence
  derived and/or modified sequence opt5 from POLG__Homo_sapiens__NP_002684
augagcagacugcucuggcggaagguggccggcgcuaccgucgggcccggaccuguuccggcccccggccgcuggguguccucuagcgugccugcguccgaccccucugaugggcagagacggcgccaacagcagcagcaacagcagcagcaacagcagcagcaaccucagcagccccaaguccugagcuccgagggaggccagcuuagacacaacccucuggacauccagaugcucucucgggggcugcaugaacagauuuucggacaaggcggcgagaugccgggggaagcugccgugcgcagaagcguugagcaccuucagaaacauggacuguggggccagcccgccgugccucuccccgaugucgaacugcggcugccuccccucuacggggacaaucuggaucagcacuuucgccuucuggcucaaaagcagucccucccguaucuggaggccgcuaaccuucugcuccaggcccagcugccucccaaaccucccgcgugggccugggcugagggauggacaagauacggccccgaaggggaggccgugccuguugcuaucccggaagaacgggcccugguguucgacgucgaggugugccucgcggaaggaacgugucccacccuggccguggcuauuagcccuucugccugguauuccuggugcagccaacgccuugucgaggaaagauacucuuggacaucccagcugagccccgcugaucucaucccucuggagguucccaccggcgccucuuccccgacacagcgggacuggcaggaacaacuuguggugggccauaaugucagcuuugaucgcgcccacauuagagagcaguaucugauccaggggucccggaugagauuccucgacaccaugucuaugcacauggcuaucagcggacuguccagcuuucaacgcucucuguggauugcggccaagcagggcaaacauaaggugcagccucccacaaagcaggggcaaaaaucccagcggaaggcuagacgcggaccugccaucagcucuugggauuggcucgacauuagcuccguuaacucucuggccgaggugcaccggcuuuacgucggcgggcccccucuggaaaaagagcccagagaacucuucgugaagggaaccaugaaagauauccgcgagaauuuucaggaccugaugcaguauugugcucaagacguuugggccacgcaugaaguguuccagcagcagcuuccgcuguuucucgagcggugcccucaccccgucacccuggcgggcaugcuggagaugggcgugagcuaccuccccgucaaccaaaauugggaaagauaccuggcugaggcccaggggacauaugaggagcuucagcgcgaaaugaagaagucccugauggaucucgccaacgacgcuugucaacugcugagcggagagcgguacaaagaggauccuuggcuuugggaccucgaaugggaucugcaggaguucaagcagaaaaaggccaaaaaggugaaaaaggaaccggcuaccgccucuaagcugcccauugagggcgcgggggccccuggagaccccauggaucaggaggaccucggcccuugcuccgaagaggaagaguuucaacaggauguuauggcuagagccugucugcagaaacuuaaggggacaaccgaacugcuccccaaacgcccucagcaccuucccggccauccgggaugguaucggaagcugugcccuagacuugacgaucccgcuuggacgccuggccccagccuccugucucugcaaaugcgggugacaccgaaacucauggcccugaccugggacggguucccucuucacuacuccgagcgccauggauggggcuaucugguccccgggagacgggacaaucucgcgaagcugccuacaggaaccacccuggagagcgccggcgugguuugucccuacagagcuaucgaaucccuuuaucgcaagcacugccucgagcaggggaaacagcagcugaugccccaagaagccggccuggcugaggaauuucuccugacagauaacucugccauuuggcagacgguggaggagcuugacuaccuggaagucgaggccgaagcuaagauggagaaucuccgggcggccgugccuggacagccgcuggcucugaccgccagaggcgggcccaaagauacacagccuagcuaccaucacggaaacggccccuauaaugacguggauaucccuggguguugguucuucaagcugccccacaaagacggaaacuccugcaauguuggcucuccuuuugccaaggauuuccucccgaagauggaagacgggacccugcaagcuggccccggaggcgccagcgggccucgcgcgcuggagaucaacaaaaugauuuccuuuuggagaaacgcucauaagcggaucagcucucagauggucguguggcucccccgcuccgcccugccuagagccgugauucggcaccccgauuacgacgaggaaggacuuuauggcgcuauccugccgcaggucgugacagccgggaccauuacgcgcagagcgguugagccuacauggcucaccgcuagcaaugcccggcccgaucgcgugggaucugaacugaaagccaugguccaagcucccccuggcuacacccuggugggggccgacguugauucccaggagcuuuggaucgcugccgugcugggcgacgcgcauuucgccggaaugcacggcugcacagcuuuuggguggaugacccuccagggaagaaagagccggggcacagaccugcacucuaaaacggccaccacagucgggaucagccgcgagcaugcuaagauuuucaacuauggaagaaucuacggcgccggccagcccuuugccgaacggcuccugaugcaauucaaucacagacuuacccagcaggaggcugcggaaaaggcccagcaaauguaugcugccacaaaagggcugcgcugguaccggcucuccgaugagggagaauggcuggugagagagcugaaccuuccuguugaccgcaccgagggcggguggauuagccugcaggaucuccggaaggugcagagagaaacggcccgcaaaucucaguggaagaaaugggaggucguggcugaacgggccuggaagggaggcaccgaguccgaaauguuuaauaaacuggagagcaucgcgacauccgacauuccgagaacccccgugcucggguguugcaucucucgcgcucuggagccuagcgccguccaagaagaguucaugacaucccggguuaacuggguggugcagucuagcgccgucgauuaccuucaucugaugcucguggcuaugaaguggcuguuugaagaguucgccaucgacggaagauuuuguauuuccauccacgaugaaguucgguaucuggugcgcgaggaggacagauaccgggcggcucuugcccugcagauuaccaaucuccugacgcgcugcauguucgccuauaagcucggccugaacgaucuuccccaaucugucgcuuucuuuagcgccguggacaucgauagaugucugcggaaagaaguuacaauggacugcaagaccccuuccaaucccacaggcauggagagacgcuacgggauuccgcagggagaagcucuggauaucuaucagauuaucgagcucaccaaaggcagccuggagaagcggucucagccugggcccuga

SEQ ID NO: 73994 - RNA, 1245 nt, Artificial Sequence
  derived and/or modified sequence opt5 from POLH__Homo_sapiens__NP_001278899
auggccaccggccaggacagaguggucgcucugguugauauggacugcuucuuugugcaaguggagcagcggcagaacccccaccuccgcaauaagccuugugccgucgugcaguacaaaagcuggaaagggggaggcaucauugcgguuuccuaugaagcuagagccuucggggugacacggucuaugugggccgaugacgcuaagaagcugugcccggaucuucugcucgcccaaguccgcgagagcagaggaaaagcuaaccugacgaaguaccgggaagccuccguggagguuauggaaaucaugucucgcuuugcggugauugagagagccagcaucgacgaggcuuaugucgaucuuaccuccgccgugcaggaacggcugcagaagcuccagggccaacccauuucugcugaccugcugccuagcacauacaucgaggggcucccccagggaccuaccacagccgaagagaccgugcagaaagagggcaugcgcaagcagggccuguuccaauggcuugauucccugcagaucgacaaucucacaagccccgaucugcagcuuaccgucggggcgguuauuguggaagagaugagagccgcuaucgaacgggagacgggauuucaauguucugccggcauuucccauaacaaagugcuggcuaagcucgccugcgggcugaauaaaccuaaccgccagacccuggucagccacggaucugugccgcagcuuuucucccagaugcccaucagaaagauucggagccugggcgggaagcucggagccucuguuaucgaaauucugggcaucgaguauaugggcgagcucacacaauuuaccgaaucccagcugcagagccauuucggggagaaaaauggauccuggcuuuacgcuaugugucgcggcaucgaacacgacccugugaagcccagacagcugccuaaaacaauugggugcucuaagaacuuucccggaaaaaccgcgcucgccacgcgggagcaaguccagugguggcugcugcagcucgcucaggaacuggaggagagacuuacaaaggaucgcaaugacaacgaccggguggccacccaacugguugugagcaucagaguccagggcgauaaacgccucuccagccugcggagauguugcgcccuuacacgcuaugacgcucauaagaugucucacgaugccuucaccgugauuaagaauuguaacaccuccgggauccagacagaauga

SEQ ID NO: 73995 - RNA, 2223 nt, Artificial Sequence
  derived and/or modified sequence opt5 from POLI__Homo_sapiens__NP_009126
auggagaagcugggcguggaacccgaggaagaagggggaggcgacgaugacgaggaggaugccgaggcuugggccauggaacucgcggacgucggggcugccgccagcucccagggaguucacgaucaagugcugccuaccccgaacgcuucuagcagagugaucguccauguggaccuugauugcuucuacgcccagguugagaugauuuccaaucccgaacugaaagacaagccucucggcgugcagcagaaauaucuggucgugacauguaacuacgaggcucggaaacuugggguuaagaagcugaugaaugugcgcgaugccaaggagaaaugcccccaacucguccuggugaacggagaagaccugacgagauaucgggagaugucuuacaaggugaccgaacuccuggaggaauuuagcccugucguugagcgccuuggcuucgaugagaauuuuguggaccugacagaaaugguggagaaaagacuccagcagcugcaguccgaugaacuuucugcggucaccgugagcggccacguuuauaacaaucaauccaucaaccugcucgacgugcugcauauucggcugcucgucgggagccagaucgccgcugagaugcgcgaagccauguacaaucagcugggacuuacaggcugugcugggguggccucuaacaagcugcucgcgaaacugguuuccggaguguucaagcccaaucagcaaaccguccuucugccugagagcugccagcaccucauucauucucugaaccacaucaaggagaucccgggcauuggguauaaaacagccaagugucuggaagcucucggaaucaauuccgugagagaccugcagaccuuuagccccaaaauucuugagaaggaacugggcaucucugucgcccaacggauucagaaacucuccuucggcgaggauaacagcccugugauccuguccgggcccccucagucuuuuagcgaagaggacuccuucaagaaaugcagcucugagguugaagcuaagaauaagauugaggaacuucuggccucccuccugaaccgcgugugucaggauggaagaaaaccccacacgguccggcugaucauccgcagauacagcucugagaagcauuacggccgggagagccgccaaugcccgauuccuucccacgugauccagaaacucgggaccggaaacuaugacguuaugacacccaugguggauauucugaugaaacuuuuuagaaauauggucaacgugaagaugccuuuccaucugacccuccugucuguguguuuuugcaaucugaaggcccuuaacacagcuaagaaaggccucaucgacuacuaucugaugcccagccuguccaccacgagccggucugggaagcacuccuucaaaaugaaggauacacacauggaagacuuucccaaagauaaggagaccaauagagacuuccucccuagcggacgcauugaaucuacacggaccagagaguccccgcuggauaccacaaacuucagcaaggaaaaagacaucaaugaguuuccccuuuguucccugccugagggcguugaccaggaagucuucaagcagcuccccguggauauccaagaggaaauucugucuggcaaaagccgcgagaaguuucaggggaaaggauccgugucuugcccucugcaugcgagccggggcguccuuuccuucuuuagcaagaagcagaugcaggacauccccauuaacccgagagaucaccucucuuccagcaaacaagugucuuccguuagcccuugcgaacccgggacgucuggauucaauagcuccucuagcuccuacaugagcucccagaaggacuauucuuacuaucuggauaaccgccugaaagacgagcggaucagccagggcccuaaggagccccagggguuucauuucaccaauuccaacccugccgugucugcuuuucacagcuuccccaaucuccaauccgaacagcuguuuucuagaaaccauacaaccgauagccacaaacagacagucgccaccgacucccacgagggccuuacggaaaaucgcgagccggauagcguggacgaaaagauuacauucccuucugauaucgacccccaaguguuuuacgagcugcccgaggccguucagaaagaacuccuggcugaguggaagcgggccggauccgauuuccauaucggccacaaguga

SEQ ID NO: 73996 - RNA, 2613 nt, Artificial Sequence
  derived and/or modified sequence opt5 from POLK__Homo_sapiens__NP_057302
auggacagcaccaaggagaaaugcgauuccuacaaggacgaucugcuccugagaaugggccuuaacgacaauaaagccgggauggaaggacuggauaaggagaaaaucaacaagauuaucauggaagcuacaaagggcucucgguucuaugggaaugagcucaaaaaggaaaaacaggugaaccaacgcauugagaauaugaugcagcagaaggcccagaucacgagccaacagcugagaaaagcgcagcuucaggucgaccgguuugcuauggagcuggaacaaucccgcaaccucucuaauaccauuguucacaucgauauggacgccuucuacgccgcuguggagaugagagauaaccccgaacugaaggacaagccuaucgccgugggaagcauguccaugcugucuacaagcaauuaucaugcucggcgcuuuggcgucagagccgcgaugccgggguucauugccaaacggcucuguccccagcugaucauugugccucccaacuuugauaaguaccgcgcuguuuccaaagaggugaaggagauccuugccgacuaugauccuaauuucauggcuaugagccuggacgaagccuaccucaacauuaccaaacaccuggaggaaagacagaauuggcccgaggacaagcggcgcuauuuuaucaaaaugggaucuuccgucgaaaacgauaauccuggcaaggaggugaacaagcugagcgagcaugaaagaucuauuuccccgcuucucuucgaggaaagccccucugacguucagccucccggcgauccuuuucaagugaacuucgaggaacagaauaacccccagauccugcaaaauuccgucguguuugggacaagcgcgcaggagguggucaaagagauccgguuccgcauugaacagaagaccacacugaccgccuccgcuggaaucgccccgaacacgaugcucgcuaaaguuugcucugacaagaauaaaccuaacggccaguaccaaauucugcccaauagacaggccgugauggauuuuaucaaggaccuuccuauucggaaggugagcgggaucggaaaagucaccgagaagaugcugaaagcccucggcaucauuacauguaccgaacuguaccagcagagagcgcuucugucccuccuguucagcgagacaucuuggcacuauuuccugcauaucucccucgggcugggaagcacccaccuuacgcgcgauggcgaacggaagucuaugagcguggagagaacauuuuccgagauuaacaaagcugaggaacaauacucucugugccaggaacucuguagcgagcuggcccaggaccuucagaaggagcgccugaagggccggaccguuacaaucaaacucaagaaugugaacuucgaagucaaaaccagagcuuccaccgugagcucuguuguguccacagccgaggaaauuuuugccaucgcuaaggagcugcugaaaacggaaaucgaugccgacuucccccacccccuccgccugcggcuuaugggggucagaauuagcucuuuuccuaaugaggaggaucgcaagcaucaacagcgguccaucauuggauuccugcaggcgggcaaccaggcucucagcgccaccgaaugcacacuggagaagaccgacaaagacaaguuugugaaaccgcuggaaaugucccacaagaaaucuuucuuugauaagaaaagaagcgagcgcaaguggucccaucaagacacauucaagugugaagccgucaauaaacagucuuuucagaccagccaacccuuccaggugcuuaagaaaaagaugaacgagaaucucgagaucuccgaaaacagcgaugacugccagauucugacguguccuguuugcuuucgggcucagggguguaucucucuggaggcccucaacaaacacguggaugaaugccuggacggacccuccauuagcgagaauuucaagauguucucuugcucccacgucagcgcuacaaaggugaacaaaaaggaaaauguuccugccucuagccuuugugagaaacaagauuaugaggcgcaucccaagaucaaagaaaucuccagcguggacugcauugcccuggucgauaccaucgacaacucuuccaaggcugagagcauugaugcccucuccaauaagcacucuaaagaagaguguagcucccugccgucuaagagcuuuaacaucgagcauugccaccagaauagcucuagcaccgugucccuggaaaacgaggacgugggcagcuucagacaggaauaccggcagccuuaucuuugugagguuaaaacagggcaagcucucgucugccccguguguaauguggaacagaagaccucugaucugacacuguuuaacguccauguggacguuugccucaauaaauccuucauucaggagcugcgcaaggacaaguuuaacccugugaaucagcccaaagagagcucuagauccacgggauccucuuccggcguccaaaaggccgugacccggacaaaaagaccuggccuuaugaccaaguacagcacauccaaaaagaucaaacccaacaauccgaagcacacccuggauaucuucuuuaaguga

SEQ ID NO: 73997 - RNA, 1728 nt, Artificial Sequence
  derived and/or modified sequence opt5 from POLL__Homo_sapiens__NP_001167555
auggaccccagaggcauccugaaggccuucccuaaacggcagaagauucacgcugaugccagcuccaaagugcucgcgaagaucccgcgcagagaggaaggggaggaagcugaggaauggcugucuagccuucgggcccaugucguucgcaccggaauuggcagagcccgggcugagcuguuugagaaacaaaucgugcagcacgggggacagcucugccccgcccagggcccuggggugacacauauugucguggacgaaggaauggauuacgagcgcgcucugagacuucugcggcucccccaacugccucccggcgcccagcugguuaaguccgcguggcucucucugugucuucaggaacgcagacugguggacgucgccggcuucagcaucuuuaucccuucccgguaucucgaucacccgcagcccucuaaggcugagcaagacgccagcauuccucccgggacgcaugaggcucugcuucagaccgcccuguccccucccccgccucccacacgcccugugagcccuccccagaaagcgaaggaagcccccaacacccaggcucaaccgaucucugaugacgaggccuccgauggagaagagacacagguuagcgcugccgaccucgaagcccugauuucuggccacuaccccaccucccuggagggggauugcgagccuagccccgcuccugcggugcucgacaaaugggucugugcccagcccucuucccaaaaggcuacaaaucacaaccugcauaucaccgaaaaacuugaggugcuggccaaggccuauagcgugcagggagauaaguggagagcucucggcuacgccaaagcgauuaaugcucugaaguccuuccacaaaccggucacgucuuaucaggaagccugcagcaucccugggauuggaaagcggauggccgagaaaaucaucgaaauucuugaguccggccaucugcgcaagcucgaccacaucagcgagucuguucccgugcuggaacuguuuuccaacauuuggggcgcugggaccaaaacagcccagaugugguaccaacagggauucagaagccucgaggacauccggucucaggcuagccugaccacacagcaagccauuggccuuaagcacuauuccgauuuucuggaaagaaugccucgcgaggaagcgaccgagaucgagcagacggugcagaaggccgcucaggccuucaauucugggcuccugugugucgcuugcggaagcuaccggagaggcaaagccacauguggggacguggauguucuuaucacccaucccgacggacgcucccaccggggcauuuuuagcagacugcucgauucucugcgccaagaaggcuuccugacagacgaucucgugucccaggaggaaaacgggcagcagcaaaaguaccugggagucugccggcuuccuggccccgggagacgccaucggagacuggacaucauugugguuccguauagcgaguuugcgugugcccuccuguacuucaccggaucugcucacuuuaaucgcuccaugcgggcccuggcuaaaaccaagggcaugagccuuuccgagcaugcccucucuacagccguggucagaaacacgcacgggugcaaagugggcccuggacggguccugcccacccccacagaaaaggauguguuccgccugcucggccugccuuauagagagccggcugaacgggacugguga

SEQ ID NO: 73998 - RNA, 1527 nt, Artificial Sequence
  derived and/or modified sequence opt5 from POLM__Homo_sapiens__NP_001271259
augcugcccaagagacggcgcgccagagugggcagcccuuccggggacgcugccucuagcaccccgcccuccacacgguucccuggagucgcgaucuaccucguugagccccgcaugggcagaucucggcgcgcuuuucugacggggcuugccagaagcaaaggauuccgggugcuggaugccugcuccucugaagcuacccacguggucauggaggaaacaagcgccgaggaagcuguguccuggcaggagcgcagaauggccgcggccccucccggcuguaccccuccggcucuccuggacauuagcuggcuuacagagucucugggggccggacaacccguuccuguggaaugccggcaccgccucgaggucgcuggccccagaaagggcccucugucccccgccuggaugccggcguaugccugucagcggccuacaccccugacccaccauaacaccgggcucagcgaagcucuggagauccuugccgaggcugccggauuugaaggcucugaggggcgccugcucacguucugcagagccgcuuccgugcugaaagcgcuuccuagccccguuaccacacugucucagcuccagggacugccccacuuuggcgaacauuccagccgggugguccaagagcugcucgaacacggggugugugaggagguggaaagaguccgccgguccgagagagccccugcuccgcccggaccugaacaccccucuccugccguucgcugccggugucccgccgcuggcggcgggggaagcugcggcgccgggccggcguggggacauagacacgcugaucgccggcugccucagggccuuauucuguaccaucagcaccagcacuccuguugcgagagccccaccagacucgcccaacagucucauauggacgccuucgaacgcuccuuuuguaucuuccggcugccucagcccccuggggcugccgugggaggcagcacaagacccugcccgucuuggaaggcugugcgcgucgaucuugugguugccccugugagccaguuucccuucgcgcugcucggcuggaccggguccaaacuguuucaacgggagcugagacgguucucucgcaaggagaagggacucuggcugaauagccacggccuuuuugaccccgaacagggguccagcucuggaaaaacgccuagauccagaaagagcugcuucuguugccggcgccauuucucuaaacggcugcagagaaagacauccagcgauaccugggcccucuccacauuucugcaaucucgcgagaccccggaacccgcuugugucccucacuuccauagcggcaacugggccgcucccaaucuugccaccgagugccugcaggcggacaugcucccucccgauccucaucugcaccccuccccgccuagacccgggucuagcggcggacagcugugucuccaggaccaacuguccccuugcuggugugccgcuggcugcgaugaagugggggcccuuagcgcuucucugauuacaguuuga

SEQ ID NO: 73999 - RNA, 2703 nt, Artificial Sequence
  derived and/or modified sequence opt5 from POLN__Homo_sapiens__NP_861524
auggagaacuacgaagcccuggugggcuucgaccucugcaauacaccccugagcuccgucgcucagaagaucaugucugccaugcacagcggggaucuuguugacuccaaaaccuggggaaagucuacggagaccauggaagugauuaacaaaagcuccgugaaguauucuguccaacuggaggauagaaaaacacagagcccugaaaagaaggaccucaaaucccugcggagccagaccucucgcggcuccgcgaaacuuagcccgcagucuuuuuccgugagacugacagaucaacucagcgcugaccagaagcagaagucuaucuccagccugacccuguccucuugucucauuccccaguacaaucaagaggccagcguucugcagaaaaaggggcauaagcggaaacacuuccuuauggagaacaucaauaacgaaaauaagggauccauuaaccugaaacgcaagcauaucacauauaauaaccucagcgagaaaaccucuaagcagauggcccuggaagaggauacggacgaugcugagggcuaccuuaauuccgggaacagcggagcccugaaaaagcacuuuugcgacaucagacaucucgaugacugggcuaagucucagcugauugaaaugcugaaacaagccgcggcccucgugaucaccgucauguauacagauggcagcacccagcugggcgcugaccagacaccuguguccucuguucgggggauugugguccuugugaagcgccaagccgagggaggccacgggugucccgacgcuccugccugcggacccgugcuggaaggcuucgucagcgaugacccuuguaucuacauucagaucgagcacuccgcgauuugggaucaggaacaggaggcccaucaacaguuugcuagaaauguucucuuccagaccaugaaaugcaaguguccggugaucugcuuuaacgccaaagacuucgugcggaucguccugcaguuuuucgggaaugauggaagcuggaagcacguggcugacuuuauuggccuugauccccgcaucgccgccuggcugauugacccuucugaugcuacgcccuccuucgaggaccucguugaaaaguauugugagaaaagcaucacagugaaggucaacucuaccuacggcaacuccagcagaaauauugugaaccaaaauguucgggaaaaccugaaaacacuguaccgccucaccauggaucugugcuccaaacuuaaggacuaugggcuguggcagcucuuuagaacccuggagcuuccucugauccccauccucgcggugauggaaucucaugccauucaggucaauaaggaggagauggaaaagacaagcgcucugcugggagcccggcucaaagagcuggaacaggaggcccacuucguggcuggcgaacgcuuccuuaucacguccaacaaucaacugagagagauucucuuugggaagcugaaacugcaccuucucucucagcggaacagccugccgagaaccggacugcagaaguacccuuccacaagcgaggccguccucaaugcgcugcgcgaccuucauccccugccuaaaaucauucucgaauauagacaggugcacaagaucaagucuaccuucguugauggccugcuggcuuguaugaaaaagggguccaucagcucuacauggaaccaaaccggaacggugacaggccggcuuuccgccaaacaucccaauauucagggcaucagcaagcaccccauucagaucaccaccccuaaaaacuuuaaggggaaagaggacaagauucucacaaucucuccgcgcgccauguucgucagcuccaagggacauaccuuucuggcugccgauuucagccaaauugaacugcggauccucacacaccugucuggcgaccccgagcuucugaaacucuuucaggaguccgaaagagaugacguguucagcacgcugaccucccaguggaaggauguuccuguggagcaggucacacacgcugaccgcgaacaaaccaaaaaggugguguacgccguugucuauggggcgggaaaagagcggcuggccgcuugccuuggcgugcccauccaggaagccgcucaguuucucgagucuuuccugcagaaguacaagaaaauuaaggauuuugccagagcggccaucgcucaaugccaucagacaggguguguggucagcauuaugggccgccggagaccucugccccgcauccacgcccaugaccagcagcuccgggcucaagccgagagacaggccgugaauuucguugugcagggauccgcugcggaucugugcaaacuugccaugauucacgucuuuaccgcuguggccgccucucacacgcugaccgcucggcucguugcccaaauccaugacgaacugcuguucgagguggaagauccgcagaucccugagugugcggcucuuguccgcagaacaauggaaagccucgaacaggugcaggcccuggagcugcaacuccagguuccccugaaggugucccuuucugccggccggagcugggggcaccuggucccucuccaggaggcuuggggacccccucccggcccgugcagaaccgaguccccuagcaacucucuggccgcgcccgggucccccgcuagcacacagccuccgccccugcauuucucuccuuccuuuugucuuuga

SEQ ID NO: 74000 - RNA, 7773 nt, Artificial Sequence
  derived and/or modified sequence opt5 from POLQ__Homo_sapiens__NP_955452
augaaccugcucagacggagcggcaagcgcagacgguccgagucugggagcgacuccuucucuggaagcggcggggauuccucugccagcccccaguuucuguccggaagcgugcuuucuccuccgcccggccuggggcgcugccucaaagcugccgcggcuggagaauguaagccuaccguccccgacuacgagagagauaaacugcuucuggccaauuggggccucccuaaggccguucuggaaaaauaucacuccuucggcgugaagaagauguuugaguggcaagcugaaugccugcuccuggggcaggugcuugagggaaaaaaccuggucuacagcgcccccacaucugcuggcaagacgcucguggccgagcugcuuauccugaaacggguucucgaaaugcgcaagaaagcgcuguucauucugccuuuuguguccgucgccaaggagaagaaauauuaccuccagagccuguuccaggaaguggggaucaagguugacggauauaugggcucuaccuccccgagcagacauuuuuccucucuugauauugcuguguguacaaucgagcgggccaaugggcugauuaaccgccucaucgaggaaaauaaaauggaccugcuuggaauggucgugguggaugagcugcacaugcucggcgacagccauagaggcuaccugcuggaacuccugcuuaccaagaucugcuauauuacacggaaauccgcuagcugucaagccgaucuggcgucuucccucagcaacgccguccagaucguugggaugucugcuacccugcccaaucuugagcugguggccagcuggcucaacgcugaacuguaccacacagacuuccgcccugugccccugcucgaguccgucaaggugggaaauucuauuuacgauagcuccaugaaacugguuagagaguuugaaccuaugcuucaggugaagggcgacgaggaucaugucgugagccugugcuaugaaaccaucugugacaaccacucuguucuccuguucugccccuccaagaaauggugugagaagcuggccgacauuaucgcccgggaauuuuacaaucuucaccaucaggcugaggggcucgugaaaccgagcgagugcccucccgucauucuggaacaaaaggagcugcucgaagugauggaucagcugcgcagacuuccuucuggacuggacuccguccuccagaaaacggugcccuggggcguugcguuccaccaugccgggcugaccuuugaggaacgggauaucaucgagggagcuuucagacagggccugauucgcgugcuugccgccacaagcacccucuccucuggcgucaaccugcccgcucggagagugaucauucgcacaccuaucuucgggggacggccgcuggacauucucaccuauaagcaaaugguuggcagagccgggcgcaagggaguggauacggucggcgagagcauccugaucuguaaaaauuccgaaaagucuaaagggauugcgcuucugcagggcagccucaagcccgugcgguccugccugcagagacgcgagggagaagaggugacaggcagcaugauccgggcuauucuggagaucauuguugggggagucgccucuaccucccaagacaugcacacauacgccgcuugcaccuuucuugccgcuagcaugaaagaaggcaagcaggggauccagagaaaccaggagucugugcaacucggagccaucgaagcgugugugauguggcugcuggagaaugaauucauucaguccaccgaggccagcgauggcacagaggggaaggucuaucacccuacgcaucucggcucugcuacccugagcuccagccuuucucccgccgacacacuggauaucuuugcugaccuccagcgcgccaugaaaggauucgugcuggaaaacgaucugcacauucuuuaccucguuaccccuauguuugaggacuggacaaccaucgacugguaucgguucuuuugccugugggaaaagcugcccacguccaugaaaagaguggcggagcucgucggcguggaagagggguuccuggcccgguguguuaagggaaaaguggucgcucgcacagagagacagcaucggcaaauggccauucacaagagauuuuucaccagccuugugcugcucgaucugaucuccgaaguuccgcugcgcgagauuaaccagaaguacggcugcaaucgggggcagauccagucucuucaacagagcgcugccguguacgccggaaugaucaccgucuuuuccaacagacugggcuggcauaauauggaacuccugcucucucaguuccagaaacgccugacauuugggauucaaagagagcuuugugaccuggugcgggugagccuccugaacgcucagcgcgcgagaguccuguaugccuccggcuuccacaccguugcugaucuugcccgggccaauaucguggaaguggaggucauucugaagaacgcugugccuuucaaaucugcccgcaaggcgguugacgaggaagaggaagcuguggaggagagacggaauaugcgcacaaucugggucacgggaagaaaaggccucaccgaacgggaggccgccgcucugauuguggaagaggcccgcaugauccuccagcaagaucugguugaaaugggggugcaguggaaccccugcgcgcuucugcacagcuccacauguagccucacccauucugaguccgaggucaaggaacacacauuuaucagccagaccaaaucuuccuacaagaagcugacgagcaaaaauaagucuaacaccauuuucuccgacagcuauaucaaacauuccccuaauauugugcaggaucugaacaagagcagagagcacacaucuagcuuuaauugcaacuuccaaaauggaaaccaggaacaccagaccuguuccaucuuucgggcuagaaaacgcgccucucuugacauuaacaaggagaagcccggcgccagccagaaugaagggaaaacauccgauaagaaaguugugcaaaccuucucucagaagacgaaaaaggcuccucugaacuuuaauagcgagaagaugucccggucuuucagaagcuggaaacgccggaagcaucucaaaagaucccgcgacagcucuccccugaaggauuccggagccugccggauccaccuccagggccagacacugagcaacccgucucuuugugaggacccuuuuacccuggaugaaaaaaagacagaguucagaaauuccgggcccuuugcuaagaacgucagccuguccggcaaagaaaaggacaauaaaaccucuuucccccuccaaaucaagcagaacugcagcuggaauauuacccugacaaacgacaauuuuguggagcauaucgugacgggaucccagagcaaaaacgucaccugccaagccacaucuguuguguccgaaaagggccgcgggguggcggucgaggccgagaaaauuaaugaagugcuuauccagaacggaagcaagaaucagaacguuuacaugaagcaccaugauauucacccuaucaaccaguaucugcggaaacaaucucacgagcagaccagcacaaucaccaagcagaaaaauauuaucgaaagacagaugccgugugaggcuguguccucuuacauuaaccgggacagcaaugucacgaucaacugcgagcgcauuaagcucaauacagaagagaacaaacccucccauuuccaagcccugggcgaugacaucucuagaaccgugauuccuagcgaaguucuccccuccgcuggggccuucagcaagucugagggacagcacgaaaauuuucugaacaucucccggcuucaggagaagaccggcacauauaccacaaauaaaacgaagaacaaucaugugagcgaucugggccugguccucugugacuucgaggauuccuuuuaccuggacacccagucugaaaaaaucauucaacagauggccacagagaacgcuaagcuuggggcgaaagauaccaaucuggccgcuggaaucaugcagaagagccucgugcagcaaaacuccaugaauucuuuccagaaggaaugccacauuccuuuucccgccgagcagcauccucugggcgccacaaaaaucgaccaccucgaucugaagaccgucgggacgaugaaacaaagcuccgacagccacggaguggauauucuuacccccgaaucuccgaucuuccauuccccuauccugcuggaggagaacggccucuuucugaagaaaaacgaaguuagcgugacagacucucagcuuaauuccuuccugcagggguaccagacccaagagacagucaagcccgugauucuccugaucccucagaagcgcacccccacaggaguugaaggcgagugucucccggugccugaaaccagccugaacaugucugacagccuucuguuugauuccuucucugacgauuaucuggucaaagagcagcuccccgacaugcagaugaaggagccucugcccagcgaagugacguccaaucacuuuagcgauucccuuugccugcaagaggaccucauuaaaaagucuaacgugaaugaaaaccaggauacacaucagcagcugaccuguagcaaugacgaguccaucauuuucucugagauggauagcguucaaauggucgaagcucuggacaacguggauaucuuccccgugcaggagaaaaaucacaccgucguguccccuagagcccucgaacuuucugacccgguucuggacgagcaccaucagggcgaucaagacgggggagaucaggacgaacgggcggagaagagcaagcugacaggcaccagacagaaccacuccuuuaucuggagcggggcuucuuucgaucucucccccggacugcagcgcauucuugacaaagugagcucuccucuggagaaugaaaagcucaaauccaugacgaucaacuuuagcucucugaaucggaagaacacagagcugaaugaagagcaagaagucauuuccaaccucgagaccaaacaggugcagggcaucagcuucuccagcaauaacgagguuaagucuaaaauugaaaugcuugagaacaaugccaaccaugaugaaacaagcucccugcugcccagaaaggagucuaauaucguggacgauaacgggcucauuccucccaccccuaucccgacaagcgccuccaagcugaccuuucccggaauccuugaaacgccugucaaucccuggaaaaccaacaaugugcugcagccuggcgagucuuaccucuucggcagccccuccgacauuaagaaccacgaucugucuccggggagccgcaauggauuuaaagacaacuccccuaucagcgauacaucuuucucccugcaacucagccaggacggccuucagcugacccccgcuucuuccagcuccgagucucugagcauuaucgacguugccuccgaucagaaucucuuucaaacauucauuaaggaauggcggugcaaaaagagauuuagcaucucucuggcgugugagaagauccgcucccuuaccagcucuaaaacggcuacaauugggagccgguucaagcaggccuccucuccccaggaaaucccuauuagagacgauggauuucccaucaaaggcugcgacgauacccugguggucgggcucgccguguguuggggaggccgcgacgcuuauuacuucagccugcagaaggagcaaaaacauuccgagauuucugccagccuggugccuccgucccucgaucccagccuuacacugaaggacagaaugugguaucugcagucuugccuccggaaggaauccgauaaagagugcagcgucguuaucuacgacuucauccaguccuauaagauucugcuucugucuuguggcaucagccucgaacaauccuacgaggauccuaaaguggcuugcuggcugcuggaccccgauucucaggaaccuacccuccacagcauugugaccuccuuucuuccccacgagcugccgcugcucgaggggauggaaacaagccagggaauccagucucugggccuuaacgccggguccgagcauagcggacgcuacagagcgucugucgaauccauucugaucuucaauagcaugaaccaacucaauucucugcugcagaaggagaaccuccaggacguguuucggaaaguugaaaugccuucccaguauugucuugcccugcuggagcucaacggcauuggguucagcacggcugagugcgaaucucaaaagcacaucaugcaggccaagcuggacgcuaucgagacccaggccuaccagcuugccggacauagcuuuuccuucacaagcuccgaugacauugcugaagugcuguuucucgagcugaaacugcccccuaaucgcgaaaugaagaaccaaggcucuaaaaagacccucggcagcacaagacgggggaucgauaauggaagaaaacuucgccugggccggcaguucuccaccucuaaggacguccugaacaaacucaaggcgcugcacccccuuccugggcugauucucgaguggagacgcaucacgaaugccauuacaaaggugguuuuuccccugcagcgggagaaaugucugaacccguuccucggaauggaaagaaucuauccugugagccaaucccacaccgcuaccggccggaucacauuuaccgagcccaauauucagaacgucccccgcgauuucgaaaucaagaugccuacacuugugggggagucuccgcccagccaggccgucggaaaaggccugcugccuaugggcagagggaaguacaaaaagggauuuuccgugaauccccggugccaggcccaaauggaggaacgcgcugccgacagaggcaugccuuucagcauuucuaugcggcaugcguucguucccuuuccugggggauccauccucgcugccgauuauagccagcuggagcuucgcauucuggcccaccucucucaugacagacggcugauccaggugcugaacacgggcgcugauguguuccgcuccaucgccgcggaauggaagaugauugagccggaaagcgucggggacgaucucagacagcaagccaaacagaucuguuacggaauuaucuauggcaugggcgcuaagucucuuggggagcagaugggaauuaaagagaaugacgccgcuugcuacaucgacuccuuuaagagccgguacaccggcauuaaccaguucaugacagaaaccguuaaaaauuguaagagagauggguuugugcaaacaauccugggacgccggagauaucugcccggcaucaaggacaacaauccuuaccgcaaagcccacgcugagcggcaggccauuaacaccaucgugcaggggucugcggccgauauugucaagaucgcuacggugaacauucaaaaacagcucgaaaccuuccauuccacauuuaagagccacggccacagagagggaaugcugcagagcgaccagaccggccuuucccgcaaacggaagcugcaagggauguucugccccaucagaggaggcuuuuucauccuccagcugcaugaugaacugcucuaugagguugccgaggaagacgugguccagguggcucagauugucaagaaugagauggaaucugccgugaaacugagcguuaagcuuaaagugaaggucaaaaucggggccuccuggggagagcugaaggauuuugacguguga

SEQ ID NO: 74001 - RNA, 5163 nt, Artificial Sequence
  derived and/or modified sequence opt5 from POLR1A__Homo_sapiens__NP_056240
augcugaucagcaagaacaugcccuggagacggcuccagggaauuuccuucgggauguacucugccgaggaacugaagaaacuuagcgugaaauccaucaccaauccuagauaucuggacucucucgggaacccgagcgcuaauggccuguacgaucuugcccuggggcccgcggacuccaaggaggucuguucuacauguguucaagauuuuagcaacugcuccggacaccucggccauauugaacugccucugacgguguauaauccccuccuguucgacaaacuuuaccugcuccugagagggagcugucuuaacugccacaugcugaccuguccucgggcugugauccaucuccugcugugccagcucagaguccuggaggugggagcccuucaggccguuuaugaacuggagcgcauucucaaucgguuucuggaggaaaaccccgauccuucugcuuccgagauccgcgaggaacuugagcaguacacaaccgaaaucgugcaaaauaaccugcucggcagccagggcgcccacgucaagaaugugugugagucuaaguccaaacugauugcucuguucuggaaggcccauaugaacgcgaaaagaugcccgcacuguaagacagggcggagcguugugcgcaaagaacacaauucuaagcucaccaucacauuucccgccaugguccauagaaccgcuggacagaaggacuccgagccucugggcauugaagaggcccagaucgggaaacggggauaucuuacgcccaccagcgcucgcgagcaccuguccgcccucuggaagaacgaaggcuucuuucugaauuaccuuuucucugggauggaugacgauggaauggagagcagauuuaacccuuccguguucuuucuggacuuccucguggugcccccgagccgguaccgcccuguuucuagacugggcgaucaaauguuuacaaacggccagaccgugaaucugcaggcggugaugaaagacgucgugcucauucggaagcugcuugcccugauggcucaggaacaaaaacuccccgaggaaguugccacaccuaccacggaugaggagaaggacucccugaucgcuauugaccgcagcuuccugucuacacuucccgggcagagccucaucgauaaacuguauaacaucuggauucgccugcagucccaugugaauaucgucuucgacucugaaauggauaagcucaugauggacaaguaccccggcauucggcaaauccuggagaaaaaggaaggacuuuuuagaaaacacaugauggggaagcgcguggauuaugccgcccggagcguuauuugcccugacauguacaucaacaccaaugagaucggcauuccgaugguguucgcuacaaaacugaccuauccccagccugucacccccuggaacgugcaggaacucagacaggcggucaucaauggcccuaacgugcaccccggggccuccaugguuauuaaugaggauggaagccgcacagcucugucugccguggacaugacgcaacgggaggccgucgcuaagcagcugcuuaccccggccacaggcgcgccuaagccccagggcaccaaaaucguguguagacauguuaagaacggggauauucuccugcugaaucgccagccuacacuccaccggcccuccauccaagcucauagagcccgcauccugccugaagagaaagugcuucggcugcacuacgccaacugcaaggcuuauaaugccgacuuugauggagacgaaaugaacgcucauuucccccagagcgagcucggcagagccgaggcguacguccuggccugcaccgaccagcaguaccuggugccgaaagaugggcaaccucuugcuggacucauucaggaccacauggugucuggcgccuccaugacgacacgggggugcuuuuucacccgcgaacacuauauggagcugguuuacagaggccugaccgauaaggucggacgggugaagcuccugagccccuccauccuuaaacccuuuccucuguggacaggcaagcaggucgucucuacccuccugauuaauaucauuccggaagaccauaucccccugaaccuuagcgggaaagcuaagauuacaggaaaagccugggugaaggagacgccuagauccguucccggcuucaacccugauucuaugugcgaaagccaggugaucauccgcgagggggagcuccuguguggaguccuggacaaggcgcacuauggcuccagcgccuacgggcucgugcauugcuguuaugaaauuuacggcggagagaccucuggcaaaguucugacaugccuugcucggcuguuuaccgccuaucuccaacuguacagaggguucacacugggaguggaagauauccuugucaagcccaaagcugacgugaagcgccagagaauuaucgaggaauccacccacuguggcccucaggccguucgggccgcucugaaucuccccgaggcggccagcuacgaugaggugcgcgggaaauggcaagacgcucaccugggaaaggaucagagagacuuuaacaugauugaucucaaauucaaggaagaggucaaucauuauucuaacgaaaucaauaaggccugcaugccguuuggccugcaccggcaguucccugagaacucccuucagaugauggugcaaagcggggccaaaggcucuacggugaauaccaugcagaucagcugucugcucggacagauugaacuggagggccgcagacccccucugauggcuuccggaaagagccuucccugcuucgagccguacgaauuuacaccucgggccggaggcuucgucaccgggcgcuuucugacaggaaucaaacccccugaguucuuuuuccauuguauggcgggcagagaagggcucguugacaccgcugugaagacgucucgguccggcuaucugcagcgcugcauuaucaaacaccucgagggacuggugguccaauacgaccuuacagugagagauagcgacggcuccguugugcaguuucuguauggggaggauggacucgacauucccaagacccaguuccugcagcccaagcaauuuccuuuccuggccucuaacuacgaagucaucaugaaaagccagcaucuucacgaggugcugucccgggccgauccgaagaaagcucuccaccauuuuagagccaucaagaaauggcagucuaagcaccccaauacacugcuccgccggggcgcguuccugagcuauucccaaaagauucaggaagcuguuaaagcccuuaagcuggagucugaaaacagaaaugggcgcagcccuggaacccaggagaugcugcggaugugguacgagcucgacgaagaguccagacgcaaauaccagaagaaagccgcugccugccccgauccuagccugucuguguggcggcccgacaucuauuuugcuuccgucagcgaaaccuucgagacaaagguggaugacuacucucaagaaugggccgcgcagacggagaaguccuaugagaaaagcgaacuuucucuggauagacuccgcacccugcuccagcugaaguggcagcggucccuuugugagccuggcgaagccguuggccugcuggcugcccaaagcauuggggagccguccacacagaugacccucaacacauuccauuuugcuggaagaggcgaaaugaaugugacccuggggaucccccggcuucgcgagauucugauggucgccagcgccaacaucaaaacgccuaugaugucugugcccgugcucaauacaaagaaagcucugaagagagucaaaagccucaagaagcagcugacccggguuugccuuggagaggugcugcagaaaaucgacgugcaagaauccuucuguauggaggaaaagcagaacaaauuucaggucuaccagcugcgcuuccaauuucucccucacgcguauuaccagcaggagaagugccugagacccgaggauauucuucgguucauggaaaccagauuuuucaaacugcucauggagucuaucaagaagaaaaacaauaaggccagcgcuuuucgcaacgugaauacacggagagccacccaacgcgaccuggacaacgccggcgaacucgggcgguccagaggagagcaggaaggcgaugaggaggaagagggccauauuguugacgcugaagccgaggaaggggaugcggacgcuucugaugccaaacgcaaggagaaacaggaggaagagguggacuaugaaagcgaggaagaggaggaacgggagggagaagagaaugaugacgaggauaugcaggaagagagaaacccgcaccgcgaaggcgccagaaagacacaagagcaggacgaagaggucgggcugggaacggaggaagauccuucccuucccgcucugcugacccagccccggaagccuacacacucucaggagccccaaggcccugaagccauggagcgcagagugcaggcgguucgggaaauccauccguucauugacgacuaccaguacgauaccgaggagagccucuggugucaggugacagucaaacugccccuuaugaagaucaauuuugacauguccagccugguggucucucucgcucacggggccgugauuuaugccaccaaaggaaucacgcgcugccugcugaacgaaaccacaaauaacaagaaugagaaagaacucguucuuaacaccgagggcaucaaucugccugaacuguucaaguacgcugaggugcucgaucugagacggcuuuauuccaacgacauucaugccaucgcuaauacauacggcauugaggccgcgcugagagucaucgaaaaggagauuaaagauguguucgccguuuaugggaucgcuguggacccccgccaccucagccuggucgccgauuacauguguuuugaaggaguguauaagccucugaaccgguucggcaucagaucuaacuccagcccccuccaacagaugaccuuugagacauccuuccaguuucuuaaacaagcuaccaugcuggggucucacgacgagcugcgcagcccguccgccugccucgugguuggaaaggucgugcggggcgggacgggacuguucgaacuuaaacagccucugagauga

SEQ ID NO: 74002 - RNA, 3240 nt, Artificial Sequence
  derived and/or modified sequence opt5 from POLR1B__Homo_sapiens__NP_001131076
auggaccccggcagcagauggcggaaccugccuuccgggccgucucucaagcaccugaccgaucccagcuacggaaucccucgcgagcagcaaaaagccgcccuucaggaacugacaagagcucauguggaguccuucaauuaugcgguccacgaaggccucgggcuggcuguucaggccgacauuaacugggccgugaauggaaucucuaagggcauuaucaaacaguuucuuggguacgugcccauuauggucaagagcaaacugugcaaccuccggaaucugccuccccaagcucugaucgagcaucacgaagaggccgaggaaaugggaggcuauuucaucauuaacggcaucgagaaggugauucgcaugcucaucaugccuagacggaauuuuccgauugcuaugauccgccccaaguggaaaacgagagggccuggauacacccaguauggcguuuccaugcauugugugcgggaagaacacucugccgucaacaugaaucugcacuaccuugagaacgggacagugaugcugaauuucauuuaucgcaaggaacucuuuuuccugccccuuggauuugcgcugaaagcccucguuagcuucuccgauuaccagaucuuucaggagcugaucaagggcaaagaagacgauagcuuccugagaaacucugugucccaaaugcuccggauugucauggaggaagggugcagcacccagaaacaggugcugaauuaccuuggagaguguuuucgcgugaagcugaacgucccugacugguaucccaaugagcaggcugccgaguuccucuuuaaccaaugcaucuguauucaucugaaaucuaacacagagaaguucuacaugcuuugccugaugaccagaaaacucuucgcucuggccaagggcgaauguauggaggauaauccggacucccugguuaaccaggaagugcucacaccuggccagcuguuucuuauguuccugaaagagaagcucgagggguggcuggugagcaucaaaauugcguuugauaagaaggcccaaaagaccucugucuccaugaauacggacaaccuuaugcggaucuucaccaugggaaucgaucugacaaagcccuuugaauaucucuucgcuaccggcaaucugcgcagcaaaacagggcugggacuccugcaggacuccggccuuugcgugguugccgauaagcugaacuuuauuagauaccucucucacuuccggugugugcauagaggggcugacuuugccaaaaugcgcaccacgacaguccggagacugcugccugagagcuggggauuccuuugccccgugcacacccccgacggcgaaccuuguggccucaugaaucaccugacagccguuugcgagguggucacccaguuuguguauaccgcuuccaucccggcgcugcucugcaaccugggggucacacccauugauggagccccucaucgcagcuacucugaauguuaucccgugcuucuggacggcguuaugguggggugggucgauaaggaccucgcuccuggaaucgccgauucccugcggcacuucaaggugcugagagagaaacgcauucccccguggauggagguugugcuuaucccuaugacgggcaagcccagccucuacccugggcuguuucuguucaccacacccugccggcucgucagaccugugcagaaucuggcccuuggcaaagaagaacugaucggaaccauggaacaaauuuucaugaacguggcuaucuuugaggacgagguuuucgccggcgucacaacccaucaggaacucuuuccccacucucugcugagcgugauugcgaauuucaucccguuuuccgaucauaaccagucuccucgcaauauguaccagugucaaauggggaagcagacgaugggauucccccuucucacauaucaggaccggagcgauaacaaacuguacagacugcagacaccccaauccccucucgugcgcccgagcauguaugacuacuaugauauggacaauuaccccauuggcaccaacgcuaucgucgccgugauuucuuauaccggguacgacauggaggaugccaugaucguuaacaaggcuuccugggaacggggauuugcccacggcagcguguacaagucugaguucaucgaccuguccgagaaaauuaagcagggggauagcucccuugucuuuggcaucaaaccuggagaccccagagugcugcagaagcucgaugacgauggccugccuuucauuggggcuaaacugcaguauggagaccccuacuauucuuaccuuaaucucaacaccggcgagagcuuuguuauguauuacaaguccaaggagaauugcguggucgauaacaucaaaguguguucuaaugacacagggagcggaaaguucaaaugcguuuguauuacgaugcgggugccucgcaaccccaccaucggcgauaaguuugccuccagacacgggcaaaaaggcauccugagccggcuguggccggcggaagacaugccuuucacagagucuggaaugguccccgauauucucuucaauccucauggcuuucccuccagaaugaccaucgggaugcugauugaaagcauggccggaaagucugcugcccuucacggccugugccaugacgcuacaccguucaucuuuuccgaggaaaacagcgcccucgaguauuucggggagaugcugaaagcggccggauacaauuuuuacggcaccgaacgccuguauucugggauuagcggccuugagcuggaagcugacaucuucaucggagugguguacuaucagcggcucagacacauggucuccgauaaguuucagguucgcacgaccggcgccagagaccgggugacaaaccaaccuauugggggacgcaaugugcagggcgggaucagauucggagagauggaacgggaugcucugcucgcccacggcaccagcuuucugcuucaugaccgccuguucaacuguucugauagauccgucgcccacgugugcguuaaguguggcagccuccugucuccccugcuugagaaaccuccucccuccuggagcgcuaugcggaaucgcaaguacaacugcacacugugcuccagaucugacaccauugauacggugagcguccccuauguguuucgguacuucguugcggagcucgccgcuaugaauaucaaagugaagcuggacgucguguga

SEQ ID NO: 74003 - RNA, 1041 nt, Artificial Sequence
  derived and/or modified sequence opt5 from POLR1C__Homo_sapiens__NP_976035
auggccgcuagccaggccguggaggaaaugagaucccgggucguucugggcgaguucggggugcgcaacgugcacaccacagacuuucccggaaauuacucuggcuaugaugacgcgugggaucaagacagauucgaaaagaacuuucgggucgaugugguucauauggacgagaauagccucgaauuugauaugguggggaucgacgcugccauugccaacgcuuuucgcagaauccugcuugccgaggucccuacgauggcuguggagaaaguucugguguacaauaacaccuccauuguccaggaugaaauccucgcccaccggcugggacuuauuccgauccaugcggacccccgccuguucgaguauagaaaucagggcgaugaagaggggacagagaucgacacccuccaguuucggcugcaagugcgcugcacaagaaacccucacgccgcuaaggauucuagcgaccccaaugaacuguacgugaaccauaaagucuauacccggcacaugacauggauuccucucggaaaucaggccgaccuguuccccgagggcaccauccgcccuguucacgaugacauucuuaucgcucagcugagaccgggccaggaaauugaucuccugaugcauugugugaaggggaucggaaaagaccacgccaaguuuucccccguggcgacggccucuuaccggcuucugccugauauuacccuccuggagcccgucgaaggcgaggcugccgaggaacugagccgcugcuucuccccuggggugaucgagguucaagaagugcagggaaagaaagucgcuagaguggccaacccccggcucgacacauuuagcagagagaucuuccgcaaugaaaagcugaaaaagguugugcggcuugccagaguccgcgaucauuauauuuucucuguggaguccaccggcguccugccgccugacgugcucguuagcgaggcuaucaaagugcugauggggaagugucggagauuccuugaugaacuggacgcgguccagauggauuga

SEQ ID NO: 74004 - RNA, 402 nt, Artificial Sequence
  derived and/or modified sequence opt5 from POLR1D__Homo_sapiens__NP_057056
auggaggaagaccaggagcuggaaagaaagaucagcggccucaaaaccuccauggccgagggggaacggaagacagcucuggagauggugcaagccgcgggaacggaucgccacugcgucaccuucguucuucaugaggaagaccacacacugggcaacucucucagauacaugauuaugaaaaaucccgagguggaauuuuguggguauaccacaacccauccuagcgaguccaagaucaaccugcggauucagacacgcggaacccuuccggcuguggagcccuuccagagaggccugaaugaacucaugaacgucugccagcacgugcuggauaaauuugaggccucuaucaaggacuacaaggaucaaaaagccagccggaaugaauccacguucuga

SEQ ID NO: 74005 - RNA, 5913 nt, Artificial Sequence
  derived and/or modified sequence opt5 from POLR2A__Homo_sapiens__NP_000928
augcacggcgggggacccccuagcggcgacuccgccugcccgcugagaaccaucaagcgggugcaguucgggguccucucucccgaugagcugaaacgcaugagcguuacagaaggaggcauuaaguacccugagacgaccgaagggggaagacccaaacuuggcggccugauggacccucggcaaggggugaucgagcgcacaggaagaugucagaccugcgcuggcaacaugacagaaugucccgggcauuuuggacacauugagcucgccaagccuguguuccaugucggcuuucuggugaaaaccaugaagguucuucggugcguguguuucuuuugcuccaagcugcucgucgauucuaauaacccgaaaaucaaggacauucuggcgaaaagcaaggggcagcccaaaaagcgccugacacacguguaugaucucuguaagggaaaaaauaucugcgagggcggcgaagagauggacaacaaguucgggguugaacagccugagggagaugaggaccugaccaaagaaaagggccaugggggauguggcagauaccaaccccggauccgcagauccgggcuugagcuguaugcugaauggaaacacgugaaugaggauucucaggaaaagaaaauucuccugagcccugagcggguccacgagaucuuuaagcgcauuuccgacgaagagugcuucgugcuuggaauggaacccagauacgcccggccggaguggaugaucgugacgguccugccuguucccccucucagcgugcgccccgccguggucaugcagggcucugcuagaaaccaggaugaccugacccauaagcuggccgauauugugaaaaucaauaaccaacuccggagaaaugaacagaacggcgcugccgcgcacguuauugccgaggacgugaagcugcuucaguuucaugucgcuacaaugguggacaaugagcugcccgggcucccucgcgccaugcagaaauccggacggccgcugaagagccuuaaacaaagacugaagggcaaggaagggcgcguucggggaaaccucaugggcaaaagaguggauuucucugcucgcaccgucaucacacccgacccuaaucuguccaucgaucaggugggggucccccggagcauugccgcgaacaugaccuuugccgagaucgugacgccuuucaauauugacagacugcaggaacucguucgccggggcaacucucaauaucccggagcuaaguacaucauuagagauaacggcgaccgcaucgaucugcgguuucacccgaaaccuuccgaccuucaccugcagacaggguauaagguggagagacauaugugugauggagacaucgucauuuucaaucggcagcccacccuccacaaaaugagcaugaugggccaucgcgugagaauccugccuugguccacauuccggcuuaaccugucuguuaccacccccuacaaugccgauuuugacggggacgaaaugaaccuccaccugccucagagccuggagacaagagcugagauucaagaacucgccauggugccccgcaugaucgucacgccgcaguccaaucggccugugaugggaauugugcaggauacccugacagccguuagaaaguucaccaagcgcgacgucuuucuugagagaggcgaagugaugaaccugcucauguuccugagcacaugggaugggaaagugccccagcccgcuauccugaagccucggccgcuuuggaccggcaaacaaaucuuuucucucauuauccccggacauauuaauugcauccgcacgcacuccacacacccugacgaugaggacagcggccccuacaagcauauuucuccuggggauaccaaagucgugguugagaacggagaacugaucaugggcauucugugcaagaagagccucgggaccuccgcgggaucucuggugcacaucagcuaucuugagaugggccaugacaucacaagacuguucuacuccaauauucagaccgucaucaacaauuggcuccugauugaagggcacacaaucggcauuggagauagcaucgccgacucuaaaacguaucaggauauccagaacaccauuaagaaagcuaagcaagacgugaucgagguuauugaaaaagcccacaauaacgagcuggagcccacaccuggcaauacccuucggcagacauuugaaaaccaggugaaccgcauccucaaugaugccagagacaagaccggguccagcgcucagaaaucucuguccgaguacaacaauuucaagagcauggucguguccggagccaagggcucuaaaauuaacaucagccaaguuaucgcgguggucgggcagcagaauguggaaggaaagcggauucccuuuggcuucaaacaucgcacgcugccgcacuuuaucaaggacgauuaugggccugaguccagaggcuucguggaaaacucuuaccucgcuggacugacccccacagaguuuuucuuccaugccaugggcgggcgggagggacuuauugacaccgccgucaaaacagcugaaaccggcuauauccaacgcagacugauuaagagcauggaguccguuauggugaaguacgaugccacggugcggaauagcaucaaccaggucgugcagcucagauacggggaagacggacuggcuggcgagucuguugaauuucagaaucuggccacacuuaaaccuuccaacaaggcguucgagaaaaaguuucgcuucgauuauaccaaugagcgggcccucagacgcacacugcaagaagaccuggugaaagauguccucagcaacgcucacauccagaaugagcuggaacgggaguuugagagaaugcgcgaagaccgggaggugcuuagaguuauuuuccccaccggcgauucuaaggugguccugccguguaaccuccugcgcaugaucuggaaugcccagaagauuuuucauaucaacccucggcugcccuccgaccuucacccuauuaaagugguugaaggggugaaggagcucagcaaaaagcuggucaucgugaacggagaugacccccugucuagacaggcucaagaaaaugccacccuccuguucaacauucaccuucggagcacacugugcucccgcagaauggcggaggaguuucggcucagcggcgaagccuucgauuggcugcugggggagaucgaaucuaaauuuaaucaggcuaucgcccaucccggagagauggugggcgcucuugccgcccagucccugggggaaccugcuacgcagaugacccucaacacauuccacuacgcgggagucagcgccaagaauguuacccugggcgugccgcgccucaaggagcugauuaacaucuccaaaaagcccaaaacaccuucucuuaccguguuucugcucggccaaagcgcuagagacgccgagcgggccaaggacauucuguguagacuggaacauacgacacuucgcaaagucaccgcuaauaccgccaucuauuacgaucccaacccucaguccacagugguugcggaggaccaggaaugggugaaugucuauuacgagaugcccgauuucgacguggcucggauuucuccuuggcugcucagaguugaacuggaucgcaagcacaugaccgaccggaaacucacaauggagcaaaucgccgagaagaucaacgccggguucggagaugaccugaauugcauuuuuaacgaugacaaugcugaaaagcuugugcugagaauccgcauuaugaacagcgaugagaauaaaaugcaggaagaggaggaagucguggacaagauggacgaugacgucuuccuccgguguaucgaguccaacaugcugacggauaugacccugcagggcauugaacagaucucuaaaguguauaugcaucuuccgcaaacagacaacaagaaaaagaucauuaucaccgaggauggggaauuuaaggcccugcaggaguggauucucgagacagacggaguuagccugaugagagugcucuccgaaaaagaugucgaccccgugcgcaccacgagcaaugauaucguugagauuuucaccgugcugggcaucgaagcggucagaaaggcucuugagcgggaacuguaccacgugauuucuuuugacggguccuacgugaacuaucgccaccuggcccuccugugcgauacaaugaccuguagaggacaucuuauggccaucacacggcacggcguuaaucgccaggacaccggcccucugaugaaaugcagcuucgaggagacagucgaugugcucauggaagcugccgcucauggggagucugaccccaugaagggaguguccgaaaacaucaugcugggccagcucgccccugcggggaccggauguuuugaccugcuucuggaugccgagaaaugcaaguacggcauggaaauucccacgaauaucccggggcugggagcugccggcccuacaggcauguucuuugggagcgcucccucucccaugggaggcauuuccccugccaugacccccuggaaccaaggggccaccccugcuuauggagcguggagcccguccgucggcagcgggaugacacccggagccgcuggcuucucuccuagcgccgccuccgacgcuucuggcuuuagccccggguacuccccugccuggucucccaccccgggaagcccuggcucccccgggccuucuagccccuauaucccuucccccggaggcgcgaugagcccgucuuacuccccuacgagccccgcuuaugagcccagaucuccugggggauacacaccgcagucccccagcuacuccccuaccucucccagcuauuccccuacaagccccucuuacuccccuaccagcccgaauuauucucccacaagcccuuccuacucucccaccagcccuuccuauucucccacgagcccguccuacagcccuaccucucccuccuauagccccacauccccuucuuacagccccaccuccccuucuuacagcccgacaucccccagcuauucuccuaccucccccagcuacucuccuacgucccccagcuauucuccgacaagcccuuccuacucucccaccagcccuuccuauagccccacauccccuucuuacagccccaccuccccgucuuauagcccuaccucccccucuuacagccccacauccccuagcuacucuccgacgucccccaacuauagcccuaccucucccaauuacacaccuaccucccccagcuauucuccuacaucccccagcuacuccccgaccagcccuaacuauacgcccacaucuccuaauuacagccccaccuccccgucuuauagcccuaccucccccucuuacagccccacauccccuucuuacagccccuccagcccucgguauaccccgcagucucccacauacacgccuuccagccccucuuauuccccuagcucccccucuuacagcccuaccuccccgaaguauacacccaccagcccuucuuacucccccagcucuccugaguauacacccaccagcccgaaauacuccccuacgucucccaaguacagccccaccuccccuaaauauucucccacaagcccuaccuacuccccgacaacccccaaguauagcccuacaucucccacguacuccccuaccagccccguguauacaccgaccuccccuaaauacucucccaccagcccuacauauucccccacgucuccgaaguacagcccuaccucccccacauacagccccaccucuccuaagggcuccacauauagccccaccucuccuggcuacuccccgacgagccccacauauucucucaccuccccugccauuagccccgaugacucugaugaagagaacuga

SEQ ID NO: 74006 - RNA, 3525 nt, Artificial Sequence
  derived and/or modified sequence opt5 from POLR2B__Homo_sapiens__NP_000929
auguacgacgccgaugaggacaugcaguaugaugaagacgaugacgagaucacccccgaucuguggcaagaagccugcuggauugugaucagcuccuacuucgacgagaagggccucgucagacagcagcuggauucuuuugacgaguucauucagaugagcguucaacggaucguggaggaugccccuccgauugaccuucaggcggaggcucagcacgccuccggggaaguggaggaacccccucgcuaucugcucaaauuugagcagaucuaccugucuaagcccacacauugggagagagauggagccccuagccccaugaugccuaacgaagcucggcuucgcaaucugacguauuccgccccgcucuacgucgacaucaccaaaacagugauuaaggagggcgaagaacaacugcagacccagcaccagaaaacauucaucgggaagauucccaucaugcugagaucuaccuauugucuccugaacggacuuacagaccgggaucugugcgaacucaaugaguguccucuggaccccggcggguacuuuauuaucaacggaagcgagaagguucuuauugcucaagagaaaauggccaccaauacgguguacgucuucgcgaagaaagauuccaaguaugccuacaccggcgaaugccgcagcugucuggaaaacucuuccagaccuacaagcaccaucugggugucuaugcucgcucggggcgggcagggagccaaaaaguccgcuaucggccagcgcauuguugccacacugcccuauaucaagcaagaggugccgauuaucauugucuuuagagcgcugggguucgugagcgaccgggauauccucgaacauaucauuuacgacuuugaggauccugagaugauggaaauggugaaacccucucuggacgaggccuucgucauccaggaacagaauguugcucuuaacuuuauuggaucccgcggcgccaagccuggggugaccaaagagaagagaaucaaauaugcuaaggaagugcugcagaaagagaugcucccccacgucggagugagcgauuucugcgagacgaagaaggccuacuuucugggcuauaugguucaucggcuucugcucgccgcucugggccgcagagaacuggacgaucgggaccacuacgggaauaaaagacucgaccuggcgggaccccuucuggccuuccucuuccgcggcauguuuaagaaccugcuuaaagaggugcggauuuacgcucaaaaguucaucgauagagggaaagacuuuaaucuggaacucgccaucaagacacgcauuaucuccgauggacugaaguauucucuggccaccggcaacuggggagaccagaaaaaggcucaccaggcccgggcgggggucagccaggugcucaauagacugacauucgcuuccacccuuagccaucugcgccggcucaacucuccuauuggcagagauggcaaacuggccaagccgcgccaacugcacaauacccuuugggggaugguuugucccgccgagacaccugagggacaugcugugggccucgucaaaaaccuggcccugauggcuuacaucuccguggggagccagcccucuccuauucucgaauuucuggaggaauggagcauggagaaccuugaagagaucucccccgccgcgauugccgacgcuacgaagaucuucgucaauggaugcugggugggcauccacaaggauccggagcagcugaugaacacccuccggaaacugagacgccagauggacauuaucguuucugaagugagcaugauucgggauaucagagagcgggaaauucgcaucuauacagacgccgggagaaucugucggccucugcuuauugucgagaagcaaaaacuccugcugaagaaaagacacaucgaucagcucaaggaacgcgaguacaauaacuauuccuggcaggaccugguggcuagcggcguuguggaguacauugauacccuugaagaggaaacagucaugcuggccaugacccccgacgaccuccaggagaaggaaguggcguauugcucuacguacacacauugugagauccacccuuccaugauucugggagugugcgccagcaucauccccuuuccugaucauaaucaaucuccccggaacaccuaccaguccgcuaugggcaaacaggccauggggguuuauauuaccaauuuccacgucagaauggacacacuggcucaugugcuuuacuauccgcaaaagccucucgugaccacacgcagcauggaguaccugagauuucgggaacugcccgccggaaucaacuccauugucgccaucgcuucuuauacgggcuacaaucaggaggauagcgugauuaugaaccgcuccgcgguugacagaggguucuuucggucuguguucuaucgcagcuacaaagaacaggaguccaagaaaggauuugaucaggaggaagucuucgagaagcccaccagagaaacaugccaaggcaugcggcacgccaucuacgacaaacucgaugacgaugggcugaucgcuccuggcgugcgcguuagcggagacgaugugauuaucggcaagaccgucacacuuccggagaaugaagacgagcuggagucuaccaacagacgguauacgaagcgcgauuguuccaccuuccucagaacaagcgaaaccgggauuguggaccagguuauggugacacugaaucaggagggauacaaauuuugcaagauccgggucagaucugugcgcauuccccagaucggcgacaaauucgccucccggcacgggcaaaagggaaccuguggcauucaguauagacaggaagauaugccuuuuacgugcgaggggaucacacccgacaucauuaucaacccucaugccauucccagccgcaugaccaucggccaccugauugaaugucuucagggaaaagugucugcuaauaagggcgagaucggggaugccacaccuuucaacgacgcggucaacguucaaaagaucagcaaucuccuguccgauuacggauaucaucugcggggcaacgaggugcucuacaauggguuuaccggaagaaaaauuaccagccagaucuucauuggccccacauauuaccagcgccugaagcacaugguggacgauaaaauccacucucgggcuagagggccgauucaaauccuuaaccgccagccuauggaaggccgguccagagacggaggccugcgguuuggggagauggaacgcgauugccagaucgcccauggagccgcucaguuccucagagagcggcuguuugaagccagcgaccccuaccaaguccacguguguaaucugugcggcauuauggcgaucgcuaacacgcgcacccauacauaugaguguagagggugccggaauaagacccagauuucccuuguuagaaugccuuacgccuguaaacuccuguuccaggagcugaugucuaugagcaucgcuccccgcaugauguccguguga

SEQ ID NO: 74007 - RNA, 828 nt, Artificial Sequence
  derived and/or modified sequence opt5 from POLR2C__Homo_sapiens__NP_116558
augcccuacgccaaccagccuaccgugagaaucacagagcugacggacgaaaaugucaaguucauuaucgagaacaccgaucucgcuguugccaauagcauucggcgcguguuuaucgcggaagugccgauuaucgcuaucgacuggguccaaauugaugccaacuccucugugcugcacgacgaguucaucgcccauagacuuggccugauuccccucaucagcgaugacauuguugauaaacugcaguauucccgggacugcacaugugaagaguuuugcccugaguguucuguggaguucacccuugauguccgcugcaaugaagaccagacaagacacgugaccagccgggaucugaucuccaacucuccccgcguuauuccugugacaagcagaaaucgggacaacgaucccaaugacuacgucgaacaggacgauauccucaucgugaagcugcgcaaagggcaagagcugagacuccgggcuuaugccaagaaaggauuuggcaaggagcaugcuaaguggaacccuaccgccgggguggcguucgaauacgacccggauaaugcccugcgccacacggucuaucccaaaccugaggaauggcccaaguccgaguacagcgaacuugacgaggaugagucucaggcuccuuaugaccccaacggaaaaccggaaagauuuuacuacaauguugaguccuguggcagccugcggccugaaaccauugugcucucugcccuguccgggcuuaagaaaaagcugagcgaucuccagacacagcugucucaugagauccaauccgacgugcugaccauuaacuga

SEQ ID NO: 74008 - RNA, 429 nt, Artificial Sequence
  derived and/or modified sequence opt5 from POLR2D__Homo_sapiens__NP_004796
auggccgcuggcgggagcgaccccagagccggagauguggaggaagacgcgucccagcugaucuucccuaaggaguuugaaaccgcugagacacuccugaacucugaaguccacaugcuucuggagcaucggaaacaacagaaugagagcgccgaagaugagcaggaacucuccgagguuuucaugaagacgcugaacuacaccgcccgcuuuucuagauucaaaaaucgggagacaauugcuagcgugcgcucccuucugcuccagaagaaacugcacaaguuugaacuggccugccucgcuaaccuguguccggagaccgccgaagagucuaaggcgcuuauccccagccuggaaggcagauucgaggacgaggaacuccaacagauucuggaugacauccagacaaaacgguccuuucaguauuga

SEQ ID NO: 74009 - RNA, 633 nt, Artificial Sequence
  derived and/or modified sequence opt5 from POLR2E__Homo_sapiens__NP_002686
auggacgaugaggaagagaccuacagacuguggaagauccggaaaacaauuaugcagcucugccacgaccgcggcuaucuggugacgcaagaugaacuugaccagacccuggaggaguucaaggcccaguuuggggauaaacccagcgaaggaagaccucggcgcacagaccucaccguccugguugcucauaacgaugacccgacagaucagauguucguguuuuuccccgaggaaccuaaggugggcaucaaaaccauuaaggucuacugucaaagaaugcaggaggaaaauaucacacgggcccuuauugugguucagcaggggaugacccccuccgcgaagcaaucucugguggacauggcuccuaaauauauccucgagcaguuucugcagcaggagcugcucaucaacauuacggaacacgagcugguccccgaacaugugguuaugaccaaggaggaagugacagagcuucuggcccgcuacaaacucagagagaaucaacugccucggauccaggccggagauccggucgcucgcuauuucggcauuaagagaggacagguggugaaaaucauucggcccagcgaaaccgccgggcgcuacaucacauauagacuuguccaauga

SEQ ID NO: 74010 - RNA, 357 nt, Artificial Sequence
  derived and/or modified sequence opt5 from POLR2F__Homo_sapiens__NP_001288058
auggugagcaucuccugccuggucauuagacccccucggccgcccaagguucucggccugcaggaggggcaagaaaacguggagauccuuccuucuggagaacgcccccaggccaaucagaaaagaauuaccacaccuuacaugacgaaguaugagcgggcucgcgugcugggcaccagagcccuccagaucgcgaugugugcucccgucaugguggaacuggagggggagacagacccucuucugauugccaugaaagaacucaaggcccggaaaaucccgaucauuauccgcagauaccugcccgauggaagcuaugaggacuggggcguugaugaacugauuaucaccgacuga

SEQ ID NO: 74011 - RNA, 519 nt, Artificial Sequence
  derived and/or modified sequence opt5 from POLR2G__Homo_sapiens__NP_002687
auguucuaccacaucagccuggagcaugaaauucuccugcaccccagauauuuuggcccuaaccuucugaauaccgugaagcagaaacucuucacagaggucgaagggacgugcaccggaaaguacggcuuuguuaucgccgugacaaccauugacaacaucggggcuggagugauucaaccgggccggggguucguccuguaucccgugaaauacaaggccaucguuuuucgcccuuucaaaggagagguggucgaugcggugguuacacaggugaauaaggucggccuuuuuaccgaaaucggccccauguccuguuucauuucuagacauagcaucccuuccgagauggaguuugaccccaacucuaauccuccgugcuauaagacaauggaugaagacauugugauccagcaggaugacgagauucggcugaaaaucguggggacccgcgucgauaagaacgacauuuucgcuaucggaagccucauggaugacuaccugggccugguuuccuga

SEQ ID NO: 74012 - RNA, 369 nt, Artificial Sequence
  derived and/or modified sequence opt5 from POLR2H__Homo_sapiens__NP_001265643
auggccggcauccuuuucgaggacauuuuugaugugaaggacaucgaucccgaagggaaaaaguucgacagagucagccggcuccacugcgaguccgaaucuuuuaaaauggaucugauucuugacguuaacauccagauuuacccuguggaucugggagacaaguuccgccucgugaucgcuagcacccuguaugaggauggcacacuugacgauggggaauacaauccgacggacgauagacccuccucuagcgccuaugucuccuacggaggccugcucaugcggcugcaaggggacgcgaacaaucugcauggauuugagguggacucucgcguuuaucuccugaugaaaaagcuggcuuucuga

SEQ ID NO: 74013 - RNA, 354 nt, Artificial Sequence
  derived and/or modified sequence opt5 from POLR2J__Homo_sapiens__NP_006225
augaacgcucccccugcuuucgagagcuuucuccuguucgaaggcgagaagaaaaucaccauuaauaaggacacaaaagugccgaacgccugccuguuuacgaucaauaaggaagaucacacccuugggaacauuaucaaaucccagcugcucaaggacccccaaguccuguucgcgggauacaagguuccucauccccuugagcacaaaauuaucaucagagugcagacaaccccugauuauucuccccaggaagccuuuacaaaugccauuaccgaccugaucagcgagcucucccugcuggaggaacgguuccgcguggccauuaaggauaaacaggagggcaucgaauga

SEQ ID NO: 74014 - RNA, 177 nt, Artificial Sequence
  derived and/or modified sequence opt5 from POLR2K__Homo_sapiens__NP_005025
auggacacccagaaggaugugcaacccccuaaacagcagccgaugaucuacauuugcggcgagugucacacagaaaacgagaucaagagcagagaccccauucggugccgcgaauguggguauagaaucauguacaaaaagcggacgaaacgccuggucguuuucgaugccagauga

SEQ ID NO: 74015 - RNA, 636 nt, Artificial Sequence
  derived and/or modified sequence opt5 from POLR2M__Homo_sapiens__NP_001018112
augugcagccugcccagaggcuucgagccucaggccccggaagaccucgcucaacggucccugguggagcuucgcgaaaugcugaagagacaggagcggcuccugcgcaacgaacuucagagaaucaccauugccgaucagggggagcaacagucugaggaaaaugcgagcacgaaaaaccugacaggacucuccucuggcaccgagaagaaaccccacuacauggaaguccuggagaugcgggcuaagaauccuguuccccagcugcgcaaauuuaagacaaacgugcucccuuucagacagaaugacagcuccucucauugucaaaagagcgggucccccaucagcucugaggaacggcgcagacgggauaaacagcaccuggacgauauuaccgccgcccgccuucugccucuccaucacaugccgacacagcugcuuuccaucgaggaaagccuggcucuccagaagcaacagaaacagaacuaugaggaaaugcaagccaagcuggcugcccagaaacuggcggagagacucaauauuaagaugcggucuuacaaccccgagggagaauccagcggccgcuauagagaggugcgggacgaagaugacgauuggucuuccgacgaguuuuga

SEQ ID NO: 74016 - RNA, 4173 nt, Artificial Sequence
  derived and/or modified sequence opt5 from POLR3A__Homo_sapiens__NP_008986
auggugaaggagcaguucagagaaaccgacgucgccaaaaagaucagccacauuugcuuuggcaugaaaucccccgaggaaaugcggcaacaggcucauauccagguugugucuaagaaccuguacagccaggauaaucaacacgccccucuccuguauggggugcuugaccaucgcaugggaacauccgagaaagauagaccgugugaaacgugcggcaagaaccuggcggacugucucgggcacuacggauauauugaucuggagcuucccugcuuccaugucggcuacuuucgggcugugaucgggauucugcagaugaucuguaagaccugcugucacaucaugcucucucaggaggaaaagaagcaguuccuggacuaucugaaacgcccuggacucacauaccugcaaaagagaggccuuaaaaagaagauuagcgauaaaugccggaagaaaaauaucugucaccauugcggcgccuuuaacgggaccguuaagaaauguggacugcucaagauuauccacgagaaauauaagacaaauaagaaaguggucgaccccauuguguccaacuuccugcagucuuuugaaaccgccaucgagcauaauaaggagguugaaccucuucugggccgcgcucaggagaaccucaauccccuggugguccugaaccucuucaaacggauuccugccgaagaugugccgcugcuucugaugaaucccgaggcugggaagccuagcgaccucauccugacaagacuucuggugcccccucucugcauccgccccuccgucguuagcgaucugaaaucuggaaccaacgaagacgaucugacgaugaagcucaccgagauuaucuuucugaaugacgugauuaagaaacacagaaucuccggcgccaagacacagaugauuauggaggacugggauuuccuucaacugcagugcgcgcucuacaucaacagcgaacugucugggaucccgcuuaauauggccccuaaaaaguggacccggggauuugugcagcgccugaaaggcaagcaaggcagauuccgggggaaccucuccggaaagcgcgucgacuuuagcggcagaacagugauuucucccgauccuaaccugcggaucgacgagguugcugugcccguccacguggccaaaauucugaccuuccccgaaaagguuaauaaagcuaacaucaauuuccucagaaagcuggugcagaacgggccugagguccauccgggagccaauuuuauucagcagcgccacacgcaaaugaaacgguuccuuaaguacggcaacagagaaaagauggcgcaggagcugaaauauggggauaucguggagcgccaucucaucgacggagaugucgugcuguuuaaucggcagcccucccugcacaagcugagcauuauggcccaucucgcuagaguuaaaccucaccgcacauuccgguuuaacgaaugugugugcacccccuacaaugccgacuucgauggcgacgagaugaaccugcaccuuccucagacagaagaggcuaaggccgaagcccucguccugaugggcaccaaagcuaaucuugugacccccagaaacggggagccgcugaucgcggccauucaagauuuucucacaggagcuuaucugcugacgcuuaaggacaccuucuuugaccgcgccaaagccugucagaucauugcuuccauccucguuggcaaggaugagaagauuaaagugcggcugccucccccuacaauccugaagcccgucacccucuggacagggaaacagaucuucucugugauucugagaccuagcgacgauaaucccgugcgcgccaaccuucggaccaagggaaaacaguacugcggcaagggggaagaccugugugcgaaugauuccuauguuacgauccaaaacagcgagcucaugucuggcuccauggacaagggaacacugggcagcgggucuaaaaacaauaucuuuuacauucugcuuagagauuggggacagaacgaagcugccgacgccaugagccggcucgcucgccuggccccggucuaucuguccaauagaggcuucucuauugggaucggagaugugaccccuggccaggggcuccugaaggcuaaauacgagcuucugaacgccggcuacaagaaaugcgacgaguauaucgaagcgcucaauaccggaaagcugcagcaacagcccggcuguacagccgaggaaacccuggaggcucuuauucucaaggaacugagcgugauccgggaucaugccggguccgcuugccugagagagcucgacaaaagcaacucuccccugacaauggcccuuuguggauccaagggcagcuuuauuaauaucucucagaugauugcgugcgucgggcaacaggccaucuccggaagccgcgugccugauggcuucgagaaccggucccugccgcacuucgaaaaacauucuaagcuccccgcugccaaaggguuuguugcuaauagcuucuacuccggccugacgccuaccgaguuuuucuuucacacaauggccggaagagaaggccugguggacaccgccgucaagacagcugagaccggguauaugcagcgcagacuugugaagucucuggaagaccucuguagccaguacgaucugacgguucgguccagcaccggagacaucauucaauucaucuauggcggggauggacucgaccccgcggccauggagggcaaagaugagccucuggaauuuaagcgcgugcuugacaacauuaaagcugucuuccccugcccuucugagcccgcccuguccaagaaugaacucauccugacaaccgagagcauuaugaaaaagucugaauuucugugcugucaggauuccuuccuucaggagaucaaaaaguuuaucaagggggugagcgagaaaauuaagaaaacaagagacaaguacggcaucaacgauaauggaaccacggaaccgcggguucuguaucagcucgaccgcauuacaccuacccaaguggagaaauuccuggaaacaugcagagauaaguacaugcgggcccagauggagcccggcucugcugucggggcccucugugcgcagagcaucggagagccuggcacccagaugacccugaagacauuucacuucgcugggguggccuccaugaacauuacgcuuggagugccccgcaucaaagaaauuaucaaugccagcaaggcuaucucuaccccgauuaucacagcccaacuggacaaagaugacgacgcggauuacgcuagacucgucaagggccggauugagaaaacccugcugggcgaaaucuccgaguauauugaagagguuuuccuuccugacgauugcuuuauccuggugaagcucagccuggagcgcaucagacuccugcggcuugaagugaacgccgagacagucagauacuccauuuguaccucuaagcugcgcgugaaacccggggacguugccgugcauggagaagcugucgugugcguuacgccucgggagaacagcaaguccucuauguauuacgugcugcaguuccucaaagaagaucugcccaaggucgugguucagggcauccccgaggugagcagagccgucauucacaucgacgagcaauccgggaaagaaaaguauaaacuucugguggagggagauaaucuccgcgcugugauggccacacauggcgucaaagggacccggaccacaucuaacaauaccuacgaaguugagaagacacugggaauugaagcggccagaacgaccaucaucaacgagauucaguauacaauggugaaucacggcaugagcaucgaccgccggcaugugaugcuccuguccgaucuuaugaccuacaaaggcgagguccuggggauuacaagauuuggacuggcuaagaugaaagaaagcgugcucaugcuggccucuuucgagaagaccgcugaccaccuuuuugaugccgccuacuucggccagaaggacuccguuuguggggugagcgaaugcaucauuaugggaaucccuaugaacauuggcacggggcuguuuaaacuccugcacaaggcugaccgcgauccgaaucccccuaaacggccccucaucuucgacaccaacgaguuucauaucccucuggucacauga

SEQ ID NO: 74017 - RNA, 3228 nt, Artificial Sequence
  derived and/or modified sequence opt5 from POLR3B__Homo_sapiens__NP_001154180
augaaggccaacgagaaagugaccagcgacgcugaucccaugugguaccugaaguaucucaauaucuacgucggccugccugacguugaagaguccuucaacgugacaagaccggugucuccccacgaaugccggcuucgcgauaugacguauagcgccccuauuaccgucgacaucgaguacacaagagggucccagcggauuauccgcaaugcgcugcccauuggaagaaugccuaucaugcuccggucuagcaacugugugcugaccggcaaaacacccgcugaauuugccaaacuuaaugagugcccucuggaucccgggggauauuucaucguuaagggcguggagaaggucauucucauccaagaacagcuguccaagaaccgcauuaucguggaggccgacagaaaaggggcuguuggagccucugugaccagcuccacacaugaaaagaaaagccggaccaauauggcugucaagcagggccgcuuuuaccugagacacaacacgcucucugaggauauuccgaucgugauuaucuucaaagccaugggcguggaguccgaccaggaaaucguccaaaugauugggaccgaggaacauguuauggcggccuuuggaccuagccuggaggaaugucagaaggcucagaucuucacacagaugcaagcccuuaaguauauuggcaauaaagugcggcgccagagaauguggggagggggccccaagaaaaccaagaucgaggaggcucgggaacugcucgccucuacaauucugacccacgugccugucaaagaguuuaacuuccgcgcgaagugcaucuacacggccgugaugguuagacgggugauccuugcucagggggauaauaaagucgacgauagagacuacuauggaaacaagcgccuggaacucgccggccagcugcugucccuccuguuugaggaucuuuucaagaaauuuaauagcgaaaugaagaaaauugcugaccaagugauccccaagcagcgggccgcccaguucgacguugugaaacauaugagacaagaucagauuacaaacggcauggucaaugcuaucucuaccgggaacuggucccugaagcgcuuuaagauggaccggcagggagugacacagguccucagcagacuguccuacauuucugcgcuuggcaugaugacccgcaucagcucccaauucgagaaaacccggaaggugagcgggccgagaucucugcagccuucccaguggggaaugcucugucccagcgauacaccugagggcgaagccugcgggcugguuaaaaaccuggcucucaugacgcacaucaccacagacauggaggauggacccauugugaagcuggccucuaaucuuggcgucgaagacgugaaccugcucuguggcgaggaacugagcuaucccaauguuuuccuuguguuucugaacgggaauauccucggagucauucgcgaucacaaaaagcuggugaacaccuuccggcugaugagacgcgccggcuacaucaaugaguuuguguccauuucuacaaaccucaccgaccggugcguuuauaucagcuccgaugggggaagacugugucggccuuacauuaucgucaagaaacagaagccggcugugacgaauaaacauauggaggaacuugcccaaggcuaucgcaacuucgaggacuuucugcacgaaagccucguggaguaccuggaugucaaugaggaaaacgacugcaauaucgcgcuguacgagcauacaauuaacaaggacaccacccaccuugaaaucgagcccuucacacuccugggggugugugcuggccugauuccuuauccccaccauaaucagucuccuagaaacaccuaccagugcgccaugggaaaacaggccaugggcacaaucggguauaaccaacggaauagaauugauacgcucauguaccugcuugcuuauccccagaagccgaugguuaagaccaaaacaaucgaacugaucgaguuugagaagcucccugccggacagaacgcuaccguggccgucauguccuacagcggcuaugacauugaagaugcgcuggugcugaauaaagccucucuugaccgcggguucggacggugccucguuuacaagaacgcuaaauguacacugaagagauacaccaaucagacguuugauaaagugaugggccccaugcuggacgccgcuacccgcaagccuaucuggagacacgagauucucgaugccgacgggaucugcucccccggcgaaaaggucgagaacaaacaagugcugguuaauaagagcaugccuacagugacccagauuccccuugaaggauccaacgucccgcagcaaccucaguauaaagaugugcccaucacauacaagggcgcgaccgacucuuauaucgagaaagugaugauuagcuccaaugccgaggaugcuuuccugaucaagaugcuccugcggcagacgcgcagacccgaaauuggggacaaguuuucuagccggcauggacagaaaggcgucugugggcugaucguuccucaagaggauaugccguucugcgacuccggaauuugucccgacaucaucaugaacccucacggcuuucccagccgcaugacaguggggaaacuuauugaacuccuggccggcaaggcuggagugcuggauggcagauuccauuacgggaccgccuucggaggcucuaaggucaaagacgugugcgaggaucucguucggcacggguauaauuaccugggaaaggacuaugugacauccggcaucaccggggaaccucuugaggccuacauuuacuuuggccccgucuauuaccagaagcugaaacacauggugcucgauaagaugcaugcucgcgcgagaggaccucgggccguucugacccgccagcccacagagggcagaagccgggacgggggacugagacuuggcgaaauggagcgcgauugucucaucggguauggagcuucuaugcugcugcucgaacggcugaugauuuccagcgacgccuucgagguggaugucugcggccaguguggccuucugggguacucuggauggugccacuauuguaaaagcuccugccaugugagcucucucagaaucccguacgccugcaagcugcuguuucaagagcuucaguccaugaacauuaucccucgccugaaacucagcaaguauaaugaauga

SEQ ID NO: 74018 - RNA, 2064 nt, Artificial Sequence
  derived and/or modified sequence opt5 from POLR3E__Homo_sapiens__NP_001244962
auggccaacgaggaagacgaucccgugguccaggagaucgacguuuaccuggcuaagagccucgccgaaaaacuguaucuuuuccaauacccugugagaccggcguccaugaccuaugaugacauuccccaccugucugcuaagaucaaaccuaagcagcagaaaguggagcucgaaauggccauugauacacugaaucccaacuacugccggagcaagggcgagcagaucgcccuuaaugucgacggggcuugugccgaugagacguccaccuauucuagcaagcugauggacaaacaaacauuuugcuccucucagaccacaagcaacaccucccgcuacgcugccgcgcucuauagacagggagaacugcaucugacaccucuccacggcauucugcagcuucggcccagcuucucuuaccuggauaaggccgacgcuaaacaucgcgagagagaagccgcuaaugaggccggggauuccagccaagacgaggcggaagaugacgugaagcagaucaccguucgguuuucucgcccugaguccgaacaggccagacagcggcgcgugcaaagcuacgaguuccuccagaaaaagcacgcugaagaaccguggguccaucugcacuauuacggacuuagagacucucgguccgagcacgaacgccaguaucugcucugucccggcagcuccgggguggagaacacggaacugguuaagucuccuagcgaguaccugaugaugcucaugcccccuucccaagaagaggagaaagauaagcccguggccccgagcaauguccugucuauggcucagcuuagaacccugccucucgccgaccagaucaaaauucugaugaagaacgugaaagugaugcccuuugccaaucuuaugucccugcucggaccuagcaucgauucugucgcuguucugcggggcauucagaagguggcgaugcuggugcaaggcaacugggucgugaaaagcgacauccucuaucccaaggauuccucuagcccccauuccgggguuccugccgaagugcugugccgcggaagagacuucgucauguggaaguuuacacagagccggugggugguuagaaaagagguggcuaccgucacaaaacuuugugccgaagaugugaaggacuuccuggagcacauggccgucgugcgcauuaauaagggcugggaauuuauccucccguacgauggggaguucauuaaaaagcaucccgacguugugcagcggcagcacaugcuguggaccggaauccaagcuaaacuugagaaggucuauaaccuggugaaggaaacgaugccuaaaaagcccgaugcccagucuggcccugcggggcucguuugcggagaccagagaauccagguggcuaaaacaaaggcccaacagaaucacgcccugcuggagcgcgaacuccagcggagaaaggagcagcugcgcguccccgcugugccgccuggcgugcggauuaaagaggaacccguuuccgaggaaggcgaggaagacgaggagcaagaagccgaggaggagccuauggauaccagccccucugggcuucauuccaagcuggcuaacggacucccucugggcagagccgcggggacagacagcuuuaauggacaucccccgcagggcugugccuccaccccugucgcucgcgaacugaaagccuucguggaggcuaccuuucagcggcaauucgugcuuacacucucugagcugaagagacuguucaaccuccaccuggccagccuuccucccgggcacacgcuguuuuccggaaucucugaucgcaugcuccaggacaccguccuggcggccggcugcaaacagauucuggugcccuucccgccccagacagcugccagcccugaugaacaaaagguuuuugcucuuugggaguccggcgacaugagcgaucagucucggcucacccaggaauguggggaggaccuguccaagcaggaaguggauaaaguccugaaggacugcugugugagcuacggaggcaugugguaccucaaagggacaguucaaucuuga

SEQ ID NO: 74019 - RNA, 327 nt, Artificial Sequence
  derived and/or modified sequence opt5 from POLR3K__Homo_sapiens__NP_057394
augcuucucuucugccccggcugugggaacggacugaucguggaggaaggccagagaugccaccgguuugccuguaauaccugcccuuacguccauaacauuacacgcaagguuacgaauagaaaauauccgaagcugaaagagguggacgaugugcucgggggagcugccgcgugggaaaacgucgacagcaccgcugaguccugucccaagugcgaacacccucgggccuacuucaugcaacugcagacacgcucugccgaugagcccaugaccacauuuuauaaauguugcaaugcucaguguggccauagauggcgggacuga

SEQ ID NO: 74020 - RNA, 3693 nt, Artificial Sequence
  derived and/or modified sequence opt5 from POLRMT__Homo_sapiens__NP_005026
augagcgcccugugcuggggcagaggggcugccggacucaagcgggcgcugcgccccuguggcagaccugggcuuccgggaaaagagggcaccgcugggggagugugcggcccccggcgcuccucuagcgccuccccucaggaacaagaccaggauagacggaaggacuggggccacgucgagcugcucgaaguucugcaggcccgcgugagacagcuucaagcugagucugugagcgaagucgugguuaaccggguggaugucgcccgccugcccgaguguggguccggagacggcucucuccagccucccagaaaagugcagaugggggcuaaggaugccacaccuguuccgugcggacggugggcgaaaauccuggagaaggacaagcgcacgcagcaaaugagaaugcagcggcugaaagccaagcuccagaugcccuuccagagcggcgaauuuaaagcucugacccgcagacuucaaguggagccucggcugcucuccaagcagauggccgggugucuggaagauugcacaagacaggcucccgagagcccuugggaggaacaacuugcccgccugcuccaggaggcgcccggaaaacugucucuggacgucgaacaggccccguccggccagcauagccaagcucagcucucuggccagcagcaacggcugcuugccuucuuuaaguguugccugcucaccgaucagcugccucuugcucaccaucugcucguggugcaccaugggcagagacagaagcgcaaacugcugacacucgacauguauaaugccgucaugcugggaugggcccggcaaggcgcuuucaaggagcuuguuuaugugcuguuuauggugaaagaugcggggcucacccccgaccugcuuuccuacgccgcugcccugcaguguaugggaagacaggaucaggacgccggcacaauugaacgcugccucgagcaaaugagccaggaggggcugaagcugcaggcucucuucaccgccguccugcuuucugaagaggaccgggcgacggugcugaaagcuguucacaaggugaaaccuaccuuuucccucccuccccaacugcccccgcccgucaacacaagcaagcugcuuagagauguguaugccaaggacggacgcguuuccuacccuaaacuccaccuuccccugaagacccuccagugucuguucgaaaaacagcuucauauggagcuggccucucgggugugcgucgugagcgucgaaaagccuacacuccccuccaaagaggugaagcacgcuagaaagacccugaaaacgcugcgcgaucagugggagaaggcccuuugccgggcucucagagaaaccaaaaaucggcuggagcgcgaaguuuaugagggcagauuuagccuguacccguuccucugucugcuugacgaacgggagguggucagaaugcugcuccaagugcugcaggcccugccugcgcagggcgagucuuuuacaacacuugcccgcgaacucuccgcucggaccuucagcagacauguugugcagcgccaaagagucucuggacaggugcaggcccugcagaaccacuaucggaaguaccugugccuccuggcuagcgaugccgaggugcccgaaccuugucuuccccgccaauacugggaggagcugggggcgccugaagcccucagagagcagcccuggccgcugccuguucagauggaacugggcaaacuucucgcugagaugcugguccaagccacccagaugcccugcucccuggacaagccccaccggucuagccgccucgugccugugcuguaucaugucuacuccuuuagaaaugugcagcagaucgggauucuuaagccgcaccccgcuuauguucaacugcucgaaaaagccgccgagccuacacugacguucgaggcuguggauguccccaugcuguguccuccccuuccuuggaccagcccccauucuggagcguuccugcucuccccgacaaagcugaugcggaccguggaaggcgccacacagcaccaggagcuccuggaaaccugcccucccacggcucugcauggggcccuggacgcccucacacagcugggcaacugugcuuggcgcguuaauggaagagugcuggaucuuguccugcaacucuuucaggccaaaggcugcccucagcugggggugcccgcgccgccuagcgaggcuccccagccucccgaagcccaccucccccacucugccgcuccugcccggaaggcggagcugcgcagagagcuugcucauugucaaaaaguugcccgggaaaugcacucccugagagccgaggcucucuaccgccugagccuggcccagcaucuucgggacagaguguucuggcugccgcacaacauggauuuucgcggacggaccuaucccugcccuccccacuucaaucaucucggcuccgacgucgcuagagcccugcucgaauuugcgcaggggcgcccucugggaccccacggccuugacuggcugaagauccaucuggugaaccucaccgggcugaagaaacgggagccucuuagaaagcgccuggccuucgcugaagaggugauggaugacauucucgauucugccgaccagccgcugacaggccggaaaugguggaugggagcugaggaacccuggcaaacccucgccuguugcauggaggucgccaaugcuguuagagcgagcgauccugccgcuuacgugucccaucugcccgugcaccaggacggcucuugcaacgggcuucagcacuaugccgcccugggacgggauagcgucggcgcugccuccgugaaucuggaaccuagcgacguuccccaagauguguacucuggggucgcggcucagguggagguuuuucgcagacaggacgcccagcggggaaugcgcguggcccaaguccucgagggcuucaucacaagaaaggugguuaaacagacggugaugaccgucguguacggggugacacgguauggcggaagacugcagaucgaaaagcgccuucgggagcuguccgauuuuccgcaggaguucgucugggaggcuagccacuaccucguuagacaaguguuuaaaucucugcaggaaauguucuccggcacccgcgccauucagcauuggcucacagagagcgcgcggcugaucucucacauggggagcguggucgagugggugaccccucuuggaguucccgugauucagcccuauagacuggacuccaaggucaagcaaaucggcgggggaauccagagcauuacguacacccauaacggcgauauuucucgcaaaccuaauacacggaagcagaaaaacggguuucccccuaacuucauccacucccuggacagcucccauaugaugcucaccgcucugcacuguuauagaaagggccuuacauucgugucuguucacgacugcuacuggacccaugccgccgaugugagcgucaugaaucaagugugucgcgaacaguuugucagacugcacuccgagccgauccuccaggaccugucucgguuccucgugaaacgcuuuugcagcgaaccccagaagauucuggaggcuucccaacuuaaggaaacgcugcaggccguuccuaaacccggagcuuucgaucuggaacaggugaagagaucuacauacuuuuucagcuga

SEQ ID NO: 74021 - RNA, 3000 nt, Artificial Sequence
  derived and/or modified sequence opt5 from POM121__Homo_sapiens__NP_001244119
auggugugcagccccgucaccguuagaaucgccccuccggaccggcgcuucuccagaucugcuauucccgagcagaucauuagcuccacacugucuagcccuuccucuaacgcccccgauccuugugcgaaggaaacggugcucagcgcucugaaagagaaggagaaaaagcggaccguggaagaagaggaccaaaucuuucuugauggccaggagaauaaacgcagacggcacgacuccagcgggucuggacauuccgccuucgaaccccuggucgccaacggcgugccugcuagcuuuguuccgaagcccgggucucucaagcgcggacuuaauucccagagcucugaugaccaccugaacaaaagaucccggagcuccucuaugagcucccugacaggcgccuacgcuagcgggauuccuucuuccagccgcaaugccaucaccucuagcuauuccucuacaagaggaaucagccagcucuggaagcggaacggccccuccagcucuccuuucuccagccccgcgucuucccgcagccaaaccccggagagaccugccaaaaagauucgggaagaggagcugugccaucacuccucuagcuccacaccccuggcugccgaucgcgaaucucagggcgagaaagcugccgacaccacgccuagaaagaagcagaauagcaacucccagagcacccccgggucuuccggacaacggaaaagaaaggugcagcuccugcccagccgccggggcgaacagcuuacacugccuccgcccccucagcucggguacucuaucaccgcggaggaucuggaccuugagaaaaaggccucccugcaaugguuuaaucaggcucucgaagauaaaagcgacgccgcuucuaacagcgucacagagacacccccuauuacgcagcccuccuucacauuuacccugccggccgccgcuccugcgucucccccuacaagccugcucgcccccuccaccaauccucugcuugaaagccugaagaaaaugcaaacacccccgucccucccucccugucccgagucugcuggagccgccaccacggaagcucugagcccuccgaagacccccucccuucugccuccccucggccugucucagagcgggccucccggacugcucccuucccccucuuucgauagcaagccgccuacaacccugcuuggccugauccccgccccuuccauggugcccgcgacagacaccaaagcuccgccuacgcuccaggccgagacagccaccaagccccaggcuaccagcgccccuucucccgcucccaaacaauccuuucuguucggcacacagaacaccagcccuucuuccccggccgcgcccgccgcuagcucugccccucccauguuuaagccuauuuucacagcucccccuaaauccgaaaaggaggggccgacgcccccuggacccagcguuaccgccacagcgccuuccagcucuagccuucccaccacaaccuccacgaccgccccgacauuucagccuguguucucuagcaugggcccucccgcuuccgucccccugcccgccccuuucuuuaagcagaccacaaccccggcuacggcccccacaaccacagccccucucuucaccgggcuggcuucugcgaccagcgccguggcucccaucacauccgccucuccuagcacggacuccgccagcaaacccgcuuuuggauucggcauuaauucuguguccucuagcuccgucagcaccacaaccuccacagccaccgcggcuucucaaccguuucuguucggggccccucaggccagcgcugccuccuuuacgcccgcgaugggaagcaucuuccaguuuggcaagccucccgcucucccuacaaccaccacaguuaccacauucucucagucccugcauacggccgugcccaccgccacaagcucuagcgcugccgauuuuuccggcuucgggucuacccuugcuacaagcgccccggcgaccuccucucaaccuacgcugaccuuuagcaacacauccacccccacauucaauauccccuucggaagcucugccaaauccccucucccgagcuaucccggcgcuaacccucagcccgccuuuggggcugccgagggacagccucccggcgccgcuaagccugcgcuggccccguccuucgggucuagcuuuaccuucggcaacuccgcugcccccgccgcugccccuacacccgcgccucccucuaugauuaaaguggucccggcuuacgugccuacccccauccaccccauuuuuggaggcgccacgcacagcgccuucgggcugaaggcuacagccuccgcguuuggagcuccugccagcucucagcccgccuucggcggguccaccgcuguguuuuucggagccgcuaccagcucuggcuuuggggccacaacccaaacggcguccagcggcucuagcuccucuguuuucggaagcacaaccccuuccccguuuacauucggcgggagcgccgcucccgccggauccggcucuuucgggaucaaugucgcuaccccuggaagcuccacaaccacgggcgccuuuucuuucggggccggccagagcggauccaccgcuacaucuacccccuuugcgggcgggcuuggacagaacgcccucggcacaaccgggcaaagcacgccuuucgcuuuuaauguguccagcacaaccgaaucuaagcccguuuucggaggcacagccaccccgaccuuugggcugaacaccccugcccccggcgugggaacguccggcagcucucuguccuucggggcuagcucugccccugcgcagggauuugucggcguggcucccuucgggaauaccuuugcccaucagcaggagcacuccccuagaaaaggacccaacaaucucagcaagcgcaaacugcuuccggccguccgggcucaaggccugccuagacgcggccaggccuccagcuuccccacacggaaggaauga

SEQ ID NO: 74022 - RNA, 804 nt, Artificial Sequence
  derived and/or modified sequence opt5 from POMC__Homo_sapiens__NP_001306134
augcccagaagcugcuguucccggucuggcgcccugcuccuggcccuucugcuccaggcuagcauggaggugcgcggguggugccuggaauccucucaaugucaggaccuuaccacagagagcaaccugcucgaaugcaucagagcguguaagccugaucuguccgcugagacgccgauguuccccggaaauggcgacgaacagccucugaccgagaacccccggaaauacgucauggggcacuuucgcugggauagauucggacggcgcaauucuagcuccagcgggucuuccggcgccggacagaagagagaggacguuagcgccggcgaagauugcggcccucuccccgaagggggaccugaaccgcggucugacggcgcuaaacccgggccucgcgagggaaagagauccuauagcauggagcauuuucgguggggcaaacccguggggaagaagcgcagaccugugaaagucuaccccaacggagccgaagaugagucugcugaagccuucccgcuggaguuuaagcgggaacuuacaggccaacgccugagagagggcgacgggccugauggacccgcggacgauggcgccggggcucaggccgaccucgagcacucccugcuuguggcugccgagaaaaaggaugagggaccuuaucggauggaacauuucagauggggcagcccucccaaagacaagcgcuacgggggauuuaugaccuccgagaagucucagacaccccugguuacccucuucaaaaaugcgauuaucaagaacgccuauaaaaagggcgaauga

SEQ ID NO: 74023 - RNA, 1554 nt, Artificial Sequence
  derived and/or modified sequence opt5 from POMGNT1__Homo_sapiens__NP_001277059
auggccaagagaguguucgacaccuacagcccccacgaggaugaagcuaugguccuguuucucaacaugguugccccuggccgggugcugaucugcacagugaaagacgagggguccuuccaucuuaaggauacggcgaaagcucugcuccgcucucugggaagccaggccggcccggcccuuggguggagagacaccugggcuuuugucggacggaagggcgggcccguguucggagaaaaacacuccaagucuccugcccugagcuccuggggcgaucccguucuccugaagacagacgugccucugucuagcgcugaggaagccgagugucauugggcggauaccgagcucaaucgcagacggcgcagauuuugcuccaaagucgaaggcuaugggagcguguguucuugcaaggaccccacaccuauugaguucuccccggauccccugccugacaacaaaguucuuaaugugcccgucgccgugaucgcuggaaaccggccuaauuaccuguaucgcaugcucagaagccugcuuucugcccaaggcgugagcccccagaugauuaccgucuuuaucgauggguacuaugaagaaccgauggacguuguggcucuguucggacuccggggcauucagcacacaccuaucuccaucaagaacgcccgcgugucucagcauuacaaagcgucccugaccgccacguuuaaucuguuccccgaggcuaaguuugccgucgugcucgaagaggaucuggacauugcuguugacuucuuuagcuuccuuucccaaucuauccaccuucucgaagaggaugacagccuguauuguauuuccgccuggaacgaucagggguacgaacacaccgccgaggacccugcucugcuguacagaguggagacaaugcccggacucggcuggguccugcggcgcagccuguauaaggaggagcucgaacccaaauggccuaccccggagaagcugugggauugggacauguggaugagaaugcccgaacagcggagaggccgcgagugcaucauuccugaugugucucgguccuaccauuucgggaucguuggacuuaauaugaacggcuauuuucacgaggcguacuucaaaaagcauaaauuuaauacagugcccgggguccagcugagaaacguggacagccucaagaaagaagccuaugaggucgaagugcaccgccugcuuucugaggcugaaguucuggaucacagcaagaauccuugugaggacuccuuccuccccgauaccgagggacauacguacguggccuuuauucggauggaaaaggacgacgauuucacaaccuggacacaacuggccaaaugccugcacaucugggaccucgaugucagaggcaaccaucgcgggcuguggcggcuuuuuagaaagaaaaaucacuuccuggugguuggagugccggcuucuccuuauagcgucaagaaacccccuuccgugacccccaucuuucucgagccucccccgaaggaagagggcgccccuggcgcgcccgagcagaccuga

SEQ ID NO: 74024 - RNA, 1743 nt, Artificial Sequence
  derived and/or modified sequence opt5 from POMGNT2__Homo_sapiens__NP_116195
augcaccugagcgccguguucaacgcucuccuggucuccguucuugccgcggugcuguggaagcaugugagacuccgggagcacgcugccacccuggaagaggaacuugcccugucucgccaggcuacagagcccgccccugcucucagaaucgacuacccgaaagcccugcaaauucugauggaaggcgggacgcauauggucugcaccggacggacacacaccgaucgcaucuguagauuuaaguggcucugcuauagcaaugaggcggaggaauuuauuuucuuccauggcaacacauccgugaugcugcccaaucuugggucucggcgcuuucagccugcccugcucgaccugagcaccguugaggaucacaacacacaguacuucaauuuuguggaacuucccgcugccgcucugagauucaugccuaaacccgucuuugugccugacguugcccucaucgcgaaccgguucaauccggauaaccugaugcacguguuucaugacgaucugcucccccuguucuauacccuucgccaguuuccuggacuggcccacgaggcuagacucuucuucauggagggcuggggagaaggggcccauuuugaccuguacaaacuucugucccccaagcaaccucuccugcgggcucagcugaagacgcucggccgccugcuuuguuucucucacgccuuugucggccugagcaagauuaccacaugguaucaguacggguucgugcagccccaaggaccgaaagccaauauccucguguccggcaacgagaucagacaguuugcucgguucaugaccgaaaagcugaaugucagccacacagggguuccucuuggagaggaauauauucugguguuuucucgcacccagaacagacucauccugaaugaggcggagcugcuccuggcccuugcucaggaguuccaaaugaaaacggugacagucucccuggaagaucauaccuuugccgacgugguucggcucgugagcaacgccucuaugcuggucuccaugcacggcgcucagcuggugacaacccuuuuccuccccagaggggccaccguuguggaacuguuuccuuacgcggucaaucccgaucauuacacacccuauaagacgcuggcuaugcucccuggaauggaccugcaguacguggccuggcgcaacaugaugccggagaacaccgucacacaccccgaacggccuugggaucaaggcggcauuacccaucuugacagagccgagcaggcucgcauccugcagagccgggaggugcccagacaccucugcugucgcaauccugaauggcuguuccggauuuaucaggacacaaaaguugauauccccucucugauucaaaccaucagacgcguggucaaggggcggccgggaccuagaaagcagaaauggacggugggccuuuaccccgggaagguucgcgaggcccggugccaggcuuccgugcacggagccagcgaagcgagacucacagucuccuggcagaucccuuggaaccugaaauaucugaaggugcgggaggugaaauacgaaguuuggcuccaagagcagggcgagaauaccuauguccccuacauucuggcccuucagaaccauaccuuuacagaaaauaucaagccuuucaccacauaccuggugugggugcgcuguauuuucaacaaaauccuccuggggcccuuugcugacguccuggugugcaauacguga

SEQ ID NO: 74025 - RNA, 1053 nt, Artificial Sequence
  derived and/or modified sequence opt5 from POMK__Homo_sapiens__NP_115613
auggagaagcagccccaaaacagcagacggggccuggccccucgcgaagugccgcccgcugucgggcuccugcuuaucauggcccugaugaauacccuccuguaccuuugccuggaccacuucuuuauugcgccuagacaguccacaguugaucccacgcauuguccuuauggacacuuccggaucggccagaugaaaaacugcucucccuggcucagcugugaggaacugcgcaccgaggugagacagcugaagcgggugggggaaggagcugucaaacgcguguuucucuccgaguggaaggagcauaaaguugcccugucucaacuuacaagccuggaaaugaaggacgauuuccuccacggccugcagaugcuuaagucccugcaggggacccauguggucacacuccugggauacugcgaggacgauaauaccaugcugacagaauaucacccucucggcucucugagcaaccuugaggagacccugaaucucuccaaauaccagaacgugaauacguggcaacacagacuggaacuugccauggacuauguuagcauuaucaacuaccugcaucacucuccggugggcacccgggucaugugugauuccaaugaccuccccaagacacugagccaguaucugcucaccucuaacuuuuccauucuggcuaaugaucuugacgcccugccucucgugaaccauagcucugggaugcuggugaaaugcggacaccgcgagcuucacggcgauuucgucgcucccgaacagcuguggccuuacggggaggacguucccuuucaugaugaccucaugccguccuacgacgaaaagaucgauaucuggaaaauuccugacaucagcuccuuccugcugggacacauugagggcucugauauggugagauuucaucucuucgacauccacaaggccuguaagagccagacacccuccgagcggccuaccgcgcaagaugugcuggaaacguaucagaaaguccuugacacacugcgcgaugccaugaugagccaggcuagagagaugcucuga

SEQ ID NO: 74026 - RNA, 426 nt, Artificial Sequence
  derived and/or modified sequence opt5 from POMP__Homo_sapiens__NP_057016
augaacgccagaggccuggggagcgagcucaaggacuccauccccgugaccgaacugucugcuagcggaccuuucgagucccacgaucuucugcggaaaggcuuuucuugcgucaagaaugaacuccugccgagccauccccuugagcuguccgagaaaaacuuccagcucaaucaagacaagaugaacuuuucuacacugcgcaauauucaggggcuguucgccccucucaaacugcagauggaauuuaaggcgguucagcaagugcagagacuucccuuccugagcuccagcaaccucucucuggaugugcuucggggaaaugacgagacgaucggcuuugaagauauucugaacgacccuucccagagcgaggucaugggggaaccccaccucaugguggaguacaagcugggacugcucuga

SEQ ID NO: 74027 - RNA, 2016 nt, Artificial Sequence
  derived and/or modified sequence opt5 from POMT1__Homo_sapiens__NP_001070834
augaagcagaucuucuuucuggacgauagcgggcccccuuucggccacauggugcucgcccugggaggcuaccuugggggauuugacggcaacuuccuguggaauagaauuggggcugaguauuccucuaacgucccgguuuggagccuccggcugcuucccgcccuggcgggagcucucuccgugccuauggccuaccaaaucgugcuggaacugcauuuuucucacugcgccgcuaugggcgccgcucuccugaugcuuauugagaaugcccugaucacccagagccgccucaugcugcuugaauccguccugauuuucuuuaaccuccuggcggugcugucuuaucucaaauucuuuaauugucagaagcauagccccuucucccugagcuggugguuuuggcuuacacugacgggcguugccugcucuugugcuguggggaucaaauacaugggagucuucaccuaugugcucguucugggcguggccgcuguccacgccuggcaucuucugggggaucagacacucuccaacgugugcguguuuugucaccuccuggcgagagccgucgcucuccugguuaucccuguggugcuuuaccugcuguucuucuauguccaccugauucuuguguuucggagcggaccccaugaccaaaucaugucuuccgccuuccaggcuagccuggagggcgggcucgcccgcauuacccagggacagccucuggaaguugccuuuggcucucaagugacacugagaaaugucuucggcaagccggugcccugcuggcuccacucccaucaggauaccuacccuaugaucuacgagaacgggcggggaagcucccaccagcagcaaguuacauguuaucccuuuaaagacgugaauaacugguggauugucaaggauccucgcagacaccagcugguggucucuagcccgccccggccugugcgccauggcgacaugguucagcuugugcacgggaugaccacgagaucccugaauacccaugaugucgcugcgccccucagcccucacucucaagagguguccugcuacaucgacuauaacauuagcaugcccgcccagaaucuguggcggcuggaaaucguuaaccgcggaucugauacagacguguggaagaccauccuuagcgaggucagauucgugcaugugaauacauccgcuguucucaaacugucuggcgcccaucugcccgauuggggguaccggcagcucgaaauugucggagagaagcugagccgcggcuaucacggcuccaccguguggaacguggaggaacacagauacggggccagccaggagcaacgggaaagagagcgcgaacuucacucuccugcucaggucgacgugucccggaaccugagcuuuauggccagauucucugagcuccaguggcgcaugcuggcgcugcgguccgacgauagcgagcauaaauauuccucuagcccgcuugaauggguuacgcucgacacaaauaucgcuuacuggcugcaccccagaaccuccgcccagauucaucugcucggaaacaucgugauuugggucucuggcagccuggcccuugcuaucuacgcccugcucucccugugguaucugcuucgccggagacgcaaugugcacgaucucccucaagacgcuuggcugcgguggguucuggccggggcgcucugugccggaggcugggcugugaacuaccugcccuuuuuccuuauggagaagacacuguuucucuaucacuaccugccugcccugaccuuccagauccuucuccugcccgucgugcugcagcauauuagcgaucaccucugcagaucucagcugcaacgcuccaucuuuagcgcucuuguuguggccugguauucuuccgcgugucaugucagcaauacccugcggccgcucacauacggggacaaaucucugagcccucacgaacugaaggcccuuagauggaaggauuccugggacauucugauccggaaacacuga

SEQ ID NO: 74028 - RNA, 2253 nt, Artificial Sequence
  derived and/or modified sequence opt5 from POMT2__Homo_sapiens__NP_037514
augcccccugccaccggcgggggacuggcugagagcgaacucagaccgcggcgcggcagaugcgggccccaggccgcgcgggcugccggacgcgacguggccgcugaggccgucgcuagauccccuaagcggcccgccuggggcucucgcagauucgaagcgguuggguggugggcccugcuugcucuggugacacuccugagcuuugccacgcgguuccaccgccuugaugagccuccccauaucuguugggacgaaacccacuuuggaaaaaugggcuccuacuauauuaacagaacauucuuuuucgaugugcauccuccgcugggcaagaugcucaucgggcuggcuggauaccugucuggcuaugacgggaccuuucucuuccaaaaacccggagauaaguacgagcaccauagcuauaugggcaugcggggguuuugcgccuuccugggauccuggcuugucccuuuugcguaccugacagugcucgaccugucuaaaagccuuuccgccgcucugcucaccgccgcucugcugacauucgauaccggcugucucacgcugagccaguauauucuucuggaccccauccucauguuuuucauuauggccgccaugcugucuaugguuaaguacaauuccugcgcugaucgcccuuucagcgcgcccuggugguuuuggcuuucucugaccggcgugucccucgccggggcucugggagucaaguucgugggccuguuuaucauccuccagguugggcugaacacaauugccgaccuuugguaccuguucggagaucucagccugucucuugugaccgucggcaaacaccugacagccagagugcucugucugaucgugcugccgcucgcucuguauaccgccacguuugcgguccacuucaugguucuuuccaagagcgggccuggagacggcuuuuucuccucugcuuuucaggcccggcugagcggcaauaaccuccauaaugccuccauucccgagcaccuggcuuacgggagcgugaucacagugaaaaaccugcgcauggccauuggauaucuucauucucacagacaccucuacccugaaggcaucggggcucggcaacagcaggucaccacauaucugcauaaggauuacaauaaccuguggauuaucaaaaagcacaauaccaacuccgacccccucgaccccagcuucccuguggaguuuguuagacauggagauaucauucgccuggaacacaaggagaccucucggaaucuucauagccacuaucacgaggccccgaugacaagaaaacauuaccaggugacgggcuacgggaucaacggcaccggagacuccaaugauuucuggcgcauugaagucgugaaccggaaguuuggcaauagaaucaaaguucugcgcucucggauuagauucauccaccucgugacagggugcguccugggaagcuccggcaaggugcugcccaaaugggggugggagcaacuugaagucaccuguacaccuuaucucaaggagacccugaacagcaucuggaacguggaagaccauauuaaucccaaacugccuaacaucucucucgauguucugcagcccuccuucccggagauucuucuggagagccacauggugaugauccgcggaaauucuggccucaagccuaaggacaacgaauuuacguccaaacccuggcacuggccuauuaauuaccaggggcugcgguucagcggcgucaacgauacagacuuuagaguguaucugcuuggaaaucccguugugugguggcucaaccugcuguccaucgcgcucuaccugcuuucuggcagcaucauugccgucgcuaugcagcgcggggcccggcugccugcugagguggccggacucucccaagugcugcugagaggcgggggacagguucuucucggcuggacccugcauuauuuccccuuuuuccugauggggcggguccucuacuuucaccauuauuucccggcgaugcuguuuucuagcaugcuuaccggcauccugugggauacacuccugcgccugugcgccuggggacuugcuuccuggccucuggccagaggcauucacguggcugggauccucagccugcuccugggaaccgccuacucuuucuaccuuuuucauccccuggccuauggcaugguggggccccucgcucaggacccucaauccccgauggcgggacugcgguggcuggauagcugggacuucuga

SEQ ID NO: 74029 - RNA, 564 nt, Artificial Sequence
  derived and/or modified sequence opt5 from POMZP3__Homo_sapiens__NP_036362
auggugugcagccccgucacccugagaaucgccccuccggaccggcgcuucuccagaucugcuauucccgagcagaucauuagcuccacacucucuagcccuuccucuaacgcccccgauccuugugcgaaggaaacgguucugagcgcucuuaaagagaagaaaaagaaacggaccguggaagaggaagaccaaaucuuucuggauggccaggagaauaagcgcuccugccucguggacgggcugacagaugccagcucugccuucaagguccccagaccuggaccggacacccuucaguuuacaguggauguuuuccacuuugcuaacgacucccggaauaugauuuacaucaccugucaucugaaagugacacucgccgagcaggaucccgacgaacugaacaaggcuugcagcuucucuaaaccuuccaauagcugguuucccgucgagggccuggccgauaucugucaaugcuguaacaagggggacugcggaaccccuucucacucccgcagacagccccgggugguuagccagugguccacgucugcgagccucuga

SEQ ID NO: 74030 - RNA, 1068 nt, Artificial Sequence
  derived and/or modified sequence opt5 from PON1__Homo_sapiens__NP_000437
auggccaagcugaucgcucucacccugcuuggcauggggcuggcccucuucagaaaccaccagagcuccuaccaaacacggcugaaugcgcuucgcgaggugcagcccgucgaacugccuaacugcaaucucguuaaaggaauugagacgggcucugaagaccuggagauccugccgaacgggcucgcuuuuauuagcuccggacugaaguaucccggcaucaaaucuuucaauccuaacagccccgggaagauucuucugauggaucucaaugaagaggacccuaccgugcuggagcuuggaaucacaggcuccaaauuugaugugucuagcuucaacccccauggcaucuccaccuuuacagacgaagauaaugccauguaccugcucgucgugaaccacccugacgccaagagcaccguugagcuguucaaguuucaggaagaggagaaaucucugcuccaucugaagacaauuagacacaaacuucugccgaaucucaacgauaucguggcugucgggcccgaacauuucuauggaaccaaugaccacuacuuucuggauccuuaucuucaguccugggagauguaccugggccucgccuggagcuaugugguuuacuacucucccuccgaagugcgggucguggcugagggguucgacuuugccaacggaauuaauaucagcccugauggcaaguauguguacauugcggaacugcuggcccacaaaauccaugucuaugagaagcacgcuaacuggacgcucacaccccugaagucucuugacuucaacacccugguugauaauauuuccguggacccggagaccggggaccucugggugggaugucauccuaacggcaugaaaaucuuuuucuacgauagcgaaaaucccccugccuccgagguccugcgcauccaaaacauucuuacagaggaacccaaggugacccagguuuaugcugaaaauggcacggugcugcaggggucuacagucgccagcguguacaaaggaaagcuccugaucggcaccguuuuccacaaagcgcuguauugcgagcucuga

SEQ ID NO: 74031 - RNA, 1065 nt, Artificial Sequence
  derived and/or modified sequence opt5 from PON2__Homo_sapiens__NP_000296
augggcagacugguggccgucgggcuccugggaaucgcucuugcccugcucggcgagcggcugcuugcgcugcgcaacagacucaaggcuagccgggaaguugaguccguggaccugccccacugccaucugauuaaagggaucgaagccggaucugaggauauugacauccucccuaauggccuggccuucuuuagcguggggcuuaaguucccgggacugcacuccuuugcucccgauaaaccuggcggcauucucaugauggaccugaaggaagagaaaccccgcgccagagagcuucggaucucucgcggguucgaucuggcuagcuuuaacccucauggaaucuccaccuucauugacaaugaugacacagucuaccucuuugugguuaaccaccccgaguucaagaauacgguggaaaucuuuaaguucgaagaggccgagaacucucugcugcaucucaaaaccgucaagcacgaacugcuuccuagcgugaaugauauuacagcgguuggcccggcccacuuuuaugcuaccaacgaccauuacuucuccgaucccuuucugaaauaucucgagacauaccugaaucuucacugggccaacguggucuauuacagcccuaaugaagugaagguggucgcugagggguucgacucugccaacggaaucaauauuucccccgaugacaaauauaucuacguugcggacauucuggcccaugaaauccacgugcucgagaagcacaccaacaugaaucugacacagcugaaggugcucgagcuggauacccuugucgacaaccugagcaucgauccuucuuccggcgacauuuggguggggugucaucccaacggacaaaaacucuucguuuacgauccgaauaacccucccagcucugaagugcugagaauccagaauauucuuuccgagaagccuacggucaccacaguguaugcuaacaauggcagcguucugcagggcuccucuguggccagcgucuacgacgggaaacuccugaucggaacccuguaucaccgggcucucuacugcgaacuguga

SEQ ID NO: 74032 - RNA, 1065 nt, Artificial Sequence
  derived and/or modified sequence opt5 from PON3__Homo_sapiens__NP_000931
augggcaagcugguggcccucguccugcuugggguuggacugagccucgugggcgagauguuccuggcuuuuagagaacgggugaacgccucccgcgaggucgaacccguggagccugaaaauugccaccuuaucgaggagcuggaaucugggagcgaggacauugauauccucccguccggacuggcguucauuucuagcggccugaaauaccccgggaugccuaacuuugcucccgacgaaccuggaaagaucuuccucauggaucugaaugagcagaaccccagagcccaagcccuugagauuuccggcggcuuugacaaagaacuguucaauccucaugggaucucuaucuuuauugauaaggacaacaccguuuaucucuacguggucaaucacccgcauaugaaaagcacaguggagaucuucaaguuugaggaacagcagcggucccugguuuaucuuaagacgauuaaacacgaacugcucaagagcgugaacgauaucgucgugcugggacccgagcaguucuacgcuacccgcgaccauuauuuuacaaauucucugcucuccuucuuugagaugauucuggaucuuagauggaccuacgugcuguucuauagcccucgggaagucaaaguuguggccaagggcuucuguucugcuaacgggaucacaguguccgccgaccaaaaauacgucuacguggcggauguugccgcuaagaauauucacaucauggagaagcacgacaacugggaucucacccagcugaaagugauccagcuuggaacacuggucgacaaucucaccguggaccccgccacgggcgauauucuggcugggugccauccuaaccccaugaagcugcucaauuauaacccggaagacccucccggaagcgagguucugcgcauccagaacgugcuuucugaaaaaccuagagucuccaccguguacgccaauaacggcagcguccugcaaggcacauccguggcgucuguuuaucacgggaagauucucaucggaaccguguuucauaaaacacuguacugugagcuuuga

SEQ ID NO: 74033 - RNA, 3075 nt, Artificial Sequence
  derived and/or modified sequence opt5 from POP1__Homo_sapiens__NP_001139332
augagcaacgccaaggagagaaaacacgcuaagaaaaugcggaaucagcccaccaacgugacacuguccucuggcuucgucgccgaccgcgggguuaagcaucacagcggaggcgaaaaaccuuuucaagcgcagaagcaggagccgcaucccgggacguccagacagcggcaaacccgcgugaauccucacucucuccccgauccugaagugaacgagcagagcuccucuaagggaauguuccggaaaaagggcggguggaaagcuggacccgaaggcacaagccaggagaucccuaaguacauuaccgccuccacauuugcccaggcucgggccgcugagaucagcgccaugcugaaagcggucacccaaaagucuuccaauagccuuguguuccagacacugccgcgccauaugagacggcgcgccaugucucacaacguuaagagacucccccggcgccugcaggaaauugcucagaaagaggccgaaaaggcugugcaccaaaagaaggagcauuccaaaaauaagugccacaaagccagacggugucauaugaaccgcacccuugaguuuaauagacggcagaagaagaacaucuggcuggaaacgcacauuuggcacgcgaaaagauuccauauggucaagaaauggggcuauugccucggggagcgcccuaccgugaaaagccaccgggccuguuacagagcuaugacaaaucgcugccugcugcaggaccucucuuauuacuguugccuggaacuuaaaggaaaggaggaagagauccugaaggcccucuccggcauguguaacaucgauaccgggcugacauuugcugccguucauugccuuagcggaaaacggcaaggcucccuggugcucuauagagucaauaaguacccccgcgagaugcuggggccugugaccuucauuuggaaaucucagcggacgcccggagacccgagcgaauccagacagcuguggaucuggcuccacccuacacugaagcaggauauucuugaggaaaucaaagccgcuugucaaugcguggagcccauuaagagcgcggucuguaucgccgacccucugcccacccccucucaggaaaagucccagacagagcucccugaugagaaaauuggcaagaaacgcaagcggaaagacgauggcgaaaacgcuaagccgaucaagaaaaucauuggggacggaaccagagaucccugccugccuuauagcuggaucucucccaccacaggcauuaucauuagcgaccuuacgauggagaugaaucgcuuucggcugaucgggccucucucccauucuauccugaccgaagccauuaaggccgcuagcguucacacagugggagaggauaccgaagagacaccccacagaugguggaucgagaccugcaaaaagccggacuccgugagccugcauugucggcaggaagccauuuucgagcuccugggcgggaucacgucuccugcggaaauucccgcuggaacaauccuuggccugaccgucggcgacccucgcaucaaccucccccaaaagaaguccaaagcccugccuaaccccgagaagugccaggauaaugagaaggugagacagcuucugcucgaagggguuccgguggaguguacccacagcuuuauuuggaaccaggacaucugcaaaucugucacagaaaauaagauuuccgaucaagaccugaaccggaugagaagcgagcugcucgugccuggaucccagcugauccuuggcccccaugaaucuaaaauucccauccugcucauucagcagccugggaagguuaccggagaggaucgccugggcugggggagcggcugggacgugcugcuuccgaaaggauggggcauggccuucuggauccccuuuaucuacagaggggucagagugggaggccucaaggaguccgcuguccacucucaauacaagcgcagcccuaaugugcccggggauuucccugacugucccgccggaaugcuguucgcugaggaacaggccaaaaaccugcucgaaaaguauaaaagacggccucccgcgaagcgcccgaauuacguuaaacugggcacacuugccccuuuuugcugucccugggagcagcugacgcaagauugggaauccagagugcaggcuuaugaggagccuagcgucgccucuucccccaacgggaaggaaagcgaccuccggcgcucugaggugccgugcgcuccuaugcccaagaaaacccaccagccuuccgaugaaguuggcacaagcauugagcaucccagagaagccgaggaggugauggacgcgggaugucaggaaucugccggccccgagcggaucaccgaccaagaagcuagcgagaaucacgucgccgcuacagggucccaucugugcgugcugcgcagcagaaaacuucucaaacagcugucugccugguguggaccuuccagcgaggauucccggggcgggcgcagagccccgggacggggccagcaggggcugaccagagaggcuugccucucuauucugggccacuucccccgcgcgcuuguguggguuagccugucccuccugucuaagggaagcccugaaccccauacgaugaucugcgucccugccaaagaagacuuucugcaacuucacgaggauuggcacuacuguggcccccaggaauccaagcauucugacccuuuccggagcaagauucucaaacagaaggagaaaaagaaaagagagaagcgccagaaaccggggcgggcuuccagcgauggacccgccggcgaggaaccuguggccgggcaagaagcucugacccugggacucuggucuggcccccugccuagagugacacuucacugcucccgcacccugcucggguuugucacacagggcgacuucagcauggccgugggauguggcgaggcgcugggguuuguuucucugaccggacuucucgauaugcuguccagccagcccgcugcccaacggggccuggugcuccugagaccgccugccucucuucaguaucgcuucgcucggaucgccaucgaagucuga

SEQ ID NO: 74034 - RNA, 663 nt, Artificial Sequence
  derived and/or modified sequence opt5 from POP4__Homo_sapiens__NP_006618
augaaaagcgugaucuaccacgcccugucccagaaggaggcuaacgacucugauguccaacccagcggcgcccagagagcggaggcuuucguucgggccuuucucaagcgcuccaccccuagaaugucuccgcaggcccgggaagaccagcugcaacgcaaagcuguggugcuugaauauuucacaagacauaagcggaaagagaagaagaaaaaggccaaagggcugagcgcucgccagagacgggaacuccgccuguuugauauuaagcccgagcagcagagauacucccuuuuccugccucuccacgagcuguggaaacaauauauccgggaccugugcucuggacucaagcccgauacgcagccucagaugauucaggccaagcugcuuaaagcggaccugcauggcgccaucauuagcgucaccaaguccaaaugucccagcuacguggggaucacaggaauccuccugcaagaaaccaagcacauuuuuaaaaucauuacaaaggaggaucgccuuaaaguuaucccuaagcugaauugcguguucaccgucgaaacagacggcuuuauuucuuauaucuacggguccaaguuccagcucagaagcucugagcgguccgcuaaaaaguuuaaagccaagggaaccauugaucuguga

SEQ ID NO: 74035 - RNA, 876 nt, Artificial Sequence
  derived and/or modified sequence opt5 from POPDC3__Homo_sapiens__NP_071756
auggagagaaacagcucccuguggaagaaucucaucgacgaacaccccgugugcaccacauggaaacaggaggccgaaggcgcuauuuaccaucuggccucuauccuuuucgucguuggguuuaugggaggcagcggguucuuuggacugcucuauguguucucccugcuuggccugggguuucucuguucugcggugugggcuugggucgaugugugcgccgccgacauuuucagcuggaacuuuguucuguucgugaucuguuuuaugcaguucguccacauugcuuaccaggugcgguccaucacguuugcccgcgaguuccagguucuguauucuagccucuuucagccucugggaaucucccuuccgguguucagaaccauugcucugagcucugaagucgugacacucgagaaggagcauugcuacgccaugcaaggcaaaaccuccaucgauaagcugagccuucuggugucuggccggauucgcgucacaguugacggggaguuccuccacuauaucuuuccccugcaguuccuggauuccccugaaugggacagccucagacccaccgaagagggaauuuuucaggugacacugaccgcggagacggauugucgguacgugucuuggcgcagaaagaaacuuuaucuccuguucgcccagcaucgguacaucucccgccuguuuagcguccuuauuggcuccgacaucgcugauaagcuguacgcccucaaugacagaguguauaucgggaaacgguaccacuaugauauucgccugccuaacuucuaccaaaugucuacccccgaaaucagacggagcccucugacacagcacuuucaaaauucccgcagauauugcgacaaguga

SEQ ID NO: 74036 - RNA, 1140 nt, Artificial Sequence
  derived and/or modified sequence opt5 from PORCN__Homo_sapiens__NP_001269096
auggugugggucguucugcucagccugcuuugcuaccuggugcuuuuccuguguagacacuccucucaucggggcguguuucuuagcgucaccauccugauuuaucuccugaugggggagaugcacaugguggacacaguuacguggcauaagaugcgcggagcccagaugaucguggcuaugaaagccgucucccugggcuucgaucucgacagaggggaagugggaaccguucccucuccuguggaguuuaugggcuaccuguauuucgucgggacaauuguguuuggaccguggaucagcuuccacuccuaccuucaagcggugcagggccggccccugucuugccgcuggcuccagaaggucgcuagaagccuggcccuugcccugcucugucugguucuguccacaugcgugggcccuuaucucuuucccuacuucauuccucugaacggggaucggcuucugcgcaaauggcucagagcuuaugaaagcgccgugucuuuucauuucuccaauuacuuugucggauuccugagcgaggcuaccgccacccuugcgggcgccggguuuacagaagagaaggaccaccuggagugggaucucaccgugucuaaaccccugaacguugaacugccucgguccaugguggaggucgugacgagcuggaaucucccgaugucuuacuggcugaacaauuauguuuucaagaacgcucuccgccugggaaccuucuccgccgugcucgucacauacgcugccagcgcgcugcuucacggcuuuuccuuccaucuggccgcugugcuccugucucuggccuuuaucaccuaugucgaacacgugcucagaaagcggcuggcucgcauccuuagcgccuguguucuguccaaaagaugucccccugacugcagccaucagcaccggcucgggcugggagugcgcgcccugaaucuucucuucggcgcucuggcgauuuuucaccuggccuaccucggcucucuguucgaugucgacguggaugacacaaccgaggagcaaggguauggaauggcuuacacgguucauaagugguccgaacuuagcugggccucucacugggugacauuuggcugcuggaucuucuauagacugauuggguga

SEQ ID NO: 74037 - RNA, 2043 nt, Artificial Sequence
  derived and/or modified sequence opt5 from POR__Homo_sapiens__NP_000932
augaucaacaugggcgacagccacguggauaccuccucuacagucagcgaggccguugcugaagaggugucccuguucucuaugacggacaugauucucuuuagccugaucguggggcuucugaccuacugguuccucuuuagaaagaaaaaggaagagguccccgaguucacaaaaauucagacccugacauccucugugcgggaaagcuccuuuguugagaagaugaaaaagaccggacgcaauaucauuguguucuauggcagccaaacagggaccgccgaagaguuugcgaacagacuuucuaaggaugcucaucgguacggaaugcgcggcauguccgccgacccugaagaguaugaucuggccgaccucagcucucugccggagaucgauaaugcucuggucguguucugcauggccacguacggggaaggagaccccaccgauaacgcucaggacuuuuaugauuggcuccaggagacagacguugaucuguccggcgugaaauucgccgucuuuggccuugggaauaagaccuacgaacacuucaacgcgaugggaaaauauguggacaagagacuggagcagcucggcgcccaacggaucuuugaacuggggcuuggagacgaugacggcaaucuggaggaggauuucauuacauggcgcgaacaguucuggccugcugugugugagcauuuuggggucgaagccaccggagaggaaagcucuaucagacaguacgagcucguugugcacacggacauugaugcugccaaaguguacaugggcgagaugggccggcugaaguccuaugaaaaccagaagcccccuuucgacgcgaaaaaucccuuucuggccgcugucacaaccaaccgcaagcucaaucaagggacagagagacaucugaugcaccuugaacuggauaucagcgacuccaaaauucgguacgagucuggagaucacguggccguuuauccugcuaacgacagcgcccucgugaaucagcugggcaagauccuuggggccgaucuggacgucgugaugucccucaacaaucuggacgaagagagcaacaaaaagcauccguuccccugcccuaccucuuaccgcaccgcucugacauauuaccucgauauuacgaaucccccuagaaccaacguucuguaugagcuugcgcaguacgccuccgaacccagcgagcaggaacugcuccggaaaauggcuucuagcuccggagagggcaaggagcuguaccuuucuuggguggucgaagcccgcagacacauccuggccauccuccaagacuguccgagccugcggccucccauugaucaucugugcgagcuccugccuagacuucaggcucgcuauuacuccaucgccucuagcuccaaggugcaccccaacagcguccacauuugugcggugguuguggaauaugagacaaaagcugggcggaucaauaagggagucgccaccaacuggcugagagccaaagaacccgcuggcgagaauggcgggcgcgcccucgugccuauguuuguucggaagucucaguucagacugccguuuaaagcuacaacccccgugauuauggucggaccuggcacggggguggcccccuucaucggauuuauccaagagcgcgcguggcugcggcagcagggcaaggaagugggggagacacuucucuacuauggcugcagacgcuccgacgaagauuaccuguaucgggaggaacuggcccaguuccauagagacggagcucucacccaacugaacguugccuuuagccgcgagcagucccacaaggucuacgugcagcaucuucugaaacaggaucgggagcaccucuggaagcugauugaaggcggggcucauaucuacguguguggagacgccagaaauauggcgcgggauguccaaaacaccuucuaugacauuguggccgagcugggcgcuauggaacacgcccaggcuguugauuacaucaaaaagcucaugacaaaagggcgcuauucucuugacguguggagcuga

SEQ ID NO: 74038 - RNA, 2340 nt, Artificial Sequence
  derived and/or modified sequence opt5 from POSTN__Homo_sapiens__NP_001129406
augauccccuuccugccuauguuuagccuccugcuucugcucauugugaacccgaucaaugccaacaaucacuacgacaagauucuggcucauuccagaauccggggccgcgaucaggggcccaacgucugcgcccuucaacagauucugggaaccaaaaagaaauauuucucuacauguaagaauugguacaaaaagagcaucugcggccagaagacgaccguucucuaugaguguugcccuggguacaugagaauggaaggaaugaaaggcugucccgcggugcugccuaucgaccacguguaugggacacugggaauugucggcgcuaccacaacccagcgguacuccgaugccucuaagcuccgcgaggaaaucgagggcaaagggagcuuuacauauuucgcccccuccaacgaggcuugggacaaucuggauucugacauuagacggggacuugagagcaacgugaauguugagcugcucaacgcccugcauucccacaugaucaauaagcgcaugcuuaccaaagaucugaagaacggcaugauuaucccuagcauguacaauaaccucgggcuguuuauuaaucauuacccgaacggaguggucacggugaacugcgcuagaaucauccacggcaaucaaauugccaccaacgggguugugcacgucaucgaccgggugcugacacagauuggaaccucuauccaggauuucauugaagcggaggacgaucucuccagcuuucgcgccgcugccaucacaucugacauccuggaagcucuuggcagagauggccauuucacccuguuugcccccacgaaugaggcguucgagaagcucccucgcggggugcuggaacggauuaugggagacaaagucgccuccgaggcucuuaugaaguaucacauccugaacacacuccaguguagcgaaucuauuaugggcggggccguuuuugagacccuggaaggaaauacaaucgagauuggcugcgacggggauuccaucaccgugaacggaaucaaaauggugaauaagaaagacauugucaccaacaauggcgugauccaucugauugaucaaguucucauccccgacagcgcuaaacaggugauugagcuggccggcaagcagcagacaacguucaccgaucuugucgcccaacuggggcucgcuuccgcgcugagaccugacggagaauacacacuucuggcccccgugaacaaugcuuuuucugaugacacccucagcauggaucagcggcugcugaagcucauccugcagaaccacauucuuaagguuaaagugggccugaaugagcucuauaacgggcaaauccuggaaacaaucggaggcaagcagcugcgcgucuucguguacagaaccgccgucuguauugaaaauuccugcauggaaaaagggagcaagcagggccggaacggagccauccacauuuucagagagaucauuaaaccggcugagaagucucuucaugaaaagcucaaacaggacaagcgcuuuuccacguuccugagccugcucgaggccgcggaucugaaagaacuucugacacaaccuggcgacuggacccucuuugugcccaccaacgacgcuuucaaggggaugacaucugaggaaaaagagauccugauccgggauaagaaugcccugcagaacauuauccuuuaucaccucaccccuggaguuuuuauuggcaagggguucgagcccggagugacaaauauccugaaaacgacccagggcagcaagauuuuucugaaagaagucaacgacacacuccuggugaaugagcuuaaguccaaagaaucugauaucaugaccacaaacgggguuauccauguggucgacaagcugcucuaccccgccgauaccccugugggcaaugaccagcugcuggagauucuuaacaagcucaucaaauauauucaaaucaaguucgugagaggaagcacguuuaaagagauuccgguuaccgucuacaagcccaucaucaaaaaguacacaaaaauuaucgauggcgugccuguggaaauuaccgagaaggaaacacgcgaggaacggaucauuaccgggcccgagaucaaguauacgagaauuuccacaggaggcggggagaccgaagagacacugaaaaagcugcuccaggaagaggucaccaaagugaccaaguucaucgaaggaggcgacgggcaccuguuugaggaugaggaaaucaaacgccuucugcagggcgacacaccuguucggaagcuccaggcuaauaagaaagugcaaggaagcagacgccggcugagagagggccgcucucaguga

SEQ ID NO: 74039 - RNA, 1905 nt, Artificial Sequence
  derived and/or modified sequence opt5 from POT1__Homo_sapiens__XP_006715980
augagccuggugcccgccaccaacuacaucuauacaccucucaaucagcugaagggcgggacgauugucaacguuuacggaguggugaaauucuuuaagccgcccuaucuuuccaaaggcaccgacuacugcucugucgugacaaucguugaucaaaccaaugugaagcugacaugucuccuguucagcgggaacuaugaggcccuuccuauuaucuacaaaaauggagacauugucagauuucaccggcugaagauccagguguauaagaaagaaacccagggcaucacauccucuggguucgcuagccucaccuuugagggaacgcugggcgcgcccauuaucccucgcaccuccucuaaguacuucaacuuuacaaccgaagaucauaaaaugguugaggcucugagagugugggccagcacacacaugucccccagcuggacccuccugaagcugugcgacguccagccuaugcaauacuucgaucugacgugucagcuccugggcaaagccgaaguggacggggcuucuuuucuucugaaggugugggauggaacacggaccccguuccccuccuggcgcguccucauucaggaccugguucuggagggcgaucucagccauauccacagacugcagaaucuuacaauugacauccugguguaugauaaccaugugcacgucgcccggucucucaaggugggguccuuucugcgcauuuacagccuucacaccaaacugcaaucuaugaacuccgagaaucagaccaugcucagccuggaguuccaucugcacggaggcacauccuaugggagaggaauccggguucucccugagucuaauagcgacguggaucagcugaagaaagaccuugaauccgcuaaccugacggccaaucagcauagcgacgucaucugccaaucugagcccgaugacuccuuuccuagcucuggcagcgugucccucuacgagguugaacgcugucagcagcugucugcgaccauucuuacagaucaccaauaucuggagagaacaccccucugcgccauccugaagcagaaagcuccgcagcaguaccggauucgcgccaagcugagaagcuauaaaccucggcgccucuuccaauccgugaagcugcacugucccaagugccaucuucugcaggaagucccucacgagggcgaccucgauaucauuuuccaggacggggcuaccaaaacccccgaugugaagcugcagaacacgagccuguacgacucuaaaaucuggacaaccaagaaucaaaaaggaagaaaggucgccgugcauuuuguuaagaacaacggcauccuuccccucuccaaugaaugucugcugcucauugaagggggaacccugagcgagaucugcaaacuuucuaacaaguucaauuccgugauuccuguccggagcggccacgaagaucuggagcuccuggaccuguccgcgccguuucuuauccaggggacaauucaucacuacggauguaaacagugcucuagccucagauccauccagaaccuuaauucucugguggauaagaccagcuggauccccuccagcguugccgaagcucucggcauugugccucugcaauaugucuucgugaugacauuuacgcuugacgacggcaccggggugcuggaggccuaccucauggauucugacaaauucuuucagauccccgcuuccgaaguucugauggaugacgaucugcaaaagagcgucgacaugauuauggauauguucugcccucccggaaucaagauugacgccuauccguggcuugaguguuuuaucaaaucuuacaacgugacaaauggcaccgauaaccagauuugcuaucagaucuucgacacaaccguggccgaggaugucaucuga

SEQ ID NO: 74040 - RNA, 1755 nt, Artificial Sequence
  derived and/or modified sequence opt5 from POTED__Homo_sapiens__NP_778146
augguggccgaggucugcagcaugcccaccgcuuccacaguuaagaaaccuuucgaccugagaucuaagaugggcaaauggugucaccaucgguuuccgugcugucgcgggagcggaaaguccaacaugggcacgucuggggaucacgacgauagcuucaugaaaaugcucagauccaagaugggaaagugcugucggcauugcuuucccuguugccgcggcucugggaccagcaaugugggaacauccggcgaccacgaaaacagcuucaugaaaaugcugagaucuaagaugggcaaaugguguugccauuguuuuccuugcugccggggguccggaaagagcaaugugggcgccuggggagauuacgaccacucugcguucauggagccccgcuaucacaucagacgggaagaucuugacaaacugcaucgcgcugccuggugggggaaggucccuagaaaggaucucauugugaugcugcgggacaccgauaugaacaaacgcgacaaggagaaaagaacagcccuucaccuggcuuccgccaauggcaacagcgaaguugugcagcuccugcuggaucggcgcugucaacucaauguccuggacaacaagaaaagaaccgcucuuaucaaggccauucagugccaggaggacgagugugugcugaugcuccuggaacauggggcggaucggaauauccccgacgaguacggaaacacagcccuucacuaugcuauuuacaaugaagauaaacugauggccaaggcucuccugcuguauggcgccgacaucgagucuaagaacaaaugcggccucaccccucugcuucuggggguucacgagcagaagcaacagguggucaaauuucucaucaagaaaaaggcgaaucugaacgugcuugauagauacggacgcacggcccugauucucgcuguguguugcggcuccgccagcaucgucaaucugcugcucgaacagaacguugacguguccucucaggaucugagcgggcaaaccgcucgggaguaugccguguccagccaucaccaugucauuugugaacuucugucugacuacaaggagaaacagaugcucaagaucuccagcgaaaacucuaauccggagcaggaucugaaacuuacaagcgaggaagagucccagagacugaaggugucugaaaacagccaacccgagaaaaugucccaggaaccugagauuaauaaggacugcgaucgcgagguugaagaggaaaucaagaaacacggaagcaaccccgugggccucccugagaaucugaccaacggggccucugcuggaaauggcgacgacggccugauuccccagcggagaucccgcaagccggaaaaccaacaguucccugauacagagaaugaggaauaccauagcgacgagcagaacgauacccggaaacagcucucugaagaacaaaauacggggaucucccaggacgagauccugacaaacaagcagaaacagauugaagucgcggagcaaaagaugaauagcgaacuuucccugucucacaagaaagaggaagaucuccugagagagaacagcgugcugcaggaggaaaucgccaugcuucgccucgagcuggacgaaaccaagcaccagaaucagcugcgggagaacaaaauucucgaagagaucgaguccguuaaggagaaaacagauaagcugcuuagagcuaugcaacugaacgaggaagcccucaccaaaaccaauauuuga

SEQ ID NO: 74041 - RNA, 3228 nt, Artificial Sequence
  derived and/or modified sequence opt5 from POTEF__Homo_sapiens__NP_001093241
augguggucgagguugacagcaugcccgccgcuuccucugugaagaaaccuuucggccugagaagcaagauggggaaauggugcugucggugcuuuccguguugccgcgaauccggaaagucuaacgugggcaccagcggggaucacgacgauuccgccaugaaaacacucagaucuaagaugggaaaguggugucggcauugcuuccccuguugccgcggcagcgggaaauccaaugucggagcgagcggcgaccacgaugacucugcuaugaagacgcugagaaacaaaaugggcaagugguguugccauuguuuuccuugcugccggggguccagcaaaucuaaggugggagccuggggcgauuacgacgauuccgccuucauggagccccgcuaucacguuagaggggaagaccuugauaagcugcaucgggcugccugguggggaaaagugccucgcaaggaccucaucgucaugcugagagauaccgacgugaauaaacaggacaagcaaaaacggacagcccuucaccuggcuagcgcgaacggcaauucugagguugugaagcuccugcuggaucgcagaugucagcucaacguccuggacaauaaaaagcggaccgcccuuauuaaggcugugcagugccaggaagaugagugugcccugaugcuccuggagcacgggacagaccccaacaucccugaugaauacggaaauaccacacuucauuaugcuauuuacaacgaggacaaacugauggccaaggcgcuccugcuguauggcgccgauaucgaauccaaaaauaagcacggccucaccccgcugcuucugggggugcaugagcaaaaacagcaggucguuaaguuucucauuaagaaaaaggcuaaccugaaugcccuugaccgcuacggaagaacggcucugauccucgccgugugcuguggcagcgccuccaucgugucucugcugcucgagcagaacauugaugucagcucccaagaccugagcgggcagaccgcucgggaauaugcggugucuucccaccaccauguuaucugccagcuucugagcgauuacaaagagaagcagaugcucaaaauuucuagcgaaaauuccaaccccgagcaagaccugaaacuuacaucugaagaggagagccagagauucaagggauccgaaaacagccagccugagaagaugucucaagaacccgagaucaauaaggacggcgaucgcgaaguggaggaggaaaugaaaaagcacgaguccaacaaugucgggcugcucgaaaaccugaccaauggagugacagccggcaacggcgacaaugggcugauuccucagcggaaaagcagaacccccgagaaccagcaguuuccggauaaugaaucugaggaguaccaucgcaucugugaacuccuguccgacuauaaggagaagcaaaugccuaaauacagcuccgaaaacucuaaucccgagcaggaucuuaagcugacgagcgaggaagagucccagcggcucaaaggaucugaaaacggccagccugagaagagaagccaagaacccgagauuaauaaagacggggaucgcgagcuggaaaacuucauggcuaucgaggaaaugaagaaacaccgguccacacauguuggauuucccgagaaucugaccaacggcgccacagccgggaacggcgacgauggacuuaucccuccgagaaagagccgcacccccgaaucucagcaguucccugacaccgagaaugaggaauaucacuccgaugagcagaacgacacacaaaagcaguuuugcgaggaacagaauacgggcauucuccacgaugaaauccugauucaugaggagaaacagaucgaaguggucgagaagaugaacagcgaacugucucucuccuguaaaaaggagaaagacauucugcacgagaauagcacccuucgggaagagaucgcuaugcugagacucgaacuggacacaaugaagcaucaaucucagcugcgcgagaagaaauaccuugaagauaucgagagcgugaagaaacggaacgacaaucuccugaaggcccugcagcucaacgagcugaccauggaugacgauacagcgguccuugugauugacaauggguccggaaugugcaaagcuggcuucgccggggaugacgcccccagagcuguuuuuccuagcaucgugggacggccccgccaacagggcaugaugggcgggaugcaccagaaggaaucuuaugucggaaaggaggcccaguccaaaagaggcauucugacccucaaguacccgauggaacacgggaucauuacgaacugggaugacauggagaaaaucuggcaucacacauucuauaaugaacugcggguggcuccugaggagcaucccguucugcuuaccgaagccacccucaacccuaaggcgaauagagagaaaaugacacaaaucauguucgaaaccuuuaacacacccgccauguacguggcuauucaggccguccugagccuguacacguccggacgcaccacaggcaucgugauggauucuggggacggagugacccacacaguuccuauuuaugagggcaaugcucucccccaugccacccugcggcuugaucuggcggggagagaacucccggacuaccugaugaagauccugacggagcacggcuaucgcuucaccacaauggccgagagagaaauuguccgggacaucaaggagaaacuuuguuacguggcucucgauuuugaacaggagauggccaccguggcuagcuccucuagccuggagaaguccuaugaacugccugacggacaggucauuacaaucggcaacgagcgcuucagaugccccgaagcccucuuucaacccugcuuccuggggauggagucuuguggaauccacgaaaccacguuuaacagcauuaugaaauccgauguggacauccggaaggaucuuuacacaaauaccguucugagcggcgggacaaccauguauccuggaauggcccaucgcaugcagaaagagauugcugcgcucgccccgucuaugaugaagaucagaauuaucgcucccccuaaacggaaguacuccgugugggucggcgggagcauccuggccucucuguccaccuuccagcagauguggauuagcaagcaagaguacgacgaaucuggccccuccaucgugcaccgcaaaugccuuuga

SEQ ID NO: 74042 - RNA, 1527 nt, Artificial Sequence
  derived and/or modified sequence opt5 from POTEG__Homo_sapiens__NP_001005356
augguggccgaggcuggcagcaugcccgccgcguccucugucaagaaaccuuucgggcugagaagcaagaugggaaaauggugccggcacuguuuuccguggugccgcggcuccgggaagucuaacguuggaaccagcggcgaccaugaugacuccgcuaugaaaacacucagaucuaagauggggaaguggugucggcacugcuuccccuggugucgcggaagcuccaaaagcaaugugggcacgucuggcgaucaugacgauuccgccaugaagacccugagaagcaaaauggggaaguggugcugucacugcuuuccuuguugccggggaucuggcaaauccaagguggggcccuggggagacuacgaugacagcgccuucauggaaccucgcuaucaugucagacgggaggaucuugacaagcugcaccgcgcugccugguggggcaaagugcccagaaaggaucucaucguuaugcugaaagacacagauaugaacaagaaagacaagcagaaacggaccgcccuucaccuggcuucugcgaaugggaacuccgaaguggucaagcuccugcuggaccgcagaugucaacucaauauucuggauaacaagaaacggacagcccuuaccaaggcugugcagugccgcgaggacgaaugcgcccugaugcuccuggagcauggaacagauccuaauaucccggacgaguacggcaacaccgcccuucacuaugcuauuuacaaugaagauaaacugauggcgaaggcccuccugcuguauggcgcugacaucgagagcaaaaacaagcaugggcucacgccccugcuucugggaguucacgaacagaagcagcaaguggucaaauuucucauuaagaaaaaggccaaucugaacgcucuugauagauacggccggaccgcccugauccucgccguguguugcggguccgcuucuaucgugagccugcugcucgagcagaauauugacgucuccagccaggaucugucuggacagacagcgagagaguaugccguuuccagccaccauaacgugaucugucaacuucugucugacuacaaagaaaagcagaugcucaaggugagcuccgaaaauucuaacccugaacaggaucugaaacuuaccagcgaggaagagucccagcgccugaagggcagcgagaacucucaacccgaagagaugucccaggaaccugagauuaauaaagggggagaccggaaggucgaagaggagaugaaaaagcacggcagcacacauaugggcuuccccgaaaaccucccgaauggggcuaccgccgacaacggagaugacggccugaucccucccagaaagucucgcacgccugagucccagcaauuucccgauacagaaaaugagcaguaccacagcgacgaacagaacgauacccagaaacaacuguccgaggagcagaauacagggauucuccaggacgaaauccugauucaugaggaaaagcagaucgagguggccgagaacgaguucuga

SEQ ID NO: 74043 - RNA, 1638 nt, Artificial Sequence
  derived and/or modified sequence opt5 from POTEH__Homo_sapiens__NP_001129685
augguggccgaggcuggcagcaugcccgccgcguccucugucaagaaaccuuucgggcugagaagcaagaugggaaaauggugccggcacuguuuugcuuggugccgcggcuccgggaagucuaacguuggaaccagcggcgaccaugaugacuccgccaugaaaacacucagaucuaagauggggaagugguguugccacuguuucccguggugccggggaagcggcaaauccaaugugggcacgagcggggaucaugacgauucugccaugaagacccugcgcuccaaaaugggaaagugguguugccacuguuuucccugcuguagaggcagcgggaaaucuaacgugggaacauccggcgaccaugaugacagcgcuaugaagacccuucggucuaagauggggaaauggugcugccacuguuucccuugcugucgcggauccggcaagaauaaagucggccccuggggagauuacgacgauagcgccuuuauggaaccuagauaucacgugcggcgcgaggaccuggauaagcuccauagagcugccuggugggggaaaguuccccggaaggaccugaucgugaugcuuaaagacacagauaugaacaagaaggacaaacagaagcgcaccgcgcugcaccucgccuccgcuaauggcaacucugaagucgugaaacugcugcucgauagacggugccaacugaauauucuugacaacaagaaacgcacagcccugaccaaggcuguucagugucaggaggaugaaugcgcccucaugcugcuugagcaugggacggacccuaauaucccggaugaguacggaaacaccgcgcugcacuaugccauuuacaaugaagacaagcucauggcuaaagcccugcugcucuauggcgcugauaucgagagcaagaacaaacacgggcugacaccccuucugcucggagugcaugaacagaagcaacaggucgugaaauuccugauuaagaagaaagccaaucuuaacgcccuggacagauacggccggaccgcucucauccuggcgguguguugcggcuccgccagcaucgucucucugcuccuggagcagaauauugauguuuccagccaggaccuuucugggcaaacagcuagagaguaugccgugagcucccgccacaacgugaucugucagcugcucucugacuacaaggaaaaacagauucugaaggucagcuccgagaacagcaauccugaacaggaucuuaaacugaccucugaggaagagucccaacggcucaagggaagcgagaacucucagcccgaagagaugucccaggaaccugagaucaauaagggcggggacagaaaaguggaagaggagaugaagaaacauggaagcacgcacaugggcuuucccgaaaaccugacaaauggggccaccgcugauaacggcgacgauggacugauuccgccucgcaagucccggacacccgagucucaacaguucccugacaccgaaaaugagcaguaccauagcgaugaacagaacgacacccaaaaacagcucuccgaggagcagaauacaggcauccugcaggaugaaauucuuauccacgaggaaaagcaaaucgagguugccgagaacgaauuuuga

SEQ ID NO: 74044 - RNA, 1527 nt, Artificial Sequence
  derived and/or modified sequence opt5 from POTEM__Homo_sapiens__NP_001138914
augguggccgaggcuggcagcaugcccgccgcguccucugucaagaaaccuuucgggcugagaagcaagaugggaaaauggugccggcacuguuuuccguggugccgcggcuccgggaagucuaacguuggaaccagcggcgaccaugaugacuccgcuaugaaaacacucagaucuaagauggggaaguggugucggcacugcuuccccuggugucgcggaagcggcaaauccaaugugggcacgagcggggaucaugacgauucugccaugaagacccugagauccaaaaugggaaaguggugcugucacugcuuuccuuguugccggggcagcgggaaaucuaaggugggacccuggggcgacuacgaugacuccgccuucauggaaccucgcuaucaugucagacgggaggaucuugacaagcugcaccgcgcugccuggugggggaaagugcccagaaaggaucucaucguuaugcugaaagacacagauaugaacaagaaagacaagcagaaacggaccgcccuucaccuggcuagcgcgaauggaaacucugaaguggucaagcuccugcuggaccgcagaugucaacucaauauucuggauaacaagaaacggacagcccuuaccaaggcugugcagugccaggaggacgaaugcgcccugaugcuccuggagcauggcacagauccuaauaucccggacgaguacggcaacaccgcccuucacuaugcuauuuacaaugaagauaaacugauggcgaaggcccuccugcuguauggggcugacaucgaguccaaaaacaagcauggacucacgccccugcuucugggcguucacgaacagaagcaacagguggucaaauuucucauuaagaaaaaggccaaucugaacgcucuugaucgcuacgggagaaccgugcugauccucgccguguguugcggaagcgccuccaucgucucucugcugcucgagcagaauauugacguuagcucccaggaucugagcggccaaacagcucgggaguaugcggugucuuccagacacaacgugaucugucagcuucugagcgacuacaaagaaaagcagauucucaaggucucuagcgaaaauuccaacccugaacaggaucugaaacuuaccucugaggaagagagccaacgccugaagggguccgagaacagccagcccgaagagaugucucaggaaccugagaucaauaaaggaggcgaccggaagguggaagaggagaugaaaaagcauggcuccacacacaugggguuccccgaaaaccucccgaauggagccaccgcugacaacggcgaugacgggcugauuccucccagaaagagccgcacgccugagucucaacaguuucccgauacagaaaaugagcaguaccauuccgacgaacagaacgauacccaaaaacagcugagcgaggagcagaauacaggaauccuccaggacgaaauucugauccacgaggaaaagcaaaucgagguugccgagaacgaguucuga

SEQ ID NO: 74045 - RNA, 876 nt, Artificial Sequence
  derived and/or modified sequence opt5 from POU1F1__Homo_sapiens__NP_000297
augagcugccaggccuucaccuccgcugacacauuuaucccccugaacucugaugccagcgcgacgcucccucugauuaugcaccauuccgcugccgagugucuuccggugucuaaucacgccaccaacgucaugagcacagcuaccggccugcauuacuccguucccucuugccacuaugggaaucaaccuagcacauacggagugauggccggcucccucacccccugucuguauaaguucccugaccauacacuuagccacggguuucccccuauccaccagccgcugcucgcugaagaucccaccgccgcggacuucaaacaggagcugagacggaagucuaaacugguggaagaaccuauugauauggacucccccgaaauccgcgagcucgagaaguuugccaacgaguucaaagucagacggauuaagcugggauacacgcagaccaaugugggcgaggcucuugccgcuguucaugggagcgaauuuucucaaacaaccaucugccgcuucgagaaccugcagcucuccuuuaagaaugccuguaaacugaaggcgauccuuagcaaauggcuggaggaagccgaacaggugggagcucucuauaacgaaaaggucggcgccaaugagagaaaacggaagcgcagaacaaccauuucuaucgcugccaaggaugcccuggaacggcacuucggcgagcagaacaaaccuuccagccaagagauuaugcgcauggcugaggagcugaaucucgaaaaggaggugguuagagugugguuuugcaaccggcgccagagagaaaaacgggucaagacgucccugaaucagucucuuuucagcaucuccaaagagcaucuggagugucgcuga

SEQ ID NO: 74046 - RNA, 771 nt, Artificial Sequence
  derived and/or modified sequence opt5 from POU2AF1__Homo_sapiens__NP_006226
augcuguggcagaagcccaccgccccugagcaagcuccggcccccgcgagaccuuaccagggcgugcgggucaaagaacccguuaaggagcuccugcgcagaaaacgggggcacgcuagcuccggagccgccccugcucccacagccguggugcuuccucaucagccgcuggcuacguauaccacagucggccccucuugccucgacauggaagggagcguguccgccguuaccgaggaagcggcccugugugcuggauggcuuucucagccuacacccgccacccugcaaccucucgcucccuggacaccguacaccgaguaugugccucacgaggccgucagcugccccuacuccgcggauauguaugugcagccuguuugucccucuuacacgguggucggccccagcuccgugcugaccuaugccagcccuccgcugaucacaaacgugaccacaagaucuuccgcuacccccgccgucgggccuccccucgaaggaccugagcaucaggcuccccugacguacuucccguggccucagccccuuagcacacugccuaccucuacacuccaauaccagcccccugcccccgcccugccgggcccucaguuuguucagcuucccauuuccauccccgaaccugugcugcaagacauggaggauccgcgccgggcugcgagcucucucaccauugacaagcugcugcucgaggaagaggauuccgacgccuaugcucugaaucacacccuuagcguggaaggcuucuga

SEQ ID NO: 74047 - RNA, 2268 nt, Artificial Sequence
  derived and/or modified sequence opt5 from POU2F1__Homo_sapiens__NP_001185712
augcuggacugcagcgauuacgugcucgacuccagaaugaacaaucccucugagaccagcaagccuuccauggaaucuggcgaugggaacacaggaacgcagaccaauggccuggacuuccaaaaacagccgguccccguugggggagccaucagcacagcucaggcccaggcguuucuuggccaucugcaccaagugcagcucgcugggaccucccugcaggccgccgcucagucucuuaacgugcaaagcaaguccaaugaggaaagcggagauucucagcagccuucccagcccagccaacagccuucuguccaggccgcuauuccccaaacacagcugaugcucgccggcggccagaucaccgggcugacacugaccccugcgcagcaacagcuccugcuucagcaggcccaagcucaggcccagcugcucgcugccgcggugcagcaacacuccgccagccagcagcauucugcugccggagcuacgauuuccgccagcgccgcuaccccgaugacacagaucccccugucccaaccuauucagaucgcgcaggaccuucaacagcugcagcagcuccaacagcagaaccugaaucugcagcaauucguucucgugcaccccaccacaaaccugcagccugcccaguuuaucauuucucagacgccccaaggccagcaggggcuucugcaagcucagaaucuccugacccagcuuccgcagcaaagccaggccaaccugcuccagucccagccuagcaucacacugaccucucaacccgccacaccuacccggaccauugcugccacacccauccagacgcugccccagucccagagcaccccuaaacgcauugauacaccgucucucgaggaacccagcgaccuggaggagcuugaacaauucgcgaagaccuuuaaacagagacggaucaagcugggauucacacagggcgaugucgggcucgcuaugggaaagcuguauggcaaugacuuuucccagaccacgauuucucgcuucgaggcccuuaaccugagcuuuaaaaauauguguaagcucaaaccucugcuggaaaaguggcucaacgaugccgagaaucuguccagcgacucuucccuuagcucucccuccgcucugaacagcccuggcaucgaggggcucuccagacggcgcaaaaagagaacaucuaucgaaaccaacauucggguggcccuggaaaagagcuuccuggagaaucaaaaacccaccuccgaggaaaucacaaugauugcugaucagcuuaacauggagaaggagguuauccgcgugugguuuugcaauagacggcagaaagaaaagcgcauuaacccgccuucuagcggaggcaccuccagcucucccaucaaagccaucuucccuucccccacaagccucgucgcgacgaccccuucucuggugacauccagcgccgcuaccacacugaccgugucucccguccucccgcugacgagcgccgcuguuaccaaucuuuccgugacagggaccagcgacacaaccucuaacaauacggccacagugauuuccaccgcgccucccgccagcuccgcugucacaucucccagccuguccccuucuccgagcgccuccgcuucuaccagcgaggccuccagcgccucugaaaccuccacaacgcaaaccacaagcacaccccucucuuccccucugggaaccagccaggugaugguuaccgcuucuggccugcagacggcggccgcugccgcccuucagggggcugcccaacuccccgcgaacgcuucccuggccgccauggcugccgcggcuggacugaauccuagccucauggcccccucccaguuugccgcuggcggcgcccugcuuagccugaacccugggacacucucuggagcucugagccccgcccugauguccaauucuacccuugcgaccauccaggcccucgcuagcggcgggucccugccgauuacaucucuggacgccaccggaaaccucguguucgcuaaugccggcggggccccuaacaucgucacagcuccccuguuccuuaauccucagaaccugagccuccugacguccaaccccgugucucugguuagcgcggccgcugccuccgccggcaauagcgcuccgguggccucucuucaugcgaccuccacaagcgcugagucuauucaaaacucccucuuuaccgucgccagcgccuccggagcugccucuacaaccacgaccgcgagcaaggcucaguga

SEQ ID NO: 74048 - RNA, 1440 nt, Artificial Sequence
  derived and/or modified sequence opt5 from POU2F2__Homo_sapiens__NP_001193954
auggugcacagcuccaugggcgcccccgagaucagaaugucuaagccucuggaagcugagaaacaggggcucgacagcccguccgaacauaccgauacagagcggaacggacccgacacgaaucaccaaaacccucagaauaagaccucucccuucagcgucuccccuacaggccccucuaccaaaauuaaggccgaagauccuagcggggacuccgcgccggcugcuccccugccuccccagccugcccagccccaucuuccgcaagcccagcugaugcucacaggaagccagcuggccggcgauauccagcaacuucugcagcuccagcagcugguucuggugccugggcaccaucuccaacccccugcucaguuucugcuuccccaggcccaacagucucagcccggacugcucccuaccccgaaccuguuccagcuuccccaacagacacagggcgcgcugcucaccucccagccucgcgccggccugcccacgcaagcugugaccagaccuacacugcccgacccgcaccucagccacccucagcccccuaaaugccuggagcccccuucucaucccgaggaaccguccgaucuugaggaacuggagcaguuugcccggaccuucaagcagcgcagaauuaagcucggguuuacacaaggagacgucggccuggcuauggggaaacuuuacggaaaugauuucagccagaccacgaucucucgguuugaggcccugaaccucuccuucaagaauauguguaaacugaagccucugcucgaaaaauggcugaacgacgcggagacaaugagcguggauuccucucuucccagccccaaucagcuguccagcccuucucucggcuuugacgggcugccgggacgcagacggaagaagcgcaccuccauugaaacaaacguuagauucgcccuugagaaaucuuuucuggcuaaucagaagcccaccucugaagagauccuccugaucgccgagcaacugcacauggaaaaagaggugauucgggucugguucugcaaccgcagacagaaggaaaaacggaucaauccuuguagcgcugcccccaugcucccuucccccggcaagccugccucuuauagcccccauauggugaccccgcagggcggggcuggaacacugccucuuucccaagcgagcagcucccugagcacgaccguuacaacccucucuuccgccgugggcacacugcaccccagccgcaccgcugggggaggcgggggaggcggcggggccgccccuccccugaacuccauuccgucugucacgccucccccucccgcuacaaccaauagcaccaaccccuccccucagggaucucacagcgccaucggccuuuccgggcucaacccgagcacaggacccggccugugguggaauccugcgcccuaccagccuuga

SEQ ID NO: 74049 - RNA, 1317 nt, Artificial Sequence
  derived and/or modified sequence opt5 from POU2F3__Homo_sapiens__NP_001231611
auggagagccccagaaccgccaagggcgggcgggacaucaaaauguccggagauguggcugacucuacagaugcccgcagcacgcugucccaggucgaaccuggcaacgacagaaaugggcucgauuucaaccggcaaauuaagaccgaggaccugucugauagccuucagcagacacugucccaccgcccgugccaucucucucagggacccgcgaugaugagcggcaaucaaauguccgggcugaacgcuagcccuugucaggacauggccucucuucacccccugcagcagcucguucuggugccuggacaucugcaauccgugagccaguuucuccugucucagacccagcccggccaacagggccuucagccuaaucugcucccguucccccaacagcaguccgggcugcuucugccucagacaggacccggccucgccagccaggcuuuugggcacccuggacugcccgggucuucccuggaaccgcaucucgaggccagccaacaucugccuguccccaaacaccuuccuuccucuggcggagcugaugaacccagcgaccuggaggagcucgaaaaguucgccaaaaccuuuaagcagagacggaucaagcugggcuucacacagggcgauguggggcuugcgaugggaaaacuguacggcaacgacuuuucccaaaccacgauuagccgcuucgaggcccucaaucugucuuuuaagaacaugugcaaacugaagccccuccuggaaaaauggcuuaaugaugcugaguccagcccuucugacccgagcguuuccacccccucuagcuauccuucccugagcgagguguucgggagaaagcggaagaaacgcacaucuaucgaaaccaacauuagacucacacuggagaagcgguuucaggacaaucccaaaccuuccagcgaagagaucucuaugaucgccgaacagcuuuccauggagaaggaggucgugcgcguuugguucuguaacagacggcagaaagaaaagcgcauuaauugccccguggcuaccccgaucaaaccucccgucuacaacagcagacugguguccccuucuggaagccucggcccccuguccgugccucccguccacucuacgaugccggggacaguuaccagcuccuguagcccuggaaauaacucucggcccuccagccccggcucuggccugcacgccuccagcccuacagcgucucaaaacaauagcaaggccgcugugaacuccgccagcucuuuuaauuccagcggguccugguauagauggaaccauucuaccuaccuccacuga

SEQ ID NO: 74050 - RNA, 1332 nt, Artificial Sequence
  derived and/or modified sequence opt5 from POU3F2__Homo_sapiens__NP_005595
auggccaccgcugccagcaaccacuacucccugcucacaucuagcgcguccaucgugcaugcugagcccccuggcgggaugcagcaaggagccggcggguauagagaagcccagucucugguccagggagacuacggcgcccuucagagcaaugggcacccgcugucccaugcucaccaauggauuacggcucucucucauggaggcggcgggggaggcgggggaggcgggggaggcggcgggggaggcgggggaggcgggggagauggcagccccugguccaccagcccucugggccagcccgacaucaagccuucuguuguggugcagcaagggggacggggcgaugagcuucacgggcccggagcccugcagcagcagcaccagcaacagcagcaacagcagcagcaacagcagcagcaacagcagcagcaacagcagcagcaacgcccuccgcaucucguccaccaugcggccaaccaccaccccggcccuggggcuuggagauccgccgcugccgcggcccaucugcccccuagcaugggcgcuucuaauggaggccugcucuauucccagcccagcuucacagugaacgggaugcugggagccggcgggcagccggcuggacuucaccaucacggccugcgggacgcccaugaugaaccucaccacgccgaccaucacccccauccucacucucacccccaucaacagcccccuccgcccccucccccucaggggcccccgggccacccuggagcucaucacgauccccauuccgacgaggauaccccuacaagcgacgaucucgaacaguuugcgaaacaauucaagcagcgcagaauuaaacugggcuuuacccaggccgacguugggcuugcucugggaacacucuacggcaauguguucucccagaccacgaucugccgguuugaggcccugcaacugucuuucaagaacauguguaaacucaagccccugcuuaauaaguggcuggaggaagccgauagcuccagcgggucuccuaccuccauugacaaaaucgcugcccagggacgcaagcggaaaaagagaacaagcaucgaggucucugugaaaggcgcgcucgaaagccacuuucugaagugccccaagccguccgcucaggagauuaccucucuugccgacagccugcagcucgagaaagaaguugugcgcgucugguucuguaacagacggcaaaaggagaaacgcaugacaccucccgggggcacccugcccggagccgaagauguguauggcggguccagagacacgccuccgcaccauggagugcagacacccguccaguga

SEQ ID NO: 74051 - RNA, 1503 nt, Artificial Sequence
  derived and/or modified sequence opt5 from POU3F3__Homo_sapiens__NP_006227
auggccaccgcugccagcaaccccuaccugccuggcaauucccuccuggcggcugggucuaucgugcacagcgacgccgccggagcuggcgggggaggcgggggaggcggcgggggaggcgggggaggcgccgggggaggcggcgggggaaugcagccgggcuccgcugccgucacaucuggggcguauagaggagaucccagcuccguuaagauggugcaaucugacuucaugcagggcgccauggcugccagcaacgggggacauaugcuuucccacgcucaucagugggugacggcccugccucacgcggccgcugccgcugccgccgcugcggccgcugccgucgaggccagcucucccugguccggcagcgcugugggcauggccgggucuccucagcaacccccucagccgcccccucccccuccccagggaccggauguuaaaggcggggcgggacgggacgaucuccaugcuggcaccgcccugcaccaccgcgggccuccccaucuuggcccucccccucccccgccccaccagggacauccuggcggguggggagccgcugccgcugccgcggccgcugccgcugccgcggccgcugccgcucaucugcccuccauggccggcgggcaacagccucccccgcagagccuccuguacucucagccuggaggcuuuacagugaaugggaugcuguccgcucccccuggccccggaggcgggggaggcggggccggaggcggggcgcaaagccucguccacccuggccuggugagaggagacacccccgaacuugccgagcaccaccaucaccaucaccaccaugcucacccgcauccuccccacccccaccaugcccagggcccuccgcaccaugggggaggcgggggaggcgccgggcccggccugaacucccacgauccucauucugacgaagauacacccaccagcgacgaucucgagcaguucgcuaagcaauuuaaacagcggcgcauuaagcugggauucacacaggccgacguuggccuugcgcuggggacccucuauggaaauguguuuucccagacgaccaucugcagauucgaagcucugcaacugagcuuuaaaaacauguguaagcucaagccucugcuuaauaaauggcuggaggaggccgauucuuccacaggcagccccaccucuauugacaagaucgccgcucaggggcggaaacgcaagaaaagaacaagcauugaagucuccgugaagggagcccucgagucucacuuccugaagugcccuaaacccagcgcgcaggaaaucaccaaccuugcugacucccugcagcucgagaaggaggugguccggguuugguuuuguaaucgcagacaaaaagaaaagcggaugacgccgccuggcauccagcagcagacacccgaugacguguacagccaagugggcaccgucucugccgauacaccucccccgcaccaugggcugcagaccuccgugcaguga

SEQ ID NO: 74052 - RNA, 1086 nt, Artificial Sequence
  derived and/or modified sequence opt5 from POU3F4__Homo_sapiens__NP_000298
auggccaccgcugccagcaaccccuacuccauccugucuagcacaucccucgugcacgcggacucugcuggcaugcagcaagggagcccuuucagaaauccgcagaagcugcuucaguccgauuaucugcagggaguccccucuaacggccauccucucgggcaccauuggguuacgagccuguccgacggaggccccuggagcucuacccuugccacauccccucuggaucaacaggacgugaaacccgggcgggaggaucuccagcugggagccauuauccaccaucgcagcccucacguggcucaccauucuccgcacaccaaucaucccaacgccuggggcgcuuccccugcccccaauccuagcauuacaucuuccggccagccccugaacgucuacagccaaccgggguuuaccguguccggaaugcucgaacacggcgggcugacaccucccccugcggccgcuucugcccagagccuucaccccguucugagagagcccccugaccauggagaacucggcucccaccauugccaggaucacagcgacgaggaaaccccgacgucugaugagcuggagcaguucgcuaagcaauuuaaacagcggcgcaucaaacuuggguucacccaggccgacgugggacuggcgcucggcacacuguauggcaaugucuuuucccaaaccacaauuuguagauucgaagcccugcagcucagcuuuaagaacaugugcaagcugaagccccuucugaauaaauggcucgaggaagcugauucuagcaccggguccccuacgucuaucgacaagaucgccgcucagggacggaaacgcaagaaaagaacaagcauugagguguccguuaagggcgugcuggagacccauuuccuuaagugucccaaaccugccgcccaggaaaucagcucucuggcugauucccuccaacuggagaaggaagucgugcgggugugguuuugcaaccgcagacagaaagagaagcggaugacacccccgggggaccagcagccucacgaagucuacagccacaccguuaaaaccgacacaucuugucaugaucuguga

SEQ ID NO: 74053 - RNA, 1260 nt, Artificial Sequence
  derived and/or modified sequence opt5 from POU4F1__Homo_sapiens__NP_006228
augaugagcaugaacuccaagcaaccccacuucgccaugcauccuacccugccggagcacaaauaccccucucuccauagcuccucugaagcuaucagacgggccugccugccuacacccccucuucaaagcaaucuguuugcgucccucgacgagacgcugcuugcucgcgccgaagcccuggcugccguggauauugcugucucucagggcaagagccaccccuucaaaccugacgccaccuaucauacaaugaacuccguuccguguaccagcacaucuaccgugccccucgcgcaccaccaucaccaucaccaccaucaccaggcccuggagccuggggaucugcucgaccauaucuccagccccucucuggcucuuauggccggagcuggcggggccggagcggccgcuggcgggggaggcgcccacgauggcccugggggaggcgggggacccggcgggggaggcggcccgggagggggcccugggggaggcgggggaggcggccccgggggaggcgggggaggcccugggggcggacugcucggcggguccgcucauccccacccccacaugcauagccugggacaccuuucucauccugccgccgcugcggccaugaauaugccguccggccugccccacccugggcucguggcugccgccgcucaccauggagccgcggcugccgccgcugccgcugccgcgggccaggucgccgcugccagcgcugccgcggccgugguuggggcugccggccuggcuuccauuugcgacucugauacagaccccagagaacuggaggccuuugccgagcgguucaagcaacgcagaaucaaacucggagugacccaggcugaugucggcagcgcgcuggccaaccuuaagauuccuggggugggaucccugagccagucuacgaucugucgguuugaaucccucacccugagccacaauaacaugaucgcucuuaagcccauucugcaggccuggcucgaggaagccgagggcgcucaacgcgagaaaaugaauaagccggaacuguucaacgggggagagaaaaagagaaaacggacaucuaucgccgcgccugaaaagcgcagccuggaggcuuacuuugccguucagcccagaccuuccucugaaaagauugccgcuaucgccgagaaacucgaccugaagaaaaaugugguccgggugugguucugcaaccagcgccagaagcagaaaagaaugaaguuuagcgcgaccuauuga

SEQ ID NO: 74054 - RNA, 1230 nt, Artificial Sequence
  derived and/or modified sequence opt5 from POU4F2__Homo_sapiens__NP_004566
augaugaugaugagccugaacuccaagcaggccuucucuaugccccacggcgggagccuccauguggagccuaaauacuccgcucugcacucuaccagcccgggauccucugcccccaucgcgccuagcgcuuccagccccucuuccagcucuaaugccggcgggggaggcgggggaggcggcgggggaggcgggggaggcgggagauccucuagcuccagcuccucuggaagcuccggcggcgggggaagcgaagccaugcggcgcgcuugccuuccuacacccccuucuaacauuuuuggcgggcuggacgagucccuccuggccagagcugaagcccuugcggccgucgauaucguuagccaaucuaagagccaucaccaucacccgccccaccauuccccuuucaaacccgacgcuacguaucacaccaugaauacaauuccuuguaccucugccgcuagcuccagcucugugcccaucucccauccgagcgcccuggcgggaacacaccaccaucaccaucaccaucaccaccaucaccaucagccucaccaggcccucgagggcgaacugcuggagcaccucucucccgggcuggcucuuggagccauggcuggcccugauggcgccguggucuccacccccgcccaugcuccccacauggcgacaaugaacccuaugcaucaggccgcucugagcauggcccacgcccaugggcucccgucccacaugggaugcaugucugacguggaugcugacccccgggaucuggaggccuuugcggaacgcuucaagcaaagacggauuaaacuuggcguuacccaggcugacguggggagcgcccuggccaaucucaagaucccuggagucggcucccugucucagagcacgaucugucgcuuugagucccugacccucagccacaacaauaugauugcucugaagcccauccuucaggccuggcuggaagaggcugagaaaucucauagagaaaagcucacaaaaccugagcuguucaacggggccgaaaagaaacggaagcgcaccuccauugcggcccccgagaagagaagccuugaagccuacuuugcuauccaaccgcggccuucuuccgagaaaauugcugccaucgcggagaagcuggaucucaaaaagaaugugguucgcgugugguucugcaaccagagacagaaacagaagcggaugaaauauagcgccggcauuuga

SEQ ID NO: 74055 - RNA, 1017 nt, Artificial Sequence
  derived and/or modified sequence opt5 from POU4F3__Homo_sapiens__NP_002691
augauggccaugaacagcaagcagcccuucggcaugcacccugugcugcaagagccgaaauuuuccucucuccauagcggguccgaagcuaugagacgggucugccugcccgccccucagcuucagggaaauaucuucggcucuuuugacgagagccugcucgcgcgcgcugaagcccuggccgcuguugauauugugucccacgggaagaaccaucccuucaaaccugacgccaccuaccacacaaugucuagcgugcccuguacguccaccagcucuacagucccuaucucccauccggcugcccuuaccagccacccccaccaugcggugcaccagggacuggagggcgaucuccuggaacauauuucuccuacacuguccguuagcgggcucggagcccccgagcacucugugaugccugcucaaauccacccccaucaccugggcgccaugggccaucuucaccaggcuauggggaugucccauccgcacaccgucgccccucacagcgcgaugcccgccugccuguccgacguggagucugauccuagagaacucgaggcuuuugccgaacgguucaagcagcgcagaauuaaacugggaguuacacaggcugacgugggcgccgcccuugcuaaucugaagauccccggggucggaagccucucccaaagcaccaucugucgguuugagucucugacgcugucccauaacaauaugauugcgcucaagcccgugcugcaggccuggcuugaggaagcugaggccgccuaucgcgagaaaaacagcaagccugaacuguucaauggcucugaaagaaaacggaagcgcaccagcaucgcugccccggagaaaagaucccucgaggcguacuuugcuauucagccccggccuucuagcgaaaagaucgccgccauugcugagaagcuggaucuuaaaaagaacgugguccgcguuugguucugcaaucagagacaaaaacagaagcggaugaaauauuccgccgugcacuga

SEQ ID NO: 74056 - RNA, 1080 nt, Artificial Sequence
  derived and/or modified sequence opt5 from POU5F1B__Homo_sapiens__NP_001153014
auggccggccaccuggcuagcgacuucgccuuuucucccccucccgggggaggcggggauggacccuggggcgcggagccuggguggguggacccccucaccuggcugucuuuccagggaccucccggcggcccugggaucggaccgggcgucgggcccggaagcgaaguuuggggcauuccucccugcccucccccguacgagcuuugugggggaauggcuuauugcggcccucaagugggcguggggcuggucccccagggaggccucgaaacaucccagccugagucugaagccggggugggaguugagagcaacuccaauggcgccucucccgagcccuguacggugccuccgggggcugucaagcuggaaaaagagaagcuggaacagaaccccgagaaaagccaagauaucaaggcccuucagaaagagcucgaacaguuugcuaagcugcugaagcagaaaagaauuacccucggauacacacaagccgacgugggccugauccuuggcguucuguucgggaagguguuuucccagaaaaccauuugccgguucgaggcgcuccagcugagcuuuaagaauauguguaaacuucgcccucugcuccagaagugggucgaagaggccgauaacaaugaaaaccugcaagagaucugcaaggcugagacacugaugcaggccagaaaacggaagcgcaccucuaucgaaaauagagugcggggaaaccucgagaaucuguuccuucagugucccaaaccuacacugcaaauuucccauaucgcucagcagcucggccuggaaaaggacgugguccgcguuugguuuugcaacagacggcagaaagggaagcgcagcuccuccgauuaugcccaaagagaggacuucgaagcggccggaagccccuuuucuggcgggccgguguccuucccucccgcuccuggcccccacuuuggaaccccuggcuacgggagcccccauuucacggcccuuuauuccucugugccguucccugagggagaggucuuuccgcccgugagcguuauuacccugggcuccccuaugcacagcaauuga

SEQ ID NO: 74057 - RNA, 495 nt, Artificial Sequence
  derived and/or modified sequence opt5 from POU5F1__Homo_sapiens__NP_001272915
augugcaagcugagaccccuccugcagaaauggguggaggaagccgacaacaaugagaaccuucaagaaaucuguaaggcugagacccugguccaggcccggaaacgcaagagaacaagcauugaaaaucggguucgcggcaaccucgagaaucuguuccuucagugcccuaaaccgacgcugcagcaaaucucccacauugcgcagcagcucgggcuggagaaggauguggugagagucugguucuguaaccggcgccagaagggaaaaagaucuagcuccgacuacgcucaacgggaagauuucgaggccgccggcucucccuuuagcgggggaccuguguccuucccccuggcuccuggcccccauuuugggaccccuggauauggcucuccgcacuucacagcccucuacagcuccguucccuuuccugaaggcgaggcuuuucccccugugagcgucaccacacuggggucucccaugcauuccaauuga

SEQ ID NO: 74058 - RNA, 906 nt, Artificial Sequence
  derived and/or modified sequence opt5 from POU6F1__Homo_sapiens__NP_002693
augcccggcaucagcucccagauucugaccaacgcccaaggacaggugaucgggacacucccuugggucguuaauucugcuagcguggccgcgccggcucccgcccagucccuucaggugcaagccgucacgccucagcugcugcucaacgcucagggccaggugauugccacccuggcuucuagcccccuuccucccccuguugccgugagaaagccguccacacccgagucuccugcgaaaagcgaaguccaacccauccagccuacccccacagugccgcagccugccguugugauugcuucccccgccccugcugccaagcccagcgcgucugcccccaucccuauuaccugcuccgagacaccgaccgucagccagcuggugucuaaaccccacacgccuucccucgacgaagaugggaucaaucuggaggaaauccgggaguucgcuaagaacuuuaaaauucgcagacugagccucggacugacccaaacacaggugggccaggcccuuaccgcuacagaggggcccgccuacucucaauccgccaucugucgguucgaaaagcuggacauuaccccuaagagcgcucagaaacucaagcccguccuggagaaauggcuuaaugaagcggagcugcgcaaccaggagggacagcaaaaucucauggaauuuguuggcggcgagccguccaagaaaagaaagcggcgcacgucuuucacaccucaggccaucgaagcucugaacgccuauuuugagaagaauccccugccuaccgggcaggaaauuacagagaucgccaaagagcucaacuacgauagagaaguggugcgggucugguucugcaaucgcagacagacccugaagaacaccagcaaacuuaauguguuucaaauccccuga

SEQ ID NO: 74059 - RNA, 1968 nt, Artificial Sequence
  derived and/or modified sequence opt5 from POU6F2__Homo_sapiens__NP_001159490
augagcgcccugcuccaggaccccaugaucgcuggccaaguguccaagccucugcuuucugucagaagcgagaugaacgccgaacugcgcggggaggauaaagcggcuaccuccgacucugaacucaaugagccgcugcuugcccccguugaaagcaacgauuccgaggacacaccuucuaagcuguucggagcccggggcaaucccgcucucagcgauccugggacgcccgaccagcaccaggccucccagacccauccuccguuucccgugggaccucaaccccugcugacagcucagcagcucgccagcgcgguggccggcgucaugccugggggacccccggcucugaaccagccuauucuuauccccuucaauauggccggccaacugggcgggcagcagggacucgugcugacccuuccuacagcuaaccugaccaauauucagggccucguugccgcggccgcugccgggggaaucaugacacugccccugcaaaaccuccaggcuaccucuucccugaauagccagcuucaacagcugcagcuccagcugcaacagcagcagcaacagcagcagcaacagcccccuccgucuacgaaccagcacccccagccugcuccccaagccccuucccagagccagcaacagccccuucagccgaccccuccccagcaaccucccccugcuucucagcagcccccggcgccuacaucccagcugcaacaggcuccccagccccagcaacaucagccucacagccauucccagaaucaaaaccagccgucucccacccagcagagcuccagcccuccccaaaaaccuucucagucccccggccacgggcucccuagcccccugacaccgccuaauccccugcagcucgugaacaauccucuggccucucaggccgccgcugccgcggcugccaugagcuccauugccucuagccaagccuuuggaaacgcccuuuccagccugcagggcgucaccggccagcucgugacgaacgcucaggggcaaaucaucggaacaauuccccugaugccgaauccuggccccucuucccaggccgcgagcgggacccagggacuucagguucaaccuaucacaccccagcugcucaccaacgcccagggccaaauuaucgcuaccgugauugggaaucagauccugcccgucauuaacacacagggaaucacgcugucuccuaucaagccgggccagcaacuccaccagcccucccagaccagcgugggccaggccgcuucccaagggaaucugcuucaucuggcccacucucaggcgagcaugucccagucuccugugagacaggccagcuccagcagcuccucuucuuccagcucuagcgcucucuccgucggacaacugguuagcaacccccagacagccgcuggcgagguggauggggugaaucuggaagagauucgggaguucgccaaagccuuuaagauccgcagacuuucucucggacugacccagacacaagucggccaggcucuguccgcgaccgaagggccugccuacagccaguccgcuauuugccgguucgagaagcucgacaucacgcccaaaucugcccagaagauuaaaccugugcuggaacgcuggauggccgaggcugaagccagacaucgggcgggcaugcaaaaccuuacagaguuuaucggaagcgaaccguccaagaaacgcaagagacggaccucuuucacaccccaggcucuggagauccucaaugcccacuuugagaagaacacccacccuagcggccaggaaaugaccgagauugccgaaaaacugaauuaugaucgcgagguugugagagucugguucuguaacaagcggcaggcucugaaaaauacaaucaagcgccuuaaacaacaugaacccgccacggcggugccucucgagccccugaccgacucccuggaggaaaacucuuga

SEQ ID NO: 74060 - RNA, 870 nt, Artificial Sequence
  derived and/or modified sequence opt5 from PPA1__Homo_sapiens__NP_066952
augagcggcuucuccaccgaggaaagagccgcucccuuuucucuggaguaccggguguuccucaagaacgaaaaagggcaguauaucagcccuuuucacgacauuccgaucuacgccgauaaggacgucuuccauaugguuguggaggugccccgcugguccaaugcgaaaauggaaauugcuacaaaggauccucugaaccccaucaaacaagacgucaagaagggaaaacuuagauauguggccaaucuguuuccuuacaagggcuauauuuggaacuacggggccaucccccagacgugggaggauccuggacacaaugacaaacauaccggcugcuguggggauaacgacccgaucgauguuugcgagauuggaucuaaggugugugcucggggcgaaaucauuggcgucaaagugcucgggauccuggccaugauugacgagggagaaacagauuggaagguuaucgcuauuaauguggacgaucccgacgccgcgaacuauaaugacaucaacgaugucaagcgccuuaaaccuggcuaccuggaggccaccguggacugguucagacgguacaaggugcccgaugggaaaccugagaaugaauuugcuuucaacgccgaguuuaaggacaaagauuucgcuaucgacauuaucaagagcacacacgaucauuggaaagcccucgucaccaagaagacaaauggaaaaggcauuuccugcaugaacaccacgcugucugaaagccccuuuaagugugacccggaugcggcccgcgcuaucguugacgcccugccucccccuugcgaguccgcuuguaccgugcccacagauguggacaaaugguuccaccaccagaagaauuga

SEQ ID NO: 74061 - RNA, 918 nt, Artificial Sequence
  derived and/or modified sequence opt5 from PPA2__Homo_sapiens__NP_008834
augagcgcccugcucagacugcuucggaccggcgcucccgccgcggcuugccugcgccucgggacauccgccggaacgggcucuagacgggccauggcucuguaccacaccgaggaacgcgggcagccuuguagccaaaacuauagacuuuucuuuaagaaugugacaggacauuacaucuccccguuccacgacauuccccugaaagucaacucuaaggaggaaaauggcaucccuaugaaaaaggcccggaacgaugaguaugaaaaucucuuuaacaugauuguugagaucccccgcuggaccaaugcuaaaauggagauugccacaaaggaaccuaugaaccccaucaagcaguacgugaaagacgggaagcugagauauguggcgaauaucuucccuuacaaaggauauauuuggaacuacggcacccugccgcagauccucagcugcggcgaggucauucaugugaagauccuggggauucuugcccugaucgaugaaggagagacagacuggaaacucauugcuaucaaugccaacgaucccgaggcuuccaaguuucacgacaucgaugacguuaagaaauucaagccuggcuaccuggaagccacccuuaauugguuucggcuguauaaagugcccgaugggaagccugagaaccaguucgcguuuaauggagaguucaaaaacaaggccuuugcucucgaggucauuaaaucuacgcaucaauguuggaaggcccugcugaugaagaaaugcaacggcggggcuaucaauuguaccaacgugcagauuagcgacucccccuuccgcugcacacaggaagaggccagaagccucguugagucuguguccagcucuccgaauaaggaauccaacgaggaagaacaggucuggcacuuucugggaaaauga

SEQ ID NO: 74062 - RNA, 855 nt, Artificial Sequence
  derived and/or modified sequence opt5 from PPAP2A__Homo_sapiens__NP_003702
auguucgacaagaccagacugcccuacguggcccucgauguccugugcguucuucuggcuggccucccuuuugccauccugacaagccggcacacgccguuccagcgcgggguguuuuguaacgacgaguccauuaaauaucccuacaaggaagauaccaucccuuaugcgcuucugggaggcauuaucauucccuucucuaucaucgugauuauccucggggagacacugagcgucuacugcaaucugcuccauuccaacucuuuuauuagaaauaacuauaucgcuaccauuuacaaagccaucggaacauuccuguuuggcgccgcugccagccaaucccuuaccgacauugcuaaguauucuaucgggcggcugcgcccucacuuccucgaugugugugaccccgauuggagcaaaaucaauugcuccgacggauacauugaauacuauaucuguagaggcaacgccgagcggguuaaggaaggccgccugagcuuuuacucugggcauuccagcuucucuauguauugcaugcuuuuuguggcgcuguaccuccaggccagaaugaagggagauugggcucggcugcugcgcccuacacuccaguucggccuggucgccguguccauuuauguugggcuuagcagagugucugacuacaaacaccauugguccgauguccugaccggacucauccagggcgcucugguggccauucuuguggcggucuauguuagcgacuuuuucaaggagcggacguccuucaaagagcgcaaggaagaggauucucacaccacacugcacgaaaccccgacaaccgggaaucauuaccccagcaaccaccaaccuuga

SEQ ID NO: 74063 - RNA, 867 nt, Artificial Sequence
  derived and/or modified sequence opt5 from PPAP2C__Homo_sapiens__NP_003703
augcagagacgguggguguucguccugcucgacguucugugccuucugguggccagccuccccuuugcuauccugacccuugugaacgccccuuacaagcgcggcuucuauuguggggaugacuccauuagauacccguaucggcccgauacaaucacgcacggacugauggcgggcgucaccauuacagcuaccgugauccucguuucugccggggaggccuaccugguguauacagaccgccuguacagcagauccgauuuuaauaacuaugucgcugccguguacaaaguucucggaaccuuccuguuuggcgcugccgugucucaaagccuuacagaccuggcgaaguacaugauugggcggcuccgcccuaauuuccuggccgucugcgaucccgacugguccagagugaacuguucuguguauguccagcuugaaaaaguuugccggggaaauccugcugaugugaccgaggcccgccugagcuuuuacuccggccauagcucuuucggcauguauuguaugguguuucucgcucuguacguccaggccagacugugcuggaagugggcgcggcuccugcgccccacggugcaguucuuucuuguugccuucgcucuguaugugggguacaccagagucuccgacuauaaacaccauuggagcgaugugcucguuggacugcuucaaggcgcccugguggcugcccucacagucuguuacaucucugacuuuuucaaggcccggccuccgcagcacugccugaaggaagaggaacuggagcgcaaacccucccucagccugacccuuacacugggggaggcugaucauaaccacuacggauauccucacucuuccagcuga

SEQ ID NO: 74064 - RNA, 795 nt, Artificial Sequence
  derived and/or modified sequence opt5 from PPAPDC1B__Homo_sapiens__NP_001096029
augggcaaggccgcugccgcgguggcuuucggggccgaggucggaguuagacuggcccucuuugcugccuuccuggugaccgaacuucugcccccuuuucagcggcucauccaaccggaggaaauguggcuguaccgcaaccccuauguggaggcugaauacuucccuacaaaacccauguuugucauugccuuccuuagcccucugucccucaucuuucuggcgaaguuccugaaaaaggccgacacgagagauucucggcaggcuugccucgccgcuagccuggcccuugcgcugaauggcguguuuaccaacacaauuaaacucaucguugggcgccccagaccugacuucuuuuaucgguguuucccggauggacuggcccacuccgaccuuaugugcaccggcgauaaggacguggucaaugaggggcgcaagucuuuucccagcggacauuccucuuucgcuuucgccggccuggcuuuugccagcuucuaccucgccggcaaacugcacuguuuuacaccucaggggagaggaaaguccuggcgguucugcgcuuuucugagcccccuccuguucgcggccgugauugcucuuucucgcaccugugauuauaaacaucacuggcaggacguucuggugggcuccaugaucgggaugacauuugccuacgucugcuauagacaauacuacccuccccucaccgaugccgagugucauaagccguuccaggacaaacuggugcuuagcacggcucagaagccuggagauucuuauugcuuugacaucuga

SEQ ID NO: 74065 - RNA, 888 nt, Artificial Sequence
  derived and/or modified sequence opt5 from PPAPDC2__Homo_sapiens__NP_982278
augcccagcccuagacgguccauggagggccgcccgcugggggugucugccagcuccucuagcuccucucccggaagcccugcucacggcgggggaggcgggggauccagauucgaauuucagagccuccugucuucccgggccaccgcggucgaccccacaugcgcucgccuuagagccagcgagucuccuguucaucggcgcggcuccuucccccuggccgcugccggcccuagccaaucuccggcucccccucuccccgaagaggauagaauggaccugaacccuuccuuucuugggaucgcccugcggagccuccuggcgauugaucuguggcucuccaagaaacugggagugugugccggcgaaucuagcuccugggggagcgugcgcccccuuaugaagcugcucgagaucucuggacacggcauuccguggcugcuugggacgcuguacugccucuguagauccgacagcugggcuggacgggagguccugaugaaucuccucuucgcccugcuucuggaucuccugcuuguggcucugaucaaaggccucguucgcagacggcgcccugcccauaaccagauggacauguuugugacccugucugucgauaaguauagcuuccccuccggccacgcgacaagagccgcucugaugucucgguuuauucucaaucaucuggugcuugccaucccucugagaguucucgugguccugugggcuuucgugcuugggcugagccgcgugaugcucggacggcacaacgucaccgacguugccuuuggcuucuuucugggguacaugcaguauuccaucguggauuacugcuggcugagcccccacaaugcccccgugcuguuccugcuuuggucucagagauga

SEQ ID NO: 74066 - RNA, 816 nt, Artificial Sequence
  derived and/or modified sequence opt5 from PPAPDC3__Homo_sapiens__NP_116117
augcccgccagccaguccagagcucgggcccgcgacagaaacaaugugcugaaccgggcggaguuccucucucugaaucaaccuccgaagggcgggcccgaaccucgcagcuccggaagaaaggcuucuggccccagcgcccagccucccccugccggggauggagcucgggagcgcagacagucccagcaacuuccggaagaggacugcaugcagcugaaccccucuuuuaaaggcaucgccuucaauagccuccuggcuauugauaucuguauguccaaacggcuuggggucugcgccggacgcgcggccagcugggcuucugccagauccaugguuaagcugauuggcaucaccggccacgggauuccuuggaucggaggcacaauccucugucuggugaaaagcucuacgcuggcugggcaggaagugcucaugaaccugcuucuggcccuccugcuugacauuaugaccgucgcgggagugcagaagcugaucaagcggcgcggccccuacgagacauccccuagccuccuggauuaucugaccauggacauuuacgccuuucccgcugggcaugccucuagagcugccaugguuuccaaauucuuucucagccaccuggugcuugccgucccgcugcgggugcuccugguucuuugggcucugugcgugggacucucccgcgucaugaucggcagacaucacgugacagaugugcugucuggcuucgucauuggguaucugcaauuucggcucguugagcugguguggaugccuagcuccaccugucagaugcuuaucagcgcgugguga

SEQ ID NO: 74067 - RNA, 1407 nt, Artificial Sequence
  derived and/or modified sequence opt5 from PPARA__Homo_sapiens__XP_011528545
augguggacaccgagagcccccugugcccucucuccccgcuggaagccggcgaucuugagucuccccugagcgaagaguuccuccaggaaauggggaacauccaagagauuucccagucuaucggagaggacagcuccggcucuuuuggguucacagaauaccaguaucugggaagcuguccuggcuccgaugggagcgucauuacggacacccuuucucccgcuuccagcccuucuuccguuacauaccccguggugccuggaagcgucgaugagucuccguccggcgcccugaauaucgaaugcagaauuuguggcgacaaggcgagcggguaucacuacggagugcaugcuugcgagggcuguaaaggguuuuuccggcgcaccaucagacucaagcugguuuaugauaaaugcgaccgguccuguaagauccagaaaaagaaccgcaauaagugccaauacuguagauuucacaaaugccugucugugggaaugagccauaacgccauucgguucggccgcaugcccagauccgagaaggccaaacucaaggcugaaauccugacaugugagcacgauauugaagacagcgagaccgccgaucuuaaaucucuggcuaagcggaucuaugaagccuaccucaagaauuuuaacaugaauaaagucaaggcgcgcgugauucuguccgggaaagccagcaacaauccucccuucguuauccaugacauggagacacuuugcauggcugagaagacccugguggccaaacucgucgcuaacggcauucagaauaaggaagccgaggugagaaucuuucacugcugucagugcacgucuguggaaaccgucacagagcugaccgaguucgcgaaagccaucccuggauuugcuaaccuggaucucaaugaccagguuacacugcuuaaguacggcguguaugaagccauuuucgcuaugcugagcuccgugaugaacaaggacgggaugcucgucgccuacggaaauggcuuuaucacccgggaguuccugaaaucucuucgcaagcccuucugugauauuauggaaccgaaauuugacuucgccaugaaguuuaacgcucuggagcucgaugacagcgauaucucccuguucguggcggccauuaucugcuguggggacagaccuggacugcucaacguuggccacaucgagaaaaugcaagaagggauugugcauguccugcggcuucaucugcagagcaaucaccccgaugacaucuuucucuucccuaagcugcuucagaagauggcugaucugcgccagcucgugacggaacacgcccaacugguucagauuaucaaaaagacagagucugacgccgcucugcacccccuccugcaggagauuuauagagauauguacuga

SEQ ID NO: 74068 - RNA, 1209 nt, Artificial Sequence
  derived and/or modified sequence opt5 from PPARD__Homo_sapiens__NP_001165290
augcaccagagagaccugagccgguccucuagcccucccucccuccuggaucaacuucagaugggcugcgacggggccucuuguggaagccugaacauggagugccgcguguguggcgauaaggcuuccggguuccauuacggaguccacgccugcgaaggcuguaaaggguuuuucagacggaccauccgcaugaagcucgaguaugaaaaaugcgagagaucuuguaagauucagaaaaagaaucggaacaagugccaguacugucgcuuucaaaaaugccuggcgcuuggaaugagccauaaugcuaucagauucggccggaugccggaagccgagaagcgcaaacugguugccggccucacagcuaacgaggggucccaguauaauccccagguggccgaccugaaggcuuuuagcaaacacauuuacaacgccuaucugaagaauuucaacaugacgaagaaaaaggcgagaucuauccucaccggaaaagccucccauacagcuccuuuugugauucacgauaucgaaacccuguggcaggccgagaagggccuugucuggaaacaacuggugaaugggcugcccccuuacaaggaaaucagcguucacguguucuaucggugucagugcacaaccgucgagacagugcgcgagcugaccgaauuugcuaaaucuauucccuccuucagcucucuuuuucugaacgaccagguuacgcuccugaaguacggagugcaugaggccaucuucgcgaugcuggccuccauugucaauaaggauggccuccugguggcuaacgggagcggauuugugaccagagaguuccuucggucccugcgcaaaccuuucucugacaucauugaaccgaaguuugaguucgccgucaaauuuaaugcucucgaacuggaugacagcgaucuugcccuguucaucgccgcuauuauccucugcggcgacagacccggccugaugaacguuccucggguggaggcgauccaggauacaauucugagagcccucgaauuucaccuccaagcuaaucaucccgacgcccaguaccuuuucccuaagcugcuccagaaaauggccgaccugcgccaacuugugaccgagcacgcucagaugaugcagcggaucaagaagacagaaaccgagacgucccugcacccccuccugcaggaaauuuauaaagauauguacuga

SEQ ID NO: 74069 - RNA, 2397 nt, Artificial Sequence
  derived and/or modified sequence opt5 from PPARGC1A__Homo_sapiens__NP_037393
auggccugggacaugugcaaccaggauagcgaguccguguggucugacaucgaaugugcugcccuggucggcgaggaucaaccccucugcccugaccugccggaacuugaucugagcgagcucgacguuaaugaucuggacaccgauuccuuccuugggggacugaagugguguucugaccagagcgaaauuaucuccaaccaguacaauaacgagcccucuaauauuuuugagaaaaucgaugaagagaacgaagcgaaucuccuggcugugcugacagagacgcucgacagccugccuguggaugaggacggccuucccuccuucgacgcccugaccgauggggacgucacaaccgauaacgaagccagcccuucuuccaugcccgacggaacaccuccgccccaggaggcugaggagccuagccuccugaagaaacuucugcucgcccccgcuaauacccaacugucuuauaacgaaugcuccggccugagcacacagaaucacgccaaccauaaucaccggauucggaccaacccugcgaucgugaagacggaaaauucuugguccaacaaagccaagagcaucugucagcagcaaaagccccagcgcagaccgugcuccgagcuccugaaauaccuuaccacaaacgaugacccuccccauaccaagccuacagaaaaucggaacucuagccgcgauaaauguaccuccaagaaaaagagccacacgcagucucagucccaacaucugcaggcuaagcccacaacccucagccugccccuuacaccugagucuccgaaugaccccaaagggagcccuuuugaaaacaagaccauugagagaacccuguccguugaacucucuggaacagccggccugacgcccccuaccacacccccgcacaaagcuaaucaggauaacccuuuccgggccagccccaagcugaaauccagcugcaagaccguggucccucccccuucuaaaaagccccgcuauuccgagagcucuggcacacaagggaauaacuccaccaagaaaggaccggagcagagcgaacucuacgcgcagcuguccaagucuagcgugcuuacgggcgggcacgaggaaagaaaaacaaagcggccuucccugcgccucuuuggagaccaugauuauugucagucuaucaauagcaaaaccgagauucugaucaacauuucccaagaacuucaggacagcagacagcuggagaauaaggacguuucuuccgauuggcagggccaaaucugcagcucuaccgacuccgaucaguguuaccuccgggagacacuggaagccagcaaacaggugucucccugcagcacccgcaagcagcugcaagaccaggagauuagagcugaacucaacaagcacuucgggcaucccucccaggccgucuuugaugacgaggcugauaaaacaggagagcugcgggacagcgauuucucuaaugaacaguuuuccaaacuuccuauguucaucaacagcggccuggccauggacggccucuuugaugacuccgaggaugaaucugacaagcugagcuauccgugggacgggacgcaauccuacucucuguucaaugugagccccuccugcucuagcuuuaacuccccuugucgcgauagcgugucucccccuaagucccuuuucagccagagaccccagcggaugagaucucgcucccggagcuucucuagacaccgcuccugcagccgguccccuuacagcagaucucgcagccggucccccggaucuagaagcuccucucgcagcuguuauuacuaugaguccucucacuaccggcauagaacccaccgcaacagcccgcucuauguccgguccagaagccggucuccuuacucccgcagaccccgguaugacagcuacgaagaguaccaacaugagagacugaagcgcgaagaguaucggagagaauacgagaaacgcgaaucugagagagccaagcagcgggagcgccagagacagaaagcuaucgaagagagacgcguuauuuaugugggcaagaucagaccugauacaacccggacagaacugcgcgacagauuugagguguucggggaaauugaggagugcaccgucaaucuccgggaugacggagauuccuacggcuuuaucacguaucgcuacaccugugacgcguucgccgcucuggaaaacggguauacacuuagacggagcaaugagaccgauuuugaacuguacuucugcggaagaaaacaauuuuucaaguccaacuacgccgaccucgauucuaauagcgacgauuuugaccccgccuccacaaagagcaaauaugacucucuggauuucgacucccugcuuaaggaggcucagcgcagccuccggagauga

SEQ ID NO: 74070 - RNA, 2955 nt, Artificial Sequence
  derived and/or modified sequence opt5 from PPARGC1B__Homo_sapiens__NP_001166169
auggccggcaacgacugcggggcucugcucgaugaggaacugagcuccuucuuucuuaauuaccuggccgacacccagggaggcgggucuggagaggaacaacucuaugcggauuuccccgagcuggaccuuagccagcuggaugcuuccgacuuugauucugccacauguuucggcgaacuccaguggugcccugagaacagcgagacggaaccgaaucaguacucccccgacgauucugagcuguuucaaaucgacagcgaaaacgaggcccugcucgcugagcugaccaagacacuugaugacauuccugaagaugacguggggcuggccgcuuuccccgcccucgacggaggcgaugcgcuguccuguaccagcgccucuccugcucccuccagcgccccuccgucucccgcuccugagaaacccuccgccccugcgcccgaagucgacgagcuuagccuggccgauucuacacaggacaagaaagcuccgaugaugcagucccagagcagauccugcaccgaacuccacaagcaucugacaucugcccaauguugccugcaggaucggggccuccagccucccugucugcagagcccucgccuucccgcuaaagaggacaaggagcccggggaagauugcccuuccccgcaacccgccccugccagccccagagacucucuggcucucggacgggcggauccuggcgcccccguuucccaggaggacaugcaggcuauggugcaacugauccgcuauaugcacaccuacugucuuccgcagagaaagcugccuccccagacgccugaaccccucccuaaagccugcagcaaucccucucagcaagugcggagccgcccgugguccagacaucacucuaaggccagcugggcugaguuuuccauucugcgggaacugcucgcccaggauguccugugugacgugagcaaaccuuaucgccuugcgacccccguuuacgcuucucugacacccagaucccggccucgcccgcccaaggacagccaggccucuccugggagacccuccagcguggaggagguccggaucgccgcuuccccuaaaucuaccggaccccgcccuagccucagaccccugcggcuugaagugaagagagagguucgccggccggccagacugcagcaacaggaagaggaagaugaggaggaagaggaagaggaggaagaggaagagaaggaagaggaggaagaguggggccgcaaacggccugggagaggacuccccuggacaaagcugggccgcaaacuggaauccucugugugcccuguccggagaagccgccggcucaaccccgagcugggcccguggcuuaccuucgcugacgaaccucuggugcccuccgagccucagggggcccuccccagccugugccuggcgcccaaggccuaugauguggagagagaacuuggaucuccuacggacgaggauuccggccaggaccaacagcuccugcgcgggccgcagauucccgcucuggaaagcccuugugagucuggaugcggcgauauggacgaagaucccuccuguccucagcugcccccucgggacagcccgagaugccucaugcuugcccugucucaaagcgaucccacauuugggaaaaaguccuucgagcagacccucacagucgagcuguguggaaccgcuggccugaccccucccacaacgccucccuacaaaccgaccgaagaggacccuuuuaagcccgauaucaagcauagccuuggcaaagaaaucgcccucucucugcccuccccugaggggcugagccucaaggcgacacccggagccgcucacaaacugccuaagaaacacccggagcgguccgaacuucugucucaucuccgccacgccaccgcucagcccgccagccaagccggccagaagagaccuuucuccugcucuuuuggggaccaugacuacugucagguucugcggcccgagggagugcugcagagaaaggugcuucgcagcugggaaccuuccggcguccaccucgaggauuggccccaacagggggcuccgugggcggaagcccaggcuccuggccgggaggaggacagaucuugcgaugccggagcucccccuaaagacagcacacugcugcgcgaucacgaaauuagagccucccucaccaagcauuucggccugcuugagacggcccuggaagaggaagaccucgcgagcuguaaaucucccgaguaugauacaguguucgaggacuccucuagcuccagcggggaaucuuccuuucugccugaggaagaggaagaggagggagaagaggaagaggaggaugacgaagaggaagauagcggcguuuccccgaccugcagcgaccacugucccuaccagucuccucccagcaaggcuaaucggcaacugugcucccgcucuagaagcuccucugggagcucccccugccauucuuggagcccugccacccggcgcaacuucagaugugagucccggggaccgugcagcgaucgcacacccucuaucagacacgcccggaaacgcagagaaaaggcuauuggcgaggggcggguggucuauauccagaaucuuuccagcgacaugucuuccagagagcucaagcgccgguuugaaguguucggcgagauugaagagugugaaguucugaccagaaaccgccggggagagaaauacggcuuuaucacauauagaugcagcgagcaugccgcgcugucccucacgaagggggcugcccugcgcaaacggaaugaaccuucuuuccagcuuagcuacggaggccugagacacuuuuguuggccccgcuauaccgacuacgauuccaacagcgaggaagcccucccugcuucugggaaguccaaauacgaggccauggacuucgauagccugcugaaggaagcucagcaaucucuucacuga

SEQ ID NO: 74071 - RNA, 1434 nt, Artificial Sequence
  derived and/or modified sequence opt5 from PPARG__Homo_sapiens__NP_005028
augaccaugguggacacagagaugcccuucuggccuacgaacuuuggcaucagcuccgucgaucugucuguuauggaagaccacagccauuccuucgauauuaagccguuuaccacaguggacuucucuagcaucuccacaccccacuacgaggauauuccuuuuaccagaaccgaccccguggucgccgauuauaaauacgaccucaagcugcaggaauaucaaucugcuaucaaaguggagccugccucucccccuuacuauuccgaaaagacacagcuuuacaauaaaccgcaugaggagcccagcaacucucugauggcgauugaaugccggguuuguggggauaaggcuuccggauuccacuauggcgugcaugccugcgagggguguaagggauuuuuccgcagaaccauccggcucaaacugaucuacgaccgcugcgaucuuaauugucggauucacaagaaaagcagaaacaagugccaguacugucgcuuucagaaaugccuggccgucggcaugucucacaaugcuaucagauucgggcggaugccucaagccgaaaaggagaagcuccuggcugagauuuccagcgacaucgaucagcugaaccccgaaucugccgaccuccgcgcgcuggccaaacaucuuuaugacuccuacauuaagagcuuuccucugacgaaagcuaaggccagagcuauccucaccggaaaaacaaccgauaagucccccuucgugauuuaugacaugaauagccugaugaugggcgaggauaaaaucaaguuuaagcacaucacaccgcuucaggaacagagcaaagagguugccauucggaucuuccaaggcugucaguuccgcuccguggaagcgguccaggagauuaccgaguacgccaagagcaucccuggguuugugaaccuggaccucaaugaucaggugacgcugcugaaauauggaguccaugaaauuaucuacacaaugcucgcuucucugaugaacaaggacggcguucuuaucuccgaggggcaaggauucaugaccagagaauuucugaaaagccuccggaagcccuucggcgauuuuauggagccuaaguucgaauuugccgugaaauucaaugcucuggagcuugacgauucugaccuggccauuuuuaucgccgugauuauccucagcggggaucgccccggacugcugaacgucaagcccauugaggacauccaggacaaucuccugcaggcucuugaacugcaacucaaacugaaccacccugaguccucucagcuuuucgcgaagcugcuccagaaaaugacagaucugagacagaucgugaccgaacacguucaacugcuccaggugauuaagaagaccgagacagacaugagccugcauccgcuucugcaggaaaucuauaaagaucucuacuga

SEQ ID NO: 74072 - RNA, 1554 nt, Artificial Sequence
  derived and/or modified sequence opt5 from PPAT__Homo_sapiens__NP_002694
auggagcuggaggaacucggcaucagagaagagugcgggguguucggauguauugccagcggcgaauggcccacccagcuggacgucccucacguuaucacacuugggcuggugggacuccaacaucggggccaggaguccgcugggauugugacgucugauggaagcuccgucccgaccuuuaagucucacaaaggcaugggccuggugaaccauguuuucacagaggacaaucuuaagaaacuguacgugagcaaccucgggaucggacacacccgcuaugccacaaccggcaagugcgaacuggagaauugucagcccuuugucguggaaacacugcaugggaaaauugcgguugcucacaacggagagcucgugaaugccgccagacugcggaagaaacuucugcgccacggcaucgggcucuccaccucuagcgauuccgagaugaucacgcagcugcuugcuuacaccccuccccaagaacaggacgauacaccugacugggucgccagaauuaagaaccugaugaaggaggcucccaccgccuauagccuccugaucaugcaucgggaugugauuuacgcggugcgcgacccuuauggaaauagaccgcugugcaucggccggcucauucccgucucugauaucaacgacaaagaaaagaaaacauccgagaccgaaggcuggguugugagcucugaguccuguagcuuccugucuauuggggcccgcuacuauagagaggugcuuccuggagaaaucgucgagaucucccggcacaaugugcagacgcuggauauuaucagccgcuccgaaggcaaccccguugcuuuuugcauuuucgaguacguguacuuugccagaccugacucuauguucgaagaucagauggucuauacagugcgguaccgcugugggcaacagcucgcuaucgaggcccccguugacgcggaccuggugagcaccgucccggaguccgccaccccugcugcccuugcuuaugccggaaagugcggccugcccuacguggaaguccucuguaagaauagauauguggggcggacauuuauucagccuaacaugagacugcgccagcugggaguugccaaaaaguucggcgugcucagcgauaauuuuaaaggcaagcggaucguccugguggacgauucuaucguuagagggaacaccauuucccccaucauuaaacuucugaaggagagcggagcuaaagaagugcauauccgcgucgcgucucccccuauuaaguacccgugcuucaugggcaucaauauccccacaaaggaggaacucauugccaacaaaccugaguuugaccaccuggcugaguaucuuggggccaacagcgugguguaccuguccguugaaggacucgucucuagcgugcaagagggcaucaaguucaaaaagcagaaagaaaagaagcacgauauuaugauccaggagaaugggaacggccuggaguguuucgaaaaauccggacauugcacggccugccugaccggcaaguaccccguggagcucgaaugguga

SEQ ID NO: 74073 - RNA, 387 nt, Artificial Sequence
  derived and/or modified sequence opt5 from PPBP__Homo_sapiens__NP_002695
augagccugagacucgacaccacacccuccugcaacucugcccggccucugcacgcccuucaggugcugcuccugcuuagccugcuccugacggcucuggcguccucuaccaagggccaaacaaaacgcaaucucgcuaaggggaaagaggaaagccuggauuccgaccuuuacgccgagcugagauguaugugcaucaagaccacaucuggcauucauccgaaaaacauccagagccucgaagucauuggaaaggggacccacuguaaucagguugaggugaucgccacacugaaggauggacggaaaauuugccuugaccccgaugcuccucgcaucaagaaaaucgugcagaagaaacuggccggcgacgaauccgcugauuga

SEQ ID NO: 74074 - RNA, 246 nt, Artificial Sequence
  derived and/or modified sequence opt5 from PPCDC__Homo_sapiens__NP_001288034
augagagccugggaccggagcaagccccuccuguucugcccugcuaugaacaccgccaugugggagcacccgaucacagcgcagcaaguggaucagcugaaagccuuuggcuacgucgaaauucccuguguugcuaagaaacuugugugcggggacgagggacugggcgccauggcugaaguggggacgaucgucgauaaggugaaagagguucucuuccagcauuccggauuucagcaaucuuga

SEQ ID NO: 74075 - RNA, 1776 nt, Artificial Sequence
  derived and/or modified sequence opt5 from PPEF1__Homo_sapiens__NP_689412
augggcugcagcuccucuagcaccaagacaagacgguccgacacgucucugcgcgccgcucucaucauucagaacugguacagaggguauaaagcccggcugaaggcgcgccaacacuacgcucuuaccaucuuccagagcauugaguaugccgaugaacagggacagaugcaacuguccacauuuuucucuuuuaugcucgagaauuacacccauauccacaaagaggaacuggaacuuagaaaccagagccuggaguccgagcaggacaugcgggaucgcugggacuauguggauagcauugacguccccgauucuuacaauggcccuagacuccaguucccgcugacauguaccgacaucgaucugcuccuggaagccuuuaaggagcaacagauccuucaugcucacuauguucuggaagugcucuuugagaccaaaaaggugcugaagcagaugcccaacuuuacacauauucagacguccccuagcaaagaggucaccaucugcggggaccuucacggaaagcuggaugaccucuuccugauuuucuacaaaaauggccugcccucugaacggaacccuuacguguucaauggggauuuuguugaccgcggaaagaacuccaucgagauucucaugauccugugugugagcuuccuugucuaucccaaugaccugcaccucaacagaggcaaucaugaagauuuuaugaugaaccugcgguacggcuucacaaaagagauucuucacaaguauaagcugcaugggaaacgcauccuccaaauccuggaagaguucuacgccuggcugccuauuggaaccaucguggacaaugagauucucguuauccacggcgggauuucugaaacaaccgaucugaaccuucugcacagaguggagcggaauaagaugaaauccguccucaucccgcccacggaaacaaaccgcgaccaugauaccgacagcaagcacaacaaagugggagugacauuuaaugcucauggcagaaucaagaccaacggguccccuaccgagcaccugacagaacaugagugggagcaggucguuacgauuuucucugccagcaauuauuacgaagagggauccaaccggggcgcguauaucaaacuuugcagcggcaccacacccagauuuuuccaguaccaagugaccaaggccacauguuuucagccucugcgccagcggguggauaccauggaaaauucugcuauuaagauccucagagagcgcgucauuucccggaaaagcgaccugacgagagccuuccagcugcaagaucaccgcaagucugggaaacucagcgugucccagugggcuuuuugcauggaaaacauccugggacuuaaucugcccuggcggucucucagcuccaaccugguuaauaucgaccagaacggcaauguggaguacaugagcucuuuccagaacauuagaaucgagaagccgguccaagaagcccacuccacacugguggagacccuuuaucgcuaccggagcgaucucgaaauuaucuuuaaugcgauugacaccgaccauucugggcugaucuccguugaggaguucagagccauguggaaacuguuuagcucccacuauaacgugcauauugaugacucucaggucaauaagcucgcuaacaucauggaucugaacaaggacggaagcaucgauuucaaugaauuucuuaaagccuucuacgugguccaccgcuaugaggaccugaugaagccugaugugacaaaccucggcuga

SEQ ID NO: 74076 - RNA, 2262 nt, Artificial Sequence
  derived and/or modified sequence opt5 from PPEF2__Homo_sapiens__XP_011530341
augggcagcgggaccuccacacagcaccauuucgccuuucaaaacgcugagagagccuucaaggcggcugcccugauccagcggugguaccgcagauauguggcccggcucgaaaugcgcagacggugcacguggucuauuuuucagagcaucgaguacgcuggacagcaagaccaggucaaacugcacgauuucuuuuccuaucuuauggaccauuucauucccucuagccacaaugaucgcgacuuucugaccagaaucuucacagaagaucgguuugcccaggacuccgagaugaagaaauguucugauuacgaaagcauugagguuccugacuccuauaccggcccgcgccucagcuucccccugcuuccugaucaugcuacagcccugguggaggcguuuagacucaagcagcaacugcacgcccgguacgugcugaaccuccuguaugaaaccaaaaagcaccuuguccagcugcccaauaucaaccgcgugucuacaugcuacuccgaggaaaucaccguuuguggggaccuccauggacagcuggaugaccuuauuuucaucuuuuacaagaauggccugccuagccccgagagaucuuauguguucaacggggauuucgucgaccggggaaaagacuccguggagauucucaugauccuguuugcuuucaugcugguuuacccuaaggaauuucaccucaaucgcggcaaccaugaggaucacauggugaaucugagauauggcuucacgaaagaagucaugaacaaguacaaagugcacgggaaggagauucuucggacccugcaggacguguuuugcuggcucccgcuggccacacuuaucgaugaaaagguccugauucuccauggaggcguuagcgacaucaccgaucuggagcugcucgacaaaaucgagagaucuaagauuguguccacaaugcgcuguaaaacccggcaaaagagcgaaaaacagauggaggaaaagagacgcgcuaaucagaaauccucugcccaagggcccaucccuugguuccugcccgagagccggucccuuccuagcucuccccugagacucggauccuauaaggcgcagaagacgagccgcucuagcuccauuccgugcucuggcagccuggaugggcgggaacuuuccagacaggugcgcagcucugucgagcuggagcucgaacgguguagacagcaagccggacugcuggugacaggcgagaaagaagaaccuucccgcagcgcuucugaagccgacuccgaggcuggcgagcuccggaagcccacccaggaagaguggagacagguuguggauauccuguggagcgacccuauggcccaggaagggugcaaagccaacacaauucggggaggcggguguuacuuuggacccgaugucacccaacagcuucugcagaaguauaauaugcaguuccucauccgcucccacgagugcaaacccgagggcuacgaauuuugucauaacagaaaggugcugaccaucuucucugcuagcaauuacuaugagguuggguccaaccggggagcguacgugaagcugggcccugcccuuacaccgcacauuguccaauaucaggcuaacaaagugacgcauacccucacaaugagacagcgcaucucucgggucgaagagagcgcccugagagcccugcgcgaaaagcucuuugcucacuccagcgaccugcuuucugaguucaaaaagcacgacgccgauaaagugggccugauuacccucuccgacugggcggcugccguugagagcgugcugcaucuggggcuucccuggagaaugcuccggccucagcuggucaauucuuccgccgauaacaugcuggaauacaagagcuggcucaagaaucuggcuaaagagcaacuuucucgcgaaaacauccagagcucccugcucgagacacuguauagaaaucggagcaaccuggaaaccauuuuucgcaucaucgacucugaucacuccggauucauuagccuugacgaguucagacagacguggaagcucuuuuccucucauaugaauaucgauauuacagacgauugcaucugcgaccuggcccggagcauugauuucaacaaagacggccacaucgauauuaaugaguuucuggaggcuuuccgccucguggagaaguccugucccgaaggggacgccucugagugcccucaagcgaccaacgccaaagacagcggauguuccucucccggcgcucacuga

SEQ ID NO: 74077 - RNA, 3609 nt, Artificial Sequence
  derived and/or modified sequence opt5 from PPFIA1__Homo_sapiens__NP_003617
augaugugcgaggugaugcccaccaucagcgaagccgagggcccucccgggggaggcgggggacacggcuccgggucucccagccagccugacgcugauucccauuucgaacaacugauggucucuaugcucgaggaaagagaccggcugcuugauacacugcgcgagacgcaggagacccucgcccugacacagggaaaacuucacgaaguuggccaugagagagacagccugcagcggcaacucaacaccgcgcugccccaggaauuugcugcccugacaaaggagcucaaugugugucgcgagcagcugcuugaaagagaggaagagauugccgaacugaaggcugagcggaacaauacccgccuccugcuugagcaccuggaaugccucguguccagacaugagcggucucugcgcaugacagucgugaaaagacaggcccaaagcccugcuggcguuuccagcgaaguggagguccugaaggcccucaaaucucuguucgaacaccacaaggcgcuugaugagaaggugcgggagcgccugagaguugcccucgaacgguguucccugcuugaggaggaacugggggcuacccauaaagaacucaugauccugaaggagcagaacaaucagaaaaagacgcugaccgacggagugcucgauauuaaccacgagcaggaaaauacacccagcaccucuggcaaacgcuccagcgacgggucucugucccaugaggaagaucuugccaaggucaucgagcugcaagagauuaucagcaagcaguccagagaacagucucaaaugaaagagcggcucgcuagccuguccagccacgugacagaacuugaggaagaccuggauaccgccagaaaggaccucaucaaaucugaggagaugaacacgaagcugcagcgcgaugugcgggaagcgauggcccagaaagaggacauggaagagagaauuacaacccuggaaaagcgcuaccucgcugcccagcgggaggcuacauccguccacgaccugaaugauaaacuugagaacgaaaucgccaauaaggacagcaugcauagacaaaccgaggauaagaaccgccagcugcaggaacggcucgagcuggccgaacagaaacugcaacagacccuuagaaaggcugagacacucccugagguugaagcggagcuggcccagcgcguggcugcccugucuaaagccgaggaacggcacggaaauauugaggaaagacuccgccagauggaggcucaacuggaagagaagaaccaggaacuucagcgggccagacagcgggagaaaaugaaugaggaacauaacaagcgccugagcgacacgguggauaagcuccuguccgagucuaacgaaagacugcaacuucaccucaaagagcggauggcggcucuggaagacaagaauagccugcucagagaggucgaguccgccaaaaagcagcuggaagagacccagcaugauaaagaccaacuugugcugaacaucgaagcccuccgcgcugagcuggaucacaugcggcugagaggcgccagccuucaccaugggcgcccgcaccucggaucuguucccgacuuuagauucccuauggcugauggccauacagacuccuauagcaccucugccgugcugcggcgcccccagaagggcagacuggcggcccuccgggacgaaccuuccaagguccagacacugaaugagcaggauugggagcgcgcucaacaggccagcgugcuugcuaacguugcccaggcguuugaauccgacgccgaugugucugacggggaggaugacagagauacccugcucagcuccgucgaccugcugucucccagcggacaggcugaugcccacacgcuugcuaugaugcuccaagaacagcuggacgccauuaauaaagagauccggcugauucaggaggaaaaggagaacacagaacagcgcgccgaggaaaucgaguccagagugggcagcgggucucucgauaaucugggacgguuccgcuccaugagcucuaucccgccuuaccccgcuuccagccuugcgucuagcuccccucccggcagcgggagaucuacccccagacggauuccucacuccccggcccgcgaggucgaccggcugggagugaugacccuccugcccccuagcagagaagagguucgcgaugacaaaacaaccaucaagugcgaaacaucucccccuuccagcccccgggcucugagacuugaccgccugcauaaaggcgcccuccacacggugucccaugaggauauucgggacaucagaaacucuaccggcagccaagaugggccggucuccaauccuucuagcuccaacagcucucaggacucccugcacaaggcccccaagaaaaagggaauuaaaagcucuaucggccgccucuuugggaagaaagaaaagggacggccuggccagacagggaaagaggcucugggccaagccggaguguccgagaccgauaauagcucucaggacgcgcuuggccuguccaagcucgggggacaggcugaaaagaacagaaaacugcagaagaaacaugagcugcuugaagaggcccggcgccaaggccugcccuucgcccagugggaugggccuacaguuguggucuggcucgaacugugggugggaaugcccgcuugguauguggccgcguguagagcuaauguuaagagcggcgccaucauguccgcccucagcgacaccgagauucagcgggagaucgggauuucuaacccgcugcaccgccuuaaacugagacucgcuauccaggaaauuaugagccugacguccccuucugccccgcccaccagccggacaacccuggcuuacggcgauaugaaucacgaguggaucggaaacgaauggcuuccuucccugggccucccgcaauauagaucuuacuuuauggagugccuggucgacgcccgcaugcucgaucaucugacaaagaaggaccuucgggggcagcugaaaaugguggauagcuuccacagaaacuccuuucaguguggaaucaugugccugcgccggcucaauuaugacagaaaggagcuggaacgcaaacgggaggaaucucagagcgagauuaaggacgugcuugucugguccaacgauagagugauccgcuggauucugagcaucggccucaaagaauacgcgaauaaccugauugagucugggguucauggagcccuccuggcucuugacgagaccuucgauuuuuccgcccuggcucugcuccugcaaauccccacgcagaauacacaggccagagccgugcuugaacgggaguucaacaaucugcucgucaugggcaccgaccgcagauucgaugaagacgaugacaagagcuuucggcgcgcuccuucuuggagaaagaaauuccggcccaaggauauuagagggcuggcggccggcuccgcugagacacucccugccaacuuucgcgugaccagcuccaugucuagccccuccaugcagccuaaaaagaugcaaauggacggaaauguuagcggcacccagcggcuggauucugccacagugagaacguacuccuguuga

SEQ ID NO: 74078 - RNA, 3744 nt, Artificial Sequence
  derived and/or modified sequence opt5 from PPFIA2__Homo_sapiens__NP_001207402
augaugugcgaggugaugcccaccaucaacgaagacacaccuaugagccagagaggcucccaaucuagcggguccgauucugacagccacuucgagcagcugauggucaauaugcucgaugaacgggaccgccugcuugauacgcugagagagacccaggaaucccucucucuggcccagcaacggcuucaggacguuauuuacgaucgcgacagccugcagagacagcucaacuccgcucugccgcaagauaucgagagccugacaggaggccucgccgggucuaagggagcggaucccccugaguuugcugcccugaccaaagaacuuaaugccugucgggagcagcugcucgaaaaggaggaggaaauuuccgagcugaaagcugaacgcaacaauacaagacuucugcucgagcaucuggaaugccuggugagccggcacgagcgcucucucagaaugaccguggucaagcggcaggcccagucccccagcggcgugucuuccgagguugaagugcugaaagcucuuaagagccuguucgagcaucacaaggcccucgacgaaaaaguccgcgagagacugcgggugucccuugaacgcguuucugcgcuggaggaggaacucgccgcugccaaccaagagaucguggcucugagagaacagaauguccauauucagcggaagauggccagcuccgaggggagcacagaaucugagcaccuggagggaauggaaccuggccaaaaagugcacgagaagagacucuccaacggcagcaucgacucuaccgaugaaacgagccagaucguggagcugcaggagcuucuggaaaaacagaauuaugagauggcgcaaaugaaggaacgccucgccgcucuguccucucgggucggggagguugaacaggaggccgagaccgcuagaaaggaccuuauuaaaacagaagagaugaacaccaaguaccagcgcgacauccgggaagccauggcccagaaagaggauauggaagagagaauuacaacccuggagaagcgcuaucucagcgcucaacgggaauccacgagcauccaugacaugaaugauaaacuggagaacgaacuggcgaauaaggaggccauucucagacagauggaagagaaaaaccgccagcugcaggagcggcuugaacuggcugagcaaaagcuccagcagacaaugagaaaggccgaaacccugcccgagguggaggccgaacuggcucagcgcaucgccgcgcuuacaaaagcugaggaacggcacggaaauauugaggaaagaaugcggcaucucgagggccaacuggaggaaaagaaccaggagcugcagcgcgccagacaacgggaaaagaugaacgaggaacacaauaagagacucucugacaccguggaucgccugcuuaccgaguccaacgagcggcugcagcuccaccugaaagaaagaauggccgcucuggaggaaaagaauguccuuauccaggagagcgaaacauuucgcaagaaccucgaggagucucugcaugacaaagaaagacuggccgaggaaaucgagaagcuccgguccgagcuggaucagcuuaaaaugcgcacggggagccugauugaaccuaccaucccgagaacacaccucgacaccuccgcugagcugcgguacucugugggaagccugguugauucccaaucugacuaucgcacaaccaaggugauuagacggccccgcagaggccggauggggguccgcagagaugaaccuaaaguuaagagccuuggagaccaugaguggaaucggacgcagcagaucggcguucucuccagccaccccuucgaaucugacacagagauguccgauauugacgaugacgauagagagaccaucuuuagcucuauggaccugcuguccccuagcggccauucugaugcccagacccucgcgaugaugcugcaagaacagcuugacgccaucaacaaggagauucgccugauccaggaagagaaagaaagcacagagcuccgggcugaggaaauugagaauagaguggccuccgucagccuggaagggcugaaccuugcucgcgugcaccccggaaccucuaucacagccuccgucacggcgagcucccucgccucuagcuccccgccuucuggccacagcacccccaagcugacaccucggucccccgcuagagagauggaucgcaugggggugaugacccugcccucugaccuccggaaacauagacgcaagauugccguuguggaagaggauggacgggaggacaaagcuacaaucaagugugaaaccagcccuccgcccacgccuagagcccugcggaugacccacacacuucccuccagcuaccauaaugaugccagaucuucccugagcgucucucucgagccugaaucccugggccuggggagcgcuaacucuucccaggacagccuucacaaggcgcccaaaaagaaaggaaucaaguccagcauuggccgccuguucggcaaaaaggagaaagcccggcucgggcaacugcgcggauuuauggagaccgaagcugccgcccaggagucucucggccuggggaaacuuggaacacaggcugaaaaggacagacggcugaaaaagaaacacgagcuccuggaagaggccagacgcaagggccugccguucgcgcaaugggaugggccuaccgugguugcuuggcuugagcuguggcucggcaugcccgccugguauguggccgcuugccgggccaaugucaaaagcggagcgaucauguccgcucugucugacacggaaauucagagagagaucggcauuagcaacccucuccaucgccugaaacuucggcuggccauccaggaaauggugucccucacaucucccagcgccccucccaccuccagaacaccgucugggaauguguggguuacccacgaggaaauggagaaccuggcugccccugcuaagaccaaggagagcgaagagggauccugggcccagugucccgucuuucugcaaacacuugcguacggcgauaugaaucaugaauggauugggaacgaguggcugcccagccucggacugccucaguaccgcucuuauuucauggaaugccucguggacgcccggaugcuggaucaccuuacgaagaaagaccugagagugcaucugaagauggucgauuccuuucaccgcaccagccuccaguacggcaucaugugucugaaaagacuuaacuaugaccggaaggagcuggagcgcagacgggaggcuucucagcacgaaaucaaggaugugcucguuugguccaaugaccgcgugauuagauggauccaagccauugggcugcgggaauacgcuaacaauauccucgagagcggcguccauggaucccugauugcccuugaugagaacuucgacuauucuagccuggcccugcuccugcagaucccgacacagaauacccaggcuagacaaauccuugaacgcgaguacaacaaucugcucgcgcugggcacagaacggagacucgaugaguccgacgacaaaaacuuucgccgggggagcaccuggagacggcaguuucccccucgcgaagugcacggaauuucuaugaugcccggcuccagcgagacgcugccugccggguucagacuuacaaccaccucuggacagagccggaagaugacaaccgaugacggcguguucuccguguauucuacauga

SEQ ID NO: 74079 - RNA, 3624 nt, Artificial Sequence
  derived and/or modified sequence opt5 from PPFIA4__Homo_sapiens__NP_001291260
augugcgaggugaugcccaccaucaacgaaggcgacagacuggggccuccgcacggagccgaugcugacgccaauuucgagcagcucauggucaacaugcuggaugaacgggagaaacuucuggaaagccuccgcgagucccaagagacacuggcggcuacgcagucuagacuucaggacgccauucaugaacgggaucagcugcaacgccaccucaauagcgcccugccccaggaguuugcuacccugacaagagaacucuccaugugucgggagcagcugcuugagcgcgaagaggaaaucucugagcugaaggccgaaagaaacaauacccggcuccugcuugagcaucuggagugccucguuagccgccacgaaagaucccugcggaugacaguggugaagcgccaggcucaaucuccuagcggcgucuccagcgagguggaaguucugaaagcccucaagucucuguucgagcaucacaaagcgcuugacgaaaaggugagagagcggcugcgcgccgcucucgagagagucaccacacuggaggaacagcuugccggggcucaccaacagguguccgcccugcagcagggagcgggcguucgggauggggccgcugaagaggaaggaaccguggagcucggccccaagagacuguggaaagaggacacgggccgcgucgaggaacugcaggaacuccuggagaagcaaaacuuugagcuuagccaggcccgggaaagacuggugacccucacaaccacagugaccgagcuggaagaggaucuugggacggcucgccgggaccugauuaaaucugaggaacucuccagcaagcaucagagagaucugcgcgaggcccuggcccagaaagaagacauggaggaacggaucacaacccucgagaagagauaccuggcugcgcaacgcgaagccacaucuauucacgaucuuaaugacaagcuggagaacgagcucgcuaauaaagaaucccugcaucggcagugugaggaaaaggccagacaucugcaggagcuucucgaagucgccgagcagaaacugcaacagaccaugcgcaaggcugagacccugccugaaguugaggccgaacucgcgcagcggaucgcugcccugacaaaagccgaggagagacacggaaacaucgaggaacaccuucggcagcuggaaggccaacucgaggaaaagaaucaggagcuggcucgcgugagacagcgggagaaaaugaacgaagaccacaauaagagacugagcgauacgguggaccgccuucucuccgagucuaacgaacggcugcagcugcaucucaaggagagaauggccgcucuggaagagaaaaauacccuuauucaagagcuggaaagcucccagcgccagaucgaggaacaacaccaucacaaggggagacucagcgaggaaauugagaaacugcggcaggaggucgaucagcugaagggacgcggcgggcccuucguggacggaguucacucuagaucccauaugggcagcgccgcggaugugcgguuuucucuuggcacaaccacacacgccccuccggggguccaucgcagauauagcgcucuccgggaagaguccgccaaagacugggaaaccucuccccugccuggaaugcuggcucccgccgcgggcccugccuucgauagcgaccccgagaucuccgauguggacgaggaugaacccgggggacucguuggcagcgcugacguggucucuccuuccgggcacagcgacgcccagacgcuggcuaugaugcuucaagagcagcuggaugccauuaacgaagagauccgcaugauucaggaagagaaggagucuacagaacucagagccgaggaaaucgagacccgggugaccuccggaagcauggaagcucugaaccugaagcagcuucgcaaaagaggcuccauccccacaucucucaccgcgcugagccuggccuccgcuucuccuccccucagcggccgguccacacccaagcugacgagcagaucugccgcccaagaccuugaucgcaugggggucaugacccugccuuccgaccuccggaaacacagacgcaagcugcugagcccggugucucgggaggagaauagagaagauaaagcuacaauuaagugcgagaccuccccgccuagcucuccccgcacacuucggcuggaaaagcucggacauccugcccugagccaggaggaaggcaaauccgcgcucgaggaccaggggagcaaccccucuuccagcaauuccucucaggauagccugcacaagggagcuaaaagaaagggcaucaaauccucuauugggcgccuuuuuggcaagaaggagaaaggacggcugauccaacucagcagagacggcgccaccgggcauguucugcugacggauuccgaguucucuaugcaggaaccgauggugccugccaaacuuggaacccaggcugaaaaggaccggcgccugaagaaaaagcaccaacuccuggaggaugccagacggaaaggcaugcccuuugcgcagugggacgggccuacagucgugagcuggcucgagcuguggguuggaaugcccgcuugguacguggccgccugucgcgcuaacgucaaguccggcgccauuaugagcgcucuuucugauaccgaaauccagagagagaucgggauuuccaaugcccugcaucggcucaagcugagacuggcgauccaggaaauggugagccuuacaucuccuuccgcucccccgaccagccgcacgucuuccggcaacguguggguuacacacgaggaaauggagacccuggagacaagcaccaaaaccgacuccgaagagggaagcugggcccaaacacucgccuauggcgacaugaaucacgaauggauugggaacgaguggcugccuucucucggacugccccaguaccggagcuauuucauggaaugccuugucgaugcuagaaugcuggaccaucugacgaagaaagaucuccgcgugcaccugaagaugguggacuccuuucaucggaccucucuucaguacggcaucaugugucugaaaagacucaauuaugaucgcaaggagcuggagaagcggagagaagagagccagcacgaaauuaaagacguccucguguggacaaacgaucaaguugugcauuggguccaguccaucgggcugcgcgacuacgccggaaaucuucacgagucuggcgugcacggggcccugcuggcucucgaugaaaacuucgaccauaauacccuggcgcuuauccugcagauucccacacagaacacccaagccagacagguuauggagcgggaguuuaauaaccuccuggcucucggcacggaucgcaagcuggacgauggagacgacaaaguguucagacgggccccuagcuggcgcaagagauuccggccgagagaacaccauggccgcgggggaaugcuuuccgccucugcugagacacugcccgccggcuuucgggucagcacccuggggacccuccagccucccccugcgcccccuaaaaagaucaugcccgaagcucacucccacuaccuguauggacauaugcuuagcgccuucagagauuga

SEQ ID NO: 74080 - RNA, 2577 nt, Artificial Sequence
  derived and/or modified sequence opt5 from PPFIBP1__Homo_sapiens__NP_001185844
augcugcagcaagagcuccugagcagaaccucccuugaaacacagaagcuggaccucauggccgagaucucuaaccugaaacuuaagcugacggcuguggaaaaagaucggcucgacuacgaggauaaguuccgcgacaccgaaggccugauucaggagaucaaugaucugagacucaaagucagcgagauggacuccgaacggcugcaguaugagaagaaacuuaaaucuacaaagagccugauggccaaacucuccucuaugaagauuaaaguugggcaaaugcaguacgaaaagcagcgcauggagcagaagugggagagccugaaagaugaacuugcgucccugaaggagcaacucgaagagaaagaaagcgaggugaagagacugcaggagaaacuggugugcaagaugaaaggagaaggcgucgagaucguggaccgggauauugaaguucagaagaugaagaaagcuguggagucucucauggccgccaacgaagagaaggaccgcaaaaucgaggaucugagacagugucuuaaucgguauaagaaaaugcaagacaccgucgugcuggcucaggggaaggauggagaauacgaggaacuccugaacuccagcucuaucuccagccuucuggacgcccagggcuuuucugaccucgagaagucccccagcccuacaccgguuauggggucccccucuugcgauccuuucaauaccagcgugcccgaagaguuucacacaaccauucugcaagucuccaucccuagccugcuccccgcuacggugucuauggagaccuccgaaaagagcaagcugacaccuaaaccggagaccucuuucgaagagaacgacggaaauauuauccuuggcgccacaguggauacccagcugugugacaagcuccugacgagcucccuucagaaaucuagcucccugggcaaccucaagaaggagacaagcgauggggaaaaagagaccauucagaagacaucugaagaccgcgcgcccgccgaguccagaccuuuuggaacccugcccccucggcccccgggccaagauaccagcauggacgauaauccuuucgggacacgcaaagucagaucuuccuuuggacggggcuucuuuaagaucaaaagcaacaagcgcacggcuuccgcccccaaucuggcugaaaccgagaaggagacagccgaacaucucgaccuggcgggggccucuagcagaccuaaagauucccagcggaacucucccuuccagauucccccuccgagccccgacuccaagaaaaagagcagaggaaucaugaaacuuuuuggcaagcugcgccggucucaguccaccacauucaauccugacgauaugagcgagcccgaauuuaaaagaggcgggacccgcgcuacggccggaccucggcucggcuggucuagagaccuggggcaauccaacagcgaucuggacaugcccuucgcuaaguggacaaaggagcagguuugcaauuggcuuauggaacagggacucggcucuuaucugaacagcgggaaacacuggaucgccuccggacagacccugcuccaagccagccagcaggaucuggagaaggagcuuggcauuaaacauucucugcaccgcaagaaacuccagcuggcucugcaagcgcuuggcuccgaagaggaaaccaaccaugggaagcucgacuucaauugggugacacgguggcuggaugacaucggacugccgcaguacaagacccaguuugaugagggcagaguggacgggcgcaugcuccacuauaugacagucgaugaccugcuuagccugaaagugguuuccgugcuccaccaucugucuauuaagcgggccauccaaguccugagaauuaacaauuucgaaccuaacugucuucgccggagacccagcgaugagaauacgaucgcuccuuccgaggugcagaaauggaccaaccaccggguuauggaauggcuccgcucuguggaccuggccgaguacgcccccaaucugagaggaagcggcguccaugggggccucauggugcuggaaccucgguuuaacgucgagacaauggcucagcuucugaauauucccccgaacaagacccuccugagacgccaccuggccacacacuucaaucuucucaucggagcggaggcucagcaucaaaaacgggacgccauggaacugccugauuacgugcugcucaccgccacggcuaagguuaagcccaaaaagcuggccuuuuccaacuucggcaaucuucgcaaaaagaaacaggaggacggggaagaguaugugugccccauggaacugggacaggcuucuggcagcgccuccaagaagggguuuaaaccuggacucgauaugagacuguacgaggaggacgaucuggacagacuugaacagauggaggauagcgaaggcaccguccggcaaaucggggcguucucugagggcauuaacaaucugacacacaugcucaaggaagacgauauguuuaaagacuucgccgcucgcuccccgagcgccucuaucaccgaugaggacuccaacguguga

SEQ ID NO: 74081 - RNA, 2295 nt, Artificial Sequence
  derived and/or modified sequence opt5 from PPFIBP2__Homo_sapiens__NP_001243497
augagcuccgagcaguggcccagacugccuggcaaggugucuguccucaccgaccaaguugaagcccagggggagaaaauccgggaucuggaagugugccuugagggacaccaggugaagcugaacgcugccgaagagaugcuccagcaagagcugcuuagccgcacaucccuggaaacgcagaaacucgaccugaugaccgaggucucugaacugaagcucaaacuggugggcauggagaaggagcagagagaacaggaggaaaagcaacggaaagcggaggaacuucugcaggagcuccgccaucugaagauuaaaguugaggaacuugagaaugaaagaaaccaguacgaguggaagcugaaagcuacaaaggccgaaguggcccagcuccaagagcaggucgcucugaaggaugccgagaucgaacggcugcacagccagcucucccgcaccgcugcccugcauucugagagccacacagaaagagaccaagagauucagcggcuuaaaauggggauggaaacccugcuccuggcgaaugaggauaaggaccgcagaaucgaggaacuuacaggacugcucaaccaguaucggaaagugaaggagauuguuauggugacccagggcccguccgaacgcacgcugagcaucaaugaggaggaacccgaagggggauucucuaaauggaacgccaccaauaaggauccugaggagcuguuuaaacaagaaaugcccccuagauguuccagccccacagucggcccuccgccccucccucagaagucucuggagacccgggcucagaagaaacuuuccugcagccuggaggaccuccgcucugaauccguggauaaguguauggacggcaaccagcccuucccugugcuggagcccaaagauagcccguuucuugccgaacauaaguacccuacacugcccgggaaacucuccggagcuaccccuaauggcgaggccgcgaagucuccucccacgaucugccaacccgacgccacagggagcucccugcugagacuccgggauaccgaaagcggaugggacgacacagcugucguuaacgaucugucuuccaccagcucuggcaccgagagcgggccgcagagcccccuuacaccugacggaaagagaaaucccaaaggcauuaagaaauucuggggcaagauccgccggacgcagucugggaacuuuuauaccgauacacugggaauggccgaguucagacgcggcgggcuccgggcuaccgccggaccuagacugagccgcacacgggacuccaaaggccagaaguccgaugccaaugcucccuuugcgcaauggucuaccgaaagagugugugccuggcuggaggacuucgggcuugcucaguacgugauuuuugcccgccagugggucuccagcggacacacgcuccugacagccaccccgcaggauauggaaaaggagcugggcaucaaacacccucuccaucggaagaaacuggugcuugcuguuaaggccauuaacaccaaacaagaagagaagucugcgcugcucgaccacaucugggugacaagauggcuggaugacauuggccugccccaguauaaggaucaguuccaugagucccgcgucgacgggcggaugcuucaauaccucaccgugaaugaccugcuguuucucaaaguuacaagccagcugcaccaccuuuccaucaagugcgcuauccaugugcugcacgucaacaaauucaacccucauugucuccacagacggcccgccgaugaaucuaaucugagcccuuccgaggugguccaguggucuaaccaucgcgugauggaauggcugagaagcguugaccuugccgaguaugcucccaaucuccggggauccggcgugcacgggggacugauuauccuggagccgagauuuacgggcgauacccucgccaugcugcuuaacauuccuccccagaagacacugcuccgccggcaccugaccacaaaauucaaugcucugaucgggcccgaagccgagcaagaaaagagagagaaaauggcgagcccugccuacaccccgcuuacgaccacagcuaagguccgccccagaaagcucggcuucucucauuuuggaaacauucggaaaaagaaauucgacgaauccaccgauuacaucugcccuauggagcccagcgacggcgugucugauucccaccgcguuuauagcggguacagaggacugucuccucuggacgcccccgagcucgauggccuggaccagguggggcagaucagcuga

SEQ ID NO: 74082 - RNA, 318 nt, Artificial Sequence
  derived and/or modified sequence opt5 from PPIA__Homo_sapiens__NP_001287910
augugccagggcggggacuucaccagacacaacggaacaggcggaaagagcaucuacggggagaaauuugaagaugagaauuucauucugaagcauacgggccccgggauccucuccauggccaacgcuggaccuaauaccaacggcucucaauuuuucauuuguacagccaaaaccgaauggcuggacggcaagcacguggucuuugggaaaguuaaggagggaaugaauaucguggaagcgauggagcgguucggcagccgcaacgggaagacauccaaaaagauuaccaucgcugauugcggacagcuugaguga

SEQ ID NO: 74083 - RNA, 651 nt, Artificial Sequence
  derived and/or modified sequence opt5 from PPIB__Homo_sapiens__NP_000933
augcugagacucagcgagcggaacaugaaggugcugcuugccgcugcccugaucgcgggcuccgucuucuuucuccugcuucccgggccuucugcugccgacgagaaaaagaaaggaccgaagguuaccgugaaaguguacuucgaucugcgcauuggcgacgaagaugucgggagagugaucuuuggacucuucggcaagacaguucccaagacgguggacaauuuugucgcccuggcuaccggggaaaaaggauucggcuauaagaacagcaaauuucaccgggugauuaaggauuucaugauccagggcggggacuuuacacgcggagauggcaccgggggaaaauccauuuacggcgagagauucccugacgaaaauuuuaagcugaagcauuaugggcccggauggguuucuauggccaacgcuggcaaagauacaaauggcagccaauucuuuaucaccacagugaagaccgccuggcucgacgggaaacacgucguguucggaaaggugcuggagggcauggaggucguucggaaaguggaauccacgaagaccgauucucgcgacaaaccucuuaaggaugugaucauugcggacugcgggaagaucgaggucgaaaaacccuucgccauugcuaaggaguga

SEQ ID NO: 74084 - RNA, 639 nt, Artificial Sequence
  derived and/or modified sequence opt5 from PPIC__Homo_sapiens__NP_000934
augggccccgggccuagacugcuccugccgcuugugcugugcgucggacucggcgcccugguuuucagcuccggggcugagggauuucggaagcgcggccccucugugaccgccaaaguguucuuugacgucagaaucggggauaaggacgugggacggauuguuaucggccuuuucggcaaaguggucccuaagacaguggaaaacuuuguugcgcuggcuacgggggagaaaggauacggcuauaaggggagcaaguuccaccgcgugauuaaagauuuuaugauccagggaggcgacauuaccacaggggauggaaccggcggcgucuccaucuacggggaaacauuccccgacgagaauuuuaagcucaaacauuauggaaucggcugggugucuauggccaacgccgggccugauaccaauggaagccaauucuuuauuacacugaccaagcccacguggcuggacggcaaacacguggucuucgggaagguuaucgauggaaugaccguggugcauuccauugaacuccaggcuacagacggccacgauagaccucugaccaacuguucuaucauuaauagcggcaagaucgacgucaaaacaccguuugugguugagauugccgauugguga

SEQ ID NO: 74085 - RNA, 1113 nt, Artificial Sequence
  derived and/or modified sequence opt5 from PPID__Homo_sapiens__NP_005029
augagccaccccuccccucaggccaagccgucuaaccccagcaauccuagaguguucuuugacgucgauaucggcggggagcggguuggacgcauugugcuggaacucuucgcugacaucgugcccaaaaccgccgagaacuuuagagcgcugugcacaggcgaaaaggggauuggacauacgaccggcaaaccucuucacuucaaggggugucccuuucaucggaucauuaaaaaguucaugauccaaggaggcgauuuuuccaaucagaacggcacagggggagagucuaucuacggcgaaaaguucgaggacgagaauuuucacuauaaacaugaucgcgaagggcugcucagcauggcuaacgccggaagaaauaccaacggcucccaguucuuuauuacaaccgucccuacaccgcaccuggacgggaagcacgugguuuucggacaggugaucaaaggcauuggcgucgcccggauccuugagaauguggaaguuaagggggagaaacccgcuaagcugugcgugauugccgaguguggagaacucaaggagggcgaugacgggggaaucuuuccuaaagauggcucuggggacagccaucccgauuucccugaagacgcugauauugaccugaaggacgucgauaaaauccugcucaucaccgaggaccugaagaacauuggaaauacguucuuuaaaucccaaaacugggaaauggccaucaagaaauacgcggaggugcuucgcuauguggauagcucuaaggccgucauugagaccgcugacagagccaagcugcagcccaucgcucucuccugcguucugaauauuggcgccuguaaacuuaagaugagcaacuggcagggcgcgaucgauucuugccuggaagcccucgagcuggacccguccaauacaaaagcucuguaccggcgcgcccagggguggcaaggacucaaggaauaugaucaggcucuggccgaccuuaaaaaggcccagggcaucgcuccugaggauaaggcgauucaggccgaacugcucaaagugaagcagaaaaucaaggcucaaaaagacaaggagaaggccguguacgccaaaauguucgcuuga

SEQ ID NO: 74086 - RNA, 624 nt, Artificial Sequence
  derived and/or modified sequence opt5 from PPIF__Homo_sapiens__NP_005720
augcuggcccucagaugcggcagccgguggcuggggcuucuguccgugccccgcucugucccucucagacugccggcugcccgggcguguagcaagggauccggcgaccccucuagcuccucuagcuccgggaacccucuuguuuaccuggauguggacgcuaauggaaaaccccucggccgcgugguccuggaacugaaggccgaugugguuccuaaaaccgccgaaaacuucagagcucucugcacaggggagaagggauuuggcuauaaaggcagcacguuccaccgggugauccccucuuuuaugugucaggccggggacuucaccaaucauaacggaacaggcgggaaguccauuuacggaagccgcuuuccugaugaaaauuucacccugaagcacgucggcccgggggugcuuucuauggcuaacgccggacccaauacaaacggcucccaauuuuucaucugcaccauuaaaacagacuggcuggauggcaagcauguuguguuugggcacgucaaagagggaauggacguggugaagaaaaucgagagcuucggcucuaaguccgggagaaccagcaagaaaauugucaucacggauuguggacagcucuccuga

SEQ ID NO: 74087 - RNA, 2265 nt, Artificial Sequence
  derived and/or modified sequence opt5 from PPIG__Homo_sapiens__NP_004783
augggcaucaaggugcagagaccccggugcuucuuugacauugccaucaacaaucaaccugcugggcgcgucguuuucgagcuguuuagcgauguguguccgaaaaccugcgaaaacuucagaugucucugcacaggagagaagggcacggggaaauccacccagaagccccugcacuacaaaucuugucuuuuucaucggguggucaaggacuucauggugcagggaggcgauuuuagcgaagggaauggacgcggcggcgaguccauuuaugggggauucuuugaagacgagucuuucgccguuaagcacaacaaagaguuucugcucagcauggcgaauagaggcaaggauacaaacgggucccaguucuuuaucaccacaaaaccuacaccccaucuggacggacaccauguggucuucggccaagugauuucugggcaggaaguugugcgggagaucgaaaaucagaagaccgaugcugccagcaaaccuuucgccgagguccgcauccuuuccugcggagagcugauucccaagagcaaggugaaaaaggaagagaaaaagagacacaaaucuuccagcagcuccucuucuuccagcuccgacucugauagcuccagcgacucucaguccagcucugauagcuccgacucugaaagcgcuaccgaggaaaaguccaaaaagcggaagaaaaagcaccgcaaaaacagcagaaagcauaaaaaggagaagaaaaagcggaaaaagucuaaaaaguccgccagcucugaguccgaagcugagaaucucgaagcccaaccucagagcacggugcgcccggaggaaauucccccuauccccgagaacagauuucugaugcggaaguccccucccaaagcggaugagaaggaacgcaaaaauagagagcgggaaagagagcgcgaauguaacccgccuaauucucagcccgccagcuaccagcggagacugcucgucacccgcuccggccggaagaucaaaggcagagggccucgccgguauagaacacccucucgcagccgguccagagaccgcuuccggagaagcgagacacccccucacuggcggcaagagaugcagcgcgcucagagaaugcggguuucuuccggagaaagauggauuaagggcgacaagagcgagcugaacgaaaucaaagagaaucaacgcucuccggugcgggugaaggagagaaaaauuaccgaucaucgcaacgucuccgaaagccccaacagaaagaaugagaaagaaaagaaagugaaggaccacaagucuaacagcaaagagcgggauauccgcagaaauuccgaaaaggacgauaaauacaagaacaaaguuaagaagcgggccaaaagcaagucucgcuccaaaagcaaggagaaauccaagucuaaggagagagacagcaaacacaaucggaacgaagagaagcgcaugagaucccggucuaaagggcgcgaucaugaaaaugugaaggagaaagaaaagcagagcgacuccaagggaaaagaucaggagagaucucggagcaaggagaaauccaagcagcuugaaagcaaaucuaacgagcacgaccauuccaagagcaaagaaaaggauagacgcgcucaaucucgguccagagagugcgacaucaccaagggcaaacacagcuauaauucucgcacgcgggaaagaucccgcagccgggacagaucccgccgggucagaagccggacacaugaucgcgacagaucucggagcaaggaguaccaccgcuauagagagcaggaauaccggagacgcgggcgguccagaucucgcgagcggagaaccccucccggacgcagccgguccaaagauagacgcagacggcgcagagacucucggagcuccgaacgcgaggagucucagagcagaaacaaggauaaauaccggaaucaggaauccaagagcucucacagaaaggagaacuccgaaagcgagaaacgcauguauucuaagucccgggaccauaauagcuccaacaauucuagagagaaaaaggccgaucgcgaccaaagcccuuuuuccaaaauuaagcagagcucucaggauaacgaacugaaguccagcaugcucaaaaacaaggaggacgagaaaauccggucuagcguggaaaaggaaaaucagaaauccaagggccaagagaacgaucacguucaugaaaagaauaaaaaguucgaccacgagucuagccccggcacagaugaggacaaauccggguga

SEQ ID NO: 74088 - RNA, 501 nt, Artificial Sequence
  derived and/or modified sequence opt5 from PPIL1__Homo_sapiens__NP_057143
auggccgcuauucccccugacagcuggcagccgcccaacguguaccuggagaccuccaugggcaucaucguccucgaacuguauuggaagcacgccccuaaaacaugcaagaauuucgcggagcuugcuagacggggguacuauaacggaacgaaauuucaucgcauuaucaaggauuucaugauucaaggcggggaccccaccggaacaggcagagggggagccucuaucuacggcaaacaguuugaagaugagcugcacccugaccucaaguucaccggcgccgggauccuggcuauggccaaugcuggacccgauacaaacggcagccaguuuuucguuacccuugccccuacacaguggcuggacgggaagcauaccauuuuuggacgggugugucaaggcaucgggauggugaaucgcgucggaaugguggaaacgaacucccaggauagaccgguugacgaugugaaaauuaucaaggcguaucccucuggcuga

SEQ ID NO: 74089 - RNA, 1563 nt, Artificial Sequence
  derived and/or modified sequence opt5 from PPIL2__Homo_sapiens__NP_680480
augggcaagagacagcaccaaaaagacaagauguacauuaccugcgccgaguauacacauuucuacgggggaaagaagcccgaucugccucagacgaacuuucggcgccucccguucgaccacuguagccugucccuucagcccuuuguguauccugucugcacccccgauggcaucguuuucgaccugcucaauaucgugccuuggcugaaaaaguacgggacaaaccccucuaauggagaaaaacuugauggcagaagccugauuaaacucaacuuuuccaaaaauucugaggggaaguaucauuguccugugcuguucaccgucuuuacaaacaauacccacaucguggcuguucggacaaccggaaacguguacgccuaugaagcggucgagcagcugaauauuaaggcuaaaaacuuccgcgaccuccugacggaugaaccguuuagcagacaagacaucaucacccuucaggaucccacaaaucuggacaaguucaacguguccaauuuuuaccauguuaagaacaauaugaaaauuaucgauccugacgaggagaaggccaaacaggaucccucuuacuaucucaagaacaccaacgccgaaacacgggagacccugcaggaacuuuacaaagaguucaagggcgacgagauucuggcugccacgaugaaagcuccugaaaagaagaaaguggacaagcucaaugccgcgcacuauagcacaggcaaagucuccgccagcuuuaccucuacagcuauggugcccgagaccacccacgaagccgcugccaucgaugaggacgugcugcgcuaccaauucgucaagaaaaagggguauguuagacugcauacaaacaagggagaucucaaucuggaacuucacugcgaccugacgccgaaaaccugugagaacuucauucggcucugcaagaaacauuacuaugauggcacaaucuuucaccgcuccauuagaaauuucgugauccaagggggagacccuaccggcacagggaccggaggcgagagcuacuggggcaagcccuuuaaagaugaguuccggccuaaccugucucacacggggcgcggaauccuuuccauggcgaauagcggccccaacucuaauagaucccaguuuuucauuacauuucggagcugugccuaccuggacaagaagcauaccaucuucgggcgcguggucggaggcuuugaugugcucaccgcuauggaaaacguugaauccgaccccaaaacagauagaccuaaggaggaaauucggaucgacgccaccacaguguucgucgacccguaugaggaggcugaugcccagauugcccaggaaagaaaaacgcagcugaagguggcucccgagaccaaaguuaagucuagccagccucaagcggggucccagggaccccagacauuucgccagggcgugggcaaguacaucaauccugccgcuaccaaacgggccgccgaagaggaacccagcacaucugcuaccgucccgauguccaagaaaaagccuagcagaggguucggagacuuuucuagcugguga

SEQ ID NO: 74090 - RNA, 498 nt, Artificial Sequence
  derived and/or modified sequence opt5 from PPIL3__Homo_sapiens__NP_115861
augagcgugacccugcacacagacgucggcgauaucaagauugaaguuuucugcgaaagaacgcccaaaaccugugagauggaaucccggugcgugccucaggccggggugcaauggcgcgaccucggaucucugcagccgcccccucccggcuuuaagcaggucuucugucuuagccugccuagaacagggcggggaggcaacuccaucugggggaaaaaguuugaggaugaauacucugaguaucucaaacauaaugugcgcggaguugugagcauggcuaacaauggccccaacaccaauggcucccaguucuuuauuacauacgggaagcaaccucaccuggacaugaaguauaccgucuucggaaaagugaucgauggccuugagacacuggacgaacucgagaagcugccgguuaacgagaaaaccuacagaccccugaaugaugugcauauuaaggacaucacgauccacgccaacccuuuugcgcaguga

SEQ ID NO: 74091 - RNA, 4302 nt, Artificial Sequence
  derived and/or modified sequence opt5 from PPIP5K1__Homo_sapiens__NP_001124330
auguggagccugaccgccuccgagggcgaaucuacaacggcucacuucuuucucggggccggagacgagggccuggggaccagaggaaucggcaugcggcccgaagagagcgauuccgaacuucuggaggacgaggaagaugaggugccuccggaaccccagauuaucgucgggauuugcgcgaugacaaagaaaucuaagagcaaaccuaugacccaaauccucgagcgccuguguagauucgacuaccuuacaguugugauucugggagaggaugugauccucaacgaacccgucgagaauuggccuuccugccauugucugaucucuuuucacagcaagggcuucccccuggacaaagcuguggccuauuccaagcuccggaacccuuuucugauuaaugaucuugccaugcaguacuauauccaggaccgcagagaaguuuaccggauucugcaggaggaaggcaucgaucucccgcgcuaugcugugcugaacagagaccccgcccggccugaggagugcaaucuuauugaaggggaggaucaagucgaagugaacggagcuguuuuccccaagccuuuuguggagaaacccgucagcgccgaagaccauaauguguacaucuauuacccgucuuccgcgggcgggggaagccagcgccuguucagaaagauuggcucucgguccagcguguacucuccugaguccagcguccgcaaaaccggguccuauaucuacgaggaauuuaugcccacagauggaaccgacguuaagguguauacggugggcccugacuacgcccacgcugaggccagaaaaucucccgcucucgauggcaaggucgaacgggacagcgaggggaaggaaauccgcuaucccgugaugcugaccgccauggagaaacugguugcgagaaaggugugugucgccuucaaacagacagugugcggauuugaucuccugcgggcuaacggccauuccuucguuugugacgugaauggguuuagcuucgucaagaacucuaugaaauacuaugaugacugcgccaagauucuuggaaauaccaucaugagagagcuggcuccucaguuccaaauuccgugguccauccccacagaagccgaggauauuccuaucgugcccaccacgagcggcacaaugauggaacuccgcugugucaucgccauuauccggcacggggacagaaccccuaaacagaagaugaagauggaggugaaacacccccgcuuuuucgcucuguuugagaagcauggaggcuacaaaacaggcaagcucaaacugaagcggccggaacagcuccaggagguucuggauauuaccagacugcuccuggcggaacuugagaaggaaccugggggagagaucgaggaaaagaccggcaagcuggagcaacucaaaucugugcuggaaauguacgggcacuucagcggaauuaaccgcaagguccagcuuacauauuacccccauggcgugaaagccuccaaugaggggcaggacccucaacgggaaacgcuggcucccucucuccugcugguucucaaguggggcggagagcugaccccugccggcagagugcaggccgaggaacuugggcgcgcuuuucggugcauguaucccggaggccagggggauuacgccggauucccgggcugugggcugcucagacugcacagcacauuucgccacgaccugaagaucuaugcguccgacgagggccggguccagaugaccgcugccgccuucgcuaaaggacuucucgcccuggaaggcgagcugacaccuauccucgugcaaauggugaaaagcgcuaacaugaaugggcugcuugauucugacggagauucccugagcucuugccagcauagaguuaaagcccggcuccaccauauucugcagcaggacgcgcccuuuggccccgaagauuacgaccaacuggccccuacccgcuccacgagccuucucaacuccaugacaaucauucagaacccggucaaggugugcgaucagguguucgcucugaucgagaaucugacccaccagauuagagagcggaugcaagaccccagaucugucgaucuccagcuguaucauagcgaaacccuugagcugaugcuccagcgcugguccaaacuggaacgggacuuuagacagaagucugggcgcuacgauaucagcaagauuccugacaucuacgauugugugaaauaugacguucaacacaacggaucccugggccuucaggggacagccgagcuccugagacugagcaaggcucucgccgacguggucaucccccaggaguacggcauuucucgggaagagaaacuggaaaucgcggugggauucugccuuccucugcuccgcaagauucugcuggaucuucaaagaacccacgaggacgaauccguuaauaaacuccauccccuguguuaucugcgguacagccgcggcgugcucucuccugggagacacguccggacacgccuguauuuuacguccgagagccaugugcacucucuucugagcguuuucagauacggaggccuccuggaugagacccaggacgcccaguggcagcgggcucuggauuaucuuuccgccaucagcgaacugaacuacaugacacaaauugugaucaugcucuacgaggacaauacccaggauccccugucugaggaacgcuuccacgucgaacuccauuuuuccccgggggugaagggaguggaggaggaaggcagcgcuccugccgggugcggcuucagacccgccuccucugagaacgaagagaugaaaacaaaucagggaagcauggaaaaccuguguccuggcaaggcuuccgacgagcccgaucgggcgcuucagaccucuccgcaaccucccgaggggccuggacugcccagacgcagcccccucauccggaauagaaaggccggcuccauggaaguccugucugagacgagcuccagccgcccugggggauaucggcuguuuucuuccagcagaccgcccaccgaaaugaaacagucuggccuuggcucccagugcacagggcuguucagcaccacaguucucggaggcagcuccagcgcuccuaaccugcaggacuacgcccgcucccacgggaagaaacuucccccugccagccugaagcaucgggaugagcuucuguuugugcccgcugugaaaagauucucugucagcuuugccaagcacccuaccaauggauucgagggcuguuccauggugccgacgauuuauccccucgaaacacugcauaacgcgcugucucuucgccaaguuagcgaguuucugucccgggugugccagagacacaccgacgcucaggcccaagccucugcugcccucuucgauagcaugcacuccucucaggcgagcgacaauccuuuuucucccccucggacacugcauucucccccgcuccagcugcagcaacgcuccgaaaagccucccugguacuccagcgggcccucuuccaccgucagcuccgcuggaccuucuagccccaccacaguggacggcaacucccaguucggcuuuagcgaucagccuucucuuaauucccacguugccgaggaacaucaggggcugggacugcuccaagagacgccgggcagcggggcccaggagcugucuaucgaaggagagcaggaacuuuucgagcccaaccagagcccucaagugcccccuauggaaaccucccagcccuaugaggaggucucucagccgugucaggaagugccugacauuagccaacccugccaggauaucuccgaggcucugucucagccuugucaaaaaguucccgacauuagccagcagugccaggaaaaccacgauaauggcaaccauacaugccaagaggugccucacaucucccagcccugucaaaagagcucucagcucugccagaaagucuccgaagaggugugucagcugugccucgagaauagcgaagaggugucccagccgugucagggggucucuguugaagugggaaagcuggugcacaaauuccaugucggcgugggcagccuuguucaagagacccugguggaggucggguccccugccgaagagauccccgaagaggugauucagcccuaccaggaauuuucuguugaggugggaagacuggcucaagagacaagcgccaucaaccuccugucccagggcauuccugaaaucgacaagccgagccaggaguuccccgaagagauugaucuucaggcgcaagaagucccugaggagaucaauuga

SEQ ID NO: 74092 - RNA, 5271 nt, Artificial Sequence
  derived and/or modified sequence opt5 from PPL__Homo_sapiens__NP_002696
augaacagccuguucagaaagcggaauaaaggcaaguacucccccaccgugcagacccgcucuaucagcaacaaagagcucuccgaacugauugagcagcuucagaagaaugcugaccaggucgagaagaacaucguugauacggaggcuaagaugcagucugaccuggccagacuccaagaagggcggcagccugagcaccgcgaugugacccugcagaaggugcuugacagcgagaaacugcucuauguccuggaagcggaugcugccauugccaagcacaugaaacacccgcagggagacaugaucgcugaggauauuagacaacugaaggaacgggugacaaaucuccgcggcaaacauaagcagaucuacagacuggccguuaaggagguggacccccaggucaacugggcugcccuuguggaggaaaaacuggauaagcucaauaaccaguccuuugggaccgaccugccucuuguugaucaccaaguggaggaacauaauaucuuccacaacgaggucaaagcgauuggaccccaccuggccaaggacggcgauaaagaacaaaauucugagcuccgggcuaaguaucagaaacugcuggccgcuagccaagcccgccagcagcaucucuccagccugcaggacuacaugcaaagaugcacaaacgagcuuuauuggcuggaccagcaggcgaaggggcggaugcaguacgauuggucugaccgcaaucucgauuauccuuccagacggcgccaauacgaaaacuuuaucaauagaaaccuggaggccaaggaagaacggauuaacaaacuucacagcgaaggagaccagcugcucgcugccgagcaucccggcagaaauucuaucgaggcucacauggaagccgugcacgccgauuggaaggaguaccugaaccugcucauuugugaagagucccaucugaaauauauggaagacuaccaccaguuccaugaggaugugaaggacgcucaggagcuucugcgcaaagucgauagcgaccucaaucaaaaguauggcccugauuuuaaggaccgguaccagaucgaacugcuucugagagagcucgacgaucaggaaaaaguucuggacaaguaugaggauguggugcaggggcugcaaaaacgcggacagcaggucgugccgcucaaguaccggagagagacaccccugaaaccuauucccguugaagcgcuuugcgacuucgagggcgaacaagggcugaucucucgcggauauuccuacacacuccagaagaacaauggcgagagcugggaacugauggauuccgccgggaacaagcugaucgcuccugccguguguuuugucauucccccgaccgacccugaggcccuugcucucgccgauucucugggaagccaguaccgguccgugagacagaaagcggcuggcagcaagcgcacgcugcaacagcgguaugagguucucaaaaccgaaaaucccggcgacgccucugaucugcaggggagacagcuucuggccggacucgacaagguggcuuccgaucuggaccgccaagagaaagccaucacaggcauucugcggccuccccuugaacaggggagagcuguccaggauagcgccgagcgggcgaaggaccucaagaacaucaccaaugaacugcugcgcauugagcccgagaaaacaagaucuaccgccgaaggagaggcuuucauccaggcccucccuggcagcgggacgacaccgcugcuucggaccagaguggaagacacaaaccgcaaguacgagcaucugcuccaacugcuggaucuugcucaggaaaaagucgacguggccaaucggcucgagaagucccugcagcaaucuugggagcugcucgcgacccaugaaaaccaccugaaucaggaugacaccguucccgagagcuccagagugcuugauagcaaaggacaggaacuggccgcuauggccugcgagcuccaggcucaaaagucucugcugggcgaggucgaacagaaccuucaggccgccaaacaguguuccagcacacucgcuucucgcuuucaagagcacugcccugaccuggaaagacaggaggcggaagugcauaagcugggccagcgguucaauaaccuccgccagcaaguugagagacgggcccagucccugcagagcgcuaaggccgccuaugagcacuuucaucgcgggcacgaucacgugcuucaguuccuggucuccauccccucuuacgaaccucaagagacggacagccucucccagauggaaaccaaacugaagaaccagaaaaaucugcuugaugagauugcuucuagagaacaagaggugcagaagaucugugccaacagccagcaguaucaacaggcggugaaagacuacgagcuggaagcugagaagcuccggucccugcucgaucuggaaaauggacgcagcucucauguuuccaagagagcccggcuucagagccccgccacaaaagucaaggaggaagaggcugcccuggcggcuaaauuuaccgagguguaugccauuaaccgccagagacuccaaaaucuggaguucgcccugaaccuucugcggcagcagccggagguggaagucacacacgagacccuccagagaaaucgcccugacucuggcguggaggaggcuuggaagauccggaaagagcuggaugaagagacggaaagacgccggcaacucgagaacgagguuaaguccacacaggaagagauuuggacccugagaaaucaggggccccaagaaagcgugguccgcaaggaggugcuuaaaaagguuccugaccccgugcuggaagagucuuuccagcagcuccagcggacccuggccgaggaacaacauaaaaaccagcugcuucaggaggaacuggaggcucuccagcugcaacucagagcccuggaacaggagacacgcgacggaggccaggaguacgucgugaaggaaguucuucggaucgagccugauagagcgcaggccgacgaagugcugcaacugcgggaggagcucgaagcucugcgcagacagaaaggggcccgggaggcugaaguccuucugcuccagcagcgcguggccgcccuggcugaggaaaagagcagagcgcaagagaaggugaccgagaaagaagucguuaagcuccagaaugauccccagcuggaggccgaauaccaacagcuucaggaggaccaccagcggcaagaucagcugagagaaaaacaggaggaggaacuguccuuucuccaggacaagcugaaacgccuugagaaggaacgggcuauggccgagggcaaaaucacagugaaggaagugcugaaggucgagaaagaugccgcuacggagagagaagugagcgaccucacccgccaauaugaggaugaagccgcgaaggcucgggccucucagagagagaaaacagagcugcuccgcaagauuugggcccuggaagaggaaaacgcuaaaguugugguccaggagaaggugcgggaaaucguuagaccggacccuaaggccgaguccgagguggcgaaucuucgccuggaacuggucgagcaggaaagaaaauaccggggagcugaggaacaacuccgcagcuaucaguccgagcuggaggcccuuagacggcgcggcccccagguggaaguuaaggaggugaccaaagaagucauuaaguacaaaacagaucccgagauggaaaaggagcugcaaagacuccgggaggaaaucguggacaagaccagacugauugagcgcugcgaccucgaaaucuaucagcugaaaaaggagauucaggcccuuaaagauacgaagccucaggugcaaaccaaagaggucguucaggaaauccugcaguuccaggaggacccgcaaacaaaggaagagguggcuucucugcgggccaagcucagcgaagaacagaagaaacagguggaucuggagagagaacgcgcuucccaggaggaacaaaucgcccggaaagaggaagaacuuucuagagucaaagagcgggugguucagcaggaagugguccgcuacgaggaggaacccgggcugagagcggaagccagcgcuuuugccgaguccauugacguggagcuccggcaaaucgauaaacugcgcgcugaacugagacggcuccagcgcagacggaccgagcuugaacgccagcuggaggagcuggaaagagagcggcaggccagacgcgaagccgagcgggaaguucaaagacuccagcagcgccuggcugcgcuugagcaggaggaagccgaggcucgggaaaaggugacacauacccaaaaggucgugcugcagcaggacccucagcaagccagagagcacgcccuccugcgccugcagcucgaagaggagcagcaccggagacagcuucuggaaggagagcuggaaacgcuccgccggaaacuggcugcccuugagaaggcggaagucaaagagaaggugguucugucugagagcgugcaagucgaaaaaggcgauacagagcaggaaauucagagacucaaguccagccuggaggaggaaucucgcuccaaacgggagcuggacguggaaguuagcagacucgaggcucgccuuucugaacuggaguuccauaacuccaagagcucuaaggagcuggauuuucucagagaagagaaucacaaacugcaacuugaacggcagaaccugcagcucgagacccgcagacugcaguccgaaaucaacauggccgccacagagacccgggaccugagaaauaugaccguggcugauagcgggacaaaccaugacucccggcucuggagccuugagcgcgaacuggaugaccugaagagacucucuaaagacaaggaucuggagauugacgaacuucaaaaacggcugggaagcgucgccgugaagcgcgagcagagagaaaaucaccuccggcgcuccaucgugguuauccaucccgauacgggcagagagcugucuccugaggaagcgcaccgggccgggcugauugacuggaacauguucgucaagcuccgcagccaggagugugauugggaagagaucuccgugaaaggccccaauggagagucuagcgugauucacgacagaaaguccggcaaaaaguuuucuaucgaagaggcccuucagagcgggcggcugaccccugcccaauaugaucgcuacgucaacaaagacauguccauucaggaacuggcugugcucguuagcggacagaaguga

SEQ ID NO: 74093 - RNA, 1149 nt, Artificial Sequence
  derived and/or modified sequence opt5 from PPM1A__Homo_sapiens__NP_066283
augggcgccuuccuggacaagcccaaaauggagaagcacaacgcucaggggcaaggaaauggccucagauacgggcugagcuccaugcagggauggcggguggaaauggaggaugcccauaccgcggucaucggccuuccuucugggcuggaaagcugguccuuuuucgcuguuuaugacggacacgccggcucucagguggccaaauacugcugugagcaucuccuggaucacauuacaaacaaucaggacuuuaagggcagcgcuggggccccguccguggaaaacgucaaaaauggaauccgcacgggcuuccuugagauugaugagcauaugagagugaugucugaaaagaagcacggggcugaccggagcggauccaccgccguuggcgugcugaucagcccccaacacacauauuuuauuaacugcggggauucucgcggacuccuguguagaaaucggaaaguccauuucuuuacccaggaccacaagccuuccaacccccuggagaaagaacgcauccagaaugcgggcggcagcgugaugauccagagaguuaacgggucucucgccgugucccgggcucugggagauuucgacuacaagugcguccauggcaaagggccuacagagcaacuugugagccccgagccugaagugcacgauauugagcgcucugaagaggacgaucaguuuaucauucuggccugugacggaaucugggacgucaugggcaaugaggaacucugcgauuucguuagaucccggcuggaggugaccgacgaucuugaaaagguguguaacgaggucguggacacaugccuguauaaggggagccgcgauaauauguccguuauucucaucuguuuuccgaacgcucccaaagugucuccugaagccgucaagaaagaggcggaacuggacaaguaccuggagugcagaguggaggaaauuaucaaaaagcagggagagggcguucccgaucucgugcacgucaugcggacccuggccagcgaaaauaucccuucccuucccccgggcggggagcuggcuagcaaacgcaacgugauugaagccgucuauaacagacucaauccuuacaagaacgacgauacggacucuaccuccacagaugacaugugguga

SEQ ID NO: 74094 - RNA, 1143 nt, Artificial Sequence
  derived and/or modified sequence opt5 from PPM1B__Homo_sapiens__NP_001028729
augggcgccuuccuggacaagcccaaaaccgagaagcacaacgcucauggggccggaaauggccucagauacgggcugagcuccaugcagggauggcggguggaaauggaggaugcgcacacagcugucguuggcaucccucaugggcuugaagacuggucuuucuucgccguguaugauggacacgccggcagccgcguggcuaacuacugcuccacgcaucugcucgagcacauuaccacaaaugaagacuuuagagccgcuggcaaaucugggagcgcccuggagcuuuccgucgagaacgugaagaauggaauccggaccggcuuccugaaaauugaugaauauaugcgcaacuuuucugaccucagaaaugggauggaucggagcggauccacagcgguuggcgugaugaucagcccgaagcacauuuacuucaucaacuguggggacucucgcgccguccuguauagaaauggacaagugugcuuuuccacccaggaucauaagcccuguaacccucgggagaaagaacgcauccagaaugcuggcggcagcguuaugauucagagagugaacgggucucuggccgucucccgggcucucggagacuacgauuauaagugcguggacggcaaagggcccacagagcaacuggugagcccugagcccgaagucuacgagauccuucgcgccgaagaggaugaauuuauuauccuggcgugugacggaauuugggacguuaugucuaaugaggagcucugcgaauacgugaaguccagacuggaggugagcgaugaccuugaaaacgucuguaauugggugguugauaccugccugcacaaaggcucccgggacaacaugucuaucgugcucgucuguuuuagcaacgccccuaagguguccgaugaggcuguuaagaaagacagcgaacuggauaagcaucuggagucucgcguggaggaaauuauggagaaauccggggaagagggaaugccggaccucgcccacgucaugagaauccugagcgcugaaaauauccccaaccuuccucccggcggcgggcuggccggaaagcggaaugugauugaggccgucuauucuagacucaacccucaccgcgagagcgauggccagaaauga

SEQ ID NO: 74095 - RNA, 1818 nt, Artificial Sequence
  derived and/or modified sequence opt5 from PPM1D__Homo_sapiens__NP_003611
auggccggccuguacagccucgggguguccgucuucucugaccagggaggcagaaaguauauggaggauguuacccaaaucgugguggaacccgagccuacagcugaagagaaaccgagcccccggcgcucccugucucagccucuucccccuagacccagcccugccgcgcugcccgggggagaagucuccggcaaggggcccgcuguggccgcccgggaggcucgcgacccucuccccgaugccggagcuucuccugcccccagcagaugcugucggcgcagauccagcguugcguuuuucgccgugugcgacggccacggcgggcgggaggcugcccaguuugcucgcgaacaucuguggggauucauuaaaaagcagaaaggcuuuacgucuuccgagccggccaaggucugugcggccaucagaaagggguuccuugcuugccaccuggccauguggaaaaagcucgcugaauggccuaaaaccaugacaggacugcccagcaccucuggcacaaccgccuccgugguuauuauccgggggaugaagauguacguggcccaugucggagauagcggcguggugcugggcauucaagacgauccuaaagacgauuuuguccgcgcuguugaggugacacaggaccacaagcccgagcuccccaaggaaagagagcggaucgaagggcugggaggcucugugaugaacaaauccggggucaaucgcgugguuuggaagagaccucggcuuacccauaacggaccggugagacgcagcacggucaucgaucagauucccuuccuggcgguggcccgggcucucggcgaccugugguccuaugacuuuuucucuggggaguuuguugugagcccugaacccgauaccuccguccacacacuugacccucagaaacacaaguacaucauucugggaagcgauggccucuggaauaugaucccgccgcaagacgccauuucuaugugucaggaucaggaggagaaaaaguaucugaugggcgaacaugggcaguccugcgccaaaaugcuggugaacagagcucucggacgcuggcggcaaagaaugcugcgcgccgacaauaccagcgcgaucgucauuuguaucucuccugagguggauaaccagggcaauuucacaaacgaagacgagcuuuaccugaaucucaccgauagccccuccuauaacucucaggaaacgugcguuaugacaccuagccccuguuccaccccucccgugaaaagccuggaggaggacccguggccucgggucaauucuaaggaucacauccccgcucuugugagauccaacgccuuuagcgaaaauuuccuggagguuucugccgaaauugcucgcgagaacgugcaaggggucgugauccccuccaaggacccugaaccgcucgaggagaauugcgccaaggcucugacacugcggauucaugauagccucaacaacucccugcccaucggacuugugccuaccaauucuaccaacacaguuauggaccagaaaaaucugaagaugagcacgcccggccagaugaaagcccaggaaauugagagaaccccucccacaaacuucaagcgcacccucgaagaguccaauucugggccucugaugaagaaacaccggagaaacggccuuagccgguccagcggagcgcaacccgccucucugccgacaaccucccagcgcaagaauagcgucaaacucacgaugagacggagacugcgcggccagaagaaaaucgggaacccucugcuccaccagcaucggaagacagugugugugugcuga

SEQ ID NO: 74096 - RNA, 2268 nt, Artificial Sequence
  derived and/or modified sequence opt5 from PPM1E__Homo_sapiens__NP_055721
auggccggcugcauccccgaggaaaagaccuacagacgguuccuggagcucuuucugggggaguuccgcggaccuuguggcgggggagagccggaacccgagccugagcccgaaccugagcccgaaccugagagcgagccggaacccgagccugaacuuguggaggcugaagccgcggaggcuuccgucgaggaacccggcgaggaagccgccacaguugcugccacggaggaaggggaccaggagcaagauccugagcccgaagaggaagcugccguggagggagaagaggaggaagagggcgcggccaccgcugccgcugccccgggccacucugcggugccucccccuccuccccagcugcccccgcugcccccucuccccagaccucuuagcgaacggauuacacgcgaggaggucgaaggggagucccuggaccucugccugcagcagcuguauaaauacaacugucccucuuuucucgccgcugcccuggcuagagccaccagcgaugaagugcuucaauccgaccugucugcccauuauaucccgaaggagacagauggaaccgaaggcacaguugagauugagaccgugaaacucgcucggagcgucuucuccaagcugcacgaaaucugcuguagcugggugaaagacuuuccucuucgcagacggccccagcuguacuaugagacgucuauucaugcgaucaagaauaugcgcagaaagauggaagauaaacacguuugcaucccugacuucaacaugcucuuuaaucuggaggaucaggaggaacaggccuacuucgcuguguuugacgggcauggaggcgucgaugccgccauuuaugcuuccauccaucugcacgugaaccucgugcggcaagagauguucccccacgacccugccgaagcgcugugucgcgcuuuuagagucaccgaugagcgguucguucagaaggccgcccgcgaaagccuuagaugcgggacaaccggaguggugacauuuauucggggcaauaugcugcacgucgcuugggugggcgacucucagguuaugcucgugagaaaagggcaggccgucgagcugaugaagccccauaaaccggaccgcgaagaugagaagcaacggaucgaggcucuuggaggcugugugguuugguucggggccuggagagugaacggaucccugagcgucucucgcgcgauuggcgacgccgaacacaagccuuacaucugcggggaugcugacuccgccagcaccgugcucgauggaacggaggacuaccugauucuggcuugugauggcuucuaugacacagucaaucccgaugaagccgugaaaguuguguccgaccaccucaaggagaacaauggcgauucuagcauggucgcgcauaaacugguggccuccgcucgggacgccgggagcucugacaacaucaccguuaucguggucuuucuuagagauaugaauaaggcugugaacguguccgaggaaagcgacuggacagaaaauucuuuccagggaggccaggaagaugggggagacgauaaagagaaccacggcgaaugcaagcgccccuggccucaacaucagugcagcgccccggccgaccugggguacgauggccggguugacuccuuuaccgauagaaccucucucagccccggaucccagauuaauguccuggaggacccuggcuaucuugaucugacacagaucgaggcuagcaaaccccacucugcgcaauuccuccugccuguggaaauguuugggcccggagccccuaagaaggcuaaccugauuaacgagcucaugauggagaaaaaguccgugcagagcucucugcccgaaugguccggcgccggggaguucccgacggccuuuaaucuuggaagcaccggcgaacagaucuaccgcaugcagucccugucuccugucuguagcgggcucgagaacgaacaauucaaaucccccggcaaucgggugucuagacugagccaucugcgccaccacuauuccaagaaauggcaucgguuuagauucaacccuaaguuuuacagcuuccuuucugcucaggagcccucccacaagauuggaacaagccucucuucccugaccggcagcgggaaacggaaucgcaucagaucuagccugccguggcggcagaacuccuggaagggauauagcgaaaauaugagaaaacuccgcaagacacaugacaucccuugccccgaucugccuuggucuuacaaaauugaguga

SEQ ID NO: 74097 - RNA, 1365 nt, Artificial Sequence
  derived and/or modified sequence opt5 from PPM1F__Homo_sapiens__NP_055449
augagcuccggcgcuccccagaagucuagcccuauggcuuccggggccgaggaaaccccgggauuccuggacacacuccugcaagauuuucccgcgcuucugaacccugaggacccccucccuuggaaagcucccggcacggugcugucucaggaagaggucgaaggggagcuugccgagcuggccaugggauuccucggcagcagaaaggcuccuccgccccuggccgcugcccuggcgcacgaagccguuucccagcuccugcagaccgaucuuucugaguuucggaaacugccucgcgaagaggaggaagaggaagaggacgaugacgaagaggagaaggcucccgugacacuccuggaugcccaaagccuugcucaguccuucuuuaauagacugugggaaguggccgggcaguggcagaaacaagucccucucgcggcccgggcuagccagcgccaguggcuggugucuauccaugccauuagaaacacccggcgcaagauggaggacagacacguuucccugcccagcuucaaucagcucuuuggacugucugauccggugaaccgggcuuacuucgccgucuuugacggccauggcgggguggaugccgcucgcuaugcggccguucacgugcauacaaaugcugccagacaaccugaacuucccaccgacccugagggagcccugcgggaagccuuccgcagaacagaucagauguuucuccggaaggccaaacgcgagagacugcaguccggcaccacgggggucugcgcgcuuaucgcuggagccacccugcacguggccuggcucggcgacagccaagugauucugguccagcaggggcagguugugaagcugauggagccccaccggcccgaaagacaagacgagaaagcucgcaucgaagcccucggaggcuucgugucucauauggauuguuggcgggucaacggcacacuggcuguguccagagccauuggggacguuuuucagaagccuuacgugagcggagaggcggaugccgcuucccgcgcccuuaccggcucugaagacuaucugcuccuggcuugcgauggguucuucgacgucgugccgcaccaggagguugugggacuuguccagagccaucugacacggcaacagggcuccgggcucagaguggccgaggaacuggucgcggccgcucgcgagcggggaagccacgauaauaucaccgugaugguuguguuucugagagacccccaggaacuccuggagggcggcaaccagggggagggagauccucaagccgaaggccgccggcaggaccuucccucuucccugccugagcccgaaacgcaggcuccgccuagaagcuga

SEQ ID NO: 74098 - RNA, 1641 nt, Artificial Sequence
  derived and/or modified sequence opt5 from PPM1G__Homo_sapiens__NP_817092
augggcgccuaccugagccagcccaacaccgugaagugcuccggggacggagucggcgcuccuagacucccgcugcccuauggguucucugccaugcaaggauggcggguuagcauggaggaugcgcacaauuguaucccugaacuugacuccgagacagcuauguuuucuguguacgauggccaugggggagaagagguggcccuguauugcgccaaauaccuccccgacauuaucaaggaucagaaggcuuauaaagaaggcaaacugcagaaggcccuugaggacgcuuuccuggccauugaugcgaagcucacgaccgaggaagucaucaaagagcuggcccagauugcuggccgcccuacagaagacgaggaugagaaggaaaaaguggccgacgaggaugacguugauaacgaagaggcugcccugcuccacgaagaggcgaccaugacaaucgaggaacugcuuaccagauacgggcaaaauugucauaagggacccccucacagcaaauccggcgggggaacaggcgaggaaccggggucucagggacugaacggcgaggccggccccgaagacagcacccgggagacgccuucccaggagaaugggcccaccgcuaaggccuauacaggauuuagcucuaacuccgaacgcggcaccgaggcuggacaggugggggaaccuggcauccccacaggggaggccggaccgagcuguucuuccgccagcgacaagcucccuagagucgcuaaaucuaaguucuuugaagauuccgaggacgagagcgaugaagcggaggaagaggaggaagacuccgaggaaugcucugaggaagaggauggcuacagcuccgaggaagccgagaaugaagaggacgaagaugacaccgaggaggcugaagaggaugacgaagaggaagaggaggaaaugauggugcccggcauggaggggaaagaagaaccuggaagcgauucuggcacgacagccguuguggcccugauucgggggaagcaacuuaucgucgcuaacgccggagacucccgcugcguggugagcgaggcgggcaaagcucuggacaugucuuacgaucauaagcccgaagacgaggucgaacucgccagaauuaaaaaugccgggggcaagguuaccauggauggacgggugaacggcgggcugaaucugagccgcgcuaucggagaccacuucuauaagagaaacaaaaaucugcccccugaggaacagaugauuuccgcccucccggauaucaaggugcuuacacugaccgacgaucacgaguuuauggucauugcuugugacggcaucuggaacgugaugucuagccaggagguuguggauuucauccaguccaaaauuagccaacgggacgaaaauggggagcuccgccugcuuucuuccaucgucgaggagcugcucgaucagugccuggcccccgacaccagcggagauggcacagggugugacaacaugacgugcauuaucauuuguuuuaagccuagaaacaccgcggaacugcagcccgagucuggcaaacggaagcucgaggaagugcuguccacagagggagccgaagagaauggcaacagcgacaagaaaaagaaagcuaagcgcgauuga

SEQ ID NO: 74099 - RNA, 1545 nt, Artificial Sequence
  derived and/or modified sequence opt5 from PPM1H__Homo_sapiens__NP_065751
augcugaccagagucaagagcgccguggcuaacuucaugggcgggaucauggccggauccucuggcagcgagcacgggggaggcuccugcgggggaucugaccucccccugcgguuuccuuacggccgcccggaguuccuuggccugagccaggaugagguugaauguuccgcggaccauauugcuagacccauccucauucugaaagagacacggcgccuuccuugggccacgggguaugccgaagugaucaaugcuggaaagucuacccacaacgaggaucaagccagcugcgaggugcugacagucaaaaagaaagcuggcgccgugaccuccacacccaauagaaacagcucuaagcggcgcuccagccucccuaauggggaaggacugcagcugaaggagaacucugaauccgagggcguuagcugucauuacuggucucucuuugacgggcacgcgggauccggcgccgcuguggucgccagcagacugcuucagcaucacauuaccgagcagcugcaagauaucguggacauccucaaaaauuccgcuguucugcccccuacaugccuuggcgaagaaccggaaaacacccccgccaauucucggacgcugacccgcgcggccagccucagagggggagugggcgcuccugggucccccagcacaccucccacccgguucuuuacagagaagaaaauuccgcacgaaugucuggucaucggagcccuggagucugcuuucaaggagauggaucuccagauugaacgcgagagauccagcuauaacaucucuggcgggugcaccgcccugauugugaucugucuucugggaaaacucuacguggccaaugcuggcgacagccgggcgauuaucauccgcaacggcgaaauuaucccuauguccucugaguuuacgcccgaaacagagagacagcggcugcaguaucuugccuucaugcaaccucaucugcucgggaaugaguuuacccaccuggaguuccccagacgcguccagcggaaggaacugggaaagaaaaugcucuacagagauuuuaacaugacaggcugggcuuauaagaccauugaagacgaggaucugaaauucccccuuaucuacggggaaggaaagaaagcccgcguuauggccaccauuggcgugacacgggggcugggcgaccaugaucucaaggugcacgacagcaauaucuacaucaaaccuuuucuguccagcgcuccggaggucagaauuuaugaccuuucuaaguacgaucacggauccgacgaugugcugauccucgccacggacggccugugggauguucugagcaacgaggaaguggcggaggcuauuacccaguuccuccccaacugcgacccugaugacccccaucgcuauacacuggccgcccaggaucuugucaugcgggcuagaggggugcugaaggaccgcggauggcggaucucuaaugauagacucggcuccggggacgacauuagcguuuacgugaucccucugauccacggaaacaaacuguccuga

SEQ ID NO: 74100 - RNA, 1119 nt, Artificial Sequence
  derived and/or modified sequence opt5 from PPM1K__Homo_sapiens__NP_689755
augagcaccgccgcucugaucacacucgugagauccggcgggaaccagguccggcgcagaguucugcuuucuagccggcugcuccaagacgaucgcagagugacgccuaccugccacuccucuacaagcgagccccgguguucccgcuucgacccggauggaucuggcagccccgccaccugggacaauuuugggauuugggauaacagaaucgacgaaccuauucugcuucccccuuccaucaaguacggaaaacccauuccuaagaucagccuggagaaugugggcugcgcgucucagaucgggaaacggaaggaaaacgaggaucgcuucgacuuugcucagcucacagaugaaguccuguauuucgccguguacgacggacauggcggcccggccgcugccgauuuuugucacacccauauggagaaaugcauuauggaccugcuccccaaggagaagaaucuggaaacacuucugacccucgcuuuccuggagaucgauaaagccuuuuccagccacgcgagacuuucugccgacgcuacgcugcucaccuccgggacaaccgccacaguugcucugcugcgggacggaauugaacucguggucgccagcgugggcgauucucgcgcgauccuguguagaaaggggaaaccuaugaaacuuaccauugaccauacgcccgagcggaaggaugagaaggaacgcaucaagaaaugcggaggcuucguugccuggaacucccuggggcagccucacgugaauggaagacucgcuaugacacggagcauuggcgaccuggaucuuaagaccuccggcgucaucgccgagcccgaaacaaaaagaaucaagcugcaccaugcugacgauucuuuucucgugcugaccaccgacgggauuaacuucauggugaauagccaagagaucugugauuuugucaaccagugccacgacccgaaugaagccgcccaugcuguuacagagcaggcgauucaguauggaacggaggauaacuccaccgccgugguggucccuuucggcgcuugggggaaauacaagaauagcgaaaucaacuuuucuuucucccgcagcuucgccucuagcggacggugggccuga

SEQ ID NO: 74101 - RNA, 1083 nt, Artificial Sequence
  derived and/or modified sequence opt5 from PPM1L__Homo_sapiens__NP_640338
augaucgaggacaccaugacacugcucagccugcuuggcagaauuaugcgguacuuccugcuccgccccgaaacgcuguuucuucugugcaucucccucgcccuguggucuuauuucuuucacaccgaugaggugaagacaauugucaaaagcuccagagacgcuguuaagauggugaaagggaagguggccgaaaucaugcagaacgaucggcugggaggccucgacguccuggaggcggaguucucuaaaaccugggaguuuaagaaucauaacguggcuguuuacagcauucaagggcgcagagaucacauggaggaccgguucgaagugcuuacagaucuggccaauaagacccauccuuccaucuuuggaaucuucgacggccacgggggagagacagccgcugaauaugucaaaucucgccucccggaggcccugaagcagcaucuucaggauuacgagaaagacaaggaaaacagcgugcuguccuaucagaccauucucgagcaacagauccugagcauugauagagaaaugcuggagaaacucacgguuucuuacgacgaagcuggcaccacaugucugaucgcccuucuguccgauaaggaccucaccguggcgaaugucggcgacagccgcggggugcugugcgauaaggacggaaacgccauuccccuuucucacgaucacaaaccuuaucagcugaaggagcggaaaagaaucaagcgggcuggcggguuuauuuccuucaauggaagcuggcgcgugcagggcauccucgccaugucuagaucccugggggacuacccccugaaaaaccucaaugucguuaucccugaucccgacauucugacauuugaucuugacaagcugcaaccugaguucaugauccucgcuagcgauggacugugggacgccuuuuccaacgaagaggcggugcgguucauuaaagaacgccuugaugagccgcauuucggcgccaagucuaucgugcugcagagcuuuuacagaggcugucccgacaauauuaccgucauggugguuaaguuccggaacuccagcaaaacggaagaacaguga

SEQ ID NO: 74102 - RNA, 744 nt, Artificial Sequence
  derived and/or modified sequence opt5 from PPM1M__Homo_sapiens__NP_001116342
augggcgggugcaccgcccugguggcugucagccuccagggaaagcuguacauggccaacgcgggcgacuccagagcuauccuuguucggcgcgaugagauuagaccccugucuuucgaauuuacaccugagacggaacggcaacgcauccagcagcucgccuucguguauccggagcugcuugccggggaauuuaccagacuggaguucccccggcgccucaaaggagacgaucugggccagaaggugcuguuuagagaccaccauaugagcgggugguccuacaaacgggucgagaagucugaucucaaauauccucugauucacggacaaggccgccaggcuagacuucugggcacacucgccgugagccgggggcugggagaccaucagcuucgcguucuggauaccaauauccagcucaagcccuuccugcuguccgugccucaagucacagugcucgacguugaucagcuggaacuucaggaggacgauguggucgugauggcuaccgacggccugugggaugugcucucuaacgaacaggucgccuggcugguucggagcuuucuucccgggaaucaagaggacccucacagauucuccaagcuggcgcagaugcucauucauagcacacagggaaaagaggacucucugaccgaagagggccaaguguccuacgaugacgugagcgucuuugugaucccgcugcacucucaggggcaggaauccagcgaucacuga

SEQ ID NO: 74103 - RNA, 1203 nt, Artificial Sequence
  derived and/or modified sequence opt5 from PPME1__Homo_sapiens__NP_001258522
augagcgcccuggagaaguccaugcaccucggcagacugcccucucggccuccgcuucccgggagcggaggcucccagucuggggcuaaaaugcgcaugggaccuggcagaaagcgggacuucagccccgugccuuggucccaauacuuugaaucuauggaggaugucgaaguugagaacgaaaccgggaaagacacauuccgcguguauaagagcggauccgagggccccgugcugcuccugcuucauggcgggggacacagcgcccugucuugggcggucuuuacggcugccaucauuuccagagugcagugccggaucguugcccucgaucugcgcagccauggcgagaccaaagugaagaauccugaagaccugucugcugagacaauggccaaggaugucgggaacgugguugaagcuauguacggagaccucccgcccccuauuaugcugaucggccacuccaugggaggggccauugcggugcauaccgccagcucuaaucuuguccccucccugcucggccuguguaugaucgaugugguggagggcacagcuauggacgcccuuaacagcaugcagaauuuccugagagggcggccuaaaaccuuuaagucccucgagaacgcuaucgaauggucugucaaaagcggacagauucgcaaucuggaguccgccagaguuagcauggugggccaagugaagcagugcgaagggaucacaucucccgagggauccaaaagcauugucgaaggcaucauugaggaggaagaggaagaugaggaagggucugagagcaucuccaagcggaagaaagaggacgauauggaaggacugccgucugagacccagaaccuccugcuuuuccugcagacgaagaaagaccacccuuauaccuggcgcauugaacucgcgaagacagagaaauacugggauggcugguuuagaggccugagcaaucuuuuccuguccugucccaucccuaagcuccugcugcucgccgggguggaccggcuggacaaagaucuuaccaucggacaaaugcagggcaaguuucagaugcagguucugccccaaugcgggcacgcugugcaugaagacgcccccgauaaggucgcugaggccguggccacauuccucauucgccacagauuugcugagccuaucggaggcuuccaguguguuuuuccggggugcuga

SEQ ID NO: 74104 - RNA, 1434 nt, Artificial Sequence
  derived and/or modified sequence opt5 from PPOX__Homo_sapiens__NP_001116236
augggcagaaccguggucguucuugggggaggcaucagcgggcucgccgcuuccuaccaccugucucgggcccccugcccuccgaagguggugcuugucgagagcuccgaacgccugggaggcuggauuagaucugugcgggggcccaacggagcgaucuucgagcucggcccucgcggcauuagacccgcuggggcccugggagcccggacacuucugcucguuagcgaacugggccuggacuccgaggugcucccuguccgcggggaucaucccgcugcccagaauagauuucuguaugugggaggcgcucugcacgcccugccuacggggcuccggggacugcuucgcccgucucccccuuucagcaaaccccuguuuugggcgggccucagagaacugaccaagccucggggcaaagagcccgacgagacaguucauuccuucgcccaacgcagacuggggccggaaguggcuagccucgccauggauucucugugucggggagucuuugcuggcaacucccgcgagcuuagcaucagaucuugcuucccuucccuguuucaggccgaacagacccaccggagcauucuccuggggcuucugcucggagcgggcagaacaccccagccugacucugcccugauccgccaagcucuggccgagcgguggucccaguggagccucagagggggacuggagaugcuuccccaggcucuggaaacccaucucacaucccgcggcgugucugugcugcggggccagcccgucugugggcuuagccugcaagccgagggaagauggaagguuucccuccgcgauagcucucuggaagccgaccacgugaucuccgcuauuccugcgagcgugcugucugagcuccugccggccgaagcugcuccccuugcccgggcucugagcgccaucaccgcggucuccguggcuguugugaaucuccaguaccagggcgcccaucugccuguccagggguucggacaccuggugcccucuagcgaggauccuggcguucuugggauuguguaugacuccgucgccuuucccgagcaagauggcagcccgccuggacucagagugacggucaugcugggcgggucuuggcugcagacccucgaagccuccggaugcgugcugagccaggagcuuuuccaacagcgcgcccaggaagcugccgcgacacagcugggccucaaagagaugcccucucacugucugguucaucugcacaagaacugcaucccucaauacacccuugggcacuggcagaagcucgaauccgcccggcaguuucugacagcucauagacugccccucacccuggccggagcuagcuaugagggcguggccgucaaugacuguauugaguccgggcgccaggcggccgugucuguucuuggcacggaaccuaacagcuga

SEQ ID NO: 74105 - RNA, 1026 nt, Artificial Sequence
  derived and/or modified sequence opt5 from PPP1CA__Homo_sapiens__NP_001008709
augagcgacuccgagaagcugaaccucgauucuaucauuggcagacugcuugaagggagccgggugcugacaccccacugcgccccuguccagggaucccgcccgggcaaaaauguucaacucaccgagaacgaaaucagagggcugugucuuaagucucgggagauuuuccugagccagcccauccuccuggaacuggaggcuccucucaaaauuugcggagacauccauggccaguacuaugaucugcuucgccuguuugaguacgggggauuucccccugaauccaauuaucucuuucugggcgacuacguggauagaggcaagcagucucuugagaccaucugucugcuccuggccuauaaaauuaaguaccccgaaaacuucuuucugcuccgggggaaucacgagugcgcgagcaucaaccgcauuuauggauucuacgacgaguguaagagacgguacaauaucaaacuguggaagaccuuuacagauugcuucaacugucuuccuauugcugccaucguggacgagaaaauuuucugcugucauggcgggcuguccccggaucuccaaagcauggaacagauccgcagaaucaugcggcccaccgacgucccugaucagggacugcuuugcgaccugcucuggucugaucccgacaaggacgugcagggcuggggagaaaaugaucgcgggguuuccuucacauuuggcgccgagguggucgcuaaauuccugcacaagcaugaccuggaucucauuuguagagcccaccaagugguugaagacggcuaugaguuuuucgcuaagcggcagcuggugacccuuuucagcgccccuaacuacugcggggaguuugauaaugcgggagccaugaugucugucgacgaaacacugaugugcuccuuccagauccucaaacccgcugauaagaacaaaggcaaguaugggcaguuuagcggacugaauccgggcgggcgcccuauuacgcccccuagaaacucugccaaagcuaagaaauga

SEQ ID NO: 74106 - RNA, 1014 nt, Artificial Sequence
  derived and/or modified sequence opt5 from PPP1CC__Homo_sapiens__NP_001231903
auggccgaccuggauaagcucaacaucgacagcauuauccagagacugcuugaggugcggggcuccaaacccgggaagaauguccaacugcaggaaaacgagauucgcggacucugccugaaaucuagagaaaucuuccuuagccagccuauucugcucgagcuggaagcuccgcugaagaucuguggcgauauccacgggcaguacuaugaccuccugcggcuuuuugaguacggaggcuuucccccugaguccaauuaucuguuccucggggauuacguugaccgcggaaaacaaucucuggaaaccauuugccuucugcucgccuauaagaucaaguaccccgagaacuucuuucugcugagaggcaaucaugaaugugcgagcauuaaccggaucuauggcuucuacgaugagugcaaacgcagauacaauauuaagcucuggaaaacauuuacggacuguuucaacugccugccuaucgcugccauuguggaugagaagaucuuuuguugccacgggggacuuucccccgaccugcagucuauggaacagauccggcgcauuaugagaccuaccgaugugccggaccagggccuccugugugaucuucuguggagcgaccccgacaaagauguccucggguggggagagaaugaccggggcguguccuucacauuuggggccgaaguuguggcuaaguuccugcauaagcacgaucuggaccucaucugccgcgcccaucaagucguggaggauggauaugaauuuuucgcuaaaagacagcugguuacccuuuucagcgccccuaacuacuguggcgaguuugacaaugcgggcgccaugaugucuguggaugagacacugaugugcuccuuccagauucucaagcccgcugagaaaaagaaaccuaacgccacccggcccgucacaccgccucgcguggcuagcgggcugaaucccucuauccagaaggccuccaacuauagaaauaacaccgugcuuuacgaauga

SEQ ID NO: 74107 - RNA, 2823 nt, Artificial Sequence
  derived and/or modified sequence opt5 from PPP1R10__Homo_sapiens__NP_002705
augggcagcgggcccaucgacccuaaggagcugcucaaaggacuggauuccuuccuuaacagagacggcgaagugaagucugucgaugggauuagcaaaaucuuuucccugaugaaggaggcccggaaaaugguuucucgcugcaccuaccucaauauucugcuucagacaagaagcccggaaauccuggugaaguucauugacgugggaggcuauaagcuccugaacaauuggcugacguacuccaaaaccacaaacaauaucccccuccugcaacagauccuucugacccuccagcaccuuccucuuacagucgaucaucugaagcagaacaauaccgcuaaacucgugaagcaacugucuaaaagcuccgaggacgaggaacugcggaagcucgccagcguucuggugucugauuggauggcggucauucgcucccagagcucuacacagcccgcugagaaggacaaaaagaaaagaaaggaugaagggaaaucccggaccacgcuuccugagcgcccccugaccgaagugaaggccgagacaagagccgaggaagcuccugagaaaaagcgggaaaagccgaaaagccuccgcaccacagcccccucucacgcuaaguuuagauccaccggacuggagcuugaaacgccuagccugguucccgugaaaaagaacgccuccacagucguggugucugacaaauauaaucucaagccuaucccccugaagcggcagagcaacgucgcggccccgggcgaugcuaccccucccgccgagaaaaaguacaaaccucugaauacaacccccaacgcuaccaaggagauuaaaguuaagaucauucccccucaaccgauggaaggccucggguuccuggacgcccuuaauuccgcgcccgugccuggaaucaagauuaaaaagaaaaagaaagugcugagccccacagccgcuaagccuucucccuuugagggcaagacguccaccgaaccgagcacagccaaaccuucuagccccgagccugcucccccuuccgaagccauggaugccgaccgccccgggaccccggucccucccguggagguucccgagcucauggacacagcuucucuggaaccuggagcgcuugaugccaagccgguggagagccccggcgacccuaaccagcugaccagaaaagggcggaagcgcaaauccgucacguggcccgaagagggaaagcucagagaauauuucuacuuugagcuggaugagacagaacgggugaauguuaacaaaaucaaggacuucggcgaggcugccaagagagaaauccugagcgaucgccaugccuuugagaccgcucggagacucucucacgacaacauggaggaaaaagugccuugggucuguccccgcccucuggugcuucccuccccgcuggucaccccuggcagcaauucucaggagcgguauauucaggccgaaagagagaaggggauccuccaagaacuguuccugaacaaagagagcccccaugagccugaucccgaaccguacgagccuauucccccuaagcugaucccccucgacgaagagugcuccauggaugaaacacccuacguggagacccuggagccuggaggcuccgggggaucuccggacggcgcugggggaagcaaacugcccccuguucucgcgaaucugaugggcuccaugggcgccgggaagggaccccagggcccugggggaggcgggauuaacgugcaggaaauccuuacaucuaucaugggcagccccaauucccacccuagcgaggaacugcucaagcaaccggauuauucugacaaaauuaagcagaugcuggucccccacggacugcuuggcccugggcccaucgccaacggauuuccucccggcgggccgggaggcccuaaagggaugcagcauuucccucccggccccggaggccccaugccugggccgcacggaggccccgggggaccugugggcccccgccuccuggggccucccccgccuccccggggcggagacccuuuuugggauggccccggggacccuaugagaggaggccccaugcgcgggggaccgggcccugggcccggccccuaccaucggggaagaggcgggcgcggaggcaaugagccuccgcccccucccccucccuucagaggggcucggggaggccgguccggcgggggaccuccgaacggccgcgggggacccggcgggggaaugguuggcggcgggggacacagaccucacgaaggccccgggggaggcauggggaauagcucuggacaucggccucacgagggccccggcgggggaaugggcuccgggcauagaccgcacgagggaccuggcgggagcaugggaggcggcgggggacaucgcccccacgaaggccccgggggaggcauuucugggggaagcggccaccggccucaugagggccccgggggaggcaugggggccggaggcgggcacagaccucaugaaggaccgggcggcuccaugggagggagcggcgggcaccgcccccacgagggaccuggccaugggggaccccacggccauagaccucacgaugugcccggccaucgggggcacgaccaccgcggaccgccuccccaugagcacagaggccaugaugggccuggacacggcgggggcggacaucggggccacgacgggggacacucucauggcggggauauguccaaccgccccgucuguagacacuucaugaugaagggaaauugccgguaugaaaacaauugugcuuuuuaccauccuggcgugaacgggcccccgcugccuuga

SEQ ID NO: 74108 - RNA, 381 nt, Artificial Sequence
  derived and/or modified sequence opt5 from PPP1R11__Homo_sapiens__NP_068778
auggccgaggcuggcgccgggcugagcgaaaccgugaccgagacgaccgucacaguuaccacagaacccgagaacagaucccucaccaucaagcugcggaaacgcaagccugagaaaaagguggaauggacaucugacaccguggauaaugagcacaugggaagacggagcuccaaaugcuguugcauuuacgaaaagccgcgcgcguucggcgagucuagcacggaauccgacgaggaggaagaggaaggguguggacauacccacugcgucagaggccaucggaaggggcgcagacgggcuacacuuggacccaccccuacaacacccccucagcccccugauccgucucaacccccucccggcccuaugcagcacuga

SEQ ID NO: 74109 - RNA, 3093 nt, Artificial Sequence
  derived and/or modified sequence opt5 from PPP1R12A__Homo_sapiens__NP_001137357
augaagauggccgacgcuaaacagaagagaaacgagcaacugaaacgguggaucggcagcgaaaccgaucucgagcccccuguggucaagcgccagaaaacaaagguuaaguucgacgauggggccguguuucuggcggcuugcuccucuggagacacggaugaagugcuuaaacugcuccacagaggcgccgacauuaauuacgccaacgucgaugggcugaccgcccuucaucaggcuuguaucgacgauaauguggacaugguuaaguuccugguggagaacggagcuaauauuaaccagccggauaaugaaggcuggaucccccuccacgccgcggccagcugcggguaucuggacauugcugaguuucugaucggacaaggcgcccaugucggcgcugugaacuccgagggggauacaccucucgacaucgccgaagaggaagcgauggaggagcugcuucagaaugaaguuaaccggcagggaguggacauugaggccgcucgcaaagaagaggaaagaaucaugcugcgggaugcccgccaguggcucaauucuggccacauuaacgacgucagacaugcuaagagcgggggaaccgcccugcacguggccgcugcgaaaggcuacacagaggugcuuaagcugcucauccaagccggguaugaugucaauauuaaggacuacgauggauggacaccccugcacgcugccgcccauuggggcaaagaggaggcuugucggauccugguugacaaccucugcgauauggaaauggugaauaaggugggccagaccgccuucgacgucgcggaugaagacauucugggguaucuugaggaacugcagaaaaagcagaaccuccugcacuccgagaaacgcgauaagaaaucuccucuuaucgagagcaccgcuaacauggacaauaaccaaucccagaagacguuuaagaauaaagaaacccugaucauugagcccgaaaagaacgccagcagaaucgagucucucgaacaggagaaaguggacgaggaagaggaaggaaagaaagaugaguccagcuguucuuccgaggaagacgaggaagaugacagcgagucugaagccgagacagauaagaccaagccucuggcuuccguuacaaaugccaacaccagcuccacgcaagcugccccgguggcggucacaacccccacagugucuagcggccaggccaccccuaccucccccauuaaaaaguucccuacaacggcuaccaaaaucagccccaaggaggaggaacggaaagacgaaucuccggccacauggcgccuggggcucagaaagaccggauccuacggcgcucuggccgagauuacagcgagcaaggaagggcagaaagagaaggauaccgccggaguuacgcggucugcuagcuccccucgccuuucuagcucccuggacaauaaagagaaggaaaaagauagcaagggcacaagacucgccuauguggcucccaccaucccucggagacuggccucuaccuccgacaucgaggaaaaggagaaccgcgauagcagcucccuucggacaagcuccucuuacaccagacgcaaaugggaagacgaucugaagaaaaauagcuccgucaacgagggcucuacauaccauaagagcugcuccuuugggcggagacaggacgaccucauuucuucuuccgugcccagcacgaccucuacacccaccgucacauccgccgcuggacugcagaaaagccugcucucuagcaccuccacgaccacaaagaucaccacaggcucuagcuccgcggggacccaaagcuccacgucuaaucgccugugggccgaggauagcacagaaaaagagaaggacuccgugccuaccgcuguuacaauuccgguggcccccaccgucgugaacgccgcugccucuaccacaacgcuuaccacaaccacagcgggaaccguuagcuccacgacagaagugcgggagagacgccggucuuaucugaccccugucagagaugaggaaagcgagucccagcgcaaggcucggagcagacaggcccggcaaucucgcagauccacccagggcgugacacucaccgaccugcaggaagccgagaaaacaaucgggcggagcagaucuacgcgcacccgggaacaggagaaugaggaaaaggagaaagaagagaaggaaaaacaagauaaggagaagcaggaggagaaaaaggaauccgaaacaagcagagaggacgaauacaaacagaaguauucucgcaccuacgaugagacauaucagagauaccggcccguguccaccagcuccagcacgaccccuucuagcucccugucuacaaugagcuccucucuuuaugcuagcucccaacucaaccgccccaauucucugguuggcauuaccagcgccuacuccagaggaaucacaaaagagaacgaacgggagggcgaaaagcgcgaggaggaaaaggagggggaagacaaaagccagccgaagucuaucagagagcggcgcagaccucgggaaaaacgcagauccaccggagucagcuucuggacacaggauucugacgagaacgagcaagaacagcaguccgauaccgaggaaggcagcaauaagaaagagacgcagacagacuccauuucucgguacgaaaccagcuccaccagcgcgggggauagauaugacucucugcucggacgcuccggcagcuacucuuaucuggaggagcggaagcccuacagcuccagacuugaaaaggacgauucuacagacuuuaaaaagcuguaugagcaaauccucgcugaaaacgagaaacugaaggcccagcugcacgauaccaauauggaacuuacggaccucaaacugcagcuggagaaggccacacagcgccaagagcgguucgcugauagaagccuccuggaaauggagaaacgcgaacggagagcccuugagcgccggauuuccgagauggaagaggaacugaagaugcucccugaccugaaggcugauaaccagagacugaaagacgagaauggggcccuuauccgggugauuucuaagcucagcaaauga

SEQ ID NO: 74110 - RNA, 1548 nt, Artificial Sequence
  derived and/or modified sequence opt5 from PPP1R12B__Homo_sapiens__NP_001161329
auggccgagcuggaacaccucggcgggaagagagcugagagcgcccggaugcgcagagcggaacagcugcggcgcuggagaggaucccuuaccgagcaagaacccgcugagcggcgcggcgccgggagacagccucugacacggcgcggaucuccgagagugcgguucgaggacggcgccgucuuucucgcugccugcagcuccggggauacggacgaaguucgcaaacugcuugcuagaggagccgauaucaacaccgugaauguggacggccugacagcgcuccaucaggccuguauugaugagaaccuggacauggucaaguuccugguggaaaaucgggcuaacguuaaucagcaagauaacgagggcuggacaccccuccacgccgcugccucuugcggguaccugaauaucgcggaguauuuuauuaaccauggagccagcgugggcaucgucaauuccgaaggggaggugccuucugaccuugcugaagaacccgccaugaaagaucugcuccuggaacagguuaagaaacagggaguggaccuugagcagagccgcaaggaggaggagcaacagaugcugcaggaugcuagacaguggcucaacuccggcaagauugaagacguccggcaagccagaagcggggccaccgcucugcacguggcggccgcuaaaggauacucugaggugcugcgccuccugauccaggccggcuaugaacuuaauguccaggauuacgacggcuggaccccucugcaugccgcugcccacuggggaguuaaggaggcguguuccauccucgcugaggcccugugcgacauggauauucggaacaaacuugggcaaacacccuucgacguggccgaugaaggccugguggagcaccucgaacugcugcagaagaaacagaauguccucagaagcgagaaggaaacccgcaacaagcugaucgagucugaccuuaauuccaaaauucagagcggguuuuucaagaacaaagagaagaugcuguaugaagaggaaacgccuaaaucucaagagauggaggaagagaacaaggaauccagcuccucuagcuccgaggaagaggagggagaagaugaggcuagcgaaucugagaccgaaaaagaggccgacaagaagccggaggcuuuugugaaucauuccaacagcgaaucuaaaagcuccaucacagagcagauucccgccccugcgcagaauaccuucucugccagcuccgcucggagauuuagcucuggccucuucaacaagcccgaggaaccuaaagaugaaucccccagcucuuggcgccuggggcuucggaagacaggaucccacaauaugcugagcgagguugccaacuccagagagccgauccgcgaccggggcucuagcauuuacagauccucuagcuccccucgcaucagcgcucuccuggauaauaaagacaaggugcaguuuggccgggucugggggaacucuaaggccguguucuuuuuccaugaaaauuccauccugggaaccaacgagaauauuuucuga

SEQ ID NO: 74111 - RNA, 2349 nt, Artificial Sequence
  derived and/or modified sequence opt5 from PPP1R12C__Homo_sapiens__NP_060077
augagcggcgaggacgggcccgccgcuggaccuggcgccgcggcugccgccgcuagagaacggcgcagagagcagcugcggcaauggggcgcccgcgcuggagccgaaccgggccccggggagagacgggcgcgcaccgugagauucgaacgggccgcugaguuucucgccgcuugcgccggaggcgaucuggacgaggcgcgccuuaugcugagagccgcugauccuggccccggggccgaacucgacccugcugcucccccuccggcccgggccguccuggauuccacaaacgcggacggaaucucugcccuucaccaggcuuguauugaugagaaucuggaaguugugcgcuuccucguggagcagggcgccacggucaaccaggccgacaaugagggguggacaccccugcauguggcugccagcugcggauaccuggauaucgcgagauaucuccugucccacggcgcuaacauugccgccguuaauucugacggggaucuuccucuggaccucgcugaaagcgaugccauggagggacugcuuaaggcugaaaucgcccggcgcggcguggacgucgaggcggccaaaagagcugaagaggagcugcuccugcaugacacccgguguuggcugaacggcggggccaugcccgaagcuagacacccucgcaccggagccuccgcgcuccauguggccgcugccaagggcuacauugagguuaugcggcugcuucugcaagcuggguaugaucccgaacucagagacggagauggcuggacaccgcugcacgccgccgcucacuggggaguggaggacgcgugccgccuucuggccgaacaugggggcggcauggauucucucacccacgcugggcagcggccuugugaccuggccgaugaggagguccugagccuccuggaggagcuugccagaaaacaggaagaccugcgcaaucagaaggaggcuucccaaagccggggacaggaaccccaggccccuucuuccagcaaacauagacggucuuccgugugccgccucagcucuagagagaagaucucccugcaggaucuuagcaaggagcgccggcccggcggggcgggagggcccccuauccaagacgaagaugagggggaagagggcccgacagagcccccucccgcugaaccuagaacccugaacggaguguccucucccccgcacccuagccccaaauccccuguccagcucgaggaagcccccuuuagccggcgcuucggccugcugaagacggggucuuccggagcccucggcccucccgagagacggaccgcugaaggggccccgggagcgggccugcagagaagcgcuucuagcuccuggcuugaggggacaucuacccaagccaaagagcugcgccucgcccggauuacaccuacccccagccccaagcugccugaaccguccguucugagcgaggugacgaaacccccucccugucuugaaaauucuuccccucccagcagaaucccugagcccgaaucuccggcuaagccuaacgugcccacagccuccaccgcuccucccgccgacagccgcgacagacggcgcuccuaccagaugccggucagagaugaggagucugaaagccagcggaaggcgcgcuccagacucaugcggcagucucgcagaagcacacaaggcgugacccugaccgaccugaaagaggccgaaaaggcugccggaaaagcuccugaguccgaaaagcccgcccagagccucgauccuucucggcgccccagaguucccggcguggaaaauuccgacagcccugcccagcgggcugaggcgccggaugggcagggacccggcccucaagccgcuagagaacaccgcaaagucgggaaggaguggcggggacccgccgaaggcgaggaggccgaaccugcugacagaucucaggaguccagcacacuggaagggggccccucugcccgccggcagagauggcagcgcgaucuuaacccugagccggaacccgagagcgaggaaccugacggaggcuuucggacgcuguaugcggagcucagacgcgaaaaugagcggcugagagaagcucugaccgagacaacccuucggcucgcccaacugaaaguggagcuggaacgcgccacacagagacaggagcgguucgcugaacgccccgcccuccuggagcuugaaagauuugagcggagagcgcuggagcgcaaggcugccgaacucgaggaggaacugaaggcccuguccgaucuucgggcugacaaccagagacucaaagaugagaaugccgcucugauucgcguuaucagcaagcugucuaaauga

SEQ ID NO: 74112 - RNA, 3273 nt, Artificial Sequence
  derived and/or modified sequence opt5 from PPP1R13B__Homo_sapiens__NP_056131
augaugcccaugauccugaccguguuccucagcaacaaugagcagauucugacagaagucccuaucacgccggagaccacaugcagagacguuguggaauuuuguaaggagcccggcgaaggguccugccaccuugccgagguguggcggggaaacgagcgcccuauucccuucgaucauaugauguacgaacaucugcaaaaauggggcccuagacgggaggaagucaaguuuuuccuccgccacgaggacucucccaccgagaauagcgaacagggcggaagacagacacaggagcaacggacccagcgcaacgugaucaauguuccuggcgagaaaagaacagagaacggggugggaaauccgcgggucgaacugacccuuuccgagcugcaggauauggcugcccgccagcaacagcagauugagaaccagcaacagaugcucguggcgaaggaacagagacugcacuuucugaaacaacaggagcggcgccagcagcaaucuaucagcgaaaaugagaagcuccagaagcugaaagaaagaguugaggcucaggagaacaaacuuaaaaagauccgggccaugcgcggccagguggacuauuccaaaauuaugaauggcaaccugucugccgaaaucgagagauucagcgcuauguuucaagaaaagaagcaggagguccagacggccauucuccggguggaucagcugucccaacagcuugaagaccugaaaaaggggaaacucaauggauuccagagcuacaacggcaagcugaccgggcccgcugccguggagcugaaaagacucuaucaggagcugcaaauccgcaaucagcuuaaccaggaacaaaacucuaagcugcagcagcagaaagagcuccugaauaagcggaacauggaagucgcgaugauggauaagagaauuuccgagcuucgcgagcggcuguacggaaagaagauccaacucaauagaguuaacggcacaagcucuccucagagcccccuguccaccucugggcgcguggccgcugugggaccuuauauucagguccccuccgccggcagcuuuccggugcugggcgacccuaucaaaccccagucccucucuaucgcuagcaaugccgcgcaugggcgguccaagagcgccaacgauggaaauuggccuacacugaaacaaaacucuuccagcucuguuaagcccgugcaggucgcuggcgccgacuggaaggaucccagcguggaaggguccguuaaacagggaaccgugucuagccagccugucccguucuccgcucuuggccccacggagaagccugggauugaaaucggaaaagugcccccucccauuccgggcgucggcaagcaacugccucccagcuacgggacauauccuucucccaccccucucggacccggcuccacaagcucucuggagagacgcaaagaagggucccuuccgcggccuagcgccggacugcccuccagacagcgccccacccuccugccugccaccggcucuacaccgcagcccgggagcucccaacagauccagcagcggauuucugugccucccagcccuacguaucccccugcugggcccccggcguuuccugccggagacuccaagcccgagcugccucucaccguugcuaucagacccuuccuggccgauaagggcagccggccgcaaucuccucgcaaagggccccagacagucaauuccagcucuaucuacuccauguaccuucagcaggccaccccucccaagaacuaccaacccgcugcccacagcgcgcugaauaaaucugugaaggcuguguauggaaaaccuguucucccgagcggcuccacaagccccucuccucugcccuuucugcacgggucccuuagcaccggaacgccucagccccagccuccguccgagucuacagaaaaggagcccgaacaggacggcccugccgcccccgcugacgggagcaccguggagucccucccuagaccccugucuccgaccaagcugacaccuauuguccauagcccccuccgguaccaauccgaugccgaccuggaagcucuuagacgcaaacuggccaacgcgccccggccucucaagaaaagaucuagcaucaccgagcccgagggcccuggaggcccgaauauucagaagcugcuguaucagcgcuucaacacacuugccgggggaauggaaggcacgcccuucuaccagccuucccccagccaagauuuuauggggacccucgcugacguggauaauggaaacacaaacgccaauggcaaccuggaggaacugccucccgcucagccgaccgccccucuccccgcggagccugcccccucuuccgacgcuaaugauaacgaacugccuagccccgagccggaggaacuuaucuguccucagacaacccaccaaacggccgagcccgcugaagacaauaacaauaacguggccaccguucccacaaccgagcagauuccuucuccggucgccgaggcucccuccccuggggaagaacaggugcccccugcgccccugccuccggccagccaucccccugcuacaucuaccaauaaaagaacgaaccucaagaaacccaauuccgaacggacaggccacggacugcgcgugagauucaacccucuggcccuucuccuggaugccagccuggagggcgaauuugaccucguccagcggaucaucuaugagguggaggaucccuccaagccgaaugacgaagggauuaccccucugcacaacgcuguuugcgccggacaucaccauaucgugaaguuccuucuggacuuuggcgucaaugugaacgcggcugauagcgacggguggacaccccuccacugugccgccucuugcaacagcguucaucuguguaaacaacugguggaguccggagcugccauuuucgcgucuaccaucagcgauauugaaaccgcugccgacaagugcgaggaaauggaggagggcuacauccaguguucccaguuucuuuacgggguccaggaaaaacucggcgugaugaauaagggaguugccuaugcucugugggauuacgaggcccaaaacucugacgaacugagcuuccacgagggcgaugcucucacaauucugcgcagaaaagacgaauccgagacggagugguggugggcccggcuuggggaucgcgaaggauaugugcccaagaaucugcucggccuguacccuagaaucaagccccggcagcgcacccuggcguga

SEQ ID NO: 74113 - RNA, 2487 nt, Artificial Sequence
  derived and/or modified sequence opt5 from PPP1R13L__Homo_sapiens__NP_001135974
auggacagcgaggccuuccaguccgcuagagauuuucuggacaugaacuuccaaucucucgccaugaagcacauggaucugaaacagauggaacuugacaccgcggcugccaagguggaugagcugacaaaacagcucgaaagccugugguccgacucucccgccccuccgggcccccaggcugggccucccagccggccuccccgcuacuccucuagcuccaucccugagccguuuggaagcagaggcucuccccggaaggccgcuacggauggggccgacaccccuuucggacgcuccgaaagcgcgcccacacuucauccuuauucuccccuguccccgaaaggcagaccuagcucuccccggaccccucucuaccugcaacccgaugccuaugggucccuggaccgcgcuacaagccccagaccucgggccuuugauggagcuggcuccucucucggccgcgccccgagccccagaccugggcccggaccucugcggcagcaggggcccccgaccccuuucgacuuucuuggccgcgcgggaucccccagaggcagcccucuggccgaggggccccaggcuuucuuuccugagcggggacccucuccgcgcccucccgccacagcuuacgaugcccccgccuccgcuuucggcagcucucuccugggcagcgggggauccgcguuugccccuccgcuuagagcucaagacgaccugacccuccggagacggcccccuaaggccuggaaugaaucugaucuggacgucgccuaugagaagaaacccagccagacggcuuccuacgaacgccuggauguuuucgccagaccugcgagccccucucuccagcugcuuccuuggcgcgaguccagccuggacggccucgggggaaccggcaaggauaaccugacaucugcuacccuuccccggaauuauaaaguguccccgcuggccagcgacagacgcuccgaugccgggucuuaccggagaagccucggauccgcuggcccuucuggcacacugccccgcagcuggcagccugugucccggauucccaugccgccuagcucuccccaaccuagaggggcuccccgccagcggcccaucccucuguccaugauuuuuaagcuccagaacgccuucugggagcacggagccagcagagcgaugcugccgggcucuccccuuuucacccgggccccucccccuaaacugcaaccccagccucagccgcagccccaaccucagucccagccccagccucaacugcccccgcagccucagacgcagccccaaacacccaccccugcuccccagcauccucagcagacauggccgcccgucaaugaagggccucccaagccucccaccgagcucgaaccggagccugaaaucgagggacuucugacccccgugcucgaggccggcgacguugaugaagggccuguggcucgcccccugagcccuacaagacugcaacccgcccucccgccugaggcgcagucuguccccgaacuggaggaaguggcccggguucuugcugagauucccagaccucugaagcgccggggcagcauggagcaggccccggcuguggcccugcccccuacgcacaaaaagcaauaccagcagaucaucuccagacucuuucaucgccacggaggccccgggccuggaggccccgaaccugagcugagcccgauuaccgaagggucugaggccagagcuggacccccugcgcccgccccucccgcuccgaucccuccucccgcccccucccagagcucucccccugaacaaccgcaguccauggagaugcggagcguccuucgcaaagccggcucccccagaaaggcucggcgcgccagacucaacccucuggugcugcuccuggacgcggcucuuacaggggagcuggaagugguccagcaggccguuaaagagaugaaugaucccucucaaccuaacgaagagggcauuaccgcccuccacaaugcuaucugcggagccaacuauagcauuguggacuuccugaucacagcgggcgcuaaugugaacucccccgacucucauggguggaccccgcugcacugugccgccagcugcaaugauacggucauuuguauggcucuugugcagcauggagccgcuaucuuugccacaacccucuccgacggcgcgaccgccuucgagaagugcgauccuuaccgggaaggguaugcugacugugccacauaccuggcugauguugagcagagcaugggacugaugaacucuggcgccguguaugcccucugggacuacuccgcugaauuuggggaugagcugagcuuccgcgaaggcgagucugucaccgugcuuagacgggacggacccgaggaaacagauugguggugggcggcccugcacggccaggagggguauguuccucgcaauuacuuuggacucuuccccagagugaaaccucaacgguccaaggucuga

SEQ ID NO: 74114 - RNA, 363 nt, Artificial Sequence
  derived and/or modified sequence opt5 from PPP1R14A__Homo_sapiens__NP_001230876
auggccgcucagagacugggcaagcgggugcucagcaaacugcaaucccccucucgcgccagagggccuggaggcagccccgggggacuucagaagcggcacgcgcgcgucaccguuaaauacgacagacgggagcugcagcgcagacucgauguggaaaaguggaucgacggccggcuggaggaacuuuaucgcgggaugggacugcucaaauccugcggcaagccgguggaggauuucauucaggaacugcuggcuaagcuccaaggccugcauagacagccugggcuucggcagcccucuccuagccacgacggaucccugucuccccuccaggaucgcgccagaacagcccauccuuga

SEQ ID NO: 74115 - RNA, 444 nt, Artificial Sequence
  derived and/or modified sequence opt5 from PPP1R14B__Homo_sapiens__NP_619634
auggccgacagcggcaccgcugggggagccgcgcuggcugcccccgccccuggcccgggguccggaggccccgggccuagaguguacuuccagucucccccuggagcugccggcgagggccccgggggagcugaugacgaaggcccuguccggcgccaagggaagguuacagugaaauaugauagaaaggagcuccggaaacgccugaaccuugaagaguggauccuggaacagcucacgagacuguacgacugccaggaggaggaaauuccggagcuugaaaucgauguggacgagcugcucgauauggagagcgacgaugcccgggcggcccgcgucaaggaacugcugguggacuguuauaaacccaccgaggcuuuuauuuccggacuccuggauaagaucagaggcaugcagaaacuuucuacaccucaaaagaaguga

SEQ ID NO: 74116 - RNA, 498 nt, Artificial Sequence
  derived and/or modified sequence opt5 from PPP1R14C__Homo_sapiens__NP_112211
augagcguggccaccggcuccucugagacagcugggggagccagcggcgggggagcgagagucuucuuucagucuccccggggcggggcuggaggcuccccuggcagcuccucugggagcggauccagccgcgaagacucugccccgguugccacggcugccgcugccggccaagugcagcagcagcaacagagacggcaccagcaggggaaggugaccgucaaauacgaucgcaaggagcugagaaaacggcucgugcuggaagaguggaucguugaacaacuuggacagcuguauggcugcgaggaggaagagaugcccgaaguggagauugacaucgaugaccuccuggaugcggacuccgaugaggaacgcgccagcaaacuucaggaggcucuggucgacuguuacaagccuacagaagaguucauuaaggaacuccugucuagaauccgggggaugcgcaagcuguccccuccccagaaaaagagcguguga

SEQ ID NO: 74117 - RNA, 2025 nt, Artificial Sequence
  derived and/or modified sequence opt5 from PPP1R15A__Homo_sapiens__NP_055145
auggcccccggccaggcuccucaccaagccaccccguggagagacgcgcaucccuucuuucugcucagcccugugauggggcugcuuucccgggcuuggucucgccugagaggacucggcccccuggagccuuggcuugucgaagccguuaagggggccgcucugguggaggccggacucgaaggcgaggcucggacaccccuggccaucccucacacgccgugggggcgcagacccgaagaggaggcggaagauagcggaggcccuggcgaggaccgggaaacccuggggcucaaaacauccucuagccugcccgaggccuggggacuucuggaugacgaugacggcauguacggggagcgcgaagcuaccuccgugccuagaggacagggcucucaguucgccgaugggcagcgggcuccccucagcccgucccugcuuauucgcacacugcaaggaagcgacaagaacccuggcgaggaaaaagccgaggaagagggcgucgcggaggaagagggggugaauaaguuuucuuaucccccuucccauagagaaugcugucccgccguugaggaagaggaugacgaggaagcugugaaaaaggaggcccaccggaccagcacaucugcucucucccccggaagcaagccuucuaccugggucuccugcccgggcgaagaggaaaaccaggccacggaggauaaacgcaccgagagaagcaagggggcccggaaaacauccgugucuccccgcagcuccggaagcgacccuagaucuugggaauaccgguccggcgaggcuagcgaagagaaggaggaaaaagcgcauaaggagaccgggaagggagaagccgcucccggcccucagucuagcgcccccgcccagagaccgcaacugaaauccugguggugucagccuucugaugaggaagagggcgagguuaaggcucugggggccgcggaaaaagacggagaggcugaaugucccccuugcauucccccucccagcgccuuccucaaggccuggguguauuggccgggcgaggacacagaagaggaggaagaugaggaagaggacgaagauuccgacagcgggucugaugaggaggaaggagaggcugaagccuccagcucuaccccugcuacgggcgucuuucugaaauccuggguguaccagcccggggaggacacagaggaagaggaagaugaggacagcgauaccggcuccgccgaagacgagcgcgaggcggaaacaucugccagcacacccccugcuuccgccuuccuuaaggcuuggguguaucggccgggagaggauaccgaagaggaagaggacgaggacgucgauucugaagacaaagaggaugacagcgaagccgcgcugggcgaggccgaauccgauccccacccuagccaccccgaccagagagcucauuuucgcggguggggauaccggccuggcaaggagaccgaggaagaggaagccgcugaggauuggggagaggccgaacccugcccuuucagaguugccaucuaugugcccggggagaagccgccucccccuugggcucccccgcgccucccucugcggcuucaaagacgccugaaacggcccgaaacgccuacccacgaccccgaucccgagacaccucucaaggcgagaaaagugcgcuuuucugaaaaggucaccgugcauuuccuggccguuugggcuggcccggcccaggccgcucggcaggggcccugggagcaacuggccagagaccggucccgcuuugcgagacggaucacacaggcucaggaggaacucagcccuugucugacccccgccgccagagcucgcgccugggcgcggcuuagaaauccuccccuggcuccuauuccggcccucacgcagacacugcccucuuccagcgugccuucuagccccguccaaaccaccccucuuucccaggccguggcuacacccagcagaucuuccgccgcugccgcggccgcucuggaucucagcggccgccggggauga

SEQ ID NO: 74118 - RNA, 2142 nt, Artificial Sequence
  derived and/or modified sequence opt5 from PPP1R15B__Homo_sapiens__NP_116222
auggagcccggcaccgggggaagcagaaagcggcugggcccucgcgccggguucagauuuuggccgcccuucuuuccucggcgcucccaggcuggaucuagcaaauuccccacaccucucggccccgaaaacuccgggaauccuacgcugcuuucuagcgcccaaccggagaccagaguguccuacuggacaaagcugcucucucagcugcuugcgccccugccuggacuccugcagaaaguccugaucuggagccagcucuuuggcggcauguuccccacccgguggcuggacuuugcugggguuuauuccgcccuucgcgcccugaagggaagagaaaaaccugcugcccccacagcucaaaagagccucucuucccugcagcuugauagcucugacccguccgugaccagcccucuggauuggcucgaggaaggcauucacuggcaguacucucccccugaccugaagcuggagcucaaagccaagggguccgcgcuggaucccgccgcucaggccuuccuucuggagcaacagcucuggggaguggaacugcuucccagcucccugcagucucggcucuauagcaaccgcgagcugggcuccagcccuucugggccgcugaauauccagagaauugacaacuuuuccgucgugagcuaccuccugaaucccucuuaucuugauugcuucccucggcuggaaguuagcuaccaaaacuccgacggaaauucugagguggucggcuuucagacacucacccccgagagcuccugucugcgcgaagaucauugccacccucagccccuuagcgcugagcugaucccggccucuuggcaaggcuguccuccccucuccacggaagggcugccugagauucaucaccugagaaugaaacggcucgaguuccugcagcaggcgagcaagggacaggaccuucccaccccugaucaagacaacggcuaucauucucuggaggaggaacacucccuccugcgcauggaucccaaacacugcagagacaauccgacacaguuugugccugccgcuggggacauccccggaaacacccaggagagcacagaagagaagaucgaacugcuuaccacggagguuccccucgcccuggaggaagaguccccuucugaaggcuguccgagcuccgagauucccauggaaaaggagccuggggagggacggaucucuguggucgauuacagcuaccuggaaggcgaccuccccauuuccgcuagaccugccugcagcaauaaacugaucgauuauauucuuggcggggccucuuccgaccuggagacaagcucugaucccgaaggagaggacugggaugaggaagcugaggacgauggcuucgacuccgauagcucucucagcgacuccgaccuggaacaggauccugaggggcugcaucuuuggaacagcuucuguucuguggaccccuacaauccgcaaaacuuuaccgcgacaauccagaccgccgcucgcauugugccugaagaacccuccgauagcgagaaggaccucuccggaaaaucugaucuggaaaauagcucccagucuggcagccugccugagacccccgaacacuccucuggggaggaagacgauugggagagcuccgccgacgaggccgaaagccucaagcuguggaacucuuucugcaacuccgaugacccguauaauccucuuaacuuuaaagcucccuuccagacaagcggcgagaaugaaaagggaugucgggauucuaaaacgccuuccgagagcaucgucgccaucucugaaugccauacccugcucuccuguaagguucaacugcugggcagccaggaguccgagugccccgacagcgugcagagagaugugcuuucugggggacgccacacacacgucaagcggaaaaaggugaccuuucucgaagagguuacagaauacuauauuagcggcgacgaggacagaaaagggcccugggaggaguucgcgcgcgauggaugccgguuucagaagagaauccaagaaaccgaagacgcuauuggcuacugucugacguucgagcaucgcgaacggauguuuaacagacugcaggggacaugcuucaaaggccucaaugugcugaagcaguguuga

SEQ ID NO: 74119 - RNA, 315 nt, Artificial Sequence
  derived and/or modified sequence opt5 from PPP1R17__Homo_sapiens__NP_001138595
augaugagcaccgagcagaugcaaccccuggaacucuccgaggacagacuggauaaacuugacccucggugcucucaccugggcguguucagcgaacaucucaucaagcgcuacgauguccaggagagacacccgaaggggaaaaugauucccguucugcauaacacagaccuugaacagaagaaaccucggcgcaaggauacgcccgcccugcacauguccccuuuugcugccggagugacccuccugagagacgagcggcccaaggcgaucguggaggaugacgaaaaagauggcgacaagauugcuaucuga

SEQ ID NO: 74120 - RNA, 1842 nt, Artificial Sequence
  derived and/or modified sequence opt5 from PPP1R18__Homo_sapiens__NP_001128342
auggccaccauccccgacuggaagcugcagcuccuggcuagacggcgccaagaggaagccagcgugagaggccgggagaaagcggaacgcgagagacuuucccagaugccugcuuggaagcgggggcugcucgaacgcagacgggccaaacugggacuuucuccgggcgagcccagcccuguccuggggacaguugaggccggacccccugaucccgacgaauccgcugugcuccuggaggccauuggcccugugcaccagaaccgcuucaucagacaggaacggcaacagcagcagcaacagcagcagcgcucugaggagcugcucgcugaaagaaagccggggccccuggaggcccgggaacgcagaccuagccccggagagaugcgggaucaauccccuaaaggcagagaaucucgcgaggagcggcuuagccccagagaaacgcgcgagcggagacugggcauugggggagcgcaggaacucucccugcgcccgcuugaggcccgggacuggagacagagcccuggcgaagucggggaucgcuccucccggcugagcgaggcuuggaaguggagacucucucccggagagaccccugaacgcucccugcggcuggccgagagcagagaacaaucuccccggcgcaaggagguggaauccagacucagccccggcgaguccgcuuaccagaaacuggggcuuacagaggcccauaaguggcggccugacucuagagaaagccaggagcagucccugguucaacucgaagcgaccgaguggcgccugcggagcggagaggaaagacaggauuauucugaggaaugcggccgcaaagaggaauggccggugcccggcgucgccccuaaggagacagcugagcuuuccgaaacccugacaagagaggcccaggggaauagcucugcuggaguggaagccgccgagcagcggcccguugaagacggcgagcgcgggaugaaaccuaccgagggauggaaguggacgcucaacagcggcaaggcuagagaauggacaccccgggauaucgaggcgcaaacccagaaaccggaaccucccgaguccgccgaaaagcugcuggagucuccugggguggaggcuggagaaggcgaggccgaaaaagaggaggccggcgcucaggggcgcccccucagagcccugcagaauuguugcagcgucccuucuccccuuccgccugaagacgcgggaaccggcgggcugcggcaacaggaggaagaggcuguggaacuccagcccccucccccggccccucugagcccucccccucccgccccuacagcuccccagccgccuggagauccccuuaugucucgccuguuuuacggcgugaaggccgggccuggcgucggagcucccagacgguccggccacaccuucacgguuaacccgcgcagaagcgugccucccgccacacccgcgacccccacaucucccgccaccguggacgcugccgucccuggggcugggaaaaagcgguauccgaccgccgaggagauucucgugcugggcggguaccugagacucucccgcagcugucuggcgaaaggaucccccgaacggcaucacaagcaacuuaagaucucuuuuagcgagacagcccuggaaacgaccuaucaguacccuuccgagucuagcguucucgaagaacugggccccgagccugaagugcccuccgcuccuaauccgcccgccgcucagccugaugacgaggaagacgaggaggagcugcuucuccugcaacccgagcugcagggaggccucagaacaaaagcccugaucgucgaugaaagcugccgccgguga

SEQ ID NO: 74121 - RNA, 516 nt, Artificial Sequence
  derived and/or modified sequence opt5 from PPP1R1A__Homo_sapiens__NP_006732
auggagcaggacaacagccccagaaagauccaauucaccgugccucugcucgaaccgcaccuggaucccgaggccgcugaacagauucggcgcagacggccuacacccgccacgcuuguccugaccuccgaccagucuagcccugagaucgaugaagaccgcauucccaauccucaucucaaauccacacuggcgaugucuccgagacagcggaagaaaaugacccgcaucacacccaccaugaaggagcuucaaaugaugguugagcaccaucugggccagcagcagcaaggggaggaaccugaaggagcugccgagagcacaggcacccaggaguccagacccccugggauucccgauacggaaguggagucucggcucggaaccagcggcacagccaaaaagaccgcugaaugcaucccgaagacacacgagcgcggguccaaagaaccuagcaccaaggagcccucuacgcauaucccuccccuggacuccaaaggagccaacagcguguga

SEQ ID NO: 74122 - RNA, 615 nt, Artificial Sequence
  derived and/or modified sequence opt5 from PPP1R1B__Homo_sapiens__NP_115568
auggaccccaaggaucggaaaaagauccaguucagcgugccugccccgcccucccaacuggacccuagacaggucgagaugauucgcagacggcgccccaccccugcuaugcucuuuagacugucugaacacagcucccccgaggaagaggccucuccucaucagcgggcgagcggcgaagggcaccaucuuaaauccaagcgcccgaaccccugcgcuuacacaccucccucucugaaagccguucagagaaucgccgagagccaccuccaauccauuagcaaucugaacgagaaucaggcuucugaagaggaagaugagcuuggagagcugcgggaacucggcuauccucgcgaggaagacgaggaagaggaggaagaugacgaggaagaggaagaggaggaagauucccaggccgaggugcugaaggugaucagacagagcgcugggcaaaagacgaccuguggacagggccuggaagggcccugggagcggccgccuccccucgacgaaucugagcgcgauggaggcuccgaggaccaggucgaagauccugcccugagcgagcccggcgaggaaccccagagaccuucuccguccgagcccgggacauga

SEQ ID NO: 74123 - RNA, 618 nt, Artificial Sequence
  derived and/or modified sequence opt5 from PPP1R2__Homo_sapiens__NP_006232
auggccgcuagcaccgccucccacagacccaucaagggcauucugaagaacaagacaucuacgaccagcuccaugguggcgucugcugagcagccucgggggaaugucgacgaggaacucagcaaaaagucccaaaaaugggaugaaaugaacauccuggccacauaccauccggccgacaaggauuauggacuuaugaagauugacgagcccucuaccccuuaccacagcaugaugggcgaugacgaagaugcuugcuccgacacagaggccaccgaggcuauggcccccgauauccuggcgcgcaaacucgccgcugccgaagggcuggagccuaaguaucggauucaggaacaggagagcucuggagaggaagacuccgaucuuagccccgaggaaagagagaaaaagcgccaguucgaaaugaaaagaaagcugcauuacaaugagggccucaacaucaagcuggcucggcaacugaucucuaaagaccuccacgaugacgacgaggaugaagagaugcuggaaacagccgacggggaguccaugaauaccgaagagagcaaccagggaucuacgccuuccgaucagcagcaaaauaaacuucgcagcuccuga

SEQ ID NO: 74124 - RNA, 3369 nt, Artificial Sequence
  derived and/or modified sequence opt5 from PPP1R3A__Homo_sapiens__NP_002702
auggagcccagcgaagugccuucccagaucucuaaggacaacuuccuggaggucccgaaucucagcgauucccugugcgaagacgaggaaguuaccuuucaacccggcuucucuccucagcccagcagacggggguccgauucuagcgaggacauuuaccuugauacaccuuccagcggaacgcgcagagugucuuuugccgacuccuucggcuuuaaccuggugagcgucaaagaguucgauuguugggaacuccccucugcuuccaccacauuugaccuggggaccgauaucuuccacacagaggaauaugugcuugccccucuguuugaccucccgagcucuaaggaggaucugaugcagcagcugcaaauucagaaagcgauccucgaguccaccgaaagccugcuuggauccacaucuauuaagggcaucauccggguucugaaugugagcuucgagaaacucgucuacgugcgcaugucccuggacgauuggcagacccauuaugacauucuugcugaauacguucccaacagcugcgacggggagacggaucaguuuucuuucaagaucgugcuggucccucccuaucaaaaggacggauccaaaguggaauuuuguauuagauacgagaccagcgugggcacauucuggucuaauaacaauggcaccaacuauacauucaucugccagaagaaagagcaggaaccugagcccgucaagccguggaaagaaguuccuaaucggcagauuaaggggugucucaaggugaaaagcuccaaggaggaaucuagcgugaccuccgaggagaacaauuuugaaaaccccaaaaauacggauacauacaucccuaccauuaucugcagccacgaggacaaggaagaucuggaggccucuaaccgcaaugucaaagacgugaacagagaacaugaugagcacaacgagaaggaacuggagcucaugaucaaucaacaucugauucggacacgcuccaccgccagcagagacgaacggaacaccuucucuacagaucccguuaauuuucccaacaaagcugagggacuugagaagaagcagauccacggcgaaauuuguacggaccuguuccagcgcucccucagcccuuccucuagcgccgaguccucugugaaaggggauuuuuacugcaaugaaaaguauagcuccggagacgacuguacccaccaaccgagcgaggaaacaaccucuaacaugggcgagaucaaacccucccugggggauacaagcucugacgagcuuguccagcugcauaccggauccaaggaagugcucgaugacaaugcuaacccugcccacggcaauggcacgguucagauucccugcccuagcucugaucagcugauggcggggaaccugaauaaaaagcaugagggaggcgccaagaacaucgaagugaaagaccucgggugucugagacgggauuuccacagcgacacauccgcuugccuuaaggagagcaccgaagagggaucuuccaaagaggauuacuauggcaaugggaaggacgaugaagaacaacgcaucuaccugggagucaacgaaaaacagagaaagaauuuucagaccauucuccacgaccaggagcggaagaugggcaaccccaaaaucagcguggccggcauuggggcuuccaacagagaucuggccacacuucugucugaacauaccgcgaucccgacacgcgccauuacggcugacgucagccacuccccucggaccaaucucucuugggaggaggccgugcugacacccgaacaucaccaucugaccagcgagggauccgcucucggcgggaucacaggacaaguuugcucuagcagaaccggcaacgugcugcgcaaugacuaucuuuuccaggucgaagagaaguccgggggcaucaacagcgaggaucaggacaauucuccucagcacaaacaauccuggaacgugcuggaaagccagggaaagucucgggagaauaaaacgaacauuaccgaacacaucaagggccagacagauugugaggacguuugggggaagagagauaauacccgcucccucaaagccacaaccgaggagcuguuuacgugccaggagacaguguguugcgaacugagcucucuugccgaccauggaauuaccgagaaggcugaagcgggcacagccuacaucauuaaaaccaccuccgagagcacacccgaauccaugagcgcucgggagaaggccaucauugccaaacucccucaagagacggcuagaucugaucgccccaucgaagucaaggagaccgccuucgacccgcacgaagggcggaacgaugacagccauuauacacugugucagagagauaccgugggagugaucuacgacaaugauuuugagaaagaaucccgccugggcauuugcaacguucgggucgacgagauggagaaggaagagacaaugucuauguacaauccuagaaagacccacgaccgggaaaaaugugggacgggcaacaucacaagcguggaggaguccucuugggugauuaccgaauaucagaaggcgaccagcaaacucgaucugcaacuuggaaugcugcccacagacaagaccgucuucuccgagaaucgcgaucucagacaggugcaggaacugucuaaaaagacagacagcgaugcuaucguucacuccgccuuuaacagcgacacgaaccgggcuccccaaaauucuuccccuuucagcaagcaucacaccgagauuucuguguccacaaacgaacaggccaucgccgucgagaaugcugugaccacaauggccagccagccgaucuccaccaaaucugagaacauuugcaauagcacgagagaaauccagggcauugagaagcaucccuacccugaauccaaacccgaggaaguuagccggucuuccgggaucgugaccagcggaucucgcaaggagagauguauuggccagaucuuccaaacagaggaauauagcgucgagaaaucccuggggccuaugauccuuauuaacaagccccucgaaaauauggaggaagcgcgccacgagaacgagggacuggugucuagcggccagucccuguacaccucuggggaaaaggagagcgauuccagcgccucuacaucccucccuguugaagagagccaggcucagggcaaugagucccuguuuucuaaauauaccaacagcaagauccccuacuuccuucuguuucucauuuuccugaucacaguguaucauuacgaccugaugauuggacuuaccuuuuacguccucucccugucuuggcugagcugggaagagggcagacaaaaagaauccgugaagaaaaaguga

SEQ ID NO: 74125 - RNA, 858 nt, Artificial Sequence
  derived and/or modified sequence opt5 from PPP1R3B__Homo_sapiens__NP_078883
augauggccguggacaucgaguacagauauaacugcauggcucccagccugcggcaggaacgcuucgccuuuaagauuuccccuaaaccgucuaagccccucagaccuuguauccaacugagcuccaaaaaugaggcgucuggcauggucgcucccgccguucaggaaaagaaagugaagaagcgggugagcuucgccgauaaccaggggcuugcucugaccauggucaaaguguuuuccgaguucgacgauccucucgacaugcccuuuaauauuacagaacugcuugauaacaucguuucucugacgaccgccgagagcgaguccuucgugcucgacuuuagccagccuucugcugauuaccuggacuuccgcaauagacugcaagccgaucacgucugccucgaaaacugugugcugaaggacaaagcgauugccggaacaguuaaggugcagaaucuugcuuuugagaaaaccgucaagauccggaugacauucgauaccuggaaguccuauacagacuuuccgugccaguacgugaaagauaccuaugccggcagcgaccgcgacacguucucuuuugauaucucccugcccgaaaagauucagagcuacgagagaauggaguucgcuguguauuacgaauguaacgggcaaaccuacugggacucuaaucggggcaaaaacuaucgcaucauuagagccgagcucaaguccacacagggaaugaccaaaccucauagcgggcccgaucugggaaucuccuucgaccaguuuggcucuccucggugcagcuacggccuuuuccccgaauggccguccuaucugggguacgagaagcucggaccuuauuacuga

SEQ ID NO: 74126 - RNA, 954 nt, Artificial Sequence
  derived and/or modified sequence opt5 from PPP1R3C__Homo_sapiens__NP_005389
augagcugcaccagaaugauccaggugcuggacccccggccucucacauccucugucaugccgguugauguggccaugcgccugugucuugcucacagcccucccgugaaguccuuccugggccccuacgacgaguuucaaagacggcauuucgucaacaaacucaagccucugaaaucuugccuuaauauuaagcacaaagccaagagccagaacgauuggaaguguucccauaaucaggcgaaaaagcgcgugguuuuugcugacucuaaagggcugagccucacggccauccacguguucuccgaucugcccgaggaaccugccugggaccugcaguuugaucuccuggaccuuaacgauauuagcucugcucugaagcaucacgaagagaaaaaucucauccuggacuucccgcaacccuccaccgauuaucuuagcuuuagaucucacuuccagaagaacuuugucugccuggaaaauuguucccuccaggagcggacagugaccggaacaguuaaggugaaaaacgucagcuucgagaagaaagugcagauucgcaucaccuuugacucuuggaagaauuacacagauguggacugcgucuauaugaaaaacguuuacggcgggaccgacuccgauacguucagcuuugccaucgaccugccucccgugauuccuaccgaacaaaagaucgaguucuguauuuccuaucaugcuaauggacagguguucugggauaacaaugacggccagaacuacagaaucguccacgugcaguggaaacccgaugggguucaaacacagauggccccgcaggacugcgcguuucaucaaaccucuccuaagacagaacuggagagcaccauuuucggaagcccccggcucgccuccggccuguuuccugaguggcagucuuggggccgcauggaaaaucuugcuuccuauagauga

SEQ ID NO: 74127 - RNA, 687 nt, Artificial Sequence
  derived and/or modified sequence opt5 from PPP1R42__Homo_sapiens__NP_001013648
auggugagacugacccucgaccugaucgcccggaacagcaaucuuaagccccgcaaagaagaaacaauuucccagugccugaagaaaaucacgcacauuaacuucucugauaagaauaucgacgcuauugaggaucucagccuguguaaaaaccuuuccguccuguaccucuaugacaauugcaucucucaaaucaccaaccugaauuacgccacaaaccugacccaucucuaucugcagaauaacuguauuagcugcaucgaaaaucuuagaucccugaagaagcucgagaaacuguaccuuggcgggaacuauauugcgguuaucgaaggacuggagggccucggggagcugcgggaacugcacguggagaaucagcgccucccucugggagaaaaacuucuguuugauccgagaacacuccauucucuggcuaagagccuuuguauucugaacaucuccaauaacaacauugacgauaucaccgaccucgagcugcuggagaaucucaaccagcugaucgccguggauaaucaacuucugcacgucaaggaccucgaguuccugcuuaacaaacugaugaagcucuggaagauugaucugaauggcaaccccgugugccugaaaccuaaguaccgggaccgccucauccugguuagcaaaucucuugggacauaucuguacuga

SEQ ID NO: 74128 - RNA, 954 nt, Artificial Sequence
  derived and/or modified sequence opt5 from PPP1R7__Homo_sapiens__NP_001269338
auggccgcugagagaggcgccgggcagcaacagagccaggaaaugauggaggaggaacacgaacugcccguggacauggagaccaucaaccucgaucgggacgcggaggaugucgaccugaaucauuaccgcauuggaaagaucgaaggcuucgagguucuuaaaaaggugaaaacacugugccucagacagaaccugauuaaguguaucgaaaaucuugaggagcugcaaucccuccgggaacuggaucuguaugacaaccagauuaaaaagaucgagaaucucgaagcucugacggagcuugaaauccuggauauuucuuuuaaccuccugcgcaauaucgaggggguggacaaacuuaccagacugaagaaacucuuccuggucaacaauaagauuagcaagaucgagaaccuguccaaucuccaccagcugcagaugcuugaacugggaucuaaccggauucgcgccaucgagaauauugauacacucaccaaccuggaaagccuuuuucugggcaaaaauaagaucacaaagcuccaaaaccuggacgcccugaccaaccucacagugcuguccaugcagucuaauagacuuaccaaaaucgaggggcugcagaaccucguuaaucugcgggaacuuuaccugagccauaacggaauugaggugaucgagggccucgaaaauaacaauaagcugacgaugcuggauauugcuuccaaccgcaucaaaaagauugagaauaucagccaccucaccgaacugcaggaguucuggaugaacgacaaucuucuggaaucuugguccgaucucgacgagcugaaaggcgccagaagccuggagacagucuaucuugaacggaacccucuccaaaaggacccgcaguaccgcagaaaagugaugcuggcucugcccucuguucggcagaucgaugccaccuuugugcgcuucuga

SEQ ID NO: 74129 - RNA, 4125 nt, Artificial Sequence
  derived and/or modified sequence opt5 from PPP1R9A__Homo_sapiens__NP_001159632
augcugaagaccgagagcuccggcgaaagaacaacgcuccggucugccagcccccaccgcaacgcuuacagaaccgaguuccaggcccugaaauccacauuugacaagccuaaaucugauggggaacaaaagaccaaagagggagaaggcagccagcagucccgggggcgcaaguauggaucuaaugugaacagaaucaagaaucuuuucaugcagaugggcauggagccgaacgagaaugcggcugucauugccaaaacacgggggaagggaggccauagcagcccccaacgcagaaugaaaccuaaggaauuucuggagaaaaccgacggcuccguugugaagcucgaaucuuccgugagcgagcggaucucucgcuucgauacaauguacgacgggcccuccuauagcaaguuuaccgagacgagaaaaauguucgaacggucuguccacgaguccggacagaacaaucgcuacagcccuaagaaagaaaaggccggcggguccgagccccaggaugaauggggaggcucuaaaagcaacagaggguccaccgacagccuggauucucuuuccagccggacagaggcugugucuccuaccguuagccagcuguccgccguguuugagaauacagacucuccgagcgcuauuaucuccgaaaaggccgagaacaaugaauauagcgucaccggacauuacccccucaaccugccuucugugacgguuacaaaucuggauaccuucggccaccucaaagacuccaacagcuggcccccuucuaauaagcgcggcguggauacagaggacgcgcauaaguccaacgccacccccgucccggaaguggcuagcaaauccaccucucuggccagcauuccuggggaggagauccaacaguccaaggaacccgaggauucuacaagcaaccagcagacgccugacuccaucgacaaagauggacccgaggaacccugcgcugaaagcaaggccaugccuaaaucugagauuccgagcccccaaucccagcuucuggaggacgcggaagccaaucucgugggcagagaggcugccaagcagcaacggaaggaacuggcugggggagauuuuaccucuccugacgccuccgccagcucuuguggcaaagagguccccgaggauagcaacaauuucgacgggucccacguuuauaugcacagcgauuacaacguguacagagugcgcucucgguauaauuccgacuggggagaaacaggcaccgagcaggaugaagaggaagacagcgaugagaacuccuacuaucagccugacauggaguacucugaaaucgucggccuucccgaggaagaggaaauuccggcuaauagaaagaucaaauuuagcuccgcgccuauuaagguguucaacacauauucuaaugaggacuacgaucgccggaacgacgagguugaucccguggccgcuagcgccgaauaugagcuggagaaaagagucgaaaagcucgaacuguuuccuguggagcuggagaaggacgaagaugggcucggaaucuccauuaucggcauggggguuggagccgacgcuggccuggagaaacuugggaucuucgugaagaccgucacggaaggcggagccgcgcagcgcgauggccggauucaagugaaugaccagaucgucgagguggaugggauuucucugguuggagugacacagaacuucgcugccaccguccucagaaauaccaaaggcaacgugcgcuuuguuaucgggcgggagaagcccggacaggugagcgaagucgcccaacugauuucccagacacuugagcaggaaagacgccagcgggagcugcucgaacaacauuacgcucaguacgacgccgaugacgaugagaauaccguggcugagcugcagggcaugagcgggaacugcaacaauaacaauaacuauuuccugaaaacaggcgaauacgccacggacgaggaagaggacgaagugggaccuguucuccccggcucugauauggcgaucgaggucuuugagcugccggaaaaugaggacauguucuccccuagcgaacuugauaccucuaagcugucccacaaguuuaaagagcuccagaucaagcaugccgugacagaagcugagauucaaaaacugaagaccaaacuucaggccgcugagaacgaaaaggugagaugggagcuggagaaaacacagcuccaacagaauaucgaagagaacaaggaacggaugcugaagcuggagagcuauuggauugaagcccagacccucugucacacggucaaugagcaccugaaagaaacccagucucaauaccaggcgcuugagaagaaauauaacaaggccaaaaagcugaucaaggacuuccagcagaaagagcucgauuuuauuaagcgccaagaagcugagcggaaaaagaucgaagaccuggagaaagcccaucugguggaaguucaggggcuucaggugagaaucagagaucucgaggcugaggucuuccgccugcugaagcagaauggaacacaagugaacaauaacaauaacauuuuugaacggagaaccucccucggcgagguuagcaagggggacacaauggaaaaccuggauggaaaacagaccuccugccaggacggccuuagccaagaucugaaugaggccgugcccgaaacggagcgccucgacucuaaggcccugaaaacaagagcucagcugagcgucaagaaccggcgccagagacccucccggacccgccuuuacgauucugugagcuccacagacggggaggacucucucgaaagaaaaccuagcaauuccuucuauaaccacaugcauaucaccaagcugcugccgcccaagggccuccggaccucuagcccugaguccgauagcggaguucccccucugacacccguggacucuaaugucccuuuuuccagcgaucacauugcggaauuucaggaggagccccuugacccggaaaugggcccucugucuuccauguggggagauacgagccucuucuccaccucuaaaagcgaccaugauguggaggaaucccccugucaccaccaaacaaccaacaagaaaauccugcgcgagaaggacgaugccaaagacccuaagagccugagagcuucuuccagccuugccgugcaagggggcaaaauuaagcggaaguucgucgaucucggggcuccccugcgcagaaauucuagcaaaggaaagaaauggaaggaaaaagagaaggaggccucccgguucucugccggcagcagaaucuuucgcgggcggcuggaaaacuggacaccgaagccuugcuccaccgcgcagacgucuacaagaagccccuguaugccuuucuccugguuuaaugacagccgcaaaggcucuuacuccuuccggaaccuccccgcucccaccagcucccugcagccuucuccggagacccuuauuagcgacaagaaaggauccaagguugaaaauacauggaucaccaaagccaacaagagaaaucccaacccuucuagcuccagcaucuuuggccgccauucucagcugauguccgugguguggauucaggagacaaauaacuucacguuuaacgaugacuucagccccucuuccaccagcucugccgaucucagcgggcugggagcugaaccuaagacacccggccugucccagucucuugcccucagcuccgacgagauccuggaugacgggcagagcccuaaacacucccaaugccagaaucgggcgguccaggaguggucugugcagcaaguuagccauuggcugaugucccucaaccuggaacaguacgugucugaguuuagcgcucagaauauuaccggagaacaacuucugcagcucgauggcaacaagcugaaagcccugggcaugacagccucccaggacagagcugucgugaagaaaaagcugaaggagaugaaaaugucucuugaaaaggcccgcaaagcucaggagaagauggagaaacaacgggaaaagcucagacggaaggagcaggaacagaugcagcgcaaaagcaagaaaaccgagaagaugacguccaccacagccgagggggcgggagaacaauga

SEQ ID NO: 74130 - RNA, 930 nt, Artificial Sequence
  derived and/or modified sequence opt5 from PPP2CA__Homo_sapiens__NP_002706
auggacgagaagguguucaccaaagaacuggaucaguggaucgagcaacucaacgaaugcaagcagcugagcgagucccaggucaaaucucuuugugaaaaggccaaagagauucugacaaaggagagcaauguucaggaagugagaugccccgugacggucuguggcgacgugcacgggcaauuucaugaucucauggagcuguuccggaucggaggcaaguccccugacaccaacuaccuuuuuaugggggauuauguugaccgcggauacuauucuguggaaacagucacccugcucguggcucugaaaguuagauaccgggagcgcauuacaauccugagaggcaaucacgagagccggcagauuacccagguguauggguucuacgaugaaugccuccgcaaguauggaaacgccaaugucuggaaauacuuuacagaccuguucgauuaccuuccgcugaccgcgcucguggacggccagaucuuuugucugcauggcgggcuuucccccucuaucgauacgcuggaccacauuagagcucucgaucggcugcaagaggugccucaugaaggacccaugugcgaccugcucuggagcgacccugaugaccgcggcggguggggaaucucccccagaggcgccggguauaccuucggacaggauauuagcgagacauuuaaccacgccaauggccugacccuugucucucgggcucaccagcugguuauggaaggcuacaacuggugucaugaccgcaauguggugacaaucuucuccgccccuaacuauugcuacagaugugggaaucaggcugccauuauggagcucgaugacacccugaaguauagcuuucuucaauucgauccggcgccccggcgcggagagccucacgucacgagacggacacccgacuacuuucuguga

SEQ ID NO: 74131 - RNA, 930 nt, Artificial Sequence
  derived and/or modified sequence opt5 from PPP2CB__Homo_sapiens__NP_001009552
auggacgauaaggccuucaccaaagagcuggaccaguggguggaacaacucaacgagugcaagcagcugaaugaaaaccaggucagaacacuuugugagaaagcuaaggaaauccugacgaaagagagcaauguucaggaggugcggugccccgugaccgucuguggcgaugugcacgggcaauuucaugaccucauggaacuguuccgcauuggaggcaaguccccugauacaaacuaccuuuuuaugggggacuauguugauagaggauacuauucuguggagaccgucacacugcucguggcccugaagguucgguacccggaacgcaucaccauucugagaggcaaucacgagagccggcagaucacacagguguauggguucuacgacgagugccuccgcaaauauggaaacgcgaaugucuggaaguacuuuaccgaucuguucgacuaccuuccccugacggcucucguggauggccagaucuuuugucugcauggcgggcuuuccccuucuauugacacccuggaucacaucagagcccucgaccggcugcaagaagugccccaugagggaccuaugugcgaccugcucuggagcgaucccgacgaucgcggcggguggggaauuuccccuagaggcgccggguauacauucggacaggacaucucugaaaccuuuaaccacgcuaauggccugacacuugucagccgggcccaccagcugguuauggagggcuacaacuggugucaugaucgcaauguggugaccauuuucuccgcuccgaacuauugcuacagaugugggaaucaggccgcgaucauggaacucgacgauacgcugaaauauagcuuucuucaauucgaccccgccccucggcgcggagagccccacgucacaagacggaccccugauuacuuucuguga

SEQ ID NO: 74132 - RNA, 1770 nt, Artificial Sequence
  derived and/or modified sequence opt5 from PPP2R1A__Homo_sapiens__NP_055040
auggccgcugccgacggcgaugacagccuguaccccaucgcggugcucauugaugagcugagaaacgaagacguccagcuucggcucaauuccaucaagaaacugucuaccauugcucuggcccuugggguugagcgcacaagaagcgaacugcucccuuuccugacggauaccaucuaugacgaggaugaagugcugcucgcccuggcugagcaacuuggaacauuuaccacacuggugggcgggccggaguacguccacugccuccugcccccucuugaaucccuggccaccguggaggaaacaguugugcgggacaaggcugucgagucucuccgcgccauuagccaugagcacucccccucugaucuggaagcgcauuucgugccucugguuaaaagacucgccggaggcgacugguuuaccagccggacguccgcuugugggcuguucagcgugugcuauccccgcgucucuuccgccgugaaggcugagcuuagacaguacuuucggaaccuguguagcgaugacaccccuauggugcgcagagccgcggccucuaaacucggagaguucgcuaagguccuggaacuugauaauguuaaguccgaaaucaucccgauguuuagcaaccuggccucugacgagcaggacuccgugcggcuccuggcuguggaggccugcgucaauauugcccagcugcucccccaagaagaucuggaggcucuugugaugccuacacugcgccaggcggccgaagacaaaagcuggagaguucgguauaugguggcugauaaguucaccgagcuccagaaagccgucggccccgaaaucacaaagaccgaccuggugccugccuuucagaaccuuaugaaagauugugaggcugagguucgcgccgcggcuucccacaaggugaaggaguucugcgaaaaucugucugccgacuguagagaaaacgucauuaugagccaaauccuccccugcauuaaagagcugguguccgaugccaaucagcaugucaagagcgcucuggccucugugaucaugggccucuccccgauucuggggaaagacaacacgaucgaacaccuucugccucucuuucuggcucagcugaaggaugagugucccgagguucggcuuaauaucauuagcaaccucgacugcgugaaugaagucaucggaauuagacagcugucucaaagccugcucccugccaucguggagcuggcggaagaugccaaauggcgcguucggcuugcuauuaucgaguacaugccccugcucgccggccagcuggggguggaguucuuugacgaaaagcugaacucccuuuguauggcuuggcucgucgaccacguguaugccaucagagaggcggccacaucuaaucugaaaaagcugguggaaaaguucggaaaagagugggcucaugccaccauuauccccaagguucucgcuaugagcggcgauccuaacuaccugcaccgcaugacaacccuuuucugcauuaacguccuguccgaagugugcgggcaggacaucaccacaaaacauaugcucccgacggugcugcggauggccggagaucccgucgccaaugugagauuuaacguugcuaagagccugcagaaaauuggcccuauccuugacaauucuacccuccaauccgaggugaagcccauccuggagaagcugacacaggaucaggacgucgaugugaaauacuucgcgcaagaagcccucaccguucugagccuugcuuga

SEQ ID NO: 74133 - RNA, 1671 nt, Artificial Sequence
  derived and/or modified sequence opt5 from PPP2R1B__Homo_sapiens__NP_001171033
auggccggcgcuagcgagcuggggaccggacccggcgccgcugggggagacggcgaugacucccucuacccuaucgcugugcugauugaugaacuuagaaacgaggacguccagcugcggcucaauucuaucaagaaacugagcacaauugcccuugcccuggggguugaacgcacgagauccgagcuccugccguuccugaccgauacaaucuaugacgaagaugaggugcuccuggcucuugccgagcaacugggaaacuuuaccggccucgugggcgggcccgacuucgcucacugccugcuuccuccccuggaaaaucucgccacagucgaggaaaccgugguucgggauaaggcgguggagucucugcgccagauuagccaggagcauacaccugucgcccuggaagcguacuuugugccccucguuaaaagacuggccuccggagacugguucaccucucggacgagcgcuuguggccuguuuuccgugugcuauccucgcgccagcaacgcggucaaggccgagaucagacagcaauuccggucucuuuguuccgaugacaccccgauggugcgcagagcugccgcuagcaaacucggggaauuugccaaggugcuggagcuugauucugucaaguccgaaaucguuccccuguucacaagccucgccucugacgagcaggacuccgugcggcugcuggcuguggaggcgugcgucagcauugcccagcuccugucccaggaugaccuugaaacccuggugaugccuacacuccgccaagcugccgaggauaaaucuuggagaguucgguacaugguggccgaccgcuuuagcgaacugcagaaggcuaugggacccaaaaucacccuuaaugaucugauuccugccuuccagaaccuccugaaggacugugaggcggaagucagagcugccgccgcucacaaagugaaggagcugggcgagaaucuccccaucgaagaucgggagacgauuaucaugaaccagauucugccguauaucaagugcccugacguuagacuuaauaucauuuccaaccuggauugugugaaugaagucaucgggauucgccaacucagccagucucugcugcccgccaucguggagcuugcugaagacgccaaauggcgggucagacucgcgauuaucgaguacaugccucugcuggccggacagcucggcguggaguuuuucgaugaaaagcugaacucccuuugcauggcuuggcugguugaccauguguaugccauccgcgaggcugccacaaauaaccucaugaaacugguccaaaaguuuggcaccgaaugggcgcagaauacaauugugcccaaaguucuggugauggccaacgaccccaacuaccuucaccggaugaccacccucuucuguaucaaugcucugagcgaggccugcgggcaggagauuacaacgaagcagaugcugccuaucguccucaaaauggcuggagaucaaguggccaacgugagauucaauguugccaagucucugcagaagauuggcccgauccuugacaccaacgcucugcagggggaagucaaacccgugcuccagaagcugggacaagaugaggacauggaugugaaauacuuugcgcaggaagccaucagcguccuggcucuugccuga

SEQ ID NO: 74134 - RNA, 1374 nt, Artificial Sequence
  derived and/or modified sequence opt5 from PPP2R2A__Homo_sapiens__NP_001171062
auguuccccaaguuuagccugagauccauguuccacggcgccgggggaggcaacgacauccaguggugcuuuucucaagugaaaggggcugucgaugacgauguugccgaggcggacauuaucagcaccguggaauuuaaucauuccggagagcuccuggcuacaggcgauaaagggggacggguggucauuuuucagcaggaacaggagaacaaaauccaaucucacagccgcggcgaauacaauguguauuccacguuccagucucaugagccugaguuugacuaccuuaagagccuggaaauugaggaaaagaucaacaagaucagauggcucccgcagaagaaugccgcccaguuccugcuuuccaccaacgauaaaacaauuaagcuguggaaaaucagcgagcgggacaagcgccccgagggcuauaaucucaaagaagaggaugggagauaccgggacccuaccacaguuaccacacugcgcgugcccgucuuuagaccuauggaucugaugguggaggcuucuccccggcgcauuuucgccaacgcucacaccuaucauaucaauuccauuagcaucaacucugacuacgagacguaucucuccgccgaugaccugagaauuaaucuuuggcaccuggaaaucaccgaccggagcuuuaacaucguugauauuaagccugcgaauauggaggagcucacagaagugaucaccgccgcugaguuccacccgaacucuuguaauacauuugucuacuccagcuccaagggaaccauucgccugugcgacaugagagccucugcucuuugugaucggcauagcaaacuguucgaagaacccgaagacccuuccaaccgcagcuucuuuucugagaucauuuccagcaucucugaugugaaguucagccacuccggcagauacaugaugacgcgggacuaucucucugugaaaaucugggaucugaacauggagaauagacccgucgaaacauaccaaguucaugaguaucugcgcagcaagcucugcucccuguacgaaaacgacuguauuuuugauaaauucgagugcuguuggaaugggagcgacucuguggugaugaccggauccuauaacaauuucuuccggauguuugauagaaacacaaagcgcgacaucacccuugaagccagccgggagaauaacaaaccuagaaccguccugaagccccgcaaggugugcgcgucuggcaaacggaagaaagacgagauuuccguugauagccucgacuucaauaagaaaauccugcacacagccuggcacccgaaggaaaacauuaucgcuguggccacgaccaauaaccuuuacaucuuucaggauaaggucaauuga

SEQ ID NO: 74135 - RNA, 1350 nt, Artificial Sequence
  derived and/or modified sequence opt5 from PPP2R2B__Homo_sapiens__NP_001258828
augauccccggcauugggacccugacacaggacacgcucuggugcuucagccaagugaagggaaccaucgagauuggcacaaccgaagccgauaucauuuccacagucgaguuuaaccacaccggggaacugcuugcuacaggagacaaaggcgggagaguugugaucuuccagcgggagcaggaaucuaagaaucaggugcaucgcagaggagaguacaacgucuauagcaccuuucaaucccacgagccugaguucgauuaccugaaaucucucgagaucgaagagaagauuaauaaaauccgguggcugccgcagcagaacgccgcguauuuucuucugagcacgaaugacaagaccgugaagcucuggaaaguuuccgagcgcgauaagagacccgaaggcuacaaccugaaagacgaggaaggccggcugcgcgauccugcuacaauuaccacacucagagugcccguccugcggccuauggaccuuaugguggaggccacgccccgcagaguuuucgccaaugcucauaccuaucacaucaacucuauuagcgucaauuccgauuacgaaacauauaugagcgccgacgaucugcggaucaaccucuggaauuuugagauuaccaaccagucuuucaauaucguggacaucaagccugcuaacauggaggaacugacagaggugauuaccgccgcggaauuucauccgcaccacuguaauaccuucguguacuccagcucuaaagggacaauccgccuuugcgauaugagagccuccgcucugugugaccggcauacgaaguuuuucgaggaacccgaggacccuagcaaccgcuccuuuuucucugagauuaucagcuccauuucugaugucaaguucagccacuccggaagauacaucaugacccgggacuaucucacaguuaaagugugggaucugaacauggaaaauagacccaucgagaccuaccaagugcaugacuaucugcgcagcaagcucugcucucuguacgaaaacgauuguauuuuugacaaauucgagugcgucuggaauggcuccgauagcgugaucaugacagggucuuauaacaacuuuuuccggauguuugacagaaauaccaagcgcgauguuacgcuugaagccagccgggaaaauuccaaaccuagagcuauucugaagccccgcaaagugugugucggaggcaagcggagaaaggacgagaucucuguggauagccucgacuucuccaaaaagauucugcacacagccuggcacccgagcgaaaacaucaucgcgguugccgcuaccaauaaccuuuacauuuuucaggacaaagugaauuga

SEQ ID NO: 74136 - RNA, 1323 nt, Artificial Sequence
  derived and/or modified sequence opt5 from PPP2R2C__Homo_sapiens__NP_001193924
augagagaggccgacacccugcggcccccucagcucauggaagugagcgcugauaucauuuccacagucgaguucaaccacacgggcgaacugcuugccaccggggacaagggaggccgcguugugaucuuucaaagagagccggaaucuaaaaaugcgccccauagccagggggaguacgauguguauuccacauuccagucucacgagccugaauuugacuaccuuaagagccucgagauugaagagaaaaucaacaagauuaaauggcugccccagcaaaaugcugcccauucccuucugucuaccaacgauaagacaaucaagcucuggaaaaucaccgagcgggacaagcgcccugaaggauauaaucugaaagaugaggaaggcaagcugaaagaccucagcacagucaccucccuucaggugcccguucugaagccuauggaucugaugguggaggucagcccgagacggauuuucgccaacgggcacacguaccauaucaauucuauuuccgugaacagcgacugcgaaaccuauaugucugcugaugaccuccgcaucaaucuguggcaccuugccauuacagauagauccuuuaacaucguugacauuaagcccgcuaauauggaggaccugaccgaggugaucacagccagcgaguuccacccucaucacuguaaccucuuugucuacucuuccagcaaaggaucccugcggcugugcgauaugcgcgcggccgcucucugugacaagcauucuaaacuguucgaagaacccgaggauccuagcaauagauccuuuuucagcgaaaucauuucuuccgugagcgacgugaaguuuucucacagcggccgguauaugcuuacccgcgauuaccugacggucaaaguuugggaccucaacauggaggccagacccaucgagacauaccaggugcacgauuaucugcgguccaagcugugcucucuguacgaaaaugacuguauuuucgauaaauuugagugcgcuuggaacggcagcgacuccgugaucaugaccggggccuauaacaauuucuuccgcauguuugauagaaacacaaagcgggacgucacccucgaagcgagcagagagucuuccaagccgcgcgccgugcugaaaccucggagaguuugugugggaggcaagcgccggagagacgauauuagcgucgacucucuggauuucaccaaaaagauccuccauacagcuuggcaccccgccgaaaauaucauugcuaucgccgccacgaacaaucuguacauuuuucaggacaaagugaacuccgauaugcauuga

SEQ ID NO: 74137 - RNA, 1245 nt, Artificial Sequence
  derived and/or modified sequence opt5 from PPP2R3A__Homo_sapiens__NP_001177376
auggacaucgaggaacagaaggccgauauuuacgagaugggcaaaaucgcuaaggugugcggguguccccuguauuggaaagccccuauguucagagcggcuggaggcgaaaagaccggguuugucacagcccagagcuucauugccauguggcggaaacuccugaacaaucaccaugacgaugcuuccaaguuuaucugccuucuggccaagccgaacuguucuagccucgagcaagaagacuucauuccccugcuucaggauguuguggacacgcacccuggacugaccuuucucaaagaugcucccgaguuccauucccgcuacaucacaaccgugauccagagaauuuucuauacagucaaucggucuuggagcggcaagaucaccuccacagagauucgcaaaucuaacuuccugcaaacccuggcccuccuggaagaggaagaggacaucaaucagauuacggauuacuuuagcuaugagcacuucuacgugaucuauugcaaguuuugggaacuugacaccgaucaugaccuguacauuucccaggcggaucucagcagauacaacgaccaggccucuuccagccggaucaucgagcgcauuuucucuggggcuguuacaagaggaaaaaccauccaaaaggaaggccggauguccuaugccgacuuugugugguuccugauuagcgaggaagauaagcgcaauccuacaucuaucgaguacugguucagauguauggacgucgauggcgacggggugcuuuccauguaugagcuggaauacuuuuaugaggaacagugcgagcggauggaagcuaugggaauugagccccucccuuuccacgaucugcugugucagaugcucgaccugguuaaaccggccguggauggcaagaucacccuucgcgaccugaaaagaugccggauggcgcacaucuuuuacgauacguucuuuaaccucgagaaguaucuggaccaugaacagcgcgaucccuucgccguccaaaaagacguggagaaugacgggccugaacccagcgauugggacagauuugcugccgaggaauacgagacacuuguggcugaggaauccgcccaggcccaguuccaagagggauuugaagauuacgagaccgacgagccugcuucucccagcgaauuuggcaacaaguccaauaaaauucugagcgcgucucucccggagaagugugggaagcugcaguccgucgaugaagaguga

SEQ ID NO: 74138 - RNA, 1728 nt, Artificial Sequence
  derived and/or modified sequence opt5 from PPP2R3B__Homo_sapiens__NP_037371
augcccccuggcaaggugcugcagccgguccucaaaaugaagguugacgagcuguuccuuuacuggcugagcgaagccuccacccaaagaaugcuccaggauugccugcggcgcaucaaagcucccgggagagaccagccuacacccggagauggcgagcagccuggggccuggcccacggcgccucuugcugccccgcggcccucuggacuggaaccucccggcaccccugggcccggaccggcccucccucugggcgcugccagcucuccccgcaacgcuccucacgugagaggcacacggcgcuccgccgggaccagagugguccaaacacggaaggaggaaccccugcccccugcgaccagccaguccauuccgacauuuuauuucccccgcggaagaccucaggacucugugaauguugaugccgugaucagcaaaauugaguccaccuuugcucgguucccccaugagcgcgccacgauggacgauaugggccucgucgcuaaggccugugggugcccucuguacuggaagggaccccuguuuuauggcgcugggggagaaagaaccggcagcgugucuguucacaaauucguggccauguggcggaagauccuucagaacugucaugacgaugcugccaaauuuguccaccuccugauguccccgggcugcaauuaccuugugcaagaggacuucgugccuuuucugcaggaugucguuaacacacaucccgggcucagcuuccugaaggaagcgucugaguuucacucccgcuauauuaccacagugauccagagaaucuucuacgccgugaaucggagcuggucuggaagaauuaccugugccgagcugcgccgguccagcuuucuccagaacgucgcucugcuugaagaggaagcggacaucaaucaacugacggaguucuucuccuaugaacacuuuuacgugauuuacugcaaauucugggagcucgauacagaccaugaccugcuuaucgaugccgacgaucuggcuagacacaacgaccaugcccucucuaccaagaugauugaucgcaucuuuagcggcgccguuacacgggggagaaaggugcagaaagagggaaagauuuccuaugcugacuucgucugguuucugaucagcgaagaggauaaaaagaccccuaccucuaucgaauacugguuccgcuguauggaccuggauggcgacggggcccucuccauguuugagcuggaauauuucuacgaggagcagugccggagacuugauagcauggcgauugaagcucugcccuuucaagacugucucugccagaugcuggaccuugugaaaccucgcacagagggaaagaucacgcugcaggaucucaaacgguguaagcuggccaauguuuucuuugacaccuucuuuaacauugaaaaguaucuggaucacgagcagaaagaacaaaucucucuccugagagacggcgauagcggcgggcccgagcuuuccgacugggagaaguacgccgcugaagaguaugauauucugguggccgaagagacagcuggagagccgugggaagacggcuucgaggccgaacucucuccugucgagcagaaacugagcgcgcugcgcagcccccuugcccagcggcccuucuuugaagcuccuuccccgcucggggccguggaucuguacgaguacgcuugcggagacgaggaucuggaaccccucuga

SEQ ID NO: 74139 - RNA, 867 nt, Artificial Sequence
  derived and/or modified sequence opt5 from PPP2R4__Homo_sapiens__NP_001180326
augggcaaguggaaaagaagccaggccuacgcugacuauaucggguucauucugacccucaacgagggagugaagggcaaaaagcugacauuugaauaccgggucuccgaggccaucgaaaaacuuguugcgcugcucaauacgcuggaucgcuggauugacgagacacccccuguggaucaaccgucuagauucgggaacaaggcuuaucggaccugguacgccaaacuugacgaagaggccgagaaucugguggcuaccgucgugcccacacaccucgccgcugccguuccugaaguggcggucuaucugaaggagagcgugggaaacuccacccgcaucgauuacggcacagggcaugaagccgcuuuugccgcuuuccugugcugucucugcaagauuggaguucugagaguggacgaucagaucgccaucgucuuuaaaguguucaaucgguaucuugaggugaugcgcaagcugcagaaaaccuacagaauggagcccgcgggcucucagggcgucugggggcucgacgauuuucaauuccugccuuuuauuuggggaagcucccagcuuaucgaccaccccuaccuggaaccucggcauuucguugaugagaaggccgugaacgaaaaucacaaggacuauauguuucucgaguguauucuguucaucacggaaaugaaaaccggcccguuugcugagcauucuaaccagcuguggaauauuagcgccgugcccuccuggagcaaggucaaccaggggcucauccgcauguacaaagcugagugccuggaaaaguucccugugauucaacacuucaaauuuggaucucuucugcccauccacccuguuacauccggcuga

SEQ ID NO: 74140 - RNA, 1290 nt, Artificial Sequence
  derived and/or modified sequence opt5 from PPP2R5A__Homo_sapiens__NP_001186685
augaucaugaacgccaccagcaaugagcagcaagaacuguucugccagaagcuccagcaguguugcauucuguuugacuucauggauuccgugucugaccuuaaaagcaaggagaucaaaagagcuacacugaacgaacucgucgaguacguuuccacgaaucggggcgugauuguggaaucugccuauagcgauaucgucaagaugauuuccgcgaacaucuuucgcacccugcccccuucugacaauccggauuucgaccccgaggaggaugaaccuacacuugaggcuagcuggccccacauccaacugguguacgaauuuuuccucagauuucuggaguccccugacuuccagcccagcauugccaaacgguauaucgaucagaaguuuguucagcaacugcucgagcuguucgacucugaagauccucgcgagagagacuuucuuaagaccgugcugcaucggauuuacgggaaauuccucggacugcgcgccuuuaucagaaagcagauuaacaauaucuuccuucgguucauuuaugaaacagagcacuuuaacggcgucgcugaacugcucgagauccugggguccaucauuaauggauucgcccugccgcucaaagcugagcauaagcaguuucugaugaaagugcuuauccccaugcacaccgccaagggccuggcccucuuccaugcgcagcuggcuuacuguguugugcaauuucuugaaaaggauacaacccugacggagccugucauucgcgggcuccugaaauucuggcccaagaccugcagccagaaagaagugauguuucugggagagaucgaagagauucucgacgugaucgagccuacacaguucaagaaaaucgaagaaccccuguuuaagcaaauuucuaaaugugucuccagcucucacuuccagguugccgaaagagcucuuuauuuuuggaacaaugaguacauccugucccucauugaagagaacaucgacaagauucugccgaucauguucgccagccuuuacaagaucuccaaagagcacuggaauccuaccauuguggcgcugguguauaacguccucaagacacugauggaaaugaauggcaaacuguuugaugaccucaccucuagcuacaaggccgagcggcagcgcgagaaaaagaaggagcuggagagagaagaacuuuggaaaaagcuggaggagcucaaacugaagaaagcucuggaaaagcagaacuccgccuauaacaugcauagcauccuuucuaauacguccgcugaguga

SEQ ID NO: 74141 - RNA, 1494 nt, Artificial Sequence
  derived and/or modified sequence opt5 from PPP2R5B__Homo_sapiens__NP_006235
auggagaccaagcugcccccugccagcacaccgacgucccccucuagcccuggccucucccccgugccucccccugacaaagucgauggguucucuagacggagccugcgcagagcucggccgcgcagaucccacucuagcucccaguuucgguaccaaagcaaccagcaggaacuuacaccccugccucuccugaaggacguucccgccucugagcuucaugaacugcucucccgcaaacuggcgcagugcggagugauguucgauuuucuggacuguguggcugaucucaagggcaaagaggucaagagagccgcccugaaugaacuuguggagugcguugggagcacccggggagugcugaucgagccugucuaucccgacauuauccgcaugauuucugugaacaucuucagaacccucccgccuuccgaaaaucccgaguuugauccugaagaggacgagcccaaccuggaacccagcuggccucaccuucaacugguuuacgaguucuuucuccgguuccuggaaucuccggauuuucagcccuccguggcuaagcgcuaugucgaccagaaauucgugcugaugcuccuggagcuuuuugauagcgaagacccuagagagcgggaguaccugaagacaauucuccaucgcguguauggcaaauuccuggggcuuagagccuacauccggaagcaguguaaucacaucuuucugagauucauuuaugaguucgagcauuuuaacggagucgcugaacuccuggagauccugggcuccauuaucaauggcuucgcccucccccugaaaaccgaacacaagcaauuucuuguucgcgugcugauuccucuccacucugugaagucccuguccgucuuccaugcgcagcuugccuacugcgugguucaguuucuggagaaagaugcuacacucaccgagcacgugauccgggggcugcugaaguacuggcccaaaacguguacccagaaggaagucauguuccucggagagauggaagagauucuggacgugaucgaaccgagccaauuuguuaaaauccaggagccucuuuucaaacagguggccagaugcgucucuagcccccauuuucaaguggcugagcgcgcccuguauuucuggaacaaugaauacauucucagccugaucgaggacaacugucacacaguccugccugcgguguuuggcacccuuuaucagguuucuaaggaacacuggaaucagacaauugugagccucaucuacaacguccugaagaccuucauggagaugaaugggaagcuguuugaugagcucacggccuccuauaaacuggaaaagcagcaagagcagcagaaagcucaggaacggcaagagcuuuggcagggacuggaagaacucagacugcgccggcugcagggcacacagggggccaaggaggcuccccuucaaagacucaccccucagguggccgccucuggaggccagagcuga

SEQ ID NO: 74142 - RNA, 1668 nt, Artificial Sequence
  derived and/or modified sequence opt5 from PPP2R5C__Homo_sapiens__NP_001155197
augcccaacaagaauaaaaaggagaaagaaagcccuaaggccggcaaauccgggaagucuagcaaggagggacaggacaccguggaauccgagggcacaucuccggaagaacccagcuccccuaaaguucccccuccccugcucccugagcugcuuguccugaucuucgggggacuccaaggcagagaugugccgcccgcugaccaggaaaagcuguuuauucagaaacuucggcagugcugugugcuguucgauuuugucucugacccucucagcgaucugaaguggaaagaggugaagcgcgccgcgcuguccgaaaugguugaguacaucacgcacaacagaaaugugauuaccgagcccaucuauccugaagucgugcauauguucgcuguuaacauguuucggacacuucccccgagcucuaauccuaccggggccgaguucgaccccgaagaggaugaaccuacacuggaggccgcuuggccccaccuucaacugguguacgaguuuuuccuccgcuuucuggaaucccccgacuuccagccuaacauugccaagaaauauaucgaucagaaguuuguccuucagcugcucgagcuguucgacagcgaagauccgagagagcgggacuuucugaaaaccacacuccaucgcaucuacggaaaguuccugggccuuagagcuuauauucggaaacaaaucaauaacauuuucuaccgcuuuaucuaugaaaccgagcaccauaauggcauugccgagcugcucgaaauccuggggucuauuaucaacggauucgcgcuuccccugaaggaggaacacaaaaucuuucuccugaaggugcugcucccucugcacaaggugaaaucccuuagcgucuaccauccccagcuggccuacugcguugugcaguuccucgagaaggauucuacgcugaccgaaccuguggucauggcucuccugaaauauuggcccaagacacacuccccgaaagaggugauguuucucaaugagcuggaagagauucuggacguuaucgaaccuagcgaguucgugaagauuauggagccccucuuuagacagcuggccaagugugucuccucuccucauuuccaaguggcugaacgggcccuuuacuauuggaacaaugaguacaucaugagccugauuuccgacaacgcggccaaaauccuccccaucauguuuccuagccuguaucgcaauucuaagacccacuggaacaaaacaauucacggccugaucuacaacgcucuuaaacucuucauggaaaugaaucagaagcuguuugaugacugcacccagcaauucaaggccgagaagcugaaagaaaagcucaaaaugaaggagagagaggaggcuuggguuaaaauugagaaccuggccaaggccaauccccaguauacgguguacucccaggcuagcacaaugucuaucccggucgcgauggaaaccgaugggccucuuuuugaggacgugcagaugcugcggaagacagucaaagaugaagcccaucaagcucagaaggaccccaaaaaggaucgcccccucgccagacggaaaagcgagcugccucaggacccgcacaccaagaaagcccuggaggcucauuguagagccgaugaacuugcgucccaggacggacgcuga

SEQ ID NO: 74143 - RNA, 1809 nt, Artificial Sequence
  derived and/or modified sequence opt5 from PPP2R5D__Homo_sapiens__NP_006236
augcccuacaagcugaaaaaggagaaagaaccuccgaagguggccaaaugcaccgcuaagcccagcuccucuggcaaggacgggggaggcgagaacacagaagaggcccagccucaaccccagccucagccccagccucaagcgcagagccagccgcccuccucuaauaaaagaccuagcaacuccacgcccccucccacccagcucucuaagaucaaauauagcgggggaccgcaaauugucaagaaagaacggcgccaguccagcucuagauucaaucuguccaagaaccgggagcuucagaagcugccugcucucaaagauagccccacacaggagcgcgaagaacuguuuauccaaaaacuuagacaguguugcguucuguucgacuuugugucugauccucucuccgaccugaaguucaaggaagugaaacgggccggccugaaugagauggucgaguacauuacccacagccgcgaugugguuacagaagccaucuaucccgaggcugugaccauguuuucugucaaccucuucagaacacugcccccuuccagcaauccgaccggggccgaauuugaccccgaggaagaugagccuacgcuugaggcugccuggccccaucugcagcucguguacgaguucuuucugcgguuccuugaguccccugacuuucaacccaacauugcgaagaaauauaucgaucagaaguucguucuggcccuccuggaccuguuugauucugaagacccgcgcgagagagauuuccucaagaccauccugcaccggauuuacggaaaauuccuuggccugcgcgcuuauaucagacggcagauuaaucauaucuuuuaccgcuucauuuacgaaacagagcaccauaacggcaucgccgagcuccuggaaauucuugggagcaucaucaauggauuugcucugccucucaaggaggaacacaaaauguuccugauuagagugcugcucccccugcacaaggucaaaucccuuagcguguaucauccucagcuggccuacugugugguccaauuucucgagaaggaaucuucccugaccgagcccguuaucgugggccuucugaaguucuggccuaaaacacacagccccaaggaggugauguuucucaacgaacuggaggaaauucuggacgucaucgagccgucugaguucagcaaagugauggaaccucucuuucggcagcuggcgaagugcguuuccucuccccauuuccagguggccgagagagcucuuuauuacuggaauaacgaauauauuaugagccugaucuccgacaaugccgcucgcguccuccccaucauguuuccugcccuguaccggaacagcaaaucucacuggaacaagaccauucacgggcugaucuauaaugcccuuaaacucuucauggagaugaaccagaagcuguuugaugacuguacgcaacaguacaaggcugaaaaacagaagggaagauuccgcaugaaagagcgggaggaaauguggcagaagauugaggaacuggcgagacucaauccgcaauaccccauguuccgcgccccucccccucugcccccuguguauuccauggagacagaaacccccacagcugaggauauccagcuucugaagcggaccguugagaccgaagccgugcagaugcucaaagacauuaagaaagagaagguccugcugagacgcaaaagcgaacuuccgcaggauguguacacaaucaaggcccucgaggcucauaaacgggccgaagaguuucugacggcgucucaagaggcucuguga

SEQ ID NO: 74144 - RNA, 1389 nt, Artificial Sequence
  derived and/or modified sequence opt5 from PPP2R5E__Homo_sapiens__NP_001269109
augagcuccgcccccaccacaccuccgucuguggacaaggucgauggcuucagcagaaaauccguucggaaggcucgccagaaaagaucucaaagcuccucucaguuucggagccaggggaagcccaucgagcugacgccucucccccugcuuaaagacgugccuuccagcgaacagcccgagcuguuccucaagaagcugcaacagugcugugugauuuuugauuucauggacacccuuucugaucugaaaaugaaggaauacaaacgcuccacacucaacgagcuggucgacuauaucaccauuagcagaggaugccugacagaacagaccuacccugaggugguucggauggugucuuguaauaucuuucgcacacucccgcccuccgauagcaacgaguucgacccugaagaggaugaacccacccuggaggccucuuggccucaccuucagcuggucuaugaguuuuucauuagauuucucgaaucccaagaguuccagcccagcaucgcgaagaaauacaucgaccagaaguuugugcugcagcuucuggaacucuucgauuccgaggacccgcgggaacgcgauuaucugaagacgguucugcauagaauuuacggcaaauuucucgggcugcgggcuuucauccgcaagcaaauuaauaacaucuuccuuagauuuguguaugagaccgagcacuucaauggagucgccgaacugcucgagauucugggcucuaucauuaacggguuugcccuuccucugaaagcugaacauaagcaguuccucgugaaagugcugaucccccugcacacaguccggagccucucccuguuucaugcccagcuugcuuacugcaucguucaauuccuggagaaggacccuagccucaccgaacccgugauucgcggacugaugaaauuuuggcccaagacauguucucagaaggaggugauguuccuuggcgagcuggaagagauccucgacgucauugaaccuucccaguuugugaaaauccaggagccgcuguucaagcaaauugccaaaugcguuagcucuccccacuuucagguggcggaaagagcccuguacuauuggaauaacgaguacaucaugagccucaucgaggaaaauuccaacgucauucugccuaucauguucucuagccuuuaucggauuuccaaggagcacuggaaucccgcuaucguggcccugguuuacaacgugcucaaggcuuuuauggaaaugaauagcaccauguucgaugagcugacggccacauauaacgagaaaaagaaagaaaaggagagagaggaacuguggaaaaagcucgaagaccuugagcugaaacgcggccugcggagagaugggauuaucccuaccuga

SEQ ID NO: 74145 - RNA, 1566 nt, Artificial Sequence
  derived and/or modified sequence opt5 from PPP3CA__Homo_sapiens__NP_000935
augagcgagcccaaggccaucgacccuaaacuguccaccacagauagaguggucaaggcuguuccguuucccccuucucaccggcucacggccaaagaaguguucgacaacgauggcaagccccgcguggacauucugaaagcgcaucuuaugaaggaggggagacuggaagagagcgucgcucuccggaucauuaccgaaggagccuccauccugcgccaggagaagaaucuucuggauauugacgccccugugacaguuugcggcgauauccacgggcaauucuuugaccucaugaaacuguucgaggugggaggcucucccgcuaacaccagauaccuguuucucggggauuaugucgaccggggauacuucagcaucgaaugugugcuguaucuuugggcccugaagauucucuacccuaaaacacuguuucuucugcgcggcaaucaugagugcagacaccucaccgaauauuucacauuuaagcaggaguguaaaaucaaguacuccgagcggguuuaugaugcuugcauggacgccuucgauugucugccgcuggcggcccucaugaaccagcaguuucugugcgugcauggcgggcuuucucccgaaauuaauacccuggacgacauccgcaagcucgauagauucaaagagccucccgcuuacggaccuaugugugacauucuguggagcgauccccuugaagacuuuggcaacgagaagacgcaagaacacuucacccacaauacaguccgggggugcuccuacuucuauagcuacccggccgugugugaguuucugcagcauaacaaucuccugucuauccugcgcgcucacgaggcccaggaugcgggauauagaauguaccggaaaucccagaccacaggcuucccuagccucauuaccaucuuuucugcccccaacuaucuggacguguacaauaacaaggcugccguccuuaaauaugaaaauaacguuaugaauauccgccaauucaacugcuccccucaucccuacuggcugcccaacuuuauggauguguucacguggagccucccuuuugugggggagaaggucacagaaaugcuggugaauguucuuaacauuuguucugacgaugagcugggauccgaagaggacggcuucgauggcgcuaccgccgccgcuagaaaagaggugauccggaauaagauuagagcgaucgggaagauggcccgcgucuuuagcgugcuccgggaagaguccgaaucuguucugacacugaaaggacucaccccgaccggcaugcugcccagcggggugcuuuccggaggcaagcagacacugcagagcgcuacggucgaggccauugaagccgacgaggcuaucaaaggguucucuccucagcacaagaucaccuccuuugaggaagccaaaggacucgacagaauuaacgagcgcaugcccccucggagagaugcgaugcccagcgacgcuaaucugaacucuaucaauaaggcccugacaagcgaaaccaacggcacagauuccaauggcucuaacagcuccaauauucaauga

SEQ ID NO: 74146 - RNA, 1578 nt, Artificial Sequence
  derived and/or modified sequence opt5 from PPP3CB__Homo_sapiens__NP_001135825
auggccgcucccgagcccgccagagcggcuccgcccccucccccucccccuccgcccccucccggcgccgaccggguggucaaggccguuccuuuucccccgacccaccgccugacaagcgaagagguguucgaucucgacgggaucccuagaguggauguccugaaaaaccaucuugugaaggaaggacggguugacgaggaaauugcucugcgcaucauuaaugagggcgccgcuauccucagacgggagaaaacgaugauugaaguggaggcccccaucaccgucugcggggauauccacggacaguucuuugaccugaugaaacuuuucgaagugggcggguccccugcgaacacacgcuaccuguuucucggagauuauguugacagaggcuacuucucuauugagugugugcuguaucuguggguccucaagauccuguaccccagcacccuuuuucugcuccggggcaaucaugagugccgccaccugacagaauauuucaccuuuaagcaagaguguaagauuaaauacuccgaaagaguguaugaggccugcauggaggcuuucgauucucuuccccuggccgcucuccugaaccagcaguuucugugugugcaugggggacucagcccugaaauccacacacuggacgauauucggcgccuugacagauucaaggagccgcccgccuuuggcccuaugugcgaucugcucugguccgaccccucugaagacuucgggaaugagaaaagccaggaacacuucucccauaacaccguccggggauguagcuacuuuuacaauuauccugcgguuugcgaguuccugcaaaacaauaaccuucugucuaucauucgcgcccacgaagcucaggaugccggcuacagaauguaucggaagucccagacgaccggguuucccagccucaucacaaucuucucugcuccgaauuaccuggacguguauaacaauaaagccgccgugcugaaguacgagaacaaugucaugaacauuagacaguuuaacuguuccccucaucccuauuggcucccuaauuucauggauguguuuaccuggagccugcccuucguuggagagaaggugacagaaaugcuugucaacgugcugucuaucugcuccgacgaugagcucaugaccgaaggcgaggaccaauuugauguuggcagcgcugcggcccgcaaagaaauuauccggaauaagauuagagcuaucgggaaaauggcccgcguguucuccguccugcgggaggagucugaaagcgugcuuacgcugaagggacucacaccuaccggcaugcugcccuccgggguccuggccggaggcagacagacacuccagagcgcuaccguggaggccaucgaagcggagaaagcuauucgcggguuuucuccgccucaccggaucuguuccuucgaggaagccaagggacuggacagaauuaacgagcgcaugccuccccggaaagaugccguucagcaagacggcuuuaauagccuuaacaccgcucacgccacagaaaaucauggcacggggaaccacaccgcucaguga

SEQ ID NO: 74147 - RNA, 1566 nt, Artificial Sequence
  derived and/or modified sequence opt5 from PPP3CC__Homo_sapiens__NP_001230903
augagcggcagacgguuccaccuguccaccacagaccgcgugaucaaggccguccccuuuccuccgacgcagagacucaccuucaaagagguuuuugaaaacgggaagcccaaaguggaugugcugaagaaucaucuugucaaagagggacggcuggaagaggaaguggcucucaagauuaucaacgacggcgccgcgauucugcgccaagagaagacaaugaucgagguugaugcuccuauuaccgugugcggggacauccacggacaguucuuugaucuuaugaaacuguucgaagucggcgggucucccagcaauacaagauaccucuuucugggagacuauguggaucggggcuacuucuccaucgaguguguucuguaucucuggucucugaagauuaaccauccuaaaacccuuuuucugcuccgcggcaaucacgaaugcagacaucugacagacuacuucaccuuuaagcaggagugucggaucaaauauagcgaacagguguacgaugccugcauggagacguucgacugucuuccccuggccgcucuccugaaccaacaguuucugugcguccacgggggaauguccccugagauuaccucucucgaugacauccgcaagcuggauagauucacagaaccgcccgccuucggcccugugugugaccuucuguggagcgaccccuccgaggauuaugggaaugaaaagacccucgagcacuacacacauaacaccgugcggggaugcagcuacuuuuauucuuacccugcugucugugaguuccugcagaauaacaaucuucuguccauuauccgcgcccacgaagcgcaggacgccggcuauagaauguaccggaaaagccaagcuacgggguuucccucucucauuacaaucuucuccgccccgaacuaucuggauguuuacaauaacaaggcugccgugcugaaauaugagaauaacgugaugaacauccgccaguuuaauugcagcccucaucccuacuggcucccuaacuucauggacgucuuuaccuggucucugcccuucgugggagaaaagguuacagagaugcuugugaauguccugaacauuuguuccgaugacgaacucaucagcgaugacgaggcggaggaucacuacauucccuccuaucagaaaggcucuaccaccgugagaaaggaaaucauucggaauaaaaucagagccaucggcaagauggcucgcguuuuuagcauucugcggcaggaguccgaaagcgugcuuacacugaaggggcucacgccuaccggaacacugccgcugggcguccucucugggggaaaacaaaccaucgagacagccaccguggaagcugucgaggccagagaggccauucgcggcuucucccugcagcacaagauccggagcuuugaagaggcuagagggcuugaccgcauuaacgaacggaugcccccuagaaaagauucuauccaugcgggaggccccaugaaaagcgugacguccgcccacucucaugcugcccaccgcagcgaccagggcaagaaggcccauuccuga

SEQ ID NO: 74148 - RNA, 513 nt, Artificial Sequence
  derived and/or modified sequence opt5 from PPP3R1__Homo_sapiens__NP_000936
augggcaacgaggccagcuacccccuggaaaugugcucccacuucgacgcugaugagaucaagagacucgggaaacgguuuaagaaacuggaccuugauaauucuggaagccuguccguggaagaguucaugucucucccugaacugcagcaaaacccgcuuguccagcgcguuauugacaucuuugauaccgacggcaauggggagguggauuucaaggaguuuauugaaggagugagccaguucuccgucaaaggcgacaaggagcagaagcugagauuugccuuccggaucuaugauauggacaaagauggguacauuucuaacggagaacucuuucaagugcugaagaugaugguuggcaauaaccugaaagacacacagcuccagcagaucguggauaagacgaucauuaaugcggacaaagacggcgaugggcgcaucagcuucgaggaguuuugugcugucgugggaggccuggacauucauaagaagaugguuguggaugucuga

SEQ ID NO: 74149 - RNA, 522 nt, Artificial Sequence
  derived and/or modified sequence opt5 from PPP3R2__Homo_sapiens__NP_671709
augagcaccaugggcaacgaggccuccuaccccgcugaaaugugcucucacuucgacaaugaugagaucaagagacuggggcggcgcuuuaaaaagcucgaccuggauaaaagcggaucccuuucuguggaagaguucaugagccugccugaacucagacauaacccgcugguccggcgcguuauugacguguuugauacagacggcgauggggagguggacuucaaggaguuuauccuuggaacgucccaguucucugucaaaggcgaugaggaacaaaagcugagauuugccuucagcauuuaugacauggauaaggacggguacaucuccaauggagaacucuuucaggugcugaaaaugaugguuggcaacaaucugaccgauuggcagcuccagcaacugguggacaagacaauuaucauccuugacaaagauggcgacgggaagauuagcuucgaggaguuuucugcggucgugcgggaucuggaaauccacaaaaagcucguucugauuguguga

SEQ ID NO: 74150 - RNA, 924 nt, Artificial Sequence
  derived and/or modified sequence opt5 from PPP4C__Homo_sapiens__NP_002711
auggccgagaucagcgaccuggauagacagauugaacaacuccggcgcugcgagcugaucaaggaauccgaggugaaagcucuuugugccaaggcgagagaaauucuggucgaggagucuaacguucagcggguggacagccccgugaccgucugcggcgauauccacgggcaguucuacgaccucaaagaacuguuucgcgugggaggcgauguuccugagacaaauuaucuuuucaugggggacuuuguggauagaggauucuacuccgucgaaacguuucugcuccugcuggcucucaaggugcgguauccggaccgcauuacccugaucagaggcaaccacgagucucggcagaucacacaaguuuacggguucuaugaugagugucuucgcaaauacggaagcgugaccgucuggagauauugcacagaaauuuuugacuaccugucccucucugccaucauugauggcaagaucuucugugugcacggcgggcugagccccuccauucagacccuugaccagauccggacaauugaucgcaagcaggaggugccucaugacggacccaugugcgaccugcucuggagcgauccugaagacaccacgggcuggggagucucucccagaggggccggcuaccuguuuggguccgauguuguggcucaauucaaugccgcuaacgacaucgauaugaucugucgggcccaccagcuggugauggagggauauaaauggcauuuuaaugaaaccguccucacaguguggagcgcgccuaacuacugcuaucgcuguggcaauguugccgcuauucuggagcuugacgagcaucugcagaaggauuucaucauuuuugaagccgcuccgcaggagaccagaggcauccccucuaaaaagccuguggccgacuacuuccucuga

SEQ ID NO: 74151 - RNA, 2853 nt, Artificial Sequence
  derived and/or modified sequence opt5 from PPP4R1__Homo_sapiens__NP_001035847
auggccgaccugagccuccugcaggaggaucuucaagaagacgcugauggcuucgggguggacgauuacuccucugagagcgacgucaucauuauccccuccgcccuggauuuuguuucucaggacgaaaugcucaccccucugggaagacuugauaaguaugcggcuagcgagaacauuuucaaucggcagaugguggcccgcucccugcucgacacacugagagaagugugcgaugacgagcgggauuguaucgccguccuggagcgcauuucuagacucgcugacgacagcgaaccgacggugcgggccgagcugauggaacagguuccccacaucgcucuguuuugccaagagaaccgcccuuccauccccuacgccuucagcaaauuucuucucccuauuguggucagauaucuggcggaucagaauaaccaggugcggaagaccucucaggccgcccuucuggcucuccuggagcaagaacugaucgagcgcuucgacguugaaacaaaagugugucccguccucauugagcugaccgcuccugauuccaaugacgaugugaagacagaagccguggcgaucaugugcaaaauggccccgauggucggcaaggacauuaccgagagacuuauccugccccgguuuugugagaugugcugugauugccgcauguuccauguuagaaaggugugugcugccaacuuuggggacauuugcagcguggucggacagcaggcuacagaagagaugcuccugccucgguucuuucagcuuuguucugauaauguguggggcguucgcaaagccugcgccgaaugcuucauggcuguguccugugcgaccugccaagagaucagacggacgaagcugagcgcccucuuuaucaaccugauuucugaccccuccagauggguccgccaggcugccuuccagagccuggggccuuucaucuccaccuuugccaaucccucuagcuccggacaauacuucaaagaagagagcaagucuuccgaggaaaugagcguggagaacaaaaaucggacaagagaucaggaagcuccggaggacguucaggugcgcccugaagacacccccucugaucucagcgucuccaacucuagcgugauucuggagaauacaauggaggaccacgccgcggaggcuuccggcaagccucuuggcgagaucagcgucccccuggauucuucccuccuguguacccuuagcucugaaucccaucaggaggccgccagcaacgagaaugacaagaaacccgggaacuauaaguccaugcugcggccugaagugggaacgacaucucaagauagcgcucuccuggaccaggagcuguacaacuccuuucacuucuggagaaccccgcuccccgaaauugaucuggacaucgagcuugaacaaaauucuggcgggaaaccuagccccgagggaccugaggaagaguccgaaggccccguuccgagcucuccuaacaucacaauggccacccgcaaggagcuggaagagaugauugagaaucucgaaccccauaucgaugacccugaugugaaagcucaggucgaggugcuguccgccgcgcugcgggccagcucucuugacgcucacgaagagaccauuuccaucgaaaagagaagcgaucuccaggacgagcuggacauuaacgagcugcccaauugcaaaaucaaccaggaagauucuguuccucucaucagcgacgccguggagaauauggauuccacacugcacuauauucauagcgacucugaucuuuccaacaauagcuccuuuucucccgacgaagaacgccggacgaagguccaggauguggugccgcaggcucugcucgaccaauaccugagcaugaccgauccuuccagagcccagacaguugacaccgagaucgcgaagcacugugccuacucucugcccggggucgcucuuacacucggacgccagaacuggcauugccugcgggaaaccuaugagacgcuggccagcgauaugcaguggaaagugagacggacacucgcuuucuccauucacgaacuggccgugauccuuggcgaccaacugaccgccgcugaucucguccccauuuuuaauggcuuccugaaggaccuggacgaggugcgcaucgggguucuuaaacaccuccaugauuuucugaagcugcuccacauugacaaaagacgggaauaccuguaucagcuucaggaguuccuggugaccgauaacucuagaaauuggcgcuuucgggcggagcucgccgaacaacugauccugcuucucgagcuguacagcccuagagacgucuaugauuaccugcgcccgaucgcucucaaccugugugccgacaagguguccagcguuagauggauuucuuauaaacuuguguccgaaauggucaagaagcugcaugccgcuacacccccuaccuucggaguggaucucaucaaugagcugguugaaaacuuuggccggugccccaaauggagcgggcgccaggccuucguguucgucugucagacagugauugaggacgauugccugccuauggaccaguuugcggugcaccuuaugccccaucugcucacgcuggcuaacgauagagucccuaauguucgggugcuccuggccaagacccuucgccaaacacugcucgagaaagacuacuuccuggccucugcuuccugucaccaggaagccguggagcagaccaucauggcgcugcagauggacagagauagcgacgucaaguacuuugcuucuauucaccccgccuccacaaagaucagcgaagaugccauguccaccgcuagcucuacguauuga

SEQ ID NO: 74152 - RNA, 1434 nt, Artificial Sequence
  derived and/or modified sequence opt5 from PPP5C__Homo_sapiens__NP_001191213
auggccauggcugagggcgaaagaaccgagugcgccgaacccccucgggacgagccgcccgcggauggggcucugaagcgcgccgaggaacucaaaacacaggccaacgacuacuucaaggcuaaagauuaugagaaugccaucaaguuuuacagccaagcuauugaacugaacccuuccaaugccaucuauuacggaaacagaucucuugcguaucugcggacggaguguuacggcuaugcccucggggacgcuacccgcgccauugaacuggauaaaaaguacaucaagggauacuauagacgggcugccagcaauauggcgcuuggcaaauuccgcgccgcucugagagacuacgagacaguggucaagguuaaaccccacgauaaggacgccaaaaugaaguaucaggagugcaacaagauugugaaacagaaggcuuuugaacgggccaucgccggggaugagcauaaacgcuccguggucgacucucucgauaucgaaagcaugaccauugaggacgaauacuccggaccuaagcuggaggauggcaaagugacaaucucuuucaugaaggagcugaugcagugguauaaagaccaaaagaagcuccacagaaaaugugcuuaccagaccgaaaagauuacaguuugcggcgacacccaugggcaguuuuaugaucugcuuaauaucuucgagcugaacggacuccccagcgaaacgaauccuuacauuuuuaacggcgacuucguggaucggggguccuuuagcgucgaggugauccugacccuuuucggauuuaaacugcucuacccggaccacuuccaucugcugcgcggcaaucacgaaacagauaacaugaaucagauuuauggguuugagggagagguuaaggcgaaauacaccgcccaaauguaugaacucuucucugagguguucgaauggcugccccuugcucaguguaucaacggcaagguccugaucaugcacggcgggcucuuuuccgaggacggagugacacuggaugacauuagaaagaucgaacggaaucgccagccucccgauagcggcccuaugugcgaccuucuguggucugauccccagccgcaaaacgggagauccauuagcaaacggggagugucuugucaguucggcccugacgucaccaaggccuuucucgaggagaacaaucuggacuacaucauuagaucccaugaaguuaaagccgagggguaugaaguggcucacggaggccgcugcgugacggucuucagcgcccccaacuacugugaucagaugggcaauaaggcguccuauauccaucugcaagggucugaccuccggccucaguuucaccaguucacagcugugccccaccccaacguuaaaccuauggccuacgccaauacccugcuucagcugggaaugauguga

SEQ ID NO: 74153 - RNA, 1029 nt, Artificial Sequence
  derived and/or modified sequence opt5 from PPP6C__Homo_sapiens__NP_001116827
auggcuccccuggaccucgauaaguacguggagaucgccagacugugcaaauaucuuccugaaaacgaccugaaggucagcccgauuuguggccucgcccccuccgggugcggagcgccugcuggccggcccuuccugucuccugggcccccuccgguuuuucacuuccuucgcuuucugaaagagagacucugugauuacgugugcgaccugcugcucgaagagagcaaugugcagcccgucuccaccccugugacaguuuguggagauauccauggccaauucuaugaccugugcgaacuuuuucggaccgggggacaggugcccgauacgaacuacauuuucaugggcgacuuugucgaucgcggcuauuacucucuggagacauucaccuaucuccuggcccuuaaggccaaauggccugacagaaucacacugcuccgggggaaucacgagagccgccagauuacccagguguacggauuuuacgaugaaugucaaacaaaguauggcaacgcuaaugccuggagauacugcaccaagguuuucgacaugcugacgguggcugcccugaucgaugagcagauccucuguguccaugggggacugucccccgacauuaaaacccuugaccagauccggacaauugaacgcaaccaggagaucccgcacaagggcgcguuuugcgaucugguguggucugacccugaggauguggacaccugggccauuagccccagaggggcuggauggcuuuucggcgccaaagucacaaaugaauuuguucauaucaacaaucugaagcucauuugucgggcucaccaacuggugcacgagggcuauaaauucauguucgaugaaaagcucgugaccgucugguccgccccuaacuacugcuaucgcugcgggaauaucgcgagcaucaugguguuuaaggacguuaacacgagagagcccaaacuguuccgggccgugcccgauucugaacgcgucauuccuccgagaacaaccacacccuacuuucuguga

SEQ ID NO: 74154 - RNA, 2802 nt, Artificial Sequence
  derived and/or modified sequence opt5 from PPP6R2__Homo_sapiens__NP_001229828
auguucuggaaguuugaccugaacaccacaagccacguggauaaacuccuggacaaggagcaugucacgcuucaggaacugauggaugaggacgauauccuccaagaaugcaaagcccagaaucagaagcugcuugacuuccuguguagacagcaaugcauggaggaacucguuucccugauuacccaggaucccccucuggacauggaggagaaagugcgguuuaaguacccgaacacagcuugugaacuccugaccugcgaugugccccagaucucugaccgccuuggcggggaugagagccugcucucccugcuuuaugacuuccuggaucacgaaccuccccucaauccucugcuggccagcuuuuucucuaagacaauuggaaaccucaucgcgagaaaaaccgagcaggucauuacauuucugaagaaaaaggacaaauucaucucccuugugcugaagcauaucggcaccucugcucucauggaccugcuucugcggcucguuagcuguguggagcccgccgggcugcgccaagauguccugcacuggcucaaugaagagaaggugauucagagacugguugaacuuauccauccuucccaggacgaggaucggcagagcaacgccucucaaacgcugugcgacauugugcgccucggaagagaucagggcucccagcugcaagaagcucuugagccggacccccugcucaccgcccuggagagccggcaggauugugucgaacagcugcucaaaaauauguuugacggggaucgcacagagucuugccugguguccggaacccaggugcuucugacacuccuggaaaccagacgggucggcacggagggccugguugacagcuucucucaagggcuugaacgcuccuacgcugugagcuccucugugcuccacggaaucgagccuagacugaaggauuuucaccagcugcuccugaaucccccuaaaaagaaagccauucuuacaaccaucggcguccuggaggaaccccucgggaacgcgcggcugcauggagcccgccugauggcugcccuucuccacacaaacaccccgagcauuaaucaggagcuguguagacugaacaccauggaccuccugcuugaccuguucuuuaaguauacauggaauaacuuccuccauuuccagguggaacugugcaucgcugccauccugucccacgcggcccgggaggaaagaacggaggcuagcggcucugagucccgcguugaaccuccccacgagaaugggaaccggagccuugaaaccccucaacccgccgcuucucuccccgauaacacaauggugacccaucuguuucagaaauguugccugguccagcgcauucucgaggccugggaggccaaugaccacacacaggcugcgggaggcaugagacggggcaacauggggcaucugaccagaaucgccaaugcugugguucaaaaccuugaacgcggaccugugcagacgcacauuagcgaggucauccggggccugccggccgauugcagagggcgcugggaauccuucguggaggaaacacucaccgagaccaaucggagaaacacagucgaccuggccuuuucugauuaccagauucagcaaaugaccgcuaauuucguggaccaguuuggauucaacgaugaggaauuugccgaccaggaugacaauaucaacgcgcccuucgaucgcaucgcugagauuaauuuuaacaucgacgccgaugaagacagcccuuccgccgcucuguucgaggccuguugcagcgaccggauucaacccuuugaugacgaugaagacgaggauaucugggaggacucugauacaagaugugcugcccggguuauggcgcgcccuagauucggcgcuccccaugcuuccgaaagcugcucuaagaaugggccggagcggggaggccaggacggcaaggccucccuugaagcucacagagaugccccuggggcgggagcucccccugcccccggcaaaaaggaggccccucccguggaaggggacagcgagggagcuauguggacggccgucuuugaugagccggccaacuccaccccuacagcucccggcgugguucgcgacguggggucuagcgucugggcggccggcaccuccgcucccgaagagaaaggaugggccaaguucacagauuuccagccuuuuuguugcucugaaagcggcccgcgguguuccagccccguggacaccgagugcucucacgccgagggguccagaagccagggaccugaaaaagccuucucucccgccuccccuugugcguggaaugugugcguuacgcgcaaggcuccccuccuggccagcgacucuagcuccagcggcgggucucauuccgaggauggagaccaaaaggccgcuagcgccauggaugcggucuccagaggcccugggcgggaagcucccccgcugccuaccguggcccgcacagaggaagccgugggcagagucggaugugcugacucucggcuccugagccccgccugcccugcucccaaagaggugaccgccgcgccggccguugcugugccucccgaggccacagucgcuauuaccacggcccuuuccaaggccggcccugcuauccccacacccgcggugucuagcgcccuggcuguugccgugccucucgggccgaucauggccgucaccgcugcccccgcgaugguggcuacacugggaaccguuaccaaagauggcaagacagacgccccucccgaaggggccgcucugaacggaccuguguga

SEQ ID NO: 74155 - RNA, 2640 nt, Artificial Sequence
  derived and/or modified sequence opt5 from PPP6R3__Homo_sapiens__NP_001157632
auguucuggaaguuugaccugcacagcuccucucauaucgauacccuccuggagagagaagacgugacacuuaaagagcugauggaugaagaggacguccuccaggaaugcaaggcccaaaaccggaaacugauugaguuccuucugaaggcugagugucucgaagaucugguuagcuuuaucauugaggaacccccucaggacauggaugagaaaauccgcuacaaguauccgaauauuuccugcgagcugcucacgucugacgugagccagaugaacgauagacugggcgaagacgagucccuucugaugaagcucuacucuuuccugcuuaaugauagcccccugaacccucuccuggccuccuuuuucagcaaagugcugucuauccucaucucccggaagcccgaacagauugucgacuuucugaaaaagaaacacgauuucguggaccuuaucauuaagcauaucgggaccagcgcgauuauggaccugcuccugcgccuucugacauguaucgagccuccccaaccuagacaggauguucucaauuggcugaacgaagagaagauuauccagcggcugguggagaucguccacccgucucaggaagaggaccgccauuccaaugcuagccaaucucucugcgaaauugugagacugucccgggaucagaugcuucagauccagaacagcaccgagcccgacccucugcucgccacacuggaaaaacaagagauuaucgagcagcuucuguccaauauuuuucacaaggagaaaaacgagucugccaucguuagcgcuauccagauucuccugacccugcucgaaacacgcagacccaccuucgagggacacaucgaaauuuguccucccggcaugucccauagcgccugcucugugaauaaguccguccuggaggcuauccgggggcgccuuggcagcuuucacgagcugcuccuggaaccgccuaaaaagucugugaugaaaacgaccuggggagugcuggaucccccugucgggaacacaagacuuaauguuauucggcucaucagcucccugcugcaaaccaacacaucuagcaucaauggagaccucauggagcugaacuccauuggcgugauccuuaacauguucuuuaaguauaccuggaauaacuuccugcauacacagguggaaauuuguaucgcccucauucuggcgagccccuucgagaauacggagaacgccaccaucacagaucaggacucuaccggcgauaaucugcuucucaagcaccuguuucagaaaugccaacugauugaacgcauccucgaggcuugggaaaugaacgagaagaaacaggccgaagggggaagacggcacggcuacauggggcaucugaccagaaucgcuaauuguauuguccacuccacagacaagggacccaacagcgcccuugugcagcagcugaucaaagaucucccugacgagguucgcgagcggugggaaacguucugcaccucuucccugggcgagacaaauaagagaaacaccguggaccuggucacaaccugucauauucacagcuccucugaugacgaaaucgauuuuaaggagacgggguucagccaagacuccucucuucagcaggcguuuagcgauuaucagaugcaacagaugacauccaauuucauugaccaguuuggauucaacgaugaaaaauuugccgaccaggaugacaucggcaaugugagcuucgaucgcguuucugacaucaacuuuacccucaauaccaacgaguccggcaacauugcucuguucgaggccugcugcaaggaacggauccaacaguuugaugacgggggaagcgacgaggaagauauuugggaggaaaaacauaucgcuuucacaccggagucucagagacgcuccagcucuggcagcaccgacuccgaggaaagcacagauucugaggaagaggacggggccaagcaagaucuguucgagcccuccagcgccaauacggaagacaaaauggagguggaucucuccgaaccucccaacuggucugcuaauuuugacgucccuauggagaccacacacggagcgccccuggauagcgugggcuccgacgucuggucuaccgaagaaccgaugccuacaaaggagaccgggugggccagcuucuccgaauuuacgucuagccuuuccaccaaggauagccugcggucuaacucccccguggagauggaaacaagcaccgagccuauggacccccucacaccuucugcugccgcccuggcuguucagcccgaagccgcgggauccguggcuauggaggccagcucugauggcgaggaagacgccgaguccaccgacaaagucacggaaacagugaugaauggcgggaugaaggagacccugagccuuacaguugaugcuaaaaccgaaaccgccguguucaagagaguccucaaauccuaccgcgaggagggaaagcugagcacaucucaggacgcugccuguaaggaugcggaagagugcccggaaacggccgaggcuaaaugugccgcuccucggccucccagcuccucucccgagcagagaaccggccaaccgagcgcccccggggacacauccgugaacggaccuguguga

SEQ ID NO: 74156 - RNA, 4203 nt, Artificial Sequence
  derived and/or modified sequence opt5 from PPRC1__Homo_sapiens__NP_001275656
auggccgcuagacggggccgcagagacgggguggcgcccccuccgagcggaggccccgggccugaucccggaggcggggcccggggauccggcuggggcucucgcagccaggcuccuuacgggacccugggagccgucuccggcggggagcaaguucuccugcacgaagaggccggagacucuggcuucgugagccuuuccagacuggggcccucucuccgggauaaggaccuggaaauggaggaacuuaugcugcaggaugagacacuccugggaacgaugcagagcuauauggacgcuucccugaucagccucauugaggauuuuggcucucugggcgaaucccgccuuagccuggaggaccagaacgaagugucucuccugaccgcccuuacagagauccuggauaaugcugacuccgagaaccucagcccuuucgauucuauuccggacuccgaacugcuggucagccccagagagggguccucucuccauaaacugcuuacccugagccggacaccucccgaacgcgaucucaucaccccuguggacccccugggaccguccacaggcagcucuagaggguccggaguugagaugagccuuccugaccccucuugggauuuuagcccucccuccuuccuggaaaccucuagccccaagcucccuuccuggcggccgccccgcagcagaccucgguggggccaaucucccccuccccagcagcgcuccgacggggaggaggaagaggaaguggccagcuuuucuggacagauucuggcgggcgagcuggauaauugcgucuccagcaucccggacuucccuaugcaccucgccugucccgaagaggaggauaaagcuacggccgcugaaauggccgugccugcggccggcgacgaguccaucucuagccuguccgaacuuguuagagcuaugcaucccuacugccugccuaaccucacccaccuggccucucuugaggaugaacugcaagagcagcccgacgaucucacacugccggaggggugugugguccuggaaauugugggacaggcugccaccgccggcgacgaucucgagaucccuguggucguuagacaggugagccccgggccccggccugugcugcuugacgacucccuggaaacaagcucugcucuccaacugcugaugccgacccuugaguccgagacggaagcggccguccccaaggugacacucugcagcgagaaagaaggacugucucucaauuccgaggaaaagcuggauagcgcuugucugcuuaagccucgcgagguuguggagcccgucgugccuaaagaaccccagaacccucccgccaaugccgcuccgggcucucagcgggccagaaaggggcgcaaaaagaaaagcaaggagcaaccugcggcuugcguugaaggcuaugcccggagacugcgcuccagcucucggggacaguccaccgugggcacagaggucaccagccagguggacaaccuccagaagcaaccccaggaggaacugcagaaagaguccgggccucugcagggaaagggcaaacccagagccugggcucgcgccugggcugccgcgcuugaaaauucuagcccgaagaaccucgagcgguccgccgggcaaucuagcccugcuaaagaaggaccccuggaucuguacccuaagcucgccgacaccauucagacaaaucccauccccacgcaucugucccuugucgauucugcucaggccagcccuaugccgguggacuccguugaggcggaucccaccgccgugggcccuguccuggcugggcccgugccuguugaccccggccucguggaucuggccagcacaucuuccgaacuggucgagccucuuccggcugagcccgugcucauuaacccugugcuggccgacagcgccgcuguugaucccgcggucgugccuaucucugacaaucugcccccgguggaugccgucccuuccggacccgcucccguggaccucgcccugguugacccugugcccaacgaucuuaccccugucgacccggugcugguuaaaagcagacccacagauccucgccggggcgccgugucuuccgcucucgggggaagcgcgccccagcugcuggucgaauccgagagccuugacccucccaagaccauuaucccggaagugaaggagguuguggauucucucaaaaucgagagcggcacguccgccacaacccacgaagcuagaccucggccccugucucugagcgaguaucgcagacggagacaacagcgccaggccgaaaccgaggaacgguccccucagcccccuacagggaaguggcccucucucccggagaccccuacaggacuggccgacauucccugucuugucauucccccugcuccggccaaaaagacggcgcugcaaagaagccccgagaccccucucgaaaucugccuggugcccgugggcccuucccccgcuucuccuagcccggagcccccugucuccaaacccguugccagcucuccuacagaacaggugcccucccaggagaugccgcugcuugcccgcccuagcccucccgugcaaucugucucccccgcugugcccaccccuccgagcauguccgccgcucugcccuuuccugccgggggccucggaaugcccccuucucugcccccgccuccccuccagccucccagccugccucuuuccaugggccccguucugccggauccuuucacacacuacgcgccccuccccagcuggccuuguuauccgcaugugucucccuccggguacccuugccugcccccucccccuaccgucccccuggugagcggaacgccgggcgccuacgcuguuccucccaccuguucugugccuugggcucccccgccugcccccgucagccccuauuccucuacaugcaccuacgggccucuuggauggggccccgggccucagcacgccccguuuuggagcacagugcccccucccccucugcccccugccuccaucggcagagcuguuccgcagcccaagauggaaucucggggaaccccugcggggcccccugagaaugugcucccccugagcauggccccgccucucucccugggccuucccggacauggcgcuccccaaacggagccuacaaaggucgaagugaaacccgugccugccagcccgcaccccaagcacaaagucucugcccugguucaguccccucagaugaaggcucucgccugcgugagcgcggagggggugaccgucgaggaacccgcuuccgaacgccugaaaccugagacacaggagaccagaccccgggaaaagccgccucugcccgccaccaaggccgugccuacaccccgccaaucuacgguuccgaaacuuccugcugugcaucccgccagacugcggaagcucagcuuccugcccaccccucgcacacagggauccgaggacgucgugcaggcguuuauuucugaaaucggcaucgaggcuagcgaucucuccagccugcuugagcaguucgaaaaaucugaggccaagaaagaaugucccccuccggcccccgcugacucccuggccguuggcaacagcgggucuuccugcagcucuagcggaagaucccggcgcuguucuagcuccagcuccucuagcuccucuagcuccucuagcuccucuagcuccucuagcuccagaagccggucuagauccccuagcccccgccggagauccgaucgccggagacgcuauagcucuuaccggagccacgaccauuaucaaagacagcgcgugcugcagaaggagcgggcuauugaagagagacgggucguguuuaucggcaagauuccugggcgcaugaccagauccgagcucaaacaacgguucucugucuucggagaaaucgaggaaugcacaauucacuuucgcgugcagggcgauaacuacggguucguuaccuauagauacgccgaggaagcguuugccgcuaucgagagcggacauaagcugcggcaggccgacgagcagcccuucgaccuuuguuuuggcggcagacgccaauucugcaaacgguccuacucugaucuggacagcaauagagaagauuuugacccugcuccggugaaguccaaauucgauucucucgacuuugauacgcugcucaagcaggcccagaaaaaccugcgccgguga

SEQ ID NO: 74157 - RNA, 909 nt, Artificial Sequence
  derived and/or modified sequence opt5 from PPT2__Homo_sapiens__NP_001191032
augcugggccucugcgggcagagacugcccgccgcuugggugcuucugcuccugccuuuccuuccgcugcuccugcuggccgcgcccgcuccucaccgggccagcuacaagcccgucaucguugugcauggacucuuugacuccucuuauagcuuccgccaucugcuugaguacauuaacgaaacccacccuggcacaguggucacggugcuggaucucuuugacgggagagagucccugcggccccuuugggaacaaguucagggauuccgcgaggccguggucccuaucauggcuaaagccccgcagggcgugcaccugauuuguuauucucaagggggacucguuugcagagcucugcugagcgugauggaugaccauaaugucgauuccuuuaucucucucagcagcccccagaugggccaguacggcgacaccgauuaucugaaguggcuuuucccuacauccaugcggucuaaccuguaccgcauuuguuauucccccugggggcaggaauuuagcaucugcaauuacuggcacgacccucaccaugaugaccucuaccugaacgccucuuccuuccuugcgcugaucaauggagagagagaucaccccaacgccaccguguggcggaaaaauuuucuccgcgugggccaucugguccugauugggggaccggacgauggcguuaucacaccuuggcagagcucuuucuuuggguucuaugacgcuaacgagaccgugcucgaaauggaggaacaacugguguaccuuagagacuccuuuggacugaagacacuccuggcccggggcgcuauuguccgcugucccauggccggcaucagccacaccgcguggcacuccaauagaacgcuuuaugagaccugcauugagccuuggcugucuuga

SEQ ID NO: 74158 - RNA, 288 nt, Artificial Sequence
  derived and/or modified sequence opt5 from PPY__Homo_sapiens__NP_002713
auggccgcugccagacugugccucagccugcuucugcucuccaccuguguggcgcugcuucugcagccccuccugggcgcucaaggggccccucuggagccggucuaccccggagacaacgccacaccugaacagauggcucaguaugccgcugaucuccggcgcuacaucaauaugcugacgagaccccgguauggcaagcgccacaaagaggacacccuugccuucucugaaugggggagcccucaugcggccguucccagagagcuguccccucucgaucuguga

SEQ ID NO: 74159 - RNA, 498 nt, Artificial Sequence
  derived and/or modified sequence opt5 from PQBP1__Homo_sapiens__NP_001161464
augccccugccuguggcccuccagaccagacuggcuaagcggggcauccuuaaacaccuggagccggaacccgaggaagagauuaucgccgaagacuacgaugacgauccugucgacuaugaggcgacacgccucgaggggcugcccccuagcugguacaagguuuucgaucccuccugcggacuuccuuauuacuggaacgcugacagagaagagggcaaagaacggcgccaucacagacgggaggagcuggccccguaucccaagucuaaaaaggccgugagccgcaaggaugaggaacucgacccuauggaucccuccucuuacagcgacgcuccuagagggacgugguccaccggacugcccaaacggaaugaagccaagacaggcgcugauaccacagccgcggggccgcuguuucaacagcgcccuuaucccucuccuggagccgugcucagagcuaacgccgaggcuagccggaccaaacagcaggacuga

SEQ ID NO: 74160 - RNA, 567 nt, Artificial Sequence
  derived and/or modified sequence opt5 from PQLC3__Homo_sapiens__NP_001269639
auggaggccgcucugcucggccugugcaacuggagcacccuuggggugugugccgcgcugaagcucccccagaucuccgcuguccuggccgccagaucugcucggggacuuagccugccuucccuccugcuggaacucgccggcuuccugguuuuucuucgcuaccaaugcuauuacggguauccgccccugacauaccucgaguauccuauucugaucgcucaggacgugauucuucugcucuguaucuuccacuuuaauggaaacgugaaacaggccacgcccuacauugcgguccuggugucuagcugguucauccuggcccuccagaaguggaucauugaucuggcuaugaaucuuugcaccuuuaucuccgccgcuucuaaauucgcccaacugcagugucucuggaagacaagagacagcggcaccguuuccgcgcugacauggagccuuucuuccuauaccugcgccauucugcuccgguuugugaucaugcuggcucugaacauuugggucacagugaccguucuccgcuacagaaaaacggccaucaaggcugaauga

SEQ ID NO: 74161 - RNA, 174 nt, Artificial Sequence
  derived and/or modified sequence opt5 from PRAC1__Homo_sapiens__NP_115767
augcugugcgcccacuucagcgaccagggccccgcucaccucaccacauccaagucugccuuucugagcaacaaaaagacguccacccuuaaacaucugcucggggagacaagaucugauggaagcgcguguaauuccggcaucucugggggacggggccgcaagauuccuuga

SEQ ID NO: 74162 - RNA, 273 nt, Artificial Sequence
  derived and/or modified sequence opt5 from PRAC2__Homo_sapiens__XP_011523050
auggacagacggcgcauggcccugagacccggcagccggcgcccuaccgccuucuuuuuccacuccagauggcucgugccgaaccugcuugccuuuuuccuggggcucucuggagcgggccccauccaucugccuaugcccuggccuaaugggcggcgccacagaguccuugauccccauacacagcugagcacgcacgaggcuccuggacgguggaagccgguugcuccccgcaccaugaaagccugcccucaagugcuccuggaaugguga

SEQ ID NO: 74163 - RNA, 567 nt, Artificial Sequence
  derived and/or modified sequence opt5 from PRADC1__Homo_sapiens__NP_115695
auggugcccggcgccgcuggguggugcugucugguccucuggcugccugccugcguugcggcucacggauucagaauccaugacuaccuuuauuuucaggugcugagcccgggcgauauucgguacaucuucaccgccacacccgccaaggacuuugggggaauuuuccacacgcgcuaugagcaaauccaucucgugccugcugaacccccugaggccuguggcgaacuguccaacggguuuuucauucaggaucagaucgcucuugucgagagaggaggcugcucuuuucugagcaaaacccgggugguucaggaacacggcgggcgcgccgugaucauuuccgacaaugcggucgauaacgacucuuucuacguggagaugauccaagauagcacacagagaaccgccgacauucccgcucucuuucugcugggacgggauggcuauaugauccgcagaucccucgagcagcaugggcugccuugggccauuaucucuauuccgguuaaugugacaagcauccccaccuucgaacuucugcagccucccuggacauuuugguga

SEQ ID NO: 74164 - RNA, 537 nt, Artificial Sequence
  derived and/or modified sequence opt5 from PRAF2__Homo_sapiens__NP_009144
augagcgaggugagacugcccccucuccgggcccuggacgauuucguccuuggcuccgcucgccuggccgcgccggaccccugcgauccucagagauggugucaccggguuaucaacaaucuccuguacuaucaaaccaacuaccuucugugcuuugggauuggacucgcucuggccggcuaugugcgcccccugcauacacuccugucugcccuuguggucgcuguggcccuggggguucucgugugggcugccgaaacgagagcggccguccggcgcuguagacggagccacccugcugccugccuggcugccgugcuugcgguuggacugcucgugcugugggucgccggcggggcuuguaccuuccuguuuuccaucgccggacccgugcuccugauucuugugcaugcuucucugcgccucagaaaucugaagaacaaaaucgagaauaagauugaaagcaucggccuuaaacggacaccuaugggccugcuccuggaggcccuggggcaggaacaggaggccggauccuga

SEQ ID NO: 74165 - RNA, 2013 nt, Artificial Sequence
  derived and/or modified sequence opt5 from PRAM1__Homo_sapiens__NP_115528
auggcccaccaucugcccgcugccauggagagccaccaggacuucagauccaucaaggcgaaauuucaagccucucagccugaaccgagcgaucuccccaagaaaccucccaagccugaguucggcaaacugaagaaguuuucccagcccgaacuuucugagcauccuaaaaaggccccgcugcccgaguucggggccgugagccucaaaccucccccucccgaagucaccgaccugccgaagaaaccucccccucccgagguuacagaucuucccaagaagccuccgcccccugaagugacggaccugcccaaaaagccucccccgccugaggugaccgaucuccccaaaaagccuuccaaacuggaacugucugaccucagcaagaaauuuccccagcugggagcuacaccuuucccccggaagccgcuucaaccugaggucggcgaggcuccccugaaggcuucccuccccgaaccuggggccccggcgcgcaaaccccugcagccugaugagcuuagccaccccgccagaccucccucugaaccuaaguccggagcuuuuccccggaaacuguggcagccggaggccggcgaagcuaccccucgcagcccccagccugagcucucuacauuccccaagaaaccggcccaaccugaguuuaacguguaccccaagaagccuccccagccccagguugggggacugccuaaaaaguccgugccgcagcccgaguucagcgaagcggcccaaaccccucuguggaaaccccagucuuccgaaccuaagagagacagcuccgcuuuucccaaaaaggccucucagccuccgcucagcgauuuccccaagaaaccuccccaaccugagcugggcgaccuuacacggaccuccagcgaacccgaggucucugugcugccgaagcgcccuagacccgcugaguuuaaagcccucuccaagaaacccccucagcccgaacugggcgggcuuccucggacgagcucugagccggaguucaauagccugccccgcaagcuccugcagccugaaagacggggacccccucgcaaguucucccagcccgaaccgucugccguucugaaaagacauccucaacccgaguuuuucggcgaucucccucggaagcccccucugcccagcuccgcuagcgagucuucccuuccggcggccguggcuggguuuagcucucgccacccucugucccccggauucggcgccgccgggacccccagauggcggagcggaggccucguccacuccggcggggcuagaccuggacugcgcccgucucaucccccucggagacgcccccuuccucccgccagcucccugggccacccuccggcgaaacccccucugcccccugggcccguggacaugcagucuuuucggagaccgagcgcugccuccauugaucuccgccggacaagaagcgccgcuggacugcauuuccaggaccgccagccugaagacaucccccaagugcccgaugagauuuaugaacucuacgacgaugucgagccucgggacgauucuucccccagcccuaagggcagagacgaggccccgucuguucagcaggcugcccgccggcccccucaggaucccgcgcugagaaaagaaaaggacccucaaccccagcagcuuccgccuauggaucccaaacugcucaagcagcugcggaaggccgagaaagcugaacgcgaguuuagaaagaaauucaaguuugaaggggagaucguggugcacaccaaaaugaugauugacccuaacgccaagacacggagaggaggcggcaagcaccuggggauccgccggggagagauccuugaagucauugaguucaccuccaaugaagagaugcucugcagagaucccaaaggcaaguauggguacgugccucgcacggcucugcugccccucgaaacagagguuuaugacgacguggauuuuugugacccgcuggagaaccaaccucuuccccugggaagauga

SEQ ID NO: 74166 - RNA, 1530 nt, Artificial Sequence
  derived and/or modified sequence opt5 from PRAME__Homo_sapiens__NP_996837
auggagagacggcgccuguggggcagcauccaguccagauacauuucuaugagcguguggaccucuccccggcgccucgucgaacuggccgggcaaucccuucugaaggacgaggcucucgccaucgcggcucuggaacuucugccuagagagcuuuucccgccccuguuuauggccgccuucgauggacggcacagccagacacugaaagcuaugguucaggccuggccuuuuacgugccucccccugggcgugcuuaugaaggggcagcaucugcaccucgaaaccuucaaagcugugcuggacggacuugauguccugcucgcccaagaggugcgcccuagacgguggaagcugcagguucuggaccuccgcaaaaacucccaucaggauuuuuggacaguguggucuggcaauagagcgagccuguauuccuuccccgagccugaagccgcucagccgaugaccaagaagcggaaagucgacgggcuuagcacagaggccgaacaacccuuuauuccuguggagguucugguggaucucuuccugaaggagggagcuugugacgaacucuuuucuuaccugaucgagaaagucaagcgcaaaaagaacgugcucagacugugcuguaagaaacugaagauuuucgccaugcccaugcaggauaucaaaaugauccucaagauggugcagcuggacuccauugaagaucuugagguuaccugcacauggaaacugccuacccucgcgaaguuuagccccuaucugggccagaugaucaaucuucggcgccugcuccugucucacauucaugccuccagcuacaucucuccggaaaaagaggagcaauauauugcucaguucacgucccaguuucugagccuccaaugucugcaggcccuuuacgucgacucccuguucuuccucagaggccggcuggaucagcugcuuagacacgugaugaacccucucgaaacccugucuaucacaaauugccgccugagcgagggggacgugaugcaccucucccagagccccucugucucccaacugagcgugcuuucucugagcggaguuaugcucaccgacguguccccugaaccccugcaggcucugcuugagcgggccucugccacacuccaggaucuggucuuugacgaauguggcauuaccgaugaccagcugcucgcucugcuucccagccugucccauugcagccaacucacgacacugucuuucuaugggaacuccaucagcaucucugcgcugcagucccuucuccagcaccugauuggacugagcaaucucacccaugugcuguacccuguuccgcuugaguccuacgaggauauccacggcacacugcaccucgaaagacuggccuaucugcaugcucgccuucgggagcuccugugugaacuggggagacccucuaugguguggcucagcgccaacccuugcccccacuguggagaccgcaccuuuuacgauccugagcccauucugugcccgugcuucaugccuaauuga

SEQ ID NO: 74167 - RNA, 429 nt, Artificial Sequence
  derived and/or modified sequence opt5 from PRAP1__Homo_sapiens__NP_001138673
augagacggcugcuccuggugaccagccuugucguugugcugcucugggaggccggcgcugugcccgccccuaaggucccgaucaaaaugcaagugaagcacuggcccuccgaacaggacccugagaaagcguggggagcucgcguuguggaacccccugagaaggaugaccagcuggucgugcuuuuccccguucagaaaccuaagcugcucacaacggaagagaagccgagagggaccaaagccuggauggagacagaagauacccugggccaugugcugucucccgagccugaccacgauagccucuaccaucccccucccgaagaggaccagggggaggaacggccgcgccugugggucaugccuaaccaccaagugcuucugggacccgaggaagaucaggaccauauuuaucacccucaguga

SEQ ID NO: 74168 - RNA, 996 nt, Artificial Sequence
  derived and/or modified sequence opt5 from PRB1__Homo_sapiens__NP_005030
augcugcucauccugcuuagcguggcccugcucgcucuguccucugcccagaaccuuaaugaggacgucagccaggaagagucccccucucugauugcgggcaacccucaggggccgagcccccagggaggcaauaagccucaggggcccccucccccuccgggaaaaccccaaggcccucccccucaagggggaaacaagccccagggcccgccucccccuggcaaaccccaggggcccccuccgcagggagauaaguccagaucuccccggagcccucccggcaaaccucaggggcccccgccucagggaggcaaucagccccaagggccucccccucccccgggaaagccucagggcccuccgccccagggcgggaaccgcccccaaggacccccucccccuggcaagccccaggggccucccccgcagggagacaaauccagaagcccucggucucccccuggcaagccccaggggccgccuccccaaggaggcaaucagccucaggggcccccucccccgcccggcaaaccucagggacccccuccccaaggcgggaagaaaccucagggaccgcccccucccggcaagccucaggggcccccgccucagggcgauaagucccgcagcucucaauccccucccggaaaaccccaggggcccccuccgcaaggcggaaaccagccccagggcccucccccucccccggggaagccucagggacccccuccccagggcgggaauaaaccucaaggacccccgccucccggcaagccccagggcccuccggcucaagggggaagcaaaucucaguccgccagaagcccucccggcaagccccaggggccuccccagcaggaaggaaacaauccucagggcccgcccccucccgccgggggcaacccucaacagccccaggcuccgccugccggacagccccaagggcccccucggcccccucaaggcggacgcccguccagacccccucaguga

SEQ ID NO: 74169 - RNA, 1251 nt, Artificial Sequence
  derived and/or modified sequence opt5 from PRB2__Homo_sapiens__NP_006239
augcugcucauccugcuuagcguggcccugcucgcucuguccucugcccagaaccuuaaugaggacgucagccaagaagagucccccucucugauugcgggcaacccucagggggcuccgccccagggaggcaauaagccucaggggcccccuagcccucccggaaaaccgcaagggcccccuccccaaggcggaaaccagccucagggcccgcccccucccccuggcaagccccaggggcccccuccgcagggaggcaauaaaccccaggggccucccccucccggaaagccgcagggcccucccccucaaggggauaaauccagaucuccccggagcccucccggaaagccgcagggcccuccuccccagggcgggaaccaaccccagggaccgcccccucccccuggcaagccccaggggccucccccgcagggaggcaauaaaccucaagggcccccucccccgggaaagccucaggggcccccuccccagggcgacaacaaaucccgcagcucuagaagcccucccggcaagccgcagggacccccuccccaaggcgggaaucagccucagggacccccuccgcccccuggcaaaccccaggggccucccccgcaaggcggaaacaagccucagggcccuccuccgcccgggaagccccagggacccccuccccagggcgauaauaaaucccaaucugcccggagcccucccgggaagccccagggaccgccuccccagggcgggaaccaaccucagggacccccucccccgccuggcaaaccccaggggcccccuccgcaaggcggaaauaagccccagggcccucccccucccgggaaaccucagggaccgcccccucagggcggguccaagucucgcuccagcagaucucccccuggcaaaccccagggaccgccuccccaaggcgggaaccagccccagggaccucccccuccgcccggcaagccucaggggcccccuccccaaggaggcaauaagccgcaggggccucccccucccggcaaaccucagggacccccgccucaaggcggguccaagagccgguccgcccgcagcccucccggaaaaccccagggcccgccccagcaggaagggaacaacccucaaggacccccucccccugcuggcggcaauccccagcagccgcaggccccucccgcugggcaaccucagggacccccgagaccuccccagggcgggcggcccucucgcccuccccaguga

SEQ ID NO: 74170 - RNA, 930 nt, Artificial Sequence
  derived and/or modified sequence opt5 from PRB3__Homo_sapiens__NP_006240
augcugcucauccugcuuagcguggcccugcucgcucuguccucugcccagagccuuaacgaggacgucucccaagaagagucucccagcguuauuuccggcaagccugaagggagacggccgcagggaggcaaucagccccagcgcaccccucccccucccgggaaaccugagggaagaccgccccaaggcgggaaccagucucagggaccucccccucggcccggcaagccggaaggcccucccccucaagggggaaaucagagccagggcccuccgccccgccccgggaaacccgagggacagccuccccagggcgggaaccaaucccagggaccucccccgagaccuggcaagcccgagggcccucccccucaagggggaaaucagagccaggggcccccgccucggcccggcaaacccgaaggaccuccgccccagggcgggaaccagucucaaggaccucccccucgccccggcaagccugaggggcccccgccucaaggcggaaaucagucccaggggcccccuccccacccgggcaagccugaaggacccccuccccagggcgggaaccagagccagggacccccuccgagacccggcaaaccugaggggcccccuccccaaggcggaaaucagucucagggcccuccgccccggccugggaagcccgagggaccucccucccagggcgggaacaaaccgcagggcccuccuccccaucccggaaagccccaaggcccuccgccccaggaagggaauaaaccucagagacccccucccccgggacgcccucaagggcccccucccccuggcggaaacccccagcagccgcugccuccucccgcgggcaagccccaggggccgcccccucccccucaaggcggacggccccaccgcccuccgcagggccagcccccucaguga

SEQ ID NO: 74171 - RNA, 537 nt, Artificial Sequence
  derived and/or modified sequence opt5 from PRB4__Homo_sapiens__NP_001248328
augcugcucauccugcuuagcguggcccugcucgcucuguccucugccgagagcuccucugaagacgucagccaggaggaaucccuuuuccugauuucuggcaagcccgaggggagacggccucaaggaggcaaccagccgcagagacccccucccccucccgggaaaccucagggaccgcccccucaaggcgggaaucagagccagggacccccucccccgccuggcaagcccgaaggccgcccuccccagggcggaaaccaaucccaggggcccccuccgcaccccgggaaaccugagcggcccccuccccagggaggcaaucagagccaagggaagccgcagggaccuccccagcaagagggcaacaaaccucaggggcccccucccccggggaagccucagggacccccucccgcgggcgggaauccgcagcaaccccaggcuccucccgccggaaagccucagggacccccucccccgccucagggcggcagacccccucgccccgcccaaggccagcagccgccucaguga

SEQ ID NO: 74172 - RNA, 1578 nt, Artificial Sequence
  derived and/or modified sequence opt5 from PRC1__Homo_sapiens__NP_001254509
augagacggagcgaggugcuggccgaagaguccaucgucugccuccagaaggcucugaaccaccuucgcgaaauuugggagcugaucggcauucccgaagaccaaagacuccagcggaccgagguugugaaaaagcauaucaaagaggaaggggagacaacgauucugcagcuugaaaaggaucugcgcacccagguggagcucaugagaaaacaaaagaaggagcggaaacaggaacugaagcugcuccaggagcaggaccaagaacugugugagauccuuugcaugccucacuacgauaucgacucugccagcgucccgucccuggaagaacucaaucaguuccgccagcaugugacaacccugagagagacaaaagcgucucggcgcgaagaguuuguuagcauuaagagacagaucauucuuuguauggaggagcuggaucacacccccgacacauccuucgaacgggauguggucugcgaggacgaggaugcuuuuugucucucucuggaaaacaucgccacccugcaaaaacuccugcgccagcuugagaugcaaaagagccagaaugaagccgugugcgagggacugagaacgcagauucgggaacucugggaccgccugcagaucccugaggaggaaagagaggcuguugccaccauuauguccggcagcaaggcuaaagugcggaaggcccuucagcuggaagucgauagacucgaggagcugaaaaugcaaaacaugaagaaagugaucgaagcgauccgcguggagcugguccaguauugggaccaguguuucuacucucaggaacaacggcaggccuuugcucccuucugcgccgaggauuauacagaaucccuccugcagcuucaugacgcugagauuguuagacugaagaauuacuaugaggugcacaaagaacucuuugagggggugcagaagugggaagagaccuggcgccuguuccuugaauuugagcggaaggccagcgacccuaacagauucacaaaucgcggaggcaaccugcucaaagaggaaaagcaacgggcgaaacugcagaagaugcugcccaaacucgaggaggaacugaaggccagaaucgaacuuugggagcaggagcacucuaaggcuuuuauggucaaugggcagaaauucauggaauacguggccgagcaaugggaaaugcaucgccuggagaaggagcgggcuaaacaggaaagacagcucaagaacaaaaagcaaaccgagacggaaaugcuguauggauccgccccucgcacaccgagcaagcggagaggccuggcccccaauaccccuggcaaagcucggaagcucaacacaaccaccaugucuaaugcgacagccaacuccagcauucgccccaucuuugggggaacgguuuaccacuccccugugucuagacuucccccgagcggcuccaaaccugucgcugccagcaccuguucugggaagaaaacaccccggaccggaagacauggcgccaauaaggagaaccuggaacugaacggguccauucucagcgcucgcacauucaagggauuccagaucuga

SEQ ID NO: 74173 - RNA, 1476 nt, Artificial Sequence
  derived and/or modified sequence opt5 from PRCC__Homo_sapiens__NP_005964
augagccugguggccuacgcuuccucugacgagagcgaacccgaugaggccgaaccugagccggaagaggaggaagcggucgcucccaccuccggcccugcccucgggggacuguucgccucucuucccgcuccuaagggccccgcccugcucccuccgcccccucagaugcuggcucccgccuuuccucccccgcuucugcucccucccccuacaggggaccccagacugcaacccccuccgccccugccuuucggacucggcggguuucccccucccccgggaguuagcccugcggaggccgcuggcgugggcgaagggcugggacuuggccugcccuccccucgggggcccggacucaaccugccucccccgaucggcggggccggaccuccccuuggccugcccaaaccuaagaaacgcaaggagccggugaaaauugcugcccccgagcuccacaagggcgauucugacagcgaagaggaugaaccuacgaagaaaaagaccauccugcagggguccagcgagggaacaggccugucugcgcuccugccccagccuaaaaaucuuaccgucaaggaaacaaacagacugcuccugccccaugccuucucccggaaaccuagcgacgggucucccgauaccaagccgucccgccuugcuagcaagacaaaaaccucuucccuggccccugugguuggaacgaccacaaccacacccagcccuuccgcuauuaaggccgccgcuaaaucugcggcccuccaggugaccaagcaaaucacgcaggaggaggacgauagcgacgaagaggucgcucccgaaaacuuuuucucccugccggagaaagccgaaccucccggcguggagccuuaucccuaccccauuccuacaguuccggaggaacugcccccugggaccgagcccgaaccugccuuucaggaugacgcugccaaugcgccccucgaguucaagauggcugccggaagcucuggcgccccuuggaugccgaaacccggcgaugacuauuccuacaaucaguuuagcacauauggggacgcuaacgccgcuggagccuacuaucaagauuacuacucuggcggguauuacccugcgcaggaccccgcccuggugccuccccaggaaaucgcuccggaugccagcuucaucgacgaugaggcuuuuaagagacuucagggaaagcggaaucgcggcagagaggaaauuaacuucgucgagaucaaaggggacgaucaacuguccggcgcccagcaguggaugaccaagucucucaccgaagagaaaacaaugaaguccuuuagcaaaaagaagggagagcaaccuacgggccagcagcggcgcaaacaccagauuaccuaucugauccaucaagcgaaggaaagagagcuugaacugaaaaauacauggagcgagaacaagcucucucggcgccagacccaggccaaauacggguucuga

SEQ ID NO: 74174 - RNA, 165 nt, Artificial Sequence
  derived and/or modified sequence opt5 from PRCD__Homo_sapiens__NP_001071088
augugcaccacacuguuccuccugagcacgcuugccaugcuguggagacggcgcuuugcuaacagagugcagcccgagccuuccgacgucgauggcgccgcgcgggggucuagccucgacgcugauccgcaauccucuggacgcgaaaaggagccccugaaauga

SEQ ID NO: 74175 - RNA, 1491 nt, Artificial Sequence
  derived and/or modified sequence opt5 from PRCP__Homo_sapiens__NP_005031
augggcagacgggcccugcuccugcuucugcucagcuuccuggcucccugggccaccaucgcgcuucgcccugcucugagagcccucgggucccugcaucugccgacaaaccccacgucucucccugccguggcuaagaauuacagcguccuguauuuucagcaaaaaguugaccacuucggauuuaacaccgugaagacauucaaucagcgguaccuuguggccgauaaauauuggaagaaaaacggcggguccauucuguuuuacaccggaaaugagggcgacaucauuugguucugcaacaauacaggguuuaugugggaugucgcugaggaacucaaggccaugcugguguucgcggaacaccgcuauuacggagagucucuucccuuuggcgacaacagcuucaaggauuccagacaucugaauuuucucaccucugaacaggcccuggcugacuucgccgagcugaucaaacaccucaagcggacaauuccuggcgcugagaaccagcccguuaucgccaucgggggaagcuauggcgggaugcuggcggccugguuucgcaugaaauacccucauaugguggucggagcucuugccgcuuccgccccgauuuggcaauucgaagaucuggugcccuguggcguuuucaugaagaucgugaccacggacuuuagaaaaagcgggccucacugcucugaguccauucaccggagcugggaugccaucaaucgccucucuaacaccggauccggccugcaguggcuuacaggcgcucugcaucucuguagcccccugaccucucaggacauucagcaccugaaggauuggaucuccgaaacaugggucaaucucgcgaugguggacuacccuuaugccagcaacuuccugcaaccccuuccggcuuggccuauuaagguggucugccaguaccugaaaaaucccaacguuuccgauucucuccugcuucagaacaucuuucaggcccugaauguguauuacaacuauagcgggcaagugaagugucucaauaucuccgagaccgccacgagcucucugggaacacugggcugguccuaccaggcuugcaccgaggucgugaugccuuucuguacaaacgggguugacgacauguuugaaccccauagcuggaaucucaaagagcugucugaugacugcuuccagcaauggggagugagaccccggccuagcuggauuaccaccauguauggcgggaagaacaucuccucucacacaaauauugucuuuagcaacggagaacuugauccgugguccggcggcggggugacgaaagacaucaccgauacacugguugccgugaccauuagcgagggagcgcaccaucucgaccugcgcacaaagaaugcucuggaucccaugucuguccuucucgccagaucccuggaagugcggcacaugaaaaacuggauccgcgacuucuacgauagcgccggcaagcagcauuga

SEQ ID NO: 74176 - RNA, 3483 nt, Artificial Sequence
  derived and/or modified sequence opt5 from PRDM10__Homo_sapiens__NP_064613
auggacagcaaggaugaguccucucacguguggcccaccagcgccgaacaugagcagaacgcugcccaaguccacuucguuccugacacaggcacgguggcgcagaucguguacaccgaugaccaggucagaccgccccagcaagugguuuauacagcugauggggccuccuacaccucuguggacggaccugaacauacacuggucuauauucaccccguggaggccgcucagacccucuuuacagauccuggccagguugccuacgugcagcaagacgcuaccgcccagcaggcgagccugcccguccauaaucaggugcuuccuuccaucgaaucuguggaugggagcgacccgcuggccacgcuccaaacaccccugggacggcuugaggcuaaagaggaagaggaugaagacgaggaugaggacaccgaagaggacgaagaggaagauggcgaggacaccgaucuggacgauugggagccugaucccccucgccccuucgacccgcacgaccucuggugcgaagaguguaacaaugcccacgcuuccgucugcccuaagcaugggccccugcacccuauucccaacagacccguucugacacgggcccgcgcgagccucccucuggugcuuuauaucgauagauuucugggaggcguguucucuaaacggcgcauuccgaagagaacccaguuuggccccgucgaagggccucucgugcggggauccgagcugaaagacuguuacauccaucuuaagguuagccuggauaagggcgaccgcaaagaaagagaccuccacgaggaucugugguucgagcugucugacgaaacgcucugcaauuggaugauguuugugcggcccgcccagaaccaccuggagcaaaaucuugucgcuuaucaguacgggcaucacguguacuauacaaccaucaagaacguugaaccuaaacaggagcugaaggugugguacgccgcuuccuaugccgaguucgucaaucagaaaauucaugauaucagcgaggaggaacgcaaggugcucagagagcaagaaaagaacuggcccuguuacgagugcaaucggcgcuuuauuucuuccgagcagcugcagcagcaccuuaacagccaugacgaaaaacuggaugucuucuccagaacacggggaagaggccgcgggcggggaaagagacgcuuuggcccgggccggagaccugggcggcccccuaaauucauccgccucgagauuaccucugaaaauggagaaaagagcgacgauggcacccaagaccugcugcacuuucccacaaaagaacaguucgaugaggccgagccugcuacgcucaacgggcuggaccagcccgaacagaccacaaucccgauuccucaacuuccccaggagacccaguccagccuggaacacgagcccgaaacacauacccuccaucugcagccucaacacgaggagucugugguuccgacgcaguccacacuuaccgcggaugacaugagacgcgccaagcggaucagacuggaacuccagaaugcugcccugcaacaccuguucauccgcaaauccuuucggcccuucaagugucuccagugcggaaaggccuuuagagagaaagauaagcuggaccagcaccuucgguuccauggccgcgaagggaacuguccucugaccugcgaccucuguaacaaaggauuuauuucuagcacaucccuggagucucacaugaagcugcauagcgaucagaaaaccuauuccugcaucuucugccccgagagcuuugacagacuugaucuccugaaggaccacguggcuauucauaucaaugauggcuacuucacauguccuacgugcaagaaacgguuucccgacuucauucaagucaagaaacacgugagaucuuuucacuccgaaaagaucuaucaguguaccgagugcgauaaagccuucugucgcccugacaagcugcggcuccauaugcugagacacagcgaucgcaaggacuuucuuugcucuacauguggcaaacaguucaagagaaaagauaagcugcgggaacauaugcagcgcaugcacaaccccgagagagaagcgaaaaaggcugaccggaucucccgcagcaagaccuucaaaccgagaauuacauccaccgauuacgacucuuuuacguucaagugccggcucuguaugaugggguuucgcagacggggaaugcugguuaaucaucugagcaaacgccacccugacaugaagaucgaggaggugcccgaacuuacccucccuauuaucaaacccaacagagauuacuucugccaauauugugacaaggucuacaaauccgccucuaagcggaaggcccacauucugaaaaaucauccgggcgcugagcugccucccagcaucagaaagcuccgcccugccgggcccggagaacccgauccuaugcuguccacacacacccagcuuacaggcaccaucgcuacgccgcccgugugcugcccucauuguagcaaacaguauucuuccaagacaaaaauggugcagcacauucggaagaagcaccccgaguuugcccaacugagcaacaccauccauacaccucucaccaccgcgguuauuucugccacacccgcuguccugacgaccgacuccgccacaggggaaaccguggugacaaccgaucugcuuacgcaggcuaugacagagcucagccagacccugaccacagacuacagaaccccucaaggcgauuaucagcgcauccaguacauuccggucucucagagcgccuccggacugcaacagccccagcacauccagcuccaagugguucagguggcgagcgccacaucuccucaucagucccagcaaagcacggucgacgugggccagcugcacgauccccagccuuauccccagcaugcuauucaaguucagcacauccagguguccgagccgaccgccucugcuccuagcuccgcccaagucucugggcagccccuuagccccuccgcccagcaggcucaacagggacugucuccuagccacauccagggcuccagcucuacacaggggcaagcgcuccagcagcagcaacagcagcaacagaauagcagcgugcagcauaccuaccugcccucugccuggaacuccuuccggggauacagcucugaaauucagaugaugacacugccuccgggccaauuuguuaucaccgacuccgggguggcuacgcccgucaccacaggccaggugaaagccgugaccagcggacacuauguccuuuccgagagccagucugaacucgaggaaaagcagacaagcgcccuguccggcgggguucaaguggagccucccgcucauucugauagccuggacccucagaccaauucccagcagcaaacaacccaguacauuaucacgacaaccaccaacggaaauggcucuagcgaggugcacauuacaaaacccuga

SEQ ID NO: 74177 - RNA, 1434 nt, Artificial Sequence
  derived and/or modified sequence opt5 from PRDM11__Homo_sapiens__NP_001243625
augaccgagaacaugaaggaaugccuggcccagacaaaugcugccgugggcgacauggucacgguugugaaaaccgagguguguagcccccucagagaucaagaauacgggcagccuugcucccggcgcccggacucuagcgcgauggaggucgaacccaagaaacugaagggaaaaagagaucuuaucgugccuaaguccuuccagcagguugacuuuugguucugugagucuugccaagaguauuuuguggaugaaugucccaaccacggcccucccgucuucgugagcgacacaccuguuccgguggggauucccgaucgggcugcccugaccaucccucagggaauggaggucgugaaggacacauccggcgaaucugaugugcgcugcgucaaugagguuauucccaaagggcauaucuuuggaccuuacgagggccagauuagcacccaggacaaguccgccggcuucuuuagcuggcucaucguggauaaaaacaauagauauaagucuaucgacggguccgaugaaacaaaagcuaacuggaugcgguacguggucauuagccgcgaggaaagagagcaaaaucugcuugccuuccagcacucugaacggaucuauuuucgcgcuuguagagacauucggcccggagaguggcugcgcgugugguacuccgaggacuauaugaagagacuccauagcaugucucaggaaaccauccaccggaaccuggcccgcggcgagaagagacugcagcgggaaaaauccgagcaaguucucgauaauccggaagaccugagagggccuauucaucuuagcgugcugcgccagggaaagucccccuacaaacggggcuucgaugagggggacguccacccucaggcgaagaaaaagaaaaucgaucucauuuuuaaggacgugcuggaggccucucuugaaagcgcuaagguugaggcccaccaacuggcucucuccacgagccuggugaucagaaaaguccccaaguaccaggaugacgccuauucucagugcgcgaccacaaugacccauggagugcagaacaucggccaaacacagggcgaaggggauuggaaagucccccagggaguguccaaggagccuggccagcuggaagacgaggaggaggaaccgagcucuuucaaagccgauagccccgcugaagccucccucgcuucugacccucacgagcugcccaccacgagcuuuuguccuaauugcauucgccuuaagaagaaaguucgggagcugcaagccgaacucgacaugcugaaguccgggaaacuucccgagccgccugugcugcccccucagguccucgaacugcccgaguucagcgauccugccggaaagcugguguggaugagacuccugucugaaggccgcguucgguccgggcuuuguggaggcuga

SEQ ID NO: 74178 - RNA, 2124 nt, Artificial Sequence
  derived and/or modified sequence opt5 from PRDM13__Homo_sapiens__NP_067633
augcacggcgccgcuagagcccccgcgaccagcguguccgcugacugcuguaucccugccgggcugcggcucggaccgguccccggcacauucaagcuggggaaauaccuuucugaucgcagagagccuggacccaagaaaaagguucggauggugcgcggcgaacugguggacgagagcgggggauccccucucgaauggauuggccugaucagagccgcucggaacucucaggagcaaacgcuugaagccauugcugaucugcccggcgggcagaucuuuuaucgcgcccucagagacguccagccuggagaggagcugaccgugugguacagcaauucccuggcgcagugguucgauauuccgacaaccgccacacccacccaugacgaaaaaggcgaggaacgguauaucugcugguacuguuggcgcacauuuagauauccuaacucucucaaggcucaucugcgguuccacugcguuuuuagcgggggaggcgggggagccuuccuucaccaugagcacgcugcccgccaaggcgcggugcccgccgcugauggccuggggcucuccccuaagcccccggccccugacuuugcugcccccagccaggccggaacccugagaccucacccccuugggcccccuccgguccaggcuuguggggcgcgggagggaaucaaacgcgaagccucuuccgcucccagcgccacgucuccuacccccggcaagugggggcagccuaaaaagggaaaagagcaacuggauagagcccucgacauguccggcgcugcccggggccaggggcauuuccugggaauugugggcgggagcucugcgggaguuggcucccuggcuuuuuaccccggggugagaagcgccuucaagccggccggccucgcucgcgccgcugccgcggcccacggagauccuuaucgggaagaguccucuagcaagcagggcgcugggcuggcccuuggaagacugcucggcgggggacgcgcuugcggccggcccggguccggcgaaaauagcgccgcgggaggcgccgggcaucaccaccaucaccaugcucaccaucaccaccauccuaaaugucugcuugccggagaucccccucccccgccuccucccggccugcccugcucuggggcucucagaggauuuccgcugcuguccgugcccccugaggaggccagcgccuucaagcacgucgaacgcgcucccccugcggccgcugcccuccccggcgcccgguacgcucagcugccucccgccccggggcuuccucuggagagaugugcgcugcccccucucgaccccggcggacuuaaggcuuacccgggcggggaaugcucucaucugccugccgugaugcccgccuuuacagucuauaacggagagcuccuguacggcagcccugcuaccacagccuauuacccccugaaacuccacuucgggggacugcuuaaauaucccgaauccaucucuuacuucagcggcccugcggcugccgcccuguccccggcugagcucgggagccuggccucuauugaccgcgagaucgcuaugcacaaucaacagcuguccgaaauggccgcgggcaagggacggggcagacuugacagcgggacccugcccccugccguugcugccgcuggaggcacgggcggaggcggcucugggggauccggcgccgggaaacccaagacaggacaucucugucuguauugcggcaagcucuacagccgcaaauacgggcugaagauucacaugcggacccauacaggauauaaaccucuuaagugcaaagugugucugagacccuuuggcgauccuuccaaccucaauaagcacauccggcugcaugccgagggcaacaccccguaccgcugcgaguucugugggaaggugcuggucagacggagagaccuugaacgccacgugaaaucucggcaccccggacagagccuccuggcuaaggcgggcgaugggccuggagccgaacccggcuauccucccgagccgggggacccuaaauccgaugacucugauguugacgugugcuuuaccgaugaccaaagcgaucccgaggucggaggcggcggggaaagagaccuguga

SEQ ID NO: 74179 - RNA, 1716 nt, Artificial Sequence
  derived and/or modified sequence opt5 from PRDM14__Homo_sapiens__NP_078780
auggcccugcccagaccuagcgaggcugugccgcaggacaaggucugcuaucccccugaauccucuccccaaaaccucgccgcguacuacaccccuuuccccagcuauggccacuaccggaauagccuggcuacaguugaggaagauuuucagccuuuccgccagcuugaggccgccgcuucugccgcuccggccaugcccccuuuucccuucagaauggcgccuccccugcucagcccggggcugggacuucagcgggaaccucuguaugaccuccccugguacuccaaacugccucccugguaucccaucccucaugugccgcgcgaggugcccccuuuucugucuagcucccacgaguacgccggcgcuagcucugaagaucucgggcaucaaauuaucggaggcgacaacgaguccgggcccuguugcggaccugauacgcugauucccccgccucccgccgacgcuagccuucugccugaaggccucagaaccucucagcugcuucccuguuccccuagcaagcagucugaggauggccccaaaccguccaaucaggaggggaaguccccugcccgguuccaauuuacagaagaggaccugcacuucguccucuacggagugacccccucccuggaacaucccgcgucucugcaccacgccaucagcggccuccugguuccuccggauuccagcgggucugacucccuuccccagacacuggauaaagacagccuccagcugccugagggacuuugccugaugcagaccguguuuggcgaagucccccauuucgggguguuuuguucuagcuucauugcuaagggaguucgcuuuggcccuuuccaaggcaagguggucaacgccuccgaggugaaaacauauggggauaauucugugaugugggagaucuucgaagacggacaccucagccauuuuaucgacggcaaagggggaaccggcaacuggauguccuacgucaauugcgcuagauuccccaaagagcagaaccugguugccgugcagugucaagggcacaucuuuuaugaaagcugcaaggagauucaccagaaucaggaacugcucgugugguacggagauuguuaugagaaauuccuggacauuccugucucucuucaggugacggagcccggcaagcaaccguccggcccuagcgaagagucugccgaaggguaccggugcgagcgcuguggaaagguuuuuaccuauaaauacuacagagauaagcaucugaaauauacacccugcguggacaagggcgaucggaaauucccuugcucccucuguaagcgcagcuuugaaaagagagaccggcugcgcauccacauucuucauguccacgagaagcauagaccccacaagugcuccaccugugggaaaugcuucucucagagcuccucucugaacaagcacaugcgggugcauagcggagauagaccguaccaguguguuuauugcacaaaacgcuuuaccgcuuccagcauccuccggacgcacauuagacagcauucuggcgagaagccuuucaaauguaaguacugcgggaaguccuuugcgagccacgccgcucacgacucucaugugcgccggucccacaaagaagaugacggcuguagcugcucuaucuguggaaagaucuucagcgaucaagagacauuuuauucccauaugaaauuccacgaagacuacuga

SEQ ID NO: 74180 - RNA, 2478 nt, Artificial Sequence
  derived and/or modified sequence opt5 from PRDM1__Homo_sapiens__NP_001189
augcuggacaucugccucgagaagagagugggcaccacacuggccgcucccaaauguaacagcuccacgguccgguuccaggggcuugccgaaggaaccaagggcacaaugaaaauggauauggaggacgcggauaugacccuguggacagaagcugaguuugaagagaagugcaccuacauuguuaaugaccacccuugggauucuggggccgacggaggcacaagcgugcaagccgaggcuucccucccgcgcaaccugcuuuucaaauaugccaccaauucugaagaggugaucggggucaugagcaaggaauacauucccaagggaacgagauuuggcccucugaucggcgagauuuauaccaacgauacagugcccaaaaaugcuaaccggaaguacuucuggcgcaucuauuccagaggggagcuccaucacuuuaucgacggauucaaugaagagaaaucuaacuggaugcgguacguuaauccugcccauagcccccgcgaacagaaccuggcggccugucagaauggcaugaacauuuauuuuuacaccaucaagccuauuccggcuaaucaggagcugcucgugugguacugcagagauuucgccgaacggcugcacuaucccuacccuggggagcuuacaaugaugaaccugacccaaacgcaguccagccucaaacagcccucuacagagaagaaugaacuguguccuaagaacguccccaaacgcgaguauuccgugaaggaaauccuuaaacuggacagcaacccgucuaagggaaaagaucucuacagauccaauauuagcccucugaccucugagaaggaccuggaugacuuucggcgcagaggcucccccgaaaugccuuucuauccccggguuguguaccccauccgcgcuccucucccggaggacuuucugaaagccagccuugcguaugggauugagagacccacauacaucacccgguccccuauccccucuagcaccacaccuucccccagcgccagaucuuccccggaucagagccugaagucuagcuccccucauucuagccccggaaacacggucuccccugugggccccggcagccaagaacaccgcgacucuuacgcuuaucucaaugccuccuacgggaccgagggacugggcagcuauccuggguacgcuccccuuccgcaccucccucccgccuucauucccucuuauaacgcccauuacccuaaguuucuccugccgcccuauggaaugaauugcaacggccuguccgcugugagcuccaugaaugggaucaacaauuucggacucuucccucggcugugucccgucuacucuaaccuucugggcggcgggagccucccucaccccaugcugaauccuacaucccuucccucuagccugccguccgauggagcgagacgccuccugcagccugaacauccccgggagguucuggugccugcuccccacagcgccuuuucuuucaccggcgccgccgcuuccaugaaagacaaggccugcagcccgacaucuggguccccuaccgcgggaacggcugccacagccgaacacgugguccagcccaaagcuaccagcgccgcuauggccgcgccuucuagcgaugaggccaugaaccucauuaagaauaaaagaaacaugaccggcuacaagacacugcccuauccccuuaagaaacagaaugggaagaucaaauacgaguguaacgugugcgcuaagaccuuuggccaacuguccaaccucaaaguucaucugcgcgugcacagcggagaacggccuuucaagugucagacaugcaauaagggcuuuacgcagcuggcccaucuucaaaaacacuaucucguccauaccggggagaagccgcacgaaugccaggugugucacaaaagauucucuuccacaagcaaccugaagacccaucugcgccuccacuccggagagaaacccuaccagugcaagguuuguccugcuaaguuuacacaguucgugcaucugaaacuucacaagcggcugcacaccagagagcgcccccauaaaugcucucaaugucacaagaauuauauucaucucugcagccugaaaguccaccugaagggcaacugugccgcggccccugcucccgggcuuccucucgaagaccugacgcggaucaaugaggaaaucgagaaauuugauauuuccgacaacgccgauagacuggaagacguggaggaugacaucucugucauuagcgugguugagaaggaaauccucgcugugguccggaaggagaaagaagagaccggacugaaggugucccuucagcgcaauaugggcaacgggcugcucucuagcggcugcucccuguacgaaagcucugaccugccgcuuaugaaacugcccccuuccaauccccugccucugguucccgugaaggucaaacaggagacaguggagccgauggauccuuga

SEQ ID NO: 74181 - RNA, 2406 nt, Artificial Sequence
  derived and/or modified sequence opt5 from PRDM4__Homo_sapiens__NP_036538
augcaccauagaaugaacgagaugaaucugagccccgugggcauggaacagcucaccuccucuagcgucuccaacgcccugccuguuucugggagccaccuuggacuggcugccuccccgacacauucugcgauccccgcuccuggccuccccguggccauuccuaaucuggggcccagccuuuccagccugccuucugcccucucccugaugcugccgaugggaaucggcgaccgcggggugaugugcggacuccccgagcggaacuacacgcugccucccccucccuauccgcaccuugaaagcucuuacuucagaaccauucugccuggcauccucuccuaucuggcugaucggcccccuccccaauacauucaucccaauagcaucaacgucgacggcaauacagcccuuucuaucaccaacaauccuuccgcucuggauccguaucagagcaacgggaaugugggacucgagcccggcauuguuuccaucgacucucgcagcgugaacacacacggggcccagucccugcacccuagcgauggacaugaagucgcgcuggacaccgccauuacaauggagaaugugucuagaguuaccucccccaucagcacggauggcauggcugaggaacucaccauggacgggguggccggagagcacucucagauuccuaacggcagccggucccaugaaccccugucugucgauagcguguccaauaaccuugcugccgacgcggugggccacgggggagucaucccgaugcacggcaacgggcuggagcucccuguugugauggagacagaucauauugccagccgcgugaauggaaugucugacuccgcucugagcgauucuauccacaccgucgccauguccacaaacagcguguccguugcucuuucuaccagccauaaucuggccucccucgaaucugugagccugcacgaggucggccugucccucgaacccguggccguuagcucuaucacgcaagagguggcuauggggacaggacaugucgacguguccagcgacucucuguccuuugucagcccuucucuucagauggaagauagcaacuccaauaaggagaacauggcgacccuguucacaauuugguguacccucugcgacagagccuaccccagcgauuguccugagcacggccccgugaccuuuguuccggacacaccuaucgaaucucgggcucgccugucccuucccaaacagcuggugcucagacagagcauugucggcgccgagguggggguuuggacgggagaaaccauccccgugcggacaugcuucggcccucugauugggcaacagucccacucuauggaggucgccgaauggaccgauaaggcugugaaucauaucuggaaaaucuaucacaacggagugcuggaguuuuguauuaucacaaccgacgagaaugaaugcaacuggaugauguucguucgcaaggccagaaaucgggaggaacagaaccucgucgcguacccgcaugauggcaaaaucuuuuucuguacgagccaggacauucccccugagaaugaacugcuuuucuacuauucccgcgauuacgcucaacagauuggggugcccgagcacccugacgugcaccugugcaacuguggcaaggagugcaauucuuauacagaauuuaaggcccaucucaccagccacauccauaaccaucugcccacccagggacacuccggcucucacgggccuagccacuccaaagagagaaaguggaaauguagcaugugcccccaagccuuuaucucuccguccaagcugcauguccacuucaugggacauaugggcaugaaaccucacaagugcgauuuuuguagcaaggcuuucucugaccccuccaaccuucggacacaucucaaaauucacaccgggcagaagaauuacagaugcacacugugugacaagagcuucacgcagaaggcccaccuggaaucucauauggugauccacaccggagagaaaaaccucaagugcgauuauugugacaaacuguuuaugcgccggcaggaucuuaagcaacauguucugauucacacacaggagagacagaucaagugcccuaaaugugacaaacucuuccugcgcaccaaucaccugaaaaagcaucuuaacucccacgaaggcaaacgggauuacgugugcgagaaguguacaaaggcuuaucucaccaaauaccaucugacgagacaccugaagaccugcaaagggcccacaagcuccagcucugccccggaagaggaagaggaggacgauagcgaagaggaagaccucgcggauuccgucggcaccgaggacugucgcauuaauucugccguguacagcgcugaugaaucccugucugcccauaaguga

SEQ ID NO: 74182 - RNA, 1800 nt, Artificial Sequence
  derived and/or modified sequence opt5 from PRDM5__Homo_sapiens__NP_001287752
augcugggcauguacgugcccgacagauucagccucaaguccucucggguccaggaugggaugggacuguauaccgcccgcagaguucggaaaggcgagaaguuugggccuuucgcuggagaaaaacgcaugccggaggaccuugaugaaaacauggacuacagacugaugugggaggugcggggcagcaagggggaagugcucuauauccuggaugccacaaauccccgccacuccaacuggcuuagauuuguccaugaggcgccuucucaagagcagaaaaaucuggcugccauucaggaaggagagaacaucuucuaccucgccguggaagacauugagacggauaccgagcugcugaucggcuaucucgacagcgauauggaagcugaggaagaggaacagcaaauuaugacaguuaucaaggagggcgagguggaaaauucccggcgccagucuaccgccgggagaaaggaccggcugggaugcaaagaggauuacgcuuguccccagugcgaaagcuccuuuacaagcgaggacauccuugccgaacaucugcagacccuccaccaaaagccuacagaggagaaagaguucaaguguaaaaacugcggcaagaaguuucccgucaaacaggcgcugcagcgccacuucgaacagcaucaagaaaccuguagaggggaugcccgguuugugugcaaggcugacucuuguggaaaacgccuuaaguccaaagacgcccugaagagacaccaggagaauguucacacgggcgauccuaaaaagaagcucauuugcagcguguguaacaaaaaguguucuuccgcuagcucucugcaggaacaucggaaaauccacgagauuuucgacugccaagagugcaugaagaaauuuaucuccgccaaucagcugaagagacauaugauuacccacagcgaaaagcgcccguauaacugcgagaucuguaauaaauccuucaagcggcucgaucaggucggggcgcacaaagugauucauucugaagacaagcccuacaaaugcaagcuguguggaaagggcuuugcccacagaaacguguacaaaaaucauaagaaaacacacagcgaggagcgcccuuuccagugcgaagaguguaaggcucuuuuccggacccccuuuucccugcaaagacaucuccugauccacaacagcgaacgcacauucaaaugccaccauugugaugccaccuuuaagcggaaggacacgcuuaauguccacguucagguggugcaugagagacacaaaaaguaucgcugcgaacuguguaacaaagccuucgucacaccuucugugcuccggucccacaagaaaacccauacaggcgagaaggagaaaaucugccccuacugugggcagaaguuugcuagcucuggaacccugagaguucacauucgcagccauaccggcgaacggccguaucagugcccuuacugcgagaagggguucuccaaaaacgauggacugaagaugcacaucagaacacauacgcgggaaaaacccuauaaguguucugagugcagcaaagccuuuucccaaaagcgcggccucgacgaacacaagagaacccacacaggggagaaaccuuuccagugugaugugugcgaccuggcuuuuagccuuaagaaaaugcugauucggcauaagaugacccacaaucccaacagaccccucgcggagugucaguucugccauaaaaaguuuacacgcaaugauuaccugaagguccacauggacaacauccauggaguggccgacucuuga

SEQ ID NO: 74183 - RNA, 1788 nt, Artificial Sequence
  derived and/or modified sequence opt5 from PRDM6__Homo_sapiens__NP_001129711
augcugaagcccggcgacccugggggaagcgccuuccucaaaguggauccggcuuaccugcagcacuggcaacagcuuuuuccccauggcggggccggaccucugaagggcuccggggcggcuggacuccugucugcuccccagccucuucagcccccuccgcccccucccccucccgagagagccgaaccgccucccgacagccugcggccucgccccgccucccucucuagcgccuccucuacccccgcuagcuccagcacaucugccuccagcgcgucuuccugcgccgcugccgcugccgcggccgcucuggccggccugagcgcucucccugucucucaacugccgguuuucgcuccccuugccgccgcggccguggcugccgagccucugcccccuaaagaacucugucugggcgccacguccgggcccggaccggugaagugcggcgggggaggcgggggaggcggcgaggggagaggagcuccucgguuucgcuguagcgccgaggaacuugauuauuaccuguauggccagcagagaauggagaucauuccccucaaccagcacaccuccgacccuaauaaccggugcgauaugugugcggacaaucgcaacggggaaugccccaugcauggaccucugcacucucugagacggcucgucggcacaagcuccgcugccgccgcugcucccccgccugagcugcccgaauggcuucgcgaucugcccagagaggugugucucugcaccagcacaguuccugggcuggccuacggaaucugugccgcgcaacggauucagcagggcaccuggaucggcccguuccagggggugcuucugcccccugagaaaguccaagccggagcugugcgcaauacacagcaucucugggaaauuuaugaccaggauggcacccugcaacacuuuaucgacgggggagagcccucuaaguccagcuggaugagauacauccggugcgcccgccacuguggcgaacagaaccugacgguugugcaguauagaucuaauauuuucuaccgggcuugcaucgauauuccuagagggaccgagcuccuggucugguacaacgacagcuauacauccuuuuucggcaucccccuucagugcauugcccaagaugaaaaucugaacgugccuucuaccgugauggaggcgaugugucgccaggacgcccuccagcccuuuaauaagagcuccaaacuggcuccgacaacccagcaacggagcgucguuuucccucagacgcccugcucuagaaacuuuucccuucuggacaagagcggaccuaucgagucuggcuucaaucagauuaacgugaaaaaucagcgcgugcucgccucccccacaagcaccucccaacugcauucugaauuuagcgauuggcaccuguggaagugugggcagugcuucaaaacauucacccagcggauccuccugcagaugcaugucuguacccaaaacccggacagaccuuaccagugcggacacuguucccagucuuuuagccaacccuccgagcuucgcaaccacgugguuacacauagcucugaucggccuuucaagugcggcuauugugggagagcuuuugccggagccacgacccugaauaaccacauccgcacacauaccggcgaaaagcccuucaaaugcgagcggugugaaagauccuuuacacaggcuacccagcucagccgccaccagcggaugcccaaugagugcaagccuauuacggagucuccggaauccaucgagguggacuga

SEQ ID NO: 74184 - RNA, 1479 nt, Artificial Sequence
  derived and/or modified sequence opt5 from PRDM7__Homo_sapiens__NP_001091643
augagccccgagagaucccaggaagagucuccugaaggcgacaccgagcggacagaacgcaagccgauggugaaagaugccuucaaggacaucagcauuuacuuuacgaaagaggagugggcugaaaugggggauugggagaagaccagauaucggaacgucaaaaugaauuacaacgcccugaucacaguuggacuccgcgcgaccagacccgcuuucaugugccaccggcgccaagccauuaagcugcaaguggacgauacagaagacuccgaugaggaguggaccccuagacaacaggugaagcccccuuggauggccuuucggggcgaacagucuaaacaucagaaggggaugcccaaagcuagcuucaauaacgaguccucucuucgcgaacugagcggaacaccuaaucuccugaacaccuccgacagcgagcaggcccagaagccggucucucccccuggcgaggcuuccacgagcgggcagcacucuagacuuaaacuggagcuccggcgcaaggagaccgaaggaaagauguauucccugagagagcggaaaggccaugccuacaaggaaaucagcgagccccaggaugacgauuaucuguacugugaaaugugccagaacuuuuucauugacucuugugcggcccacggcccucccacauuugugaaagauuccgcuguugacaaggggcauccgaaucgcagcgcccucucccugccucccggacuuagaaucggcccuucugggaucccccaggcuggacugggcguguggaaugaggccagcgaccucccccuggggcuucacuucggaccuuaugagggccggauuaccgaagaugaggaagcggccaacuccggcuacagcuggcugaucacaaaagggagaaauugcuacgaguaugucgacggaaaggauaaaucuuccgcuaacuggaugcgcuacgugaauugugcccgggacgaugaagaacaaaaccucguugcuuuucaguaucacagacagauuuucuaccggaccugccgcgugaucagaccgggcugugagcugcuggucuggagcggggacgaauauggacaagagcucggcauucgcucuagcaucgaacccgccgagucccuggggcaggccgugaauugcuggucuggaaugggcaugagcauggcucggaacugggcguccagcggcgccgcuucugggagaaaguccagcuggcagggagagaaccagucucaacgcuccauucaugugccucacgccgucuggcccuuucagguuaagaauuucagcgugaacauguggaaugccaucacgccucuucggacaucccaggaucaucugcaggaaaacuuuucuaaucaaagaauccccgcucagggcauucgcauccggagcgggaacauucucauccacgccgcggugaugaccaaaccgaaggucaaaagauccaagaaaggaccuaauucuuga

SEQ ID NO: 74185 - RNA, 2070 nt, Artificial Sequence
  derived and/or modified sequence opt5 from PRDM8__Homo_sapiens__NP_064611
auggaggacaccggcauccagagagggauuugggauggagacgccaaggcugugcaacagugccugacagauaucuucacgagcgucuacaccacaugugacauucccgaaaacgccaucuuuggcccuugcguucucucccacaccucucuguaugauagcauugcguucaucgcucuuaaauccacagacaagcggaccgugccguacaucuuucgcguggauacaucugccgccaaugggagcuccgagggacugauguggcucagacugguccagucugcucgggacaaagaggaacagaaccuugaagccuauauuaagaauggccaacuguucuaccgcagccucagacggaucgcuaaagaugaggagcugcuggugugguaugggaaggaacucaccgagcugcuucugcucugucccucccgcagccauaacaagaugaauggaucuuccccuuacacgugccuggaauguagccagagauuucaguucgaguuucccuauguugcccaccuucgguuccgcugcccuaaaagacugcauucugcggacauuucuccccaggaugagcaaggcggcggggugggaaccaaggaccacggcgggggaggcgggggaggcaaagaucagcagcagcaacagcaggaagccccucucggcccggggcccaaguuuuguaaagcuggaccucugcaucacuaccccagcccuucucccgaguccagcaacccguccgccgcugccggcgggucuagcgcgaagccuuccacagacuuccacaaucuggcccgggaacucgagaacagccgcggaggcuccuccugcagccccgcucaaucucugagcuccgggucuggaagcggcggcgggggaggccaucaggaagccgagcuuuccccugacgggaucgcuaccggaggcgggaagggcaaaagaaaguuucccgaggaagccgccgagggaggcgggggagcuggccuggucgggggacggggccgcuucguggaaagaccccucccugcgagcaaagaggaucugguuuguacaccgcagcaguaccgggccucuggguccuauuuuggccuugaagagaauggaagacuguucgcucccccuagccccgagaccggcgaagccaagcgcucugccuucguggaggucaaaaaggcugcccgggcggcuucccuccaagaagaggggacggccgacggagccggcguggcuagcgaagaucaggacgccgggggaggcgggggcuccucuaccccugcugccgcgagccccgugggagccgagaaacugcuggcuccgagaccuggcgggccccucccuucccgccuggagggaggcucucccgcccgggggagcgcuuuuacauccgucccucagcuuggaagcgccggcucuacauccgggggcggaggcaccggggcgggagccgcuggcggggccggaggcggccagggggcugccagcgaugaaagaaagucugccuucucccaacccgcucgcagcuuuucucagcugagcccgcucguucugggacagaaacuuggcgcgcuggagccuugccaccccgccgacggggugggacccacccggcucuacccugcugccgccgauccgcuggcugugaagcugcagggcgccgcggaccucaacgggggauguggcucccugcccagcggcgggggaggccuuccuaagcaaucucccuuccuguaugcuacagccuuuuggccuaaauccagcgccgcugccgcggcugccgccgcugccgcugccgcggggccccuccagcugcagcugccuuccgcccuuacgcuccugcccccgucuuucaccagccugugccucccugcucagaauuggugcgccaaguguaacgcuuccuuuagaaugacaucugaucuggucuaccauaugcgcagccaccacaaaaaggaauaugccauggagccccuugugaagcggagacgcgaggaaaaacugaagugcccuauuuguaaugaguccuuccgggaaagacaucaccucucucggcauaugaccagccacaacuga

SEQ ID NO: 74186 - RNA, 2685 nt, Artificial Sequence
  derived and/or modified sequence opt5 from PRDM9__Homo_sapiens__NP_064612
augagccccgagaagucccaggaagagucuccugaagaggacaccgaaagaacagagcggaaaccgauggugaaggaugccuucaaagacaucagcauuuacuuuacgaaggaggaaugggcugagaugggcgauugggaaaagacccgcuauagaaacgucaagcggaauuacaacgcccugaucacaauugggcuccgcgcgaccagacccgcuuucaugugccaccggcgccaagccaucaagcugcagguugacgauacagaggacuccgaugaggaauggaccccuagacaacaggugaaacccccuuggauggcccuucggguggagcagcgcaagcaucagaaaggaaugcccaaggcuucuuuuagcaaugaauccucucugaaagagcucagcagaacagccaaccugcuuaaugcuuccggcagcgaacaggcccagaagccugucucuccguccggggaggcgagcaccucuggacaacacucccggcugaagcucgagcugcgcaaaaaggaaacggagagaaaaauguauagccugcgggaacgcaagggccaugccuacaaagaggugucugaaccccaggacgaugacuaucucuacugugagaugugccagaacuucuuuauugauuccugugcugcccacgggccucccaccuucguuaaggacagcgcuguggauaaaggacauccuaauagauccgcccugucucuucccccgggccugcggaucggcccuagcgggaucccccaggcgggacucggcgucuggaacgaggccuccgaccugccucuugggcugcacuuuggacccuaugaaggcagaauuacagaggacgaagaggcugccaauaacggguacagcuggcucaucaccaagggacgcaauugcuacgaauauguggauggcaaggacaaaucuugggcuaacuggaugcgguacguuaauugugccagagaugacgaggagcaaaaccugguggccuuccaguaucaccgccagaucuuuuaccggacaugcagagucauucgccccggcugugaacugcucgugugguauggggaugaguacggacaagaacugggcauuaaguggggguccaaauggaagaaagagcuuauggcuggacgggagccuaagccggaaauccaucccugcccuagcuguugccuggcguucucuagccagaaguuucucucccagcacguggagagaaaucauucuagccagaacuuccccggcccuuccgcccgcaaacugcuucaacccgaaaacccguguccuggggaccagaaucaggagcagcaauaucccgauccucacagccggaacgacaagaccaaaggacaggaaauuaaggagagaucuaaacugcucaauaagcgcacguggcagcgggagaucuccagagcuuuuagcucucccccuaagggccagaugggcuccugccgggucgggaaacgcaucauggaagaggaaagcagaacaggacaaaagguuaaccccggcaauaccgggaaacuguucgugggagugggcauuucccggaucgccaaggucaaauacggggagugcggccagggauucucugugaaaagcgauguuauuacacaccagagaacccauaccggcgaaaagcuguacgugugucgcgagugcgggcggggauuuuccuggaaaucucaccuccugauccaucagcgcauucacacaggcgagaagccguaugucuguagagaaugcgggagaggauucagcuggcaauccgugcuucugacgcaucagcggacccacacaggcgagaaaccuuacguuugucgcgaaugcgggagaggcuuuagccggcagucugugcuccugacccaccaacgcagacauacaggagagaagcccuaugucugucgggaaugcggccgcggguucuccagacagagcgugcuucugacccaccagcggcgccauacgggagagaaacccuacgucuguagagagugcggccggggguuuucuuggcaguccgugcuccugacacaccaaagaacccacaccggagaaaagccuuauguuugucgcgagugcggccggggguucagcuggcagucugugcugcucacacaucagagaacccacacaggcgaaaaaccguacgucugccgcgaguguggacggggcuuuagcaacaagucccaucugcuuagacaccagcgcacgcauaccggggagaagcccuaugugugccgggaauguggaagaggcuuccgcgacaaaagccaucugcuccggcaccaaagaacacacaccggggagaagccuuacguuugccgggaauguggacgcggcuuuagagauaaaucuaaucugcugucccaccagcggacacauaccggggagaagcccuacgugugccgcgaauguggcagaggauucagcaacaaaucccaccuucuccggcaucagagaacgcacaccggcgagaagccuuaugucugccgcgagugugggcggggauuuagaaauaagucucaucugcugcgccaccagcggacacacaccggcgaaaaacccuacgugugcagagagugugggcgcggauucagcgaccgguccucucucugcuaucaucaaagaacacacaccggcgaaaagccuuacgugugccgcgaggacgaauga

SEQ ID NO: 74187 - RNA, 597 nt, Artificial Sequence
  derived and/or modified sequence opt5 from PRDX2__Homo_sapiens__NP_005800
auggccagcggcaacgcuagaaucgggaagcccgccccugacuucaaagcgaccgcuguggucgauggagccuuuaaggagguuaaacuguccgacuacaagggcaaauauguggugcuuuucuuuuacccgcuggauuucacauuugucugccccacggaaauuaucgccuucucuaaucgggcugaggacuuucgcaagcucgggugugaagugcugggaguuagcguggauucccaguucacccaccucgccuggauuaacacaccuagaaaggagggcgggcugggaccccuuaauaucccucugcucgcugacgucacccggcgccugucugaagauuauggcgugcugaaaacagacgagggcauugccuacagagggcucuuuaucaucgauggaaagggcguucugcggcaaauuaccgugaacgaccuucccgucgggcgcagcguggaugaggcgcugagacucgugcaggccuuccaguauacagacgaacauggagaggucugcccugcuggcuggaaaccgggguccgauaccaucaagcccaauguugacgacucuaaagaauacuuuagcaagcacaacuga

SEQ ID NO: 74188 - RNA, 771 nt, Artificial Sequence
  derived and/or modified sequence opt5 from PRDX3__Homo_sapiens__NP_006784
auggccgcugccgugggcagacugcuccgggcgagcgucgcucgccacguuuccgccauccccugggggauuucugccaccgcugcccugagaccugcugccugcggacggacaagccuuacgaaccugcucuguuccggcucuagccaggcgaagcuguucuccaccucuagcuccugccaugccccggcugugacacaacacgcccccuacuuuaaagggaccgcuguggucaauggagaguucaaggaccuuagccuggaugacuuuaaaggcaaguaucucgugcuguucuuuuacccucuggauuucacauuuguuugucccaccgaaaucguggccuucucugacaaagcgaacgaguuucaugaugucaauugcgaagugguugccguguccgucgacagccacuucucucaucucgcuuggauuaacacaccucgcaagaaugggggacugggccacaugaacaucgcccuucuguccgaucucaccaagcagauuagcagagacuauggcgugcugcuugaggggucuggacuggcucuccggggccuguuuaucaucgaucccaauggggugauuaaacaccuguccgucaacgaccucccuguuggacgcagcguggaagagacgcugagacuugugaaggccuuccaguacgucgagacccauggcgaaguguguccggccaauuggacacccgauuccccuaccaucaaacccucuccugcugcgagcaaggaguauuuucagaaaguuaaccaauga

SEQ ID NO: 74189 - RNA, 816 nt, Artificial Sequence
  derived and/or modified sequence opt5 from PRDX4__Homo_sapiens__NP_006397
auggaggcccugccccuccuggcugccaccacaccugaccacggcagacaucggcgccuucugcuccugccgcuucuccuguuccugcugcccgcgggggcugugcagggaugggaaacggaggaaagaccucggacccgcgaggaagagugccacuuuuacgccggcgggcaagucuaucccggagaggccagcagaguuuccguggcugaucauucucuccaccugagcaaggccaaaaucuccaagccugcucccuacugggaaggcacagccgugauugacggggaguucaaagaacuuaagcugaccgauuaucggggaaaauaccucgucuuuuucuuuuauccucuggacuucacauuuguguguccgaccgagaucauugcguucggcgaucgccuugaggaauuuagaucuaucaacacagagguuguggccugcagcgucgacucccaguucacccaucuggcuuggauuaauacgccccggcgccagggcgggcucggaccuaucagaaucccccugcugucugaucucacccaccagauuagcaaggacuacggcguguaucuggaagauuccgggcacacacuucggggacuguuuaucauugacgauaagggcauccuccgccaaauuacccugaacgaccuuccuguugggagaagcguggaugagacacugcggcucguccaggccuuccaguacaccgacaaacauggagaagugugucccgcuggcuggaagccgggcucugagacgaucauuccugaccccgccgggaaacugaaguacuuugauaaacugaauuga

SEQ ID NO: 74190 - RNA, 645 nt, Artificial Sequence
  derived and/or modified sequence opt5 from PRDX5__Homo_sapiens__NP_036226
augggccuggccggggugugcgcucucagacggagcgccggauacauccuggucggcggggcgggaggccaguccgcugccgccgcugcccgcagauguucugagggggaaugggcuagcggaggcguucgguccuucucucgcgccgcggccgcuauggcccccauuaaggugggcgacgcuaucccugccguggaggucuuugaaggggagccgggaaacaaagugaaucuugcggaacuguucaagggcaaaaaggggguucucuuuggagugcccggcgccuucaccccugggugcagcaaaacacaucugcccggauuugucgagcaagcugaggcccuuaaggcuaagggcgugcagguuguggccugucuguccgucaacgaugccuucgugacgggcgaaugggggagagcucacaaagcggagggaaaggugcggcuccuggccgacccuaccggcgcuuuugggaaagaaacagaucugcuccuggacgauucucuugucagcauuuucggaaaucgcagacugaagcgguuuuccaugguugugcaggacggcaucgugaaagcccucaacgucgagcccgaugggaccggacugacaugcagccuugccccuaauauuaucucucagcuguga

SEQ ID NO: 74191 - RNA, 675 nt, Artificial Sequence
  derived and/or modified sequence opt5 from PRDX6__Homo_sapiens__NP_004896
augcccggcgggcugcuccugggagacguggccccuaacuucgaggcuaauaccaccgucggcagaauccgguuucacgauuuccuuggggacagcuggggaauccuguuuucccauccgcgcgauuucacgcccguuugcaccacagaacucggcagagccgcgaagcuggcuccugaguuugccaaacggaacgugaaacuuauugcccugucuauugacagcguggaagaucaccucgcuugguccaaggacaucaaugccuacaacugugaggaacccaccgagaagcugccuuuccccauuaucgaugaccgcaauagagagcuggcuauccuccuggggaugcuugauccugccgaaaaagacgagaagggaaugccggucacagcgcgggugguuuuuguguucggccccgauaagaaacugaagcucucuauucuguauccugccaccacaggccgcaacuuugacgaaauccuuagagucgugauuagccugcagcucaccgcugagaaacggguugccacgcccguggauuggaaggacggggacuccgucauggugcugccuaccauccccgaggaagaggcuaaaaagcuguucccgaagggaguguuuacaaaagaacucccuucuggcaagaaauaccugcgcuauacaccccaaccuuga

SEQ ID NO: 74192 - RNA, 1254 nt, Artificial Sequence
  derived and/or modified sequence opt5 from PREB__Homo_sapiens__NP_037520
augggcagacggcgcgcccccgagcuguacagagcuccuuucccgcucuaugcccuucagguggaccccagcaccgggcugcugaucgcggcuggaggcgggggagccgccaagacaggcauuaaaaacgggguccacuuucuccaacuggaacuuaucaauggacggcuguccgcuucucuccugcauagccacgauacggagacccgcgccacaaugaaccuggcucucgccggcgacauucuggcggccggccaggaugcucauugccagcuucugagauuccaggcccaccaacagcaggggaauaaggcugaaaaagccggauccaaggagcagggcccucggcaacgcaaaggggcggcccccgcugaaaagaaguguggagccgagacccagcaugagggccucgaacugagaguugagaaccuucaggcugugcagacagacuuuucuagcgauccucugcaaaaaguggucugcuucaaucacgacaacacccuccuggccacagggggaaccgauggcuacgugcggguuuggaaggugcccucccuggaaaaaguccucgaguuuaaggcccacgagggcgaaaucgaggaccuggcucuugggccugauggaaaacuggugacgguuggccgcgaccucaaggcgucuguguggcagaaggaucagcuggucacccaacuucauuggcaggaaaaugggccgacauucagcuccacccccuauagauaccaggccugucgguuuggacaggugccugaccaacccgcuggccugcgccucuucacagugcagauuccucacaaaagacugcggcagcccccgccuugcuaucugaccgccugggaugggagcaacuuucucccccugcgcacgaagucuuguggacaugaggucguuuccugccuugacgugagcgaaucuggcacauuccugggccucgggaccgugacaggauccgucgccaucuacaucgcuuuuagccugcagugucuuuauuacgugagagaggcccacggcauuguugugaccgacgucgcguuccugccugagaaagggcggggacccgaacuccugggcucucacgagaccgcucuguuuuccguggccguugauagcagaugccaacuccaucugcuucccucccgccggucugugccugucuggcugcuccugcugcuuuguguggggcucaucauugucacaauccugcugcuccagagcgccuucccgggcuuccuguga

SEQ ID NO: 74193 - RNA, 1149 nt, Artificial Sequence
  derived and/or modified sequence opt5 from PRELP__Homo_sapiens__NP_958505
augagaagcccccugugcuggcuccugccucuucugauccucgccuccguggcucagggccaaccgacccggcgccccagaccugggacaggacccggccggcgcccuagaccccggccucgcccgacgcccucuuucccucagcccgacgagccugccgaacccaccgaucugccgccuccccuuccucccgggcccccuagcauuuuuccggacugucccagagagugcuacuguccucccgauuucccuuccgcgcuguauugcgacucucggaaccuccgcaagguccccguuaucccgccuagaauccacuaccuguaucugcagaauaacuuuaucacagaacuccccguggagagcuuccagaaugcuaccggacugcgguggauuaaccuugauaauaaccgcaucagaaaaaucgaccaacgggugcuggaaaagcucccuggccuggucuuucuuuacauggagaaaaaucagcuggaggaagugcccuccgcccucccucgcaaccuggagcagcugagacucucucagaaucauauuagccggauucccccggggguuuucuccaagcuggaaaaccuucugcuccuggaucuucaacacaauagacugagcgacggaguguuuaaaccugauacauuccauggccucaagaaccugaugcagcugaaucucgcccacaacauucugcgcaagaugccuccccggguccccaccgcuauccaucagcuuuaucuggacucuaauaaaauugagacaaucccgaacggcuacuuuaaguccuuccccaaccucgccuuuauuagacugaauuauaacaaacuuaccgaucgcgggcugccuaagaauagcuucaacaucucuaaucuccuggugcugcaccucucccacaaccggaucagcucuguucccgcuauuaauaacagacuggagcaucuuuaccugaauaacaauuccaucgagaaaauuaacggaacgcagaucuguccuaaugaccucguggccuuucacgauuucagcuccgaccuggaaaacgucccccaucugcgcuaccuucggcucgacggcaauuaucugaagccucccauuccgcuggaucucaugaugugcuucagacugcuucaaucuguggugaucuga

SEQ ID NO: 74194 - RNA, 2133 nt, Artificial Sequence
  derived and/or modified sequence opt5 from PREP__Homo_sapiens__NP_002717
augcugagccuccaguaccccgacguguauagagaugagaccgccguccaagacuaccacggccauaagaucugcgauccuuaugcuuggcuggaagacccggauuccgagcagacaaaagccuucguugaagcgcagaacaagauuacggugcccuuucuugagcaguguccuauccgggggcuguacaaagaacgcaugaccgagcucuaugacuaccccaaguauucuugccacuucaaaaagggaaagagauacuuuuacuucuauaauacaggccugcaaaaccagcgggugcuuuacguccaggauagccuggagggggaagcucgcguguuucucgacccuaauauucuguccgaugacggaaccguugcccugagaggcuaugccuucucugaggauggggaauacuuugcuuauggacucagcgccuccggcucugacugggugacaaucaaauucaugaaggucgauggcgcuaaagagcugcccgacgugcuugagcggguuaaguuuagcuguauggccuggacccaugacgggaaaggaauguucuacaacuccuauccucagcaagauggcaagagcgacgggacagaaaccucuacgaaucugcaccagaagcucuacuaccaugugcugggaaccgaucaguccgaggacauucuuugcgcggaauuuccggaugagcccaaauggaugggcggggccgaacugagcgacgauggacgcuauguccuccugucuaucagagagggcugugacccugugaaccggcugugguacugcgaucuccagcaagaguccagcggcaucgcugggauucugaagugggugaaacuuaucgacaauuucgaaggagaguaugauuacgucacaaacgaaggcaccguuuuuacauucaagaccaaucgccagucucccaacuauagagugauuaauaucgacuuccgggacccugaggaauccaaauggaaggugcugguccccgagcacgagaaagaugugcucgaauggauugccuguguucgcagcaacuuucuggugcuuugcuaccugcacgacgucaagaauauccuccagcugcaugaucugacgacaggggcucuccugaagaccuucccgcuugacgugggauccauuguuggcuauucugggcaaaagaaggauacagagaucuuuuaccaguucaccagcuuucuguccccuggaaucauuuaccacugugaccucaccaaagaggaacuggaacccagaguguuccgggaggucacagugaagggcaucgaugccagcgacuaucagacgguccagaucuuuuacccuucuaaagauggcaccaagauucccauguucauugugcauaagaaagggaucaaacuugacggaucccaccccgcguuucuguauggcuacgggggauucaacaucagcauuacaccuaauuauucuguuagccgccucaucuuugugagacacaugggcgggauucuggccgucgcuaacauccggggcggaggcgaguacggggaaaccuggcauaaaggaggcauucuggccaacaagcaaaauugcuucgaugacuuucagugugcugccgaguaucucaucaaagaaggguacacauccccgaagagacugaccaucaacggaggcucuaaugggggccuucugguggccgcuugcgcgaaccagcgccccgaucucuucggaugcguuauugcccaggugggcgucauggacaugcugaaguuccacaaauacacgaucgggcaugcuuggacaaccgacuauggauguagcgauuccaagcaacacuuugaguggcuggugaaauacagcccucuucauaaugugaagcuccccgaggccgacgauauucaguauccuucuaugcugcugcucaccgccgaccacgaugaccggguugucccccugcacucccuuaaauucaucgcuacacugcaguacauugugggcagaagccgcaagcagucuaacccgcuccugauccauguggauaccaaggccgggcacggagcgggcaaaccuacagcuaaggucauugaagagguguccgacauguuugccuucaucgcccggugccugaauguugauuggauccccuga

SEQ ID NO: 74195 - RNA, 1998 nt, Artificial Sequence
  derived and/or modified sequence opt5 from PREPL__Homo_sapiens__NP_001035844
augcagcaaaagaccaaacuguuccuccaggcccugaaguacagcaucccccaccuuggcaaaugcaugcagaagcagcaucugaaccacuauaauuuugcugaccauuguuacaacagaauuaaacucaagaaguaucaccugacaaaaugccuucaaaauaagccuaaaaucuccgagcuggcccggaacauuccgucucgcagcuucuccuguaaggaucuccagcccgugaaacaggaaaaugagaagccucugcccgaaaacauggacgcguuugagaaggucagaacgaaacuggaaacccagccucaagaggaguacgaaaucauuaauguugaggugaagcaugggggauucguguauuaccaggaaggcugcugucucguccggucuaaagaugaggaggcugacaacgauaauuaugaagugcuguuuaaccuugaggaacugaagcucgaccagcccuucaucgauugcauccgcguugccccugacgagaaauacguggccgcuaagauuagaacagaagauagcgaggccuccaccugugucaucauuaaacugucugaccagccggugauggaggcuagcuuucccaauguuuccagcuucgaaugggugaaggaugaggaagacgaggauguccuguuuuacacauuccaacggaaccuucgcugccacgacguguauagagccaccuuuggggacaauaagcggaacgaacgcuucuacacagagaaagauccuucuuauuuuguguuccucuaccugaccaaggacuccagauuccugacgaucaauauuaugaacaaaaccacaagcgaggucuggcucaucgauggacugucucccugggacccucccguucuuauucagaagcggauccacggcgugcuguauuacguggaacaucgcgaugacgagcucuauauccugaccaacgucggggaaccgacagaguuuaaacuuccucccugggcguguggauucauuauggauaccaauuccgacccuaagaacugccccuuucagcuguguagccccaucagaccuccgaaguacuacacguauaaauucgccgaaggcaagcucuuugaggagacaggccacgaagaucccauuaccaaaacaucucgggugcugcgccuggaggcuaaguccaaagacgggaagcucguuccuaugaccguguuccauaagaccgauagcgaagaccugcagaaaaagccccuucugguccacguguacggagccuauggcauggaccucaaaaugaauuuuagaccugagcggagaguucugguggaugacggguggauccuugcuuacugccacguccgcggaggcggggagcugggacuccaauggcaugccgauggccggcugacaaagaaacugaacggccucgcggaccuggaagccugcauuaagacgcuucacgggcagggauucucccagcccucucugaccacacucaccgcuuuuagcgccggcggggugcuggcuggagcccuguguaauuccaacccggagcuugucagagccgugacacucgaagcuccuuuccuggauguucugaauaccaugauggacacgacacucccccugacccuugaggaacuggaggaguggggcaacccuagcucugaugaaaagcauaaaaauuauaucaagcgcuacugccccuaucaaaacaucaaaccucagcacuaccccuccauucauaucaccgcguacgagaaugacgaacgggugccgcucaaggggauugucagcuauacagagaaacugaaggaagccaucgcugagcacgccaaagauaccggagagggcuaccagacaccuaacauuauccuggacauccagcccggcgggaaucacgugauugaagauucucauaagaagaucacggcccaaauuaaauuucuuuaugaggaacucggacuggacagcaccuccguuuucgaggaucugaagaaauaccucaaguuuuga

SEQ ID NO: 74196 - RNA, 4980 nt, Artificial Sequence
  derived and/or modified sequence opt5 from PREX1__Homo_sapiens__NP_065871
auggaggcccccagcggcuccgaaccugggggagacggcgcuggggauugcgcccacccggaccccagagcgccuggagcugccgcccccucuagcggcccugggcccugugcugccgcucgggaguccgaacgccagcugagacuccggcugugcgugcuuaacgagauccugggaaccgaacgcgauuacgucggcacacucagauuccugcaaucugccuuucuucaucggauucgccagaauguugcggacagcguggagaagggccugacggaggaaaacgugaaaguccucuucuccaauaucgaggauauucuggaagugcacaaggacuuucuggccgcucucgaguauugucugcauccugagccgcagucucagcacgaacuugggaacguuuuccugaaauuuaaggauaaauucugcguguacgaggaauauuguagcaaucaugagaaggcccucagacugcuugucgaacugaacaagauccccaccgugcgggcuuuucuccuguccugcaugcugcucggaggccgcaaaacaaccgacauuccucuggagggguaccuucugagccccauccaaagaaucuguaaguauccucuccugcuuaaagagcuggccaagcggacacccggaaaacacccggaucacccugcgguucagucugcccuccaggcuaugaagaccgugugcuccaauauuaacgaaacaaagcgccagauggagaaacuggaagcccuggagcaacuccagagccauaucgaaggcugggaggggucuaaucugaccgacauuuguacgcagcuucugcuccagggaacccugcuuaagaucuccgcuggcaacauucaagagagagccuucuuucuguucgauaaucuccuggucuacugcaaaagaaagagccgcgugacaggcucuaaaaaguccaccaaaagaacaaagagcaucaacgggucccuguauauuuuucggggaagaaucaauaccgaagugauggaggucgaaaacguugaggacggcacggccgauuaccacucuaauggguacacagugaccaacggauggaagauccauaacacagcuaaaaauaagugguucguguguauggcgaaaaccgccgaagagaagcagaaauggcucgacgcuauuauccgcgagcgggaacagagagagagccugaagcugggcauggaacgcgacgccuaugucaugauugccgagaagggggagaaacuguaccacaugaugaugaacaagaaagugaaucucaucaaggaucggagacgcaaacuguccaccguucccaagugcuuucugggaaacgaguucguggcuuggcuucucgaaauuggcgaaaucagcaagacagaggaaggcgucaaucuggggcaagcccugcucgagaacggaaucauucaccaugugucugacaaacaccaguucaagaaugagcagguuauguaucgguuuagauacgaugacggcacguauaaagcgcgcuccgaacuggaggauaucaugagcaagggggugcggcuuuacugcagacugcauucucucuauaccccugucauuaaagaccgcgauuaccaccugaagacauacaagagcgugcugcccggauccaaacuugucgacuggcuccuggcucagggcgauugucaaacccgggaagaggccguggcccuggggguuggccucugcaacaauggauucaugcaucacgugcuggaaaagucugaguuuagagacgagagccaguauuuccgguuucacgcugaugaagagauggaaggcacauccagcaaaaacaagcagcuucgcaaugacuucaaacuggucgagaacauccucgccaagagacugcugauucuuccccaggaagaggacuacggguuugauaucgaggaaaagaauaaggcugugguugugaagucuguccaacggggaucccucgccgagguggcgggccuucagguggggagaaaaaucuauagcauuaacgaagaccugguuuuccuccgcccuuuuucugaggucgaguccauccugaaucagagcuucuguucccggagaccgcuucgccugcucguggccaccaaggcuaaagaaauuaucaagauucccgaucagccugacacgcugugcuuucaaaucagaggagccgcucccccuuacguguaugccgucggccgggggucugaggcgauggccgcuggccugugugccggacagugcauucuuaaagugaacggcagcaacguuaugaaugauggggcucccgaagugcucgagcauuuccaggccuuucgcuccagacgggaagaggcccugggacuguaccaguggaucuaucacacacaugaggacgcucaagaagcgcgcgccucucaggaggcuagcaccgaagauccguccggcgagcaggcccaagaagaggaccaggccgauagcgcuuucccucuccugucucuugggcccagacugucccucugugaggacagcccuauggucacccugacaguggauaacguucaccuggaacacggaguggucuacgaguacgugucuaccgccggcguucggugccaugugcuugaaaagaucgucgagccccgcggguguuucggccugacagcgaagauucucgaggcuuuugccgccaaugacuccguguucguggaaaacugcagacggcugauggcucucagcucugccaucgucacgaugccucacuuugaguuccgcaauauuugugauaccaaacuggaaagcaucggacagagaauugcgugcuaucaggaguuugcugcccaacuuaagucccggguuucucccccguucaaacaggccccucuggaaccccauccccucugcggccuggacuuuuguccuacaaacugccacaucaaucugauggaggugagcuacccgaagaccacacccuccguggggcggagcuucuccauccgcuuuggacggaaaccuucucuuauuggccuggaccccgagcaggggcaucucaacccuaugagcuauacccagcacuguaucacgaccauggcugcccccuccuggaagugccugccugcugccgaaggagauccccaaggccaggggcuccacgacggcucuuucggaccggcgagcggcacacuggggcaggaggauagaggacuuuccuuucugcucaagcaggaagaccgcgagauucaagaugccuaccugcagcuguucaccaaacuugacgucgcucugaaggaaaugaaacaguaugugacacaaaucaaucggcuccugucuaccauuacggagccuacaagcggcggguccugugaugccagccucgcugaggaagccucuucccugccccuuguuagcgaggaaucugagauggacagauccgaucauggaggcaucaagaaagugugcuuuaaggucgccgaagaggaccaggaggauagcggccacgacaccaugucuuaccgcgauuccuauagcgaauguaacuccaaucgggacagcgugcugucuuacacaagcguuagauccaacucuagcuaccugggguccgacgagaugggaucuggcgaugaacucccuugcgacaugcgcauccccagcgauaagcaggacaaacugcaugggugucuugagcaccuguucaaucagguggauuccauuaacgcucuccugaagggaccggucaugucucgggcguucgaagagaccaaacauuuuccuaugaaucacagccuccaagaguucaagcagaaagaagagugcaccaucagaggccggucccugauucagaucagcauucaggaagaccccuggaaccuuccuaacucuaucaagacacugguggauaauauccaacgcuauguugaggacgggaaaaaccagcugcuccuggcccuucugaaguguacggauaccgagcuccagcugagacgggacgcuaucuuuugccaggcccucguggccgcugucugcacauucuccgaacaacugcuugccgcgcugggauaccgcuauaauaacaauggcgaguacgaagagagcucuagagaugcuucccggaaguggcuggaacagguggccgccaccggcgugcuccugcacugucagagccuucugucccccgcuacagucaaagaggagagaaccaugcucgaagacauuuggguuacgcugucugagcucgacaacgugacauuuagcuucaagcagcuggaugaaaauuauguggccaacaccaaugucuuuuaccauauugaggggucccgccaagcgcuuaaagugaucuucuaucuggacagcuaccacuuuucuaagcugcccucccggcucgaaggaggcgcuagccugagacuucauaccgcccuguucacaaaaguucucgagaacguggaggggcugccuucuccgggaagccaggccgcugaagaucugcagcaagacauuaaugcccagucccucgagaagguccagcaguacuaucgcaaacuucgggcuuuuuaccuggaaagaucuaaccugcccaccgaugccagcacaacggcggugaaaaucgaccaacucauucgcccuaucaaugcccuggaugagcuuugccggcugaugaaguccuucguucaccccaaaccuggcgcugccgggucugugggagcuggccucauccccauuagcuccgaacuguguuauagacugggcgccugccagauggucaugugugggaccggaaugcagcgcagcacacucucugugucccuugagcaggccgcuauccuggcgagaagccacggccugcucccuaagugcauuaugcaagccaccgacaucaugcggaaacaggggccgcgcgucgagauucuggcuaagaaccuuagagugaaggaucagaugccccagggagccccucggcuguaccgccucugucaacccccuguugacggcgaucuguga

SEQ ID NO: 74197 - RNA, 4821 nt, Artificial Sequence
  derived and/or modified sequence opt5 from PREX2__Homo_sapiens__NP_079146
augagcgaggacuccagaggcgauucucgggccgaaagcgcuaaggaccuggagaaacagcuccgccugagagugugcguccuuuccgaacugcaaaagaccgagcgggauuacguugggacacucgaguuccuggugucugccuuucuucaccgcaugaaccagugugcggcuagcaaaguggacaagaaugucacggaggagaccgugaaaaugcuguucuccaacaucgaagauauucucgccguucauaaggaguuucugaagguggucgaagagugccugcaccccgagccuaaugcccagcaggaagugggaacauguuuccuccauuuuaaagacaaguucagaaucuaugaugaguacugcucuaaccacgaaaaagcucaaaagcugcuucuggagcucaauaaaauucggaccauccgcacauuucugcuuaacuguaugcugcucggcgggagaaagaauaccgacguuccgcuggaaggauaucuggugacacccauucagcggaucugcaaguacccucucauccugaaagagcuucugaagcgcacccccagaaaacauagcgauuaugccgcugucauggaggcccuccaggcgaugaaggccguguguuccaacauuaaugaagcuaaacggcagauggagaagcuggaagugcuugaggaauggcaaagccacaucgagggcugggaggggucuaacauuacggauaccugcacagaaaugcugauguguggaguccuccugaaaaucuccagcggcaauauucaggagcgcguuuucuuucuguucgacaaccuccugguguacugcaagagaaagcaccggcgccuuaaaaauucuaaggccuccaccgacggccauagauaucuguuucgggggagaaucaacacagaagugauggaggucgaaaauguggaugacggaaccgcugacuuccacagcucuggccauauuguugugaacggguggaaaauccacaacacggccaagaauaaaugguuugucuguauggcgaagacaccugaggagaagcacgaaugguucgaggccauccucaaagaacgcgagcggagaaagggacugaaacuuggcauggagcaggauaccugggugaugauuuccgaacagggggagaagcuguacaaaaugaugugccgccaaggaaaccucaucaaggaccggaagagaaaacugacaaccuuccccaagugcuuucugggcagcgaguucguuuccuggcuccuggaaauuggcgaaauccaucgcccugaggagggggugcaccuuggacaggcucugcucgaaaauggcauuauccaucacgucaccgauaaacaucaguuuaagccggagcaaaugcuguaccgguucagauaugacgaugggacauuuuacccccgcaacgaaaugcaggacgugaucucuaaaggaguccggcuguauuguagacuucacagccucuucacgccugugauucgcgauaaggacuaccaucugcggaccuauaaguccguugugauggccaauaaacugaucgauuggcucauugcucagggcgacugcagaacacgggaggaagccaugaucuuuggggucggacugugugauaacggcuucaugcaccacgugcuugaaaagagcgaguuuaaagacgaaccccuucucuuccgcuuuuucucugacgaggaaauggagggcuccaauaugaagcauagacugaugaaacacgaucugaagguuguggaaaacgucauugccaaaagccuucucaucaagucuaaugaggggagcuacggauuuggccuggaggacaagaacaaagugccuaucauuaagcugguggaaaaaggguccaaugcugagauggcgggaauggaaguuggcaagaaaaucuucgccauuaacggggaucucgucuucaugcggcccuuuaaugagguggacugcuuccugaagucuugucuuaacagcagaaagccgcugcgcgugcucgucuccaccaaaccucgggagacagugaagauccccgauagcgcugacggccugggauuucagauuagaggcuucgggccuucuguugugcacgccgucggacgcggcaccguggccgcugccgcggggcugcaucccggacaaugcaucauuaaaguuaauggcaucaacguguccaaggaaacgcacgcuagcgucaucgcccaugugacagccuguagaaaauaucggcgccccaccaagcaggauucuauucaguggguuuacaacuccaucgagagcgcucaggaagaccuucaaaagucccacucuaaaccuccgggggaugaggccggcgacgcuuuugauugcaagguggaagaggucauugacaaauucaauaccauggccaucauugauggaaagaaagagcaugugagccucacaguggacaacguccaccuggaauacggcguuguguaugaguacgacuccaccgcggggaucaaguguaauguggucgaaaagaugaucgagcccaaaggauuuuucucucugacagccaagauucucgaagcucuggccaaaagcgaugagcacuuugugcagaacugcacgucccuuaauagccugaacgagguuaucccuaccgaccuccagucuaaguucuccgcucuguguagcgaaagaauugagcaucugugccagcggaucucuuccuauaaaaaguuuagccgcgugcuuaaaaauagagccuggcccacauucaagcaagcgaagucuaaaauuagcccucuccacuccagcgauuuuugccccaccaacugucaugucaaugugauggaaguuucuuacccgaagacauccaccagccugggcuccgccuucggggugcagcuggacucucggaaacacaacagccaugauaaggagaauaaauccucugaacagggaaagcucagcccuauggucuauauccagcacacgaucaccacaauggcugcccccuccggccugucucuugggcaacaggacggccacggacugcgcuaccuccugaaggaggaggaucuggaaacccaggacauuuaucaaaaacuucugggcaagcuccagacagcucugaaagagguggaaaugugcguuugucagaucgaugaccuccugagcuccauuaccuacagcccuaagcuggagagaaaaacgucugaggggaucauucccacagauuccgacaacgaaaagggagagcggaauagcaagcgcgugugcuucaacgucgccggcgaugaacaggaggacucugggcaugacaccaucuccaauagagauagcuacucugacuguaacuccaaccggaauagcaucgccuccuuuacaagcauuugcucuagccaauguuccucuuauuuccacagcgaugaaauggacuccggagaugagcugccucucucugugagaaucagccaugacaaacaggauaagauucacuccugccuggagcaccuguuuucucagguggacagcaucaccaaccuucugaaaggccaggcugucguucgcgcguucgaucaaaccaaguaccucacacccgggcggggccugcaggaauuucagcaggagauggaaccgaaacucuccuguccuaagagacugcgccuucauauuaagcaagaccccuggaaucugcccagcucugugcggacgcucgcccagaacaucagaaaauucguggaggaagucaagugccgccugcugcuugcucugcucgaguauuccgauagcgagacccagcugcggagagacaugguguuuugucaaacacucguugccaccgugugcgccuucucugaacagcugauggcugcccuuaaucagauguuugacaacuccaaagagaaugaaauggagacaugggaagcgagccgccgguggcuggaucagauugcuaacgccggaguccuguuccacuuucaaucccuccugucuccuaaucuuaccgacgagcaggccaugcuggaggauacgcucguggcucuguucgaccucgaaaagguuagcuucuacuuuaaaccguccgaggaggaaccccugguggccaacgucccucuuacauaucaggcggagggcagcagacaggcucugaagguguacuucuauaucgauucuuaccauuuugaacaacugccccagcggcucaagaaugggggaggcuucaaaauccacccuguccuguuugcccaggcccuugaguccauggaaggguacuauuaccgcgacaacgugagcguugaggaguuccaggcucaaauuaaugccgcuucucuggaaaaggugaaacaguauaaccagaagcucagagccuuuuaccuggauaaaagcaauucucccccuaacuccaccagcaaggcggccuaugucgacaaacucaugcggccccugaacgcucuugaugagcuguaccgccugguggccuccuucaucagaucuaagcggaccgcugccugcgccaauacagcuuguagcgcguccggaguuggccuccugagcgugucuuccgaacuuugcaacagacugggcgccugucauauuaucaugugcagcuccgggguccaccgcuguacccucucugugacacuggagcaggcuauuauccucgcccggagccacggacugccgccuagauauaucaugcaagccacggacgugaugcgcaagcagggcgcucggguucagaauaccgccaaaaaccuuggggucagagaucgcacaccccaauccgcgccucggcuguacaagcugugcgaacccccgccucccgcuggagaggaauga

SEQ ID NO: 74198 - RNA, 1668 nt, Artificial Sequence
  derived and/or modified sequence opt5 from PRF1__Homo_sapiens__NP_001076585
auggccgcuagacugcuccugcuuggcauccugcuccugcuucugccccucccugugccggcccccugccacaccgcggcucggagcgaguguaagcgcucccauaaauucgucccuggggccuggcuggccggagaaggcguugacgugacaucucugagacggagcggguccuuucccguggauacgcagcgcuuccucagaccugacggaaccugcacacugugugagaacgcccuucaagaaggcacccugcagcggcucccccuggcucuuacaaauuggcgcgcucaggggucuggaugccagagacacgucacccgggccaaggugagcuccacagaggcgguugcccgcgaugcugccagaucuauucggaacgacuggaaagugggccuggaugucaccccuaagccgacgagcaaugugcauguuuccguggcuggcagccacucucaagccgcgaacuuugccgcucagaaaacccaucaggaccaguacuccuucagcacagauaccgucgaaugucgcuuuuauucuuuccacguggugcacacacccccucuccaucccgacuuuaagagagcccugggggaucugccucaccauuucaaugcuuccacccaacccgccuaccuccggcugaucagcaacuauggaacgcacuuuauucgcgccgucgagcuuggcgggagaaucucugcucugacagcgcuccggaccugcgagcuggcccuugaaggacugacagacaaugagguugaagauugucucaccguggaggcucaggugaacauuggcauccacggguccaucagcgccgaggccaaggcuugcgaagagaaaaagaaaaagcauaaaaugaccgccuccuuccaccagacauacagagaacgccauucugaggucgugggaggccaccauacgagcauuaaugaccugcuguuuggcauccaggcggggccggaacaauauuccgcuuggguuaacagccucccuggaucucccggccugguggauuacacccuugagccucugcacguccuccuggacucccaggacccccggagagaggcccuucgccgggcccugagccaguaucucacagauagagcucgcuggcgggacuguucuagacccugcccuccggggcgccaaaagagcccccgggauccuugucagugcgugugccacggauccgccguuaccacacaggacuguugccccagacagcgcggccuggcucaacuggaagugaccuucauucaggccugggggcucuggggagauugguuuacggcgacagacgccuacgucaagcuguucuucggcggccaggagcuucggaccucuaccgugugggauaauaacaauccuaucuggagcgucagacuggacuuuggggaugugcuccuggcuacaggaggcccccugcggcuucagguuugggaccaagauuccgggcgcgacgacgaucuccugggaaccugugaccaggccccgaaaagcggcucucaugaagugagaugcaaccugaaucacgggcaucucaaguuccgguaccacgcuagaugucugccucaccuuggcggaggcacaugccuggauuaugucccccagaugcuccugggggagccucccggaaaccgcuccggcgccgugugguga

SEQ ID NO: 74199 - RNA, 636 nt, Artificial Sequence
  derived and/or modified sequence opt5 from PRG2__Homo_sapiens__NP_001230174
augaagcugccccuccugcuugcccuccuguucggcgcugugagcgcccugcaccuuagauccgagaccucuacauuugaaacgccucugggggcgaaaacccucccggaggacgaagagacacccgaacaggagauggaggaaaccccuugccgggagcuggaagaggaggaagaguggggaagcggcuccgaagaugcuucuaagaaagacggggccgucgagagcaucuccguucccgauaugguggacaagaaccugacauguccugaagaggaggauaccgugaaagucgugggcauucccggaugccaaacaugucgcuaccuccuguuuaccugcagacgguguuaucgcgggaaucuuguuucuauccauaacuucaauauuaacuacagaauccagugcagcguguccgcccugaaucagggacaggucuggauuggcggccggaucacggggagcggacgcuguagacgguuccaauggguggacggcucucgcuggaacuuugcuuauugggccgcucaccagccuugguccagagggggacauugcguugcccucuguacccggggcgggcacuggcgcagagcgcauugccugcggcgccuuccguucaucuguagcuacuga

SEQ ID NO: 74200 - RNA, 4092 nt, Artificial Sequence
  derived and/or modified sequence opt5 from PRG4__Homo_sapiens__NP_001121180
auggccuggaagacccugcccaucuaccuccugcuucugcucagcguguucgucauucagcaaguuuccucucaggagcugagcugcaaaggcagauguuuugaauccuucgagcgggggcgcgaaugcgacugugaugcucagugcaagaaauaugacaaguguugcccugauuacgagucuuuuugugccgaagugcacaacccgacaucucccccuuccucuaaaaaggcgcccccucccagcggagcuucccagacgaucaagagcaccacaaaaagaucuccuaagccgcccaauaaaaagaaaaccaagaaggugauugaguccgaggaaaucacagaggaacauagcgucucugagaaccaagaguccagcagcuccagcuccucuagcuccucuagcuccaccauucggaaaaucaagagcucuaaaaauagcgccgccaaccgcgaacuucagaagaaacugaaggugaaagacaauaagaagaacagaaccaaaaagaaaccuacccccaagccucccguuguggaugaggcuggcuccgggcucgacaauggagauuucaaagucacgaccccggacacaucuaccacacagcacaacaaggugagcaccuccccuaagaucacgacagccaaacccauuaauccucggcccagccugcccccuaacucugauaccuccaaggaaacaagccugaccguuaauaaagagaccacaguggaaacgaaggagaccacaaccacaaacaaacagaccucuacggacggcaaggagaagacaaccuccgcuaaagaaacccaaagcaucgagaagacauccgccaaagaucucgcgccgaccucuaagguccuggccaaacccacaccuaaggcugaaacgaccacaaaggggcccgcccuuaccacaccuaaagagcccaccccgacgaccccuaaggaacccgcuagcacaaccccuaaagagcccacaccuaccacgauuaaguccgcccccacaaccccgaaagagccugcgcccacaaccaccaagucugcccccacaacgccuaaagaaccggcucccaccacaaccaaggagccugcccccacaaccccuaaggaacccgcuccuacgacaaccaaagagcccgccccgaccacaaccaagagcgccccuacaacgcccaaagaaccugcucccaccacaccgaagaaaccugcgcccaccacaccuaaggagcccgcccccaccacgccuaaggagccgacccccacaaccccuaaagaacccgcuccuacaaccaaggagcccgccccuacaaccccgaaagaacccgccccuacggcucccaagaaaccugcccccacaaccccgaaggagccugcgcccaccacacccaaggagccugcucccaccacgacaaaagaaccuuccccgaccacacccaaggagccugcccccaccacaaccaaaagcgccccuacgaccacaaaggaacccgcuccgaccacaaccaaaucugccccuacgacacccaaggagccuucccccaccacaaccaaggaaccugcucccaccacaccgaaagagccugcccccacgacccccaagaaaccugcgccgacaacccccaaggagccugcccccacaaccccuaaagaacccgcuccuacgacaaccaagaaaccggcccccaccacaccuaaggagcccgcuccuaccacacccaaggaaacggccccgaccacaccuaaaaagcugacccccacaacccccgagaaacucgcgccuacgacccccgaaaagccugccccgacaacccccgaggagcuggcuccuacaacccccgaagaaccuacacccacgaccccggaggagccugcccccacaaccccuaaagcugccgcccccaauaccccuaaggaacccgcuccgacaacgccuaaggagcccgcgcccaccacaccuaaagagccggcccccaccacaccuaaggaaaccgcucccacgacaccuaaaggaaccgcccccaccacacuuaaggagccugcccccaccacaccgaaaaagccugcucccaaggaacuggccccuaccacgacaaaagagcccaccagcacaaccucugacaagccggcgccuacgacccccaaaggcacagcucccaccacaccuaaggagcccgccccuaccacaccgaaagaacccgccccuaccacgcccaagggcacagcuccuaccacccucaaggagcccgccccuacaaccccgaaaaagcccgcgccuaaagaacuggcucccacaacgaccaaggggccuacauccaccacaagcgauaaacccgccccgaccacgccuaaggagaccgcccccacaacccccaaggaaccugcucccacaaccccuaaaaagccggcccccacgacaccugagacacccccucccacaaccucugaggugagcaccccgacaacgaccaaagaaccuacaaccauccauaagucccccgacgagagcacaccugaacugucugcugagcccaccccgaaagcccucgaaaacuccccuaaggagcccggagugcccacgacaaaaaccccugcggccaccaagcccgagaugacaaccacagcuaaggacaaaacgaccgaacgcgaucugagaacaaccccugagacaaccacggccgcuccgaagaugaccaaagaaacagccaccacaaccgagaagacaaccgaaagcaaaauuacggccacaaccacccaggucacauccacgaccacacaggacaccacacccuuuaagaucaccacacuuaagaccacgacccuggcuccuaaaguuacaaccacaaagaaaaccauuacgacaaccgagaucaugaauaagcccgaggaaacagcgaaaccuaaggaucgggccaccaacucuaaggcuacgacccccaaaccucagaagccgacaaaagcccccaagaaaccuaccagcacaaagaagcccaaaaccaugccucgcgugagaaagcccaaaacaaccccgacgccucggaagaugacauccaccaugcccgagcucaaccccaccucucgcaucgccgaagcuaugcugcaaacaaccacaagaccuaaucagacgcccaacagcaaacuuguggaggucaauccuaaguccgaggacgccggcggggcggaaggagagaccccgcacaugcugcuccggccccauguguucaugccugaaguuacacccgauauggacuaucugccucgcgugcccaaccagggcauuaucauuaauccgaugcugucugaugagaccaacaucugcaaugggaaaccugucgacggacucacaacccugagaaacggcacgcuuguggcuuuucggggccacuacuucuggaugcugagccccuuuuccccucccagcccugccagacgcauuaccgaaguuugggggauccccucuccgaucgauacaguguucacccgguguaauugcgagggaaagacauuuuucuuuaaggacucccaauauuggagauucaccaacgauauuaaagacgccggcuaccccaagccuaucuucaaaggguuuggaggccucacggggcagauugucgcugcccugagcacagcgaaguauaaaaauuggcccgagucuguguacuucuuuaagcgcggaggcuccauccagcaguacauuuauaagcaagaaccuguccagaaauguccgggccggagacccgcucuuaacuacccuguguauggggagaccacacagguucgccggagacgcuucgaacgggccaucggacccagccagacccacaccauccgcauucaauacucuccugccagacuggcuuaucaggacaagggcgugcuccauaaugaggucaaaguguccauccuguggcgggggcugcccaacguugugacaagcgccauuucccucccuaauaucagaaagcccgauggauacgacuauuacgcuuuuagcaaagaucaguacuauaacauugacgucccgucucggacggcccgcgcgaucaccacaagaagcggccagacccuguccaaggugugguacaacugcccuuga

SEQ ID NO: 74201 - RNA, 564 nt, Artificial Sequence
  derived and/or modified sequence opt5 from PRH1__Homo_sapiens__NP_001278243
augcugcucauccugcuuagcguggcccugcucgcuuucuccucugcccaggaccugaacgaggaugucagccaagaagacguuccccuugugauuuccgauggcggggacucugagcaguuucuggaugaagagagacagggaccuccgcucggcgggcagcaaagccagcccuccgcgggagacggcaaucaggaugacgggccucagcaaggacccccucagcagggcggccagcaacagcaggggcccccuccgccccaaggaaagccucaggggcccccucagcagggcggacaacagcagcaggggcccccgccuccccaagggaaaccucagggaccuccccagcagggcggccacccuccgcccccucaagggcggccccagggaccuccccagcagggcgggcauccgcgcccucccagaggacggccucaaggacccccucagcagggcggccaccaacagggcccgcccccucccccgcccggcaagccccaggggcccccuccccagggaggccgcccucaagggcccccucagggacagucuccccaguga

SEQ ID NO: 74202 - RNA, 501 nt, Artificial Sequence
  derived and/or modified sequence opt5 from PRH2__Homo_sapiens__NP_001103683
augcugcucauccugcuuagcguggcccugcucgcuuucuccucugcccaggaccuggaugaggacgucagccaagaagauguuccccuugugauuuccgacggcggcgauucugagcaguuuaucgacgaagagagacagggaccuccgcugggcgggcagcaaagccagcccuccgcgggagauggcaaccagaaugacgggccucagcaaggacccccucagcagggcggccagcaacagcaggggcccccuccgccccaaggaaagccucaggggcccccucagcagggcggacaucccccgccuccccaaggccggccucaggggccuccccagcagggaggccacccccgcccgcccagaggccggccucaagggcccccucagcagggaggccaccagcaagggcccccgccucccccucccggaaaaccucaggggcccccgccucagggcggacgcccccaggggcccccucaaggccagucuccgcaguga

SEQ ID NO: 74203 - RNA, 2496 nt, Artificial Sequence
  derived and/or modified sequence opt5 from PRICKLE1__Homo_sapiens__NP_001138354
augccccuggagauggaaccuaagaugagcaaacucgccuucggcugccagagauccucuaccagcgacgaugacuccgggugugcucuggaggaauacgccugggugccgcccggacuucggccugagcaaauccagcuguauuuugcgugccuccccgaagagaaggucccuuacguuaacucucccggcgagaaacaccgcauuaagcagcugcuuuaucagcugccuccgcaugauaaugaagugagauacugucaaagccucuccgaggaagagaaaaaggagcuccagguguucucugcucagcggaagaaagaagcccuggggcgcggaacaaucaagcugcugagcagagccgucaugcacgcugugugcgagcaguguggccuuaaaauuaacgggggagaaguugccguguuugcuucccgggccggccccggcgucugcuggcauccuagcuguuucgugugcuuuacguguaaugagcugcucguugaccugaucuauuucuaccaagaugggaagauucacugcggacgccaucacgcggaacuucugaaacccagauguucugccugcgacgagaucaucuuugcugaugagugcaccgaagccgagggccggcacuggcauaugaagcacuucuguugccucgaaugugagacagugcucgggggacagcgcuauauuaugaaggacggcagaccuuuuugcugugggugcuucgaaucccuguacgcugaguacugugagaccugcggagaacauaucggcgucgaucacgcccagaugacauaugacggccagcacuggcaugcgaccgaggccuguuuuagcugcgcucaauguaaagccucucugcuggggugccccuuccuuccgaagcagggacagauuuacugcuccaaaacauguagccugggcgaagaugugcacgcuucugacuccagcgauuccgccuuucaaucugcccggagccgcgacuccagacggagcgugcgcauggggaagucuuccagaagcgcugaccagugccggcagucucuccugcuuagcccugcgcugaacuauaaauuccccggacucuccggcaaugccgaugacacccugucuagaaagcuggaugaccucagccugucccgccaggggacgagcuucgcuucugaggaauuuuggaaaggacgggucgagcaagagaccccugaagaucccgaggaaugggccgaccaugaggauuacaugacacagcuucugcucaaguucggcgacaagucccuguuucagccccagccuaacgagauggauaucagagccagcgaacacuggauuucugacaauaugguuaaauccaagaccgagcuuaaacaaaacaaucagagccuggcuuccaagaaauaucagucugauauguacugggcccagagccaagacggccucggggacuccgcguauggaucucauccgggccccgcuagcucccgccggcugcaggaacuggagcucgaucacggggccagcggauacaaccacgacgaaacacagugguacgaggauucucuggagugucuuuccgaccugaagccugaacagagcgugagagauucuauggacucccucgcccugagcaauaucaccggcgcuucuguggauggggagaacaagccccgcccuagccuguauucccuucaaaauuucgaagagauggaaacggaggacugcgagaaaaugagcaacaugggcacacucaauucuuccaugcugcaucggagcgccgaaucccugaagucucucagcuccgagcugugucccgagaaaauucuuccggaggaaaagccuguccaucugcccgugcucagacgcucuaaaagccagucccggccucagcaaguuaaguuuucugaugacgugaucgauaacggaaacuacgacaucgagauuagacagcccccuaugagcgagcgcacccggagacgggucuauaauuucgaagaacgcggcuccagaagccaccaccaccggagacgccggucuagaaagucccgcagcgauaacgcucugaaucuggugacagaaagaaaauacucucccaaggaccggcuucgccucuauaccccggacaacuacgagaaauuuauccagaauaaguccgccagagagauucaggcguauauccaaaacgccgaucuguacgggcaguacgcucaugccaccagcgacuauggacugcagaauccuggcaugaaccgguuccucgggcuguacggagaagaugacgauucuuggugcuccagcuccagcucuagcuccgacucugaggaagagggcuauuuucuugggcagcccauuccccaaccucgcccgcagagauucgcuuacuauacagaugaccugagcucucccccuuccgcccuccccacgccucaguuuggccagcggaccacaaaaagcaagaagaaaaagggacacaaaggcaagaauuguaucaucuccuga

SEQ ID NO: 74204 - RNA, 2535 nt, Artificial Sequence
  derived and/or modified sequence opt5 from PRICKLE2__Homo_sapiens__NP_942559
auggugaccgucaugccccuggagauggaaaagacaaucagcaaacucauguucgacuuucagagaaacuccacgucugaugacgauagcggcugcgcccuggaggaauacgcuuggguuccuccggggcuuaagcccgagcaagugcaccaguauuacuccugucugccugaagagaaagugcccuaugucaauucuccuggagagaagcuccggauuaaacagcugcuucaucagcugcccccucacgacaacgaagugcgcuacugcaauagccucgaugaggaagagaagagagagcugaagcuguucuccucucaacggaaacgcgaaaaccucggcagagggaauguucggccguuucccgugaccaugacaggagccaucugugagcagugcggcgggcagauuaacggaggcgacaucgcggucuucgcuagccgcgccggccaugggguguguuggcacccucccugcuuuguuuguaccgugugcaaugaacugcuugucgaucugauuuauuucuaccaggacggaaagaucuauuguggcagacaucacgccgagugccucaaaccucggugugcugccugcgaugaaaucauuuuugcugacgagugcacagaggccgaagggcgccacuggcauaugaagcacuucuguugcuuugagugugaaaccgugcugggaggccaaagauacaucaugaaagaggggcggcccuacugcugucauugcuucgaaucccuuuaugcggaguacugugauacaugcgcccagcacauuggaaucgaccagggccagaugaccuaugauggccaacacuggcaugcuacggagaccuguuuuugcugugcccacugcaaaaagagccugcucgggcgcccguuccugccuaagcagggacagaucuuuugcucuagagcuuguuccgccggcgaagaccccaacgggagcgacucuuccgauagcgcguuccaaaaugcccgggcuaaggagucucgcagauccgccaaaauuggaaagaacaaaggcaagacagaggagccuaugcugaaucagcauagccagcuccagguguccucuaaccggcugagcgcugacgucgauccccuuucccugcaaauggacaugcucagccugucuucccagacccccagccuuaauagagauccuauuuggcgcucucgggaggaaccguaccacuaugggaacaaaauggagcagaaucagacacaaagcccccugcagcuccugucccagugcaacaucagaaccucuuacagcccuggaggccagggcgccggggcccaacccgaaauguggggaaagcauuucuccaacccuaagcgcucuagcucccuggcuaugacgggccacgcggggagcuuuaucaaagagugucgggaagacuauuaccccggaagacuccgcucucaggaguccuacagcgauauguccucucagagcuucuccgagacacggggcucuauucagguuccgaaguaugaagaggaagaggaagaggaagggggccugagcacccaacagugcagaacacgccacccuaucuccagccuuaaauacaccgaagacaugacccccacagagcagacgccucggggaucuauggaaucccuggcccucagcaaugcuaccggccugucugccgaugggggagccaagagacaagagcaucuuucccgcuuuagcaugcccgaccugucuaaagauagcggcaugaacguguccgaaaagcucagcaauauggggacacugaacucuuccaugcaguuccggagcgcugaguccgugagaucucugcucagcgcccagcaguaucaagagauggaaggaaaucugcaccagcuuuccaacccuauuggcuaccgggaccugcagucucaugggcgcaugcaccagagcuuugacuucgauggcggaauggcgggcuccaagcuccccgggcaagagggagucagaauccagccgaugucugaacggaccagacgccgggcuacaagcagagacgauaaucgcagauuucggccucaccgcuccagacggagccgcagaucucgguccgacaacgcccugcaucuggccagcgagcgcgaagcuauuucuagacuuaaagaucggccuccccuccgcgccagagaggacuaugaucaguucaugcggcagagauccuuucaagagagcaugggccacgggucucgccgggaccuguacggacagugucccagaaccguguccgaucuggcucuccagaaugccuucggcgaccgcugggggccguauuuugcggaauacgauuggugcagcacguguuccagcucuagcgaguccgacaacgaaggcuacuuccugggagagcccaucccucaacccgcccggcuuagauauguuacaucugaugagcugcuccauaaguacagcuccuauggccugccuaaaucuagcacccuugggggacgcggccagcugcacucccggaagagacagaaaucuaagaauugcaucauuagcuga

SEQ ID NO: 74205 - RNA, 1155 nt, Artificial Sequence
  derived and/or modified sequence opt5 from PRICKLE4__Homo_sapiens__NP_037529
augagcgugcagaacuccggcuggccccaccaagaggacucuccuaagccgcaggaucccgggccucccgccaauagcgacuccgauucuggacaucugccuggcgaagaccccgaggauacccacgcucaggggccugccguccucagccugggaucccuuugccuggacacaaaccaggcgccgaauuggacgggccuccaaacccugcuucagcagcugcccccucaggauaucgacgaaagauacugucucgcucugggggaggaggaacgggccgagcugcaacucuucugcgcccgcagaaaacaggaagcucugggacagggcguugcccggcuugugcugcccaagcucgagggccauacaugugaaaaaugccgcgagcugcuuaagccuggggaguauggaguguuugcugccagagcgggcgaacagcgguguuggcaccaacccugcuucgccugucaggcuugcgggcaggcccugauuaaccucaucuacuuuuaucaugauggacaacuguacuguggccgccaccacgcugagcugcucagaccgcggugcccugccugugaccagcugauuuucucuuggcgcugcaccgaagcggaggggcagagauggcaugaaaaucacuuuugcugucaggauugcgccggaccccuuggcggcgggcgguaugcucugccuggaggcagccccuguugccccuccuguuucgagaaccgcuacagcgacgccgggucuuccugggcuggagcccucgagggccaagccuuucugggggaaacaggacuugauagaaccgagggccgggaccagacaagcgucaauucugcuacccugucccgcacgcuccuggcggccgcuggcgggagcucucugcagacccagagaggacucccuggcuccagcccgcaacaggaaaaccggcccggggacaaagccgaggccccuaagggacaggaacagugcagacuggagacaauccgcgaucccaaggacaccccuuucuccacauguucuagcuccagcgauucugagcccgaaggcuuuuuccuuggggagcggcugccgcaauccuggaaaaccccuggcagccuccaggcugaagacucuaaugccagcaagacgcauugcacaauguguuga

SEQ ID NO: 74206 - RNA, 1263 nt, Artificial Sequence
  derived and/or modified sequence opt5 from PRIM1__Homo_sapiens__NP_000937
auggagaccuucgaccccacagaacugccugagcuccugaaacuuuacuauagacggcuguuuccguacagccaguauuaccgcuggcucaacuauggcggggugaucaagaauuacuuccaacacagagaauuuuccuucacgcugaaggaugacauuuauauccgguaccagucuuuuaacaaucagagcgaucuugagaaagaaaugcagaagaugaaccccuacaaaauugacaucggagccgucuauucccaucgcccuaaucaacacaacaccguuaagcugggcgcuuuccaggcccaggagaaggagcucguguuugauauugacaugacagauuacgacgaugugagacggugcuguucuagcgcggacaucugccccaaauguuggacccugaugacaauggcuauccgcauuaucgauagagcccugaaggaagacuucggguuuaaacaucggcucugggucuauuccggacgcagaggcgugcacugcuggguuugugaugagucugugcggaagcugagcuccgccguccgcagcgggauuguggaauaccuuucucugguuaaaggaggccaggacgugaagaagaaaguccaucucuccgagaagauccacccuuucauuagaaaaagcaucaauauuaucaagaaauauuuugaggaauacgcucuggugaaccaagacauccuugagaauaaggaaucuugggauaaaauucuggcccucgugcccgagaccauccacgacgaacugcagcaguccuuccaaaagagccauaacucucugcagcggugggagcaccucaagaaagucgcuucccgcuaucagaauaacauuaagaaugauaaauacggcccuuggcuggagugggaaaucaugcuucaguacugcuuuccgagacuggacauuaacguuagcaaggggaucaaucaucuccugaaaucccccuucucugugcacccuaagacaggacggaucagcgugcccauugaucuucaaaaggucgaccaguucgauccuuuuaccgugcccacgaucuccuucauuuguagagagcuggacgccaucagcaccaacgaagaggaaaaagaggagaacgaagcggagucugauguuaagcaccgcacacgggacuauaaaaagaccucccucgccccguacgugaaagucuuugaacauuuccuggagaaucuggauaagagcagaaagggcgaacuccugaaaaagucugaccuucagaaagacuuuuga

SEQ ID NO: 74207 - RNA, 462 nt, Artificial Sequence
  derived and/or modified sequence opt5 from PRIMA1__Homo_sapiens__XP_011544946
augcugcucagagaccuggugcuucggcgcggcugcuguuggagcucccugcuccugcacugcgcccuucauccccuguggggguucguccagguuacccacggagagccucaaaagucuuguagcaaagugacagauuccugcagacaugugugucagugccggccgcccccuccccucccucccccuccgcccccucccccucccccgcgccugcugucugcuccugcccccaacagcacguccuguccuaccgaagagucuugguggagcggccucgucaucauuaucgcggugugcugugcuucccugguuuuucuuacagugcuggucauuaucugcuacaaggccauuaaaagaaagccccuccggaaagacgaaaaugggaccagcguggccgaguaucccaugucugcuucccagagcaacaagggaguugaugugaauaacgccgucguguga

SEQ ID NO: 74208 - RNA, 1683 nt, Artificial Sequence
  derived and/or modified sequence opt5 from PRIMPOL__Homo_sapiens__NP_689896
augaacagaaagugggaggccaaacugaagcagaucgaagagagagcuagccacuacgaacgcaaaccccucuccucuguguauagaccucggcugagcaagccggaggaacccccuuccauuuggcgccuuuuccauagacaagcccaggcguuuaauuucgucaaaucuugcaaggaggacguucacguguuugcucuggaguguaaggugggcgaugggcagcggaucuaccucgucaccacauaugccgaguucugguuuuacuauaaaagccgcaagaaccugcuucauugcuacgaggugauucccgaaaaugccguuuguaaacuguauuucgaccucgaguuuaacaagccugcuaaucccggagccgauggcaaaaagaugguggcucugcugaucgaguacgucugcaaggcccuccaggaacuguacggggugaacuguuccgcggaggacguucuuaaucuggauucuagcacggacgaaaaauucuccagacaccucauuuuucaacugcaugauguggccuucaaggacaacauccacgucggaaauuuucuucggaaaauccugcagccugcucucgaucugcugggcagcgaggacgaugacucugccccggaaaccacagggcacggauucccccauuuuuccgaggcuccugcccgccagggcuucagcuucaacaagauguuuaccgagaaagcgacagaagagucuuggaccuccaauagcaagaaacucgaaagacugggcucugccgagcaguccagccccgaucuuuccuuccugguggugaagaacaauaugggggaaaagcaccucuuugucgaccugggaguuuauacacggaaccgcaauuucagacuuuacaaaucuagcaagauuggcaaacggguggcucuggaggugaccgaggacaacaaguuuuucccuauccaauccaaagaugucagcgacgaauaucaguacuuucucucuucccuggugagcaacguucgcuucucugauacgcugcggauucugaccugcgagcccagccagaauaagcagaagggggugggauauuuuaacuccaucggcacaucugucgaaaccauugagggguuccaauguagcccguacccugaaguggaccauuuuguucucucccuugugaauaaagauggaaucaagggcggcauucggagauggaacuauuucuuucccgaggagcugcucgucuacgacaucugcaaauaccgcuggugugaaaauaucgggcgggcccacaagagcaacaauauuaugauccugguggaucuuaaaaacgaggucugguaucagaagugccacgacccuguguguaaggcugaaaauuucaaaucugauugcuucccccugcccgccgagguuugccuccuguuucuguucaaggaggaagaggaauuuacaaccgacgaggccgaugaaacgagauccaacgagacacagaauccucauaaaccgagccccucucgccucuccaccggagcuagcgcggacgccgugugggacaacggcauugaugacgcuuacuuccuggaggccacagaagaugccgagcuugcugaagccgcggaaaauucccugcucucuuauaacagcgaagucgacgagaucccugaugagcugauuaucgaagugcugcaagaguga

SEQ ID NO: 74209 - RNA, 1680 nt, Artificial Sequence
  derived and/or modified sequence opt5 from PRKAA1__Homo_sapiens__NP_006242
augagacggcugagcuccuggcgcaagauggccaccgcugagaaacagaagcacgacggcagagugaaaaucgggcauuacauucucggagauacacugggcgucgggacguucggaaagguuaaagugggcaagcacgaacuuaccgggcauaagguggccgucaaaauccugaaccggcaaaagauucgcucucucgacgugguuggaaaaaucagacgggagauucagaaucugaaacuuuuucgccacccccauaucaucaagcuguaucaggugauuagcacaccuuccgauaucuucauggucauggaauacgugucuggcggcgagcucuuugacuauauuugcaagaacgggagacuggaugaaaaggagagccggcgccuguuccagcaaauccucuccggaguugacuacugucacagacacauggugguccaucgggaucugaaaccggagaaugugcuucuggacgcgcacaugaacgcuaagauugccgauuuuggccucucuaauaugaugagcgacggggaauuucugcgcaccuccugcggaagccccaacuaugccgcuccugaggugaucucuggcagacuuuacgccgggcccgaagucgauauuugguccagcggaguuauccuguaugcucuccuguguggcacacugccuuuugacgaugaccaugugcccacccucuucaaaaagaucugcgacggcauuuucuacacaccucaguaccugaauccgucugugaucucccuucugaaacacaugcuccaggucgaucccaugaagcgggccaccauuaaagacauccgcgagcacgagugguucaagcaggaucugccuaaguaucuuuuucccgaagacccuagcuacucuuccacgaugauugaugacgaggcgcugaaagaagugugugagaaguucgaaugcagcgaggaggaaguucucuccugucuguauaacagaaaucaucaagauccccuggccguggcuuaccaccucaucaucgacaaccggagaauuaugaaugaggccaaagauuuuuaucuggcuaccucuccgccugacagcuuccuugaugaccaucaccugacacgcccccauccugaacggguccccuuccucguggccgagacccccagagcgcgccacacacuggacgaacuuaacccucagaaguccaaacaccaggggguucggaaggccaaguggcaucugggaaucagaagccagucucgcccgaaugauauuauggcugaggugugccgggccaucaaacaacucgacuacgaguggaaggucgugaaccccuauuaccugagaguccgccggaaaaauccugugaccuccacguacagcaagaugucucugcagcucuaucagguugauagcagaacauaccugcuugacuuucgcuccauugaugacgaaaucaccgaggcuaaaucuggcacagccacaccccaacggagcggguccgugagcaacuauagaucuugucagcgguccgauagcgacgccgaagcucagggaaagucuuccgaggucagccugaccuccucugugaccagccucgauuccucuccuguugaccugacgccccgcccgggcagccacaccaucgaguucuuugaaaugugcgcgaaccugauuaagauccuugcccaguga

SEQ ID NO: 74210 - RNA, 813 nt, Artificial Sequence
  derived and/or modified sequence opt5 from PRKAB1__Homo_sapiens__XP_005253966
augggcaacaccagcuccgagagagccgcucuggaacggcacgggggacauaagacaccccgcagagacucuagcggcgggacgaaagauggagaccggccuaagauccucauggauuccccggaggacgccgaucuguuccacucugaagagauuaaagcgcccgaaaaggaggaguuucuugcuuggcagcaugaccuggaagugaaugauaaagccccugcccaagcucgccccaccgucuucagauggacaggcgggggaaaggagguuuaccucagcggcuccuuuaacaauuggucuaagcugccucuuacccggagccacaacaauuucguggccauccuggaccuccccgaaggcgagcaucaguauaaauuuuucguggaugggcaguggacacacgacccuuccgagccgauugucaccagccagcugggaacagugaacaauaucauucaaguuaagaaaaccgauuuugaaguguucgacgcucugauggucgauucucagaagugcuccgacgugagcgagcucucuuccucucccccuggccccuaccaccaggaaccuuauguuuguaaacccgaggaacgcuuuagagccccgccuauccugcccccucaucuucuccaggugauccugaacaaggacacggggauuagcugcgaucccgcgcugcuucccgagccuaaucacgucaugcugaaccaucucuacgcccuguccaucaaggacggagugauggugcugagcgcuacccaccgguauaaaaagaaauacgucacaacccuccuguauaagccgauuuga

SEQ ID NO: 74211 - RNA, 1056 nt, Artificial Sequence
  derived and/or modified sequence opt5 from PRKACA__Homo_sapiens__NP_002721
augggcaacgccgcugccgcgaagaaagggagcgagcaggaauccgugaaggaguuccuggcuaaagccaaggaagacuuucucaaaaagugggagucucccgcccaaaauaccgcucaccuggaucaguucgaaagaaucaagacacuuggaacgggcagcuuugggcgggucaugcugguuaaacauaaggagaccggaaaccacuacgccaugaaaauucucgacaagcagaaaguggugaagcugaagcagaucgagcauacacuuaaugaaaaacgcauucugcaagcugucaacuucccuuuucucgugaagcuggaguucuccuuuaaagauaauucuaaccuguauaugguuauggaauacgugccgggcggggagauguucagccaccucagacggaucggacgcuuuuccgagccccaugccagauucuaugcggcccagauuguccugaccuuugaauaccuucacucucuggaccucaucuaucgggaucugaagccugagaaucuucugaucgaccagcagggcuacauucaagugacagauuucggcuuugcuaaacgcguuaaggggagaaccuggacacucugcggaacccccgaauaucuggccccugagaucauucugagcaaaggcuacaacaaggcuguggacuggugggcccucgggguccugaucuacgaaauggcggccggauaucccccuuucuucgcugaucagccgauucagaucuacgagaagauuguguccggcaaagugcgguuucccagccacuucucuuccgaccuuaaggaucugcuccgcaaucugcuucaggucgaccugacgaaaagauuugggaaccucaagaauggaguuaacgauaucaaaaaucauaagugguucgccaccacagacuggaucgcuauuuaucaacggaagguggaggccccuuuuauccccaaauucaagggcccuggcgacaccagcaacuuugaugacuacgaagaggaagagauucgcgugucuaucaaugaaaaaugugggaaggaguucuccgaguuuuga

SEQ ID NO: 74212 - RNA, 795 nt, Artificial Sequence
  derived and/or modified sequence opt5 from PRKACB__Homo_sapiens__NP_001287844
augagcgccagaaaguccucugacgcuagcgccugcuccucuagcgagaucuccgauucuuucgugaaagaauuucuggcgaaggcuaaagaggacuuccucaagaaaugggaaaaccccacccagaauaacgccggccuggaggauuuugaacggaagaagacacuugggacggggagcuucggccgcgucaugcugguuaaacacaaggccaccgagcaauacuaugcuaugaaaauucucgacaagcagaaaguggugaagcugaagcagaucgagcauacacuuaaugaaaaacggauucugcaggccgucaacuuuccuuuccucgugagacuggaguacgcuuuuaaggauaauuccaaccuguauaugguuauggaauacgugccgggaggagagauguucagccaccuccgcagaaucggccgguuuucugagccccaugcccgcuucuaugcggcccaaauuguccugaccuuugaauaccuucacucccuggaccucaucuauagagaucugaaaccugagaaucuucugaucgaccaucagggguacauucaggugacagauuucggauuugcuaagcggguuaaaggccgcaccuggacacucuguggcacccccgaauaccuggccccugagaucauucugagcaagggguauaacaaagcuguggacuggugggcccucggaguccugaucuacgaaauggcggccggcuaucccccuuucuucgcugaucagccgauucaaaucuacgagaagauugugucugggaagcagaauuuuuga

SEQ ID NO: 74213 - RNA, 1056 nt, Artificial Sequence
  derived and/or modified sequence opt5 from PRKACG__Homo_sapiens__NP_002723
augggcaacgcccccgcuaagaaagacaccgaacaggaagagagcgugaaugaguuccuggccaaggcgagaggggauuuucucuaccgguggggaaacccugcucaaaauacagccuccucugaccaguucgagcgccugagaacgcuuggcauggggagcuuuggacgggucaugcugguucgccaccaggaaaccggcgggcacuaugccaugaaaauccucaacaagcagaaaguggugaagaugaagcaagucgagcacauucugaaugagaaaagaauccuucaggcuauugauuucccguuucuggugaagcuccaguucuccuuuaaagacaacucuuaccuguaucugguuauggaauacgugcccggaggcgagauguucagccggcuccagcgcgucggcagauuuuccgaaccucaugccugcuucuaugcugcccaagugguucuggcggugcaguaccuucacucucuggaucucauccaucgggaccugaagcccgagaaucuucugauugaucagcagggguaucuccaagucacagacuuuggauucgccaaacgcgugaagggcagaaccuggacacugugugggaccccugaguaccuggcucccgaaaucauccucagcaagggauacaacaaagccguggauuggugggcucugggcguccuuauuuaugagauggccguuggguuuccuccguucuacgcggaccagcccauccagauuuaugaaaagaucguguccggacgggugcgcuucccuagcaaacugucuuccgaucucaagcaucugcuuagaagccugcuccaagucgaccugacaaaacgguuuggcaaucugcgcaacggcgugggggauauuaagaaucacaaaugguucgccaccacgucuuggaucgcuauuuacgagaagaagguugaagcccccuuuaucccuaaauauaccggacccggcgacgcuuccaacuucgacgauuacgaggaggaagaacucagaaucagcauuaaugaaaagugcgccaaagaguuuucugaguucuga

SEQ ID NO: 74214 - RNA, 1023 nt, Artificial Sequence
  derived and/or modified sequence opt5 from PRKAG1__Homo_sapiens__NP_001193638
auggagaccgugaucagcuccgacucuagccccgccgucgaaaacgagcacccucaggaaacaccggaguccaauaacucuguuuacacgagcuucaugaagucccauagaugcuaugaucugauucccaccucuagcaaacucgugguguuugacacaucccugcaagucaagaaagccuucuuugcucuugugaccaauggcguucgggcggcuccucugugggauagcaagaaacagucuuucgugguccuccgcgcccuguccuguccccuugggaugcugacaaucaccgacuuuauuaacauccuccacagauacuauaagagcgcccuggugcagauuuacgaacuggaggagcauaagaucgaaacauggcgggagguuuaucuccaggauucuuucaaaccucuggugugcaucucccccaaugcuagccuuuuugacgccgucucuucccugauucgcaacaagauccacagacucccugugauugauccggaaagcggaaauacccuguacauccuuacgcauaaacggauucugaaguuccucaaacuguuuaucaccgaguuccccaagccugaguuuauguccaagucucuggaggaacuccaaauuggcacauaugcuaacaucgccauggugcgcaccacaacccccgucuacguugcgcuggggaucuucgugcagcacagagugagcgcccuuccugucguggacgaaaaaggacggguuguggauauuuacuccaaguuugacgucaucaaucuggcugccgagaaaacguauaacaaucucgaugugagcguuacaaaggcucugcagcaccgcucucauuacuucgaaggcgugcuuaaauguuaucugcacgagacccucgagacaauuaucaacagacuggucgaagccgaggugcaucggcuggucgugguugacgaaaaugauguggucaaggggauugugucccucagcgacauccugcaggcgcuuguucugaccggaggcgagaaaaagcccuga

SEQ ID NO: 74215 - RNA, 1578 nt, Artificial Sequence
  derived and/or modified sequence opt5 from PRKAG2__Homo_sapiens__NP_001035723
augccccugcucgacggcgaucuggaggggagcggaaagcacuccucuagaaaaguggacagcccuuucggcccggggucccccucuaagggauuuuucagccggggcccucagccccgcccuuccucucccaugagcgccccugucagaccgaaaaccucccccgggagcccuaagacaguuuuucccuucucuuaccaagaauccccuccccggagcccgcgcagaaugucuuuuuccggaaucuuccggagcuccuccaaagagagcuccccuaacucuaaucccgcuacgagcccuggcggcauucgcuuuuucuccagaagccggaagaccucugggcuuuccagcucucccagcacacccacccaggugacaaagcagcauaccuuuccucuggaauccuauaaacacgagccggaacgccucgagaacagaaucuacgccucuagcucucccccugauacaggacagcgguucugccccagcucuuuucaauccccuacccgcccuccgcuggcgagcccuacgcauuaugcucccucuaaggccgccgcucuugccgcugcccugggcccugcggaggccgggaugcucgaaaaacuggaguucgaagacgaggcuguggaggauuccgaaagcggagucuacaugagauuuaugcggucccacaaguguuaugacauugugcccaccucuagcaaacugguuguguucgauacaacccuccaggucaagaaggccuucuuugcucugguggccaauggcguucgcgcggccccucuuugggaguccaaaaagcagucuuucguggggaugcugacaaucaccgacuuuauuaacauccuccauagauacuauaaaagccccaugguccagaucuacgaacuggaggaacacaagauugagacguggcgggagcuuuaccugcaagaaacauucaaaccgcucgugaauaucuccccugaugcuagccuguuugacgccguguauucucugauuaagaacaaaauccacagacuccccgucauugaucccaucuccggaaaugcucuguacauucuuacccauaagcgcauccugaaguuccuccagcuguuuaugagcgacaugccuaaaccggccuucaugaagcagaaccuugaugagcugggcaucggcacauaucacaauauugccuuuauccaucccgacaccccuauuaucaaagcucucaacauuuucguugaacggagaaucucugcgcugcccgugguggacgaguccgggaaggucguggauaucuacagcaaauuugacguuauuaaucuggccgcugaaaagaccuauaacaaucucgauaucacagugacgcaggcccugcaacaccgcucucaguacuucgagggagucgugaagugcaacaaacuugagauucuggaaaccaucguugaccggauugugagagccgagguccaccgccucguggucgugaaugaagcugauagcaucguuggcaucauuucccugagcgacauccuucaggcccugauucucacacccgcgggggcuaagcaaaaagagaccgaaacagaguga

SEQ ID NO: 74216 - RNA, 1470 nt, Artificial Sequence
  derived and/or modified sequence opt5 from PRKAG3__Homo_sapiens__NP_059127
auggagcccggccuggaacacgcccucagacggaccccuagcugguccucucuugggggaagcgagcaucaggaaauguccuuccuggagcaagaaaacucuagcuccuggccgucucccgcugugacaagcuccagcgagcgcaucagaggcaagcggcgcgccaaagcgcugagauggacgcggcagaagucugucgaggaaggggagccucccggacagggcgaagggccucgcuccagacccgcugccgagagcaccggacucgaggccacauuuccuaaaaccacaccgcuggcucaggccgaccccgcuggcguuggcaccccucccacagggugggauugccuuccuucugacuguaccgccuccgcggccggaagcucuacggaugacguggaacuggcuaccgaguuccccgccacagaggcuugggagugcgaacucgagggccugcuggaggaacggccggcccucugucuguccccucaagcgcccuuuccuaaacuugggugggaugacgagcugcgcaaacccggagcccagauuuacaugagauucaugcaggaacauaccugcuaugaugcuauggccacaagcuccaagcucgugaucuuugacaccaugcuggagauuaagaaggcuuucuuugcccuugucgccaauggcgugcgggcugcgccccugugggauucuaagaaacagagcuucguugggaugcucacgaucacagacuuuauucuggugcugcaccgcuacuauagauccccucucguccaaaucuacgaaaucgagcagcacaagauugagaccuggcgggaaaucuaucugcagggauguuucaaaccgcuugugagcauuucucccaacgauucccuguuugaggccguuuacacacucaucaagaaucgcauucauagacugccugugcuugaccccgucagcggcaacgugcugcacauccucacccacaagcggcugcugaaauuccuccauauuuuuggcucucugcuuccuagacccagcuuccuguaucgcaccauccaggaucucgggaucggaacauuccgggaccuggcugugguccuugaaacggccccgauucugaccgcccucgacaucuuuguugauagacgcguguccgcucugccuguggucaaugagugcggccaagugguugggcuguacucucgguucgacgugauucaccucgccgcgcagcagacauacaaccaucuggauaugagcgucggagaagcucuuagacaacgcacccugugucucgagggcgugcuguccugccagccccacgagagccugggggaaguuaucgaccggauugccagagaacaggugcaccgccuuguccucguggaugaaacacagcaucugcugggagucgugucucucuccgacauccugcaagcccuuguucugagcccugcuggcaucgaugcccucggcgcuuga

SEQ ID NO: 74217 - RNA, 1146 nt, Artificial Sequence
  derived and/or modified sequence opt5 from PRKAR1A__Homo_sapiens__NP_001263218
auggagagcggcuccaccgccgcuucugaagaggccagaagccugcgggaaugcgagcucuacgugcagaagcacaacauccaagcgcugcuuaaagacuccauuguccagcuguguacagcucgccccgaaagaccuauggccuuccuccgggaguauuuugagcgccuggaaaaggaggaagccaaacagauccagaaucuucaaaaggcugggacgagaaccgauucucgggaggacgagauuagcccgcccccucccaacccuguugugaaaggacgcagacggcgcggcgccaucuccgcugaaguguacacagaggaagaugccgcgucuuaugucagaaaggugauucccaaggacuacaaaaccauggccgcucuggccaaggcuaucgagaaaaauguucucuucagccaucuggaugacaacgaacgguccgauaucuuugacgccauguucagcgugucuuuuauugcgggggagacagucauccagcagggagaugagggcgacaauuucuaugugauugaucagggggaaaccgacguuuacgugaacaaugagugggccacauccgucggagaaggcggcagcuuuggggagcuggcucucaucuauggaaccccucgcgccgcuacggugaaggccaaaaccaacgugaagcuguggggcauugauagagacucuuaccggcgcauccuuaugggguccacacugagaaagcggaaaauguacgaagaguuccucagcaaggucucuauucuggagucccuugacaaaugggaaagacugaccguugccgaugcucucgagccggugcaauuugaagacggacagaagaucgugguccagggcgagcccggggaugaguucuuuaucauucuggaaggaagcgcggccgugcugcagcgccgguccgagaaugaagaguucguugaagugggcagacucggcccuucugacuauuuuggggagaucgcucugcuuaugaaccgcccccgggccgccacagucguggcuagaggaccucugaaaugcguuaagcucgaucgcccccgguucgagagagugcugggcccguguagcgacauucuuaaacgcaauauccaacaguacaacuccuucgucagccugucuguguga

SEQ ID NO: 74218 - RNA, 1146 nt, Artificial Sequence
  derived and/or modified sequence opt5 from PRKAR1B__Homo_sapiens__NP_002726
auggccagcccucccgcuugcccguccgaggaagacgagucucugaagggcugugaacucuacgugcagcugcacgggauccaacagguccuuaaagauugcauuguucaucuguguaucagcaagcccgagagaccuaugaaauuccuccgggaacacuuugagaagcuggagaaagaagagaaccgccagauucuugccagacagaaguccaauucucaaagcgacucccaugaugaagaggugucucccaccccucccaacccuguggucaaggcgcggcgcagacggggaggcgugagcgcugagguuuauacagaagaggacgccguguccuacguccgcaaagugaucccgaaggauuauaaaacgaugaccgcccuggcuaaggccauuagcaaaaauguucucuucgcucaccuggacgauaacgaaagaucugacaucuuugaugccauguuccccgugacacauaucgcgggggagaccgucauucagcagggaaaugaaggcgacaacuuuuacgugguggaucagggggaggucgacguuuaugugaauggagagugggugacaaacaucuccgaaggcggcagcuucggggagcuggcccucauuuacggaaccccucgggcugccacagucaaggcuaagaccgaucugaaacuuuggggcaucgaccgcgacucuuauagacggauucugaugggguccacgcuccgcaagagaaaaauguacgaagaguuucugagcaaggugucuauccuugaaucccuggagaaaugggagcggcucaccguugccgaugcgcuggaacccgugcaauucgaggacggagaaaagauugucgugcagggcgagccuggggaugacuuuuacaucaucacagaaggaaccgccagcguucugcagcgcagaucccccaaugaggaguauguggaagucggccggcucggcccgucugauuacuucggggagauugcucugcuucugaacagaccucgcgccgcuacaguggucgcccggggaccccucaaaugcgugaagcuggacagaccucgcuuugaacggguucuuggccccuguagcgagauccugaagagaaauauucagcgcuauaacuccuucaucagccucaccguguga

SEQ ID NO: 74219 - RNA, 1215 nt, Artificial Sequence
  derived and/or modified sequence opt5 from PRKAR2A__Homo_sapiens__NP_004148
augagccacauccagauucccccuggccugaccgagcuccugcaaggguacacaguggaaguccuuagacagcagccgcccgaccugguugaguucgccguggaauauuuuacgcggcuccgcgaggcuagagccccugcguccgugcugcccgcugccaccccucggcagucucuuggacaucccccuccggaacccggcccugaucgcgucgccgacgcuaagggggauagcgaguccgaggaagacgaggaucuggaagugcccguuccuucuagauucaaccggcgcgugagcgucugcgccgagacauacaaucccgacgaggaagaggaagauaccgacccgagagugauccacccuaaaacagaugagcaacggugucgccuccaggaggcuugcaaggacauucugcuguuuaaaaaccucgaucaggaacagcugucccaaguucuugacgccauguucgagagaaucgugaaggcggaugaacaugucauugaccagggagacgauggcgacaauuuuuaugugaucgagcgggggaccuacgauauccuggugacaaaagacaaccagacccgcucugucggacaguaugauaauagaggcagcuucggcgaacucgcccugauguacaacacgccccgggcugccaccauuguugcuacauccgaggggagccuuuggggacuggaccgcgugaccuuuagacggaucauugugaagaauaacgccaagaaaagaaagauguucgaaucuuuuaucgaguccgucccucuccugaaaagccuggaggugucugaacgcaugaagauuguugaugugaucggcgagaaaauuuauaaggacggggaacggaucaucacacaaggagagaaggcggauuccuucuacauuaucgaaagcggcgaggucucuauucucaucagaucccgcaccaaaagcaauaaggacgggggaaaccaggagguggaaauugcccggugucacaaaggccaguacuuuggcgagcuggcucuuguuacgaauaagcccagagccgcuuccgccuaugccgugggggaugucaaaugccuggugauggacguccaggcuuucgaacgccuccugggacccuguauggacaucaugaagcggaacaucucucauuacgaggagcaacuugugaaaauguuuggcagcuccguugaucuggggaaucucggacaguga

SEQ ID NO: 74220 - RNA, 1257 nt, Artificial Sequence
  derived and/or modified sequence opt5 from PRKAR2B__Homo_sapiens__NP_002727
augagcaucgagauucccgccggccugaccgaacuccugcagggguucacaguggagguccuuagacaccaaccugcugaccugcucgaauuugcccugcagcauuucacgcggcuucagcaggagaacgaacgcaagggaaccgcgagauuuggccacgaggggcggacauggggagaucugggcgcugccgccgggggaggcaccccguccaaaggcguuaauuucgcugaggaacccaugcaaucugacagcgaggauggggaagaggaggaagccgcuccugccgacgcgggagccuuuaacgcucccgugaucaaucgcuucacaagacgggccuccgugugcgcugaggccuacaacccugaugaagaggaagacgaugcggagucucgcauuauccaucccaagaccgacgaucagagaaaucggcuccaggaggccuguaaagacauucugcuguuuaagaaccucgauccugaacagaugagccaaguccuggacgcuauguucgagaaacuugugaaggauggcgaacacguuaucgaccagggggacgauggagacaauuuuuaugugaucgaucgcggcacauucgacauuuacgucaagugcgauggggugggaagauguguuggcaacuaugacaaucggggcuccuuuggggagcuggcccucauguacaacaccccgcgcgcugccacgaucaccgccacaucucccggagcucuguggggccuugauagagugaccuuccggcgcauuaucgucaaaaauaacgcgaagaaaagaaagauguaugagagcuuuauugaaucccugccuuuccucaaaagccuggaguucucugaacggcugaaggugguggacgucaucgggacaaagguuuacaaugauggagagcagauuaucgcccagggcgacuccgcugauagcuuuuucaucguggaaucuggggaggugaaaauuaccaugaagagaaaaggaaaguccgaagucgaggagaacggcgccguggaaaucgcccgcugcagccggggccaauauuuuggggagcucgcucugguuacgaauaaacccagagccgcgucugcucaugccauuggaacagugaagugucuugccauggacguccaggcuuucgaacgccugcucggcccuugcauggagaucaugaaacggaacauugccaccuacgaggaacagcugguggcucuuuuugggacaaacauggacaucguugagcccaccgccuga

SEQ ID NO: 74221 - RNA, 2019 nt, Artificial Sequence
  derived and/or modified sequence opt5 from PRKCA__Homo_sapiens__NP_002728
auggccgacguguuccccggcaacgauagcaccgcuucccaggacgucgccaauagauuugcgcggaagggggcucugcgccagaaaaacguucacgaggugaaggaucauaaauucaucgccagauuuuucaagcaaccuacauuuugcucucacuguacggacuucauuuggggauuuggcaaacagggguuccagugccaaguguguugcuuugucgugcauaagcggugucacgaguucguuaccuuuagcugcccgggagccgauaagggccccgacacagaugacccucgcuccaaacauaaguucaaaauccacaccuacgggucucccacauuuugugaucacugcggaagccuccuguauggccuuauucaucagggcaugaagugugauaccugcgacaugaaugugcacaaacagugugucaucaacgugccuucccugugcgggauggaccauacagaaaagagaggacggauuuaccucaaggcugaaguugccgaugagaaacugcacgugaccguccgcgacgcuaagaaucuuauccccauggacccuaacggccugucugauccguaugugaaacucaagcugauccccgacccuaaaaaugaaagcaagcagaaaacgaagaccauuagauccacacugaacccccaauggaaugagagcuucaccuucaagcucaaaccuucugauaaggaccggcgccuguccguggagaucugggauugggacagaacaacccggaacgauuuuauggggagccuuucuuucggagucuccgaacugaugaaaaugcccgccagcggcugguacaagcuccugaaucaggaggaaggggaguauuacaacguuccgauuccugagggagacgaagagggcaauauggaacuucgccagaaauuugagaaggcgaagcugggccccgccgggaacaaagugaucucuccuuccgaagauagaaagcagcccagcaauaaccucgaccgggugaaacugacggauuucaacuuucugaugguccucggaaagggcuccuucgggaaagugaugcuggcugaccgcaagggaacagaggagcuuuaugccauuaagauccugaaaaaggacguugugauucaagaugacgaugucgaaugcaccaugguggagaaaagaguucucgcucugcuugacaagcccccuuuucugacacagcuccacucuuguuuccagaccguggaucggcuguacuuugucauggaauacgugaauggcggggaccugauguaucauauccaacaggucggaaaauucaaggagccgcaggccguguuuuacgcggccgaaaucagcauuggccucuucuuucugcacaagagaggcaucauuuaucgcgaucuuaaacuggacaacguuaugcucgauuccgaggggcauaucaagauugcugacuucggaaugugcaaagagcacaugauggauggcgugaccacacggacguucugugggacccccgacuacaucgccccugaaaucauugcuuaucagcccuacggaaagagcgucgauuggugggccuauggcgugcugcuuuacgagaugcuggccgggcaaccucccuuugacggcgaagacgaggaugaacucuuccagucuaucauggagcauaauguuuccuacccgaaaagccugucuaaggaggcugugagcauuugcaaaggacugaugacaaagcacccugcgaagagacucggcugugggcccgaaggagagcgcgacguccgggaacacgccuuuuucagacgcaucgauugggagaaacuggagaaccgggaaauucagccucccuuuaagccuaaagugugcggcaagggggcugagaauuucgacaaauuuuucaccagaggacagcccgugcuuacaccgccugaucaacugguuaucgccaacaucgaccaguccgauuuugaaggcuucucuuaugucaauccccaguuugugcaucccauucuccagagcgccguguga

SEQ ID NO: 74222 - RNA, 2022 nt, Artificial Sequence
  derived and/or modified sequence opt5 from PRKCB__Homo_sapiens__NP_002729
auggccgaccccgcugccggcccuccgcccagcgagggggaagaguccaccgugagauucgcgcggaagggagcucugcgccagaaaaacguccacgaaguuaagaaucacaaauuuacagccagauucuuuaagcaaccuacguucugcucucacuguaccgauuuuaucuggggcuucgggaaacagggauuucagugccagguguguugcuucgugguccauaagcggugucacgaguuugugacauucagcugccccggcgccgacaaggggccugcuuccgaugacccccgcucuaaacauaaguuuaaaauucacaccuacagcuccccuacauucugugaucacugcggaucucuccuguauggccuuauccaucaaggcaugaagugugauaccugcaugaugaacguucacaaaagaugugugaugaaugucccgagccugugcgggacagaccauaccgaacggcgcggaagaauuuacauccaggcccacauugaccgggaugugcucaucguucuggugcgcgacgcuaagaaccuuguccccauggauccuaauggccuguccgaccccuaugugaagcucaaacugaucccugaucccaagagcgagucuaaacagaagacgaaaaccauuaagugcucccugaacccggaguggaaugaaacauuuagauuccagcucaaagagagcgacaaggaccggcgccugucuguggaaaucugggauugggaccuuaccuccagaaacgauuucauggggagccugucuuuuggaauuuccgagcuccaaaaggccagcgucgacggcugguucaaacugcuuucccaggaggaaggggaguacuuuaauguuccugugcccccugaaggaucugaggcgaacgaggaacugcggcagaaguucgagcgcgccaaaaucagccagggcacaaaggugcccgaagagaaaaccacgaauacagucuccaaguuugauaacaauggcaacagagaccggaugaagcucaccgauuucaauuuucugauggugcuggggaaaggcagcuucggaaagguuaugcucucugaaagaaaagggacagacgagcuguaugcugugaagauucuuaaaaaggaugucgugauccaagacgaugacguugaauguaccaugguggagaagcgcguccuggcccuccccggaaaaccuccguuucugacccagcuucacuccugcuuccagacaauggaccggcuguacuuugugauggaguaugucaacggcggggaucucauguaccauauucaacaggugggaagauucaaggaaccccacgcuguguuuuacgccgcggagaucgccaucggccuguucuuccugcagagcaaaggcauuaucuaucgcgaccucaagcuggauaacguuaugcuugacucugaagggcauauuaaaaucgcugauuuuggaauguguaaggagaauauuugggacggcgucacgaccaagacauucugcgggaccccugauuacaucgcccccgaaaucauugcuuaucagccuuacggaaaaagcguggacuggugggccuuuggcguucugcucuaugagaugcuggccgggcaagcucccuucgagggcgaagaugaggacgaacuuuuucaguccaucauggagcacaacguggcguacccgaagucuaugagcaaagaggccgucgcuauuuguaagggacugaugacaaaacauccuggcaagcggcucgggugcggacccgaaggcgagagagauaucaaagaacacgccuucuuucgcuauauugacugggagaagcuggaacggaaggagauccagccucccuacaaaccuaaggccugugggagaaaugcugagaacuucgaucgcuuuuucacccggcaucccccggugcugacgccucccgaccaggaagugaucagaaauauugaccaauccgaguuugaaggauucagcuuuguuaacucugaguuccucaaacccgaagucaaguccuga

SEQ ID NO: 74223 - RNA, 786 nt, Artificial Sequence
  derived and/or modified sequence opt5 from PRKCDBP__Homo_sapiens__NP_659477
augagagagagcgcccuggaacggggccccgugccugaggcuccggccgggggacccguccacgcgguuaccguggugacacuccuggaaaaacuugcuuccaugcuggagacgcuccgcgaaagacagggcgggcuggcccggcgccaaggaggccuugccgggucugucagacggauccagagcggacugggcgcucucucccgcucucaugacaccacaagcaacacccuggcccagcugcucgcuaaggccgagagaguguccucucacgcgaaugccgcucaggagcgggccguucgcagagcugcccaagugcagcggcuggaagcgaaccauggccuucuggucgcccgcgggaagcuccacgugcugcuuuucaaagaggaaggagagguuccugcuagcgccuuucagaaggcucccgagccucugggccccgccgaucaguccgaacucgggccugagcaacuggaagccgaggugggagaaagcucugacgaggagccggucgaauccagagcucagcggcugcgcagaacaggccuccagaaagugcagagccugcggagagcgcuuucugggcgcaagggacccgccgcuccucccccuacccccgugaagccgccucggcugggccccggcagauccgccgaggcccaaccugaagcucagcccgcccucgagcccacacuggaaccugagccgccccaggauaccgaggaagacccugggcgccccggagcggcugaggaagcccuucugcaaauggagagcgucgccuga

SEQ ID NO: 74224 - RNA, 2031 nt, Artificial Sequence
  derived and/or modified sequence opt5 from PRKCD__Homo_sapiens__NP_997704
auggcccccuuccugagaaucgcuuuuaacagcuacgagcucggcucccugcaggccgaagacgaggcgaaucaaccuuucugcgcugugaagaugaaagaagcccuuucuaccgagcgggggaagacacugguccagaaaaagccgacgauguaucccgaauggaaaagcaccuuugaugcccacauuuacgagggacgcguuauccagauugugcucaugagagcugccgaggaaccuguguccgaggucacagugggcguuucugugcuggcugaacgguguaagaagaacaaugggaaagccgaguucuggcuugaccugcagccccaagcgaagguccucaugagcgugcaguauuuucuggaggauguugacugcaaacaguccaugcgcucugaagaugaggccaaguucccuaccaugaacagacggggagcuaucaaacaggccaagauucacuacaucaagaaucacgaauuuaucgcuacauucuuuggccaacccaccuucuguagcgugugcaaagacuuugucugggggcugaacaagcagggauauaaaugucgccagugcaaugccgcgauucauaagaaauguaucgauaagauuaucggcagaugcacaggcaccgccgcuaacucccgggacacgauuuuccagaaagagcgcuuuaauaucgauaugccucacagauucaaggugcauaacuacaugagcccgaccuucugugaccacugcgggucucuccuguggggacuugugaagcaaggccugaaaugugaagauugcgggaugaauguccaccauaagugccgggagaaaguugccaaccucuguggaauuaaucagaagcugcuugcugaggcccugaaccaggugacacaacgcgccuccagacggagcgacucugcuuccagcgaacccgugggcaucuaucagggguuugagaaaaagaccggagucgcgggcgaagauaugcaggacaauucuggcacauacgggaagaucugggagggauccagcaaaugcaacauuaacaauuucaucuuucacaaggugcucggcaaaggguccuucggaaagguucugcugggcgaacucaaagggcgcggagaguacuuugccauuaaggcucugaagaaagacgugguccuuaucgaugacgauguggaguguaccaugguugaaaagagagugcugacgcucgccgccgagaacccuuuccugacacaucuuauuugcaccuuucagacaaaagaccaccuguucuuugucauggaguuccucaauggcggcgaucugauguaucacauccaagacaaggggcgguuugaacuguacagagcuaccuucuaugccgcggaaaucauguguggacuccaguuucugcauucuaaaggcauuaucuaccgcgaucuuaagcuggacaacgugcuccuggaucgggacgggcacauuaagaucgcugauuucggaaugugcaaagagaauauuuucggcgagagcagagccuccaccuuuugugggacacccgacuauaucgccccugaaauccuucagggccugaaguacacguucagcgucgacugguggucuuuuggagugcuccuguaugagaugcugauuggccagucccccuuccauggggaugacgaagaugagcucuuugagagcauccgcguugacaccccgcacuacccucgguggauuacaaaagaaucuaaggauauccuggagaaacuuuucgaaagagagcccaccaagcgccugggagugacaggcaacauuaaaauccaucccuuuuucaagaccauuaauuggacgcuccuggaaaagcggagacuggagccucccuuucgcccuaaagucaagagcccgcgggacuacuccaacuucgaucaagaguuucuuaaugaaaaagcuagacucucuuauagcgacaagaaccugaucgauuccauggaccagagcgccuucgcuggguuuucuuucgugaaucccaaauucgagcaucugcucgaagauuga

SEQ ID NO: 74225 - RNA, 2214 nt, Artificial Sequence
  derived and/or modified sequence opt5 from PRKCE__Homo_sapiens__XP_005264485
augguggucuucaacggccugcucaagaucaaaauuugcgaggccguuagccugaagcccaccgcuuggucccuuagacacgccguggggccucggccgcagacauuucugcucgaccccuacaucgcgcugaauguggaugacucucgcauuggacaaacggcuaccaaacagaagacaaacagcccugccuggcaugaugaguucgucaccgacguguguaauggcagaaaaaucgagcuugccguuuuucacgaugcucccauuggguaugacgauuucguggccaacugcacaauccaguuugaagaacugcuccagaauggaucccggcauuucgaagacuggaucgaucuggagccugagggccgcgucuacgugauuaucgaccugucugggagcuccggagaagcucccaaggauaacgaggaaagaguuuuucgggagcgcaugagaccucggaagcgccaaggcgccgugagacggcgcguccaccaggugaauggccauaaauucauggcgaccuaucucagacagccgacauacuguucucacugccgggacuuuauuuggggagugaucgggaagcagggcuaucaaugucaggucugcaccuguguugugcacaaacgcugccaugagcugauuaucacgaagugugccgggcuuaaaaagcaggaaacccccgaucaggugggaagccaaagauucuccgucaacaugccucacaaguuuggcauucauaauuacaaagugcccacauucugcgaccacugugggagccugcucuggggacugcuucggcagggccugcagugcaagguuugcaaaaugaacgugcacagacgcugugagaccaaugucgcuccuaacugcggcguggacgcccgggggaucgcuaagguucucgccgaucugggagugacacccgacaaaaucaccaauucuggccaaagacgcaagaaacugauugcgggggccgaauccccgcagccugcuagcggaucuucccccagcgaggaagaucggucuaaguccgccccuacgagccccugugaccaggagaucaaggagcucgaaaacaauauuagaaaagcucuguccuuugauaaccgcggcgaggaacaucgggccgccucuagccccgacgggcagcuuauguccccuggagagaacggcgaagucagacaaggccaggcuaagcgccuggggcucgaugaguucaauuucaucaaagugcugggaaagggcagcuuugggaaagucaugcuugcggagcugaagggaaaggacgaaguguaugccguuaaagugcucaagaaagaugucauucugcaggacgaugacguggacugcacaaugaccgagaagcggauccuggcucucgccagaaaacacccguaccugacacagcuuuacuguugcuuccaaaccaaggaucgccuguuuuucguuauggaauaugugaacggcggggaccucauguuucagauccagcggucuagaaaguucgaugagccccggucccgcuuuuacgccgcugaagucaccagcgcccugauguuccuucaucagcacggcgugauuuauagagaccugaaacucgauaauauccugcuggacgcggagggacauuguaagcucgcugauuuuggcaugugcaaagaggggauucugaacggagugacaacgaccacauucuguggcaccccugacuacaucgcccccgaaauucuucaagagcuggaauaugggccuucuguugauuggugggcccucggaguccugauguacgagaugauggcuggccagcccccguuugaggccgacaaugaagaugaccuguucgagagcauccuucacgaugacgugcucuauccuguguggcuguccaaggaagcugucucuauccugaaagccuuuaugacaaagaacccccacaagcggcucgggugcguggcgagccagaauggcgaggacgccauuaaacagcauccuuucuucaaggaaaucgauuggguucugcuugagcagaaaaagauuaaacccccuuuuaagcccagaaucaaaaccaagcgcgacgugaacaauuucgaucaagacuuuacgcgggaggaaccgguccugacacucguggaugaggcuauuguuaagcagaucaaccaagaagaguucaaaggauuuuccuacuucggcgaagaccugaugccuuga

SEQ ID NO: 74226 - RNA, 2094 nt, Artificial Sequence
  derived and/or modified sequence opt5 from PRKCG__Homo_sapiens__NP_002730
auggccggccuggggcccggagugggcgacagcgaagggggaccuagaccgcuuuucugccggaagggcgcucugcgccagaaagucguucacgaagugaagucccauaaauuuaccgccagauucuuuaagcaacccacauucuguucucacugcacggauuuuaucugggggauuggaaaacagggccuucagugucaggugugcagcuucgucgugcaucggcgcugucacgaguuuguuaccuucgaaugcccuggcgcggggaagggaccccaaacagacgauccuagaaacaagcauaaauuucggcugcacuccuacucuagccccaccuucugugaccacugcggcucccuccuguaugggcuugugcaucagggaaugaaguguucuugcugugagaugaauguccaccgcagaugcgugcggagcguuccuucccugugcggcguggaucauacagaacgcagagggcggcuccagcuggagauccgcgcuccgaccgccgacgagauucacgucacagugggagaagccagaaaccugauccccauggauccuaauggccucagcgaccccuacgugaaacugaagcucauuccugauccccggaaccugaccaaacagaagacgcgcaccgucaaggcuacacucaauccgguuuggaacgagaccuuuguguucaaucugaaaccuggcgacguggaaagacggcuuucugucgaggugugggauugggacagaacaucccgcaacgauuuuaugggggccaugagcuucggaguuucugagcugcucaaggcucccguggacggcugguauaaacugcugaaucaagaagagggggaauacuauaacgucccuguggccgacgcggauaauuguucccuccugcagaaguucgaggccugcaacuacccccuugaacuguaugagcggguuagaaugggacccucuagcuccccuaucccgagccccuccccuucucccaccgacccuaaacgcugcuuuuucggcgcuagccccgggcggcuccacaucuccgauuuuagcuuccugauggugcuuggaaagggcucuuuuggcaaagucaugcuggccgagagacgcggguccgacgaacucuacgcuauuaagauccugaagaaagaugugauuguccaggacgaugacguggauuguacgcugguugagaagcgggugcucgcccugggaggcagagggccgggaggccgcccucauuuccuuacacagcugcacagcaccuuucaaacacccgaccggcucuacuucgucauggaauaugugaccgggggcgaucugauguaccauauccagcagcuuggaaaauuuaaggagccucacgcggccuucuaugcugccgaaauugcuaucggccuguuuuuccuccauaaucaagggauuaucuacagagaccugaaacuggacaacguuaugcucgaugccgagggacacaucaagauuaccgacuuuggcauguguaaggagaauguguuccccgggacaacgacccgcacauucugcggaaccccugauuauaucgcccccgaaauuaucgcuuaccagccguauggcaaaucugucgacugguggagcuuuggggugcugcuuuacgagaugcuggcgggccagccucccuucgauggagaagacgaggaggagcucuuucaggccauuauggagcaaacagugaccuaccccaagucccugucucgggaagcuguugccaucuguaaaggcuuccugacgaagcacccugggaaaagacuuggaagcggcccggauggggagcccacaauccgggcccauggauuuuuccgcuggauugacugggaaagacucgagcggcuggagaucccucccccuuuuagaccccgcccuugcggccgguccggggaaaacuucgauaaguuuuucaccagagcugcccccgcgcugaccccgccugaccgccucguccuggcuagcauugaucaggccgacuuucagggcuucacauaugugaaccccgauuuugugcacccugacgccagaucucccaccuccccggucccugugcccguuauguga

SEQ ID NO: 74227 - RNA, 2052 nt, Artificial Sequence
  derived and/or modified sequence opt5 from PRKCH__Homo_sapiens__NP_006246
augagcuccggcaccaugaaguucaacggguaccugagagugcggaucggagaggccgucggccuccagcccacacgcuggucucugagacacagccuuuuuaaaaaggggcaccaacugcucgacccuuaucugacgguuuccguggaucaggugcgggucggacagaccucuacaaaacagaagaccaauaaaccgacauacaacgaagaguucugcgcuaaugugaccgacggcgggcaccuugaacuggccguuuuucaugagacaccccucggauaugaucacuucguggcgaacuguacccugcaauuucaggaacugcuccgcacgaccggcgcuagcgacacauucgagggcugggucgaucuggagccugaagggaagguguuuguugugauuacccuuacaggauccuucaccgaggccacgcugcagagagaccggaucuuuaagcauuucacacgcaaaagacagcgggccaugcgcagacggguccaccaaauuaauggccacaaguuuauggcuaccuaccuccgccagcccacauauugcucucauuguagagaguucaucuggggaguguuugggaaacagggcuaccagugccaaguguguaccugcgucguucacaagcggugucaucaccugauugugaccgccugcacaugucagaacaauaucaacaaaguggauagcaagaucgcugaacagcgcuucgggauuaauaucccucacaaguucuccauucauaacuauaaaguccccacguuuugcgaccacuguggaagccuucuguggggcaucaugagacaaggccuccagugcaagauuugcaaaaugaaugugcauauccggugucaggccaacguugcgccuaauugcggggugaacgccgucgagcuggcuaagacccuggccggaaugggccuccagccggggaauauuucucccacauccaaacuggugagcagaucuacccuucgccggcaaggaaaggaauccagcaaagagggcaacgggaucggaguuaacucuuccaauagacugggcaucgauaacuucgaauuuauucgcgugcucggcaaggggagcuucggaaaggucaugcuggcucgggugaaagagacaggcgaccuuuacgccgucaaggugcugaaaaaggauguuauccuccaggacgaugacguggaauguaccaugacggagaaacgcauucugucccuggcgagaaaucacccuuuucucacacagcuguucugcuguuuucagacccccgaccggcuuuucuuugucauggaguucgugaacgggggagaucugauguuucauauccaaaagucuagacgcuucgacgaagcccgggcuagauuuuacgccgcugagauuaucagcgcccucauguuccugcacgauaagggcaucauuuaucgcgaccuuaaacuggauaauguucuccuggaccacgaagggcauugcaagcuggccgauuucggcauguguaaagagggaaucugcaacggcgugaccacagcuaccuuuugugggacaccugacuacauugcgcccgaaauccuccaggagaugcuguauggaccggccgucgauuggugggcuaugggcgugcuucuguacgagaugcucugcgggcacgccccuuucgaagccgagaaugaagacgaucuguuugaggcuauucugaacgacgaagugguuuaucccacguggcuucaugaggacgccaccggaauccucaaguccuucaugaccaaaaauccuacaaugcggcugggcagccugacacaagggggcgagcacgcgauccucagacaccccuuuuucaaggaaauugauugggcucagcugaaccaucggcagaucgagcccccuuuucgcccgagaauuaagucucgggaagacgucuccaauuucgaucccgacuuuaucaaagaggagccugugcuuacccccauugaugaaggacaucugccuaugaucaaccaggacgaguucagaaauuuuagcuacgugucucccgaacuccagccguga

SEQ ID NO: 74228 - RNA, 1791 nt, Artificial Sequence
  derived and/or modified sequence opt5 from PRKCI__Homo_sapiens__NP_002731
augcccacccagagagacagcuccacaaugucucacacgguggccggcgggggaagcggcgaucauucccaccaaguccggguuaaggcuuacuaucgcggggacaucaugauuacccauuucgagccuucuaucagcuuugaaggacugugcaacgaggugagagauauguguuccuucgacaaugaacagcucuuuacaaugaaauggauugaugaggaaggcgacccgugcaccgugucuagccagcuggagcuugaggaagccuuccggcuguacgagcucaacaaggauuccgaacugcuuauccacgucuuucccugugugccugagcgccccgggaugccuugccccggagaggacaaaagcauuuauagacggggcgcgcgcagauggcggaagcuguacugugcuaauggccauacauuccaggccaaacgcuuuaacagacgggcccacugcgcuaucuguaccgaucgcaucugggggcucggaagacaaggcuauaagugcauuaauuguaagcugcugguucacaaaaagugccauaaacucgugacaaucgaaugugggcggcacucucugccucaggagccggucaugcccauggaccaguccagcaugcauucugaucacgcccagaccgugauuccuuacaaccccuccagccacgaaucucuugaccaaguuggagaggaaaaggaggcuaugaauacgcgcgaguccggcaaagccagcuccucucuggggcuccaggauuucgaccugcuuagagugaucggacggggcagcuaugcgaagguccugcucgugagacugaagaaaaccgaccgcauuuacgccaugaagguggucaaaaaggaacugguuaacgaugacgaggauaucgacugggugcagacagaaaaacauguguuugagcaggcuuccaaucacccuuuccucgucggccugcauagcugcuuucaaaccgaaucucggcuuuucuuugugauugaguacguuaacgggggagaucugauguuccacaugcagagacagcgcaagcuccccgaggaacaugcccgguucuauuccgcugagaucagccuggcccuuaauuaccugcacgaaagaggcaucauuuaucgcgaccucaaacuggauaacgugcugcucgacucugaggggcacaucaagcugacagauuacggaaugugcaaggaaggccuucggccgggggacaccacgagcacauuuuguggaaccccuaauuauauugcgcccgagauccugagaggcgaggauuacggcuucuccgucgacuggugggcccucggggugcugauguuugaaaugauggcuggacgcucuccuuucgacauuguuggcagcuccgauaaccccgaccaaaauacagaggauuaucuuuuucaggugauccuggaaaaacagauccggauucccagaagccucucugucaaggccgcuuccgugcugaaaucuuuccugaacaaggacccuaaagagcgccucgggugccauccgcagaccggauuugccgauauccaaggccaccccuucuuucggaacgucgacugggauaugauggagcagaaacaggugguuccucccuucaagccuaauauuagcggggaauuuggccuggacaacuucgauucccaguuuaccaaugagcccgugcaacuuacaccggacgaugacgauaucgucagaaagauugaccagagcgaguucgaaggauucgaauacaucaacccucugcucauguccgccgaggaguguguguga

SEQ ID NO: 74229 - RNA, 1932 nt, Artificial Sequence
  derived and/or modified sequence opt5 from PRKCQ__Homo_sapiens__NP_001229342
augagccccuuccugagaaucggccucuccaacuuugacugcgggucuugucagagcugccaaggagaggccgugaauccuuacugugcuguccugguuaaggaauauguggaguccgaaaacggccagauguacauucagaaaaagccgaccauguaucccccuugggauucuacauucgacgcccacaucaauaaagggcgggugaugcagauuaucgucaagggcaaaaacguggaucuuauuagcgagacgaccguugaacuguacucccucgcggagcgcugcagaaagaauaacggaaagacagagaucuggcuggaacuuaaaccccaagggcggaugcugaugaaugcucgcuauuuucucgagaugucugacaccaaggauaugaacgaguucgagacagagggauuuuucgcccugcaucagagacggggcgccaucaaacaggcuaaggugcaccaugucaaaugucacgaauuuaccgccacauucuuuccucagcccaccuucugcagcgugugucaugaguuuguuuggggccugaauaagcaaggguaccagugccgccaguguaacgcugccauucacaagaaaugcaucgacaaggugauugcgaaauguacgggauccgccaucaauagcagagaaaccauguuccacaaggagcgguuuaaaauugauaugccucaucgcuucaaggucuauaacuacaaaucuccgacauucugcgaacacugcggcacccuccugugggggcuugcuagacagggacugaagugugacgccugcggcaugaaugugcaucaccggugucaaacaaagguggcuaaccucugcgggaucaaucagaaacugauggccgaggcgcuugccaugauugaguccacccagcaagcucgcugucugagagauacggaacagaucuuucgggagggacccgucgaaaucggccucccuugcagcauuaagaacgaggcccggcccccuugucugcccacaccgggcaaaagagaaccucaggggaucucuugggagagcccccuggacgagguugauaagaugugccaccucccugaacccgagcugaacaaagaacggcccucccuucagauuaagcugaagaucgaggacuucauucuccauaaaaugcugggaaagggcucuuuugggaaaguguuccuugcugaauuuaagaaaaccaaucaauucuuugccaucaaggcccugaagaaagaugugguccucauggacgacgauguggaguguacaaugguugagaagagagugcugucccuggcuugggaacacccuuuccucacccauauguuuugcaccuuccagacaaaagagaaccuguuuuucgucauggaauaccuuaauggaggcgaccugauguaucacauccagagcugucauaaguuugaucucucccgcgcgacguucuacgccgcugagauuauccuggggcuucaguuccugcacucuaaaggaauuguguaucgggaccucaagcuggauaacauccugcucgacaaggauggccacauuaaaaucgccgacuuuggcaugugcaaggagaauaugcugggggaugccaaaaccaacacauucugcggaaccccggacuacaucgcucccgaacuuuuuguuagagagccugaaaagcgccugggcgugcgcggggauauuagacaacauccccucuuccgcgagaucaauugggaagaacuggagcggaaagaaauugacccucccuuuagaccgaaggucaaaagcccuuucgacuguuccaacuuugauaaggaguuccugaaugaaaagccccgccuuagcuuugccgaccgggcgcucaucaacucuauggaucagaauauguucagaaacuuuuccuucaugaauccuggaauggagcgccugauuagcuga

SEQ ID NO: 74230 - RNA, 1587 nt, Artificial Sequence
  derived and/or modified sequence opt5 from PRKCSH__Homo_sapiens__XP_011526433
augcugcucccccugcuucugcuccugccuaugugcugggccguggaggucaagagaccgcggggcguuagccuuaccaaccaccauuucuacgacgaauccaaacccuuuacaugucuggaugggucugcuacgaucccuuucgaccaggugaaugaugacuauugcgauuguaaggacggaagcgaugagcccggcaccgccgcgugcccuaacggguccuuucacuguacaaauaccggauacaaaccccucuauauuccuucuaaccgcgugaaugacggcgucugcgauuguugcgacgggacagaugaauacaacagcggagugaucugugagaauaccugcaaggaaaaaggcagaaaggagcgggagucccugcaacagauggcugaaguuacacgcgagggcuucagacugaagaaaauucucaucgaagacuggaagaaagcccgggaggagaagcagaaaaagcugauugaacuucaggccgggaagaaaucucuggaggaucaaguggaaaugcuccgcaccgucaaggaggaagcugagaaaccggagagagaagccaaggagcagcaucagaaacugugggaggaacagcuugcugccgcgaaggcccaacaggaacaggagcuggcugccgacgcuuuuaaagagcucgacgaugacauggauggaacggugagcguuaccgaacugcagacacaccccgagcuggacaccgauggcgacggggcccucuccgaagcggaggcccaagcucugcuuagcggagauacacagaccgacgccacgucuuucuaugaucgggugugggcugccauccgcgacaaguacagauccgaagcccugccuacagaucuccccgcuccuagcgcgcccgaccugaccgagccgaaggaggaacagccucccgucccuucuucccccacagaggaagaggaggaagaggaagaggaagaggaggaagaggccgaagaggaagaggaggaagaggacagcgaagaggcucccccuccgcuuucucccccucaacccgccuccccugccgaagaggauaaaaugcccccguaugacgagcagacccaggcuuuuaucgaugccgcgcaggaagcucggaacaaguucgaggaagccgagcgcagccugaaagacauggaggaauccauuagaaaucucgagcaagaaaucucuuuugauuucggcccuaacggggaguuugccuaccuguacagccaguguuaugaacugaccacaaaugaguacguguaucggcucugccccuucaagcuggugucccagaaaccuaaacuuggaggcagccccacgucucugggcaccuggggguccuggauuggaccugaccaugauaaguuuagcgcuaugaaguacgagcagggcacagggugcuggcaaggacccaaccgcucuaccacagucagacuccuguguggcaaggaaaccaugguuacgagcacaaccgagccgucccggugcgaauaucuuauggagcugaugaccccugccgcuugucccgaacccccuccggaggcccccacagaggacgaucacgacgaacucuga

SEQ ID NO: 74231 - RNA, 1788 nt, Artificial Sequence
  derived and/or modified sequence opt5 from PRKCZ__Homo_sapiens__XP_011540075
augcccagcagaaccggcccuaagauggagggguccggaggccgggugcgccugaaagcccacuacgggggagacaucuucauuacaucugucgaugcugccacgaccuuugaggaacucugcgaagagguuagagacaugugucggcugcaucagcaacacccgcuuacacugaaguggguggauagcgaaggcgaccccugcaccguguccucucagauggagcucgaggaagcguuccgccuggcuagacagugucgggaugaggggcuuaucauucaugucuuuccuagcacacccgaacagccuggacugcccugcccuggcgaggacaaauccaucuaucgcagaggcgcccggcgcuggagaaagcucuaccgggccaacgggcaccuguuccaagcuaaacgcuuuaauagacgggccuauuguggacagugcucugagcgcauuuggggccuggcuagacagggguaccgguguaucaacugcaagcuccuggugcauaagagaugucacggacuuguuccgcugaccugccgcaaacacauggauagcgugaugcccucccaggaaccucccgucgacgauaagaaugaggacgccgaucucccuagcgaagagacagacggcaucgcguauauuucuuccagccggaaacaugauucuaucaaggacgacuccgaagaucugaaacccgugauugacgggauggauggaaucaagauuagccaaggccuuggccugcaggacuucgaucucaucagaguuauugggcgcggaucuuacgccaaggugcugcugguccggcucaaaaagaacgaccagaucuaugcuaugaaaguggugaagaaagagcugguccacgaugacgaggauaucgacuggguucagaccgaaaagcauguguuugagcaagccuccagcaauccguuccuugugggccugcacuccuguuuucagacgaccucuagacucuuccuggucauugaauacgugaacgggggagaucuuauguuucacaugcagcgccaacggaaacugccugaggaacaugcuagauucuacgccgcggagaucugcauugcccucaauuuucugcacgagcgcggcaucauuuaucgggaccugaagcucgacaacguucugcuugaugcugacgggcauaucaagcugacagauuacggaaugugcaaagaaggccucggccccggggacaccacaagcaccuucuguggaacgccuaauuauaucgcccccgagauucugagaggcgaagaguacggguucuccguggauuggugggcucuuggaguccugauguuugaaaugauggccggccgcagccccuucgacaucauuacagauaacccugacaugaauaccgaggauuaucucuuucaggugauccuggagaagccgauucggauccccagauuccugucuguuaaagccucccacgugcucaagggguuucugaacaaagacccuaaggaacggcuuggcugccgcccccagacaggauucagcgauaucaagucucaugcguuuuucagaagcauugacugggaucugaugcaccggcagcucagauguaccgacgcucgcaccacauggacgccucggagaugcggccgcaccgacgauauggacgcccaaacaauguggaugcacgggagacggcgccauaccgaugacuccucuacagaugacagcgaugcuagaacgccccggcgcagaggacggaccgacgaugccgacgcccagaugacauggacccaccgcuga

SEQ ID NO: 74232 - RNA, 2739 nt, Artificial Sequence
  derived and/or modified sequence opt5 from PRKD1__Homo_sapiens__NP_002733
augagcgcucccccugugcugagaccgcccuccccucuccugcccgucgccgccgcggcugccgccgcugccgcugcccuuguuccuggcucugggcccggaccugcgccguuccuggcccccguggcugccccugugggcgggaucagcuuucaccuccagauuggacugucccgggagcccguccuucugcuccaagacucuagcggcgauuacucccuggcucaugugcgcgaaauggccugcucuaucguugaccagaaguucccugaguguggguuuuauggaauguacgauaaaauucuccuguucagacacgaccccaccagcgaaaacauccugcagcuugugaaggcggccuccgauauucaggagggcgaccugaucgaagucgugcucagcgcuucugccacauuugaggauuuccaaauccggccgcaugcucuguuuguucacuccuaucgcgccccugccuucugcgaccauuguggcgagaugcuuugggggcuggugagacagggacucaaaugcgaaggcugugggcugaauuaccacaagcggugcgcuuuuaaaauucccaacaauuguagcggaguccgcagacggcgccugucuaacgugucccucacgggcgugagcaccaucagaacaucuuccgcggagcugagcaccuccgccccugaugaaccccuucugcagaagucucccagcgaguccuucauugggcgggagaagcgcagcaauucucaguccuauaucggaagaccuauucaccucgacaaaauccugaugagcaaggucaaaguuccgcauacauuugugauucacucuuacacccggcccacagugugccaauauuguaagaaacuucugaagggccucuuccgccagggccugcagugcaaggauuguagauuuaacugccauaaacggugcgcuccuaagguccccaauaacugucugggggaagugaccaucaauggagaccuccugagcccuggcgccgaguccgauguugugauggaagaggggucugacgacaacgauagcgaaagaaauuccggacuuauggacgauauggaggaggccaugguccaggacgcugaaauggccauggcggagugccaaaacgauagcggcgaaaugcaggaccccgauccggaccacgaggaugcuaaucgcacgaucucuccuuccaccagcaacaauauuccccugaugcgggugguucagucugugaaacacacaaagagaaaauccagcaccgucaugaaggaaggguggauggugcauuacacauccaaagacacccuccgcaagcggcacuacuggagacuggauucuaaguguaucacgcuuuuccaaaacgacacaggaagccgcuauuacaaagagauuccucuguccgagauccucucucuggaacccgucaagaccagcgcccugauuccuaacggcgccaauccccauugcuucgagaucacaaccgcuaacgugguuuauuacgugggcgaaaaugucgugaacccguccagcccuucucccaauaacuccguucucaccagcggggugggagccgacgucgcucggaugugggagaucgccauucagcacgcgcugaugcccgugaucccuaaaggcagcuccguggggacaggaacgaaucuucauagagauauuagcguuucuaucagcgucuccaacugucagauucaggaaaauguggacaucagcaccguguaucaaaucuuuccggaugagguccugggcucugggcaguucggcauuguguacggaggcaagcaccgcaaaacagggcgggacguugccaucaagauuaucgauaagcucagauuucccaccaaacaggagucccagcugcgcaacgaaguggcuauucugcaaaaucuucaccauccuggagucgugaaccucgagugcauguucgaaacacccgagcggguuuuuguggucauggagaagcugcacggcgacaugcuggaaaugauccucagcuccgagaaagggagacugccugaacauauuaccaaguuccuuaucacgcagauccugguggcccuccggcaucugcacuuuaaaaauauuguucacugugaucugaagcccgagaacgugcuucucgcuucugccgacccuuucccccaggucaagcugugcgauuuuggauucgcgcgcaucauuggcgaaaaaucuuuuagacgguccgugguggggacaccggccuaucuggcuccugagguccucagaaauaagggcuacaaccgcucucuggacauguggagcguuggagugaucauuuacgugucccuuucuggcaccuuccccuuuaacgaggaugaagacauccacgaucagauccaaaaugccgcuuucauguauccucccaacccguggaaagagauuagccaugaagccaucgaccugauuaauaaccuccugcaggucaagaugcggaaaagauacuccguggacaagacccugagccacccuuggcuucaggauuaucagacauggcucgaccugcgcgagcuggaauguaagaucggggagagauacauuacccaugagucugaugaccuccggugggaaaaauaugccggagagcaaggccugcaguaccccacacaccuuaucaauccuuccgcuagccacucugauacgcccgaaaccgaggaaacagagaugaaggcgcugggggagcgcguuuccauccucuga

SEQ ID NO: 74233 - RNA, 2673 nt, Artificial Sequence
  derived and/or modified sequence opt5 from PRKD3__Homo_sapiens__XP_005264294
augagcgccaacaauuccccucccucugcucagaagucugugcugccgaccgccauccccgcgguccucccugcugccucccccugcucuagcccuaaaacaggccuguccgccagacuuucuaacgggagcuucuccgcucccagccugacgaauagccggggauccguucacaccgugagcuuucuccugcaaauuggccuuacacgcgagucugugaccaucgaagcccaggagcugucccucagcgcugucaaggaccugguguguucuauuguuuaccagaaauucccugaaugcggguuuuucggaauguaugauaagauccugcucuuuagacaugacaugaacuccgagaauauucugcagcuuaucacaagcgccgaugaaauccacgagggcgaccugguggaggucgugcucuccgcgcuggccaccguugaagauuuccaaauucggccgcauacacuuuacgugcacucuuauaaagcucccaccuuuugugacuacugcggggagaugcuguggggacucguccgccagggccugaagugugaaggcugcgggcugaacuaucauaagagaugugccuucaaaaucccuaauaacugcagcggagugcggaagcgcagacucuccaaugugagccugcccggcccugggcuuucugucccccggccgcugcagccugaguacguugcucuccccuccgaggaaagccacgugcaccaggagccuucuaaacgcauucccagcugguccggaagacccaucuggauggaaaagauggugaugugucgggucaaagugccucauacguuugccguucacucuuauacccgcccgacaauuugccaauacuguaagagacugcuuaagggccuguuccggcaggggaugcagugcaaagauugcaaguuuaacugucauaaacgcugcgcgagcaaggugcccagagacugucucggagaggucaccuucaauggcgaaccuuccagccugggcacagauaccgacauccccauggauauugacaacaaugauaucaacucugacuccagccgggggcuggacgauacggaggagccuucucccccggaagacaaaauguuuuuccucgauccuuccgaccuggauguggagagagacgaagaggccguuaagacaaucagccccuccaccucuaauaacauuccucuuaugcgcgugguccagagcaucaaacacacaaagcggaaguccucuaccauggugaaagaaggauggaugguccacuacaccagcagagauaaccugcgcaagcggcauuauuggagacucgacuccaaaugccugacacuuuuccaaaaugagagcggcucuaaguacuauaaagagauuccccuguccgaaauccuccgcauuagcucuccucgggauuuuacgaacaucucccaggggagcaauccccacuguuucgagaucauuaccgacacaaugguguacuuuguuggagaaaacaauggcgauucuagccauaacccggugcuggcugccaccggggucggacuggacguggcucaguccugggagaaggccaucagacaagcccucaugccuguuacaccccaggcuagcgugugcaccucucccggccagggcaaggaccacaaagaucuguccacgagcauuuccgucucuaauugucagauccaagaaaacguggacauuagcacaguguaucagaucuucgcggaugagguucuuggguccggacaguuuggcaucgucuacgggggaaagcaucgcaaaaccggccgggacguggccauuaaggugaucgauaaaaugagauucccuaccaagcaggagucucaacugcgcaaugaagucgcuauucuccagaaccugcaccacccggggaucgugaaucuggagugcauguuugaaacacccgagcggguuuucguggucauggagaaacuucauggcgacaugcucgaaaugauucugagcuccgagaagucuagacugccugaacggaucaccaaguuuauggugacacagauucucguugcccugcgcaaccuucacuucaaaaauaucgugcauugugaucugaagcccgagaacguccuccuggccagcgcugaaccuuuuccccaggugaaacugugcgacuucggauuugccagaaucauuggcgagaaguccuuccggagaagcguuguggggacgccugcguaucuugcucccgagguccuccgcucuaagggauacaaucggucccuggauauguggagcgugggcgugaucauuuacgucucucuguccgggaccuucccguuuaacgaagacgaggauaucaacgaccaaauucagaaugccgccuucauguauccucccaacccuuggagagaaaucagcggagaggcuaucgaucucauuaauaaccugcuucagguuaaaaugcgcaagagauacucuguggacaaaucccugagccaccccuggcuccaggacuaucaaacauggcuggaucugcgggaauuugagacccgcaucggcgagagauacauuacacacgaauccgacgaugcccggugggagauccaugcuuauacccacaaucuuguguacccgaagcauuucauuauggccccuaaccccgacgauauggaagaggacccuuga

SEQ ID NO: 74234 - RNA, 12294 nt, Artificial Sequence
  derived and/or modified sequence opt5 from PRKDC__Homo_sapiens__NP_001075109
auggccggcagcggggcuggagugagaugcucccugcuccggcugcaggaaacccuuucugccgcggaccgcuguggcgcugcccuggccgggcaccaacucaucagaggacugggccaggaaugcgugcuuagcuccucucccgcuguucuggcccuccagaccagccugguguucucccgggauuuugggcugcucguguucguccgcaagucucugaacagcauugaauuuagagaaugucgggaggaaauccuuaaguuccugugcauuuuucucgagaagaugggacagaaaaucgcuccuuacuccguggagauuaagaauacguguaccagcguuuauacaaaagaccgcgccgcgaagugcaagauccccgcccuggaucuucugaucaaacuccugcaaaccuucagaucuucccggcugauggacgaauuuaagauuggcgaacuguucagcaaauuuuacggcgaacuggcucuuaagaaaaagauccccgauacagugcuggagaaggucuaugagcuccuggggcuucugggagaagugcacccuucugagaugauuaacaaugccgaaaaccucuuccgcgcuuuucugggcgagcugaaaacccagaugacauccgccguuagagaacccaagcucccugugcuggcggggugucuuaaaggacugagcucucuccugugcaauuucaccaaguccauggaggaggacccccagacgagccgggaaaucuuuaacuucguccuuaaagccauucgcccucagaucgaucugaagagauacgcugugccguccgccggccuccggcuguucgcucugcacgccucucaauuuagcaccugucuccuggacaauuaugugucccuuuucgagguccugcucaaauggugcgcccauacaaacguugaacugaagaaggcugcgcugagcgcccuugagucuuuucucaaacagguguccaauaugguggcuaagaacgccgaaaugcacaaaaauaagcugcaguacuucauggagcaguuuuaugggauuauccgcaacgucgauagcaauaacaaagagcugucuaucgccauuagaggauacggccucuucgcuggccccuguaaggugaucaaugccaaggacguugauuuuauguacguggaacugauucaacggugcaaacagauguuccuuacccagacagacaccggggaugacagagucuaucaaaugccuagcuuucugcaguccguggcgucuguucuccuguaccuggacacggugcccgaggucuauacaccugugcuugaacaucucgucgugaugcagaucgauagcuucccccaguacuccccgaagaugcaacugguuugcugucgcgcuauugugaaagucuuucuggcccucgccgcuaagggaccugugcugcggaacugcaucagcaccguugugcaccagggccuuaucagaauuuguucuaaacccgucgugcugccuaaggggcccgaguccgaaagcgaggaccaccgcgccucuggagaggugcggacaggcaaguggaaaguucccaccuauaaggauuacgucgaccucuucagacaucugcuguccagcgaucagaugauggacuccauccuugcugaugaagccuuuuucucugugaacagcuccucugagagccucaaucaccuccuguaugacgaguucgugaaauccguccucaagauuguggagaaacuggaucuuacccuggagauccagacaguuggggaacaagagaacggagacgaagcgccuggcguguggaugauuccgacgagcgaucccgccgcuaaucuccauccugccaagcccaaggacuuuucugcuuucaucaaccuggucgaguuuugccgcgaaauccugccugagaaacaggccgaguucuuugaacccuggguguacuccuucagcuacgagcuuauucuccagucuacccggcugccgcugaucuccggcuuuuauaagcuccugagcauuacaguuagaaaugcgaaaaagaucaaauacuucgaaggggugucuccuaagagccuuaaacacucccccgaggacccugaaaaguauagcuguuuugcccuguucgucaaguuuggaaaagagguggcuguuaagaugaaacaguacaaggaugagcuccuggccucuugccugaccuuccuucugucccucccccacaacauuaucgaacuggacgugcgcgcuuaugucccugcccuccaaauggccuuuaaacugggccuuagcuacacaccccuggcugagguggggcucaaugcgcuggaagagugguccauuuauaucgaucggcaugugaugcagccguacuacaaggacauccugccuugucuugauggauaucugaagaccucugcccucagcgacgaaacgaaaaacaauugggaggucuccgcucugucuagagccgcccagaagggcuucaacaaaguugugcucaagcaccugaaaaagacaaagaaucuuagcuccaacgaggcuauuucucuggaagagauccgcauucgggugguccagaugcucgggagccugggcggacaaaucaauaaaaaccugcuuaccgugaccuccagcgaugaaaugaugaagucuuacguugccugggacagagagaaacggcuguccuucgcggugcccuuucgcgagaugaagcccgucauuuuccucgauguguuucugccuagaguuacagaacucgcucugaccgccagcgaccggcagacaaaaguggccgcuugcgagcuucugcauucuauggucauguucaugcugggcaaggccacgcagaugccggaagggggacaaggcgcgcccccuauguaucagcucuacaagagaaccuuucccgugcugcuucgccuggcuugugauguugaccaggugacacggcagcucuaugagccucuggucaugcaacucauccacugguucaccaauaacaaaaaguuugaaucccaggauacaguggcccugcuugaggccauccuggacgggauuguggaccccgucgauagcacccugagagacuucugcggacgcuguaucagagaguuucucaaauggucuauuaagcagaucacgccucagcaacaggaaaaaucccccguuaacaccaagagccuguucaaacggcuuuacucccuggcucuccauccgaaugccuuuaagcgccugggcgcuagccucgccuucaacaauauuuauagagaguuccgggaagaggaaucucugguggagcaguuuguguucgaggcgcuugucaucuacauggaaagccuggcccuggcucacgccgaugagaagucccucgggacaauccagcaaugcugcgacgcuauugaucaccugugucgcaucauugagaagaagcaugugucucuuaacaaagccaagaaaagacggcugccucgcggcuuucccccuagcgccucccucugccugcucgaccugguuaaguggcuucuggcucacuguggaagaccccagaccgagugccggcauaagucuaucgaacuguucuacaaauuugugccgcuccugccuggcaaucgcagccccaaccuuuggcugaaggauguccucaaagaggaggggguguccuuccugauuaauacauuugaaggaggcggguguggacagccuucuggcauccuggcgcaacccacccuccuuuaucugagagggcccuucagccugcaggccacgcucugcuggcuggaccuucugcucgcugcccuggaguguuacaacacauuuaucggcgaacggaccguuggagcccuccaggugcucggcacagaggcucaguccagccuucugaaggccgucgcguucuuucuggagucuauugcuaugcacgauaucauugccgccgaaaaaugcuucgggaccggagcugccggcaauagaaccuccccucaagagggggaacgcuauaacuacagcaaguguacaguggucgugcggaucauggaguuuacgaccacacuccugaauaccucuccggaaggauggaaacuucugaaaaaggaccucugcaacacacaccugaugagaguucuggugcagacccucugugagcccgcguccauuggcuucaauaucggggauguccaggugauggcucaucuuccugacguuugcgugaaccugaugaaagcccugaagaugagccccuauaaagauauucucgagacgcaucugcgcgaaaagaucacagcccaguccaucgaggaacuuugcgcugucaaucuguacggcccugacgcccaaguggaccggucuagacucgcugccgugguuagcgcguguaagcagcugcaucgcgccggacugcuccacaacauucuucccucccagagcaccgaucugcaucacucugucggcaccgagcugcucucccugguguauaaagggaucgcuccuggagacgaacggcagugccuuccgagccuggaucucucuuguaagcaacuggccagcggccugcucgagcuugcuuucgccuuugggggacugugcgagagacuggugucccuccugcuuaaccccgccguccugucuacagcuagccucggcuccucucagggcagcgugauucacuucucccauggggaauacuuuuacagccuguucucugagaccaucaauacagaacugcucaaaaaccuugaccuggcgguucuggagcucaugcaguccagcguggauaauacgaagauggucuccgccgugcugaacggaaugcuugaccagucuuuucgcgaacgggcuaaucaaaaacaccagggccugaagcucgccaccacaauucugcagcauuggaagaaaugugauagcuggugggccaaggacuccccucuggagaccaaaauggcuguucucgcccuucuggcgaagauccugcaaaucgauucuagcguguccuucaacacaagccacgggucuuuucccgaggucuucaccacguauauuucccuccuggcugacaccaaacuugaucugcaucucaagggacaggccgugacacugcugcccuuuuucaccagccucacaggcgggucucuugaagaacugagacggguucuggaacagcucaucguggcccacuuuccuaugcagucccgcgaguucccgccuggaacccccagauuuaauaacuacgucgacugcaugaaaaaguuccuggacgcucuugagcugagccaaucucccaugcuccuggaacugaugacagaggugcucugucgggaacagcagcacgugauggaggaacuuuuccagagcuccuuucgcagaauugcccggagaggcucuugcgucacccaaguuggccugcuggagagcguguaugagauguuccgcaaggaugacccucggcucuccuuuacgagacagagcuucguggaucgcucccugcuuacacugcucuggcauuguucucuggacgcgcugcgggaauuuuucagcaccaucgucguggaugccauugacguucucaaauccagauuuaccaagcugaaugagucuacauucgauacccagaucacgaaaaagaugggguacuauaaaauccuugacgugauguacagccgccugcccaaggaugacguccacgcuaaggaauccaaaauuaaccagguguuucauggaucuugcaucacagagggcaaugaacucaccaagacacugauuaaacuuuguuaugaugccuucaccgagaacauggcuggggagaaucaacugcucgaacggagacgccuguaccacugcgccgcuuacaacugcgccaucagcguuauuuguugcguguuuaaugagcugaaguucuaucagggauuucucuucuccgaaaaaccugagaagaaccugcuuaucuucgaaaaccugauugaccucaagagacgguacaauuuuccggucgagguggagguccccauggaacgcaaaaagaaauauaucgagaucagaaaggaagcgcgggaggccgcuaacggcgauagcgacgggccuucuuacauguccagccugucuuaucuugccgacuccacacugagcgaggaaaugucucaguucgauuuuuccaccggagugcaaagcuacuccuauagcucucaggacccccgcccugcuacgggcagauuccggagacgcgagcagcgggaucccaccguucacgacgaugugcucgaacuggagauggacgaacugaauagacaugaguguauggccccgcucacagcccuggugaaacacaugcaucgcagccuuggcccuccccagggggaggaagauuccgucccucgggaccugcccucuuggaugaaguuucuccacggaaagcugggcaacccuauuguuccccuuaauaucagacuguuccucgcuaaacuggugauuaacaccgaggaaguguuucggccguacgcgaagcauuggcugagcccucuccugcaacuugccgcuuccgagaauaacgggggagaaggcauccacuacauggucguggagauuguugccacaauccugucuuggaccgggcucgccacgcccacaggagugcccaaagaugagguccuggcuaaucgccuucugaacuuccucaugaagcacguguuucauccuaaaagagccgucuuccggcacaaucuggaaaucauuaagacccugguggagugcuggaaagacugucucagcaucccguaucgccugauuuuugaaaaguucuccggcaaggaucccaacucuaaagacaauagcguuggcauccagcuucuggggauugugauggcgaacgaucucccucccuacgacccucagugcggaauccaguccagcgaguauuuucaagcccuggucaauaacaugucuuucgugagauacaaggaaguuuaugcugccgcugccgaggugcuuggccugauccuccgguacgucauggagcgcaaaaauauucuggaagagucccugugugaacucguggcgaagcagcugaaacagcaucagaacacaauggaggacaaguucaucgugugccuuaacaagguuaccaagagcuuucccccucuggccgauagauucaugaaugcugucuuuuuccuccugccgaaguuucacggggugcuuaaaacccugugucucgaggugguccugugccggguugaaggaaugacagagcuguauuuccaacucaagucuaaagacuuuguccaggugaugcgccacagagaugacgaacggcagaaggucugucuggauauuaucuacaagaugaugcccaaacuuaagccuguggagcugagagaacuccugaaccccguuguggaguucgucucccauccuagcacgaccugccgcgagcagauguacaauauucuuauguggauccacgacaacuaucgggaucccgaauccgagacagacaaugauucucaagaaauuuuuaaacuggccaaggacgugcucauccagggccugaucgaugagaacccggggcugcagcuuauuaucagaaauuucuggagccaugaaacccgccugccuuccaacacacucgaccggcugcucgcucugaauagccuuuacucucccaaaauugagguucacuuucugucccuggccaccaacuuccuccuggagaugacgagcaugucucccgacuauccuaaucccauguuugaacauccucuuagcgagugcgaguuccaagaguacacaaucgauuccgacuggagauuccgcucuaccgugcugaccccgauguuugucgaaacacaggcuagccagggaacccuccagacacggacgcaagagggcucccugucugccagauggcccguggcgggccagauucgcgccacccagcagcaacacgauuucacacucacccagacagcugacgggcggagcuccuuugauuggcugaccggaagcucuacggacccucugguggaucacaccucccccagcuccgacucucuucuguucgcccauaagagaagcgagcgccuccagcgggcuccucugaaguccgucggccccgauuuugggaaaaagagacuuggacugccgggcgacgaaguugauaacaaagugaagggggccgccggacgcacagaccuccugagacuccggcgcagauucaugcgggaucaggagaaacugucucugauguaugcgagaaagggcguggcugaacaaaaacgggagaaggagaucaagagcgaacuuaaaaugaagcaggacgcccaggucgugcuguaccgcuccuauagacacggcgaccucccugauauccaaauuaaacauagcucucugaucacaccccuucaggcuguugcccagcgggacccuauuaucgccaagcagcuguuuuccagccucuucucugggauucugaaagagauggauaaguuuaagacacuguccgagaagaacaacaucacccaaaagcuccugcaggacuucaaucgcuuucuuaacacaacguucagcuucuuucccccuuucgugucuuguauccaggauauuuccugccagcacgcugcccugcucagccuggaccccgcggccgucucugcuggaugucuugccagccugcaacagccggugggcaucagacuccuggaggaagcucugcuccggcugcuuccugccgagcugcccgcgaaacgcguuagagggaaggcccggcugcccccugaugugcugcgcugggucgagcuugcuaaacuguacagauccauuggagaauacgacgugcuccggggcaucuuuaccagcgagauugggacaaagcagaucacccaguccgcccugcuggcugaagcccgcucugauuauagcgaggcugccaagcaauacgacgaagcgcucaacaaacaggauuggguugacggagagccgaccgaggccgaaaaggacuucugggagcuggcuucccuugauugcuauaaucaccuggccgaauggaaaucucucgaguacuguagcacagcuuccauugacucugaaaaucccccugaucugaauaagaucuggagcgagcccuuuuaucaggagacguaccuuccuuauaugaucagauccaaacugaagcuccugcugcaaggcgaagccgaccagagccuccugaccuucauugauaaggccaugcauggcgagcuucagaaagcgauccuggaacuccacuacucucaggagcugucccuucuguaccuccugcaagacgauguggaccgggcuaaguauuacauucagaacgggauccagagcuuuaugcagaauuauucuuccauugauguccugcuccaucaaagccgccugacaaaacuucagucugugcaggcccugaccgagauccaggaguucaucuccuuuauuagcaagcaaggaaaccucucuucccaggucccccugaaaagacuucugaauacauggaccaaccgguacccugacgccaagauggaucccaugaauaucugggacgauauuaucacgaacagaugcuucuuucucagcaagauugaggaaaaacugacaccgcugccugaggacaauagcaugaacguggaccaggauggcgaccccuccgaucgcauggaaguucaggagcaagaggaagacaucucuagccucauccgguccuguaaguucucuaugaaaaugaagaugauugauagcgcuagaaaacagaauaacuuuucccuggccaugaaacuucugaaagagcuccacaaggaaucuaagacccgcgacgauuggcuggugagcuggguccaguccuauugccggcugagccauuguagaucucgcucccaagggugcagcgaacaggugcucaccgugcuuaaaacaguuucucugcuggacgaaaauaacguguccagcuaccucuccaagaacauccuggcuuuccgggaucagaauauucuucugggaaccacauauagaaucauugccaacgcgcucucuagcgagccugccugucuggcugagaucgaagaggacaaagcccgccggauucuggaacuuuccggcucuagcuccgaggauagcgaaaaggucaucgcugggcucuaccagagagccuuccaacaccugucugaggcggugcaggccgcugaggaagaggcccagcccccguccuggagcugcggcccugcugccggaguuaucgacgcuuacaugacccuggccgauuuuugcgaccagcaacuccgcaaagaagaggagaaugcgucugugauugacagcgccgaacugcaggcuuaucccgcccuugucguggagaagaugcugaaggcccucaaacugaacuccaaugaagcucggcugaaguuccccagacuucuccagaucauugagcgguacccugaagagacgcugucucugaugacaaaagagaucagcuccguccccuguuggcaguuuauuagcuggaucucucacaugguggcccuccuggauaaggaccaagcgguugcugugcagcauuccgucgaagagaucaccgauaacuauccucaggccauuguguacccguucaucauuagcuccgaaucuuauagcuuuaaagacacauccaccggccacaagaauaaggaguucguugccagaaucaaaucuaaacuugaucaagggggagugauucaggacuuuaucaacgcucuggaucagcucagcaaucccgaacugcuguucaaagacugguccaacgauguccgcgccgagcuugcuaagacgccugugaauaaaaagaacaucgagaagauguacgaacggauguaugccgcgcucggcgaccccaaagccccugggcugggagcuuuuagacgcaaguucauucagaccuuuggcaaagaguucgauaagcauuuugggaaaggcggaucuaagcugcucagaaugaaacugagcgacuucaaugacaucacaaacaugcuucugcucaagaugaauaaggauuccaaacccccuggcaaccugaaggaaugcagcccguggaugucugacuucaaaguggaguuucugcggaacgaacuugagauucccgggcaauacgauggacgcggcaagccucuccccgaguaccacguuagaaucgccggguucgacgaacgggucaccgugauggcuucccugcgcagaccuaaacggauuaucauccgcggacaugaugagagagaacaccccuuucuggugaagggcggggaggaccuccggcaggaucagcgcgucgagcagcuguuccaagugaugaauggcauucuugcccaggacagcgcguguucucagagagcccugcagcuccggacauauuccguugugccgaugaccagcucugauccucgcgcuccgcccugcgaauacaaggacuggcugacaaaaaugagcggaaagcacgaugucggcgccuauaugcugauguacaaaggggcuaacagaaccgagacggugacauccuuucggaagagagaaagcaaaguuccugccgaccuucucaagcgcgccuucgugcggauguccaccucucccgaggcuuuucuggcgcugagaagccauuucgccuccucucacgcucucaucuguauuagccauuggauccugggaauuggcgaucgccaccuuaauaacuuuauggucgccauggaaaccgggggagugaucggcauugacuucggccacgccuuuggguccgcuacacaauuccugccuguuccggagcucaugcccuuucggcugaccagacaguucaucaaucugaugcuuccuaugaaggagacaggacucauguauucuaucauggugcaugcccugcgcgcguuccggagcgaccccggccugcucacgaacaccauggaugucuuugugaaagaaccuuccuucgacuggaagaauuuugagcagaaaaugcugaagaaagggggaagcuggauucaggaaaucaacguggcugagaagaauugguaccccagacaaaagauuugcuaugccaaacgcaaacuugccggcgcuaacccggccgucaucacaugugaugaacugcuccuggggcacgagaaagcuccugccuuccgggacuacguugcgguggccagaggaucuaaggaucauaauauucgggcucaggagcccgaauccggccugagcgaggaaacccaggugaaaugccuuauggaccaagccacagauccuaacauccucggccgcaccugggaggggugggaacccuggauguga

SEQ ID NO: 74235 - RNA, 2016 nt, Artificial Sequence
  derived and/or modified sequence opt5 from PRKG1__Homo_sapiens__NP_001091982
augagcgagcuggaagaggacuucgccaagauccucaugcugaaagaagagagaauuaaggaacuugagaaacggcuguccgagaaggaagaggaaauccaggagcucaaacgcaagcugcacaagugccaaucugugcuucccgucccuagcacccauauuggcccgagaacaacgcgggcucaggggaucuccgccgagccccagaccuaccgcucuuuucacgaucugagacaggcguuccggaaauuuacaaagagcgaacgcuccaaagaccucauuaaggaggcuauccuggauaacgacuucaugaaaaaucuggaacucucucaaauccaggagauuguugauuguauguauccuguggaauacggaaaggacagcugcaucauuaaggagggcgauguggggucccuggucuaugugauggaggacggaaaaguugaagugaccaaggagggcgucaaacuuuguacaauggggcccggaaagguguuuggcgaacuggccauccucuacaacugcaccagaacagccaccguuaaaacgcuggugaaugucaaacuuugggcuauugaucggcaguguuuccagaccaucaugaugcgcacaggccugauuaaacauaccgaguauauggaauuucucaagagcgugccuacauuccaaucucugcccgaggagauccuguccaagcucgccgacgugcuggaagagacccacuacgaaaacggggaguauaucauuagacagggagcucggggcgauacguuuuucaucauuagcaaagggacagucaauguuacccgcgaagacucuccuuccgaggauccgguguuucuuagaacacugggaaagggcgacugguucggggagaaagcccuccagggagaagacgugcggaccgcgaacgucaucgccgcugaggccgugaccugccugguuauugaucgcgacagcuuuaagcaucuuaucggcggccuggaugacgugucuaauaaggcuuacgaagaugccgaggcgaaggccaaguacgaggcugaagccgcuuucuucgccaaccucaaacuguccgacuuuaauaucauugauacacugggggucggaggcuucgggagaguggagcucguucagcuuaagagcgaagaguccaaaacguuugccaugaagauccugaaaaagcggcacauuguggacaccagacaacaggaacacauccgcucugagaagcagauuaugcaaggagcucauagcgauuucaucguccggcuguauagaacauuuaaagacuccaaguaccucuauaugcugauggaggcgugucuuggcggggaacuguggaccauccuccgcgaucggggcagcuucgaggacucuacaaccagauuuuacacggccugcguggucgaggcuuucgccuaucugcacuccaaaggaauuaucuaccgcgaccugaagcccgaaaaccucauucuggaucaucggggcuaugccaaacuuguggacuuuggguucgcuaagaagaucggauuuggcaaaaagacauggaccuucugugggaccccugaauacguugcccccgagauuauccugaauaaaggacacgauauuagcgcggacuacuggucucucggcauccugauguaugagcugcuuacagggagcccucccuuuuccggcccggauccuaugaagaccuacaacaucauucucagaggaaucgacaugauugaguuccccaaaaagaucgcuaaaaaugccgccaaccugauuaagaagcugugccgcgauaauccuucugaacggcucggcaaccugaaaaacggggugaaggacauccagaaacacaagugguucgaaggauuuaauugggagggccuuagaaaagggacacugacgccucccaucauucccagcgucgcuuccccgaccgauacaagcaacuucgacucuuuucccgaagauaaugacgagccucccccugaugacaacuccggaugggacaucgauuucuga

SEQ ID NO: 74236 - RNA, 1029 nt, Artificial Sequence
  derived and/or modified sequence opt5 from PRKG2__Homo_sapiens__NP_001269410
augagcaacuggaagcuguccaaagcccucucucuggagaugauccagcuuaaggaaaaaguggcuagauucagcuccucuagccccuuucaaaaucuggagauuaucgccacccucggcgucgggggauucggccggguugaacuggugaaggugaaaaacgagaaugucgcguuugcuaugaagugcauucgcaagaaacacaucguggacacaaagcagcaggaacauguuuacuccgagaaacggauucuugaggaacuguguucuccuuucaucgugaagcucuacagaacguuuaaagauaacaaguacgucuauaugcugcuggaggccugccucgggggagaacuguggagcauccuucgcgacagaggcuccuucgaugagccgaccagcaaguuuuguguggccugcguuacagaggcuuucgacuaccugcaccggcucgggauuaucuaucgcgaucugaaacccgaaaaucuuauucuggacgccgagggauaccucaagcugguggauuuuggcuucgcuaaaaagaucggcucugggcagaaaaccuggacauuuuguggaaccccugaauaugucgcccccgaggugauucugaacaagggccaugacuucuccguggauuuuuggagccucgggauccuggucuacgaacuucugacaggaaauccucccuucucuggcguugaccaaaugaugaccuacaaccucauucugaaagggaucgagaagauggauuucccuagaaagaucacgcggcgcccggaggaccuuauuagacggcugugccgccagaaucccaccgaaagacucggaaaccugaaaaauggcaucaacgauauuaagaaacaccgguggcugaauggcuuuaacugggaggggcucaaggcgcgcucccugccuagcccccuucagagagaacugaaaggaccuaucgaccauucuuauuucgacaaguaucccccggagaagggcaugccucccgaugaacucuccgggugggacaaagauuuuuga

SEQ ID NO: 74237 - RNA, 909 nt, Artificial Sequence
  derived and/or modified sequence opt5 from PRKRA__Homo_sapiens__NP_001132989
augcagagcacccccuucugcggcuuuuguucccuggggaagaugaucacagccaaaccuggaaagacgccgauucaagugcuccacgaguacggcaugaaaaccaagaacauccccgucuaugaaugcgagagaucugacguucagauucaugugccuacauucaccuuucgggugacagucggggauaucaccuguacaggagaaggcaccagcaaaaagcuggcuaagcaccgcgccgcggaggcugccauuaauauccuuaaagccaacgcuuccaucugcuucgccgugcccgacccucugaugcccgauccuucuaagcagccgaaaaaucagcucaaccccauugggagccugcaagaacuugcuauccaucacggauggagacugccugaguacacgcucucccaggagggcggccccgcccauaagcgggaauauaccacaauuugucgccuggagucuuuuauggaaaccgggaaaggagcgagcaagaagcaggccaaaagaaaugcugccgagaaguuccuggcuaaauuuuccaacaucagcccugagaaucacauuucucucacaaacguugugggccacucccuggggugcaccuggcauagccuucgcaauucucccggagaaaagaucaaccugcucaaacggucccugcuuagcauuccgaauacggacuacauccagcugcucucugagaucgccaaggaacaaggcuucaacauuacauaucuggauaucgacgagcuguccgcgaaugggcaguaccagugucucgccgaacugagcaccuccccuauuacagucugccacggaucuggcaucagcuguggcaacgcucaguccgaugccgcucauaaugcccuucaauaucugaaaauuaucgccgagagaaaguga

SEQ ID NO: 74238 - RNA, 2286 nt, Artificial Sequence
  derived and/or modified sequence opt5 from PRKRIR__Homo_sapiens__NP_004696
augcccaacuucugcgccgcuccuaauuguaccagaaagagcacacaguccgaccuggccuuuuuccgguuuccgcgcgaucccgcgagaugccaaaaauggguggagaacugucggcgcgcugaccucgaagauaagacgccugaccagcugaauaaacacuacagacuuugcgccaagcacuucgagaccucuaugaucugucggacaagccccuaucgcaccguccugagagauaacgccauuccuacaaucuuugaccucaccucccaccugaauaacccccauucucggcaccgcaaaagaauuaaggaacuuagcgaggaugaaauccggacacugaagcagaaaaagauugacgagaccuccgagcaggaacaaaaacauaaggagacgaauaacucuaaugcucagaacccuagcgaagaggagggcgaagggcaggaugaggacauccucccgcugacccuggaagagaaagaaaauaaggaguaccucaagucccuguucgagauccuuauucugaugggaaaacagaacaucccccucgauggccacgaagccgacgagauuccugaagggcuguuuacacccgauaauuuccaagcccuucuggagugccgcaucaacagcggagaagagguucucagaaagcgguuugagaccacagcugugaauacccuguucuguucuaaaacgcagcagcgccagaugcuggaaauuugcgaguccuguaucagagaagagacacuccgggaagugagagacagccacuuuuucucuauuaucaccgacgaugucguggacaucgcgggcgaggagcaucugccuguucuugugcgcuuugucgaugaaucccacaaccugcgggaggaguucauuggguuccuccccuaugaggccgacgcugagauccuggccgugaaguuucauacaaugauuaccgaaaaauggggacuuaacauggaguacugcagaggccaggcuuauaucguuagcucuggcuucuccagcaagaugaaaguggucgccucccgccugcucgaaaaguacccgcaagcgauuuauacccuguguucuagcugcgcccugaauauguggcucgcuaaguccgugccugugaugggggucagcguugcccugggaacaaucgaggaagugugcuccuuuuuccaccggucuccccagcuucugcucgagcuggauaacgugaucagcguccuuuuucaaaauucuaaagagagaggcaaggaacugaaagagauuugucacagccaguggacggggcgccaugacgcuuucgaaauccucguggagcugcugcaggcccucguucugugccuugauggaauuaacuccgacaccaauauccgguggaacaauuacauugccggcagagcuuuugugcuguguucugcggucagcgauuucgacuuuaucgugacaaucguugugcucaagaacguccuguccuucacccgcgccuuugggaaaaaucugcagggacaaacaagcgauguguucuuugcugccggcucucuuaccgccguccuccacucccugaacgaagugauggagaauauugagguuuaccaugaguucugguucgaagaagcuacgaaccuggccacaaagcucgacauccagaugaagcugccuggcaaauuucggagagcgcaccaggggaaucuugagagccagcugaccucugaauccuauuacaaggagacccucagcgugcccacagucgagcauauuauccaagaacugaaagacauuuucuccgagcagcaccugaaggcucuuaaaugccucucucuggugcccagcguuaugggacagcugaaguuuaacaccuccgaagaacaccaugccgauauguaucgcucugaccucccuaauccggauacacugagcgccgagcuucacuguuggcggaucaaguggaaacauagaggcaaggacauugaacugcccuccacgaucuacgaggcucuccaucugccugauaucaaauucuuucccaacguguaugcccugcuuaagguccucugcauucugccugugaugaaaguggaaaacgagcgguacgaaaaugggcgcaagagacugaaggcuuaucuccggaacacccugacagaccagagaagcucuaaucuugcccugcucaacaucaauuucgauauuaaacacgaccuggaucugaugguugacaccuacaucaaacuuuacacauccaagagcgagcuccccaccgauaacucugagacggucgaaaauaccuga

SEQ ID NO: 74239 - RNA, 1077 nt, Artificial Sequence
  derived and/or modified sequence opt5 from PRKX__Homo_sapiens__NP_005035
auggaggcccccggccuggcucaggccgcggcugccgaaagcgacuccagaaagguggccgaggaaaccccugauggggcuccggcccucugccccucuccugaggcucugagccccgaaccucccgucuacucccuucaagacuucgauacacuggccacgguuggaaccggcacauuugggcgggugcaccucgugaaagagaagaccgcgaaacauuucuuugcccugaaggucaugucuaucccugacgugauucgccuuaaacaggagcagcacguucauaacgaaaagagcgugcugaaggaggucucccacccguuccucaucagacuguuuuggacauggcaugaugaacgguuccuguauaugcucauggaguacgugcccggaggcgagcuguuuucuuaucuucgcaauagagggcgguucagcuccaccacaggacuguuuuacagcgcugaaauuaucugugccauugaguaucuccacucuaaagaaaucguuuaccgcgaccugaagccugagaacauccuucuggauagagacggccacauuaaacucaccgauuucggcuuugcuaagaaacugguggaccggacguggacccugugcgggacacccgaauaucucgccccugaggucauccaguccaagggacauggccgcgcgguggauuggugggcccuggggauucuuaucuucgagaugcugagcggauuucccccguucuucgacgauaauccuuuuggcauuuaccaaaagauccucgcugggaaaauugacuuccccagacaccuggacuuucaugugaaggaucuuaucaaaaagcugcucgucguugaccggacccgcagacugggaaacaugaaaaauggcgccaacgaugugaagcaccaccggugguuccgcucuguggacugggaagcugucccucagagaaaacugaagccucccaucgugcccaagauugccggcgauggggacacauccaauuuugagaccuacccggaaaacgauugggacacggccgcucccguuccucagaaagaucucgagaucuucaagaauuuuuga

SEQ ID NO: 74240 - RNA, 264 nt, Artificial Sequence
  derived and/or modified sequence opt5 from PRLH__Homo_sapiens__NP_056977
augaaggugcugagagccuggcuccugugccuucugaugcucggccuggcccuucgcggggcugcgagccggacccacagacauuccauggagauccggacacccgacauuaacccugcuugguacgccucucgcggaaucagaccggucggccgguucgggcgcagacgggccacgcugggagauguucccaaaccuggccuccgccccagacugaccuguuuuccucuggaagggggagcuaugagcucccaggacggcuga

SEQ ID NO: 74241 - RNA, 684 nt, Artificial Sequence
  derived and/or modified sequence opt5 from PRL__Homo_sapiens__NP_000939
augaacaucaagggcagccccuggaaagggucccugcuccugcuucuggugucuaaucuccugcuuugccagagcgucgccccucugccgauuugucccggaggcgcugccagaugccaaguuacccuccgggaccuguucgaucgcgcgguggugcugucccacuacauccauaaccucucuagcgagauguuuuccgaguucgacaagagauauacacacgggcggggauuuauuacgaaagcuaucaauucuugucauaccagcucccuggccacaccugaagauaaggaacaggcccagcagaugaaccaaaaagacuuccuuagccugauugucucuauccuccgcuccuggaaugagccccuguaccaccuugugaccgaaguuagaggcaugcaggaggcuccugaggccauccugagcaaggcuguggaaauugaggaacagacaaagcggcuccuggaggggauggagcugaucgucucucaggugcaucccgaaaccaaagagaacgaaauuuauccuguuugguccggacucccgagccugcaaauggccgaugaggaaucucgccuuuccgcguacuauaaucugcuccacugccugagacgggacagccacaagaucgauaacuaccuuaaacugcucaagugucgcauuauccauaauaacaauugcuga

SEQ ID NO: 74242 - RNA, 1113 nt, Artificial Sequence
  derived and/or modified sequence opt5 from PRLHR__Homo_sapiens__NP_004239
auggccagcuccaccacaagaggcccccgggugucugaccuguucagcgggcucccuccggccgucacgacccccgccaaccaguccgcggaggcuucugccggaaauggcagcguugccggggcugaugccccugcugugacacccuuucaaucccugcagcuugugcaccagcugaagggacucaucguccugcuuuacucugugguuguggucgugggccugguugggaacugccuccuggugcuggucauugcccgcgugagacggcuccauaaugugaccaacuuccugaucggaaaucuugcgcugagcgacguccucauguguacagccugcguuccucugacccuugcuuaugccuuugaaccccgcggcuggguguucggcgggggacugugucaccucguguuuuuccugcagccugucacaguguacguuuccguguuuacccugacgaccauugcugucgauagauaugugguucucgugcauccgcugcggcgcagaaucagccuucggcugucugccuacgcgguccucgccauuugggcucuguccgccgugcuugcucugcccgccgccguccacacauaucauguggagcucaaaccucacgacguucgccugugcgaagaguucuggggcagccaagaaagacagcggcagcuguacgcuugggggcuccugcuugugaccuaucugcucccccugcuugucauccugcucucuuacgugcgcguuuccgugaagcugagaaaccgggucgugccuggaugugugacacagagccaagcggauugggaccgcgccagacggagacgcaccuuuugccugcucguugucgugguggucguguucgcuguuuguuggcugccccuucacguguuuaaucugcuccgggaucuggacccgcaugccaucgauccuuacgccuucggccugguccagcuucucugccacuggcuggcuaugucuuccgccuguuauaaccccuuuauuuacgcguggcugcaugacagcuucagagaggagcuccgcaaacugcuuguggcuuggccucggaagaucgcuccccacgggcagaauaugacgguuuccguggucauuuga

SEQ ID NO: 74243 - RNA, 1566 nt, Artificial Sequence
  derived and/or modified sequence opt5 from PRLR__Homo_sapiens__NP_001191243
augaaggagaacguggccagcgcuaccgucuucacacugcuccuguuucuuaauacgugccugcucaacguucagcccgacccuccgcuggaacuugccguggaggugaaacaacccgaagauagaaagccuuaccuguggaucaaauggucucccccuacccucauugaccugaagacaggcugguucacccugcucuaugagauccggcugaaacccgaaaaggcggcugagugggagauucacuuugccgggcagcagacagaguucaagauccuuucccugcauccuggacagaaauaccucguccaagugcgcuguaagccggaucacggcuauuggagcgccuggucccccgcuaccuuuauucagaucccuucugacuucacaaugaaugauaccacgguuuggaucagcguggccguccuguccgcugugauuugccuuaucauuguuugggccguggcgcugaaaggguacucuauggucaccuguaucuuucccccugugcccggaccgaagauuaaaggcuucgacgcccaucuccuggagaagggaaagagcgaagaacugcucuccgcucuggggugccaggauuuuccucccacaagcgacuaugaggaucuucugguggaauaccucgaggucgacgauucugaagaccagcaccugauguccguucauagcaaagagcacccuucucaaggcaugaagcccaccuaucuugaucccgacacagacuccggcagagggagcugugauucuccuucccugcucagcgaaaaaugcgaggagccgcaggccaaccccuccaccuucuacgacccugaagugaucgagaagcccgaaaauccugagacgacacacaccugggauccccaguguauuucuauggaaggaaaaaucccguacuuucaugcuggcgggagcaagugcuccacauggccucugccccagccuagccaacacaacccccggucuuccuaucauaauaucaccgacgugugugagcuggccgucggaccugcgggcgcccccgcuacccuccugaacgaggccgggaaagaugcucuuaagagcucucagacaauuaagagccgcgaagagggaaaagccacgcagcaaagagaaguggaguccuuccacucugaaaccgaccaggauacaccguggcugcucccucaggagaagacccccuuuggcagcgccaaaccccuggacuacguugagauccacaaggugaauaaagauggcgcucuuucccugcucccuaagcagcgggaaaacagcgggaagccgaaaaagcccggaacaccugagaauaacaaagaauaugcgaaggucucuggcgugauggacaauaacauucugguucuggugcccgauccucaugccaaaaaugucgcuugcuucgaggaguccgccaaggaagcucccccuagccucgagcaaaaccaggccgaaaaggcccuggcgaacuucaccgcuacgucuuccaaaugucgccuucagcucgggggacuggacuaccuggaccccgccugcuuuacacacagcuuccauuga

SEQ ID NO: 74244 - RNA, 156 nt, Artificial Sequence
  derived and/or modified sequence opt5 from PRM1__Homo_sapiens__NP_002752
auggccagauaccggugcugucgcagccaguccagaucucgguauuaccgccaaagacagcggagccgcagacggcgcagacgguccugccagacccgcagacgggcuaugcgcuguugcagaccccgguauagaccucgcugucggagacacuga

SEQ ID NO: 74245 - RNA, 423 nt, Artificial Sequence
  derived and/or modified sequence opt5 from PRM2__Homo_sapiens__NP_001273285
auggugagauaccggguccgcagccuguccgagagaucucacgaaguuuaucggcagcaacuccauggccaggagcaggggcaccauggacaggaggaacaaggccugagccccgaacacguggagguguacgagcgcacccaugggcagucccacuauagacggcgccacugcucuagacggcgccuucauagaauccaccggcgccagcauagaagcugucggcgcagaaagcggagauccugccgccaccggagacgccaccggagagaaucucugggagacccucucaaccagaauuuccugagccaaaaagccgcugagccgggccgcgaacaugccgaggggacaaaacuucccggaccucugacgcccuccuggaagcucagaaagagccggccuaaacaccagguccgccccuga

SEQ ID NO: 74246 - RNA, 312 nt, Artificial Sequence
  derived and/or modified sequence opt5 from PRM3__Homo_sapiens__NP_067070
augggcagcagaugcgccaagcugaacaccgggcagucccccggacacucuccuggccauagcacagggcacggacggggccaugaguccucuaugaaaaagcucauggcuugugugagccaagacaauuucucccugucuagcgccggggaagaggaagaggaagaggaggaagagggagaagaggaggaaaaagaggaacuuccgguccagggcaagcugcuccugcuugagcccgaacgccaggaggagggccacaaagauaacgcggaagcucagcaauccccugagcccaagagaacgccuagcuga

SEQ ID NO: 74247 - RNA, 1116 nt, Artificial Sequence
  derived and/or modified sequence opt5 from PRMT1__Homo_sapiens__NP_001527
auggccgcugccgaggcggcuaacugcaucauggaaaauuucguggccacccuggccaacggcaugagccuccagcccccucuggaggaagucuccugugggcaagcugagucuagcgaaaagccgaaugccgaggacaugacauccaaagauuacuauuuugacucuuacgcucacuucggcauucaugaggaaaugcuuaaggaugagguuagaacgcugaccuaucggaacagcauguuucacaaucgccaucucuucaaagacaagguggugcuggaugucggauccgggacaggaauccuuugcauguuugccgcgaaagccggcgcuagaaaggugauugggaucgaauguucuagcauuuccgacuacgccguuaagaucgugaaagcuaacaagcuggaucacgucgugaccaucauuaaaggaaagguugaggagguggaacuccccgucgagaaaguggacaucauuaucagcgaauggaugggcuauugccuguucuacgagucuaugcugaauacagugcucuaugcccgggauaaguggcuggcgccugacggccuuauuuuucccgaucgcgccacccuguacgucacagcuaucgaagacagacaguacaaggauuauaaaauucauuggugggagaacguuuacggguucgacauguccuguaucaaggacguggccaucaaagagccucucguggaugucguggaccccaagcagcugguuaccaaugcuugccuuauuaaagaaguggauaucuauacggucaagguggaggaccugaccuuuacaagcccuuucugucuccagguuaaacggaacgauuacgugcacgcccuggucgccuauuuuaauauugaguucacccgcugccacaagagaacaggauuuucuaccuccccggaaagccccuacacgcauuggaagcaaacaguguucuauauggaagacuaccugaccgucaaaacaggcgaggagaucuucgggaccauuggaaugcggccuaacgcuaagaauaaccgcgaucucgacuuuaccaucgaucuggacuucaaaggccagcuuugugaacugucuugcuccacagauuacagaaugcgguga

SEQ ID NO: 74248 - RNA, 996 nt, Artificial Sequence
  derived and/or modified sequence opt5 from PRMT2__Homo_sapiens__NP_001229793
auggccaccagcggcgacugccccagauccgagucucagggggaggaaccugcugaauguagcgaggccggacugcuccaagaaggcgugcagccggaggaguucgucgcgaucgcugauuacgccgccacagacgaaacgcagcuguccuuucuucggggcgagaagauucugauccuccgccagaccacagcugauuggugguggggagaaagagccggcugcuguggguauauucccgcuaaccacguuggaaaacauguggacgaguacgauccugaggacaccuggcaagaugaagaguauuucggcucuuacggcacacugaaacuucaccuggaaaugcucgccgaccagccccggaccacaaaguaucauagcgugauccugcagaauaaggagucccugaccgauaaagucauucucgacguggggugcggaacgggcaucaucucucuguuuugugcgcacuacgcccgcccuagagcuguuuaugccguggaagcuagcgagauggcccagcauaccgggcaacuuguccugcagaacggauucgcggauauuaucacaguguaccagcagaagguugaggacgugguccuccccgaaaagguggaugugcuggucuccgaguggauggggaccugccuucugacacuccgcggggaacugcgguuugacauuagaaaagccggaacccugcacggcuucacggcuugguuuagcguucacuuccaaucucuccaggagggccagccuccgcaagugcuguccacagggcccuuucauccuaccacacacuggaagcagacccuuuucaugauggacgaucccgugccuguccauaccggagacgugguuacaggcagcgugguccugcagcggaaucccguguggcgcagacacaugucuguugcccucuccugggcugugacgagccggcaggauccgaccucucaaaaagucggggaaaagguguuuccuaucuggcgcuga

SEQ ID NO: 74249 - RNA, 1410 nt, Artificial Sequence
  derived and/or modified sequence opt5 from PRMT3__Homo_sapiens__NP_001138638
augugcagccuggccuccggcgcuaccggguacucucaccuccugaagaaacauuuccacacagugagccuuuccaucucucugauucucacggccugguuuaucaacaugaaucccaccgucgaguauaugaacagcauuuacaauccuguuccgugggaaaaggaggaauaucugaaacccgugcuugaggacgaucugcuccugcaguucgacguggaagaucuguacgagccugucuccgugcccuuuucuuauccuaacggacucagcgagaauacauccguuguggaaaagcugaaacauauggaggcgagagcucuuagcgccgaagccgcucuggcccgggcucgcgaggaccuccaaaagaugaagcaguucgcccaggauuuugucaugcacaccgacgugagaacauguucuuccagcaccucuguuaucgcggaucugcaggaggacgaagauggcguguacuucuccagcuaugggcauuacggcauucacgaggaaaugcuuaaagacaagauccggacagagucuuaccgcgauuuuaucuaucaaaacccccacauuuucaaagacaaggucgugcuggaugugggaugcgggaccggaauccucuccauguuugccgcuaaagccggcgcuaagaagguccugggcguugaccagagcgaaauucuguaccaggccauggacaucauuagacucaauaaacuggaggauacgaucacccuuauuaaggggaaaaucgaggaagugcaucugccuguggagaaggucgacgugaucauuuccgaauggaugggauauuuccuccuguuugagucuaugcuugauagcguucuguacgcgaaaaacaaguaucucgccaaaggcggguccguguacccggacaucuguacaauuagccuggucgcugugucugauguuaauaagcacgccgaccggaucgcuuucugggaugacguguauggauuuaagauguccugcaugaaaaaggccgucauucccgaagccguggucgaggugcuggauccuaaaacccucaucagcgagcccuguggcaucaagcauauugacugccacacaaccucuaucagcgaucuggaguucuccucugacuucacgcuuaaaauuacacgcaccagcauguguacagcuaucgcgggguacuuugacauuuacuucgaaaagaacugccacaauagaguuguguuuuccaccggaccucagagcaccaagacacauuggaaacaaacggucuuccugcucgaaaagcccuuuucugugaaagccggcgaggcucugaagggcaaaguuaccgugcacaagaacaagaaagauccgcggucccuuacagucacccugacacucaauaacagcacccagacguaugggcugcaguga

SEQ ID NO: 74250 - RNA, 1863 nt, Artificial Sequence
  derived and/or modified sequence opt5 from PRMT5__Homo_sapiens__NP_001034708
augagaggccccaacagcgggaccgagaagggacggcuggugaucccugaaaaacagggcuucgacuuucucugcaugccggucuuccacccccgcuuuaagagagaguucauucaagaaccugccaaaaaucggcccgggccucagacacgcuccgaucugcuucugucuggaagagacuggaacacgcucaucguuggcaagcugagccccuggauucggccugauuccaaaguggagaagauccgcagaaauucugaagcugccaugcuucaggagcugaacuuuggggcguaccucggacugccggcuuuccugcucccccugaaucaggaggacaacaccaaucuugcccgggugcugacaaaccauauucacaccggccaucacagcuccauguuuuggaugcgcgucccucucguggcccccgaagaucugagagacgauaucaucgagaaugcuccuacaacccauacagaagaguauucuggcgaggaaaagaccuggaugugguggcacaacuuccggacgcuuugugacuacagcaaacgcauugccguugcucuggagaucggggccgaucuccccuccaaucacgugauugacagauggcugggagaaccgaucaaggcggccauucugccuaccagcaucuuucucacaaacaaaaagggcuuccccguccugucuaaaaugcaucaacggcuuauuuuucgccugcucaagcuggaggugcaguucaucaucaccgggacaaaucaccauuccgaaaaggaguuuugcagcuaucuucaguaccuggaguaucucucucagaacagaccuccucccaaugcuuacgaacuguucgccaaaggauaugaggauuaccugcaaagcccccuccagccgcugauggacaaccuugaaucccagaccuacgagguuuucgaaaaggaucccauuaaauauucucaguaccaacaggcuaucuauaagugucugcucgaccgggugccugaggaggaaaaagacacgaacguccaggugcugauggugcuuggcgccgggagaggaccccuggucaaugcgucccuccgcgccgcuaagcaagccgaucggagaauuaaacuguacgcuguugagaagaacccuaaugccguggugacacuggaaaacuggcaguuugaggaauggggcagccaggucaccgugguuuccucugacaugcgcgaguggguggcccccgagaaggcugauaucauugucagcgaacuccugggcuccuucgcggacaaugagcuuagcccggaaugccuggauggggcccagcacuuucucaaagacgauggagugucuaucccuggcgaguauacauccuuccuggcucccaucagcucuagcaagcuguacaacgagguucgggccuguagagaaaaagaccgcgauccugaggcccaauuugaaaugcccuaugugguccggcuucacaauuuccaucagcucuccgcuccucagcccugcuuuaccuucucucacccgaacagagacccuaugauugauaauaaccgcuacuguacccuggaguuucccguggaagucaauacagugcugcauggguucgccggauacuuugagacgguucucuaucaggacaucacccugagcauucggcccgagacacacuccccuggcauguucagcugguuuccgauccuuuuccccauuaagcaaccuaucaccgugagagaagggcagacaaucugcguccgcuucuggcgguguucuaacuccaaaaaggugugguacgagugggcgguuaccgcucccgugugcagcgccauucauaauccuacgggaagaucuuauacaaucggccuguga

SEQ ID NO: 74251 - RNA, 1158 nt, Artificial Sequence
  derived and/or modified sequence opt5 from PRMT8__Homo_sapiens__NP_001243465
auggagagccuggccuccgacggcuucaagcucaaagaagugucuagcgucaacucucccccuucccagccgccccaaccuguugugcccgcuaagccugugcagugcguccaccaugugagcacccagcccuccuguccugggagaggaaaaaugucuaagcugcuuaauccggaggaaaugacaagccgggauuacuauuuugacuccuacgcccacuucggcauccaugaggaaaugcugaaagaugagguucgcacgcucaccuauagaaacagcauguaccacaauaagcauguguuuaaggacaaagucgugcuggauguugggucuggaacaggcauucuuuccauguucgcggcuaaggccggggccaaaaagguguuuggaaucgagugcagcucuauuuccgacuauagcgagaaaaucauuaaggcuaaccaccuggauaauaucaucaccauuuucaagggcaaagucgaagaaguggagcuccccguggagaaggucgacaucauuaucucugaauggaugggcuacugucuguuuuaugaguccaugcugaacacaguuauuuucgcccgggauaaauggcucaagccugggggacugauguuucccgaccgcgcugcccuuuacgugguggcgaucgaagauagacaguacaaagacuucaagauucacuggugggagaaugucuauggcuuugauaugaccugcauccgggacguggccaugaaagaaccucugguugacaucguggaucccaagcaagucgugacaaacgcuugucucauuaaggagguugacaucuacaccgugaaaacggaggaacugagcuucaccuccgccuuuugccuucagauucagcgcaaugauuauguccaugcucuggugacauacuucaacaucgaguucaccaagugucacaaaaagaugggguuuucuacagccccggacgcgccuuauacccauuggaaacagacggucuucuaccucgaagauuaucugacagugagacggggagaggaaauuuacggcaccaucagcaugaagcccaaugccaagaacguucgcgaccuggauuuuacaguggaccucgauuucaaagggcaacugugcgagaccuccgucagcaaugacuacaagaugagauga

SEQ ID NO: 74252 - RNA, 531 nt, Artificial Sequence
  derived and/or modified sequence opt5 from PRND__Homo_sapiens__NP_036541
augagaaagcaccugagcuggugguggcucgccaccgugugcaugcugcuuuucucccaucugucugcuguccagacacggggcaucaaacaccgcauuaaguggaacagaaaagcccuccccagcacggcgcaaaucaccgaggcucagguugccgaaaaucggccuggggccuuuauuaagcagggacgcaaacuggacaucgauuucggcgcugaggggaacagauacuaugaagccaauuacuggcaguuuccggacggcauucauuauaacggauguuccgaggcuaaugugacaaaggaagccuucgugaccgggugcaucaacgcgacacaagccgcuaaucagggagaguuucagaagcccgauaacaaacuucaccagcaaguccuguggcggcucgugcaggagcuguguucucugaagcauugcgaguucuggcucgaacgcggcgccggccugagaguuaccaugcaccagccugugcuucugugucuccuggcucuuaucuggcugacagucaaauga

SEQ ID NO: 74253 - RNA, 762 nt, Artificial Sequence
  derived and/or modified sequence opt5 from PRNP__Homo_sapiens__NP_001073592
auggccaaccugggcugcuggaugcucgugcuguucgucgcuaccuggagcgaccuugggcuguguaagaaaagacccaagccuggaggcuggaauacagggggaucccgguacccgggccaggggucucccggaggcaaccgcuauccuccccaaggcgggggaggcugggggcagccucacggaggcggguggggacagccccauggcggcggguggggacagccucacggcgggggauggggccaaccgcaugggggaggcuggggccaagggggaggcacgcacagccaguggaauaaacccuccaagccuaaaaccaacaugaagcauauggccggggcggcugccgccggagcuguugugggcgggcucggcggauacaugcugggcucugccaugagcagacccaucauucacuuuggguccgauuaugaggaccgguacuaucgcgaaaauaugcacagauacccuaaccagguguauuaccggcccauggaugaguacucuaaucaaaacaauuucguccaugacugcgugaacaucacaauuaagcagcacaccguuacaaccacaaccaaaggagaaaauuuuacggagaccgaugugaagaugauggaacgcgucguggagcagauguguaucacacaguaugagagagaaagccaggcuuacuaucagcggggcuccagcaugguucuuuucucuuccccgccugugauucugcucaucagcuuucugaucuuccugauugucggguga

SEQ ID NO: 74254 - RNA, 1386 nt, Artificial Sequence
  derived and/or modified sequence opt5 from PROC__Homo_sapiens__NP_000303
auguggcagcugaccagccuccugcuuuucguggccacauggggcaucuccgggacgcccgcuccucuggacucugucuuuagcuccucugagagagcccaccagguucuccggauucgcaagagagcgaacagcuuccuggaggaacuucggcauuccucucuggaacgcgagugcaucgaagagauuugugauuuugaggaagcuaaagagaucuuccagaauguggacgauacccucgccuuuuggagcaagcacguggacggagaucagugccugguccugccgcucgaacaucccugugccucccugugcuguggccacgggacaugcauugacggaaucggcagcuucucuugugauugcagauccgggugggagggacgguuuugucagcgcgaggugagcuuccuuaacugcucucuggacaauggcggcuguacccauuacugccucgaagagguuggguggagacggugcuccugugcuccuggauauaaacugggcgaugaccuucugcaaugccaccccgccgugaaguuuccuugugggcgccccuggaaaagaauggaaaagaagcggagccaccucaaacgcgauacagaggaccaggaagaucaggucgacccuagacugaucgacggaaagaugacccggcgcggcgauucuccguggcaagugguucugcucgacuccaaaaagaaacuggcuugcggggccgugcuuauucaucccagcuggguccugacagcggcccacuguauggaugaguccaagaagcuccuggugagacuuggagaguacgaccugcggagaugggaaaaaugggagcucgaucuggacaucaaggaaguguucguccauccuaacuauucuaaaagcaccacggauaaugacauugcucugcuccaccuggcccagcccgcuacccuuucccagacaaucguuccuauuugccugcccgauagcggccucgccgagcgcgaacugaaccaggcgggccaggagacccuugugacaggguggggauaccacucuucccgggagaaggaagccaaaagaaaucgcaccuuugugcugaacuucaucaagauuccggucgugccucauaaugaguguagcgaaguuaugucuaacauggugagcgagaauaugcucugcgcuggcauccugggggaccggcaagaugccugugaaggagacuccggcgggcccauggucgcuucuuuucacggaacgugguuccuggugggccucguuagcuggggcgaggggugcggacugcuucauaacuauggcguguacacaaaagucuccagauaucuggacuggauccacgggcauauucgcgauaaggaggccccucaaaagagcugggcccccuga

SEQ ID NO: 74255 - RNA, 717 nt, Artificial Sequence
  derived and/or modified sequence opt5 from PROCR__Homo_sapiens__NP_006395
augcugaccacacuccugcccauccuucugcucagcggcugggccuucugcucccaggacgcuucugaugggcugcaaagacuucacaugcugcagauuagcuacuuucgggacccuuaucaugugugguaccagggaaacgccucccucggcgggcaccugacgcauguccuggagggaccggauaccaauacaaccaucauucagcuccaaccccugcaggaaccugagucuugggcgcgcacacagagcggccuucaguccuaucugcuccaauuccacgggcugguuagacuugugcaucaggaacggacccuggcuuuuccccucacaauccgcuguuuccugggaugcgagcugccucccgaaggcucuagagcccacguguuuuucgaggucgccgugaacggcagcuccuuuguuagcuuccggccugagcgcgcucucuggcaggccgacacccaggugacgucuggggucgugaccuuuacacugcaacagcuuaaugcuuacaacagaacccgguaugaacugcgcgaguuccucgaagauacauguguucaguacgugcaaaagcacauuuccgccgagaauaccaaaggaagccagacgucuagauccuauacaagccugguccuuggcgugcugguggggucuuuuaucaucgcgggagucgccguuggcauuuuccucugcaccgggggacggcgcuguuga

SEQ ID NO: 74256 - RNA, 1230 nt, Artificial Sequence
  derived and/or modified sequence opt5 from PRODH__Homo_sapiens__XP_011528580
auggccguggcuagaaucagcggcaccuccaacacacggcccacggggccuucuggaaccgccggcauggucagcuccguuccggcgcccacaucuaccccuaugcgccccagcgcuacagccaccuggagacacuccugcgccgcuucuaagccucagcugcaauucagcgaggugcucgccaaauggcggugcuuuuuccaucagauggcuguggaacaggggcaggccggacuggcggccauggacacaaaacuugaggucgcugugcugcaagaauccguugccaagcucggcauugcuagccgcgccgagaucgaagauugguuuaccgcggagacgcugggggugucuggaaccauggaccuucuggauugguccagccucauugacucuagaacaaagcuguccaaacaccuggucgugcccaaugcccagaccggccagcucgagccucugcuuagccgguucacagaagaggaggagcugcagaugacccgcaugcuccaaagaauggauguucuggcuaagaaggccacggagaugggcgugcggcuuauggucgacgcugaacagacauacuuucagccggccaucucucgccugacccucgagaugcagagaaaauucaacguggaaaagccccugauuuuuaauacauaucaauguuaccugaaagaugccuaugacaacgugacccucgaugucgagcuggcucggcgcgaagggugguguuucggagcgaaacuuguuagaggcgccuaccuggcucaggagcgggcccgcgccgcugagaucggguaugaagacccuaucaaucccaccuacgaggccacaaacgcgauguaucauagaugccucgauuacgugcuggaggaacuuaagcacaaugcuaaggccaaggugauggucgccucccauaacgaagacacggugcgguuugcucugagacgcauggaggagcucggacugcacccugccgaucaccggguuuacuucggccagcugcucgggaugugugaccaaauuagcuuuccccugggacaggcuggcuauccgguguacaaauaugucccuuacggccccgugauggaaguucuuccuuaucuguccagacgcgcccucgaaaauucuagccugaugaaggggacccaucgggaaagacagcuucuguggcucgagcugcugcgccggcucagaacaggaaaccuguuccaccgccccgcguga

SEQ ID NO: 74257 - RNA, 390 nt, Artificial Sequence
  derived and/or modified sequence opt5 from PROK2__Homo_sapiens__NP_001119600
augagaagccugugcugugccccucuccugcuucugcuccugcuuccuccgcugcuccugacccccagagcuggcgacgccgcggugaucacaggggcuugcgauaaggacucccaguguggaggcgggaugugcugugccgucucuauuuggguuaaaagcauccgcauuugcacgccuaugggaaagcugggcgauuccugucacccccucacccggaaaaacaauuucgggaacggacggcaagagcgcagaaagcggaaacgcucuaagagaaagaaagaagugcccuuuuucggccggcgcaugcaucacacaugccccugucugccuggccuugccugccugagaaccagcuuuaaucgguucaucugucucgcucagaaguga

SEQ ID NO: 74258 - RNA, 1182 nt, Artificial Sequence
  derived and/or modified sequence opt5 from PROKR1__Homo_sapiens__NP_620414
auggagaccacaaugggcuucauggacgauaacgccacgaauaccagcacauccuuucugucugugcucaacccccacggggcucaugccaccagcuucccuuuuaauuucuccuacucugacuaugauaugccgcuggacgaagaugaggacgucacaaacagcagaaccuuuuucgcggcuaagaucguuauuggaauggcccuugugggcaucaugcuggugugcgggauuggaaauuuuaucuucauugccgcucucguccgguacaaaaagcugcgcaaccuuacaaaucugcucaucgccaaccuggcuaucuccgauuuucugguggccauuguuuguugccccuucgaaauggacuauuacguggucagacagcucucuugggagcacggccaugugcuguguaccagcguuaauuaucuucggacggugucccuguacgucagcaccaacgcgcuccuggccaucgcuauugaucgcuaucuugccaucgugcacccucugagaccccggaugaaaugccaaacagcuaccgggcucauugcccugguguggacagucucuauccugauugcgaucccuuccgccuacuuuaccacggaaacaguucucgugaucgucaagagccaggagaaaauuuucuguggacagaucuggcccguggaccagcaacuguacuauaagucuuacuuucuuuucauuuucggcaucgaguuugugggcccuguugugaccaugacacugugcuaugcucgcauuuccagagaacucugguucaaggccgucccgggguuucagaccgagcagauccggaaacgccugagaugucggcgcaagaccgugcuuguucugaugugcauccucacagcuuacgugcuguguugggcccccuucuauggauuuacgauugucagagauuucuuuccuaccguguucgucaaagaaaagcauuaccugacagccuuuuauaucguggagugcauugcuaugagcaauucuaugaucaacacccucuguuucguuacagugaaaaaugacaccgucaaguacuuuaagaaaauuaugcugcuucacuggaaggcguccuacaacggcgggaaaagcuccgccgaucuggaccucaagacgaucggaaugcccgcuacagaggaaguggacugcauccggcugaaauga

SEQ ID NO: 74259 - RNA, 1155 nt, Artificial Sequence
  derived and/or modified sequence opt5 from PROKR2__Homo_sapiens__NP_658986
auggccgcucagaacggcaauaccagcuucacacccaacuuuaauccuccgcaagaccacgccuccucucugagcuucaacuuuuccuacggggauuaugaccuccccauggaugaggacgaagauaugacgaagaccagaacauucuuugcggcuaaaaucgugauuggaaucgcccuggccggcauuaugcuugucugcgggaucggaaauuucguuuuuauugcugcccugacccgguacaagaaacuccgcaaccugacaaaucuucugaucgcuaaccucgccaucucugacuuccugguggcgauuaucuguugcccuuuugagauggauuauuacguggucagacagcugagcugggaacauggccacgugcucugugccuccguuaauuaucugcggaccgugucucuuuacgucagcacaaacgcucugcucgccauugcuaucgaccgcuaucuggccauugugcauccccuuaagccuagaaugaauuaccagaccgcguccuuccugaucgcccucguuuggauggugagcauucugaucgcuauccccucugccuacuuugcuacggagaccguccuguucauugugaaaucccaggaaaagaucuuuugcgggcaaauuuggccuguggaucagcagcucuauuacaagagcuauuuccuguucaucuuuggagucgaguucguuggcccgguggugacaaugacccuuuguuacgcccggauuucucgcgagcugugguuuaaagccguccccggcuuccagacagaacaaaucagaaagcggcuccgcugcagacggaaaaccgugcugguucuuauguguauccugacggcuuaugugcucugcugggcgccuuuuuacggguucacaauuguccgcgacuuuuuccccaccguguuuguuaaggagaaacacuaucugacagccuucuacguggucgaauguaucgcuauguccaacagcaugauuaauaccgugugcuuugucaccgugaagaacaauacaaugaaguacuucaaaaagaugaugcugcuccauuggagaccuucucagcggggauccaaaagcuccgccgaucuggaccuucgcacgaacggcguucccaccacagaggagguggauuguaucagacugaaguga

SEQ ID NO: 74260 - RNA, 747 nt, Artificial Sequence
  derived and/or modified sequence opt5 from PROL1__Homo_sapiens__NP_067048
augaagcugaccuucuuucucggccugcuugcccugaucagcugcuucacacccuccgagucucagagauuuagccggcgcccuuaccucccggggcaacugcccccucccccucuuuauagaccccggugggugccuccgucucccccucccccuuacgacucucgccugaacagcccccucucccugccguucgucccuggaagaguucccccuucuagcuuuucccgguucagccaggcugugauucugucucagcucuuuccccuggaauccauccgccagcccagacuuuucccuggcuauccgaaucugcacuuuccccuccggccuuacuauguggggcccauucgcauccugaaaccucccuucccgccuauucccuuuuuccuugccaucuaccugccuaucagcaaccccgagccucaaauuaauaucacgaccgcggauacaaccauuacaaccaaucccccgacaaccgcuacggccaccacaucuaccuccacaaagccuaccaugacgaucagcuccuccacaguccccauuagcuccacccccgaaccugccacaucuaucagcgcugccaccccggcugccuccaccgagaacacaacgcagauucucgcgaacagaccccauaccgugcugcugaaugccacaguucaggugaccacaagcaaccagaccauccucucuuccccugcuuuuaagagcuucuggcaaaaacuguucgccaucuuuggauga

SEQ ID NO: 74261 - RNA, 2571 nt, Artificial Sequence
  derived and/or modified sequence opt5 from PROM1__Homo_sapiens__NP_001139319
auggcccuggugcucggcagccugcuucugcucgggcugugcggaaacuccuucucuggcgggcagcccagcuccaccgacgcuccuaaggccuggaauuacgagcuuccggcgacaaacuaugaaacgcaagauucucacaaagcuggacccaucggcauucuguuugagcucguccauaucuuccuguacguugugcagccuagagacuuucccgaagauacccugcggaaguuccuccagaaagccuaugagagcaagauugacuacgauaaaaucguguauuacgaagccgggauuauccuguguugcguccuuggacugcucuuuaucauucugaugccucuugugggcuauuucuuuuguaugugccgcuguugcaauaaguguggcggggagaugcaccagagacaaaaggagaacggacccuuccugcggaaaugcuuugcuaucucccuccugguuauuuguaucauuaucucuauuggcaucuucuacggguuuguggccaaucaucagguccgcacaagaaucaagcggagccgcaaacuggcugacuccaacuucaaggaucucagaacccugcuuaaugaaacaccugagcagauuaaauacauccuggcccaguauaacaccacaaaggacaaggcguuuaccgaucucaauagcauuaacucugugcugggaggcgggauccuugaccggcugcgcccgaauauuauccccguucucgaugaaaucaaauccauggccacggcuauuaaggagaccaaagaggcccuggaaaacaugaauagcacacugaagucucuccaccaacaguccacccagcugucuagcucccuuacaagcgugaaaaccucccugagaucuagccucaacgacccucugugccuuguccaucccuccagcgagacguguaauucuauccggcugucccucagccagcugaacucuaacccugaacugcgccaacugcccccgguggaugcugagcuggacaaugugaacaauguccuuagaacagaccuggauggacucguucagcagggcuaccaaagccugaacgacauuccugaucgggugcagcgccagaccacaaccguggucgccggcaucaagagagugcucaauuccauugggucugacaucgauaacguuacccagcggcuucccauccaagacauucucagcgcguucuccguguaugucaauaacacagaaagcuacauccacagaaaucugccuacgcuggaggaguaugauucuuacugguggcucggaggccuggugauuugcucccuucugacccucaucguuauuuucuauuaccuggggcugcuuugcggaguguguggcuacgaccgccacgccacacccaccacacgggggugcgucagcaacaccggaggcguguuucucauggucggcguggggcugucuuuccuguuuuguuggauccucaugauuaucguugugcugacguucgucuuuggagcuaauguggaaaaacuuaucugcgagcccuauacauccaaggaacuguucagaguucucgauaccccuuaccugcugaacgaggacugggaauauuaccuuagcggcaagcucuuuaauaaauccaagaugaaacugaccuucgaacagguguauucugauuguaagaaaaaccgcgggacauacggaacccugcaucuccagaauagcuuuaacauuuccgagcaccugaacaucaaugagcauacaggcucuauuagcuccgagcuugaaagccugaaggucaaccucaauaucuuccugcugggggccgcuggccggaagaaccuucaggacuuugccgccugcggaauugacagaaugaauuaugauucuuaccucgcucaaacgggcaaauccccggcgggggugaaccugcugagcuucgccuacgaccucgaggcuaaggccaauucucugcccccuggaaaccuucgcaauucccugaaacgggaugcccagaccaucaagacaauccaccagcagagagugcuccccauugaacaaagccugucuacccuguaucagagcguuaaaauccuucagcgcacaggcaacgggcugcucgagcgggucacccgcauucuggcuucccucgacuuugcccagaauuucaucacgaacaauaccagcucugugauuaucgaggaaacaaagaaguacggaagaaccaucauuggcuauuucgagcacuaccugcaauggaucgaauuuuccauuagcgagaaaguggcguccuguaagccugucgcuacagcccuugauaccgccguggacguuuuccugugcucuuauaucauugauccccucaaccuguuuugguucgggaucggcaaagcuacgguguuucugcuuccggcccugaucuucgcugucaagcucgccaaauacuaucggagaauggacagcgaggauguguacgacgauguugaaacaauuccuaugaagaauauggagaacggaaacaauggcuaccauaaggaccacguguaugggauccauaaccccgucaugaccuccccuucucagcacuga

SEQ ID NO: 74262 - RNA, 2505 nt, Artificial Sequence
  derived and/or modified sequence opt5 from PROM2__Homo_sapiens__NP_001159449
augaagcacacccuggcccuccuggcuccccuucugggccucgggcugggacuugcccugagccagcucgcggcuggcgccacagacugcaaauuccuggggccugccgagcaucugacguuuaccccggcugccagagcucgguggcucgcccccagagugagagcgccuggacugcuugauucccuguacggcacaguccggcgcuuccucucuguugugcaacugaaccccuuuccuagcgaacuugugaaggcccugcucaaugagcuggcuuccgucaaagugaacgaaguugugagauaugaggccggguacgucgugugugcuguuaucgccggacuguaucuccugcuugugcccaccgcgggccugugcuucuguugcugucggugccaccgcagauguggcgggcgggucaagacagaacauaaagcccucgcuugcgagcgcgccgcucugaugguguuucuucugcucaccacacugcugcuccugauuggaguggucugugccuucguuaccaaucagagaacgcacgagcagaugggcccuucuaucgaagccaugccggagacccuucugagccucugggggcugguguccgacgugccccaggaacuucaagcugucgcgcagcaguuuucucugccucaggagcaagugagcgaggaacucgauggaguuggcguguccauugggagcgccauccauacacagcugcggucuuccgucuacccccugcucgcugccgugggaagccugggccagguucuucaggugucuguccaccaucugcaaacccucaacgccacaguggucgagcugcaggcuggccagcaagaccuggaaccugccauucgcgagcacagagaucggcuucucgaacugcugcaggaggcgcgcugccagggggacugugcuggagcccucuccugggccagaacccuggagcuuggcgcugauuucagccaggugcccucuguugaccacgugcugcaucaacucaagggggucccggaagccaauuuuuccagcauggugcaggaggaaaacuccacguucaaugcucugccugcccuggcggccaugcagacaucuagcguugugcaggagcuuaagaaagcugucgcccaacagcccgaaggagugcggacccucgcugagggcuuuccugggcuggaggccgcguccagaugggcccaggcucugcaggaaguggaggaaagcucucgccccuaucuccaagagguucagcgguacgaaacauauagauggaucgucggaugcgugcugugcuccgugguccuuuucgugguucuguguaaccuccugggccugaaucuuggcaucugggggcucagcgcccgcgaugaccccucucacccugaggcuaagggagaggccggcgcccgguuucugauggcuggggugggacugagcuuccucuucgcggccccgcugauucuucuggucuuugcuaccuuccucgugggcgggaacguucagacccuggugugccaguccugggaaaauggcgagcuguuugaguucgccgauacacccggaaaccuuccucccucuaugaaucucagccaacugcugggccucagaaagaacaucuccauucaccaggccuaccagcaauguaaggaaggggcugcccuguggacgguccuucagcugaaugacagcuacgaucucgaggaacaucuggacaucaaccaguauaccaacaaacugcgccaggagcuucaaucucugaagguggacacacagucccucgaucugcucagcucugcggcucggagagaccuggaagcccuucaguccagcggacugcagcgcauucacuacccugauuuucucguucaaauccagcggcccguggucaagaccuccauggagcagcuggcccaggaacugcaaggccuugcucaggcccaggacaauucugugcuggggcaaagacuccaggaggaggcgcagggacugcgcaaccuccaucaggaaaaaguggucccgcaacagagccugguugcuaaacuuaaucuguccgugcgggcccucgagucuagcgccccuaaccugcagcuggaaacauccgaugugcuugcuaaugucaccuaucugaaaggcgagcuccccgccugggcugcccgcauucugcggaacgugagcgaaugcuuccucgcgcgcgagaugggguacuuuucucaguauguugccugggugagagaggaagucacgcaacggaucgcuacaugucagccucuguccggcgcccuugacaauagcagagugauccugugcgauaugauggcugaccccuggaacgccuucugguuuugucuggccuggugcaccuucuuucucauuccuucuaucauuuucgcuguuaagaccuccaaauacuuucgccccauccggaagagacugagcucuacaagcuccgaggaaacccagcuuuuccacauuccgcgcgugacaagccugaaacucuga

SEQ ID NO: 74263 - RNA, 681 nt, Artificial Sequence
  derived and/or modified sequence opt5 from PROP1__Homo_sapiens__NP_006252
auggaggccgaaagacggcgccaggcugagaagcccaaaaagggcagaguggggagcucccugcucccugaacggcacccggccaccggaacacccacgaccacagucgacucuagcgcgccucccugccgcagacugccuggcgcugggggaggccggucccgcuucucuccccaagggggacagagaggccggccucauagccgcagacggcaccgcaccacauuuuccccgguucagcuugagcagcuggaaucugccuucggcagaaaccaauaccccgauauuugggcccgggagagccucgcucgcgacaccgggcuguccgaggccagaauccaggugugguuucagaaucggagagcuaaacagcgcaagcaagaacggagccuucugcagccucucgcccaucugucucccgcggccuucuccagcuuucugccugagucuacagcuugucccuauuccuacgccgcuccgccucccccugugaccugcuucccccaccccuauagccaugcccucccuucucagccguccacgggaggcgcguuugcccugagccaccaguccgaagauugguaccccacccuucacccugcucccgccgggcaucugccuugucccccgccucccccuaugcucccccugucucuugagccuagcaaauccuggaacuga

SEQ ID NO: 74264 - RNA, 2031 nt, Artificial Sequence
  derived and/or modified sequence opt5 from PROS1__Homo_sapiens__NP_000304
augagagugcugggcgggcggugcggagcccuccuggcuugucuucugcucguccugcccguuagcgaggccaacuuccuuuccaagcagcaagcgucucaggugcuggugcgcaaaagacgggcuaauagccuccuggaagagacaaagcagggcaaccuggaacgcgagugcaucgaggaacucuguaauaaagaggaagccagagaggucuuugaaaacgacccugagacagauuacuucuauccgaaguaccuggugugccuucgguccuuucagacggggcuguucaccgccgcucgccaaucuacaaaugccuaucccgaccucagaagcuguguuaacgcuauuccugaucagugcucuccccugccuuguaaugaggacggauacauguccugcaaagauggcaaggccagcuuuaccuguacaugcaagcccggguggcagggagaaaaaugugaguucgacaucaacgaaugcaaggauccuuccaauauuaacggcggcugcagccagaucugugacaauaccccggggucuuaucacugcuccuguaaaaacggauuugugaugcuuagcaauaagaaagauugcaaggacgucgaugaguguucucugaagcccuccauuugcggcacagcgguguguaaaaacaucccuggggacuucgaaugcgagugucccgagggauaccgguauaaucucaagagcaaaucuugcgaagauaucgacgaguguuccgaaaacaugugcgcccaacugugcguuaacuacccuggcggguacaccuguuauugcgacggaaagaaaggcuuuaagcuggcucaggaucagaaaagcugugagguggucuccgugugccucccccugaaucuugacacgaaguacgaacugcucuaucuggccgagcaguucgcuggcgugguccuuuaccugaaguuucgccucccggagauuucuagauucagcgccgaauuugauuuccggaccuaugacuccgaggggguuauccuguacgcggaaagcauugaucauucugccuggcugcucaucgcucugcgcggaggcaaaauugaggugcaacuuaagaacgaacacacauccaaaaucaccacagggggagacgugauuaauaacggccuguggaauauggucagcguggaggagcucgaacauucuaucagcaucaagauugccaaagaggcuguuauggauaucaacaagccugggccccuguucaagccugaaaauggacuucuggagaccaaaguguauuuugccggcuuccccagaaaggucgaguccgaacucauuaaacccaucaacccucggcuggacggcuguauucgcucuuggaaucugaugaagcagggggccagcggaaucaaagagaucauucaggaaaagcaaaacaagcacugccucgugacgguugagaaaggcuccuacuacccggggagcggaaucgcucaguuucauauugauuauaauaacgugucuuccgcggaaggcuggcacgucaaugugacacugaacaucagacccagcaccgggacaggcgucaugcuugcccuggugucuggaaauaacaccguuccuuucgcugugucccucgucgacagcaccuccgagaagucucaggauauucugcugagcguggagaacacaguuaucuaccggauccaggcccuuucccucuguucugaccaacagagccaccuggaauuuagagugaaucgcaacaaucuggagcucuccacgccccugaaaauugaaaccaucagccaugaggaccuucagcggcagcuggccguccucgauaaggcuaugaaagccaagguggcgacauaucugggcgggcugccugacgugcccuucucugcuaccccgguuaacgccuuuuacaauggaugcauggaagucaacauuaauggcgugcaacuugaucucgacgaggccaucuccaagcacaacgauauuagagcucauagcuguccuucuguguggaaaaagaccaaaaauuccuga

SEQ ID NO: 74265 - RNA, 2835 nt, Artificial Sequence
  derived and/or modified sequence opt5 from PROSER1__Homo_sapiens__NP_079414
auggacaagaaauccuucgagauggugcuggaugaaaucagaaaggccguccucaccgaguacaaacugaaggcuauugaauauguucacggcuacuuuagcucugaacaggugguggaccuucugcgguauuucagcugggccgagccccaacucaaagcgaugaaggcucugcagcauaagauggucgccgugcagccuacagagguugugaacauccuuaauugcuuuacguucuccaaagauaagcuggucgcccucgagcugcuggcuucuaacauuaucgacgcccagaauagccgcccgauugaagaucucuuuagagugaacauguccgagaaaaagcgguguaaacgcauccuggaacaggcuuucaagggcggaugcaaggcgccccacgccaugaucucuagcuguggcaccauuccugggaaucccuacccuaaaggaagacccucccggaucaacggcauuuuuccugggacaccgcuuaagaaagacggagaggagugcaccaaugaaggcaagggcaucgccgcucgcauucuggggcccagcaaaccucccccuucuacauauaacccccauaagccgguuccuuaccccaucccucccuguagaccccacgccaccauugcuccuuccgccuauaauaacgcgggacucgugccgcuggccaaugucaucgcucccccucccccucccuacacaccgaacccugugggcaccgagaaugaagaucuuagcaaccccucuaaaccuauccagaaucagacguucuccacccccgccagccagcuguuuucuccucauggguccaaccccagcacaccggcugccaccccugugcccacagccucccccgucaaggcuauuaaccacccuucugcgagcgccgcugccaccguuuccggaaugaaucuccugaacacggugcugccgguguuccccggccaagucagcucugccgugcacacaccucagcccuccaucccuaaucccaccguuauucggacaccuagccuccccaccgcuccggugaccucuauccauagcacaacgaccacaccuguccccuccaucuuuucugggcuggugagccuuccuggacccuccgccaccccgacagcggcuaccccuacgcccggcccuacaccccgcagcacccuggggucuuccgaggccuucgccagcaccucugcucccuuuacaucccucccuuucagcaccuccucuagcgccgcuuccacaucuaacccgaauagcgccucccugagcucuguuuucgcggggcuuccccugccucugcccccuacgucccagggacucagcaaccccaccccugugauugccggcgggucuacaccguccgucgcuggaccccugggcgugaauagcccucuccugucugcccuuaagggguuucugaccagcaacgacacaaaucucaucaacuccagcgcucugucuuccgccgucaccagcggacuugcgucccugucuagccucacgcugcaaaauuccgauucuagcgccuccgcucccaacaaaugcuacgccccuucugcuauucccaccccgcaaagaacaagcaccccuggccuggcccucuuccccggccugcccuccccuguggccaauagcacaucuacgccccuuacccugccuguucaguccccgcucgcuacagcggccagcgcuucuaccuccgugcccgucagcugugggucuuccgccagccugcugcggggaccucaccccggcacauccgaccuucauaucagcucuaccccugccgcuaccacacuccccgugaugauuaagacggaaccgaccagcccuacacccuccgccuuuaaagggccuucucacagcggaaaccccucccacggcacccuggggcugucuggcacacucggacgcgcguauaccagcacguccguuccuaucucucugagcgcuugccuuaaucccgcccuguccggccucagcucucuguccacaccgcugaacgggagcaacccucuuucuuccauuagccucccuccccauggauccucuacccccaucgccccgguguucaccgcucugcccagcuuuacaucccugaccaauaacuucccucucacaggcaaucccagccugaacccuucugucucccuucccgggagccugaucgccacgucuagcaccgcggcuacauccaccucucucccucacccgagcuccacagccgccgugcugucuggacugagcgcuuccgcccccgugagcgcugccccuuuuccccuuaaucucucuaccgcgguuccuucccuguucagcgucacgcagggcccccuguccucuagcaacccguccuacccuggguuuucugugagcaauacccccuccgugacacccgcccucccuagcuuccccggccugcaagcuccuucuaccgucgccgcugugacaccgcuucccguugccgccaccgcuccuucccccgcgccugugcugcccggauuugccagcgcuuucucuuccaacuuuaauagcgcccucgucgcccaggcuggccugucuagcgggcugcaggccgcgggauccucuguguucccgggccuucucagccugccugggauucccggauucccucagaaccccucccaaagcucccugcaggagcuccagcauaaugcugccgcccagucugcucugcuucaacagguucacagcgccuccgcgcuggagucuuauccugcucagcccgauggcuuuccgagcuacccuuccgcccccgggacacccuucucucuccagccuagccugucccaaagcggcuggcaguga

SEQ ID NO: 74266 - RNA, 2217 nt, Artificial Sequence
  derived and/or modified sequence opt5 from PROX1__Homo_sapiens__XP_011508075
augcccgaccacgauagcaccgcccugcucuccagacagacaaagcggcgcagaguggacaucggcgucaaacggacgguugggaccgcuucugccuucuuugcgaaggcucgcgccacauucuuuagcgccaugaacccucaaggauccgagcaggauguggaauacucugugguccagcaugcugacggcgagaaaagcaaugugcugagaaaacuucugaagcgggccaacuccuaugaagaugcuaugaugccguuccccggggccaccauuaucucucagcuccugaagaauaacaugaauaagaacggaggcacagagccuagcuuucaagcguccgggcuuagcucuaccggauccgaaguucaccaggaggacauuugcagcaauucuucccgcgauagcccucccgagugucugucucccuucggcagaccuacaaugucccaguuugacauggaucggcucugcgacgaacaucugcgcgccaaaagagcucggguggagaacaucauucgcggcaugagccacuccccgucugucgcccugagagggaaugaaaacgagcgggagauggcuccccagagcguguccccucgcgaaagcuacagagagaauaagcggaaacaaaagcucccccagcagcagcaacagucuuuccagcaacugguuuccgccagaaaagaacagaagcgcgaggaacggagacagcuuaagcagcaacuggaggauaugcagaaacagcuccgccagcugcaagagaaguuuuaucagaucuacgacagcaccgauucugaaaacgacgaggacggaaaucuuagcgaagauuccaugcggucugagauccuggacgcgagagcccaggauagcgugggccgcuccgacaacgaaaugugugagcucgauccugggcaguucauugaccgggcuagagcccugauccgcgagcaagaaauggcugagaauaaacccaagcgggaaggaaacaacaaagagagagaucauggcccgaauagccugcagccugaagggaagcaccucgccgagacgcugaaacaggagcuuaacaccgccaugucucaggucguggacacaguggucaagguguuuuccgcuaagcccagccgccaaguuccucagguguucccuccccugcagauuccccaagcgcgguuugccgucaauggagaaaaccacaauuuccauaccgcuaaccagagacuccagugcuucggcgaugugaucauuccgaauccccuggacacauuuggcaacguucagauggccucuuccaccgaucaaacggaggcccuuccucuggugguccggaaaaauagcuccgaccagucugcuagcgggcccgccgcgggaggccaccaucagccucuccaccagucuccccuguccgcuacaaccggguucacaaccagcaccuuucgccacccguucccucugccccucauggccuauccuuuucaaagcccccugggagccccuuccggcucuuucuccgggaaggacagagcuagccccgaaucucuugaucugacacgggacacgaccucccucagaacaaaaaugagcucucaucaccugagccaucacccguguuccccugcccauccucccagcaccgcugagggacuuucucugucccucaucaagagcgagugcggcgaucugcaggacauguccgaaauuucucccuacagcggcuccgccaugcaggaggggcugucuccgaaccaccucaaaaaggcgaagcugauguuuuucuauacacgcuaccccagcuccaauaugcuuaaaaccuacuuuucugaugugaaguucaaccgguguaucacgagccagcugaucaaaugguuuuccaauuucagagaauuuuauuacauucaaauggagaaguaugcccgccaggcuaucaacgacggaguuacaagcaccgaggaacucucuauuaccagagauugcgagcuguaccgggcccugaauaugcacuauaacaaagcuaacgacuucgaacaggugccugagcgcuuccuugaagucgcccaaaucacacucagagaguuuuucaaugcgauuaucgccggcaaggauguggaccccuccuggaagaaagcuaucuacaaggucauuuguaaacuggauagcgaagugccugagaucuuuaagucucccaacugccugcaggagcuccugcaugaauga

SEQ ID NO: 74267 - RNA, 1269 nt, Artificial Sequence
  derived and/or modified sequence opt5 from PROZ__Homo_sapiens__NP_001243063
auggccggcugcgugccccugcuccaggggcugguccuuguucuggcucuccacagaguggagccuagcgccaccucccugaaggaacggcauggacuucacucugacagcgcguguacaggcgugcaagagucccuguuccucccggcuucuaaagccaacgauguccuggugcgcuggaagagagccgggagcuaccugcucgaggaacuguuugaaggaaaucuugagaaagagugcuaugaagagaucuguguuuacgaagaggcucgggagguguucgaaaacgaggucgugacggacgaauuuuggcgcagauauaagggcgggucccccugcauuucucagccuugucugcauaauggaagcugccaggauuccaucuggggcuacaccuguacaugcagccccggcuaugaggggucuaacugugaacucgccaaaaaugagugccacccugagcggaccgacggaugucagcauuucugccugcccggccaagaauccuacacaugcagcugugcucagggguaucgccuuggagaggaucacaagcagugcguuccucacgaccagugugccugcggcgugcugaccucugaaaagagagcgccggaucuccaagaccugcccuggcaggucaaacugacaaacuccgaggggaaggauuuuuguggaggcgugauuauccgggaaaauuucgugcucaccacggccaaaugcagccugcuucaucgcaacauuaccgucaagacauacuuuaauagaaccucucaggacccucugaugaucaaaaucacacacguucaugugcacaugcgguacgaugcugacgccggcgagaacgaucucucccugcuugagcuggaauggcccauucaguguccuggggcuggacuccccgugugcaccccggagaaggacuucgccgaacaucugcugaucccucgcacgagaggccuccugagcgggugggcgcggaauggaacagaccuuggcaacucccugaccacacgccccgucacccucguggagggggaagaguguggacaaguucugaaugugaccgucacaacgagaaccuauugcgagcggucuagcguggccgcuaugcacuggauggauggcuccguugugacaagagaacaccgcggcagcugguuucuuaccgggguccugggaucucagccugugggcgggcaggcccauaugguccucgugacaaagguuucccgguacagccugugguucaaacaaauuaugaacuga

SEQ ID NO: 74268 - RNA, 1515 nt, Artificial Sequence
  derived and/or modified sequence opt5 from PRPF19__Homo_sapiens__NP_055317
augagccugaucugcuccauuucuaacgaggugcccgaacacccuugugucagcccgguuuccaaucauguguacgagagacggcucaucgaaaaguauauugccgagaacggcaccgaccccaucaauaaccagccucugucugaagaacaacuuauugauaucaaaguggcucaccccauccgcccuaagcccccuagcgccacauccauuccggcgauccugaaagcucuccaggacgagugggaugccgucaugcugcauucuuucacgcuuagacagcagcugcaaaccacacggcaggaacucagccacgcccuguaccagcaugacgcugccugccgcgugauugcuagacugaccaaggagguuacagccgcgcgggaagcccucgcuacccugaaaccccaggccgggcuuaucgugccucaagcuguccccuccagccagccuucugugguuggagccggcgagcccauggaucugggggagcucgugggaaugacaccggaaauuauccagaagcugcaggacaaggcgaccguccuuacgaccgagcgcaaaaagagaggcaaaacagugccugaggagcuggugaagcccgaggaacucuccaaauaucggcaagucgccagccacguugggcugcacucugcuuccauuccuggaauccuggcccucgaucugugucccagcgacaccaauaagauccuuacaggcggcgcugauaagaacgugguggucuuugacaaaucuuccgagcagauucuggccacccucaaggggcauacgaaaaaggugacaagcguuguguuccaccccucccaggaucuggucuuuucugccagcccugacgcuaccauccgcauuugguccgugccgaaugcgagcugcguucaaguggucagagcccaugaaucugcugugacaggacuuucccugcacgccaccggcgauuaccuccugagcucuagcgacgaccaguauugggccuucuccgauauccagaccgggcggguccugacaaaagugacggacgagaccucuggauguagccucacaugcgcucaguuucaccccgauggccugauuuucgggaccggaacaauggacucccaaaucaagaucugggaucuuaaagaacgcaccaacguugccaauuuuccuggccauagcggccccauuacgucuaucgcguucuccgagaacggguacuaucuggcuacagccgccgacgauagcucugugaagcucugggaccugagaaaacuuaagaauuuuaagacccugcagcucgauaacaauuucgaagucaaaucccugauuuuugaccagagcggaaccuaccuggcucucggcgggacagaugugcagaucuacauuuguaagcaauggaccgagauccugcacuucacagagcauuccggacuuacgaccggcguugccuuugggcaccaugcuaaauucaucgccucuacaggaauggaccggagccugaaguucuauucccucuga

SEQ ID NO: 74269 - RNA, 1500 nt, Artificial Sequence
  derived and/or modified sequence opt5 from PRPF31__Homo_sapiens__XP_006726118
augagccuggccgacgagcuccuggcugaucuugaagaggccgcggaagaggaagagggcggguccuacggagaggaagaggaagaacccgcuaucgaggacgugcaggaagagacccaacuggaucucucuggcgacagcgucaagacaauugccaaacugugggauuccaagauguucgccgaaaucaugaugaaaauugaggaauauaucucuaagcaggcuaaagccagcgagguuauggggccuguggaggcugccccggaauacagagugauugucgacgcgaacaaucuuacgguggagaucgaaaacgagcugaauaucauucacaaguuuauccgggauaaguauuccaaacgcuuccccgaacucgagucucugguuccuaacgcccuggacuacauuagaaccgugaaggagcucggaaauagccuggauaaaugcaagaacaaugaaaaccuucagcagauccugacaaaugcuaccauuauggucguguccguuacagccagcaccacacaaggccagcagcucucugaggaggagcuggaacggcuugaggaggcuugugacauggcccuggaacucaacgcguccaaacaucgcaucuaugaguacguggaaagcagaaugucuuuuauugcccccaaucuguccaucaucauuggggcuagcaccgccgcuaagaucaugggagucgccggcggccugacgaaccucucuaagaugccugccugcaauauuaugcugcuuggggcucagcggaaaacccuguccggauucagcuccacaucugugcucccccacaccggcuauaucuaccauagcgauauugugcaaucccugccuccggaccuucgcagaaaggcggcccggcuggucgcugccaaauguacacucgccgcucgcguugauagcuuucacgagucuaccgaggggaaggugggauacgaacugaaagacgagaucgaaagaaaguucgacaaauggcaggagcccccucccgugaagcaggucaagccucugcccgccccgcucgauggccagcggaaaaagcgcgggggaagacgguaucgcaaaaugaaggaaagacugggccuuacggagauccggaaacaagcgaacagaauguccuuuggcgagauugaagaggacgcuuaccaggaagaucugggguucagccucggacaucugggcaagucugggagcggacgcgugcggcagacacaaguuaaugaggccaccaaggccagaaucuccaaaacacuucagcgcacccugcagaagcagucuguggucuauggcgggaaaagcaccauucgggacagauccagcggaacagcuucuuccguggccuuuacgccucuccaaggccuggaaaucguuaacccccaggcugccgagaagaaaguggcggaggccaaccagaaguacuucagcucuauggcugaauuucugaaggucaaaggcgagaaguccgggcucaugagcaccuga

SEQ ID NO: 74270 - RNA, 1050 nt, Artificial Sequence
  derived and/or modified sequence opt5 from PRPF38B__Homo_sapiens__XP_011539987
augaccaucggcgagaugcugagauccuuccucacaaagcuggaaugguuuagcacgcuuuucccccggauuccugugccgguccagaaaaacaucgaccaacagauuaagacccgccccagaaaaaucaagaaagaugggaaggagggagccgaagagauugaccggcacguugaacgcagacggucucgcagcccuagacggucccugucuccccgcagaagcccucggcgcuccagaucucggagccaucaccgcgagggccauggguccagcucuuuugauagagagcucgaacgggagaaggaaagacagcgccuggagcgggaggcuaaagaaagagagaaggaacgccggagaucccgcagcaucgaccggggacuugagagacgccggucuagaucccgcgaacggcacagaagccggucucgcuccagagaucggaaaggcgacagacgcgaucgggacagagagcgcgagaaggaaaaugagagagggcggcgcagagaucgggacuacgauaaagaacgcggaaacgagagagaaaaggagcgggagcgcagcagagaacgguccaaggagcagcgcucuagaggcgaaguggaggagaaaaagcauaaagaggacaaggaugaccggagacaccgcgacgauaaacgggacagcaagaaagagaagaagcacuccagaagccgcucucgggaaagaaaacaucgcucccggagcagaucucgcaaugccggcaagcggagcagaucccggucuaaagaaaagagcuccaaacacaagaacgaaagcaaggagaaaucuaauaagcgcuccagaagcgggucucaaggacggacagauuccguggagaaaagcaagaaacgcgaacauucccccucuaaggaaaagagcagaaaacgguccagaucuaaggagcgcagccacaaacgggaccacuccgauagcaaggaccagucugauaaacaugacagacgccggucccagagcaucgagcaggaaucucaagagaagcagcacaagaacaaagaugagaccgucuga

SEQ ID NO: 74271 - RNA, 1251 nt, Artificial Sequence
  derived and/or modified sequence opt5 from PRPF3__Homo_sapiens__XP_011508434
auggcccugagcaagagagagcucgacgaacugaaacccuggaucgagaagaccgugaaacggguccuuggcuucuccgaaccuacaguugugacggcugcccugaacugcguggggaagggaauggauaaaaagaaggcggcugaccaccucaaaccguuucuggaugacucuacccuucgcuucgucgauaagcuguuugaggccguggaagagggcagaagcucccggcauucuaaaagcuccucugaccgcagcagaaagcgggagcucaaagaaguuuucggggaugacuccgagauuagcaaggaaucuuccggagugaagaaacgcagaaucccccgguuugaggaggucgaagaggaaccugaggugauucccggcccucccagcgaaucuccugggaugcugacaaagcugcagaucaaacaaaugauggaggccgcuacccgccagauugaggaaagaaagaaacagcucuccuucaucagcccgcccacaccucagcccaagaccccuucuuccagccaacccgagcggcugccgaucggaaauacaauucagccuucccaggccgcuaccuuuaugaacgaugccaucgaaaaagcgcgcaaggccgcugagcuucaggcccggauucaagcucagcuggcccucaagcccggccugaucggcaaugcgaacaugguugggcuugccaaucugcacgcuaugggaauugccccucccaaaguggaacucaaggaccagacgaaacccaccccucugauccuggaugagcagggcagaacagucgacgcuaccgggaaggagauugaacucacacaucgcaugccgacccugaaagccaacaucagagccgugaagcgggagcaauucaagcagcagcuuaaagaaaagcccucugaggauauggaaagcaauacguuuuucgacccuagaguguccaucgcucccagccaacgccagcggagaacauuuaaauuccacgacaagggaaaauuugagaagauugcgcagcgccugcggaccaaggcccagcucgagaaacugcaagcugaaaucucucaggccgccagaaagacaggcauucauaccuccacccgccuugcucugaucgccccuaaaaaggagcucaaagaaggggauauucccgagaucgaguggugggacagcuacaucauuccgaacggauucgaucugggcaagucucaggaacggagacuguucuggaaucacaagagcuguuga

SEQ ID NO: 74272 - RNA, 2793 nt, Artificial Sequence
  derived and/or modified sequence opt5 from PRPF40A__Homo_sapiens__NP_060362
augugcagcggcuccgggagacggcgcucuagccugucccccaccaugagaccuggaacaggcgccgagcgcgggggacucaugaugggccacccggggaugcauuacgcucccaugggaaugcacccuaugggccagcgggccaacaugcccccugugccccauggcaugaugccucaaaugaugccgcccaugggagggccucccaugggccagaugccugggaugaugucuagcgucaugcccggaaugaugaugucccacaugucucaggcgagcaugcagccggcucugccucccggcguuaauuccauggacguggccgccgggacggcuagcggagccaagucuauguggaccgaacauaaauccccugauggcagaacauauuacuauaacaccgagacaaagcaaagcaccugggaaaaacccgacgaucuuaagacacccgcugagcagcugcucucuaaauguccuuggaaggaauacaaguccgacagcggcaaaccguauuacuauaauucucagaccaaggagucccggugggccaaacccaaggagcuggaagaucuugagggguaccagaacacgaucguggcgggaagccugauuaccaaauccaaucuccacgccaugaucaaggcugaagagucuagcaagcaagaggaaugcacaaccacauccaccgccccuguccccacgacagagauuccuaccacaaugagcaccauggcugccgcggaagccgcugccgcugugguugccgccgcugcggccgcugccgccgcugccgcggcugccaacgccaaugcuucuaccuccgccagcaacacagugucuggcacgguccccgugguuccggagccugaagugaccagcaucgucgcuacagugguggacaaugagaacaccgucacaauuuccaccgaggaacaggcccagcugacgucuacacccgcgauccaggaucaaagcguugagguguccagcaauaccggggaagagaccucuaaacaggaaacaguggccgacuucaccccuaagaaagaggaggaagagucccagcccgcuaagaaaacauacacguggaacaccaaggaagaggccaaacaagccuuuaaggaacugcucaaggagaaacgcgucccuagcaaugccucuugggagcaggcgaugaagaugaucauuaacgaucccagauauuccgcccuggcuaaacuuagcgaaaagaaacaggccuucaaugcuuacaaggugcagacagagaaggaagagaaagaggaagcccgguccaaguauaaagaggccaaggaaucuuuucaacgcuuccuggagaaccacgagaaaaugaccagcacaaccagauacaagaaggcugaacagauguuuggagagauggaaguuuggaacgcgaucuccgagcgggaccgccucgaaauuuaugaggaugugcuguucuuucuuucuaaaaaggaaaaagagcaggccaagcagcugagaaaacggaauugggaggcucucaagaacauccuggacaauauggccaacgucacguacagcaccacaugguccgaagcccaacaguaucugauggauaauccgaccuucgcugaggacgaggaacuccagaacauggacaaggaagaugcccugauuuguuuugaggagcauauccgcgcgcuugaaaaagaggaagaggaggaaaagcagaaaagccugcucagagagcggagacgccaacggaagaauagagaaucuuuccagauuuuucuggacgagcuucacgaacauggccagcugcacuccaugagcucuuggauggagcucuacccuacaaucuccagcgauauccgcuucaccaacaugcuggggcagcccggaucuacggcucuggaccucuuuaaauucuacguggaggaucugaaggcccgguaucacgacgagaaaaagauuaucaaggauauucuuaaagacaagggcuucguuguggaagucaauacaaccuuugaagauuucguggccaucauuagcuccacaaaaagaagcaccacccuggacgcuggcaacaucaagcucgccuuuaauucucugcuugagaaagcggaagcucgcgagcgggagagagaaaaggaggaagcccgcaagaugaaacggaaggaguccgccuucaaaagcaugcugaagcaagcugcucccccuaucgaacucgaugcugucugggaggacauuagagagcgcuuugugaaagaaccggccuucgaggacaucacacuggaauccgagcggaagagaauuuuuaaggauuucaugcauguucuggagcacgaaugccagcaucaccauucuaaaaacaagaaacacagcaagaaauccaagaagcaccaucggaaacgcucuagaagccgguccgggucugacagcgaugacgaugacucccacagcaagaaaaagagacagcgcucugagucccggagcgcgucugaacauuccagcucugccgaguccgaaagaagcuacaaaaaguccaaaaagcacaagaaaaagagcaaaaagcgcagacacaaaucugauagccccgaguccgacgcugagcgggaaaaggauaagaaagagaaggaccgcgaaucugagaaagauagaacgcggcaacgcagcgaauccaagcauaaaucuccuaagaagaaaaccggaaaggacagcggcaauugggauacauccgggucugagcucagcgagggagaacuggagaaaagacggcgcacccuucuggaacagcucgacgacgaucaguga

SEQ ID NO: 74273 - RNA, 3024 nt, Artificial Sequence
  derived and/or modified sequence opt5 from PRPF4B__Homo_sapiens__NP_003904
auggccgcugccgagacccagagccugagagaacaacccgagauggaagacgcgaacuccgagaagucuaucaaugaagagaacggcgaggugagcgaagaucagucccagaauaaacacucucggcauaagaaaaagaaacacaagcaucgcagcaagcacaaaaagcauaaacacuccucugaggaagacaaggauaaaaagcacaagcauaaacacaagcauaaaaagcacaaaagaaaggagauuaucgacgcuagcgauaaagaggggauguccccugccaagcggacaaagcucgacgaucuggcccuucuggaagaccucgagaaacagcgcgcucugauuaaggccgaacuugauaacgagcugauggaaggaaaaguccaaagcggcauggggcucauccugcagggauacgagucuggcuccgaggaagagggggaaauucacgagaaggcuagaaauggaaaccggagcucuacgcgcuccagcucuaccaaaggcaagcuggaacucguugacaauaagaucacaaccaaaaagagauccaaaagccgguccaaggagcgcacaagacaucggucugauaaaaagaaaagcaaaggcgggaucgagauugugaaggaaaagaccacacgcuccaagagcaaagagagaaagaagucuaaauccccgagcaagcggucuaaaagccaggaccaggcccgcaaguccaaaucucccacccugagacggagaagccaagaaaagaucggaaaagcgcgcuccccuacggaugacaaggugaagauugaggacaaaagcaagucuaaagaucggaagaaaucccccaucauuaacgaaagcagaucucgcgaccggggcaagaaguccagaagcccugucgaucuucgcgggaaauccaaggaccggagaucucgcagcaaagagcggaaguccaaaagaucugagaccgauaaggaaaagaaacccaucaagagcccuuccaaagacgccagcucuggaaaggagaaucgcuccccgagccggagacccggccggucuccuaaacgcagaucccugagccccaagccucgggauaagucuagacgcagccggucuccccuccugaacgacagacgcagcaaacagucuaaguccccgagcagaacacuuuccccugggcggcgcgcuaaaucuagaagccuggaacggaagcgcagagagcccgagcggcgcagacucuccucuccucggacccgccccagagaugacauucugagccggagagaacgcuccaaagaugccucucccaucaaucgguggagcccuacaagacgccgguccagaagcccgauccgccggagaucucgcagcccccugcggagaucccggucuccucgcagacggucccgcagccccagacggagagaccgcggacggagaucucgcucccggcucagacgccggagcagaucccgcggcggcagacggcgcagaagccggucuaaggugaaagaggacaaguucaaggggagccuguccgaaggaaugaaaguugagcaggaaucuagcuccgaugacaaccuugaggauuuugacguggaggaagaggaugaagaggcucugauugaacagcgcagaauccaacggcaggccauuguccagaaguauaaauaccucgcggaggacucuaauaugagcgugccuuccgagcccucuagcccgcaauccagcaccagaacgcgcucuccuucccccgaugacauccuggaacggguugccgcugaugugaaggaguaugaaagagagaacgucgacacauucgaagccagcgugaaagcuaagcacaaucuuaugaccguggagcagaacaacggcuccucccagaagaaacugcucgccccugauauguuuacagagagcgacgauauguucgccgcuuacuuugacuccgcgcgccugcgggccgcugggauuggaaaggacuucaaagaaaaucccaaccugagagauaauuggaccgacgccgagggcuauuaccgggucaacaucggggaaguucucgauaagcgcuauaauguguacggauacaccggccagggcguguuuucuaacgucgugagagcccgggacaaugcucgcgccaaccaagagguugcggugaaaaucauuagaaauaacgagcugaugcagaagacagggcuuaaggaacuggaguuccucaaaaagcugaaugaugcugacccugaugacaaauuucauugccuucggcuguuccgccacuuuuaucauaagcagcaccucugucuggucuucgaaccccugagcaugaaccucagagaggugcugaaaaaguacggaaaggauguuggccuucacaucaaagccgugcgguccuauagccagcaacuguuucucgcccugaagcugcuuaaacgcugcaauauucuccaugcugacaucaagccggauaacauucuggucaaugaaucuaaaacgauccugaagcucugugacuucggguccgccagccacguggcugauaacgacaucaccccuuaccuggucucuagauucuaucgggcccccgagauuaucauuggaaagagcuacgacuauggcaucgauaugugguccguggggugcacacuuuacgagcuguacaccggcaaaauucucuuucccggaaagacaaacaaucauaugcugaaacuggcgauggaccuuaagggcaaaaugccuaacaagaugaucagaaaagggguuuucaaggaucagcacuuugaccagaaucucaacuucauguauauugaaguggauaaggucaccgagcgcgaaaaagugacgguuaugucuacaaucaauccgaccaaggaccugcuggccgaucucaucggaugucagcggcugcccgaggaccaacgcaaaaaggugcaccagcuuaaagaucugcucgaccagauucugaugcuggauccugcuaagagaaucagcauuaaccaggcccuucaacaugcuuuuauccaggaaaagauuuga

SEQ ID NO: 74274 - RNA, 1566 nt, Artificial Sequence
  derived and/or modified sequence opt5 from PRPF4__Homo_sapiens__NP_001231855
auggccagcuccagagcuucuagcaccgccacaaagacgaaagcgcccgacgaucugguggcuccugucguuaagaaaccgcacaucuacuauggcucccucgaggaaaaggagcgggaacgccuggccaaaggggagucuggcauucuuggaaaggacgggcugaaggccggaaucgaagcuggcaacauuaauaucaccagcggggagguguucgagauugaggagcauaucuccgaaagacaggccgaggugcucgcugaguuugaacggcgcaaaagagcccggcaaaucaacgucucuacagaugacagcgaggugaaggcgugccugcgcgcccuuggagaacccauuacccuguucggcgagggcccugcugaaagacgggagcgccucagaaauauccuguccguuguggggacagaugcccugaaaaagaccaaaaaggacgaugaaaagagcaaaaagucuaaagaagaguaccagcagacaugguaucacgaaggacccaacucccucaaggucgcucggcuguggauugccaauuacagccuuccucgcgcgaugaaaagacuggaggaagcccggcuccauaaggagauccccgagaccacgcgcaccucucagaugcaagaacugcacaaaucccuuagaagccugaacaauuuuuguucucagauuggcgacgaucggccuaucuccuauugccauuucagcccgaacuccaagaugcucgcuacagccuguuggucugggcugugcaagcuguggagcgugcccgacuguaaucuccugcacacccuuagaggacacaacacaaauguuggcgcuauuguguuucauccuaaauccaccgucagccuggaucccaaggacgugaaccucgccucuugcgccgcugauggguccgugaaacuguggagccuugacucugacgagccugucgcggauaucgaaggacacacgguucgcguggcccgggugauguggcaucccagcggcagauuccugggcacaaccuguuacgaccgcuccuggcggcucugggaucuggaggcucaggaagagauccugcaccaggaggggcacucuaugggagucuaugacauugccuuucaucaagauggcagccucgccgggacaggaggccuggacgcuuucgggagagugugggaucuucgcaccggacggugcaucauguuucuggaaggccaccucaaggagauuuacggcaucaauuucuccccgaacggguaccauauugccaccggaagcggcgacaauacauguaaaguuugggaucugagacagcgccggugcguguauacgaucccugcgcaccagaaccuugucaccggggugaaguuugaacccauccauggaaacuuccugcucacaggcgcuuacgacaauaccgccaagauuuggacacacccuggguggucuccccugaaaacccuggccggccacgagggaaagguuaugggccucgauaucuccagcgacgggcagcugauugcuacguguucuuaugacagaacauuuaaacuuuggauggccgaguga

SEQ ID NO: 74275 - RNA, 2826 nt, Artificial Sequence
  derived and/or modified sequence opt5 from PRPF6__Homo_sapiens__NP_036601
augaacaagaaaaagaaacccuuccugggcaugccugccccgcucggguacgugcccggacugggcagaggggcuaccggauuuacaacgcggagcgacaucggcccugcccgcgaugcgaaugaccccgucgaugacagacacgcuccucccgggaagcggaccguuggagaucagaugaaaaagaaccaagccgccgacgaugacgaugaggaccuuaaugauacaaacuaugacgaauuuaauggcuacgcuggcucccuguuuucuagcgggccuuaugagaaggaugacgaagaggccgacgcuauuuacgccgcgcucgauaaacgcauggacgaaagacggaaggagcgcagagagcagcgggaaaaagaggaaaucgagaaguaucgcauggagagaccgaaaauucagcagcaauucuccgaucugaagcggaaacuugccgaagugaccgaggaagaguggcugucuauccccgaagugggagacgcucgcaacaagagacagcggaauccucgcuacgagaagcucacacccgucccugauagcuuuuucgccaaacaucugcagaccggcgagaaccacacauccguggaccccagacagacccaauuugggggacugaauacgccguauccuggcgggcucaacacccccuacccuggaggcaugacacccggccugaugacccccgggacaggagaacuugauaugcggaagauuggccaggcuagaaauacccugauggacaugcgccucucucagguuagcgauuccgugagcgggcagacggucguggacccuaaaggauaccugacagaucuuaacucuaugaucccgacccauggcggggacaucaaugacauuaagaaagcccggcugcuccugaaguccguuagagagacaaacccccaccauccucccgcguggaucgccagcgcucgccuggaagaggugaccggaaagcuccaagucgcccggaaucugauuaugaaaggcaccgaaaugugcccuaagucugaggauguguggcuugaggcugccagacugcagcccggcgacacagccaaagcuguggucgcgcaggccguucgccaccucccgcaauccgugcggaucuauauuagagcugccgaacuggagacggauauccgcgccaagaaacgggugcuuagaaaggcucuggaacacgucccuaacagcgugcgccucuggaaggccgcgguugagcuggaagaacccgaggacgcucggauuaugcugucuagagccguggaauguugcccuaccuccgucgagcucuggcuggcccuugcucggcuggaaacauacgagaacgcccgcaaagugcucaauaaggcuagagagaacauccccaccgaucggcauaucuggauuacagccgcgaaacuggaagaggccaaugggaacacccagaugguugaaaagaucauugacagagcuaucacgagccuucgcgccaauggaguggagauuaaccgggaacaguggauccaggaugcugaggagugugacagagccggcuccgucgcgacaugccaagccgugaugcgcgcugucaucgggauuggaaucgaagaggaagauagaaaacacaccuggauggaggacgccgauucuuguguggcucauaaugcccuggaaugcgcccgggcuauuuaugcguacgcccuccagguuuucccuagcaagaaguccguguggcugcgcgcugccuauuuugagaaaaaccacggcaccagagagagccuggaagcccuccugcagcgggcugucgcccacugucccaaggcggaggugcuuuggcugaugggggcuaaaucuaaguggcucgccggcgacguuccggccgcucgcuccauccuggcccuggcguuccaggcuaauccuaacagcgaagagauuuggcuugccgccgugaaacucgaaucugagaaugaugaguacgaaagagcucggcgccugcuggccaaggcuagaagcuccgcccccacagcgcgggucuuuaugaagucugugaaacucgagugggugcaagacaacauccgcgccgcucaggaccugugcgaagaggcccuuagacauuaugaggauuuccccaagcuguggaugaugaaaggacagaucgaggagcagaaggaaaugauggagaaagcucgggaagccuacaaucaaggccucaagaaauguccucacagcaccccgcuguggcugcuucucuccagacuggaggagaagauugggcagcugacacgcgcccgggcuauccucgaaaagagcagacugaaaaaccccaagaauccuggacuuuggcuggagucuguucgccucgaauaccgggcgggccugaaaaacauugccaacacgcugauggcuaaggcccuucaggagugccccaauuccgggauccucuggagcgaagccauuuuucuggaggcuagaccucagcgccggaccaaaucugucgacgcccugaagaagugugagcaugauccccacgugcuccuggcgguggcuaaacuuuucuggucccaaagaaagaucacaaaagcccgcgaaugguuccaucggaccgucaagauugacagcgaucugggagacgccugggcuuucuucuauaaauuugagcuccagcacggcacagaggaacagcaagaagaggugagaaagcggugcgaguccgccgaaccucgccacggggagcuguggugcgcgguuucuaaggauaucgcuaacuggcagaaaaagaucggcgacauucugagacuuguggccggacggaucaaaaauaccuucuga

SEQ ID NO: 74276 - RNA, 7008 nt, Artificial Sequence
  derived and/or modified sequence opt5 from PRPF8__Homo_sapiens__NP_006436
auggcuggcguguuccccuacagagggccuggaaacccggugcccggcccucuggcuccccucccugacuauauguccgaagaaaaacugcaggaaaaagcccggaaguggcaacagcuucaggcgaaaagauacgcugaaaagagaaaauuuggguucguugaugcccagaaggaagacaugcccccugaacacgugcggaagauuauucgcgaucacggagacaugaccaauagaaaauuucggcacgauaagcgcguguaucugggcgcccucaaauacaugccgcaugcuguccugaaacuucuggaaaacaugcccaugccuugggagcaaaucagagacgugcccguucucuaucacauuacaggggccaucuccuucgugaaugaaauuccuugggucaucgagcccguguacaucucucaguggggaagcauguggauuaugaugcggcgcgagaagcgggaucggcgccauuuuaagagaaugcgguucccgccuuuugacgaugaggagcccccucuggacuaugcugauaacauccuggacguugaaccccucgaggccauucagcuggaacuugaucccgaggaagacgcgccugugcuggacugguucuacgaucaccagccgcuccgcgacuccagaaaguacgucaauggcucuacguaucaacgguggcaguuuacccugcccaugaugagcacacuuuacagacuggccaaccagcuccugaccgaucugguggacgauaauuauuucuaccucuuugaccugaaggcuuucuuuacauccaaggcccuuaacauggcuaucccuggcgggcccaaauucgagccucuggugcgcgauauuaaucuccaggacgaggauuggaacgaguucaaugacaucaacaagauuaucauccggcaacccauuagaaccgaauauaaaaucgccuuuccguaccuguauaauaaccuuccucaccauguccaccugacaugguaccauacccccaauguuguguucauuaagacggaagauccugaccuccccgcguuuuacuucgacccucugaucaaccccauuucucaccgccacagcgugaaaucccaggagccgcugccugaugacgaugaagaguuugagcuccccgaguucgucgagcccuuucugaaggacaccccucuuuauacagauaacaccgccaauggaaucgcucugcucugggccccgcggcccuucaaccugagaagcggccgcacacggagagcucuugacaucccucuggugaagaauugguaccgcgaacauugccccgccgggcagccuguuaaagugcgggucucuuaucaaaagcuccugaaauacuaugugcugaacgcccucaagcacagacccccuaaagcucagaagaagcgcuaccuguuucgguccuucaaagcgaccaaguuuuuccagagcacgaaacuugauuggguugaggugggacugcaggucuguagacaaggcuauaauaugcucaaccugcugauucaucggaagaaucuuaacuaccuccaccuggacuacaauuuuaaccugaaacccgugaagacacucaccacaaaggaacgcaaaaagucuagauucgggaaugccuuccaucugugccgggagguccuuagacugaccaaacucgugguugauucccacgugcaguaucgccugggaaacgucgacgcuuuucagcuggccgauggccuucaguacaucuucgcccacgugggccaacucaccgggauguaucgguacaaguauaaacugaugagacagauucgcauguguaaggaccugaagcaucucaucuacuauagauuuaauacaggaccgguuggcaaagggccuggaugcggcuucugggcugccggguggcggguguggcuguuuuucaugcgcggaauuacgccccuucuggagagauggcucggcaaccugcuggcgcggcaguuugaaggccgccacagcaagggggucgcuaaaaccgugacaaagcagagaguggagucucauuucgaucuugaacuccgggccgccguuaugcacgacauccuggacaugaugccugagggaaucaaacaaaauaaggcucgcaccauucugcagcaccucuccgaggccuggagauguuggaaagcuaacauccccuggaaggucccgggccugccuacacccauugaaaacaugauccuucgguacgugaaggccaaagcggauugguggaccaauacggcccauuacaaccgcgagcgcauucggagaggggcuacaguggacaagaccgucugcaaaaagaaucugggacgccucacccggcuguaucugaaagccgaacaggagagacagcacaacuaccuuaaggauggcccuuauaucacagcugaagaggccguggcgguuuacaccacaacggugcauuggcucgagagccgccgguuuucccccauucccuucccuccgcugucuuauaagcacgacaccaaacugcucauccuggcccuugaaagacugaaggaggcuuacagcgucaaaucccgccucaaucaaagccagcgggaagaacuggggcugaucgaacaggccuaugauaacccccaugaggcucuuucuagaauuaagcgccaucugcucacacaacgggccuuuaaagaggugggcaucgaguucauggaccuguacucccaccucguuccuguguacgaugucgagccccuggaaaagauuaccgacgccuaucuugaucaguaccugugguaugaggcugacaagagacggcucuuuccucccuggaucaaaccugcggauacagaaccgcccccucugcugguguacaaguggugucagggaauuaauaaccuucaggacguuugggagaccagcgagggcgaaugcaaugugaugcuggagucucgcuucgagaaaauguaugagaagaucgaucucacgcugcucaacagacugcuucggcugaucgucgaccacaauauugccgacuacaugaccgcuaaaaacaauguggugaucaacuauaaggauaugaaucacacaaacagcuacgggauuauccgcggacuccaauucgccuccuuuauuguccaguacuauggccugguuauggaccugcuugugcuggggcuccauagagccucugagauggcuggacccccucagaugcccaacgauuuccugagcuuucaggacaucgccaccgaagcggcucacccgaucagacucuucuguagauacauugaucgcauccauaucuucuuccgguuuacagccgacgaggccagagaucugauccaacgcuaucuuaccgaacacccugaccccaauaacgagaauauugugggcuacaacaauaagaaaugcuggccccgggaugcuagaaugcgccugaugaagcacgacgucaaccuggggcgggccguguucugggauaucaaaaauagacucccucgcuccguuacgacagugcagugggaaaacagcuuugucucuguguauuccaaggacaaucccaaccugcuuuucaauauguguggcuuugagugcagaauccugccuaaaugccggaccagcuacgaggaguucacacauaaggacggaguuuggaaccuccagaaugaggugaccaaagaacgcaccgcgcaguguuuccugagagucgaugacgagucuaugcaacgguuucacaaccgcgugagacagauucucauggcuuccggcagcacaacguucaccaagaucguuaauaaguggaacacagcccugauugggcuuaugaccuauuuucgggaagccguggucaacacacaggagcugcuggaucuccuggugaaaugcgagaauaagauccaaaccagaauuaaaaucggacuuaacuccaagaugccgucucgcuuucccccuguggucuuuuacacgcccaaagaacugggcgggcucggaaugcugagcaugggccauguucucauuccucaguccgaccugcgguggucuaagcagacagauguggggaucacccacuucagaagcggcaugucccacgaggaagaccagcuuauccccaaucuguaccgcuauauucaaccgugggagagcgaauuuaucgauucucagcgggugugggcugaguacgcccugaagagacaggaggcuauugcccagaaccggcgccucacccuggaagaccuugaggauuccugggacagaggaaucccucggauuaauacacuguuccaaaaagaucgccauacccucgcguaugacaagggcuggagaguccggacagauuuuaaacaguaccaggugcugaagcagaaccccuucugguggacgcaccaacgccaugacgggaaacucuggaaucugaacaauuauagaaccgacaugauccaggcccuuggaggcguugaagggauccuggagcacacacuguuuaagggaaccuacuucccuacaugggagggccucuuuugggaaaaggcuagcggguucgaggaaucuaugaaauggaagaaacugaccaacgcccagcgguccggccuuaaucagauucccaaccgcagauucacgcugugguggagcccuaccaucaaucgggcuaacguguaugucggauuucaagugcagcucgaucugacaggcauuuucaugcaugggaagauccccacccugaaaauuucucucauccagaucuuuagagcccaccuuuggcaaaagauucacgagagcaucguuauggaccugugucagguguucgaucaggaacuggacgcccucgagauugagacaguccagaaggaaaccauccauccgcgcaaauccuacaagaugaauagcucuugcgcugauauucugcuuuuugcguccuacaaauggaacgugagccggccuucccugcucgccgacucuaaggaugucauggacagcacaaccacgcaaaaauauuggaucgauauucagcugagauggggagacuacgauucccacgacaucgagcgcuaugcucgggccaaguuccuggauuacacaaccgacaauaugucuaucuaucccagccccaccggcgugcucauugccaucgaccuugcuuacaaccugcauuccgccuaugggaacugguuuccuggaucuaagccgcugauucagcaggcgauggcuaaaaucaugaaggccaaucccgcccucuacguucugagagaacgcauucggaaaggccuucaacuguacagcuccgagccuacagaacccuaucucagcucucagaacuacggcgagcuguucuccaaucagaucaucugguuuguggaugacaccaacgucuauagagugacgauucacaagacauucgaggggaaucugaccacaaaaccuaucaacggagcuauuuuuaucuucaauccccgcaccggccagcucuuucuuaagauuauccacacaagcguuugggccgggcaaaaacggcugggacagcuggcgaaguggaagaccgcugaagagguggccgcccucaucagaucucugccugucgaagaacagccgaaacaaauuaucgugacgcgcaagggcaugcuugauccccuggaagugcaucuccuggacuucccuaacauuguuaucaaaggguccgagcugcagcuccccuuccaggcuugucuuaaggucgagaaauuuggagaucugauucugaaggccaccgaaccucagaugguccucuucaaucuguacgacgauuggcuuaagacaaucagcucuuauaccgcuuuuucccggcugauucucauccugagagcccugcacgugaacaaugaccgcgcgaaagucauccucaagcccgauaaaacaaccauuacggagccgcaucacaucuggccuacacuuaccgacgaagaguggauuaagguggagguucaacugaaagaucugauccucgccgacuacggcaagaagaacaaugugaacgucgcuagccugacacaguccgaaauuagagacaucauccuuggcauggagauuagcgcccccucucagcagcggcaacagaucgcugaaauugagaaacagaccaaggaacagagccaacugaccgccacacagacgcgcaccgugaauaaacauggggaugagaucauuacauccaccacaucuaacuaugagacccagacguucagcuccaagacagaauggagaguucgggccaucucugcugcgaaccuccaccugagaaccaaucacaucuacgugagcuccgacgauauuaaagagaccggauacacauauauccugcccaagaacguccucaagaaauuuauuugcaucucugaccuucgggcccagauugcuggcuaccuguauggggugagcccucccgauaauccucaaguuaaggaaauccgcuguauugugauggucccgcaguggggaacccaucagacagugcaucugcccggccaacucccucagcaugaguaccugaaagaaauggagccccuuggguggauccacacgcagccuaacgagagcccccagcugagcccgcaagacgugaccacacacgccaagaucauggccgauaauccuucuugggacggagagaaaaccauuaucauuacaugcuccuucacccccggcagcuguacgcucaccgcuuauaagcugacaccuucuggcuacgagugggggagacagaacaccgauaaaggaaauaaccccaagggcuaucugccuucccauuacgaacggguccagaugcuccuuagcgaccgcuuucugggguucuuuaugguucccgcccaguccucuuggaauuacaacuucaugggagugagacacgauccgaauaugaaguaugagcugcaacucgcgaacccuaaagaauuuuaccaugaggugcaccggcccagccauuuccugaauuuugcccuucugcaggagggcgaagucuauuccgccgaccgcgaggaucucuacgccuga

SEQ ID NO: 74277 - RNA, 1041 nt, Artificial Sequence
  derived and/or modified sequence opt5 from PRPH2__Homo_sapiens__NP_000313
auggcccugcucaaggugaaauucgaccagaagaaaagagucaagcuggcucaaggccuuuggcugaugaacugguuuagcguucucgccgggaucauuaucuucucccugggacuuuuucugaaaauugagcuccggaagcgcucugaugugaugaauaacagcgaaucccacuucgugcccaauucucugaucggcauggggguccugagcugcguguuuaacucccucgcgggaaagauuuguuacgacgcucuggauccugccaaauaugccagauggaagccguggcuuaaacccuaccuggcuaucugcguucucuucaauaucauucuguuucuuguggcccuguguugcuuccuccugcggggcucucuggagaacacccucgggcagggacugaagaauggcaugaaauauuaccgcgacacagauacgccuggcagauguuuuaugaagaagaccaucgacaugcuucagauugaguucaaaugcugugggaacaauggauuucgggauugguucgaaauccaguggauuagcaaccgcuaucuggacuuuuccagcaaggaagucaaagauagaaucaagucuaauguggacggccgguaccucguugauggggugcccuucuccugcuguaacccuagcucuccccgcccuugcauucaauaucagaucacaaauaacuccgcucauuacagcuacgaccaccagaccgaggagcugaaucuuugggucagaggaugucgggccgcgcugcucucuuauuacuccagccugaugaacuccaugggcguggugacacugcucaucuggcuguucgaagucaccauuacaaucgggcuucgcuaucugcagaccucucucgauggaguuagcaacccggaggaauccgagagcgagucucaaggcuggcugcuugaaagauccgugcccgagacguggaaagccuuucuggaaagcgugaagaaacucggcaaggggaaucaggucgaggcugaaggagccgacgcuggccaggccccugaggcgggguga

SEQ ID NO: 74278 - RNA, 1413 nt, Artificial Sequence
  derived and/or modified sequence opt5 from PRPH__Homo_sapiens__NP_006253
augagccaccaucccuccggccugagagccggguucucuagcaccuccuaccggcgcacauuuggaccuccgcccucucucagcccuggcgcuuucuccuauucuagcuccagcagauuuucuuccagccggcugcuugggucugccucccccagcagcuccgugcgccugggaucuuucagauccccucgggcgggcgcuggggcccuccugcgccuucccucugagagacuggacuuuagcauggccgaagcucucaaccaggaguuccuggccacgcgguccaaugaaaagcaagagcugcaggaacucaacgaucgcuuugcuaauuucaucgagaaagucagauuucuggagcagcagaacgccgcgcuucggggagaacugagccaagcccgcggccaggagccugcuagagccgaccagcucugccagcaagaacugcgggagcuucgcagagagcuggaacuccugggccgggagagagaucgcguucagguggaacgggacgggcuggcugaggaucucgccgcgcugaagcagagacuugaagaggagacccgcaaacgggaagacgccgagcacaaucuggugcuguucagaaaggaugucgacgaugcuacacugucucgccuugaacuggagcggaaaauugaaucccucauggacgagaucgaguuucugaagaagcugcaugaagaggaacucagagaucuccaggugagcguugagucucaacaggugcagcaagucgaaguggaggccaccguuaaaccggagcuuacagcugcccugcgcgacauucgggcccaguacgaaagcaucgcugcgaagaaccuccaggaggccgaagagugguauaaauccaaguacgcugaucugucugacgccgccaauagaaaccacgaggcccuucgccaggcuaaacaagaaaugaaugagagccggagacagauucagucccugaccugugaaguggacggacuccggggcacaaacgaggcgcugcugcgccagcucagagaacuggaggagcaauucgcucuugaagccgggggauaucaggccggcgcugcccggcuggaggaggaacucagacagcugaaggaagagauggcucgccaucugcgggaguaccaggaacuucucaaugucaagauggcccuggauaucgagaucgcgaccuauagaaaacugcucgaaggggaggaaagccgcauuucugugcccgugcacuccuuugccagccugaacaucaagacgaccgucccugagguugagcccccucaagacucucacuccagaaaaacagugcuuauuaagaccaucgaaacacggaauggagagguggucaccgaaagccagaaagagcagcgcuccgagcuggauaagucuagcgcucauuccuacuga

SEQ ID NO: 74279 - RNA, 957 nt, Artificial Sequence
  derived and/or modified sequence opt5 from PRPS1__Homo_sapiens__NP_002755
augcccaacaucaagauuuucagcggcuccucucaccaggaccugagccaaaagaucgccgauagacucgggcuggagcuuggaaagguggucaccaaaaaguuuuccaaucaggaaacaugcguugagauuggcgaaucugugcgcggggaggacguguacaucguccagagcggauguggcgaaauuaacgauaaucugauggagcuccugaucaugaucaacgcuugcaaaauugccuccgcgucucgggugacggcuguuaucccuuguuucccguaugccagacaggacaagaaggauaaaagccgggcccccauuuccgcuaaacuuguggccaauaugcugagcgucgcuggggccgaccauaucauuaccauggaucuccacgcgucucaaauccagggauuuuucgacauuccuguggauaaccuguacgccgagcccgcuguucugaaauggauccgcgaaaauaucuccgaguggagaaacugcacaauugugagcccugacgccggcggcgcuaagcgggucaccucuaucgccgaucgccucaauguggacuuugcgcugauucauaaagaaagaaagaaggccaacgagguggaucggaugguccuuguuggggacgugaaagaccgcguggcuauccuggucgaugacauggccgauacauguggaaccauuugccacgcugccgacaagcuccuguccgccggcgcuacaagaguguaugcgauccuuacccaugggaucuucagcggacccgccauuucucggaucaauaacgcuuguuuugaggccguuguggucacgaauaccauuccucaggaagauaaaaugaagcacugcuccaaaauccaggugauugacaucagcaugauccuggccgaggcuauucgcagaacacacaacggcgaauccguuucuuaccucuucagccaugugccgcuguga

SEQ ID NO: 74280 - RNA, 957 nt, Artificial Sequence
  derived and/or modified sequence opt5 from PRPS1L1__Homo_sapiens__NP_787082
augcccaacaucaagauuuucagcggcuccucucaccaggaccugagccaaaagaucgccgauagacucgggcuggagcuuggaaagguggucaccaaaaaguuuuccaaucaggaaacaugcguugagauugacgaaucugugcggggcgaggauguguacaucguccagagcggguguggagaaauuaacgacucccugauggagcuccugaucaugaucaaugcuugcaaaauugccucugcgagccgcgugacggcuguuaucccuuguuucccguaugccagacaggauaagaaggacaaaucccggagccccauuucugccaaacuuguggcuaacaugcuguccaucgccggcgcugaucauauuaucaccauggaccuccacgccagccaaauucagggguuuuucgauaucccugucgacaaucuguacgcggagcccacagugcugaaauggauccgcgaaaacauuccugaguggaagaauugcaucauuguuucucccgaugccggaggcgcuaaaagagugaccuccaucgccgaccagcucaacgucgauuuugcucugauucauaaggaacggaagaaagccaaugagguggacuguaucgugcuugucggcgacguuaacgaucgcguggcgauccugguggacgauauggccgacacaugcgucaccauuugucucgcugccgauaagcugcuuagcgcuggggccacaagaguguaugccauccugacccacggaauuuucucuggcccugcuaucucccggauuaauacggcgugcuuugaggccguuguggucaccaacacaaucccgcaggacgagaaaaugaagcauuguagcaaaauccgcgugauugauaucuccaugauucucgcugaagccaucagacggacccacaauggggaaucuguuagcuaccuguucucccacgugccccuguga

SEQ ID NO: 74281 - RNA, 966 nt, Artificial Sequence
  derived and/or modified sequence opt5 from PRPS2__Homo_sapiens__NP_001034180
augcccaacaucgugcuguucagcggcuccucucaccaggaccucagccaaagagucgccgaucggcuggggcuugagcugggaaagguugugaccaaaaaguuuuccaaucaggaaacaucuguggagauuggcgaaagcguccgcggggaggacguguacaucauucaguccggaugcggcgaaaucaacgauaaucucauggagcugcuuauuaugaucaacgcuuguaaaaucgccucuagcuccagaguuacggcggugauuccuugcuucccguaugcucggcaggacaagaaagauaaggucggggagagccgcgcccccaucucugccaagcugguggcuaauaugcucuccguugccggagcugaccauauuaucaccauggaucugcacgccagccaaauucagggcuuuuucgacaucccuguggauaaccuguacgcggaacccgccguccuccaguggauuagagagaauaucgcugaauggaaaaacuguaucauugugucuccugacgccggcggggcuaagcgggugacauccaucgccgaucgccugaaugucgaguuugcgcuuauucauaaagagagaaagaaagccaacgaaguugaccggauggugcuggugggagaugucaaggaccgcguggcuauccucguugacgauauggccgauaccugcggcacaauuugucacgcugccgacaagcugcuuagcgccggggcuaccaaaguguaugcgauccugacacauggaaucuucucuggccccgccauuuccagaaucaauaacgcugccuuugaggccgucgugguuaccaauacgauuccucaggaagacaagaugaaacacugcaccaagauccaagugauugauaucagcaugauccucgcugaggccauucggcgcacacacaacggggaauccgucucuuaccuguucagccaugugccgcuguga

SEQ ID NO: 74282 - RNA, 1158 nt, Artificial Sequence
  derived and/or modified sequence opt5 from PRPSAP1__Homo_sapiens__NP_002757
augcccaagaaacugcuccugcuuccuccgcccagcgccuccucugcuuucagagugccucgggcccgccccgucccucccccugcgaugaacgcugccagaaccggcuaccggguuuuuagcgccaauuccacagcugccugcacggagcuggcuaagcgcaucaccgaaagacucggggccgagcugggaaaaucugugguguaucaggaaacaaacggcgagacccgggucgaaauuaaggagagcgugcgcgggcaagacaucuucauuauccagacaauuccgagagauguuaauaccgcggugauggagcuucugaucauggccuacgcucucaaaacagccugugcucggaacaucauuggagucauccccuauuuuccuuacuccaagcagucuaagaugcgcaaaagaggcagcauugugugcaagcugcuggccuccaugcucgcgaaagccgggcugacccacaucauuacgauggaccuucaucagaaggaaauccaaggauucuuuagcuuccccguugauaaucugcgggcuucuccuuuucuccugcaguauauucaggaggaaauccccaacuaccgcaaugccgugaucgucgcuaaauccccggacgccgccaagagagcucagagcuaugcggagcggcuucgccugggccucgccgugauucacggcgaggcucaauguaccgaacuggauauggacgaugggagacauucuccucccauggugaagaacgccacaguccacccuggacuggagcucccccugaugauggccaaagaaaagcccccuaucaccguugugggcgacgucgggggacggauugcuaucauuguggaugacaucaucgaugacguggaguccuucguugccgcggcugaaauucuuaaagagagaggcgccuacaagaucuacgugauggccacacaugggauucugagcgcugaggccccgcgccucaucgaagagucuuccgucgaugaagugguugugaccaauacggucccccacgaggugcagaaacugcagugcccuaagauuaaaacagucgacaucagccuuauccuguccgaagcuauucggagaauccacaacggagagucuauggccuaucucuuucgcaauauuaccguggacgauuga

SEQ ID NO: 74283 - RNA, 990 nt, Artificial Sequence
  derived and/or modified sequence opt5 from PRPSAP2__Homo_sapiens__NP_001230865
auguucugcgugacacccccugagcuggaaaccaagaugaacaucacgaaaggcgggcucguccuguuuagcgccaauuccaacucuagcuguauggagcuuuccaagaaaauugcugaagacguuaauaccacaaucauggagcugcucauuaugguguacgccugcaagaccucuugugcgaaaagcaucauuggagugaucccguauuuccccuacuccaagcagugcaagaugagaaaacggggcucuaucgucagcaagcugcuugcuuccaugauguguaaagccgggcugacacaccucauuaccauggaucugcaucaaaaggaaauccagggauuuuucaacauuccuguggacaaucugcgcgccagccccuuucuccugcaguauauccaggaggagauuccugauuacagaaacgcuguuaucguggccaaaucucccgcuuccgccaagcgggcgcagagcuucgccgaacgccuuagacugggcauugcugucauccacggggaggcccaagacgcugaaucugaucucguggacggacggcauuccccuccgaugguucgcagcguggccgcgauccaccccucucuggagauuccuaugcuuauccccaaggagaaaccucccauuacagucgugggcgaugugggcgggagaaucgccauuaucgucgacgauaucauugacgauguugacuccuuucuggcugccgcugaaacccucaaggagcggggagccuauaaaaucuucgugauggccacgcauggccugcugagcuccgaugcuccgcgcagaauugaagagucugcgaucgacgaaguggucgugaccaauacaauuccucacgagguucagaagcuccagugccccaaaaucaagaccguggacaucagcaugauucuguccgaggccauccggcgcauucacaacggggaaagcaugucuuaccuuuuuagaaauaucggacuggaugacuga

SEQ ID NO: 74284 - RNA, 1083 nt, Artificial Sequence
  derived and/or modified sequence opt5 from PRR11__Homo_sapiens__NP_060774
augcccaaguucaaacagagacggcgcaagcugaaagccaaggcugagagacucuuuaaaaagaaggaagccagccacuuccaauccaaacugaucaccccuccgcccccucccccuucucccgagcgggugggcauuagcuccaucgacauuucucagagccgcuccuggcuuacaucuagcuggaacuuuaauuucccuaacaucagagaugcgauuaagcuguggacgaaucgggucugguccaucuacagcuggugccagaacuguaucacccagucucucgaaguucugaaagacacaauuuuuccgucccgcaucugccauagagagcuuuauagcgugaagcaacaguucuguauucuggaaucuaaacucugcaagcugcaggaggcucugaagaccaucuccgagucuagcuccugucccagcugcgggcagacaugucacauguccggaaaacucaccaaugugccugccugcguccugauuacacccggcgauucuaaggccgugcuuccucccacccugccgcaaccugcuagccauuuucccccuccgcccccuccgcccccucuucccccucccccgccuccccuggccccuguucuucugcggaaacccucccucgcuaaggcccugcaggcggggccucugaaaaaggacggacccaugcagaucacggugaaagaucuccugaccgucaagcucaagaaaacacagagccuggacgaaaagcgcaaacucauuccgucuccuaaggccagaaacccccuggugaccguuuccgaucuucaacacgugacacugaaacccaauagcaagguccucucuacccgggugacgaacgugcugaucacaccuggcaagagccagauggaccugcgcaaacuccugagaaaggucgauguugagcggucccccgggggaacaccccuuaccaauaaagaaaacauggagaccggcaccggccugacaccugugaugacgcaggcucuccgcagaaaguuccaacuggcccauccccggucuccuacccccacacuuccucugagcaccuccagcuuugacgagcagaauuga

SEQ ID NO: 74285 - RNA, 297 nt, Artificial Sequence
  derived and/or modified sequence opt5 from PRR13__Homo_sapiens__NP_001005354
auguggaaccccaaugccggcgggccuccgcaccccgugccucagcccggauacccuggcugccaaccccuggggccuuauccgcccccuuaucccccucccgcuccgggaaucccucccgucaacccucucgcccccggcaugguugggcccgcggugauuguggacaagaaaaugcagaagaaaaugaagaaagcucauaagaagaugcacaaacaucagaagcaccauaaauaccacaagcacggaaaacauagcuccucuagcuccucuagcuccucuagcgauuccgacuga

SEQ ID NO: 74286 - RNA, 390 nt, Artificial Sequence
  derived and/or modified sequence opt5 from PRR15__Homo_sapiens__XP_011513501
auggccgacagcggcgaugcuggguccucuggacccugguggaaaagccugaccaacuccagaaagaagucuaaagaggccgcggugggcgucccuccgcccgcucagccugcccccggggaaccuacacccccugccccgcccagcccugacuggacguccucuagccgggagaaucaacaccccaaccuccugggaggcgcuggggaaccucccaagccggauaaacuuuacggagacaaguccggcagcucucgcagaaaucugaagaucucccggagcggccgcuucaaagagaagagaaaaguucgggccacccuccugccugaagcugggcgcucucccgaggaggccggauuuccuggcgauccccaugaagacaagcaguga

SEQ ID NO: 74287 - RNA, 915 nt, Artificial Sequence
  derived and/or modified sequence opt5 from PRR16__Homo_sapiens__NP_001287712
augagcgccaaguccaaaggcaaccccucuagcuccugcccugcugaggggccgcccgccgcgucuaagaccaaagugaaggaacagaucaaaauuaucgucgaggaccuggaacucguucugggagaucuuaaggacguggcuaaggagcugaaagaaguggucgaucaaauugacacacucacgagcgaucugcagcuugaggacgagaugaccgauuccucuaagacagacacccugaauagcuccagcucuggcacaaccgccuccagccucgagaaaaucaaggugcaggccaacgcuccucugauuaaacccccugcccaccccucugcuauccugacaguucucagaaagccuaauccgcccccucccccuccccggcugaccccggugaagugugaagauccuaaacgcgucgugcccacggccaacccuguuaagaccaaugggacacuucugagaaacggaggccuccccgggggacccaauaaaaucccuaacggcgacauuugcuguauccccaauuccaaccuggauaaggcgcccgugcagcuucugaugcaucggccugaaaaagaccgcugcccccaagccggcccuagagagcggguccgcuucaaugagaaggugcaguaccacggguauugucccgauugcgacaccagauacaacauuaaaaaucgggaagugcaucuccacagcgagccgguccauccucccggaaagaucccucaccaggggcccccucugcccccgacaccucaucugccgcccuuuccucucgaaaacggcggaaugggcauuucucacuccaauagcuucccgcccauccgcccugcuaccguucccccucccacggccccuaagccccagaaaacaauucugagaaaguccaccacaaccaccguguga

SEQ ID NO: 74288 - RNA, 417 nt, Artificial Sequence
  derived and/or modified sequence opt5 from PRR34__Homo_sapiens__NP_060750
augcccgccagcgcuaccgccgcguggcacugcccuccgcugugucugcccccucuccccgcuuccgccccuacaucucccccuaacccggccacgcgccccgcuccuggccccgggcggcgcgccagaugcccucagagcgcucaucccgccccgacccggggagcgcuuacauucugggccccuggcuccuggccccgcgugcugcucgucccuagaucucccgggcccguucugcgggcuccucgccuuccgcaccccgccgcuagagcccggcgcagagcguggcauggagcccggcugccuggcagccccgcucgcgccgggagaaccuuucaacggggacucguguccaauucuugggcucacgccaucuuccugccuagacccccgaacgugcuggagcuccaggucuga

SEQ ID NO: 74289 - RNA, 504 nt, Artificial Sequence
  derived and/or modified sequence opt5 from PRR3__Homo_sapiens__NP_001070965
augcccaagcggaaaaagcagaaccaccaucaaccuccgacccagcagcagcccccucugcccgagagagaagagacaggcgacgaagaggaugggagcccuaucgcccuccaccgcggacccccuggcuccagagggccgcugauucccccucuucugucucugcccccucccccguggggacggggcccuauccgcagagggcucggaccccggagcuccccuuacggccgcggcugguggggcgugaaugcugaaccucccuuccccggaccgggccaugggggacccacgagaggcucuuuucacaaagagcaacggaacccucgcagacuuaagagcuggucccugauuaaaaauaccugucccccuaaggacgauccccaggucauggaggacaagucugaucggccgguuugccgccauuucgccaaaaaggggcacugcagauaugaagaccucugugcguuuuaccacccuggagugaacgggcccccucuguga

SEQ ID NO: 74290 - RNA, 1140 nt, Artificial Sequence
  derived and/or modified sequence opt5 from PRR5__Homo_sapiens__NP_001017528
augagcucccccucucugagcgaccucggcaagagagagccugccgccgccgcggaugaacgggggacccagcaacgcagagcuugcgccaacgccacauggaacuccauccacaauggagugauugcugucuuccagcggaaaggccugccggaccaggagcuuuuuagccugaaugaagggguucgccagcuccugaagacggagcuuggaucuuucuuuaccgaauaccugcaaaaccagcuccugacaaaaggcauggugauccugagagauaagauucgguucuaugaggggcagaaacuccuggacucccuugccgagaccugggacuuuuucuuuucugaugugcugcccaugcuccaggcuaucuucuacccuguccaaggaaaggaacccagcgugcgccagcuggcccuucugcauuuuagaaaugcgauuacacucuccguuaagcuggaggaugcccuggcucgggcccacgcucgcgugccucccgccaucguccagaugcuccuggugcuucagggcguucaugaaagcagaggcgugaccgaggacuaucugcggcucgagacacugguccaaaaaguggugucuccuuaccuugggaccuauggacugcacuccagcgaaggcccguucacgcauucuuguauccucgagaagcgccugcugagacggucccgcagcggggauguccucgcgaaaaaccccguugugagaucuaaguccuacaauaccccucugcuuaaccccgugcaggaacacgaggccgaaggagcugccgcuggcgggacaagcauucggagacacuccgucucugagaugaccagcugcccugagccccagggauuuuccgacccgccuggccaaggccccacagggaccuuccgcagcucuccugcuccccauuccggacccuguccuagccggcuguauccgacgacacagcccccugaacagggccucgaucccaccagaucuagccugccucgcuccucucccgagaaucuuguggaccagauccuggaaagcguugauuccgacagcgaggggauuuuuaucgacuucggacggggcagagggucuggaauguccgaucucgaaggcagcggcgggcgccaaucuguggucuga

SEQ ID NO: 74291 - RNA, 387 nt, Artificial Sequence
  derived and/or modified sequence opt5 from PRR9__Homo_sapiens__XP_011508108
augaccgccugcacauguagcgcuaaccaccccagaauguccuucucugagcagcaaugcaagcagccuugugugccgcccccuugccugcccaaaacgcaggaacagugucaagccaaggcggaggaagucugccucccuaccugucagcaucccugccaggacaaaugucugguucaggcucaagaggugugccuuagccagugucaggaauccucucaggagaagugcccucaacagggccaggagccguaccugcccccuugccaagaucagugucccccucagugcgccgaacccugucaggagcucuuucaaacaaaaugcguggaagucuguccgcagaaggugcaggagaagugcagcuccccugggaaaggaaaguga

SEQ ID NO: 74292 - RNA, 1389 nt, Artificial Sequence
  derived and/or modified sequence opt5 from PRRC1__Homo_sapiens__NP_001273737
augauggaggaaagcggcaucgagaccacacccccugggacgccgcccccuaaccccgccggacuggcugccaccgcgauguccucuacaccugugccccucgcugccaccagcuccuucucuagcccuaaugucuccucuauggagagcuuuccgccccuggccuacuccacaccucagcccccucuucccccgguuagaccuagcgcuccccugccuuucgugcccccucccgccgugccgucugugcccccucucgucaccuccaugcccccucccguuagcccgucuacagcugccgcguuuggcaacccucccgugucccacuucccucccagcaccucugccccuaauacgcugcuucccgcuccgccuuccgggccucccauuagcggauuuuccgucggcucuaccuaugacaucacacgggggcaugccggacgcgcuccccaaaccccgcugaugcccagcuucuccgccccuagcggcacaggccuccugcccaccccuauuacgcagcaggcgucucugacaucccucgcccaggggaccggaacaaccagcgcuaucaccuuucccgaagaacaagaggauccuagaauuacacggggccaggacgaggccucugcugggggaaucuggggcuucaucaaggggguggccggaaaccccaugguuaaaagcgugcuggauaagacgaaacacuccgucgaaucuaugauuaccacacuugacccgggcauggccccuuacaucaagagcggcggggagcuggauauuguggugaccuccaauaaagaagucaagguugcugcggugcgcgacgccuuucaggagguguucggacucgcugucgugguuggcgaggccgggcagagcaacaucgcuccccaaccugugggauaugccgccggccugaagggggcgcaggaaagaauugauucucuucggcgcacaggagucauccaugagaaacagaccgcuguguccguugaaaauuuuauugccgagcugcuccccgacaagugguucgauaucggcugccugguggucgaagacccggugcacggcauccaucuggagacguuuacacaggccaccccugucccccucgaguucgugcaacaggcucagagccugaccccucaagauuacaaccuuagauggucugggcugcucguuacagugggagaaguccuggagaaaucccuucugaaugugagccggaccgacuggcacauggccuucacaggcaugucccgcagacagaugauuuauucugcugcccgggcgaucgccgaugacuacuuuccccgcauucccaaggaacaguggcagagcauggcuuggcucaaacuggagaucuuccugccucucguuacgugguga

SEQ ID NO: 74293 - RNA, 6474 nt, Artificial Sequence
  derived and/or modified sequence opt5 from PRRC2A__Homo_sapiens__NP_542417
augagcgaccgguccggccccaccgccaaggggaaagauggaaagaaauacucuagccugaaccucuucgacaccuacaagggcaaaucccuggagauccagaagccugcugucgcgccccggcacgggcuucagucucugggaaaggucgccauugcucgccggaugcccccucccgccaaucucccuagccugaaagccgaaaacaagggcaaugaucccaacguuucccuugugccuaaagacgggacgggaugggcuucuaagcaggagcagagcgauccgaaauccagcgacgccucuaccgcucagcccccugaaucccaaccccugccugccagccagacccccgccucuaaucagccgaagcggccucccgccgcuccugagaacacaccccucgugcccuccggcgucaagagcugggcccaggcuucugugacccauggcgcccacggggauggaggccgcgccuccagccugcugucccgguuuucucgggaagaguucccuacccuccaagccgcuggggaccaggauaaagccgcuaaggagcgcgaaagcgccgagcaguccagcggaccgggccccucucugagaccucaaaauagcacaaccuggcgggacgggggaggccgcggccccgaugaacuugaggggccugacagcaaacugcaucacggacaugaucccagaggcgggcuccaaccgucuggaccuccccaguuuccucccuaccggggcaugaugccucccuucauguauccgccuuaccugcccuuucccccuccguaugggccccagggaccuuaccgcuaucccacgccugacggccccagcagauucccucggguugccggcccccgcggguccggaccgccuaugagacuuguggagcccgucggccggccuucuauccugaaggaagacaaccucaaagaguuugaucaacuggaccaggaaaaugaugacgggugggcuggagcgcacgaggaaguggauuacaccgagaagcugaaauucagcgacgaggaagauggcagagacuccgaugaggaaggggccgagggccaccgcgacagccagucugcuuccggagaggaacggcccccggaggccgauggcaagaaggggaacagcccuaauucugaacccccuacacccaaaaccgccugggcugagacauccagacccccugaaaccgagccgggacccccugcccccaagccuccccucccuccgccccaucgcggcccugcggggaacuggggacccccuggcgacuaccccgacagagggggcccgccuugcaaaccgcccgcuccugaagaugaggacgaggccuggagacagcgccggaagcaaagcuccucugaaauuagccuggccguugagagagcucgccggagacgcgaagaggaggaacggagaaugcaggaggaacggcgcgccgcuugugccgagaaacuuaagagacuggaugaaaaguuuggagcgcccgacaaacggcucaaggccgagccugcugccccgcccgcugccccuuccacgcccgcgccucccccggccgugccuaaagagcugcccgcuccucccgccccucccccggcuucugccccuacacccgaaaccgagcccgaggaaccugcccaggcuccgcccgcgcagagcacaccuacccccggcgucgccgcugccccuacccuuguguccgggggaggcagcacaucuuccacgagcucuggguccuucgaagccagccccguggagccucaacugccgucuaaggagggacccgaaccucccgaggaagucccucccccgaccacaccucccguucccaaaguggagccuaagggcgaugggaucggccccaccagacagccuccgagccagggacucggcuaucccaaguaccagaaaucccugccuccccgcuuucaacggcagcagcaggaacaacugcucaagcagcagcaacagcaccaguggcagcaacaucagcaggggagcgcuccucccacaccggugccucccucuccuccccagccugucacccugggagccgugcccgcgccgcaagcuccuccgcccccuccgaaagcccuuuaucccggcgcccuggggagaccucccccuaugcccccuaugaauuucgacccccgcuggaugaugauuccgccuuacguugaucccagacuccugcagggacggccuccccuugacuuuuauccgccuggcgugcaccccuccgggcuggucccccgcgagagaagcgauuccggcggaucuagcuccgagccuuucgaccggcacgcucccgccaugcuccgcgaaagaggcacgccuccgguggaucccaagcuggcguggguuggggacguguucacagcuaccccugccgagccccggccucugaccucuccccuccgccaggccgcugaugaagacgacaaaggaaugagaagcgagacaccuccggugcccccucccccucccuaccuggccuccuauccgggcuuuccugagaacggggcucccggacccccuaucucucgguucccccuugaggaaccuggcccgcgcccccugccuuggcccccuggcagcgaugaaguggccaagauccagacacccccucccaagaaagagcccccuaaggaagagacagcgcaacucacggggcccgaggccggaagaaaaccggcucggggcgucggguccggaggccaggggccuccgcccccuagacgcgaaagccggaccgagacaagauggggaccccgcccuggaucuucccggagaggcauuccgcccgaggaaccuggggcgcccccucgccgggcuggacccaucaagaaaccuccgcccccuaccaagguggaagaacugcccccuaaaccccucgagcagggcgacgaaacaccgaagccucccaagcccgauccucuuaaaauuaccaaggggaaacucggaggccccaaggagacgccuccgaaugggaaccugagccccgccccuagacugcgccgggacuacucuuacgaaagaguuggacccaccuccugccggggccgcggcagaggggaguauuuugcccggggacgcggcuucagagggacauacggaggccgggggagaggagcucgcagccgggaauuuagaucuuaucgcgaguuccggggcgaugacggcagagggggaggcaccgggggaccuaaccaucccccggcgccucgcggccggacagccuccgagaccagaagcgaaggguccgaguacgaagagauccccaaacgcagacggcaacgcggaagcgagacgggcucugaaacacacgagagcgaucucgcuccuuccgacaaggaagcccccaccccuaaggagggcacacugacccaggugccccuugccccgcccccucccggggcuccuccgucucccgccccugcgagauuuaccgcucggggaggccgcgucuucacacccagaggggugccuagccggagaggacgcggcgggggacggcccccuccccagguuuguccgggcugguccccucccgccaaaucucuggccccuaagaaacccccgacgggcccucugccgcccagcaaggaaccucugaaagagaagcugauucccgggccucuuuccccgguggcuagaggaggcucuaaugggggaagcaacgucggcauggaggauggggaacgcccccggagacggcgccauggccgggcccagcaacaggacaagccuccccgguuucgcagacucaaacaggagcgggaaaaugcggcucgcggcuccgagggcaagccuagccugacccugcccgccucugccccggggccugaagaggcucucacaaccgugacaguggcccccgcuccuagacgggccgcggccaaaucccccgaucugagcaaccaaaauucugaccaggcuaacgaggaaugggagaccgccuccgaaagcuccgauuucacgucugagcgcagaggagacaaggaagcuccucccccgguucuucugacacccaaagccgucggcaccccugggggaggcgggggcggagccgugcccggcaucagcgcuauguccagaggggaccucagccagagagcgaaggaucugucuaagcgcuccuuuagcucucagcggccuggaauggagagacagaaucgccggcccggcccugggggaaaagccggcagcuccgggucuagcuccggcggaggcgggggaggccccgggggaagaaccggccccgggcgcggcgacaagcggucuuggccuagccccaaaaacagaucccgcccucccgaggaacggccgccuggacugccccuuccucccccgccucccuccucuuccgcuguguucagacucgaucaagucauucacagcaaucccgccggcauccagcaggcccuggcucagcuguccucucgccaagggagcgugacagccccuggaggccauccccggcacaagccugggcucccgcaggcgccccagggaccuucccccagaccucccacccgcuaugagccucaaagaguuaacucuggccugagcuccgacccgcacuuugaggagcccggcccuauggugagagggguuggaggcacaccccgcgauagcgcuggggugucuccuuucccucccaaaagacgggagagaccuccccggaagcccgaacuucugcaggaggaaucccucccuccgccccauagcucuggauuccugggcuccaaacccgaggggcccggaccucaggccgaaagccgcgacacgggcaccgaggcccugacaccccacaucuggaauagacuucauaccgcuacaucuagaaagagcuaccgcccuuccucuauggagcccuggauggaaccgcucagcccuuuugaggauguugccggcaccgaaaugucccagagcgacuccgggguggaucugucuggagacagccaagucuccucuggccccugcagccagagauccucuccugaugggggacugaagggcgcggccgaggggcccccuaaacggcccggaggcagcuccccgcucaacgcugugcccugugaaggcccucccgggagcgagccuccccgcagaccgccucccgccccucacgacggagaccggaaggagcugccccgcgaacagccucuucccccgggcccuauugggacggagagaucucagcggaccgaucgcggaacagaacccggcccuaucagacccucccaccggccggggcccccuguucaauucggaaccagcgacaaagauucugaccugcgccucguggucggcgauucccugaaggcugagaaagaacugacagccagcgugaccgaggcuauucccgugucuagagacugggagcuucugccuuccgccgcggccagcgcugaaccccaguccaagaaucucgauagcggccauugcgucccugagccgucuagcuccgggcagcggcuguaucccgaagucuuuuacggaucugccggcccuagcuccucucagaucagcgggggagcuauggacucccaacuccaccccaacucuggcggguucagaccuggaacacccagccugcauccguaccgcucccagccucuuuaucugcccccuggccccgccccucccagcgcccuccugucuggccuggcucuuaaggggcaguuucuggauuucuccaccaugcaagcgacggagcucggaaaacugccggccggcggggugcucuaucccccucccagcuuucuguauucuccugcuuucugucccuccccucuuccggacacaagccugcuccaggugcggcaggaucugcccuccccuucugacuuuuacagcacaccccugcagccuggaggccaauccggguuccuucccagcggagccccggcccagcagaugcugcucccuauggucgauucucagcugcccgugguuaauuuuggcucccucccucccgcuccgcccccugcgcccccuccccugagccuucugccugugggcccggcgcugcaacccccuucucucgccgucagacccccucccgcuccugccacccgcgugcugccgagccccgcucggccuuuccccgccucccuugggagagcggagcugcacccuguugaacucaagcccuuucaggacuaucagaaacugucuagcaaccucggaggcccgggguccucucgcacacccccuaccggacggagcuucuccggccugaacagcagacuuaaggccacgcccucuacauacuccgggguguuccgcacccagcgggucgaccuguaucaacaggcuagcccucccgaugcccugagauggauuccuaaaccgugggagcgcacaggacccccuccccgggaaggcccuuccagacgggcugaggaacccggcucuagaggggacaaggagccgggacucccucccccucgcuga

SEQ ID NO: 74294 - RNA, 8454 nt, Artificial Sequence
  derived and/or modified sequence opt5 from PRRC2C__Homo_sapiens__NP_055987
augagcgagaaguccggccagucuaccaaagcuaaggacgggaaaaaguacgcuacacugagccucuucaacacguacaaaggaaagucccuggaaacccaaaagacaaccgccagacacggccuucagucucuggggaaagugggaaucagccggcgcaugcccccuccggcgaaucuccccucccugaaggcugagaacaaaggcaaugauccuaacgugaauauuguucccaaggacgggacaggaugggccucuaaacaggaacagcaugaggaagagaagaccccugaggugcccccugcccaaccgaagcccggcguggcugccccucccgaagucgcuccugcccccaaaagcugggcguccaacaagcagggcgggcagggagauggcauccaggugaauagccaauuccagcaggaguucccgucucuucaggccgcuggggaccaagagaagaaggagaaagagacaaacgaugacaauuacggaccuggccccucccugagaccucccaacguugccugcuggcgggaugggggaaaggcugccggcagccccucuuccagcgaccaggaugaaaaacucccuggccaggacgagucuaccgcggggacguccgaacaaaaugauauucugaagguggucgagaagcgcaucgccuguggaccgccccaggcuaaacugaacggccagcaggccgcucucgccagccaauauagagccaugaugccucccuacauguuucagcaguauccucggaugaccuauccuccccugcacgggcccaugcgcuuucccccuucccuuucugaaacaaauaagggacugagaggccgggggcccccucccagcugggcuuccgagccggagcgcccuagcauucucucugcguccgaacugaaagagcuugacaaguuugauaaccuggacgccgaagcugacgagggaugggccggcgcccagauggaaguggauuauaccgagcaacucaauuucagcgacgaugacgagcagggcucuaacagccccaaagaaaacaauuccgaggaucaggggucuaaggcuagcgaaaacaaugagaacaagaaagaaacagacgagguuuccaauaccaaguccucuagccagauccccgcccaaccuagcguggcgaaagucccguacggaaagggccccucuuuuaaccaggagagagggacguccagccaucugccucccccucccaaacugcucgcucagcagcacccucccccggaucggcaagccgugccuggacgccccggcccuuuccccuccaagcagcaggucgccgacgaagaugagaucuggaagcaaagacggcgccagcagucugaaauuagcgcugccgucgagagagcucggaaaagacgcgaggaagaggaacggagaauggaggaacagcgcaaggccgcgugcgccgagaaacugaagcggcuugacgagaaacuggggauccucgaaaagcaaccguccccugaggaaauuagagagcgcgaacgggagaaggagagagaacgcgagaaagaacuggagaaggaacaggagcaggagcgggaaaaagagagagaaaaggaucgcgagcggcagcaagagaaagaaaaggagcuugaaaaagagcaggaaaagcagagagagauggagaaggaacggaaacaggagaaggaaaaagagcuggaacgccaaaaggagaaagagaaggaacuccagaagaugaaagagcaggaaaaggagugugaacuggagaaagagagagaaaagcuggaggagaaaaucgagccccgggagccuaaucucgaacccaugguugagaagcaagaaucugagaacagcugcaauaaggaagaggagcccguguuuacaagacaggacuccaaccgcagcgaaaaagaggcuaccccugugguccaugaaacagagccggaaucuggcucccagccccggccugccgugcugagcggauacuucaagcaguuucaaaaaucucuucccccuagauuccagcgccagcaggagcaaaugaagcagcagcaguggcaacagcagcagcaacagggcguucugccccagaccgugccuucccaaccgagcucuagcaccgugcccccucccccucacagaccccucuaucagccgaugcagccucacccccagcaucuggcuuccaugggguuugacccccgguggcuuaugaugcaaagcuacauggauccucgcaugaugucuggaagacccgccauggacauuccuccgauccaccccggcaugauuccucccaaaccucugaugcggcgcgaucagauggaggggucccccaauagcuccgaaucuuucgagcauaucgcgagaagcgcccgggaccacgcuaucucccucucugaaccgcgcaugcuguggggaagcgauccuuauccccacgccgagccucagcaggcuacaacgcccaaggccaccgaagaaccugaggacgugagauccgaagccgcucuggaucaagagcagauuacagcggccuacucuguugaacauaaccagcucgaggcucaccccaaggccgacuucauccgggagagcuccgaagcccaggugcaaaaauuucugagccgcucugucgaggaugugagaccgcaucacaccgacgcuaauaaccaguccgccuguuucgaagcgccugaucagaagacacuuagcgcuccccaagaggaacggauuucugccgucgagucccagcccagcagaaaacgcucugugucccauggcagcaaucacacccagaagccugacgagcagcgguccgaaccgagcgccgggauccccaaaguuacgucuagaugcauugauagcaaggagccuaucgaacgccccgaggaaaaaccuaagaaggagggcuuuauccgguccucugagggacccaaaccugaaaagguguauaaaagcaaguccgagacaagauggggcccgcgccccucuagcaaccggagagaagaggucaacgaccgcccugugcggagauccgggcccauuaaaaagccuguucugcgggacaugaaggaagaacgcgagcaaagaaaagaaaaggagggagaaaaagcugagaaggugaccgagaaagucguggugaagcccgaaaagaccgagaaaaaggaucucccgccuccgcccccucccccucagccgcccgccccuauccagccccagucuguuccucccccgauucaaccugaagcggagaaauuccccagcacagaaaccgcuacacuggcccagaagccuucccaggacacggagaaaccccuggagccugucagcaccguccagguggaacccgccgucaagacagugaaucaacagaccauggcugccccgguugugaaggaggaaaaacagccugagaaggucaucucuaaagaucuugugauugaacggccccgccccgacuccagaccugcuguuaagaaagagagcacacucccgccccggaccuacuggaaggaggccagagaacgcgauugguuuccugaccagggcuaucgggggagaggacgcggcgaguacuacucucgggggagauccuaucgcggcagcuacggaggccgggggagaggaggccgcgggcacacgagagauuauccccaauaccgggacaacaagccucgcgcggaacauauccccuccggaccucugagacagcgggaggaaucugagacccgcagcgaguccagcgauuucgaagugguccccaaaagacggagacagcgcggcucugagacagacaccgauuccgaaauccacgagagcgccucugacaaggauagccuguccaaagggaagcucccgaaacgggaggaaagaccugagaauaagaaacccgugaagccucauucuagcuuuaagcccgacaaccacguucgcauugacaaucggcugcuugaaaaaccguaugugagagaugacgauaaggcuaaaccuggcuuccugcccaagggagagcccacacggcgcggcagagggggaaccuuucggcgcggcgggagagacccuggaggccggcccucccgcccuucuacgcucagacggccggccuaccgcgauaaccaauggaaucccagacagagcgaagucccuaaacccgaggacggcgagccuccccggagacacgaacaguucaucccuauugcugccgauaagcgcccgcccaaguuugagcggaaauucgacccugccagagaacgcccccggagacagcgcccuacacggcccccgagacaagauaagccuccccgcuuucggagacugcgcgagcgggaagcugcguccaaaagcaacgaggugguggccguccccaccaaugggacaguuaacaauguggcucaggagccugugaacacccugggagacaucucuggcaauaagacccccgaucuuuccaaccagaauagcuccgaccaggccaacgaagagugggaaacagccucugagagcuccgacuucaacgaaagacgcgagagagaugagaaaaagaaugcugaccucaacgcccaaacggucgugaagguuggggaaaaugugcugccuccgaaacgggagauugcgaagcgcucuuucagcucccagagacccgucgaucggcagaacagacggggaaauaacggcccucccaaaagcgggcgcaauuuuucuggaccuagaaacgaacggcgcuccggacccccgagcaagucuggcaaaagagggccuuucgacgaucagcccgcuggaaccacaggcguggaccugaucaauggguccagcgcccaucaccaagagggaguuccuaacggcaccgggcagaaaaauucuaaggauagcacaggcaaaaagcgggaggaccccaaaccgggcccuaagaaacccaaggaaaaaguggaugcccucucccaguuugaccugaacaauuaugcuucugucgugauuaucgaugaccaucccgagguuaccgugaucgaagauccucaaagcaaccuuaaugacgacggcuucacggaggucguguccaagaagcagcagaaacgccugcaggaugaagagagacggaagaaagaggaacaagugauucaggucuggaacaagaaaaacgccaaugagaaggggcgcagccagacauccaagcugcccccuagauuugcgaaaaagcaggcuaccggaauccaacaggcccagucuagcgccuccguuccgccccuggcuucugccccucugcccccuagcaccuccgcuucugugcccgccagcacauccgcgccucuuccggccacccucacacccgugccugcuagcacgucugcccccgucccugcuuccacccuggcccccgugcuggccagcacaucugcuccgguuccugcgagcccccucgcccccgugagcgcuucugccuccgucagcgccuccgugccugcuagcaccucugccgcggcuauuacaagcuccucugcccccgccagcgcuccugccccgacccccauccuggcguccguuucuacgccugccagcgugaccauucuugcuuccgccucuauccccauccuggcuagcgcccucgcuuccacaagcgccccuacccccgcgccggccgcuucuuccccugccgcucccgucauuacagccccuaccauccccgccagcgcuccuacagcgucugugccccuggccccggcuuccgccagcgcccccgcuccugcccccaccccugucuccgcgccgaaccccgccccucccgcuccugcccagacgcaagcucagacacacaaacccgugcagaauccucugcaaaccaccucucagagcuccaagcagcccccgccuagcauucggcuucccucugcccagacaccuaacggcaccgacuacguugcguccgggaaaagcauccaaacgccccagucucauggaacacucaccgccgaacugugggauaauaagguggcuccgccugccguccugaacgacauuagcaagaaacucggccccaucucucccccucagcccccuagcgugagcgcuuggaauaagccgcugacauccuucgggucugcccccagcuccgagggagcuaaaaacggccaggaaagcggccuugagaucgggaccgauacaauucaauuuggagccccugcgucuaauggcaacgagaaugaaguugugcccguccuguccgaaaagagcgccgacaaaaucccugagcccaaggagcagcgccagaagcagccgagagcugggccuauuaaagcccaaaagcuccccgaucuguccccuguggaaaacaaagagcacaagcccggaccuaucggcaaagagcggucucugaagaaucgcaaagugaaggacgcucagcagguugaacccgaggggcaggaaaagccgagccccgccaccgucagauccacggauccugugaccacaaaagagaccaaggccgugucugagaugagcacagaaauuggaaccaugaucuccgucagcucugcggaguacggcacgaacgcuaaagaauccgugacagacuauaccacacccuccucuucccuuccuaauaccguugccaccaacaauacaaagauggaggauacgcuggugaacaacgucccccucccuaauacccugccgcuccccaaacgggaaacaauccaacaguccucuucccugaccagcgugccucccacaaccuucucucuuacguuuaagauggagagcgcuagaaaggccugggagaacuccccuaauguucgcgaaaaaggcagccccgugacauccaccgccccgccuauugcuaccggggucucuagcuccgccucuggacccagcacagcgaacuacaauuccuucucuagcgccuccaugccucagauccccguggcuagcguuaccccgacagccucucuguccggcgcugggacguauaccacaagcucucucuccaccaagagcacaaccacgucugacccucccaacauuuguaaagugaagccccaacagcugcagaccuccagccugccuucugccucccacuuuagccagcuuagcugcaugcccucccugaucgcgcaacagcagcagaauccucaagucuacgugucucagagcgccgcugcccagauuccggcuuucuauauggauacaucccaucucuuuaacacccagcacgcccggcuggcucccccuucucucgcccaacagcagggauuccaacccggccugagccagccuacauccgugcagcagauccccauuccuaucuacgcgccgcuucaagggcagcaucaggcccagcugucucucggagcuggccccgccgucagccaagcucaggagcuguucuccagcucucugcagccuuauagaucccagcccgccuuuaugcaaagcucucuuucccagccuagcguugugcuguccggcaccgccauccacaauuuccccacagugcagcaucaggaacucgcgaaagcucaaucugggcuggccuuucagcagacgagcaacacccaaccgauucccauccucuacgagcaccagcugggacaggccuccggccuugggggaucucagcugauugacacacaccuccuccaagcucgcgccaaucugacccaggcuagcaaccuuuacuccggccagguccagcaaccugggcagaccaauuucuauaacacagcccagagccccucugcgcugcagcaagugacgguuccucuccccgccucccagcugagccucccuaauuuuggaucuaccggccagccgcugaucgcccuuccccaaacacugcagccuccccugcagcauaccacaccucaggcccaagcucagagccucucccggcccgcccaggugucucagccguucagaggccugauuccugcggggacccaacacagcaugaucgccacgacaggaaagauguccgaaauggagcuuaaggcuuuuggcagcgggaucgacauuaaacccggaaccccucccaucgccggccgcucuaccacaccuaccuccagccccuuccgggcuacauccaccucuccgaacagccaguccucuaagaugaacagcauugucuaccagaaacaguuucaauccgcccccgcuacggugagaaugacacagccuuuccccacccaguuugccccucaagcgaagcagcgcgccgagguucugcagucuacacagcgguucuucagcgaacaacagcaguccaaacagaucgggggcggaaaggcucaaaagguggauagcgacucuuccaaacccccggagacccucacggauccucccggcgucugucaggaaaagguggaggaaaaaccucccccugcccccagcauugccaccaagccggucagaacagggccuaucaaaccccaggcuaucaagaccgaggagacaaagucuuga

SEQ ID NO: 74295 - RNA, 681 nt, Artificial Sequence
  derived and/or modified sequence opt5 from PRRG4__Homo_sapiens__NP_076986
auguucacccugcucgugcugcuuagccagcugcccacagucacgcucggcuuuccucacugcgccagagggccgaaggcuuccaaacaugccggagaggaaguuuucaccucuaaggaggaagcgaacuuuuucauccaccggcgccugcuuuacaauagauuugaccuggaacucuucacacccggcaaccuggagcgggaguguaaugaggaacugugcaacuaugaggaagcucgcgagauuuuuguggaugaggacaaaaccaucgccuucuggcaagaauacagcgccaaggggccuacaaccaaauccgauggaaauagagagaagauugacgugaugggccuccugacagggcuuaucgcugccggagucuuucuggugauuuucggccuccugggcuauuaccuuuguaucaccaagugcaaccggcugcagcaucccuguucuagcgcuguuuaugaacgcgggagacacacgccuuccaucauuuuucggcgccccgaggaagccgcgcucucuccucugccgcccagcguggaggaugccggacugccuuccuacgagcaggcugucgcccucaccagaaaacauagcgugucucccccucccccguauccuggccacacaaagggguuccggguuuuuaaaaaguccaugagccugcccucucacuga

SEQ ID NO: 74296 - RNA, 921 nt, Artificial Sequence
  derived and/or modified sequence opt5 from PRRT1__Homo_sapiens__NP_085154
augagcuccgagaagucuggccugcccgacagcgugccucacaccuccccgcccccuuacaacgcuccccagccucccgccgaaccuccggcgcccccuccccaagccgcuccuucuagccaucaccaucaccaucaccacuaucaucaguccgggacagccacgcuccccagacugggagccggcgggcuugcuucuagcgccgcuaccgcccagcggggaccguccagcucugcgacacugccuagacccccucaccaugccccucccggccccgcugccggggcuccgcccccuggaugcgccacccucccccgcaugccucccgauccguaccugcaggagacacgguucgaaggcccucuucccccucccccucccgcggccgcugccccgccuccucccgcucccgcccaaaccgcccaggcuccgggcuuugucguucccacacacgcggggaccgugggaacgcugccucucggcggguauguggcccccggauacccucugcagcugcagcccuguaccgcuuaugucccuguguaccccguuggcacaccguaugccgggggaaccccuggcggcacaggggugaccuccacgcugcccccucccccgcaaggaccuggccucgcccuucuggagccccgcagaccuccccacgacuacaugcccaucgcuguccucacaaccauuugcuguuucuggccuacagggaucauugccaucuuuaaagcggugcagguucggaccgcucuggcccgcggagauauggugagcgccgaaauugcuucuagagaggcccggaauuucuccuuuaucagccuugcugucggcaucgccgcgauggugcugugcaccauucucacaguggucaucauuaucgccgcucagcaucacgagaacuacugggacccguga

SEQ ID NO: 74297 - RNA, 900 nt, Artificial Sequence
  derived and/or modified sequence opt5 from PRRT2__Homo_sapiens__NP_001243372
auggccgcuagcuccucugagaucagcgaaaugaagggcguggaggaaucccccaaagucccuggggagggaccgggccacucugaagccgagaccgggcccccucagguucuggcgggagugcccgaccaaccugaggcuccccagccuggcccgaacacaacggccgcccccguggauagcgggccuaaggcuggacucgcccccgaaaccacagagaccccugcuggcgccuccgaaacagcgcaggccaccgaccugucucuuagccccggcggggaguccaaagcuaauugcagcccggaggauccuugucaggaaacagucucuaagcccgagguguccaaagaagccaccgcugaccaaggaagcagacuggagucugccgcgccucccgaacccgccccugagccggcuccccagccugauccccggccugacucccagcccacgccgaagccugcccuccagcccgagcugccuacccaagaagaucccacaccugagauucuuagcgaaucuguuggcgagaagcaggaaaacggggcuguggucccccugcaggccggagacggcgaggaggggccggccccugaaccccauuccccucccagcaaaaaguccccgcccgcuaauggagcgccuccccgcgugcuccagcaacugguugaggaagauagaaugcggcgcgcccacucuggccauccuggcagccccagagggucccugagccggcacccuucuucccagcucgcuggacccggcguggaagggggagagggcacccagaaaccgcgcgacuacaucauucuggccauccuuagcugcuucuguccuauguggcccgucaacauuguggccuuugcuuaugccgugauggucucuccuauggggcccuga

SEQ ID NO: 74298 - RNA, 654 nt, Artificial Sequence
  derived and/or modified sequence opt5 from PRRX1__Homo_sapiens__NP_008833
augaccagcuccuacggccacgugcuggagagacagcccgcccucgggggacggcuggacucuccuggcaaccuugauacacugcaagcuaagaaaaauuucagcgucucccaucuccuggaccuugaagaggccggggauaugguugcggcucaggccgacgaaaacgugggagaggccggccgcucucugcucgaaagcccggggcugacguccggaucugauacaccccagcaggacaaugaucaacugaacagcgaggagaagaaaaagagaaaacagcggcgcaauagaaccaccuuuaacuccagccagcuccaggcucuggaacggguguucgagcgcacacacuauccugacgccuuugucagagaagaucuugcucggcgcgugaaucugaccgaggccagaguucaagugugguuccagaaccggcgcgcgaaguuuagacggaaugagcgcgccaugcucgcuaacaagaaugccucucugcuuaaauccuacagcggcgacgucacagcuguggaacagcccaucguuccuagacccgccccucggccgaccgauuaucugucuuggggcacggcgucccccuacagaucuagcucccucccucgcugcugucugcaugaggggcugcacaacggauucuga

SEQ ID NO: 74299 - RNA, 762 nt, Artificial Sequence
  derived and/or modified sequence opt5 from PRRX2__Homo_sapiens__NP_057391
auggacagcgccgcugccgcguucgcucuggauaagcccgcccucggcccugggccgcccccucccccucccgcccugggaccuggcgacugcgcucaggcccggaaaaacuuuuccgugucucaccuucuggaucucgaggaagucgcugccgcggggagacuggccgcucgcccgggagccagagcugaggcccgggaaggcgcggcccgcgagcccagcgggggauccucuggcagcgaagcugccccucaagacggcgagugucccuccccugggagaggaucugcugccaagcggaaaaagaaacagcgcagaaaucggaccacauucaacagcucccagcuucaggcccuggagcgcguuuuugaaagaacgcauuaccccgaugcuuucgugcgggaggaacucgcgcgcagagugaaucugagcgaggcccggguccaagugugguuucagaaccgcagagcuaaguuccggagaaaugagcgcgccaugcuggccucucgguccgcuagccuccugaagucuuauucccaggaagccgcgaucgagcagccgguugcuccuagacccaccgcccuuagcccugacuaccugucuuggacagccuccagccccuauuccaccgugcccccuuacucuccgggcagcuccgggcccgcuacaccuggagucaacauggccaauagcauugcuucucuccgccugaaagccaaggaauuuucccuucaccauagccaagugcccaccguuaacuga

SEQ ID NO: 74300 - RNA, 2628 nt, Artificial Sequence
  derived and/or modified sequence opt5 from PRSS12__Homo_sapiens__NP_003610
augacccuggccagauucgugcucgcucugaugcuuggcgcccugcccgaggucguuggguuugacagcgugcucaacgauucccugcaccauucucaccggcauagcccuccggcgggaccccacuacccuuauuaccuucccacacagcaacgcccucccagaacgcggccuccgcccccucugccccgcuucccuagacccccgcgggcucucccugcccagcgcccccaugcccugcaggcuggccacaccccuagaccccaccccugggggugcccugccggagaaccguggguguccgucacagacuuuggcgcucccugucugcggugggccgaggugccucccuuccucgaacgcucuccucccgcgagcugggcccagcugagagggcaacggcauaauuuuugccgcuccccggauggagcuggcagaccuugguguuucuauggcgacgcccgggggaagguugauuggggauacugcgacugucgccacggcucugugagacuucggggcggaaagaacgaguuugaaggcaccgucgagguguaugcuagcgggguuuggggaacagugugcuccagccauugggaugacucugaugccuccgucaucugucaccagcugcagcucggcggcaaggggauugcgaaacagacccccuucagcggacugggccuuaucccuauuuacuggucuaaugugagaugccgcggggacgaggaaaacauccugcucugugagaaggauauuuggcaaggaggcgugugcccccagaaaauggccgcugccgucacauguuccuuuagccacgggccuaccuuccccaucauccggcuggcuggagggucuuccguucaugaaggcagaguggagcuguaucacgccgggcaguggggaacggugugcgacgaucagugggacgacgccgaugcugaggucauuugccgccaacucggccugagcgggaucgcgaaggccuggcaucaggcuuacuuuggagaaggcuccgggccggugaugcuugacgagguucgguguaccggcaaugaacugucuauugagcagugcccuaagagcuccuggggagaacacaacuguggccauaaagaggaugccggggugagcugcacaccccucaccgacggagucaucagacuggccggcgggaagggaucucacgagggccgccuugaaguguacuaucgggggcaauggggcacaguuugugaugacggauggaccgagcugaauacguacguggucugcagacagcucggcuucaaauaugggaagcaggcuuccgccaaccacuuugaagagagcacaggacccauuuggcuggaugacgugucuuguagcggcaaagaaacccgcuuccugcagugcucccggagacaaugggggcgccaugauuguucucaccgggaggacgucagcaucgcgugcuacccuggaggcgaggggcauagacucucccugggcuucccggugcggcuuauggauggagaaaauaagaaggagggccgcguugaaguguuuauuaacgggcaguggggaacaaucugugacgacggcuggaccgauaaagacgcugccgucaucugcagacagcugggguauaagggacccgcccgggcuagaaccauggccuacuucggcgaggggaaaggcccuauucacguggauaauguuaagugcacaggaaacgaacgcagccucgcugacuguaucaaacaggauauuggccggcacaauugcagacauucugaggacgccggggugaucugugauuauuuuggaaagaaagcguccggcaacagcaauaaggagucucuguccagcgucugcgggcuucgccugcuccacagacggcaaaagcgcauuaucggaggcaaaaacucccugagaggcggguggcccuggcaagugucucugcggcucaagagcucccauggagacggccgccugcuuuguggggccacgcugcucucuagcugcugggugcugaccgcugcccacuguuucaaaagauacggaaacuccacacggagcuacgcuguucgcgucggcgauuaucauacccuggugccugaagaguuugaagaggagaucggggugcagcagauugucauccacagagaauaccggcccgaccgcucugauuaugacauugcccuugugagacuccagggaccugaggaacagugcgcgcgguucuccagccacguucugcccgccugucugccgcucuggagagagcgcccucagaagacagcuucuaauugcuacaucaccggcuggggcgauacggggcgggccuauuccagaacacugcagcaagcugccauuccccuucugccuaaacgcuuuugugaggaacgguacaagggaagauucaccggccgcaugcucugcgccgggaaccugcaugagcacaagcggguggacagcugccagggagacucuggcgggccccugaugugugaaagaccgggagagagcugggucguguauggcguuaccuccuggggcuacgggugcggagugaaagauagcccuggcgucuacacaaaggugucugcuuuuguucccuggaucaaauccgugaccaaacuuuga

SEQ ID NO: 74301 - RNA, 1545 nt, Artificial Sequence
  derived and/or modified sequence opt5 from PRSS16__Homo_sapiens__NP_005856
auggccguguggcuggcucaguggcucggcccccugcuucuggucagccucugggggcugcuugccccugcgucccugcucagacggcugggagagcacauccaacaguuccaggaaucuagcgcucagggccuggggcucucccugggaccgggcgccgccgcccuucccaagguuggguggcuggagcaacuccuggacccuuuuaacgugucugaucgccggagcuuccuucagagauacugggugaaugaccagcauugggucggacaggauggccccauuuuucugcaccucggcggggaaggaucccugggcccugggucugugaugcgcggacaucccgccgcucuggccccugcguggggcgcccucguuaucagccuggagcacagauucuaugggcuuuccauuccggcuggaggccuggaaauggcccaacuccgguuucugagcucucgccuugcucuggccgacguggucuccgcgagacucgcccugagccggcuguucaacaucucuuccagcucucccuggauuugcuuuggcggguccuacgcuggaagccucgccgcuugggcccgccugaaauucccucaucuuaucuuugccuccguggcuucuagcgcgcccguuagagccgugcuggauuucuccgaguauaaugacgucgugagccggucucucauguccaccgcuaucggcgggagccuggagugucgcgccgccgugucugucgcuuuugccgaaguugagagacggcuucgcagcggaggcgcggcucaggccgcccugagaacagaacucuccgcuugcgggccucugggacgggccgagaaccaggcugagcugcucggcgcccugcaggcgcuugugggcggggugguccaauacgauggacagacgggcgcuccccugucugugagacagcucugugggcugcugcuuggaggcgggggcaaucgcagccacuccaccccguauugcggacuccggagagcuguucaaauugugcugcacagccugggccagaagugucucucuuucucccgcgccgaaacagucgcucagcugcggagcaccgagccucagcuuucuggggugggagacagacaauggcuguaccagacaugcaccgaauuuggcuucuauguuacaugugagaacccccgcugcccuuucucccagcuccccgcccugcccagccagcuggaucuuugugaacaaguguuugggcucuccgcgcugucugucgcccaggcuguggcccagaccaauagcuacuacggaggccagacgccuggggcuaacaaaguccuguucgugaauggcgacaccgauccguggcauguucucuccgugacacaagcccugggaucuagcgaguccacccuucugauccggacaggcagccacugccucgacauggcccccgagagaccuucugauucccccagccugcgccuggggcggcagaacauuuuucagcagcuucaaaccuggcucaagcuggcuaaagaaucucagaucaagggagaggucuga

SEQ ID NO: 74302 - RNA, 744 nt, Artificial Sequence
  derived and/or modified sequence opt5 from PRSS1__Homo_sapiens__NP_002760
augaacccccugcucauccugaccuucguggccgcugcccuugcggcuccuuuugacgaugacgauaagauugucggcggguacaauugcgaggagaacagcguuccguaucaggugucccucaauucuggauaccacuucuguggcgggagccugaucaacgagcaauggguggucuccgccggacauugcuauaaaucucggauucaggugagacugggcgaacacaauaucgagguucuugaagggaacgagcaguuuauuaaugccgcuaagaucauccgccauccccaguacgacagaaaaacacugaacaaugauauuaugcucaucaagcugagcucccgggccgugauuaacgcucgcgucucuacgaucagccugccuaccgcgcccccugccacaggaaccaaaugucucauuuccggcuggggcaauacagccagcucuggggcugacuaucccgaugagcugcaaugccuugacgccccugugcugucccaggcuaagugugaagccagcuacccgggaaagaucaccucuaacauguucugcguuggcuuucucgaagggggaaaagauuccugucagggcgacagcgggggacccguggucugcaauggccagcugcaaggcguggugucuuggggagaugggugugcgcagaagaacaaaccuggcgucuauacaaagguuuacaauuacgugaaauggauuaagaacaccaucgccgcuaacuccuga

SEQ ID NO: 74303 - RNA, 678 nt, Artificial Sequence
  derived and/or modified sequence opt5 from PRSS21__Homo_sapiens__NP_001257381
augggcgccagaggggcucugcuccuggcccuucugcucgcgcgggcuggacugcgcaagcccgagagccaggaagccgccccucuuuccggcccgugcgggagacgggugaucaccucucgcauugucggaggcgaggacgcugaacuggggagauggcccuggcaaggaagccuccggcugugggauucccacguuuguggcgugucucugcucagccaucgcugggcccugacagcugcccacugcuucgagacggaccuuuccgauccuucuggcuggauggugcaguuugggcagcugaccagcaugcccuccuucuggagccuccaggcguacuauacaagauacuuugucucuaacaucuaucuguccccucgguaccuuggaaauagccccuaugacauugcccuggugaaacucucugcuccuguuaccuacacaaagcauauccaaccgauuugucugcaggccuccaccuucgaauuugagaaccgcacagauugcugggugaccggcuggggguauaucaaagaggacgaaggaagcucuggcagacaccauaagcagcuguacguccagcccccucucccccaagugcaguucccucaggggcaccuguggcggcacggacuuuguuggcagugcccccgcagagagggcugucugcuccgguga

SEQ ID NO: 74304 - RNA, 954 nt, Artificial Sequence
  derived and/or modified sequence opt5 from PRSS22__Homo_sapiens__NP_071402
augguggucagcggcgcucccccugcccucgggggaggcugccuggggaccuucacaucccugcuucugcucgccucuacggcgauccugaacgcugcccggauuccgguucccccugccuguggaaagccccagcaacuuaauagaguggugggcggggaggacagcaccgauuccgaauggccuuggaucgucucuauucagaaaaacggaacacaccauugcgcuggcagccugcucaccucccgcugggugaucacagccgcucacuguuuuaaggacaaucugaacaaacccuaccuguucucuguucuccugggcgccuggcagcuugggaauccuggaagcagaucccagaaggugggcgucgcguggguggagccgcaucccguuuauagcuggaaagaaggggccugcgcugauauugcccuggugcggcucgagcgcucuauccaauuuuccgaaagaguccugccuaucugucuucccgacgcuagcauucaucugccucccaacacccacugcuggaucucuggauggggcuccauucaggauggggugccgcucccucacccccagacacugcagaagcugaaggugccuaucauugacagcgaggucuguucucaccucuacuggcggggagccggccaaggccccaucaccgaggauaugcugugcgcgggguaucuugaaggagagcgcgacgccugucugggcgauuccgggggaccccucaugugccagguugacggcgcuuggcugcuugccgggauuaucagcuggggagaaggcugugcugagagaaaucggccuggcguguacaucucccugucugcccaucgcagcuggguggagaaaauuguccagggggugcagcucagaggacgggcccaaggcgggggagcucugcgcgcgccgucccagggcagcggggccgcugccagaucuuga

SEQ ID NO: 74305 - RNA, 1299 nt, Artificial Sequence
  derived and/or modified sequence opt5 from PRSS23__Homo_sapiens__NP_001280107
augugcagcggcgccgggggagugagagcugccagcccccggccugaggcgggccgcgcugggcugggauggagaggcgggcggacccgccagcucccggcccugcuugccucucugcucgcucugggaugugccgcuggccaagccugggaacccagagcgcuuagccggcgcccucaccuguccgagagacggucugaaccccgcccuggcagagccgcucggcgcgggacaguccucggaauggccggcauccccgggcugcuguuccuccuguuuuuccuucugugcgcuguuggacaggugagcccuuacuccgccccguggaagcccacguggccugcguauagacuccccgugguccugccucagucuacccuuaaccuggccaaacaguaccucagcuaugagacacuguacgcuaauggcucccggaccgaaacacaaguggggauuuauauccuguccucuuccggagacggcgcccagcaucgcgauagcgggucuuccggcaagagcagacggaaaagacagauuuacggauaugacucucgcuuuuccaucuucggcaaggauuuucuccugaacuaccccuucagcaccuccguuaaacuuucuacaggguguaccggaacgcugguggcugagaagcacguccucaccgccgcccauugcauucacgacggcaagacauacgugaaagggacccagaagcugcggguuggauuucuuaaaccgaaguucaaagauggcggcagaggggcuaaugacagcacauccgcgaugccugagcaaaugaaguuucaguggauccgcgugaagcggacccauguccccaaaggauggaucaagggcaacgccaaugauauugggauggacuaugauuacgcucugcucgaacugaaaaagccucacaaaagaaaguucaugaaaaucggagugagcccucccgccaagcagcugcccggcgggcgcauucacuuuucuggcuaugacaacgaucggccgggaaaucucguguacagauucugugacgucaaggaugagacguaugaccugcuuuaccagcaaugcgacgcccagcccggcgcuuccgggagcggaguuuaugugcgcauguggaaacggcagcaacagaagugggaaagaaaaaucauuggcaucuuuucugggcaucaguggguggauaugaacggaagcccucaggacuucaaugucgccgugcgcauuacaccccugaaguacgcgcaaaucuguuacuggaucaaaggcaacuaucucgauugccgggagggguga

SEQ ID NO: 74306 - RNA, 873 nt, Artificial Sequence
  derived and/or modified sequence opt5 from PRSS27__Homo_sapiens__NP_114154
augagacggcccgccgcugugccucugcuccugcuucugugcuucggcagccagcgcgccaaggcggcuaccgccugugggagaccgcggaugcucaaccgcauggucggaggccaagacacacaggagggggaauggcccuggcagguuuccauccagagaaauggaucucacuuuugcggcgggagccugauugccgagcaaugggugcuuacggcugcccauuguuuccggaacaccuccgaaacaucucuguaccaggugcuccugggagcucgccagcugguccagccuggcccccacgccauguaugcgagagugcggcaaguugagagcaauccucucuaccagggcaccgccuccucugcugauguggcccuggucgaacuugaggcucccgugccuuuuacaaacuauauccugccgguuugccuccccgacccuagcgugauuuucgagaccgggaugaauuguugggucacaggauggggcucccccagcgaagaggaucugcuuccugaaccccgcauccugcagaaacucgccgugccgauuaucgacaccccuaagugcaaccugcuguacucuaaagauacggaguuuggguaucagcccaagaccaucaaaaaugacaugcucugugcgggauucgaggaaggcaagaaggaugccugcaaaggggacuccggaggcccucuggugugucuugucggccaaagcuggcugcaggcugggguuauuucuuggggagagggcugcgccagacagaaccggcccgggguguacauccgcgugacagcucaucacaauuggauucauagaaucauucccaagcuccaauuucagccugcccggcugggaggccagaaauga

SEQ ID NO: 74307 - RNA, 744 nt, Artificial Sequence
  derived and/or modified sequence opt5 from PRSS2__Homo_sapiens__NP_002761
augaaccugcuccugauccuuaccuucguggccgcugccgucgcggcucccuuugacgaugacgauaagauuguuggcggguacaucugcgaggagaauagcgugccuuaucaggugucccugaacucuggauaccacuucuguggcgggagccucauuuccgagcaaugggucgugucugccggacauugcuauaaaagcagaauccagguucggcugggcgaacacaauauugaggugcuugaagggaacgagcaguuuaucaaugccgcuaagaucauucgccauccgaaauacaacuccagaacacuggacaaugauauccuccugauuaagcugucuagccccgccgucaucaacucccgggugagcgcuauuucucucccuacggcgcccccugccgccggaaccgagucccugaucagcggcuggggcaauacacuuucuuccggggcugacuaucccgaugaacugcagugucucgacgccccuguucugagccaagcugagugcgaagccucuuacccgggaaaaauuaccaacaauauguucugugugggcuuucuugaagggggaaaggauuccugccagggcgacagcgggggacccgucguguccaacggcgagcugcagggcaucgugucuuggggguauggaugugcgcagaagaaucgcccuggcgucuacacaaaaguuuacaacuauguggauuggaucaaggacaccauugccgcuaauagcuga

SEQ ID NO: 74308 - RNA, 843 nt, Artificial Sequence
  derived and/or modified sequence opt5 from PRSS33__Homo_sapiens__NP_690851
augagaggcgugagcugccugcagguccuccugcuucugguucucggggccgcuggaacccaaggccggaaguccgccgcgugugggcagccccgcaugucuagcagaaucgugggaggccgggacgggcgcgauggagaguggccuuggcaggcuuccauucagcacagaggcgcccaugugugcggcgggucucugaucgccccgcaauggguccuuacagcugcccacuguuucccccggcgcgcucugccugccgaauacagagugcggcucggagcgcugcgccugggcagcacgucccccagaacccucucuguuccugugcggcgcguccugcuucccccugacuauagcgaggauggggccagaggagaccuggcucuccugcagcuucggcgcccggugccccuguccgccagaguucagccugugugccuccccgucccuggcgcucggcccccgccugggacacccuguagagugaccggauggggcagccugcgcccuggcgugccccugcccgaauggcggccucuccagggggucagaguuccgcugcuugauucucgcacaugcgacggacuguaccaugugggcgccgaugugccccaagcggagcggauuguccucccugggucccugugugccggauauccccagggccacaaagacgcuugccagggggauagcggaggcccucuuaccugucugcagucuggcuccugggugcucguugggguggucagcuggggaaagggcugcgcccugcccaacagaccggggguguacacaucuguugcuaccuauuccccuuggauccaagcccgcgugagcuuuuga

SEQ ID NO: 74309 - RNA, 1242 nt, Artificial Sequence
  derived and/or modified sequence opt5 from PRSS35__Homo_sapiens__NP_001163894
auggagaacaugcugcucuggcugaucuucuuuacccccggcuggacacuuauugacgggagcgaaauggagugggauuucauguggcaccugagaaaggugccucggaucgucuccgaacgcacguuucaucucaccucuccggccuucgaggcugacgccaaaaugaugguuaauacagugugcggaauugaaugucagaaggagcugcccaccccuagccuuuccgagcuggaagauuaccucucuuaugagacaguguuugaaaacggcaccagaacacugacccgggucaaagugcaagaccugguucucgagcccacgcagaauaucaccacaaagggggugagcguccgcagaaaacgccagguguacggaaccgauucccgguucucuauucuggacaagagauuucuuacaaacuucccuuuuagcaccgcgguuaagcuguccacgggcugcagcgggauccucaucucuccccagcacgugcugacagcugcccauuguguccacgauggaaaagacuaugugaagggcuccaaaaagcugcgggugggccuucucaaaaugcgcaauaagagcgggggaaagaaaagacggggcucuaagcgcuccagacgggaggccagcgggggagaucaacgcgaaggcaccagagagcaucugcgggaaagagcuaaagggggacgccggagaaagaaaucuggccgcggccagcggauugccgaggggagaccuuccuuccaguggacacgcgucaagaacacccacaucccgaaaggaugggcucggggcgggaugggagacgccacccuggauuacgacuaugcgcuccuggaacuuaagagagcccacaagaaaaaguacauggagcugggcauuagccccacaaucaaaaagaugccugggggaaugauucauuuuuccggcuucgauaaugaccgcgcugaccagcucguuuaucgguuuugcucugugagcgaugaguccaacgaccugcuuuaccaauacugugaugccgaaagcggcucuacgggguccggaguguaucugagacucaaagaccccgauaagaagaauuggaaacgcaagaucauugcugucuacagcggccaccaguggguggacguucauggggugcagaaagauuauaacgucgccgugcggaucaccccucugaaguacgcgcagaucugccuguggauucacggaaaugacgccaacugugcuuauggcuga

SEQ ID NO: 74310 - RNA, 786 nt, Artificial Sequence
  derived and/or modified sequence opt5 from PRSS3__Homo_sapiens__NP_001184026
augcacaugagagagaccagcggcuucacacugaagaaagggcgguccgcuccccucguguuucauccuccggacgcccugaucgccguccccuucgaugacgaugacaagauuguuggaggcuacacgugcgaagagaacucucuuccuuaucaggugagccucaauuccgggucucacuuuuguggaggcagccugaucuccgaacaauggguggucucugcggcucauugcuacaaaacccgcauucaggugagacugggggagcacaacaucaagguucuugaaggaaaugagcaguucauuaacgccgccaaaaucauccggcaucccaaguauaaucgcgauacacuggacaacgauauuaugcucaucaagcugagcuccccugcugugauuaaugccagagucagcaccaucucucugcccacagcuccuccggccgcgggcaccgagugucucauuuccggcugggggaacacacugagcuuuggagccgacuaccccgaugaacuuaaaugccuggacgcuccugugcucacccaggccgaguguaaggcuucuuaucccggcaaaaucaccaauuccauguucugcguuggguuucuggaaggaggcaaggauagcugucaacgggacucugggggaccuguggucugcaacggccagcuucagggcgugguguccugggggcacggaugugccuggaaaaaucgccccggcgucuacacgaagguuuauaacuacguggauuggauuaaggacacaaucgcggccaauagcuga

SEQ ID NO: 74311 - RNA, 1158 nt, Artificial Sequence
  derived and/or modified sequence opt5 from PRSS50__Homo_sapiens__NP_037402
augggcagauggugccagaccguggcccgggggcaacgccccagaacaagcgcuccuucccgggccggagcgcugcuccugcuucugcuccugcuucgcucugcuggcuguuggggagccggggaggccccgggcgcucugagcacggccgaccccgcugaucaguccguccagugcguuccuaaggccaccugucccucuagcagaccucggcuccuguggcagacacccaccacacaaacccugccuuccacaaccauggaaacgcaguucccggugucugaggggaaaguggaccccuaccgcagcugcggauuuuccuaugaacaggauccuacccucagagaccccgaggcggucgcccggcgcuggccuuggauggugagcguuagagcuaacggcacacacaucugugccggcaccauuaucgcuucucagugggugcugacagucgcccauugccuuauuuggcgggaugugaucuacuccguucgcguggggagccccuggauugaccaaaugacccagacggcgucugaugucccggugcuucaggugaucaugcacuccagauaucgggcccagcgcuucuggagcugggucggacaagcuaaugacaucggccuccugaagcugaaacaggaacugaaguacucuaacuauguuagaccuauuugucuccccgggacagauuacgugcugaaagaccauucccggugcaccgugacaggauggggccugagcaaggccgaugggauguggccucaguuuagaaccauccaagagaaggaggucauuauccucaauaacaaagaaugugacaauuucuaucacaacuuuaccaagauucccacacuggugcagaucauuaaaucccagaugaugugcgcugaggauacgcaucgcgaaaaguucuguuacgagcuuaccggagagccccugguuugcucuauggaaggcacaugguaccucgugggccuggucagcuggggagccgggugccagaaauccgaggccccuccgaucuaucuucaagugagcucuuaccagcacuggaucugggacugucugaauggccaggcucucgcgcugcccgccccuucccggacccugcuccuggcccuuccccugccucucagccugcuugcugcccuguga

SEQ ID NO: 74312 - RNA, 1662 nt, Artificial Sequence
  derived and/or modified sequence opt5 from PRSS53__Homo_sapiens__NP_001034592
augaaguggugcuggggccccgugcugcucaucgccggggcuaccguccugauggagggacuucaggccgcgcagagagcuuguggccagcgggggccuggaccgcccaaaccucaggaaggcaacacaguucccggggaguggccuuggcaggccagcgugcgcagacaaggagcccacauuugcuccggcucucugguggcugacacguggguccucaccgccgcucauuguuucgaaaaggccgcggccacagagcugaauagcugguccgugguucuuggcucucugcagcgggaagggcucagccccggagcugaggaggugggcgucgccgcucugcagcugccucgcgccuacaaccacuauucccaggggucugaucucgcgcugcuucaacuggcccauccgaccacacacacaccccucugccugccucagcccgcucauagauuuccuuucggagccagcuguugggcuaccggcugggaccaggauaccuccgacgcccccgggacgcuucggaaucugcgccucagacugaucagccggccgaccugcaacuguauuuacaaucagcugcaccaacgccaccucucuaacccugccagacccggaaugcugugcggcggcccucagcccggggugcagggacccugucaaggcgauuccgggggaccuguucuuugccuggaaccggacggccauugggugcaggcugggaucauuagcuuugcgucuuccugugcccaggaggaugcucccguccuccugacaaauaccgccgcccacagcucuuggcuucaggcucgggugcaaggagccgcguuccuggcucaguccccugaaacacccgagaugagcgacgaggauuccugcguggccugcggcucucuccgcaccgccggcccucaggcuggggcccccagcccguggccuugggaagcuagacugaugcaucagggacaacuggccuguggcggggcgcucgucuccgaggaagccguucugacggcugcccacugcuuuaucggacggcaggcucccgaggaauggagcgugggccuugggacacgcccugaggaguggggccugaaacagcucauccugcacggagccuauacccaucccgaaggcggguacgacauggcgcuucugcuccuggcccagccugugacacugggagcuucucucagaccccugugucuuccguauccugaucaccaucugcccgacggcgagcggggguggguccucggcagagcccgccccggagcugggauuuccagccugcaaaccgugccuguuacccugcuuggcccgcgggccugcucuagacuccacgccgcucccggaggcgaugggagcccuauccugcccggaaugguguguacauccgcggucggcgaacugccuucuugcgaggggcucagcggagcuccccuggugcaugaaguucgcggcacgugguuccuugccgggcugcacuccuuuggcgacgccugucagggaccugcccggcccgcuguguucaccgcccucccggcguacgaggacugggucagcucucuggauuggcaaguguauuuugcugaggaaccugagcccgaagccgagccuggcuccugccuggccaacauuagccagcccacaucuuguuga

SEQ ID NO: 74313 - RNA, 831 nt, Artificial Sequence
  derived and/or modified sequence opt5 from PRSS55__Homo_sapiens__NP_001183949
augcuccuguucagcgugcugcuucugcucucccuggucaccggcacacagcuugggcccagaacgccucugccggaggccggaguugcuauccucggccgggcccgcggggcgcacagaccccaaccuccccauccucccucuccugugagcgaaugcggagaccgguccauuuuugagggccgcaccagauacucucggaucacagggggaauggaagcugaggugggcgaguucccguggcaggucagcauucaggcccgcuccgaacccuuuuguggcgggucuauccugaacaagugguggauucugaccgccgcucacugccucuauagcgaggaacuguucccugaggaacuuuccgugguucugggaacaaaugaucucaccagccccucuauggagaucaaagagguggccuccaucauucugcauaaggacuuuaaaagagcuaacauggauaaugacaucgcccuucugcuccuggcgagcccuauuaagcuggaugaccucaaaguccccaucugucugccgacacagccuggccccgccaccuggcgggaaugcuggguggcuggguggggacaaacgaacgccgcugauaaaaauucuguuaagaccgaccuuaugaaggccccuauggugauuauggauugggaggaauguuccaagauguuccccaaacugacaaagaacaugcucugcgcgggcuacaaaaaugagagcuaugacgccuguaagcagucuuacuuucccacccugcagcgcaugaacacaggguccagccagaccaagccuccgggaucccacacguuccaucuucaaaauuga

SEQ ID NO: 74314 - RNA, 852 nt, Artificial Sequence
  derived and/or modified sequence opt5 from PRSS57__Homo_sapiens__NP_999875
augggccuggggcucagaggauggggccggccccugcuuaccguggccacagcucugaugcucccugucaagccgcccgccgggagcuggggagcgcagaucauuggcgggcacgagguuacgccucauucccgccccuacauggcuucugugagauucggaggccaacaccauugcggcggguuucugcuucgggcccgcuggguggucagcgccgcucacuguuucucccauagagaccugcggaccggacucgugguucugggcgcccacgugcugucuacagcugaaccuacccagcaggucuuugggaucgaugcccucacaacccaccccgacuaucauccuaugacacacgcgaacgauauuugccugcuucgccugaauggaagcgccgugcucggcccggcuguugggcugcuuagacugcccggacggcgcgccagaccucccaccgcuggcacgcggugucgcguggccggcuggggguucgucuccgacuuugaggaacucccucccggacugauggaggcgaaagugagagugcuggauccggacgucugcaacucuagcuggaagggccaucucacccugacaaugcuuuguacccgguccggggauagccaccgcagaggauucugcucugccgacuccggcgggccucugguuugucggaauagagcucacggacucgugagcuuuucuggccuguggugcggcgaucccaaaacaccugacguguacacccaggucuccgccuucguggcuuggaucugggauguugugcgccggagcucuccccaacccgggccucuuccgggaacgacaagacccccuggcgaagccgccuga

SEQ ID NO: 74315 - RNA, 726 nt, Artificial Sequence
  derived and/or modified sequence opt5 from PRSS58__Homo_sapiens__NP_001001317
augaaguucauccugcucugggcccugcuuaaccugaccguggcucucgccuuuaaucccgacuacacagucagcuccacgccuccguaucugguuuaccuuaaaucugauuaucugcccugcgcgggcgugcucauucacccucugugggugaucaccgcugcccauuguaaccugcccaagcucagagucauucugggggugacaaucccugccgacagcaaugagaaacaccuucagguuauuggauacgaaaagaugauccaucacccccauuucuccgugaccucuaucgaucacgacauuaugcugaucaaacucaagacagaggcugaacugaacgauuaugucaaacuugccaaucugccuuaccaaaccauuagcgagaacacaaugugcuccgugucuaccuggagcuauaauguuugugacaucuacaaggaaccggauucccuccagacggugaacauuagcgucaucucuaagccccagugccgggacgcuuacaaaaccuauaauauuacagagaacaugcugugugugggcaucgugccugggcgcagacagcccugcaaggaggucuccgccgcgccugccaucuguaauggaaugcugcaaggcauucucagcuuugcugaugggugcguucugcgggccgacgugggaaucuacgcuaaaauuuucuauuacauccccuggauugaaaacgugauccagaauaacuga

SEQ ID NO: 74316 - RNA, 1032 nt, Artificial Sequence
  derived and/or modified sequence opt5 from PRSS8__Homo_sapiens__NP_002764
auggcccagaagggcgugcuggggcccggacaacucggcgcugucgccauccugcuuuaccuggggcuccugagaagcggaaccggcgcggagggggcugaagccccuugcggaguugccccgcaggcucggauuacaggcggcuccucugccguggcugggcaguggcccuggcaagugagcaucacguaugagggaguccacguguguggcgggucccuuguuucugaacagugggugcugagcgccgcgcauugcuucccuuccgagcaccauaaagaagccuacgaggucaagcucggagcucaccagcuggacucuuauagcgaggaugccaaaguguccacccugaaggacauuaucccccauccuagcuaccuccaggaaggcucucagggggauauugcucugcuucaacugucccgccccaucacauuuagcagauauauccggccuauuugucucccggccgcgaacgccucuuuccccaauggacugcacugcaccguuacaggcuggggccacguggcuccuuccgucagccuucugacccccaaaccucuccagcagcuggaggugccccugaucucucgcgaaacauguaacugccucuacaauauugacgccaagccggaggagccucauuuugugcaggaagauauggucugugcuggguauguugagggaggcaaggacgccugccaaggggauuccggaggcccccugagcuguccuguggaagggcuuugguaccugaccggaaucguguccuggggcgacgccugcggcgcuagaaaccggcccggggucuacacgcucgcgucuagcuaugccuccuggauucagagcaaagugaccgagcugcagccccgcguugugccucaaacacaggaaucucagccggauuccaaucuuuguggaagccaccuggcuuucucuagcgcccccgcccagggccuccugagaccuauccuguuucucccccuggggcuugcucugggacuccuguccccuuggcuuucugagcauuga

SEQ ID NO: 74317 - RNA, 573 nt, Artificial Sequence
  derived and/or modified sequence opt5 from PRTFDC1__Homo_sapiens__NP_001269715
auggccggcagcuccgaggaagcucccgacuacgggagaggaguggucaucauggaugacuggccuggcuaugaucugaaccucuucaccuacccgcagcacuauuacggggaccuggaguauguucuuauuccccauggaaucauuguggaucggaucgaacgccuggccaaggacauuaugaaagauaucggcuacucugacaucauggugcucugcguccugaaagggggauauaaguuuugugcggaucuuguggagcaccugaagaauauuagcagaaacuccgaccgguucguuucuaugaaaguggauuuuauccgccucaagagcuacagaaaugaccaauccaugggcgaaaugcagauuaucggcggggaugaccugucuacacuggcuggaaagaacguccucauuguggaggacguugugggcacggggcggaccaugaaagcccugcuuagcaauaucgagaaguacaaaccuaacaugauuaaggucgccucccugcucgugaaacgcacaagcagaucugauggauuccggcccgacucccauaugcgccaccaguga

SEQ ID NO: 74318 - RNA, 3453 nt, Artificial Sequence
  derived and/or modified sequence opt5 from PRTG__Homo_sapiens__NP_776175
auggcucccccucugagaccgcucgcccggcugagacccccuggcaugcuucugcgcgcccuccugcuucugcuccugcugagcccccucccugggguguggugcuucuccgagcugucuuuugucaaggaaccccaggacguuaccgugacacggaaagauccugugguccuugacugucaagcgcacggagaggugccgaucaagguuacguggcugaaaaacggcgcuaagaugagcgaaaauaaacgcauugaggugcucuccaacgggucucuguacaucagcgaagucgagggaagacggggcgagcaguccgaugaaggguucuaucagugccuugccaugaauaaguacggagccauucugucucagaaggcucaucucgcccugagcaccaucuccgcuuuugaggugcaacccauuagcacagaaguucacgagggcggcguggcccgcuucgcguguaaaaucucuucccauccucccgccgucaucaccugggaguuuaacagaacaacccugccuaugacaauggaccggauuaccgcucuccccacgggggugcugcagaucuaugaugugagccagcgcgacucuggaaauuacagaugcauugccgcuaccgucgcccaccggcgcaaguccauggaagcgagccuuacaguuaucccggccaaagagucuaaguccuuccauaccccuacaauuaucgcuggcccccagaacauuaccacgagccugcaccaaacaguggugcucgaauguauggccaccgggaauccuaaacccaucaucuccuggucuagacuggaucacaagagcauugacgucuuuaacacacgggugcuuggaaauggcaaccugaugaucuccgauguucgccuccagcaugcugggguguaugucugcagagccaccacccccggaacacggaauuucacgguggccauggcuacccugacaguucuggcgccuccgagcuuuguggaguggcccgaaucucucaccagaccucgcgccggcacagcucgguucgucugucaggccgagggcauucccuccccuaagaugagcuggcugaaaaacgggagaaagauccacucuaauggacgcauuaaaauguacaacagcaaacuugugaucaaucagaucauucccgaggacgaugccaucuaucaaugcauggcugaaaacucccagggcucuauucugagccgggccagacucaccgucgugauguccgaggaccgcccgagcgcgccuuacaacguucaugcugaaacgaugucuuccagcgccauccugcuugccugggagcggccccuguacaauucugauaaggugauugcuuauuccguccacuacaugaaggccgaagggcucaacaaugaggaguaucaggugguuaucggaaacgacacaacccacuacaucauugacgaucuggaaccugcuagcaauuauaccuuuuacaucguggccuauaugcccaugggcgcgucccaaaugucugaccaugucacacagaacacccuggaggaugugccucucagacccccggaaauuagccugacaucccgcucuccuacggacauccuuauuagcuggcugcccauccccgccaaauaccggagaggccaggugguucucuaccgccuguccuuccggcugagcaccgaaaauucuauucagguccuugagcucccuggaacaacccacgaguaucugcuggagggccucaagccggauuccguguaccuggugagaaucacagcugccacccgggucggccuuggggaaagcucuguguggacgucccaucgcacccccaaggcuacaagcguuaaagccccuaagucucccgagcugcaccucgaaccucugaacuguaccacaaucagcgugagauggcaacaggacgucgaggauaccgcggccauucagggauauaaacuguacuauaaggaggaaggccagcaagagaaugggcccaucuuucuugacacgaaagaucuccuguacacacuguccggacucgacccucggagaaaguaucaugugcgccugcuugcuuacaacaauauugaugacggcuaccaggccgaccagaccguuagcacacccgggugcgugucuguccgggauagaauggugccgccucccccucccccgcaccaccuguaugcuaaggccaacaccuccagcuccaucuuccuccauuggcgcagaccugccuucaccgcugcgcagauuaucaauuacacaauccgguguaaccccguuggccugcaaaaugccucucuggugcuuuaucuccagacgagcgaaacccacaugcugguccagggacuggagccuaacacaaaauacgaauuugcugugcgccuccauguggaccagcuguccucucccuggagccccgucguuuaucacuccacccuuccugaggccccggccgggcccccugugggggugaaggucacacugauugaggaugacaccgcucucgugucuuggaaacccccugauggacccgaaacgguugugacaagauacaccauccuguaugccagccggaaggcguggauugcuggcgaguggcaaguccugcaccgcgaaggggccaucaccauggcccuucucgagaaccugguggcuggaaauguuuacauugugaaaaucuccgccagcaacgaagucggcgaggggccuuucucuaauuccguggagcuggcgguucucccgaaggaaacaagcgagucuaaccagagacccaagcggcuggacuccgcugaugccaaaguguacagcggcuauuaccaucuugaccagaagucuaugaccggaaucgccgucggcguggggauugcucugacaugcauccucauuugcgugcugauccugauuuaucgcuccaaagccagaaagagcuccgcuagcaaaacggcccaaaauggaacccagcagcuuccucggacaucugcgagccuggccuccggcaacgaagucgggaagaaucucgagggagcuguuggcaacgaagagucucugaugcccaugaucaugccuaauagcuuuaucgaugccaaagggggcaccgaccucauuaucaacuccuacggacccauuaucaagaauaacucuaagaaaaagugguucuuuuuccaggauagcaaaaagauucaaguggagcagccgcagcgcagauuuaccccugcuguguguuucuaucagcccggcacaacgguccugaucuccgacgaagauucucccagcuccccugggcaaaccaccagcuuuucucggcccuucggaguggccgccgacacagagcacuccgcuaauagcgaaggcucucaugagacaggggacuccggaagauuuagccacgaguccaacgaugaaauucaucuuucuagcguuaucuccaccacaccuccgaaucuguga

SEQ ID NO: 74319 - RNA, 771 nt, Artificial Sequence
  derived and/or modified sequence opt5 from PRTN3__Homo_sapiens__NP_002768
auggcccacagacccccuagcccggcucuggccuccgugcuccuggcgcuucugcucucuggcgcugcccgggccgcugagaucgucgggggacaugaagcccagccccacagccgcccuuacauggcuucccugcaaaugagaggcaaccccgggucucauuucugcggaggcacccuuauucacccuagcuuuguucugacagccgcgcauugucuccgggacaucccccagcgccuggugaaugugguccugggggcccacaacgugagaacgcaggagccuacccagcaacacuucuccguugcucagguguuucucaauaacuaugaugccgaaaauaagcugaacgacguccuucugauucagcucucuagcccggcuaaucuguccgccagcguggcgacaguucagcuuccccaacaggaucagccugugccccauggaacccagugccuggccaugggcuggggccgggucggggcucacgacccucccgcccaagugcuccaggagcugaacgugacagucguuaccuucuuuugucgcccgcauaauaucugcacauucgugccuagacggaaagcuggaauuuguuuuggcgauucugggggaccccugaucugcgacggcaucauucaggggaucgauuccuucgugauuuggggaugugccacccgccucuuuccugacuucuuuacgagagucgcccuguacguggauuggauccggagcacccuucgcagaguugaagcuaagggccggcccuga

SEQ ID NO: 74320 - RNA, 9267 nt, Artificial Sequence
  derived and/or modified sequence opt5 from PRUNE2__Homo_sapiens__NP_056040
auggaggaguuccugcagagagccaagagcaaacucaaccgguccaagcgccuggaaaaagugcacgucguuaucggccccaagucuugcgaccuugacagccugauuuccaccuuuacauacgcuuauuuccucgacaaagugucuccuccgggggugcugugucuucccguccugaauaucccucggacggaauuuaacuacuucaccgaaacacgguuuauucucgaagaacugaauaucagcgaguccuuccauauuuuucgcgacgaaaucaaccugcaccaacucaaugacgagggaaagcugucuaucacccuugugggcagcuccguucuggccagcgaagauaagacacucgagucugcgguggucaaagugauuaaccccguugagcaguccgacgcuaauguggaguucagagaguccucuagcagccugguccuuaaggaaauccugcaggaggccccugaacucauuaccgagcagcuggcccaucggcugcgcgggucuauccucuuuaaauggaugacaauggaguccgaaaagauuagcgagaaacaagaagagauccuguccauucuugaagagaaguuccccaaccugccuccgagagaggauaucaucaaugugcuccaggaaacccaguuuucugcucagggacugagcauugagcaaacgaugcuuaaggaccugaaagaacucuccgauggcgagaucaagguggccauuagcaccgucucuaugaaccuggaaaauugccuguuccacuccaacaucacaagcgaccucaaggcuuuuaccgauaaguucggguucgacguucugauucucuuuucuagcuaucuguccgaggagcagcagccccggcgccagaucgccguguacucugaaaauauggagcucuguagccaaaucugcugugaacuggaggagugccagaacccuugucuugaacuggagcccuucgauugcggaugugacgaaauucucguguaucagcaagaggacccuuccgucacaugcgaucaggugguucugguggucaaagaagugaucaauagacggugucccgagaugguuagcaacucucgcaccuccagcacggaggcgguggccggcucugcuccgcugucccagggcagcuccgggauuauggaacucuacggaucugacaucgagccucagcccagcuccgucaacuuuauugaaaauccucccgaucugaacgacucuaaucaagcccagguggaugcuaacgucgaccuugugagccccgauuccggccuggccacaaucagaagcucucgguccagcaaggagucuuccguuuuccucagcgacgauucuccugugggggaaggagcgggcccgcaucacacccugcugcccgggcuugacagcuauuccccuauccccgagggagccgucgcugaggaacacgccuggagcggcgagcauggcgaacacuuugaucucuucaauuuugacccugcucccauggccucugggcagucccagcaaagcucccauucugccgacuacagcccggcugaugacuucuuuccuaacuccgaucugucugagggacagcugcccgcgggcccugaagggcucgacggaaugggcacaaauaugagcaacuacuccucuagcucccugcuuagcggggccggaaaagauucucugguggagcacgacgaggaguucguucagcgccaggauucccccagagacaauagcgagcggaaccucucucugaccgauuuugugggcgacgaauccccuagccccgagagacugaagaauaccggcaagcgcauuccgccuacacccaugaacucucuugucgaguccagccccuccacggaagaaccugcuagccucuauaccgaagauaugacacaaaaagccaccgacacagggcacaugggaccgccccagacccaugcccggugcucuagcugguggggcgggcuggagaucgauuccaagaauauugcugacgccuggucuagcuccgaacaggagucuguguuccagagcccugaguccuggaaagaacacaagcccucuagcaucgacagacgcgcguccgauagcguguuucaaccuaaaucucuggaguucacgaaguccggacccugggaaagcgaguucggccagccugaacucgggucuaacgacauucaggauaagaaugaggagucccugcccuuucaaaaccuuccgauggagaaaagcccucugcccaacacauccccucagggcaccaaucaucucaucgaggacuucgcuucucuguggcacagcggacggucccccaccgccaugccggaaccuuggggcaaccccacagaugacggggagccugccgcuguugcccccuuucccgcuuggagcgccuucggaaaggaagaucaugacgaggcgcugaaaaauaccuggaaccuucacccuacaucuuccaagacgccgagcgucagagaucccaaugagugggccauggcuaaaucuggcuuugccuucagcuccucugaacuccuggacaacagcccuuccgagauuaauaacgaagcugcccccgagaucugggggaagaagaauaacgauucucgcgaccacaucuuugcgccuggaaaucccagcuccgaucuggaccauaccuggacaaacagcaaaccuccgaaggaggaccagaauggccucguggaucccaaaacccgggggaagguguacgaaaaagucgacucuuggaaccuguucgaggaaaauaugaagaagggcggauccgaugugcuuguuccuugggaggacagcuuucuguccuauaaaugcucugauuacagcgccuccaaccucggcgaagacucugugcccagcccucuggauacaaacuauuccaccagcgacucuuacacgucccccaccuucgcuggggaugagaaggagacagaacacaaaccguuugccaaggaggaaggauucgagagcaaagacggcaauucuaccgcugaagagacagauauuccuccccagucccugcaacagagcucuagaaaccgcaucagcuccgggcccggaaaucuugacaugugggccucuccucauaccgacaacagcuccgagauuaauacgacacacaaccucgaugaaaaugagcugaagaccgaacacacagacggcaaaaacaucagcauggaggaugacgucggggaauccucucagagcuccuaugaugaccccucuaugaugcagcuguacaaugagaccaaccggcaacucacccugcuucauagcuccacaaauucuagacagacggccccugauagccuggaccucuggaaccgcgugauucuggaggauacccaguccacagcuaccaucagcgacauggauaaugaccuggauugggacgacuguucuggcggagcggccaucccguccgauggccagacagaaggguacauggcugagggaagcgaacccgagacccgguuuacgguuagacaacuugagccuuggggccuggaauaucaggaggccaaccagguggacugggaacuccccgccucugaugagcacacaaaggacuccgcuccuagcgaacaucacacccugaaugagaagucugggcaacucauugccaacuccaucugggauagcgucaugcgggacaaagauauguccagcuucaugcugcccggaucuagccauauuaccgacuccgagcagcgcgaacuuccgccugagauccccucucacagcgcgaacgugaaggauacacacuccccugacgcucccgccgccucuggcaccagcgaauccgaggcucugauuucucaucucgauaaacaggacacagaaagagagacgcugcagagcgaugccgcgucccuggcuacccggcuugagaauccuggguacuucccccacccggacccuuggaagggccauggagacggccaaagcgaaucugagaaagaagcccagggggccacagauagaggacaccuggacgaggaagagguuaucgcuuccggcguggagaacgccagcgggaucucugaaaagggacaguccgaucaggagcucagcucccuggucgcuucugaacaucaagagauuugcaucaagagcggcaaaauuuccagccucgccgugaccuuuucuccccagacagaggaacccgaggaagugcuggaguaugaagagggcuccuacaaucuugacagccgcgauguccagaccgggaugucugcggacaaccugcagccuaaggauacgcacgagaaacaccucaugagccaaagaaauuccggagaaaccacagagaccucugacggcaugaacuucacaaaguauguuagcgugccggaaaaagaucuggagaagaccgaagaguguaauuuucuggagcccgaaaacgucgggggcggcccuccccauagagugccucgcucccuugacuucggggaugugcccaucgacucugacguucacgugagcuccacaugcagcgagauuaccaagaaucuggaugucaaaggaucugaaaacucccucccuggcgccggcagcuccgggaauuuugacagagauacgaucucuagcgaguacacacauuccucugcuagcuccccggaacugaacgacagcucuguggcccucuccagcuggggacagcagcccucuuccggcuaucaggaggagaaucaagggaacuggagcgaacagaaucaccaggagucugaacugaucaccaccgauggacaaguugagauugugacaaaggucaaagaccuugagaagaaccggaucaaugaguucgagaaauccuuugaucgcaagaccccuacguuccuggaaauuuggaacgacagcguggauggcgacucuuuuagcucccugagcucccccgagacagggaaguacucugaacacagcggaacccaucaggaguccaaccucaucgcuucuuaccaggagaaaaaugaacacgauauuagcgccacaguucagccugaggacgccagagugaucuccaccucuagcggcuccgaugacgacagcgucggcggggaagagucuauugaagaggagauccaaguggcuaacugucauguggcggaagaugagucccgggccugggacagccugaaugaaucuaacaaguuccuugucacagcugaucccaaauccgagaauaucuaugacuaccuggauagcucugaaccggccgagaacgagaauaaguccaacccuuuuugcgacaaucagcagagcucucccgaucccuggaccuucuccccucucacggaaaccgagaugcagauuacagccguugaaaaagagaagcgcagcagccccgagaccggaacaaccggcgacguggcuuggcaaaucuccccuaaagccucuuucccgaagaacgaagauaauagccagcuggagaugcucggguuuuccgcggacucuacggaaugguggaaggcuagcccccaggagggaagacugauugaauccccuuucgagcgggagcuuucugauagcuccggcgugcuggaaaucaacagcucuguccaccagaaugccucccccuggggagugccuguucaaggggacauugagcccguggaaacacauuauaccaacccguuuagcgacaaucaccagucuccuuuccuggagggcaacggcaaaaacucccacgaacagcucuggaauauccaaccccgccagccugaucccgacgccgauaaguuuagccagcuggucaaacuugaccagaucaaggagaaagauuccagagagcaaacauucgugucugcugccggggacgaacugaccccugagacccccacacaggaacagugucaggauacgaugcucccgguuugcgaccauccugauaccgcguuuacacacgcugaggaaaacagcugugugaccuccaaugucucuacaaacgagggacaagagaccaaucagugggaacaggagaaaagcuaccugggcgaaaugacgaacuccagcauugccacagaaaauuuccccgccgugucuucccccacccagcucaucaugaagccugggagcgagugggacggaucuaccccgagcgaagauucccggggcacauuuguccccgacauucugcaugggaacuuccaagagggaggccagcuugcuucugccgcuccugaucuguggaucgacgccaaaaagcccuuuagccugaaagcggacggcgaaaauccugauauucucacccacugcgagcacgacuccaacagccaggccucugauucccccgacaucugucaugauagcgaagcuaagcaggagacagagaaacaccuguccgccugcauggggccugaaguggagucuagcgaacuuugccugacggagcccgaaaucgacgaggagccgauuuaugaaccuggacgcgaguucguucccuccaaugcugaacucgauucugagaacgccaccgugcugccucccaucggcuaccaagccgacauuaaggggagcucccagccggcuucucauaagggaagcccugaacccuccgagaucaauggcgauaacagcacagggcuccaggucucugagaaaggagcgucccccgacauggccccuauucuggaacccguggauagacggaucccuagaauugagaauguugcuaccagcaucuuugugacacaccaagaaccgacccccgagggcgacggcucuuggaucuccgauagcuucucuccugagagccagcccggggcccgcgcccuuuucgacggagacccucaucuguccacggaaaaccccgcucuggucccugaugcccuccuggcgagcgacaccugucuugauauuuccgaggcugccuuugaccacucuuucagcgaugccuccggccugaacacaucuaccgggacaaucgacgauaugagcaagcucacccuguccgaaggacacccggagacacccguggacggcgaucuggggaaacaggacauuugcucuagcgaggcuuccuggggagauuuugaguaugacgugaugggccagaauaucgacgaggaucuccuucgggaaccugagcauuuccuguacggcggggaucccccucuggaagaggauagccucaagcaaucucuggcccccuacacgccgccuuuugaccuuuccuaucugaccgaacccgcgcagagcgccgagacaauugaggaagcuggaucucccgaggaugaaucccucggcuguagagccgcugagaucguucugagcgcccugccugaccgccggucugaagggaaccaggcugagaccaaaaauagacuccccggaucccagcuugccguccugcacauccgcgaggauccugaaagcguguaccugccggugggcgcggggucuaacauucucucccccagcaaugucgacugggagguggaaaccgauaacuccgaccugccugccggcggagauaucggacccccuaauggggcuagcaaggagauuucugagcuugaagaggaaaagacaauccccacgaaagagccggaacaaauuaagagcgaguauaaagaggaacggugcaccgagaagaacgaagacagacaugcccugcacauggauuacauccucguuaaucgcgaggaaaacucccacucuaaaccugagacaugugaggaacgggagagcaucgcugaacuggagcuguaugugggauccaaggaaaccggccuccaggggacacagcuugccucuuuccccgauaccugccagccugccagccugaaugagagaaagggacuguccgcugagaaaaugagcucuaaguccgacacgcggagcucuuuugaaucccccgcgcaagaucagagcuggauguuccucggccauucugaggucggggacccgucccuggaugcccgcgacagcggcccuggaugguccggcaaaacaguggaacccuuuucugagcuugggcugggagagggcccccagcuccaaauucuggaagagaugaagccucuggaaagccucgcucuugaggaagccuccgggcccguuagccagucucagaaauccaagagcagaggacgggccggcccugaugcugugacccugcaggccgucacccacgacaacgagugggagaugcugucuccgcaacccgugcagaaaaauaugaucccugauacagaaauggaggaagagaccgaguuccucgagcuggggacacgcauuagcagacccaacggccuucuguccgaggacguuggaauggauaucccuuuugaagagggcgugcucucucccagcgcggccgacaugcggccugaaccgcccaauucccuggaucugaacgacacccauccuagacgcauuaagcucacggcucccaacaucaaucuuagccuggaucagucugagggguccauucugagcgacgacaaccucgauucuccugacgaaaucgauaucaaugucgacgagcuggauacacccgacgaggccgauuccuucgaauacaccggacacgacccgacagcuaacaaggauagcggccaggaguccgaaucuauuccugaguauaccgccgaggaagaacgggaagacaauagacuuuggcgcacgguggugaucggggagcaagaacagcggauugauaugaaagucaucgagcccuacagacgcguuauuagccauggaggcuacuauggcgacgggcugaacgcgaucaucguguuugccgcuuguuuccuccccgacuccucucgggccgauuaccacuaugugauggagaaucuguuccuguacgucauuagcacccucgaacuuaugguggcugaggacuauaugaucguuuaccugaacggagccacaccuagacgcagaaugcccggccugggguggaugaagaaaugcuaucagaugauugaucggcgccucagaaagaaucugaaauccuuuaucauugugcacccuagcugguucauccggaccauccuugcugucacacgcccguuuauuucuuccaaguucagcucuaagaucaaauacgugaacucccugagcgaacucucuggacugauucccauggacuguauccauauuccugaguccaucauuaagcuggaugaagaacuuagagaggccagcgaagcggccaaaaccagcugccuuuacaaugaccccgagauguccucuauggaaaaggauaucgaccugaaacugaaggagaagccuuga

SEQ ID NO: 74321 - RNA, 816 nt, Artificial Sequence
  derived and/or modified sequence opt5 from PRUNE__Homo_sapiens__NP_001290158
auggaccugaagaucggcaaagccacccccaaggauagcaaauacguggagaagcucgaagcucuguucccugaccuuccgaaaagaaaugauauuuuugacucccugcagaaggccaaguucgaugucucugggcucacaacggagcaaaugcugcggaaagaccagaagaccaucuaucgccagggaguuaaaguggcgauuagcgcuaucuacauggaucuugaagccuuucugcagagauccaaucuccuggccgaccugcacgcuuucugccaagcccauucuuaugaugugcucgucgcuaugacaauuuucuuuaacacccacaaugagcccgugcggcagcuggccaucuuuuguccucauguugcgcuucagacaaccaucugcgaagugcuggagcgcagccacucucccccucucaagcugacacccgccuccagcacccauccuaaccuucacgcuuaccugcagggcaauacgcaagucucccggaaaaagcuccugccgcugcuccaggaggcccugagcgcuuauuucgacucuaugaagauucccuccgggcagccugaaaccgccgaugugagcagagagcagguugacaaagaacuugaucgcgcgucuaacucccugaucagcggacucucucaagacgaggaggaucccccucugcccccgacaccuaugaacucccuuguggacgaauguccccuggaccagggccucccuaagcugagcgccgaggcugucuuugaaaaaugcucccagauuucucugagccaauccaccacagccagccucucuaagaaauga

SEQ ID NO: 74322 - RNA, 444 nt, Artificial Sequence
  derived and/or modified sequence opt5 from PRX__Homo_sapiens__NP_066007
auggaggccagaagccgguccgcugaggaacugcgcagagccgaacucguggagaucauugucgaaaccgaggcgcagacaggcguuucugggaucaacguggcuggaggcgggaaggagggaauuuucgugcgggaacugcgcgaggacagccccgccgccagaucccuuucucugcaagaaggcgaucagcuccugagcgcucgggucuuuuucgagaauuuuaaauacgaggacgcccuucgccugcuccagugcgcugaaccuuauaagguguccuucugucugaaaagaacgguuccgaccggggaucuggcccuccggcccggaacagugucuggcuacgagaucaagggcccucgcgcgaaagucgccaagcuggugagaguucuuagccccgcuccugcccuggacugccccuccgauccugugagcgcuccguga

SEQ ID NO: 74323 - RNA, 444 nt, Artificial Sequence
  derived and/or modified sequence opt5 from PRY__Homo_sapiens__XP_011529813
augggcgccaccgggcugggauuccuccugagcuggagacaggacaaccuuaauggcacagauugccaaggguguaacauccuguacuuuuccgagacgaccggaucuaugugcagcgaacucucccugaaucggggccuugaggcucgcagaaagaaagaccugaaggauucuuuccucuggcgguaugggaaagugggauguauuagccugccccugcgcgaaaugacagccuggaucaacccuccgcagauuuccgagaucuuucagggcuaccaccagagaguccauggcgcggacgcucucucucugcaaaccaauagccuucggucccgccugagcucucagugccucgggcaguccuuccugcuuagaacacuggaacggggacgcggcuuuagagcccucggggauauuuguggacacguucaugaggaggacuga

SEQ ID NO: 74324 - RNA, 1584 nt, Artificial Sequence
  derived and/or modified sequence opt5 from PSAP__Homo_sapiens__NP_001035930
auguacgcccuguuccuccuggcuagccuucugggcgccgcgcucgcugggcccgugcugggacuuaaggagugcaccagaggcuccgccgucuggugucagaacguuaaaacagccucugacugcggggcugugaagcacugucugcaaacgguguggaauaaaccuaccgucaagagccucccgugcgauaucuguaaagacgugguuacagccgcuggagauaugcugaaggacaacgccaccgaagaggaaauucugguguaucucgagaagacaugcgauuggcugcccaaaccuaauauguccgcgucuuguaaggaaaucgucgacagcuaccuucccgugauucuggauaucauuaaaggcgagaugucccggccuggggagguuugcucugcccucaaccugugugaaagccuucagaagcaucuggcugagcucaaucaccagaaacagcuggaauccaacaagauccccgagcuggacaugaccgagguggucgccccuuuuauggcuaauaucccgcuccugcuuuauccccaagauggaccucgcagcaagccccagccuaaagacaacggcgaugugugccaggacuguauucagauggugacagauauccaaaccgccgucagaaccaauucuacguucguucaggcgcugguggaacaugugaaggaggaaugcgaccggcucggccccgggauggccgacauuugcaaaaacuacaucucccaguauagcgagauugcuauccagaugaugaugcacaugcaagaucagcagccgaaggaaauuugugcccuggucggauuuugcgacgaggugaaagagaugccuaugcaaacacuuguucccgcuaagguggccucuaaaaaugucaucccugcccuggaacucguggagcccaucaagaagcaugaaguucccgcuaaauccgauguguacugugaggucugcgaguuccuggugaaggaagucaccaaacugauugacaacaauaagacagagaaagaaauccucgaugcguuugacaagauguguagcaagcugccuaaaucucuuuccgaggaaugccaggaggugguugauaccuauggcagcuccauucugucuauccuccuggaagaggugagcccggagcuugucuguuccaugcugcaccucugcagcgggacgcgccugcccgcccugacagugcacguuacccagccuaaggacggaggcuucugugaagugugcaaaaagcucgucggguaccuggauagaaaccuugagaaaaauucuacaaagcaggaaauucuggcugcccucgagaagggauguuccuuucugcccgacccuuaccaaaaacagugcgaucaguucguggccgaguaugaacccgugcugaucgagauccuuguugaagucauggacccgagcuuugugugccucaagauuggcgcuuguccuucugcccauaaaccccugcugggcaccgagaagugcaucugggggccuagcuacuggugucagaacaccgaaacagcggcucaaugcaacgccguggagcacuguaaacggcaugucuggaauuga

SEQ ID NO: 74325 - RNA, 975 nt, Artificial Sequence
  derived and/or modified sequence opt5 from PSAT1__Homo_sapiens__NP_066977
auggacgcccccagacagguggucaacuucggcccugggccggcuaagcugccccacagcguucuccuggagauccaaaaagaacuucuggauuacaagggagugggcauuuccgugcucgagaugucucaucggagcuccgacuuugccaaaaucauuaauaacaccgaaaaucugguccgcgagcuucuggcggugccugauaacuauaagguuaucuuccuccaagggggaggcugcgggcaguuuucugcugugccccugaaucugauuggacucaaagccggcagaugugccgacuacgucgugacaggcgcuuggagcgccaaggcugccgaagaggcgaagaaauucgggacgaucaacaucguucacccuaagcugggauccuauaccaaaauucccgauccuucuacauggaaucuuaacccggacgccagcuacguguauuacugcgcuaaugagaccguccauggcguggaauuugauuucauccccgacgugaagggggccguccugguuugugauauguccagcaacuuucucucuaaaccuguggacguguccaaguucggagucauuuuugcuggcgcccagaagaauguggggagcgcgggaguuacaguggucaucgugcgggaugaccugcuuggcuucgcccugcgcgagugccccucuguucucgaauauaaagugcaggcuggcaacuccagccuguacaauaccccucccuguuuuucuauuuacgucauggggcuggugcucgaguggaucaagaacaauggaggcgccgcugccauggagaaacuguccagcauuaagucccagacaaucuaugaaaucauugauaacucucagggguucuacgucagcgugggaggcaucagagccucccuuuauaacgcuguuaccauugaggacgugcagaaacuggcggccuuuaugaagaaauuccucgaaaugcaccaacuguga

SEQ ID NO: 74326 - RNA, 345 nt, Artificial Sequence
  derived and/or modified sequence opt5 from PSCA__Homo_sapiens__NP_005663
auggccggccuggcucuccagcccgggaccgcccugcuuugcuacagcuguaaggcgcaaguguccaacgaggacugccugcaggucgaaaauuguacacagcucggagagcagugcuggacggcuagaauccgggccguuggccugcuuaccgugauuucuaaaggguguagccugaacugcguggaugacucccaagauuauuacgucggaaagaaaaauaucacauguugcgacaccgaucucuguaacgccucuggcgcucacgcccugcagccugcugccgcgauucuggcccuccugccggcucuugggcugcuccuguggggacccggccagcuuuga

SEQ ID NO: 74327 - RNA, 3144 nt, Artificial Sequence
  derived and/or modified sequence opt5 from PSD3__Homo_sapiens__NP_056125
auggagggcagaagcgccgcugccgaaaccuucgugugggucaacaaugcguccgcucacucucagagcguugccaaggccaaauacgaguuucuguucgggcgguccgaaggaaaggcucccgacacaucugaucauggcgggagcacgcuccugccuccgaacgugaccaaugaguuucccgaauauggaacaauggaggagggcggggaaggacuucgcgccucccuggaguucgacggcgaagcucucccuugccacccccaagagcagcagggcgugcagccucugaccgggugucauucuggacuugauagcgucacagagggccccaaagacgugagagaagccccuucccaaagccaccugaaggagcagucucuccagccgaucgauucccugauuagcgcgcugaaagccaccgaagcucggaucauuucugggacacuccaggccaccaagguucuggaccaagaugcuguguccagcuuuucuguccaacagguggagaaggaacuugacacggccucccgcaaaacccagagaguuaacaagacacugcccgcgggacagaaaaaucucccugagaucccccugagcgccgaggugaccacagaagaguccuucuaccuuucuauucagaaggaucugaccgcucuccugacgggcgacacacaggccgaaaucagccaaaucaugaacaaugggcggaaaggagcugucugcgugcaggagccuuccuguccccuggccagccucggaucuuccgccgugaccugccauagcgcuggcucugucggguuucugaaggaacagcgcagcgcgcuuggaagagagcacccgggcgggugugaucgguccucuagcaugggacgcccuggcagaguuaagcacguggaguuccaggggguggaaauucuguggacaggaggcgacaaacgggagacccaacaucccaucgauuuugaaaccucccuccagcgcacagccagcccugacucuaaggaguccagcaaaguccccagacaccugauuucuuccgcuggccuuugcaacagcuccucucugacggaaaaugugugggacgagagcuggaaggcccccuccgagcggccugggaccucuagcggaacauucuccccgguucgccucgaugaaagcggcgaggacgaaguguuucugcaggagaacaaacagcaucuggagaagacccccaaaccugaaagagaucgggagagaaucucugaacaagaggaacacgucaagggggaggacgaggauauucucggacccggcuauacagaagacuccaccgauguguacagcucucaguucgagacgauccuggacaauacaucccuuuauuacagcgccgaaucucuggagacccucuauagcgaaccugauuccuacuuuagcuucgagaugccccugaccccgaugauucagcagcgcaucaaggaagggggccaauuccuugaacggacaucuggaggcgggcaccaggacauccuguccguuagcgcugauggaggcauugugaugggguacuccucuggagucaccaacggccucaaugacgccagcgacuccaucuauacaaaagggacgccugagauugcguuuuggggcucuaacgcuggagugaagaccacaagacuggaagcccauagcgagaugggcuccaccgaaauccuggagaaagagacacccgaaaaucucucuaacgggaccagcuccaacgucgaggccgcuaagcgccuggccaaacggcuuuaccagcuggauagauucaagcgcagcgacguggcuaagcaccucggcaaaaauaacgaauuuucuaagcugguugccgaggaguaucugaaauucuuugauuucacgggcaugacccuugaccagucccuccgguacuuuuucaaggcguuuagccuggugggggaaacacaagagagagaacgcguccugauucauuucucuaaucgguauuuuuacuguaacccugauaccaucgccucccaggacggagugcacugccucacaugugcuaucaugcugcuuaauaccgaucugcauggccacaacauugggaaaaagaugacgugccaggaguucaucgccaaucuccaaggcguuaacgaaggaguggacuuuagcaaggaucugcugaaagcucuuuauaauucuauuaagaacgagaaacucgagugggccgucgacgaugaagagaagaaaaagucccccagcgaauccacagaggaaaaggcgaauggcacccacccuaaaacaaucagcagaauugggucuaccaccaaccccuuccuggacaucccgcaugauccuaaugccgcuguguacaagagcggauuccuggcccgcaaaauccacgcugacauggacggcaagaaaacaccccgggggaagagaggauggaaaacguuuuacgccgugcucaagggcaccguucuguaucuucagaaggaugaguacaaacccgagaaggcccuguccgaagaggaccucaaaaacgcugucucugugcaucacgcgcuggccagcaaggcuacagauuaugaaaagaagccuaauguguucaagcugaaaaccgccgacuggcggguccuucucuuucagacacaguccccggaggaaaugcaaggguggauuaacaagaucaacuguguggccgcuguuuucucugcgcccccuuuucccgccgcuauuggcagccagaaaaaguucucccgcccucugcugcccgccaccacgacaaaacucucucaggaggagcagcuuaagagccacgaauccaaacugaaacaaaucaccaccgagcuggccgaacauagaagcuacccucccgauaagaaagugaaggcuaaagacgucgaugaguauaagcucaaggaccacuaccuggaguuugagaaaacacgguaugagauguacgugucuauucugaaggaaggaggcaaagagcuucucuccaaugaugaaagcgaggccgcggggcugaagaaaucucauuccagcccgucccugaacccugacaccucucccaucacagcuaagguuaaaagaaaugugagcgagcgcaaggaucaccggccugaaacgcccuccauuaagcagaaagucaccuga

SEQ ID NO: 74328 - RNA, 3171 nt, Artificial Sequence
  derived and/or modified sequence opt5 from PSD4__Homo_sapiens__NP_036587
augaugggcgacuacagacugcccgaucacccucagccgauggagauccucaaccuguaucuuggggacagccuggaaccccauccuggagagugcccccgggaaaccuguucccacgaggauccucccgaaccuuucgaggagcaaacaugggccacggacccgcccgaaccuacccgccagaaugugcccccuuggggcucuggggucgagcucacacaucugggaagcuggguucaccaggauggccuugaacccugccaggagcaaaccagagcuacagacccgccugaguccacccggcaggaugcgcccccuugggggucuggaguggaacugacacaucucggcagccccuccgcccagcgcgagcacagacagaacaccgcuucucccggcagcccugucaauucccaucugccggggagccccaagcaaaaccggucuacguccacccaggugguguuuugggccgggauucugcaggcccagauguguguucucgaccuggaagaggaacuugagaaaacagagggccugaaggcugggcucaaaugcugucugccuacacccccuguggaucuucccggagacaccggccugcacagcucuccgccugaaaaugaggauuccggggaagacagcucugagcccgaaggagagggccaagccuggcuccgcgagggcaccccugauuccagcccccaguggggagcugaagaggaauccauguucuuuucuaacccucuguuccuggccagccccugcuccgagaauagcgcgucuggagaauguuuuuccuggggcgccagcgacucucacgcuggggucagaacgggaccggagagcccugccacacucgagccuccccugcccgaagacaccgugcuuugggagcuggaauccgagccggaucucggcgacggggcugccaucucuggacauugcacacccccuuuccccguuccuauuuacaagccccacagcaucuguugggcguccguggccgcugccgagggcgcuccugccgcucccccgggccacggggaaagcgagggagaucggcugggcccugcccccucugcggccccuugcgucgacgaagcucuuaccugggaguccgggugugugggaagcgaucugggccccgccgcccauccggugcagccuugggcuucucucucccccgaaggguggcaacgcggcggaccuuuuuggccccaggucacccugaacagccaggacagagaugagcgggagggcgggcacccccaggaaucccugccuugcacacucgccccgugccccuggcgcucuccugcgagcucccccgagccuucuagccccgaauccgagagcagaggaccuggcccgcggcccucuccugcuuccagccaagaagggucuccccagcugcagcaucacuccagcggcauucuuccuaaauggacgcuggacgccucucagagcucccuccuggagaccgauggagagcaacccagcucucuuaagaagaaagaagccggggaggcuccgaagccuggcgaagagguuaaauccgaaggaacagcccgccccgcugagaccggcgacgugcagcccgauauccaucugacaagcgccgagcacgaaaaucucagaaccccuaugaacuccucuuggcugcccgggagcccuaugccgcaggcgcagucccccgaggaaggacaacggccucccgccggcgacaagcuggcuaauggggugagaaacaauaaagucgccuggaaccucgcuucucgccuguaucggcuugagggauucagaaagagcgagguggccgcguaccugcagaagaauaacgacuuuucccgcgccguugcugaagaguaucucucuuucuuucaguucggcgggcagagccuggaucgggcccugagauccuuucuucaagcucucgugcugagcggcgaaacgcaggagcgcgaacggauccuguaccaguucucuagacgcuuccaccauuguaacccuggaauuuuucccuccgucgacagcgugcacacacugaccugcgccaucaugcuccuuaauaccgaucugcauggccaaaacauugggaaaucuauguccugucaggaguucaucacaaaucucaacggacugcgggacggcgggaauuuuccgaaggagcugcuuaaagcccucuauuggagcauuagaucugaaaagcuggagugggcuguugaugaagaggacaccgcgcgcccugaaaaagcccagcccucccugccugcuggaaagaugagcaaacccuuccuccagcuggcccaagauccuacagugcccacguacaagcagggcauccuugcccggaagaugcaccaggacgcugaugggaaaaagaccccguggggcaaaagaggauggaagauguuucacacacugcuccggggcaugguccuguacuuccugaaacagggggaggaccauugccuugagggagaaucccucgugggccaaauggucgaugagccuguggggguucaccauagccuggccacccccgcgacacacuauaccaagaagccccauguguuucagcugcgcacggcugacuggagacucuaccuguuccaggccccuaccgccaaagaaaugucuagcuggauugcucggaucaaccuugccgcggcuacacacuccgccccgcccuuuccugccgcugucggaucucagagacgcuucgugcggcccauccugccuguuggccccgcccaaagcucccucgaggaacagcacagaucucaugagaauugucuggaugcugccgcggacgaccugcuugaucuccagcgcaaccugccugagagacggggccgcgggagagaacuggaggaacaccggcuccgcaaggaguaucuggaguacgagaaaaccagauaugaaacauacgugcaacuucuggucgcccggcuccauugcccgagcgacgcucuggaucugugggaggaacagcuuggacgcgaagccggcgggaccagagagcccaagcugucccucaaaaagucucacagcuccccuagccugcaucaggacgaggcucccacgacagccaaggugaaacggaauauuucugaacgcagaaccuaucggaagaucauuccuaaaagaaaccgcaaucagcucuga

SEQ ID NO: 74329 - RNA, 3075 nt, Artificial Sequence
  derived and/or modified sequence opt5 from PSD__Homo_sapiens__NP_002770
auggcccagggcgcuaugagauucugcagcgagggggacugugccaucucucccccucggugcccgcgcagauggcugcccgaaggaccugugccccaauccccucccgcgagcauguacggcuccaccgggucucuccugcggcgcgucgcuggaccuggcccgagagggcgggagcuuggacgcguuacagcccccuguacgccucugagagggcccccuagcccccggguggccccguccccuugggcucccucuagcccuaccggccagccucccccuggcgcccaguccagcguggucauuuuucgcuucguggaaaaggcuucuguuagaccgcucaacggacugcccgccccuggcgggcuuucccggagcugggaucugggaggcgugucucccccucgccccacaccggcgcucgggccuggauccaauagaaaacugcggcuggaggccagcaccucugacccccucccugcucgcggcggcuccgcccugcccgggagcagaaaccuuguccacggaccucccgcuccgccucaggugggcgccgaugggcuguauuccucucuccccaauggacugggcgggcccccugaacggcuugcgacacuguuuggaggcccggccgacaccggcuuccucaaccaaggggauacauggagcucccccagagagguuagcucucaugcucagcgcaucgcccgggcuaagugggaguuuuucuacggaucccuggacccucccagcucuggcgccaaaccucccgaacaggccccucccagcccgccuggggugggauccagacagggcucuggggucgcugugggccgcgcggccaaguauagcgagaccgaucuggacacggugccccuccggugcuacagagaaaccgauauugacgagguccuggcugagcgcgaagaggccgauuccgccaucgaaagccaaccuucuuccgagggacccccgggcacagcuuauccucccgccccucggcccgggccccuuccuggaccgcaccccagccugggcucugggaaugaagacgaggaugacgacgaggcgggaggcgaagaggauguugacgaugaaguguuugaggcuuccgaaggggccagaccuggcagccgcaugccccucaaauccccugugcccuuccugccuggaaccucuccgagcgccgacggccccgauuccuuuucuugugucuucgaggcuauucuugagagccaucgggccaaggggacauccuacaccagccuggcuucucucgaagcccuggcguccccuggacccacgcagagccccuuuuucacauuugagcugcccccgcagccucccgcccccagaccugaucccccugcuccggcuccccucgcuccucuggaacccgacucuggcaccuccagcgccgcggacgggccuuggacacagcgcggagaggaagaggaggccgaagcucgggccaaacuugcucccggcagagagccgccuucucccugccacagcgaagauucccuggggcucggcgccgccccucugggaagcgagcccccucuuucucaacugguguccgacagcgauuccgagcucgacucuaccgaacggcuggcucugggcagcaccgacacacucuccaacgggcagaaggcggaucuggaggccgcucagcgccuugccaagagacuguaucggcucgacggauucagaaaagccgauguugcucgccaucugggcaagaauaacgacuucucuaaacugguggccggggaauaccuuaaguuuuucgucuuuacgggaaugacccucgaucaagcgcugcggguguuccugaaggagcucgcucugaugggcgaaacacaggagagagagcgcguucuugcccacuuuagccagagauacuuccaguguaaucccgaagcccuguccucugaggacggggcucacacccucacaugcgcccugaugcugcuuaacaccgaucuccauggccacaauaucggaaaacggaugacguguggcgacuuuaucgggaaccuggaaggacugaaugauggcggggacuucccgcgcgagcuccugaaggcgcuuuauagcuccauuaaaaacgaaaagcugcaaugggcuaucgaugaggaggaacucagacggagccugucugagcuggccgacccuaaucccaaagugauuaagcgcaucuccggaggcagcggcucuggguccagccccuuucuugaucucacaccugaaccgggagccgcugucuacaaacauggcgcccuggugagaaagguccacgcugaccccgacugccggaagaccccucgcgggaaaagaggauggaagucuuuccacggcauucugaaagggaugauccucuaucugcagaaggaggaauacaaacccggaaaggcccuuuccgagaccgagcugaagaacgcgauuagcauccaucacgcccucgcuacacgggccuccgauuauagcaaacgcccucauguguuuuaccugagaaccgcugacuggcggguuuuccuguuucaggcccccucucuugaacagaugcaaagcuggaucacaagaauuaacguggucgccgcuauguucuccgcgccuccguuccccgccgcugugucuagccagaagaaauuuucccgcccucuccugcccucugccgccacgcggcugagccaggaggaacagguuagaacccacgaggcuaagcucaaagccauggcguccgagcugcgcgaacaucgggcugcccaacuuggcaagaagggcagagggaaagaggccgaggaacagcgccagaaggaagccuaucuggaguucgagaaaucucgguacagcacauacgccgcgcuccugagagugaagcugaaagcuggauccgaggaacuugaugccgucgaagccgcucuggcccaggcuggcagcaccgaggacgggcucccucccucucacuccagcccgucucugcaaccuaagcccuccagccagccccgcgcccagcggcacuccucugaaccuagacccggagcgggcagcgggcggcgcaagccuuga

SEQ ID NO: 74330 - RNA, 1404 nt, Artificial Sequence
  derived and/or modified sequence opt5 from PSEN1__Homo_sapiens__XP_011535274
augaccgagcugcccgccccucucagcuacuuccagaacgcucaaauguccgaagacaaucaccugucuaacacagugagaagccagaaugauaaccgggagcgccaggaacauaaugacagacggucccuuggccacccggagccccugucuaacgggcgcccucagggaaauagcagacaagucguugaacaggaugaggaggaagacgaggaacucacgcugaaguauggcgccaaacaugugaucaugcuuuuugugcccgucacccugugcauggugguuguggucgcgacaauuaaguccgugucuuucuacacccggaaagaugggcagcucaucuauacaccuuuuaccgaggacacagagaccguuggacagcgcgcucugcacagcauucugaacgccgccaucaugauuuccgugaucgucgugaugacgauccuccuggugguccuuuacaaguauagauguuacaaaguuauucaugcuuggcugaucauuagcucucuccugcuucuguucuuuuucuccuuuaucuaucucggcgaaguguucaagaccuacaauguggccgucgauuacauuacaguggcucugcugaucuggaacuuugggguugugggaaugauuagcauccacuggaagggcccccuccggcugcaacaggccuaucuuaucaugauuucugcgcugauggcccucgucuucaucaaauaccugccugaguggaccgcuuggcuuauucuggccgugaucuccguuuaugaccucguggcuguccugugcccgaagggcccccugcgcaugcucguggaaacagcccaggagagaaaugaaacccuguuuccugcgcuuauuuacagcucuacgauggucuggcuggugaacauggccgagggggaucccgaggcucagcggcgcguuuccaaaaauagcaaguauaacgccgaauccacagagagagaaucucaagacaccguggcugagaaugaugacggaggcuucagcgaagagugggaggcccagcgggauucccaccucgggccucaucgcagcacacccgaaucuagagccgcuguccaggagcuguccagcucuauccuugcgggagaagacccggaggaacggggcgugaaacuggggcucggagacuuuaucuucuacagcguucuggugggcaaggccuccgcuaccgccucuggcgauuggaacaccacaauugccuguuucgucgcuauccugauugggcucugccugacgcuucugcuccuggccaucuuuaagaaagcgcugccugcccuucccauuagcaucaccuucggacucguguuuuauuucgcuacagacuaccuggugcaaccuuuuauggaucagcuggccuuccaccaguuuuacaucuga

SEQ ID NO: 74331 - RNA, 1344 nt, Artificial Sequence
  derived and/or modified sequence opt5 from PSEN2__Homo_sapiens__NP_036618
augcugaccuucauggccagcgacuccgaggaagaggugugcgaugaaagaacaucucucaugagcgcugagucccccacgccucggucuugucaggaaggccgccaagggccggaggacggagagaacaccgcccaguggagaagccaggaaaaugaggaagauggcgaggaggaccccgaucgguacgucugcuccgggguuccuggaagacccccuggccuggaagaggaacuuacacugaaguauggggcgaaacacgugaucaugcucuuugugcccgucacccuguguaugauugugguuguggcuacaaucaagucuguccgcuucuacaccgagaaaaacggacagcuuauuuauacaccuuuuaccgaagacacgccgagcgugggccaacggcugcucaauuccguucugaacacccugaucaugauuagcgugaucgucgugaugacaaucuuccucgugguccuguacaaguaucgcugcuacaaauuuauucauggcuggcuuaucaugucuucccugaugcuccuguuccuuuuuaccuauauuuaccugggggagguucucaagacauacaauguggccauggauuaucccacccugcugcucacgguguggaacuucggagccgucggcaugguguguauccacuggaaggggccucugguucuucagcaggcuuaccugauuaugaucagcgcccucauggcucugguguuuauuaaauaucuucccgaguggucugccugggucauccugggagcgaucuccguguacgaccucguugccgugcugugcccuaagggcccccugagaaugcucgucgaaacagcucaggagcggaaugaaccgauuuucccugcccugaucuauagcucugcuaugguguggaccgucgggauggccaaacuugaucccuccagccaaggagcgcugcagcucccuuacgaccccgagauggaagauuccuaugacucuuuuggcgagcccagcuacccugagguguucgaaccgccccugacaggcuacccuggggaggaacuugaggaagaggaggaacgcggaguuaagcugggccucggggauuuuauuuucuauuccgugcuggucggaaaagccgcugccaccggcagcggggacuggaacaccacacuggcuuguuucguggccauccucauuggacugugccuuacgcugcuccugcuggccguuuuuaagaaggcgcuucccgcucucccuaucucuaucaccuucggccugaucuuuuacuucuccacagacaaucuggugagacccuuuauggauacccucgccagccaucagcuguauauuuga

SEQ ID NO: 74332 - RNA, 306 nt, Artificial Sequence
  derived and/or modified sequence opt5 from PSENEN__Homo_sapiens__NP_001268461
augaaccuggagagagugagcaaugaagagaagcucaaccugugccggaaauacuaucuuggcggguucgccuuucugcccuuccucuggcuggucaauaucuuuugguucuuucgcgaggcuuuccuuguuccugccuacaccgaacagucccaaauuaagggauauguguggagaucugcggugggcuuucuguucugggucaucgugcucacaagcuggauuacgaucuuucagauuuaccggccgcgcuggggagcucugggggacuaucuguccuucaccaucccccucggcacaccuuga

SEQ ID NO: 74333 - RNA, 1260 nt, Artificial Sequence
  derived and/or modified sequence opt5 from PSG1__Homo_sapiens__NP_001171754
augggcacccugagcgcucccccuugcacacagagaaucaaguggaaagggcuccugcuuacggccucccugcucaacuucuggaaucugccgaccacagcccaagugaccauugaggcggaacccacaaaggucucugagggaaaagacguucuucugcucgugcacaaccugccucagaaucugaccggcuacaucugguauaaggggcagaugcgggaucucuaccauuauauuacaagcuacguggucgacggagaaaucauuaucuauggccccgcuuacuccgggcgcgagaccgccuauucuaacgccagccugcuuauccagaaugugacgagagaagaugcuggauccuacacccugcacauuaucaaaggcgacgauggcacacgcgggguuaccggacgguuuacauucacccuccaucuggagacgccuaagcccucuauuagcuccagcaaccuuaauccuagagagacaauggaagccgugucucugaccugugacccggagacacccgaugcuuccuaccucugguggaugaacggccaaagccugccuaugacccacucucugaagcucuccgaaaccaaucggacacuguuucuucugggggucacgaaauauaccgccggacccuacgagugcgagauccgcaacccugugagcgcgucuagauccgaccccguuacacucaaucugcuuccgaagcugccuaaacccuauauuaccaucaacaaucucaacccucgggaaaauaaggaugugcugaacuucacaugugagcccaaaagcgaaaacuacaccuauauuugguggcugaauggccagucccuccccgucucuccucgcgugaagagaccgaucgagaaccggauccugauucuucccagcgugacgcgcaaugaaacagggccuuaccagugcgagaucagagaccgguauggaggcauucgcuccgaucccgucacccugaacguucucuacggcccugaccugcccagaaucuacccgagcuuuaccuauuaccggucuggggaggugcuuuaucuguccuguagcgccgauucuaauccucccgcucaguacagcuggacaauuaacgaaaaguuccaacucccuggacagaaacuguuuaucagacauaucaccacaaagcacuccggccuguaugugugcucuguccgcaauagcgccacggggaaagaguccagcaagucuaugaccguggaaguuuccgacuggacagugcccuga

SEQ ID NO: 74334 - RNA, 1008 nt, Artificial Sequence
  derived and/or modified sequence opt5 from PSG2__Homo_sapiens__NP_112536
augggcccccugagcgccccuccgugcaccgagcacaucaaguggaaagggcuccuggugacagcuucccuucugaacuucuggaaucuccccacgaccgcccaggucacaauugaagcgcaaccucccaagguuucugagggaaaagacgugcugcuucuggugcauaaccucccucagaaucugaccggcuacaucugguauaaggggcagauuagagaucuguaccacuauaucacaagcuacgucguggacggacagauuaucaucuauggccccgcuuacuccgggcgggaaaccgccuauucuaacgccagccuccugauucaaaauguuacacgcgaggaugcuggauccuacacccuucauaucauuaaaagaggcgacggcacgcgcggggugaccggauacuuuacauucacccuguaucucgaaacaccuaagccgucuaucagcuccagcaaccugaauccccgggaggccauggagaccgucauucuuacgugugauccugaaacacccgacaccucuuaccagugguggaugaacggccagucccugccuaugacacacagauuucagcucagcgagaccaaucggacccuguuccuguuuggggugacaaaguauacggcuggacccuacgaaugcgagauccgcaacucuggcuccgccagcagaucugauccgguuacccucaaucugcuucaugggccugaccugccccggauucacccuuccuauacaaacuaccgcagcggagauaaucucuaucuguccuguuucgcgaacucuaauccucccgcccaauacagcuggaccaucaacggcaaauuucagcaguccggccagaaccuuuucaucccccaaauuacaaccaagcacagcgggcuguacgugugcucugucagaaauuccgcuacgggagaggaaagcucuacaagccucaccgugaaaguguccgccucuacccggaucggccugcugccgcuccugaaccccacauga

SEQ ID NO: 74335 - RNA, 1008 nt, Artificial Sequence
  derived and/or modified sequence opt5 from PSG5__Homo_sapiens__NP_001123486
augggcccccugagcgccccuccgugcacccagcacaucacauggaaggggcuccugcuuacggcuucccugcucaacuucuggaaucugcccauuaccgcccaagugacaaucgaggcgcuuccucccaaagucucugaaggaaaggacguucugcuccuggugcauaaccugccucagaaucucgcuggcuacauuugguauaaagggcagcugauggaucuuuaccacuauaucaccagcuacguggucgacggacagauuaacaucuauggccccgccuacacagggagagagaccguguauuccaaugccucucugcucauccaaaacguuacacgggaagaugcuggaagcuacacccugcauauuaucaagcgcggcgacagaacgcggggcgugaccggguacuuuacauucaaucuuuaucugaaacucccuaagccguacauuaccaucaacaauuccaagccccgcgagaacaaagauguccuggccuuuacaugugaaccuaagucugagaauuauaccuacauuugguggcugaacggacagagccuccccguguccccuagaguuaaacggcccaucgagaaucgcauucugauccuuccgagcgugacgagaaacgaaacaggcccuuaugagugcgaaauccgggaccgcgaugggggaaugagaucugaccccgucacccugaaugugcucuacggcccugaucugcccuccauuuaucccagcuucacauacuaccggucuggggagaaccuuuaucuguccuguuuugcugagagcaacccuccggccgaauacuucuggaccaucaauggaaaguuucagcagucuggccaaaaacucuccauuccccagaucaccacaaagcaccgcggccuguauacgugcagcgugagaaacuccgcgaccgggaaggagucuagcaaauccaugacagucgaaguuagcgccccuucuggaauuggccggcugccccuccugaauccuaucuga

SEQ ID NO: 74336 - RNA, 1275 nt, Artificial Sequence
  derived and/or modified sequence opt5 from PSG6__Homo_sapiens__NP_001027020
augggcccccugagcgccccuccgugcacccagcacaucacauggaaggggcuccugcuuacggcuucccugcucaacuucuggaaucugcccaccacagcccaagugauuaucgaggcgaaaccucccaaggucucugaaggaaaagacguucuucugcucgugcauaaccugccucagaaucugaccggcuacauuugguauaaggggcagaugacagaucucuaccacuauaucaccagcuacgugguccauggacagauuaucuauggccccgcuuacuccgggcgggagacaguguauucuaacgccagccugcuuauccaaaauguuacccaggaagacgccggauccuacacgcugcacauuaucaaacggggcgauggcaccgggggagugacaggcuacuuuaccgucacacucuauucugagaccccuaagccgagcauuuccagcucuaaccugaauccccgcgaagugauggaggcuguuagacuuaucugugacccugagacgcccgaugccuccuaccuguggcuccugaacgggcagaaucugccuaugacacaucggcuccagcugagcaagaccaaccgcacacuuuaucuguucggagugaccaaauacauugcuggccccuaugaaugcgagaucagaaauccggucucugccucccggagcgacccugugacccucaaccugcuucccaagcugccuaugcccuacauuacaaucaauaaccucaauccccgcgagaaaaaggaugugcuggcguuuacgugugaaccuaaaucuagaaacuauaccuacaucugguggcugaacgggcaaucccucccggucagcccccggguuaagcgcccuauugagaauagaauccugauucuucccuccgugacacggaacgaaaccggaccuuaccagugcgagauccgcgacagauauggcggcauucggucuaaucccgugacacugaacguccucuacgggccggaucugccucgcaucuaucccagcuucaccuacuauagauccggagaaaaucuugaccugagcuguuuugccgauucuaacccucccgcugaguacuccuggacgaucaauggcaaguuccagcucagcgggcagaaacuguuuauuccucaaaucacaaccaaccacucuggacuguaugccugcagcgugagaaauuccgcuaccggcaaggaaauuucuaaaagcaugaucguuaagguguccgggcccugucacggaaaccagacagagagccauuga

SEQ ID NO: 74337 - RNA, 1260 nt, Artificial Sequence
  derived and/or modified sequence opt5 from PSG8__Homo_sapiens__NP_001123639
augggccugcucagcgcucccccuugcacccagagaaucacauggaaggggcugcuucugacggccucccuccugaacuucuggaauccgcccaccacagcccaagugaccauugaggcgcagccuacaaaagucucugaaggaaaggacguucuucugcucgugcacaaccugccccagaaucugaccggcuacaucugguauaaagggcagauucgggaucucuaccauuauaucacaagcuacguggucgacggacaaauuaucaucuauggcccugcuuacuccgggcgcgagaccauuuauucuaacgccagccugcuuauccagaaugugacgcaggaagaugccggauccuacacccugcacauuaucaugggcggcgacgagaacagagggguuacaggacauuuuaccuucacacucuaccuggaaacccccaagccuucuauuagcuccagcaaacuuaauccgcgggaggcuauggaggccgugucucugacgugugaucccgaaacaccugacgcuuccuaucucugguggaugaacggccagagccugcccaugucucaccgccugcaacucuccgagaccaauagaacacuguuucuucugggggucaccaaguacaccgccggaccuuaugaaugcgagauccggaaccccgugagcgcgucucgcuccgauccguucacacucaaucugcuuccuaagcugcccaaaccuuacauuacgaucaacaaucucaagcccagagagaacaaagacguucugaauuuuaccugugaacccaagagcgagaacuauacauacaucugguggcugaacggccagucccucccugugucuccgcgggucaaacgccccauugaaaauagaauccugauucuuccuagcgugacccggaacgagacagggcccuaucagugcgaaauccgcgaucaguacggaggcauuagauccuacccugugacccugaauguccucuauggccccgaccugccgcggaucuacccuagcuucacguauuaccgcucuggggagguucuuuaucuguccuguagcgccgauucuaaucccccugcucaauacagcuggacaaucaacggaaaguuucagcucuccggccagaagcuguucauuccccaaaucaccaccaaacauucugggcuguaugccugcagcgugagaaacuccgcuacaggaaaggagagcucuaaauccaugaccgugaaggucagcgacuggacacucccuuga

SEQ ID NO: 74338 - RNA, 1002 nt, Artificial Sequence
  derived and/or modified sequence opt5 from PSG9__Homo_sapiens__NP_001288636
augggcccccugccugccccgagcugcacccagagaaucacauggaaggggcuccugcuuacggcuucccugcucaacuucuggaaucccccuaccacagccgaggugaccauugaagcgcaacccccuaaagucucugagggaaaggacguucugcuucuggugcacaaccucccccagaaucugccuggcuacuuuugguauaaaggggaaaugacagaucuguaccauuauaucauuagcuacaucguggacggaaagauuaucaucuauggcccggcuuacuccgggcgggagaccgucuauucuaacgccagccuccugauucagaaugugacacgcaaagaugccggaaccuacacgcuucacaucauuaagagaggcgacgaaacccgggaggagauccgccauuucacauuuacccuguacuccaagcuccccauuccuuauaucacaauuaacaaucugaaccccagagaaaauaaagauguucuugcuuucaccugugagccuaagucugaaaacuacacguauaucugguggcugaauggccagagccuccccguguccccgggggucaaacggccuaucgagaaccgcauucugauccugcccagcgugacaagaaaugagaccggaccuuaccaaugcgaaauucgggaccgcuauggcgggcucagaucuaaccccguuauccugaaugugcuuuacggacccgaucugccucggauuuauccguccuuuacauacuaccgcagcggcgagaaccucgaccugucuuguuucaccgaauccaaucccccugccgaguauuuuuggaccaucaacgggaaguuccagcagagcggacagaaacuuuuuaucccccaaauuacaagaaaccacucuggccuguacgcuugcuccguccauaauagcgccacgggcaaggaaaucuccaagucuaugaccgugaaagugagcgggccuugucacggagaucucacagagucccagagcuga

SEQ ID NO: 74339 - RNA, 1593 nt, Artificial Sequence
  derived and/or modified sequence opt5 from PSIP1__Homo_sapiens__NP_001121689
augaccagagacuucaagcccggcgaucugaucuuugccaaaaugaagggguacccucacuggccggcucggguggacgagguccccgauggagccguuaaaccucccacaaacaagcucccuauuuucuuuuucggcacgcaugaaaccgcguuucuggggcccaaagacaucuucccuuauagcgagaauaaggaaaaguacggaaaaccgaacaagcgcaaaggcuuuaaugaggggcuuugggaaauugauaacaaucccaaggugaaauucuccucucagcaagcugccacaaagcagagcaacgccuccucugacguggaggucgaggaaaaggagaccagcguguccaaagaagauacagaccacgaggagaaggcuucuaaugaagauguuaccaaagccguggacaucacaaccccuaaggcugccagacggggacgcaaaagaaaggcggagaaacaggucgaaacggaggaagccggcgugguuaccacagcuaccgccagcgugaaccugaaggucucccccaagcggggccgcccugcugccacagaggugaaaauucccaagccgagagggcggccuaaaauggugaagcagcccugcccuagcgagucugauaucaucaccgaagaggacaaauccaagaagaaaggacaagaagagaagcagcccaaaaagcagcccaaaaaggaugaagagggccagaaggaggaagacaaaccucgcaaggagccggacaaaaaggaagggaaaaaggaggucgaaagcaagagaaagaaucucgcgaagacgggaguuacaucuaccuccgauagcgaggaggaaggcgacgaucaagagggggagaaaaagcggaaaggaggccgcaacuuucagacagcccauagacggaauaugcugaagggccagcacgagaaagaggcugccgaccgcaagagaaagcaggaagaacaaauggaaaccgagcagcagaacaaagaugaagggaagaaacccgaggugaagaaaguggagaagaagcgggaaaccucuauggacuccagacuucaacgcauucaugcugagaucaaaaauagccugaagauugauaaccucgacgucaaucgguguaucgaagcccuggaugagcuggccucccuccaggugacaaugcagcaggcucaaaaacacacggaaaugauuaccacacugaagaaaaucagacgcuucaagguuucucaggugauuauggagaaaagcaccaugcuuuauaacaaauuuaagaacauguuccuggucggagagggcgacuccgugaucacacagguucucaauaaaagccuggcggaacagcggcaacacgaggaagccaacaagaccaaagaucaggggaagaagggaccuaauaaaaagcuggagaaagaacagacgggcucuaagacacuuaacgggggauccgacgcucaggacggcaaucaaccccagcauaacggcgagagcaaugaggauucuaaagacaaccacgaagccagcaccaagaaaaagccuuccucugaggaaagagagaccgagaucagccucaaggauuccacacuggacaauuga

SEQ ID NO: 74340 - RNA, 1275 nt, Artificial Sequence
  derived and/or modified sequence opt5 from PSKH1__Homo_sapiens__NP_006733
augggcugcgggaccagcaaggugcugcccgagccuccgaaagacguccagcucgaucugguuaagaaaguggaacccuucuccggaacaaagucugacguguacaaacacuuuaucacggaggucgauagcgugggcccuguuaaggccggguuccccgcugccucccaauaugcgcauccuugucccggaccuccgaccgcuggccacacagaacccccuucugagcccccuagacgggcccgcguggccaaguacagagcuaaauuugacccccgggucaccgccaaguaugauauuaaagcucuuaucgggcgcggcagcuucuccagagugguucggguggaacaucgcgccacaagacagccguacgcgauuaagaugaucgagaccaaauaucgggagggacgcgaagucugcgagucugaacugagagugcuccggcgcgugagacacgccaacauuauccagcuggucgagguuuuugagacacaggaacggguguacauggugauggagcuugcuaccggcggggaacuguucgaccgcaucauugccaagggcagcuuuacggagagagaugcuacccggguccuccaaauggugcuggacggaguuagauaucugcaugcccucgggaucacacaccgcgaucugaagccugaaaaucuucuguacuaccaccccggaaccgacuccaaaauuaucauuacagauuucggccucgcgagcgcccggaagaaaggggacgauugucugaugaagaccacgugcggaacaccugaguauaucgcucccgaggugcuugucagaaaacccuacaccaacucuguggacaugugggcccugggcguuauugcuuauauccuccuguccggcacaaugccuuuugaagacgauaaucgcacccggcuguacagacagauccuccgcgggaaguauagcuacucuggagagccguggcccuccgugagcaaccuggccaaagacuucauugaucggcuucugaccgucgacccuggcgccagaaugacagcucuccaggcgcugcgccaucccuggguggucucuauggccgcuuccagcuccaugaagaaucuucaccggucuaucagccagaaccugcucaagagagccuccagccgcugucaaucuacgaaauccgcccagagcacccggucuagcagauccacacggucuaauaagagccgcagagugcgggaaagagagcugcgcgaacugaaccuccgguaucagcagcaauacaauggguga

SEQ ID NO: 74341 - RNA, 393 nt, Artificial Sequence
  derived and/or modified sequence opt5 from PSMA1__Homo_sapiens__NP_001137409
auguucagaaaccaguacgacaaugaugugaccgucuggagcccccaaggccggauccaccagauugaguaugccauggaagcuguuaagcagggguccgccacagugggacugaaaucuaagacgcaugcggugcucgucgcucugaaacgcgcccagagcgagcuugccgcucaccaaaagaaaauccugcauguggacaaccacauuggcaucuccauugccgggcucaccgcugaugccagacugcuuugcaauuuuaugcggcaggaaugucuggacucucgcuucguuuuugauagaccucucccggugagccggcuggucucccugaucggaucuagcauccucuucaugcuggcguuuauggacaugaacuucgagggcuuuuga

SEQ ID NO: 74342 - RNA, 705 nt, Artificial Sequence
  derived and/or modified sequence opt5 from PSMA2__Homo_sapiens__NP_002778
auggccgagagaggcuacagcuucucccugaccacauuuucucccagcgggaagcucgugcagaucgaauaugcucuggccgcggucgcuggaggcgccccuuccguugggauuaaagccgcuaacggaguggugcuugccacggagaagaaacaaaagucuauccuguacgacgaacggagcguccacaaaguggagccgauuaccaagcauaucggccucguuuauuccgggaugggacccgauuaccgcgugcugguccacagagcucggaaacuugcccagcaguauuaccugguguaucaggaaccuauucccacagcgcaacucguucagcgcguggccucugucaugcaggaguacacccagagcggcggcgugagaccuuucggggugucccugcugaucugcggauggaaugagggccggcccuaccucuuucaaagcgacccuucuggggcuuauuucgccuggaaggcuacagccaugggaaagaacuacgucaauggcaaaaccuuucuggaaaagcgcuauaacgaggaucuugaacuggaggacgcgauccauacagccauucucacccugaaagaguccuucgaagggcagaugacggaggauaauaucgaaguuggaauuuguaacgaggcuggcuuuagacggcuuaccccgacagaagugaaggacuaccuggccgcuaucgccuga

SEQ ID NO: 74343 - RNA, 768 nt, Artificial Sequence
  derived and/or modified sequence opt5 from PSMA3__Homo_sapiens__NP_002779
augagcuccaucggcaccggguacgaccugucugccagcacauucucccccgauggaagaguguuucaggucgaguaugcuaugaaggccguugaaaacucuagcacggcgauuggcauccggugcaaagacggggugguguucggagucgagaagcucgugcuguccaaacuuuacgaagagggcucuaauaagcgccuguuuaacguugauagacacguggggauggcugucgccggacuccuggccgacgcucggagccuugccgauauugcucgcgaagaggccuccaauuucagaagcaacuuuggcuauaauaucccucugaaacaucucgcggaccggguggccauguacguucacgcuuauacccuguacucugccgugcgcccguucggcuguuccuuuaugcuggggagcuauucugucaacgauggagcucaacucuacaugauugaccccuccggcgugagcuacggguauuggggaugcgccaucggcaaggcgagacaggccgcuaagacagagaucgaaaaacugcagaugaaggagaugaccugucgggauauugugaaagaagucgccaagaucauuuacaucguucaugacgaggugaaagauaaggcuuucgagcuugaacugucuugggugggggagcucacaaauggacgccacgaaauugucccuaaggacaucagagaggaagccgagaaauaugccaaggagucccugaaagaagaggaugaaagcgacgacgauaacauguga

SEQ ID NO: 74344 - RNA, 786 nt, Artificial Sequence
  derived and/or modified sequence opt5 from PSMA4__Homo_sapiens__NP_001096137
augagcagacgguacgacucccgcaccacaaucuucucucccgagggcagacuguaucagguggaauacgccauggaggcuauugggcacgccggaacgugccucggcauccuggcgaacgaugggguccuucuggcugccgaacggcgcaauauucauaagcuccuggacgagguguuuuucagcgaaaagaucuauaaacuuaacgaggauauggccuguuccguugcuggaauuaccucugacgccaaugugcugacaaacgagcucagacugaucgcucaacgguaccugcuccaguaucaggaaccuaucccgugcgagcagcuggucaccgcccuuugugauauuaaacaagcguacacacaguuuggcgggaagcgccccuucggagugagccugcucuauaucggcugggacaaacacuacggcuuucagcuguaccaguccgauccuucugggaauuauggaggcuggaaggcuaccugcauugggaacaauagcgccgccgcuguuuccaugcuuaagcaagacuacaaagaaggagagaugacacucaagagcgcccuggcgcuggccaucaaagugcugaacaagaccauggaugucucuaaacucuccgcugagaagguggaaauugccacgcugaccagagagaauggcaagacaguuauccgggugcuuaaacagaaggaagucgagcagcugauuaaaaagcaugaagaggaggaagcuaaagccgagcgcgaaaagaaagagaaggaacagaaggagaaagacaaguga

SEQ ID NO: 74345 - RNA, 504 nt, Artificial Sequence
  derived and/or modified sequence opt5 from PSMA6__Homo_sapiens__NP_001269161
augaccggcaugacagccgacagcagaucccaggugcaacgggcucgcuacgaggccgcgaacuggaaguauaaauacggguaugaaauccccgucgauaugcugugcaagagaauugcugacaucucucagguuuacacgcagaaugccgagaugcggccucucggauguugcaugauucugaucggcauugaugaggaacaggggccgcaaguguauaaaugugaccccgccggauacuauugcggcuucaaggcuaccgccgcuggggugaaacagacagaaagcaccuccuuucuugagaagaaggucaaaaagaaauucgauuggacauuugagcagaccguggaaacagccaucaccugucugucuacgguucucagcaucgacuucaagccuuccgagauugaagugggagucgugaccguugagaaccccaaauuucgcauccugacagaggcggaaauugaugcccaccuuguggcucuggccgagagagacuga

SEQ ID NO: 74346 - RNA, 747 nt, Artificial Sequence
  derived and/or modified sequence opt5 from PSMA7__Homo_sapiens__NP_002783
augagcuacgacagagcuaucaccguguucucccccgauggccaccuguuucaggucgaguaugcucaagaagccguuaagaaagggucuacagcggugggagugcggggccgcgacauugucgugcucgggguugagaagaaaagcguggcuaagcugcaggaugaaagaacgguccggaaaaucugcgcccuugacgauaacguguguauggccuucgcuggacugaccgccgacgcucgcauuguuaucaauagagcccggguggagugccagucccaucgccucacagucgaagauccugugaccguggaguacauuacaagauauaucgcgucucugaagcagcgguacacccaaagcaacggccgcagaccguuugggaucuccgcccuuauugucggauucgacuuugauggcacaccccggcuguaucagaccgacccuucuggcacguaccacgcuuggaaggccaaugcuaucgggcgcggagccaaaagcguuagagaguuccucgaaaagaacuauaccgaugaggcgauugaaacagacgaucugaccaucaaacuggugauuaaggcccuccuggaggugguccaguccggcgggaaaaauaucgagcuugcugugaugcggcgcgaccagagccugaagauucucaaccccgaagagaucgaaaaguacguugccgagaucgaaaaagagaaggaggaaaaugagaaaaagaaacaaaagaaagccucuuga

SEQ ID NO: 74347 - RNA, 822 nt, Artificial Sequence
  derived and/or modified sequence opt5 from PSMB10__Homo_sapiens__NP_002792
augcugaagcccgcccucgagccuagaggcggguucagcuuugaaaacugccagcggaaugcuucccuggagcgcgugcuuccgggacugaaagucccccacgccagaaagaccggcacaacgaucgcggggcucguuuuccaagacggagugauucugggcgcugauacccgggccacaaacgacucuguggucgccgauaaaagcugugaaaagauccauuuuauugcuccuaaaaucuacugcuguggggccggaguggcugccgacgcggagaugaccacacgcaugguugccuccaagauggaacuucacgcucugucuaccggcagagagccccggguggccacagucacccgcauucucagacagacgcuguuccgguaucagggccaugugggggcuagccugaucguuggaggcguggaucucaccgggccucagcuguacggaguccacccccauggcuccuauucucgccuuccuuuuacagcccuggggagcggacaagacgcggcccucgcugugcuggaggauagauuccagccgaauaugacccuugaagccgcucagggccugcucguggaggccgucacagccggcauccugggggaccugggauccggcgggaacguugaugcuugcgugauuaccaagacgggagcgaaacuccugcggacacuuagcucucccaccgaaccugugaagcgcuccggcagauaccacuuuguccccgggacaaccgccgugcugacccagacaguuaaaccucucacgcuggagcuuguggaggaaaccguccaagcuauggagguggaauga

SEQ ID NO: 74348 - RNA, 726 nt, Artificial Sequence
  derived and/or modified sequence opt5 from PSMB1__Homo_sapiens__NP_002784
augcugagcuccaccgccauguacucugcucccggcagagaccucgggauggagccucaccgggccgcgggaccgcugcagcuucgcuucagccccuauguguuuaacggcgggacaauccuggcuauugccggagaagauuucgccaucgucgcuuccgacacgagacucucugagggcuuuagcauucauacccgggauuccccuaagugcuacaaacugacagacaagaccguuaucggguguucuggauuccacggcgauugccuuacacugaccaaaauuaucgaagcccgccucaagauguauaaacauagcaauaacaaggcuaugacaaccggcgccaucgcggccaugcuguccacgauucuguacagcagacgguuuuuccccuauuacguguauaauaucauugggggacucgacgaggaaggcaagggggcuguguacucuuuugauccugucggauccuaccaacgcgacagcuucaaagccggcgggucugcuuccgccaugcugcagccccuucuggauaaccaggugggauuuaagaauaugcagaacguugagcacgugccucucagccuggacagagcgaugcggcuugucaaagauguguucaucucugccgcugagcgcgacguuuauaccggcgaugcccugagaauuuguaucgugacaaaggaaggcauucgggaggaaaccgucucccuccgcaaagacuga

SEQ ID NO: 74349 - RNA, 795 nt, Artificial Sequence
  derived and/or modified sequence opt5 from PSMB4__Homo_sapiens__NP_002787
auggaggccuuccugggcagcagauccgggcucugggcuggaggccccgccccugggcaguuuuaccggaucccgucuacccccgacagcuucauggauccugcguccgcucuguaucgcggacccauuacaagaacgcaaaacccuauggugaccggcacaucuguccuugggguuaaguuugaaggaggcguggugaucgccgccgacaugcugggcagcuacgggucccucgcucgguuccgcaauauuucuagaaucaugcgggucaacaauagcaccaugcugggagccuccggcgauuaugcugacuuucaguaccuuaaacaggugcuggggcagaugguuauugaugaggaacuccugggagacggccacagcuauucuccccgcgccauccauuccuggcugacaagagcgauguacagccggcgcucuaagaugaacccucucuggaauaccauggugaucgggggauaugccgauggcgaguccuuccugggcuacgucgacaugcuugggguggcuuacgaagccccgagccuggcuacaggauauggcgccuaccucgcgcaaccccugcuuagagagguucuggagaaacagccugugcucucucagaccgaagcccgggaucuggucgagcgcugcaugagagugcuguauuaccgggacgcucgcuccuauaacagauuucagauugccacggugaccgaaaagggggucgagaucgagggaccccucagcacagaaaccaauugggauauugcucacaugaucuccggcuucgaguga

SEQ ID NO: 74350 - RNA, 483 nt, Artificial Sequence
  derived and/or modified sequence opt5 from PSMB5__Homo_sapiens__NP_001124197
auggccggcggggcugccgacugcagcuucugggagagacugcucgcgcggcagugucgcaucuacgaacugagaaacaaggagcggauuuccguggcugccgccucuaaacuucuggcuaauauggucuaucaauacaagggaaugggccucagcauggggaccaugaucugcggaugggauaaacgcggccccgggcuguauuacguugacuccgaaggaaacagaauuucuggcgccacauuuagcgugggcuccgggucuguguaugcuuacggagucauggaucggggcuauagcuacgaccuugagguggaacaggccuacgaucuggcgcgcagagccaucuaucaggcuacguaccgggacgccuauuccgggggagcuguuaaucucuaccacgugcgcgaggauggcuggauuagagucagcucugacaacguggccgaucugcaugagaaguauuccgggagcaccccuuga

SEQ ID NO: 74351 - RNA, 720 nt, Artificial Sequence
  derived and/or modified sequence opt5 from PSMB6__Homo_sapiens__NP_002789
auggccgcuacccugcucgccgcgagaggcgcugggcccgccccugccuggggaccggaggcuuucacacccgacugggaaagccgggagguguccacgggcaccacaaucauggccguccaguuugaugggggaguugugcugggcgcugacucucgcaccacaaccgggagcuacauugccaacagagugacagauaaacuuaccccuauccacgaccggauuuucugcugucgcuccggaucugcggccgauacgcaagcugucgccgacgcugugaccuaucagcugggcuuucauagcaucgaacucaaugagcccccucugguucacacagccgcgucccuuuucaaggaaaugugcuacagauaucgggaggaucugauggccggcauuaucaucgcugggugggacccccaggagggaggccagguguacucugucccuaugggagggaugauggugcgccagagcuuugccauuggcggguccggaagcucuuauaucuacggcuauguugaugcuaccuacagagaaggcaugacaaaggaggaaugucuccaauucaccgccaacgcccuggcucuggcgauggagcgggacggguccagcggaggcgugauucgccucgccgcuaucgccgagucuggggucgaaagacaggugcugcuuggagaucagauuccgaaauuugccguggcuacgcugcccccugccuga

SEQ ID NO: 74352 - RNA, 834 nt, Artificial Sequence
  derived and/or modified sequence opt5 from PSMB7__Homo_sapiens__NP_002790
auggccgcugugagcgucuacgcgcccccuguuggcggguucuccuuugacaacugcagacggaaugccgugcuggaggcugauuucgccaagcgcggauauaaacucccgaaggugagaaaaaccggcacaacgaucgccggggucguguacaaggacggaauuguucugggcgcugauacccgggccacagaagggaugguggucgcugacaaaaacuguucuaagauccacuuuauuagccccaauaucuauugcuguggagccggcaccgcggccgauacagacaugaccacacagcuuauuuccucuaaccuggagcuccauagccuguccaccggccgccuuccuagagugguuacggcuaaucggaugcugaagcaaaugcuguuccgcuaccagggguauaucggagccgcucucgugcugggcggggucgaugugaccggaccccaccucuacucuaucuauccucauggcagcacagacaaacugcccuacgugaccaugggguccggaagccuugccgcgauggccgucuuugaagauaaguucagaccugacauggaggaagaggaggcuaaaaaccugguuucugaagccauugcugccggcaucuuuaaugaucucggcuccgggagcaacauugaccugugcgugaucucuaagaauaaacuugauuuccugcggccguacacagugcccaacaagaagggaacccgccucggcagauaucggugugagaaagggacgacagccguccugaccgaaaagauuacaccucuggagaucgaggugcucgaagagaccguucagaccauggacacauccuga

SEQ ID NO: 74353 - RNA, 819 nt, Artificial Sequence
  derived and/or modified sequence opt5 from PSMB8__Homo_sapiens__NP_004150
augcugaucggcacccccacaccuagagacacgaccccgagcuccuggcucacaucuagccugcuuguggaggccgcuccccuggaugacaccacacucccuacccccgucuccucugggugcccuggacuggaacccacagaguucuuucagagccuuggcggggauggagaacggaacguucaaauugagauggcccacggcaccacgacccuggcguucaaguuucagcauggggugaucgcugccguggacucccgcgccucugcuggaagcuacauuuccgcccucagagucaauaaagugaucgaaauuaacccuuaucugcugggcacaaugagcggcugugcugccgauugccaguacugggagcggcuccuggcgaaggagugucgccuuuauuaccugagaaauggggaacggaucucuguuuccgccgcuagcaaacuccugucuaacaugaugugccaguaucgcggaaugggccuuuccauggggagcaugaucuguggaugggacaagaaaggcccggggcuguacuauguggaugagcacggaaccagacucucuggcaauauguucuccacaggcagcgggaacaccuacgccuacggagucauggacuccggcuaucggcccaaucugucuccugaagaggcuuacgaucuggggcgcagagccauugcguaugccacgcaucgggacagcuacuccggaggcgugguuaacauguaucacaugaaggaggaugggugggugaaggucgaaagcacagacgugucugaucuccugcaucaauaccgcgaggcuaaucaguga

SEQ ID NO: 74354 - RNA, 660 nt, Artificial Sequence
  derived and/or modified sequence opt5 from PSMB9__Homo_sapiens__NP_002791
augcugagagccggcgcucccaccggggaccucccucgggccggagaggugcacacaggcacgaccaucauggcggucgaguucgaugggggaguugugaugggcagcgacucccgcgugucugcuggggaggccgucgugaacagaguuuuugauaagcugagcccgcuucaugaacggauuuacugcgcccuguccggaucugcugccgacgcucaggccguggcggauauggccgcuuaucaacucgagcugcacggcaucgaacuugaggagcccccucugguccucgccgcugccaaugugguucgcaacauuagcuacaaauauagagaagaccuguccgcgcaucugaugguggccggcugggaucagcgggaagggggacaggucuacggcacacucgggggaaugcugacccgccagcccuucgcuaucggcgggucuggaagcacauuuauuuauggcuacguggacgccgcuuauaagccuggcaugucccccgaagaguguagacgguucaccacagaugccaucgcccuugcuaugagccgcgacgggucuuccggaggcgugaucuaccuggucaccauuacggcggccgggguugaucacagagugauccucggaaaugagcugccuaaauuuuacgacgaauga

SEQ ID NO: 74355 - RNA, 1323 nt, Artificial Sequence
  derived and/or modified sequence opt5 from PSMC1__Homo_sapiens__NP_002793
augggccagagccaauccgggggacacggccccgggggaggcaagaaagacgauaaggacaaaaagaaaaaguacgagccuccggugcccaccagagucgggaagaaaaagaaaaagacaaaaggaccugaugccgcuucuaagcugccccucguuacgccucauacccagugccggcugaaacuucugaaacucgaacgcaucaaggacuaucugcuuauggaggaagaguucauuagaaaccaggaacagaugaaaccccuggaggagaagcaagaagaggaacggagcaaaguggaugaccuccgcggcacaccuauguccgugggcacccuggaggagaucauugaugacaaucacgccaucgucucuacaagcgugggguccgaacauuacguuucuauucugagcuuuguggauaaggaccuccuggagccgggauguuccguccuucugaaccacaaagugcaugcgguuaucggcgugcucauggaugacaccgauccccuggucacagugaugaagguggaaaaggcuccucaggagaccuaugccgacaucgggggacuugacaaucagauucaggaaaucaaagagagcgucgagcugccccucacgcacccugaauacuaugaggaaaugggcauuaagcccccgaaagggguuauccuguacggaccucccggcaccggcaagacacugcucgccaaagcuguggccaaccaaaccucugcuacauuccugagaguggucggguccgagcuuauucagaaguaucugggagauggcccuaagcucgugcgggaacuguuucgcguugccgaggagcacgcgcccagcaucguguucauugacgaaaucgaugccaucgggaccaaaagauacgacucuaauuccggaggcgagcgggaaauucagcgcacgaugcuugagcugcucaaccagcuggauggguuugacagcagaggagaugucaaggugaucauggcuacaaaucggauugaaacccuggaccccgcccucauccgcccuggcagaauugaucggaaaaucgaguucccgcugcccgacgagaagacaaagaagcgcaucuuucaaauucauaccucuagaaugacccuugcugaugacguuacacuggacgaucucaucauggccaaggacgaucuguccggcgcggacauuaaagccaucugcacggaagcugggcuuauggcccugcgggagagacgcaugaaggugaccaacgaagauuucaaaaagagcaaagagaauguccucuacaagaagcaggagggaacaccugaaggccuguaucuguga

SEQ ID NO: 74356 - RNA, 426 nt, Artificial Sequence
  derived and/or modified sequence opt5 from PSMC2__Homo_sapiens__NP_001191382
augcccgacuaccugggcgccgaucagagaaagaccaaagaggacgaaaaggaugacaaaccuauccgggcucucgaugagggggacauugcccugcuuaagacauauggacaaagcacguacucccgccagaucaaacagguggaagaugacauucagcaacugcucaagaagaucaacgagcugaccggcauuaaagaaucugauacagggcuugcgccgcccgcucugugggaccucgccgccgauaagcagacccugcagagcgagcagccucugcaagucgcuagaugcacaaaaaucaucaaugccgacuccgaggaucccaaguauauuaucaacguuaaacaguucgcuaaguuugugguggaccucucugaccaggucgccccuaccgauauugaagagggaaugcgggugggcuga

SEQ ID NO: 74357 - RNA, 1320 nt, Artificial Sequence
  derived and/or modified sequence opt5 from PSMC3__Homo_sapiens__NP_002795
augaaccugcuccccaauaucgagagcccugugaccagacaggaaaagauggccacagucugggacgaggcugaacaagauggcauuggggaggaaguucugaaaauguccacggaggagaucauucagcggacccgccuucuggacucugaaaucaagauuaugaaaagcgaggugcucagagugacacacgaacugcaggccaugaaggauaaaaucaaggagaacuccgagaagaucaaagucaauaagacccuuccguaccuggugucuaacguuauugaacuccuggacguggaucccaaugaccaggaggaagauggagcgaacaucgaccuggauagccaacggaaaggcaagugcgcugucauuaaaacauccacccgccagacauauuuccucccugugaucgggcugguugacgccgagaaacuuaagcccggagaucuggugggcgucaauaaggacucuuaccucauucuggaaacccuuccuacggaguaugauagcagagugaaggccauggagguggacgaacggcccaccgagcaguacuccgacaucgggggacuggauaaacagauucaagaacucgucgaggcuaucguucugccuaugaaccauaaggaaaaauuugagaaucugggcauccagccgcccaagggcgugcucauguaugggccucccggaacaggcaaaacccugcuugcccgcgcuugugccgcgcagacaaaggccaccuuccugaagcucgcugggccucagcuggugcaaauguuuauuggagacggcgccaaacuugucagagaugcuuucgcccuggcgaaggagaaagcccccagcaucauuuuuaucgacgaacucgaugcuauugggacgaagcgguucgacucugagaaagccggagaucgcgaagugcagagaacaaugcuggagcugcucaaccagcuggacggcuuucaaccgaauacccagguuaaggugaucgcugccacaaaccgggucgauauccuugacccugcccugcuccgcuccggcagacuggaucggaagauugaguuccccaugccuaaugaggaggcucgcgcgagaaucaugcagauucacagccggaaaaugaacgugucucccgacguuaauuacgaagaacuugccagaugcaccgacgauuuuaacggggcucaguguaaggccgugugcgucgaagccggaaugaucgcucugcgccggggcgccaccgagcucacacaugaggacuauauggaagggauucuggaggugcaagcgaaaaagaaagcuaaccugcaguacuacgccuga

SEQ ID NO: 74358 - RNA, 465 nt, Artificial Sequence
  derived and/or modified sequence opt5 from PSMC3IP__Homo_sapiens__NP_001242943
auguacggcaagcagaaaaucuauuucgccgaccaagaucaguuugacauggugagcgaugcugaccugcagguccucgaugggaagauuguugcccugaccgcgaaagugcagucccuucaacagucuugcagauacauggaggcugaacugaaggagcucagcuccgcccugacaacgcccgaaaugcagaaagagauccaggaacuuaagaaggagugugccggauaucgggagcgccugaaaaacauuaaggcugccaccaaucacgugacaccugaagagaaagaacaagucuacagagagcggcagaaguauugcaaagaguggcgcaagagaaagcggauggcuaccgaacucucugacgccauccuggagggcuacccgaaaagcaagaaacaguucuuugaagagguggggauugaaacagaugaggacuauaacguuacccugcccgauccuuga

SEQ ID NO: 74359 - RNA, 1257 nt, Artificial Sequence
  derived and/or modified sequence opt5 from PSMC4__Homo_sapiens__NP_006494
auggaggaaaucggcauucugguggagaaggcccaggacgaaauccccgcucucagcgucuccagaccucaaaccgggcugucuuuccuuggaccggagcccgaagaucuggaggaccucuacagccgguauaaaaagcugcagcaggagcuugaauuucuggagguucaggaagaguacauuaaagaugagcaaaagaaccucaaaaaggaguuccugcacgcccaggaagaagugaagcgcauccaguccauuccucuggugaucggccaguuucucgaggcggucgaccaaaauacagcuaucguggggucuacgaccggaagcaacuauuacguucggauucuguccacaaucgauagagaacuucugaaacccaaugccucuguggcccuccauaagcacagcaacgcucuggucgacgugcuuccucccgaggccgauuccagcauuaugaugcugaccucugaccagaaaccugauguuauguaugcugacaucggcgggauggauauucagaagcaggaggugcgcgaagccgucgagcucccgcugacacauuucgaacuguacaaacaaaucggaauugaucccccuagaggcgugcucauguaugggcccccuggcugcggaaagaccaugcuggcgaaggccguggcucaccauacaaccgccgcuuuuauccgggucguuggcuccgaguucgugcagaaauaccuuggggaaggaccccgcauggugagagacgucuuucggcuggccaaggagaaugcgccggccaucauuuucaucgacgagauugacgcuaucgccacgaaacgcuuugaugcucagaccggcgccgacagagaagugcaacggauucuccuggagcuucugaaccagauggauggguucgaccagaauguuaacgugaaggucaucauggccacaaaucgcgcugauacccucgacccugcgcugcugagacccggacggcucgaucgcaaaaucgaauuuccucugcccgacagacggcagaagagacuuauuuucagcacaaucaccucuaaaaugaaccuguccgaggaaguggaucucgaggacuacguugcccgccccgauaagauuagcggcgcugacaucaauucuauuugucaagaguccggcaugcuggccgugcgggaaaacagauauaucguccuugccaaggacuuugagaaggcuuacaaaacggugaucaaaaaggaugaacaggagcacgaguucuauaaauga

SEQ ID NO: 74360 - RNA, 1197 nt, Artificial Sequence
  derived and/or modified sequence opt5 from PSMC5__Homo_sapiens__NP_001186092
auggagcuggaagagggcaaggccgggagcggacucagacaguacuaucuguccaaaaucgaggagcuucaacugauugugaacgacaagucucagaaucuccggcgccugcaggcucagagaaacgaacuuaaugccaaaguccggcugcuccgcgaggagcugcaacugcuccaggaacagggcagcuacguuggggagguggugagagcgauggauaagaaaaagguccuggugaagguucaccccgaaggaaaauucguggucgacguggauaagaacaucgacauuaaugauguuaccccuaacugccggguggcccuucgcaaugacuccuauacacugcauaaaauccucccgaacaaggucgauccccuggugucucuuaugaugguggagaaagucccugacagcacguacgagaugauuggcgggcuggauaagcagaucaaggaaaucaaagagguuauugaacuccccgugaagcacccugagcuguuugaagcucugggaaucgcccaacccaaaggcgugcuccuguauggcccuccggggaccggaaagacacuucuggcuagagccgucgcucaucacaccgacuguacauucauucggguguccggcucugagcucguucagaaauuuaucggggagggagcccgcauggugagagaacuguucgucauggcgcgggagcaugcccccagcauuaucuuuauggaugaaauugacuccaucggcagcucucgccuugaagggggauccggcggcgauagcgaagugcagagaaccaugcuggagcuccugaaucagcuggacggguucgaggcuacaaagaacaucaaaguuauuauggccaccaaucggaucgacauucucgauucugcucugcuucgcccuggaagaaucgaccggaagauugaauuucccccucccaacgaggaagccagacuggauauccucaagauccacucccgcaaaaugaaucugacgcggggcauuaaccuuagaaagaucgcggagcugaugccgggggccagcggagcugaagugaaaggcgucugcaccgaggccgggauguacgcucuccgcgagcggagagugcacgucacacaagaagacuucgagauggccguggccaagguuaugcagaaagauucugaaaagaauauguccauuaagaaacuguggaaguga

SEQ ID NO: 74361 - RNA, 1212 nt, Artificial Sequence
  derived and/or modified sequence opt5 from PSMC6__Homo_sapiens__NP_002797
auggccauccccggcauuccuuacgagagacggcugcucaucauggcugacccgcgcgauaaggcccugcaggacuauagaaagaaacuucuggaacacaaagagauugaugggcggcucaaggaacugcgcgagcaacuuaaagaacugaccaagcaguacgaaaagagcgagaacgaccucaaagcgcugcaguccgugggacagaucgucggcgagguucugaagcaacucacagaggaaaaauucauugugaaggcuacgaaugggcccagauauguggucggaugccggcgccagcuggauaaaucuaaacuuaagccuggcaccagaguggcccuggacaugacaacccucacaaucaugcgguaccugccccgcgagguugauccucuuguguauaacaugagccaugaggaccccgggaaugucuccuacucugaaaucggaggccugagcgagcagauuagagaacuccgggaggugaucgaacugccucugaccaacccggagcucuuucagcgcguuggcauuauucccccuaaggggugucugcuuuauggacccccuggcacagggaagacccugcucgccagagcuguggccucccaacuggauugcaauuuccuuaaagucgugucuagcuccaucguggacaaguacaucggagagagcgcucggcugauucgcgaaauguuuaacuacgccagagaucaccagcccuguaucaucuucauggacgagauugaugcgaucggcgggcggagauuuucugaaggaacguccgccgaccgcgagauucagcggacccucauggaacugcugaaucagauggacggcuucgauacacuccauagagucaaaaugaucauggcuaccaaccgcccggacacacuggauccugcccuucugcggcccggcagacucgaccgcaagauucacaucgaucugccuaaugagcaagcucggcuugacauccugaaaauucaugccgggcccaucaccaagcacggagagauugauuaugaagcgaucguuaagcucagcgacggcuuuaacggggccgaucugagaaaugugugcacggaggcuggaauguucgccauucgcgcugaccacgauuuugugguccaggaagacuucaugaaagccgugcggaagguugccgacucuaaaaagcuggaguccaaacucgauuacaagcccguguga

SEQ ID NO: 74362 - RNA, 681 nt, Artificial Sequence
  derived and/or modified sequence opt5 from PSMD10__Homo_sapiens__NP_002805
auggagggcugcgugagcaaccugauggucuguaaucucgccuacuccgggaagcuggaagaacuuaaagaaucuauccuggcugacaagagccucgccaccagaaccgaucaggacucccggacggcgcugcacugggcuugcucugccggacauaccgagauuguugaguuccuucugcaacucggcgugcccgugaacgauaaagacgaugccggguggagcccucugcacaucgcugccuccgcuggacgcgacgagauugucaaggcccugcucggcaaaggggcccaggugaaugcgguuaaccagaauggauguacaccgcugcauuaugcugccucuaagaacagacacgagaucgcugugaugcuucuggaaggcggcgccaaucccgaugcgaaggaccauuacgaggccaccgcuaugcaccgggccgcugccaaagggaaccucaagaugauucacauccugcuuuauuacaaagccagcacaaauauccaggauaccgaaggaaacacaccucugcaucucgcuugcgacgaggagcgcgucgaagaggcgaagcugcuggugucccaaggcgccagcauuuauaucgaaaauaaagaggaaaagacaccccuccagguugcuaaagggggacugggccuuauucugaagagaaugguggagggguga

SEQ ID NO: 74363 - RNA, 1371 nt, Artificial Sequence
  derived and/or modified sequence opt5 from PSMD12__Homo_sapiens__NP_002807
auggccgacggcgggagcgagagagcugauggacggaucgugaagauggaagucgacuacuccgccaccguugaucagcgccugcccgagugcgcgaaacucgcuaaggaaggcagacugcaagaggugauugaaacacuucugucucucgagaaacagacgcggaccgccagcgacaugguguccacaucucgcauccuggucgccgugguuaagauguguuaugaggcuaaagaaugggaucuucugaacgagaauauuaugcuccugagcaagagacggucccagcugaagcaggccguggcuaaaaugguccaacagugcuguaccuacguggaagagaucacagaccucccuauuaagcugcgccuuaucgauacccugagaaugguuacagaggggaaaaucuauguggaaauugagcgggcccgccucaccaagacgcuggcgaccaucaaagaacagaacggagacgucaaggaggccgcuucuauucuucaggaacugcaaguggagacauacggcagcauggagaagaaagaaagaguggaguucauccucgaacagaugcggcugugccuggccgucaaggauuauauucgcacccagaucauuuccaaaaagaucaauacaaaauuuuuccaggaggaaaacaccgagaagcucaaacugaaguacuauaaucuuaugauccaacuggaccagcacgaggggagcuaccucucuauuuguaagcauuacagagcuaucuaugauacgccgugcauucaggccgaauccgagaaauggcaacaggcgcuuaagagcguugugcuguacgugauccuggcccccuuugacaacgaacagucugaucucguccaccggauuuccggagacaaaaagcuggaggaaaucccuaaauauaaggaccugcucaagcuguucacaaccauggagcuuaugcgcuggagcacacugguggaggauuacggcauggaacucagaaaaggcucucuggagucccccgcuaccgacguuuuugggagcaccgaagagggagagaagcgguggaaagaucuuaagaauagaguggucgaacauaacauccgcauuauggccaaauauuacacacggaucacgaugaagagaauggcucagcugcucgaccuguccguggaugagucugaagccuuccugagcaaucucguugugaacaagaccauuuuugccaaagucgaccgccuggcuggcaucauuaauuuccaacggccuaaggaucccaacaaucuucugaacgacuggucccagaaacucaauagccugaugucucuggugaacaagacaacccaccuuaucgcgaaagaggaaaugauccauaaccuccaguga

SEQ ID NO: 74364 - RNA, 1131 nt, Artificial Sequence
  derived and/or modified sequence opt5 from PSMD13__Homo_sapiens__NP_002808
augaaggacgugcccggcuuccugcagcaaagccagaacuccgggccuggacagccggccgucuggcacagacucgaggaacuguacaccaaaaagcuguggcaucagcuuacacuccaaguucuggauuuugugcaggaccccugcuucgcucagggcgaugggcuuaucaaacuguaugagaauuuuauuucugaguucgaacaccgggugaacccucucagccuggucgaaaucauucugcaugugguucgccagaugacggaccccaauguggcccucaccuuucuggagaagacaagagagaaagucaaguccucugaugaagcggugauccuuuguaagaccgcuauuggagcccugaaacucaacaucggcgaccugcaaguuacaaaggagaccaucgaagauguggaggagaugcuuaauaaccugccuggggucacaagcgugcacucccgguucuacgaccucucuagcaaauauuaccagaccauuggaaaucaugccuccuauuacaaggaugcucugcgcuuucugggcugcguggacaucaaagaucuccccgucagcgaacagcaggagagagccuucacgcugggccuugcugggcugcucggagaaggcguuuuuaacuucggggagcugcuuaugcacccugugcuggaaucucuccggaauaccgaccgccaauggcugauugauacacuguaugccuuuaacuccggaaauguggagagauuccagacccucaagacagcguggggccagcaaccggaccuggccgcuaacgaggcccagcuucugcggaagauccagcuccugugucuuauggaaaugaccuuuacgcgccccgcuaaucacagacagcugacauucgaggaaauugccaaaagcgcgaagaucaccgucaacgagguggaacuccugguuaugaaagcccugucuguggggcucgucaagggauccauugacgagguggauaaacggguucauaugacaugggugcaaccucgcguccuggaccuucagcagaucaagggcaugaaagauagacuggaguucuggugcaccgacgucaagagcauggaaaugcucguggagcaccaggcucaugauauccugaccuga

SEQ ID NO: 74365 - RNA, 933 nt, Artificial Sequence
  derived and/or modified sequence opt5 from PSMD14__Homo_sapiens__NP_005796
auggacagacugcuccggcugggcgggggaaugcccggccuugggcagggaccuccgaccgaugcccccgcuguggacacagccgagcaagucuacaucagcucccuggcgcuccugaagaugcuuaaacacggccgcgcugggguuccuauggaagugaugggacugaugcucggcgaguucguggaugacuauacggucagagugauugauguuuuugccaugccccagucuggcaccggggugagcgucgaagccguggacccuguuuuccaggcuaagaugcuggauaugcugaaacagacaggacggcccgagaugguggucggcugguaccauucccacccuggguuuggaugcuggcucucuggcguggacaucaacacccaacagagcuucgaagcccuguccgagcgcgcuguggccgucguuguggauccgauucagucugugaaggggaaagucgugaucgacgcguuuagacuuauuaaugccaacaugaugguucugggacaugagccccggcagacaaccagcaaucucggccaccugaacaagccuuccauccaagcucuuauccauggccugaaucgccacuauuacagcauuacaaucaacuauagaaagaaugaacucgagcagaaaaugcugcugaaccuccacaagaaaucuuggauggaagggcugacccuucaggauuacuccgagcauuguaagcacaaugagagcguggucaaagaaaugcuggagcucgccaagaacuauaauaaggcuguggaagaggaagacaaaaugacgcccgagcagcuggccauuaagaacguuggaaaacaagauccuaagcggcaucuugaggaacacguggacguccugaugaccucuaauaucgugcagugccucgcggccaugcuggacacagucguguucaaauga

SEQ ID NO: 74366 - RNA, 2769 nt, Artificial Sequence
  derived and/or modified sequence opt5 from PSMD1__Homo_sapiens__NP_001177966
augaucaccagcgccgcuggcauuaucucccugcucgacgaggaugaaccccagcugaaggaguucgcccuucacaaacugaacgcgguggucaaugacuuuugggcugaaauuucugagagcguugauaagaucgaagugcucuacgaggacgagggguucagaucccggcaauuugccgcccugguggcuucuaaagucuucuaucaucuuggagccuuugaagagagccugaacuacgcucucggcgccggggaucuguucaaugugaacgacaauuccgaauauguugagacaauuaucgcgaagugcaucgaucacuacacgaaacaguguguggagaacgccgaccugccugaaggagagaagaagccgauugaucagcgccucgaaggcaucgucaauaaaauguuucagagaugccuggacgaucauaaguauaaacaagcuauugggaucgcccuugagacccggcgccuggacguguucgaaaagacaauucucgagucuaacgauguucccggaaugcuggcuuacagccuuaaacuguguaugucccucaugcagaauaagcaguuuagaaacaaggugcugcggguccuggugaaaaucuauaugaaucucgagaagccugacuucauuaacgugugccagugucugaucuuucuugacgauccccaagccgucagcgacauccuggaaaaacucguuaaggaggauaaucugcuuauggcguaccagauuugcuucgaccuguacgaaucugccucccagcaguuucucagcucugugauccaaaaccugcgcaccgugggcacaccuauugcuuccguccccggcagcaccaauacagggaccgugccuggaucugagaaagauuccgacagcauggaaacggaggagaagaccuccucugccuucguuggcaaaacaccggaagcuagccccgagccuaaggaucagacccugaagaugaucaaaauucucuccggggaaauggccaucgagcugcaccuucaguuccugaucagaaacaacaauacagaccucaugauucugaagaacaccaaagaugccgugcggaauagcgucugucauacggcuacagugaucgcgaacucuuuuaugcacugcggaaccacauccgaccaauuccuucgcgauaaucuggaauggcucgccagagcuaccaacugggccaaguuuaccgccacagcuagccugggcguuauucacaaagggcaugagaaggaggcccugcagcucauggcgacguaucugcccaaggacaccucuccuggaagcgcuuaccaggaaggcggcgggcuuuaugcccugggacucauccacgccaaucauggcggggacauuaucgauuaccugcugaaccagcuuaaaaaugcuuccaacgacaucgugcggcacggaggcucucucgggcugggacuggccgcuaugggcacagcccgccaagaugucuaugaccuccugaagaccaaucuuuaccaggaugacgcggugacaggcgaggccgcugggcuggcccucggacuggucaugcugggcagcaaaaacgcucaggccauugaagauauggugggguaugcgcaggagacccaacacgagaagauccuuagaggacucgccguuggcauugcucuggugauguacgggcggauggaagaggccgacgcucugaucgaaucccucugucgcgauaaagaccccauucugagacggagcggcauguacacggucgccauggccuauugcggaucuggcaauaacaaggcuaucagacgccuucugcauguggcgguuuccgaugugaaugacgauguccggagagccgcuguggagagccucggguucauucuguuucgcacaccggaacaguguccuucugugguuucccugcuuagcgaguccuacaacccccacguccgguauggagccgccauggcucucggcaucugcugcgccgggaccggaaacaaggaggcgaucaaucugcuggaaccuaugaccaacgaccccgugaauuacgugagacagggcgcucucauugccucugcccugaucaugauucagcaaacagagaucaccugucccaaagucaaccaguuccgccagcuuuauagcaaggugauuaaugacaaacaugaugacguuauggcuaaguuuggggccauccuggcgcagggcauccucgaugcuggaggccacaacgugacaauuucccugcaaucucggacggggcauacccacaugccuagcgucgugggaguucugguguucacacaguuuugguucugguuuccgcuuucccacuuccucagccuggccuacacccccacaugcgucaucggccugaauaaagaccucaaggugucuaccgccguucuguccauuacggcuaaggccaaaaagaaagaaaaggagaaagaaaagaaagaggaggaaaagauggagguggaugaagcugagaagaaagaagagaaggagaaaaagaaagaaccugagcccaacuuucagcuucuggacaauccugccagagucaugcccgcgcaacucaaggugcugaccaugccggaaacaugucgcuaucagccuuucaagccccugagcaucgggggaauuaucauccuuaaagauaccucugaggacauugaggaacugguggagccugucgccgcucauggccccaagaucgaagaggaggaacaggagccugaacccccggagccuuucgaauacauugaugacuga

SEQ ID NO: 74367 - RNA, 2250 nt, Artificial Sequence
  derived and/or modified sequence opt5 from PSMD2__Homo_sapiens__NP_001265638
augagcauguccggcgagguggccaaggaauggcaggagcuggacgaugcugaaaaaguccaaagagagccccuccugacccuuguuaaggaaaucgugccuuacaacauggcccacaaugcggagcaugaggcuugcgaccugcucauggaaauugaacagguggauaugcuggaaaaagacaucgaugagaacgccuaugccaaggucugucuuuaccugacaucuugcgugaauuauguuccggagcccgaaaacagcgcucuccugcggugugcccuggggguguuccgcaaauuuuccagauucccugaggcucuccggcuggcccuuaugcugaaugacauggaacucgucgaggauauuuuuacgucuugcaaggacgugguugugcagaagcagauggcguucaugcugggacgccacggcgucuuucuugaacugagcgaggauguggaggaauacgaggaccucaccgaaaucauguccaacgugcaacuuaauucuaacuuccuggcccucgcuagagagcuggauauuauggaacccaaagucccugacgauaucuauaagacacaucuugagaauaaccgguuugggggaagcggcucccagguugacagcgcccgcaugaaucuggcuucuuccuucgugaacggguuugugaaugccgcguucggacaggacaaacuccugaccgaugacggcaacaaguggcuuuacaaaaauaaggaucacggcaugcugagcgccgcugccucucucgggaugauccugcugugggacgucgauggaggccucacacagauugacaaguaucuguacuccagcgaggauuacaucaaaucuggggcucugcuggccuguggaauugugaacuccggcguuagaaacgaaugcgaccccgcccucgcucugcuuagcgauuaugugcugcauaauuccaacaccaugcggcucgggucuaucuuuggacugggccuggcguacgccggcagcaaucgcgaggacguccucacacugcuucugccugugaugggggauuccaagagcucuauggaaguugcuggagugaccgcccucgccuguggcaugauugcugucggguccugcaacggagacgugacgagcaccauccugcaaacaauuauggagaaaucugaaaccgagcugaaggacacauaugccagauggcuuccgcucggccuggggcugaaucaccucggaaaaggcgaggcgaucgaagcuauccuggccgcccuugaggucgugagcgaacccuuccgguccuuugcuaacacccugguugaugugugugccuacgcuggcucugggaauguccucaaggugcagcagcugcugcacauuugcagcgagcauuucgacuccaaagagaaggaagaggauaaggacaaaaaggagaaaaaggauaaagacaagaaggaggccccugcggauaugggagcccaccagggcguugcugugcuugggaucgcccucauugcuaugggagaagagaucggcgccgagauggcgcugcgcacguucgggcaucugcucagauauggcgaacccacacugcggcgcgccgucccucuugcucuggcccucauuagcgugucuaaccccagacugaauauccuggacacccuuuccaaauuuagccacgaugcugacccggaggugucuuacaacuccaucuucgccaugggaaugguuggcagcgggacaaauaacgcccggcucgcugcgaugcugagacaacuggcccaguaucacgcuaaggauccuaauaaccucuuuaugguccgccuggcccagggacuuacccaucugggcaaagggacccucacacugugucccuaccacuccgaccggcaacugaugucucagguggccguggcuggacuucucacgguccuggugagcuuccuggauguuagaaauauuauccucggcaagucccauuacgugcuguaugggcuugucgccgcgaugcagccucgcaugcuggugaccuuugacgaggaacuccggccccugcccguuucugugagagucggccaggcuguggacguugugggacaagccggcaaaccuaagacaauuaccggguuccagacacacaccacgccgguccugcuugcccauggagaacgcgcugagcuggccacagaggaauuucuccccgugaccccuauccuggagggcuucgugauucuccggaagaaccccaacuacgaucuguga

SEQ ID NO: 74368 - RNA, 1605 nt, Artificial Sequence
  derived and/or modified sequence opt5 from PSMD3__Homo_sapiens__NP_002800
augaagcaggagggcagcgccagacggcgcggggcugacaaagccaagcccccuccgggaggcggggaacaagagcccccucccccucccgcgccucaggauguggaaaugaaagaggaagcugccaccggaggcggguccacaggagaggccgacggcaagacggcugccgcugccgcggagcacucucagagagaacuggauaccgucacacucgaggacaucaaagaacauguuaagcagcuggagaaggccgugagcggcaaagagccgcgguucgugcuucgcgcucugagaaugcuccccuccaccucucggcgccugaaccacuacguccuuuauaaggccgugcaaggguuuuucacaagcaauaacgcuaccagagauuuucugcucccuuuccuggaggaacccauggacacagaagccgaucugcaguuucggccucgcaccggaaaagcggccuccacgccccuccugccggagguugaagccuaccuucagcugcucguggucauuuucaugaugaacucuaagagauauaaagaggcccagaagaucagcgacgaucugaugcaaaagauuuccacccagaaucggcgcgcucuugaccugguggccgccaaaugcuacuauuaccaugcuagaguuuaugaguuucucgauaagcuggacgugguccggagcuuccugcacgcgcgccucagaacagccacccugcggcaugaugcugacggccaggccacacuucugaaucuccugcuuagaaacuaccugcacuacucucucuaugaccaggccgaaaaacugguguccaagagcguguuuccugagcaagcuaauaacaaugaaugggcccgcuaccuguauuacaccgggcggaucaaagcgauucagcucgaguauucugaagcuagacgcacgaugacaaacgcccugcggaaggcuccccagcacaccgcugucggauucaaacaaacaguucauaaacuucugaucgugguggagcuccugcuuggcgagaucccugauagacugcaguuucgccagcccucccucaagcggagccugaugcccuacuuccugcucacccaggccgucagaaccgggaaucuggcuaaguuuaaccaagugcuugaccaguucggagaaaaguuccaggccgauggcacauauacgcugauuauccgccuccggcacaauguuauuaaaaccggcgugagaaugaucucucuguccuacagccgcauuucccuggcggacaucgcccagaaacuucaacucgauucuccugaggacgcugaauuuauugucgccaaggcuauccgggauggggugaucgaggccagcauuaaccaugaaaagggauacguucaguccaaggagaugaucgacauuuauagcacaagagagccgcagcuggcguuccaccagcggaucucuuuuugucuggauauucacaauauguccgugaaagccaugcgcuucccucccaagagcuacaacaaagaccucgaaucugcugaggaaagacgggagagagagcaacaggaucuggaauuugccaaggagauggcugaagacgacgaugacagcuuccccuga

SEQ ID NO: 74369 - RNA, 1134 nt, Artificial Sequence
  derived and/or modified sequence opt5 from PSMD4__Homo_sapiens__NP_002801
auggugcuggagagcaccauggucugcguugacaacuccgaauacaugagaaauggcgauuuccuccccacacggcugcaggcccaacaggacgcugugaacaucgugugucacucuaagacgcgcagcaauccugagaacaaugucgggcuuauuacccuggccaacgauugcgaagugcucacaacccugacaccggacaccggaagaauccuuuccaaacugcauacaguucagcccaagggcaaaauuaccuuuuguacggggauccggguggcgcaccucgcucugaagcaucgccagggaaagaaucacaagaugagaauuaucgccuucgucggcucuccuguggaggauaacgaaaaggaccugguuaaacucgccaagcggcugaaaaaggagaaagugaaugucgauaucauuaacuuuggggaggaagaggugaauaccgaaaaacuuacagcuuucgugaacacccugaauggaaaggacggcacaggcagccaucucgucaccguucccccugggcccucccuggccgaugcucuuaucucuagcccuauucuggccggagagggcggggcgaugcucggacugggcgccuccgacuuugaguucgggguggauccgagcgcugaccccgaacuggcccucgcucugcgcgugucuauggaggaacaaagacagcggcaggaggaagaggcccgcagagcggccgcugccuccgcugccgaggccggaaucgcuacgacaggcaccgaagauagcgacgacgcgcuucugaaaaugacaauuucucagcaagaguuuggccggaccgggcucccugaucuguccagcaugaccgaagaggaacagaucgccuaugcuaugcagaugucucuucagggagccgaguucggccaagccgaguccgcugacauugaugccagcuccgcgauggacacaucugaacccgcuaaggaggaagaugacuacgaugucaugcaggacccugaguuucugcagagcgugcucgaaaaccugcccgggguugauccgaauaacgaggccauccgcaacgccaugggaucccuggcuagccaagccacgaaagacggcaagaaagauaagaaagaggaagacaagaaguga

SEQ ID NO: 74370 - RNA, 1329 nt, Artificial Sequence
  derived and/or modified sequence opt5 from PSMD6__Homo_sapiens__NP_001258708
augccccuggagaaccucgaagaggaaggccugccuaagaauccggaccuuagaaucgcccagcugcgguuccuccugagccuucccgagcaccgcggggaugcugccgugagagacgaacugauggcggcuguccgggauaacaauuuuuggaaccgcauuagacaagagcagaccgaggacugcccucccuccucuccuagccggggauggcauugucaggauuggcccucccgcaaaccuccgacaucuaucagacucugcuucgccaagcccauuaucaaacggcaccgcaugccuagcuacauggcccccuauuacgaagcucuguguaagucccuggacuggcagauugauguugaccuccugaauaaaaugaagaaggccaacgaggaugaacuuaaaagacuggacgaggagcucgaagaugcugagaagaaucugggcgaaucugagauccgggacgccaugauggcgaaagccgaauaucuuugccgcaucggggauaaggagggagcucugacggccuuuagaaaaaccuacgacaagacaguggcucucggccaucggcuggacauuguguucuaucugcuccgcaucgggcuguuuuacauggauaacgaccuuauuaccagaaauacagagaaggccaaaagccugaucgaagagggaggcgauugggaccggagaaaccgccucaaggucuaucaaggccuguacuguguggcgauucgggauuucaaacaggccgcugaacuuuuucuggacaccguuuccacauucaccagcuacgagcucauggauuauaagacguuugugaccuacacagucuaugugucuaugaucgcccuggaaagaccugaccugcgcgagaaaguuauuaagggggcugagauccucgaagugcugcacucccuucccgccguccggcaguaccuguucagccucuaugagugcagauacucuguguuuuuccagucccuggccguggucgaacaagagaugaaaaaggauuggcuuuuugcuccgcauuaucgcuacuacguucgggaaaugagaauccacgcguauagccagcugcucgagucuuaccgcucccugacccugggauauauggccgaggcuuucggcguggggguggaguucauugaccaggaacucagccgguuuaucgccgccggaagacugcacuguaagauugauaaagucaaugaaaucguggagacaaaccgcccugacuccaagaauuggcaguaccaagagaccauuaaaaagggcgaccuucugcucaaccggguucagaaacugucuagagugaucaauauguga

SEQ ID NO: 74371 - RNA, 975 nt, Artificial Sequence
  derived and/or modified sequence opt5 from PSMD7__Homo_sapiens__NP_002802
augcccgagcuggccgugcagaaggucguugugcacccucucgugcugcuuagcgucguggaccauuucaacagaaucggcaaaguugggaaucaaaagcggguggucggagugcugcucggcuccuggcagaaaaagguucuggaugugucuaacagcuuugcugucccguucgacgaagaugacaaagaugacuccgugugguuucuugaucacgacuaccuggagaauauguaugggauguucaagaaggugaacgcccgcgaaagaauugucggaugguaccauaccggccccaaacuccacaagaaugauaucgcgauuaacgagcugaugaaacgguauugcccuaauucuguucuggugaucauugacgugaagcccaaagaucucgggcugccuacagaggcuuacaucagcgucgaagaggugcaugacgauggaacgcccaccuccaagacauuugaacacguuaccucugagaucggcgccgaagaggccgaggaagugggcgucgagcaccuucugcgcgacauuaaggacacaaccguggggacacucagccagagaaucaccaaccagguucauggacugaaaggccuuaauuccaagcugcucgauauucggagcuaucuggaaaaaguggcuacggggaagcugccuaucaaccaccaaauuaucuaccagcuccaggacgucuucaaucugcuuccggaugugucucugcaggaguuugucaaagccuucuaucucaagaccaacgaccaaauggugguuguguaccuggcuucccuuauucgcagcgucguggcccugcauaaucucaucaacaauaaaaucgcgaacagagaugccgaaaagaaggagggacaggagaaagaagagucuaagaaagaccggaaggaagauaaagagaaggacaaggauaaagaaaaguccgacguuaaaaaggaggagaaaaaggaaaagaaauga

SEQ ID NO: 74372 - RNA, 1053 nt, Artificial Sequence
  derived and/or modified sequence opt5 from PSMD8__Homo_sapiens__NP_002803
auguucaucaagggcagagcuccccgggccccuccgcgcgagagacggcgcgccaccagagggggacugcgccagguggucgcgcccccucgggcucucggcagcacauccagaccccacuuucggcgcgccucuguuugcagacggcgcuguagaaaaagcgggggacugcuugccgcuucccggaagauggccgcugccgcggugaacggcgccgcuggguucucuagcuccggaccugccgcuacgucuggcgccgugcugcaagcggccaccggcauguacgaacagcucaaaggggaguggaaucgcaagagccccaaccuguccaaaugcggagaggaacuuggcagacugaagcucguccugcuggaacucaauuuucugccuacaaccgggacaaaacuuaccaagcagcagcugauucucgcucgggacauccuggagauuggagcccaauggagcauccuuagaaaggauauuccgucuuucgagcgcuauauggcucagcugaaauguuacuauuuugacuacaaggaacagcuccccgaguccgccuauaugcaucagcugcugggccucaaccugcuuuuccugcucagccaaaaucggguggccgaauuucacacagagcuggagagacuuccugcuaaagauauccagaccaacguuuacaucaagcaucccgugucucuggaacaguaucucauggagggguccuacaauaaggucuuccuggcgaaaggaaacauuccugccgaaagcuacacguuuuucaucgacauucugcucgauaccauccgcgacgagauugcuggcugcaucgaaaaggccuaugagaaaauucuguuuacagaggccacccggauccuuuucuuuaauacacccaagaaaaugaccgauuacgcuaagaaaagaggcugggugcuggggccgaacaauuauuacucuuucgccucccagcaacagaagccugaagacacgacaauccccagcaccgagcucgcgaagcagguuauugaauaugcucgccaacuggagaugaucguguga

SEQ ID NO: 74373 - RNA, 672 nt, Artificial Sequence
  derived and/or modified sequence opt5 from PSMD9__Homo_sapiens__NP_002804
augagcgacgaggaagccagacaguccggcgggucuagccaagcuggaguggucaccguuuccgaugugcaggagcugaugcggcgcaaggaagagaucgaagcccagauuaaagcgaacuacgacgugcucgagucucagaagggcaucgggaugaaugagccccuggucgauugcgaaggauauccuagaagcgacguggaucuuuaccaaguucggacagcucgccacaacauuaucugucugcagaaugaccauaaagccgugaugaagcaggucgaggaagcccuccaccagcugcaugcuagagauaaagagaagcaagcccgggacauggcugaggcccacaaggaagcgaugucccgcaaacuuggccagucugagagccaggggccgcccagagccuucgcuaaggugaacuccauuagcccuggaucucccgccuccaucgcuggccugcagguugaugacgaaaucguggaguuuggcagcgucaauacgcaaaacuuccagucucuccauaauauuggguccguggugcagcacagcgaaggaaaaccucugaacgucaccguuauccggcgcggcgagaagcaccaacugagacucgugcccacacggugggccgggaaaggacugcuuggcugcaauauuaucccucugcagcgcuga

SEQ ID NO: 74374 - RNA, 750 nt, Artificial Sequence
  derived and/or modified sequence opt5 from PSME1__Homo_sapiens__NP_006254
auggccaugcugagagugcagcccgaggcucaagccaaggucgacguuuuccgggaagaucucugcaccaaaacagagaaccugcuuggcagcuacuuuccuaagaaaaucuccgaacuggacgcguuccucaaggagccggcucugaaugaagccaaccuuucuaaucugaaagcuccccucgauauuccugugcccgacccugugaaggagaaggagaaagaagaacgcaagaaacagcaggaaaaggaggauaaagacgagaagaagaaaggggaagaugaggacaagggacccccuuguggcccggucaacugcaaugagaaaaucgugguucugcugcagagacucaagcccgagauuaaagaugugaucgaacaacugaaccuugucacgaccuggcugcagcuccagauuccucggaucgaggacgggaauaacuuuggaguggccguucaggagaagguguucgaacugaugacaagccuucacaccaaacuggagggcuuucauacacaaaucuccaaguauuucucugaacgcggggaugccgucaccaaggcugccaaacagccccacgugggagacuacagacagcucgugcaugagcuggaugaagcggaguaucgggacauucgccugauggucauggagaucagaaaugccuacgcuguucucuaugacauuauccugaagaacuuugaaaaacuuaagaaaccucggggcgagacaaagggcaugauuuacuga

SEQ ID NO: 74375 - RNA, 720 nt, Artificial Sequence
  derived and/or modified sequence opt5 from PSME2__Homo_sapiens__NP_002809
auggccaagcccugcggcgugagacugagcggggaggcucggaaacaggucgaaguuuuccgccaaaaccucuuucaggaggccgaagaguuccuguacagauuucuuccucagaagaucauuuaucugaaucagcuccugcaagaagacucccuuaacguggcggaucugaccucucuccgggcuccgcuggacauccccauuccugaucccccucccaaagacgaugagauggagacagacaagcaggagaaaaaggaagugcacaaguguggauuccugccuggcaaugaaaaaguccucagccugcuugcccuggugaagccggagguuuggacgcucaaagagaagugcauccuggugauuaccuggauccagcaucuuauccccaaaauugaagaugggaacgacuuuggagucgccauccaggagaaggugcuggaacgcguuaaugcugugaagacaaaagucgaggccuuccaaaccacaauuuccaaguacuuuucugaaagaggcgaugcuguggccaaagcgagcaaggagacccacgugauggacuaucgggcccucguccaugagcgcgaugaagcugccuacggggagcugagagcuaugguucuggaccuccgggccuucuaugcggaacuguaccacaucauuuccucuaaccuugagaaaaucgugaauccuaagggagaagagaaacccagcauguauuga

SEQ ID NO: 74376 - RNA, 798 nt, Artificial Sequence
  derived and/or modified sequence opt5 from PSME3__Homo_sapiens__NP_001253974
auggagaaguggauccugaaaaagauuaaauaccuccagagcggcgggcuguccgccucuuauuacagcuauaagguggacuccuucagagaacggaucaccucugaggcugaagaucuugucgccaacuuuuuccccaaaaagcugcucgagcuggacagcuuucuuaaggaaccuauucugaauauccacgaucucacacaaauucauuccgacaugaaccugccgguucccgauccuauccugcucacgaauagccacgacggacuggauggccccaccuacaaaaagcgcagacuugacgagugcgaggaagcguuccaggggacaaaaguguuugugaugccuaacggaaugcugaagucuaaucagcagcucgucgauaucauugagaaagugaagcccgaaauccggcugcuuauugagaaguguaacaccguuaaaaugugggugcaacugcucaucccucgcauugaggacggcaauaacuucggggucuccauccaggaagagacaguggcugaacugagaaccguugagagcgaagccgccucuuaucuggaucagauuucccgguacuauaucacacgcgcuaagcucgugagcaaaaucgccaaguacccgcaugucgaggacuacagacggaccgugacggagauugaugaaaaagaguauaucucucugcgccuuauuaucuccgaacugagaaaucaguacgugacccuccacgacaugauucugaagaacaucgagaaaaucaagcggccccgcagcucuaaugcugaaacacuuuauuga

SEQ ID NO: 74377 - RNA, 5532 nt, Artificial Sequence
  derived and/or modified sequence opt5 from PSME4__Homo_sapiens__NP_055429
auggagcccgccgaaagagcuggcgugggggagccuccggaacccggaggccggccugagcccgggccucgcggauucgucccccagaaggaaaucguuuacaacaaacugcucccuuaugccgagagacuggacgcggagagcgaucuucaacuggcucagauuaagugcaaucucggccgggccgugcagcugcaggaacuuuggccggggggacuguuuuggacccgcaaacucuccacauacaucagacuguauggccggaaguucucuaaagaggaccacgugcuguuuauuaagcuccuguacgaacuugucagcauccccaagcuggagauuuccaugaugcaaggcuucgcccgccuccugaucaaccuucugaaaaagaaagagcuccugucuagagcugaucuggaacucccuuggcggccccuguaugacaugguggagcgcauccuuuacagcaagacggaacaucuggggcucaauugguuuccuaacuccguugagaauauucugaaaacccuugugaagucuuguagacccuauuucccggccgaugcuacagccgaaaugcuggaggaguggcggccucucaugugccccuuugacgucaccaugcagaaggcgaucacauacuucgaaauuuuucugccuaccagccugccccccgagcuccaccauaaaggauucaagcugugguuugaugaacuuaucggccuguggguguccguucagaaccucccucagugggaggggcaacuggugaaucuuuucgcccgccuggcuacagacaacauuggauacaucgauugggacccguauguccccaaaauuuuuaccagaauccuccggagccugaaucugccugugggcucuucccaggugcucgucccccgcuuccugacgaacgccuacgauaucgggcacgcuguuauuuggaucaccgccaugaugggaggcccuagcaagcuugugcagaaacaucuggcgggccucuucaauucuauuacauccuuuuaucaccccagcaacaaugggagauggcugaacaagcugaugaaacuucuccagcggcugccgaauucuguggucagacgccugcaccgggaaagauacaagaagccuuccuggcucacccccgugccugacagccauaaacugacagaucaagacguuaccgacuucgugcaguguaucauucagcccguccuucuggccauguuuuccaagacgggaucucucgaggcugcccaagcucugcagaaccuggcccuuaugcgcccugagcucgugauccccccgguucuggaacggacauauccugcccuggagacccucacagaaccccaccagcugaccgcuacccuuagcugcgugaucggcgucgcgagaucccuggugagcgggggacgcugguuccccgagggcccuacacauaugcucccgcugcugaugcgggcccuucccggggucgauccuaacgacuuuucuaaauguaugauuacguuccaguuuaucgcuaccuucuccacacucgugccccugguugauugcagcucugugcugcaagaaagaaaugaccucaccgaggucgagcgcgaacuguguagcgccacagccgaguuugaagauuucgugcuucaguuuauggaccggugcuucggacugauugaguccucuacccucgagcagacgagagaagagacagaaaccgagaagaugacccaccuggaaagccugguugagcuuggccucuccagcacauuuucuaccauccugacacaguguuccaaagagauuuucaugguggcucugcaaaaggucuucaacuuuagcacgucucacaucuucgaaacccgcguggccggccggaugguggcggauaugugcagagcugccguuaaguguugcccugaggaaucccucaaacuguuugucccccauugcuguagcgugaucacacagcuuaccaugaaugacgaugugcugaacgacgaggaacucgauaaggagcugcuguggaaucuucagcugcucuccgagauuacacgggucgacgggcgcaaacugcuccuguacagagaacagcuugugaagauccugcaacggacccuccaccugacgugcaaacagggauauacccugucuuguaaccuucugcaucaccuccugagaagcacaacccucauuuacccuacagaguacugcuccguucccggcggguucgacaagccgccuucugaauauuuucccaucaaggauuggggaaaaccuggcgaccuguggaaucuugggauucaguggcaugugcccagcuccgaggaagucagcuucgccuuuuaccugcucgauucuuuccugcagccggagcuggugaagcuucaacacuguggcgacggaaaacuggagaugucccgcgaugacauccuccagagccugaccauuguucacaacugccucaucggcucugggaaucugcuuccuccccugaagggagaaccugugacgaaccugguccccuccauggugagccucgaggaaacaaaacuguauaccggccuugaguacgaucugucucgggagaaucauagagaaguuaucgcuacagugauucgcaagcuccugaaccacauccucgacaauagcgaggaugacaccaagucccuguuucuuauuaucaaaauuaucggggaucugcugcaguuccaaggaagccauaagcacgaauuugacucuagauggaaauccuucaaccucgucaagaaaagcauggagaaucggcugcacggcaagaaacagcauauccgcgcccuucugauugauagagugaugcuccagcacgaacugcggacccucacaguggaggggugugaguauaagaagauccaucaggacaugauucgcgaccugcuuagacuguccacgucuagcuacucccaaguccggaacaaagcucagcagaccuuuuucgccgcgcugggcgccuauaacuucugcugucgcgauaucauuccccucguucuggaauuucuuagaccugaccggcagggagugacacaacagcaguucaagggcgcucuguacugccuccuggggaaucacucuggagugugucucgccaaccugcaugauugggacugcaucguccagaccuggccggcuaucgugagcuccggccuuucucaagccaugagccuggagaaacccuccauuguucgccuguuugaugaccucgcggaaaagauccacagacaguacgagacaauugggcuggauuucaccaucccuaaaagcugcguggaaauugccgagcuucugcagcaaucuaagaaucccuccaucaaccagauccuccugagcccugagaagauuaaagaaggaaucaagcggcagcaggagaaaaaugcugacgcccugagaaacuaugaaaaucucgucgauacgcuucuggacggcguggagcaacgcaaccugcccuggaaguuugaacacauugggaucggccuccugucucuucugcuccgggaugacagaguucugccucugcgcgcuauucgguucuuuguggagaaucucaaccaugaugccaucgucgugagaaaaauggccauuuccgcuguugcgggaauccuuaagcagcugaagcgcacacacaaaaagcugaccaucaauccgugugagauuagcggcugccccaaaccuacccagaucauugccggggaccggcccgacaaccauuggcuccacuacgauucuaagacaaucccuagaaccaaaaaggaaugggaguccagcuguuucguggaaaagacacauuggggauauuacacguggcccaaaaauauggucguguaugcuggcguggaggagcagccgaagcuggggcgcucccgggaagacaugaccgaggccgaacaaauuaucuuugaucacuucagcgacccuaaauuugucgagcagcuuaucacauuccugucucucgaagauagaaagggaaaagacaaguucaacccccggcgcuuuugccuguucaaaggcauuuuuagaaauuucgaugacgccuuucugcccguucucaagccucaccuugagcaucugguggcugauagccacgaguccacccagcgguguguggccgaaaucauugcggggcugauccgcggcucuaagcauuggacauucgagaaagucgaaaagcucugggagcugcuuugcccccugcucagaaccgcucugagcaacauuacgguggaaaccuacaacgacuggggagccuguaucgccacauccugcgagucucgggauccuagaaaacugcacuggcucuuugagcuucugcuggaaagcccgcucuccggcgaggggggaucuuucguugacgcuugucgccuguaugugcuucagggcgggcuggcccaacaggaauggcggguccccgagcuccugcacagacugcucaaguaccuugaaccuaaacugacccagguguacaagaauguucgcgagcggaucggaagcgugcugacauauauuuuuaugaucgacgucucccuccccaacaccacaccuaccauuagcccccaugugccggaguucacggcgagaauccuggaaaagcuuaaaccucugauggaugucgacgaggaaauucagaaucacgugauggaggagaacggcaucggcgaagaggaugaacgcacacaagggauuaagcuccugaaaaccauccugaaguggcucauggcuucugccggacgguccuuuagcaccgccguuacagagcagcuucagcugcugccccucuucuuuaaaaucgcuccuguggaaaaugacaacucuuacgaugagcugaagagagacgccaagcuuugccugucccucaugagccaaggccugcuguauccccaucaggucccucucgugcuucagguucugaaacagaccgcucgcuccucuagcuggcacgccagauacacggugcugacauaucuccaaaccauggucuucuacaaucuguucauuuuucuuaacaaugaggaugcggugaaggacauccgguggcuggugauuucccuccuggaagaugagcagcuggaaguucgcgagauggccgcuacaacccucagcgggcuucugcaguguaacuuccugacaauggacucucccaugcagauccauuuugaacaacucugcaaaaccaagcugccgaaaaagagaaagcgggauccuggauccgucggcgacacgauucccagcgccgagcuugugaaacgccacgcuggggugcugggacucggcgccugcguccugucuagccccuaugaugugccuaccuggaugccgcagcugcucaugaaucuuuccgcccaccugaacgacccccagccuaucgagaugacaguuaagaaaacccugucuaauuucagacggacacaucacgacaacuggcaggaacauaagcaacaguuuaccgaugaccagcuccuggugcuuacggaucugcucgucagccccuguuacuacgcuuga

SEQ ID NO: 74378 - RNA, 816 nt, Artificial Sequence
  derived and/or modified sequence opt5 from PSMF1__Homo_sapiens__NP_848693
auggccggccuggagguccucuucgcuagcgccgcgcccgcuauuaccugcagacaggacgcccugguguguuuucuucacugggaaguugugacacauggguacuucggacugggcgugggggaucaaccuggaccgaacgacaagaaauccgagcuccugcccgccggcuggaauaacaauaaggaucuuuauguccugcgguacgaauauaaagacgggucucgcaagcuccuggugaaagcuaucacgguugagagcuccaugauccugaacgugcucgaauacggaucucagcaggucgccgaucugacccuuaaucuggacgauuauauugacgcugagcaccucggcgauuuucauagaacauacaagaacagcgaggaacugcggucccgcaucgugucuggcauuaucaccccuauccacgagcagugggaaaaggccaauguuagcagcccccauagagaguucccucccgcgacagcccgggagguggacccucuucgcauuccgccccaccacccucauaccuccagacaacccccuuggugcgauccccuggggccguuugucgugggaggcgaagaccucgauccuuucgggccccggcgcggaggcaugaucguggacccucugagaucuggguuuccccgggcucugauugaccccuccagcggacucccuaaccgccugccgcccggcgccgucccucccggcgcuagauucgauccuuuugggcccaucggaacaucuccgccuggccccaauccugaccaccuucccccucccggguaugaugacauguaccuguga

SEQ ID NO: 74379 - RNA, 867 nt, Artificial Sequence
  derived and/or modified sequence opt5 from PSMG1__Homo_sapiens__NP_003711
auggccgcuaccuucuuuggcgagguggucaaggcccccugcagagcggggacagaagacgaggaagaggaagaggagggacggcgcgaaacgccugaggauagagaaguucggcuucagcucgcucgcaaaagagaggugcggcugcuucgcagacaaaccaagacaagccuggaggugucccuccuggaaaaauacccguguucuaaguucaucauugccaucggcaacaaugccgucgcuuuucuuagcuccuucgugaugaacucugggguuugggaggaagugggaugcgccaaacuguggaaugaguggugucggaccacagacaccacacaccucagcuccaccgaggcuuuuugcgucuucuaucaucugaagucuaaccccagcguguuucugugucagugcuccuguuacguugccgaagaucagcaguaucaauggcucgagaagguguucggcagcugcccucgcaaaaauaugcagauuacgauccugaccuguagacacgucacagacuacaagaccucugaauccacagggagccuucccucuccuuuucugcgggcgcucaaaacccagaacuucaaggauuccgccugcuguccccugcuugagcagccuaauauugugcaugaccugccggcugccgugcucagcuauugccaagucuggaaaauccccgcuauccuguaccugugcuauacggauguuaugaagcucgaccugauuacaguggaagccuuuaagccuauccuuucuacccgcucccugaaaggacucgugaagaacauuccccagagcacagagauccugaaaaagcugaugaccaccaaugaaauucaguccaacaucuacacauga

SEQ ID NO: 74380 - RNA, 795 nt, Artificial Sequence
  derived and/or modified sequence opt5 from PSMG2__Homo_sapiens__NP_064617
auguucgugcccugcggcgagagcgccccugaccuggcuggguuuacccuccugaugccggccgucuccguuggaaacgugggccagcuugcgauggaucugaucauuucuacacucaauaugagcaagaucggguacuucuauacggacugucuggugcccauggucggaaacaauccuuacgcuaccacagaaggcaacuccaccgagcuuucuauuaaugccgaaguguauagccugcccuccagaaaacucguugcccugcaacugcggucuaucuuuauuaaguacaaaagcaagccuuucugcgagaaacuccuguccugggucaagagcucugggugugcucgcgugaucgugcuuuccagcucucacuccuaucagagaaacgaucugcagcuccggagcacacccuuucgcuaccugcuuaccccuucuaugcagaaguccguucaaaauaaaaucaagagccugaacugggaagagauggagaaauccagaugcauuccggaaaucgacgauucugaguucuguauucggauccccggaggcggcauuacaaagacccucuaugacgaaagcugcuccaaagagauccagauggccgugcugcugaaguuugucagcgagggggauaauauuccugacgcucucggacugguggaauaccuuaacgaguggcugcagauccucaagccccugucugaugacccuacgguguccgccagccgcuggaaaauccccucuagcuggagacuucuguucggcuccgggcucccgccugcgcuguuuuga

SEQ ID NO: 74381 - RNA, 369 nt, Artificial Sequence
  derived and/or modified sequence opt5 from PSMG3__Homo_sapiens__XP_011513881
auggaggacacaccccuggugaucagcaagcagaaaaccgaagucguuugcggcgugccuacgcaaguggucuguaccgccuucuccucucacauucucgugguugugacacaguuugggaagaugggaacccuggucagccuugagccguccucuguggcuagcgauguuuccaaacccgugcugacaaccaagguccuccugggccaggacgaaccucuuauccauguguucgccaaaaaccugguggcguuugucucucaggaggcugggaauagagccguucuccuggccguggcugugaaggauaagagcauggaaggacugaaagcccuccgggaggucauucgcgugugccaaguuugguga

SEQ ID NO: 74382 - RNA, 459 nt, Artificial Sequence
  derived and/or modified sequence opt5 from PSORS1C1__Homo_sapiens__NP_054787
augaccugcacagaccaaaagagccacucccagagagcccugggcacgcagacccccgcucuccaggggccucagcugcuuaacacagauccgucuagcgaggaaacccggcccccucaugugaaucccgaccgccugugucacauggagccugccaaccauuucuggcacgcgggagaucuccaagcuaugaucuccaaagaauuucaucuggccgccacacaggacgauugcagaaagggccggacccaggaggacauucuuguccccucuagccacccugaacuguucgcuuccguucucccgauggcccccgaggaggcugcccgccugcagcaaccucagccccugccucccccgucugggauccaccucagcgcguccagaacacuggccccuacccuucuguacagcucucccccuucccauagccccuuuggacucucuucccugauuuga

SEQ ID NO: 74383 - RNA, 411 nt, Artificial Sequence
  derived and/or modified sequence opt5 from PSORS1C2__Homo_sapiens__NP_054788
augauccugaacuggaagcuccugggcauucuugugcugugccuccacaccagagggaucagcggauccgagggccaccccucucaucccccggccgaagaccgggaggaagcugggagccccacacugccucagggacccccuguccccggcgauccuuggccgggggcgcccccucuuuucgaggaucccccucccacgcgcccguccagaccuuggcgggaccugcccgaaaccggaguuuggcucccugagccuccccgcacagaucccccgcaacccccuagacccgacgacccuuggcccgccggcccgcagccucccgagaauccuuggcccccugcucccgaaguggauaaccggccgcaggaggaaccugaccuggauccuccccgcgaggaguacagauga

SEQ ID NO: 74384 - RNA, 1572 nt, Artificial Sequence
  derived and/or modified sequence opt5 from PSPC1__Homo_sapiens__XP_006719907
augaugcugagaggcaaccucaaacaggugcggaucgagaagaaucccgcccgccugagagcucuugaaagcgccgucggggaguccgaaccugcggcugccgccgcuauggcccuggcucucgccggagagccggcgcccccugcccccgcuccucccgaagaccacccugaugaggagaugggcuucaccauugacaucaagucuuuucugaaaccgggggaaaagaccuacacgcaacggugccgccuuuucguuggaaaccugcccaccgauauuacagaggaagacuuuaaaagacucuucgagcgguauggcgagccuagcgaaguguuuaucaaucgcgauagaggguucggauuuauucggcuggagucccgcacccuggccgaaaucgcuaaggccgagcucgacggcacaauccugaagucuagaccccuucggauucgcuucgcgacccauggcgccgcucugacagugaaaaaccucagcccugucguguccaaugaacugcuugagcaggccuuuucucaguucgggcccguugagaaggcuguggucgugguugaugacagaggacgggccaccggcaaaggguuuguggaguucgccgcuaagccgccugcgcgcaaagcccuggagagauguggagauggcgcuuuucuccugacgaccacaccccggccugucaucguggaacccauggagcaguucgacgaugaagacgggcugcccgagaagcucaugcaaaagacccagcaguaccacaaagagagagaacagccuccgcgcuucgcccaacccggaacauuugaguucgaauaugccagccgguggaaggcucuggaugagauggaaaaacagcagagagaacagguggaccgcaacauucgggaggccaaggaaaaacuugaggcggaaauggaggcugccagacaugagcaccaacugaugcucaugcgccaggaccugaugcggagacaggaagaacuucgccggcuggaggagcucagaaaucaagaacugcagaagcgcaaacagauccagcugcggcaugaggaggaacacagacggcgcgaggaagagaugauuagacaccgggaacaagaggagcucagacgccagcaggaaggcuuuaagccuaacuacauggagaaucgggaacaggagaugagaaugggcgauauggggccccgcggagccaucaacaugggcgacgcuuucuccccugcccccgcugggaaucaaggaccgccucccaugaugggcaugaacaugaauaacagagccaccauuccugggcccccuaugggacccggcccggcgaugggcccugaaggggccgcuaauaugggaacgcccaugaugcccgauaacggcgccguccauaacgaccgguuuccucaggggccgcccagccagaugggaucuccuaugggcucccgcacagggagcgagacaccccaggcuccuaugucuggcguuggacccguguccggcgggccuggaggcuucgggagaggaagccaaggcgggaauuuugagggccccaacaagcggcgcagauauuga

SEQ ID NO: 74385 - RNA, 678 nt, Artificial Sequence
  derived and/or modified sequence opt5 from PSPH__Homo_sapiens__XP_011513763
auggugagccacuccgagcugagaaaacucuucuacucugccgacgcugucugcuuugauguugacagcaccgugauccgggaagagggcauugaugaacuggccaagaucugcgggguggaggacgcggucuccgaaaugacacgcagagcuaugggaggcgccgugcccuucaaggccgcucuuacggagcggcuggcccucauucagccuucucgcgagcaaguucagagacugaucgcugaacagccgccccaucuuaccccugggauucgggagcuggugagccgccuccaggaaagaaacguccaaguguuucugaucuccggaggcuuccggucuaucguugagcacguggccagcaaacugaauauucccgcgacaaacgucuuugccaaucgccucaaguucuauuuuaacggggaguacgcuggauucgaugaaacccagccuacagccgaguccggcggcaaagggaaggugaucaagcugcuuaaagaaaaguuucauuucaaaaagauuaucaugauuggagacggcgcuaccgauauggaggccugucccccugcggacgccuuuaucggguucggaggcaaugugauuagacagcaggucaaagauaacgcuaagugguauaucacagacuuuguugaacugcucggggagcuggaggaauga

SEQ ID NO: 74386 - RNA, 471 nt, Artificial Sequence
  derived and/or modified sequence opt5 from PSPN__Homo_sapiens__NP_004149
auggccgugggcaaguuccugcucgggagccugcuucugcucucccugcagcuuggacaaggcugggggcccgacgcuagaggagucccuguugccgauggcgaguuuucuagcgaacagguggcgaaagcugggggaaccuggcugggcacacaccggccgcucgcccgccugagacgggcccuguccggccccugccagcucuggucucugacgcuuagcguggcugagcuggggcucggauacgccuccgaagagaaggucaucuuccgcuauugugcuggcucuugcccuagaggggcccggacccagcauggacuggcgcuugcccgccugcaaggccaggggagagcucacggaggccccuguugccggccuacacgcuacaccgacguggccuuucucgaugacagacaucgguggcagcgccugccccagcugagcgcugccgcguguggcugcgggggauga

SEQ ID NO: 74387 - RNA, 1251 nt, Artificial Sequence
  derived and/or modified sequence opt5 from PSTPIP1__Homo_sapiens__NP_003969
augaugccccagcugcaauucaaggacgccuuuuggugcagagauuucaccgcucacacaggcuacgaggugcuccugcagcggcuucuggacgggcgcaaaauguguaaggauauggaagaacuccugagacagcgggcccaggcggaggagcgcuauggaaaagaacuuguccaaaucgcuagaaaggccggcgggcagacggagauuaacagccugcgggccuccuuugacucucucaaacagcagauggagaauguuggaagcucccauauccaacuggcucugacccuccgcgaggaacugagaucucuugaagaguuccgggagcgccagaaggaacagagaaagaaauacgaggccgugauggaucgggugcaaaagagcaaacugucccucuauaagaaagcuauggaaucuaagaagacauacgagcagaaaugccgcgacgccgaugacgcggaacaggccuuugagagaauuagcgcuaacggccaccagaagcaagucgagaaaucccagaauaaggcccggcaguguaaagauagcgcuaccgaagccgagcgcguguauagacagucuaucgcgcaacuggaaaagguucgggccgagugggaacaggagcauagaacaaccugcgaggcuuuccagcuucaggaauuugaccgccugacaauucuccggaacgcccugugggugcacuccaaucaacugagcaugcagugugucaaagaugacgagcucuacgaagaggugagacugacccuugaagggugcucuaucgaugcugacaucgacuccuucauucaggccaagagcacgggaaccgagccuccggcccccguuccuuaucagaacuacuacgaucgcgaggugacaccccugaccucuuccccuggcauccaacccagcuguggcaugauuaagcgguuuuccgggcuccugcauggaucuccuaaaacaaccagccuugcugcguccgccgcuagcacggaaacacugaccccgacacccgagagaaaugaaggcgucuauaccgccaucgccgugcaggagauucaggggaacccugcuucucccgcccaggaguaccgcgcgcucuaugacuacaccgcucaaaauccugaugaacuggaccuguccgccggagauauccucgaggugauucuggaaggcgaggacgggugguggacagucgaacggaacggacagagaggcuucguucccggcagcuaucuugagaagcuguga

SEQ ID NO: 74388 - RNA, 1005 nt, Artificial Sequence
  derived and/or modified sequence opt5 from PSTPIP2__Homo_sapiens__NP_077748
augaccagaagccuguucaagggcaacuuuugguccgccgacauccucucuacaauuggguacgauaauaucauucagcaccugaacaauggacggaaaaacugcaaggaguucgaagacuuucuuaaagagcgcgcugccaucgaagagagauauggcaaggaucugcucaaucugagccggaaaaagcccugugggcaauccgaaauuaacacgcuuaagcgcgcgcuggagguguucaaacagcaggucgacaauguugcucagugccauauccaacucgcccagucucugagagaggaagcccggaagauggaggaauuucgcgagaaacagaagcugcagcggaaaaagaccgagcucaucauggaugcuauucacaagcagaaaagccugcaauucaagaaaacaauggacgccaagaaaaacuacgaacagaaguguagagauaaagacgaggcugaacaggccgugucccgcucugcgaaucuugugaacccuaagcaacaggagaagcuguuugucaaacucgccaccagcaagacagcuguggaagauuccgacaaagccuauaugcugcauaucggaacccuugauaagguuagagaggaguggcagagcgaacacauuaaggcuugcgaggccuucgaagcgcaagagugugaacggaucaacuuuuuccgcaaugcccuguggcuccaugugaaucagcugucucagcagugcgucacauccgacgagauguacgagcaagugagaaaaagccuggaaauguguucuauucagcgggauaucgaguauuuuguuaaccagcgcaagaccggccagauuccgcccgcuccuaucauguacgaaaauuucuauuccagccagaaaaacgccgugcccgcugggaaggccacgggaccuaaccucgccagacggggcccccugccuaucccgaaaucuucccccgacgacccuaauuacagccuugucgaugacuacucccugcucuaucaauga

SEQ ID NO: 74389 - RNA, 1674 nt, Artificial Sequence
  derived and/or modified sequence opt5 from PTBP1__Homo_sapiens__NP_002810
auggacggcaucgugcccgauauugccgucgggaccaagagaggaagcgacgagcuguucuccacaugcguuacgaacggcccuuuuaucaugucuagcaauuccgcuucugccgcgaacgggaaugauagcaaaaaguucaaaggagacucccggucugcuggcgugccgagccgcgugauucacaucagaaagcuccccauugaugucaccgaaggggaggugaucucccugggacuuccuuuuggcaaaguuacaaaccugcucaugcugaagggcaagaaucaggccuucaucgaaaugaacaccgaggaagccgcuaauacaauggugaacuacuauaccagcgucacacccgugcuucgggggcaaccuauuuacauccaguuuucuaaucauaaagagcugaagaccgacuccagccccaaccaggcccgcgcucaggccgcgcuccaagccguuaauucugugcaguccggaaaccuggcucuggccgcuagcgccgcggccgucgaugcuggcauggccauggcugggcagucuccugugcucagaauuaucguggagaaucuguucuauccggucacgcuugacguucugcaccagaucuuuuccaaauucggaaccgugcucaagauuauuacauuuaccaaaaacaaucaauuccaggcccugcuucaguacgccgaucccgugagcgcucagcaugcgaagcugucccucgacggccaaaacaucuauaacgccuguugcacacugcggaucgauuuuucuaagcugaccagccucaaugucaaauacaacaaugacaagucccgcgauuauacgagaccugaccugcccagcggggacucucagccuucccuugaucagacaauggcugccgccuucggagcucccggcauuaucagcgccucuccguacgcgggcgcuggguuuccucccaccuucgccauuccucaagccgcuggacugagcgugcccaacguucacggcgcccucgcuccccuggccaucccuuccgcggccgcugccgcugccgcggccgggcggauugcuaucccgggacuugccggcgcuggaaauucugugcugcucgucagcaaccugaaucccgaacgcgugacaccucagucccuguucauccucuuugggguuuacggcgacgugcagagagucaaaauucuguucaacaagaaagagaaugcccuugugcagauggccgauggcaaccaagcucagcuggcgaugagccaucucaaugggcacaagcugcacggaaaacccauccggauuacccuuucuaagcaucagaacguccagcugccucgcgaaggccaagaggaccaggggcucaccaaggauuauggaaauagcccccugcacagauuuaaaaagccgggcuccaaaaacuuccagaauaucuuuccucccucugccacacugcaucucuccaacauuccucccagcguguccgaggaagaccugaagguucuuuucucuagcaacgggggcguggucaaaggauuuaaguucuuucagaaggaucggaaaauggcucugauccaaaugggcuccguggaggaagccguucaggcccucaucgaccugcacaaucacgaucugggggagaaccaucaccuucgcgugucuuucagcaaguccacgauuuga

SEQ ID NO: 74390 - RNA, 1614 nt, Artificial Sequence
  derived and/or modified sequence opt5 from PTBP2__Homo_sapiens__NP_001287914
auggacggcaucgugaccgaggucgccguuggggugaagagaggaagcgaugaacugcucuccggcucugugcugagcucccccaacucuaauaugagcuccauggucgugacagcuaacgggaaugacucuaaaaaguucaaaggagaggauaagauggacggcgccccuagccggguucuucacauucgcaaacugccgggggaagugacggagaccgaagucaucgcgcucggacugcccuuuggcaaggugacaaacauucuuaugcugaagggcaaaaaucaggcuuuccucgagcuggccaccgaggaagccgcuaucacaaugguuaacuacuauuccgccgugaccccucaucugagaaaucaacccauuuacauccaguauagcaaccacaaggagcucaaaacagauaauacccugaaccagcgggcucaggccguccuucaagcggugacggccgugcagaccgcuaauacaccucugucugggaccacagucuccgaaagcgccguuacccccgcucagucuccugugcuccgcaucauuaucgacaacauguacuauccggugacgcuggauguccuucaucagaucuuuuccaaguucggagccgugcugaaaauuauuacauuuaccaagaauaaccaauuccaggcgcuccugcaguacggcgaccccguuaaugcccagcaagcuaagcuggcccucgaugggcagaacaucuauaacgcuugcuguacacugagaauugacuuuagcaaacuugugaaucugaacgucaaguacaauaacgauaaaucucgggacuacacccgcccugaucuccccuccggagacggccagccugcccuggaccccgccaucgcugcggccuucgcuaaggagaccagccuucuggggcucccgguggccgccguuccuggagcucugucuccccuggccaucccuaaugcggcugccgccgcugccgcugccgcggccggcagagugggcaugcccggggucuccgcuggaggcaacacagugcuccuggucagcaaucuuaacgaggaaauggugacgccccaaucccuguuuacccucuucgggguuuauggagaugugcagcgggucaaaauucuguacaauaagaaagacagcgcccuuauccagauggcugauggcaaccagucucaacuggccaugaaucaccucaacgggcagaagauguauggaaagauuauccgcgugacacuguccaaacaucagaccguucagcugccuagagagggccucgacgaucaaggccugacaaaggacuuugggaauagcccgcuucaccgguucaaaaagcccggaucuaaaaacuuucagaauauuuucccucccagcgcgacccugcaccucuccaacaucccucccucuguggccgaagaggaucugcgcacgcuguucgcuaacacaggcgggaccgucaaggccuuuaaguucuuucagagagaccauaaaauggcucugcuccagauggccaccguggaagaggccauccaagcucugauugaucugcacaauuacaaccucggagagaaucaucaccuucgggugagcuucuccaagagcacaaucuga

SEQ ID NO: 74391 - RNA, 2103 nt, Artificial Sequence
  derived and/or modified sequence opt5 from PTCD1__Homo_sapiens__NP_056360
auggacuucgugagacuggcccggcucuuugcucgcgccagacccaugggccuguucauccuucagcaccuggauccuugccgggcgcgcugggcugggggaagagagggccucaugcggccgaugugggcccccuuuagcuccucuagcucccaacugccucuugggcaggaacgccaggagaacaccggaucucugggcagcgaccccucccauucuaauagcacagccacgcaggaagaggaugaagaggaggaagaguccuucgggacccucagcgacaaguacucuuccagacggcuguuucgcaaaagcgcugcccaauuccacaaccugagauuuggagaacggcgcgaugagcagauggagccugaacccaagcucuggagaggccggcgcaauacaccuuauugguacuuccugcaguguaaacaucuuauuaaggagggcaaacuggucgaagcucucgaccuguuugagagacagaugcuuaaggaggaacggcugcaaccgauggagucuaacuauaccguucucaucgggggaugcggcagagugggguaccugaagaaagccuucaaucuguauaaccagaugaagaaacgcgaucucgaacccuccgacgcgacauacaccgcccuguuuaaugugugugcugagagcccuuggaaggauucugcccuucaguccgcucugaaacuccggcagcaacugcaggccaagaacuucgaacuuaaucugaagacauaucacgcgcuccugaaaauggccgcuaagugcgccgaccugagaaugugucucgaugucuuuaaagagauuauccauaagggacacgugguuaccgaagagacguucagcuuccugcuuaugggcugcauucaggacaaaaagaccggguuucgcuacgcucugcaaguguggcggcucaugcugucccuuggacugcagcccucuagagauagcuacaaccuccugcuggucgccgcccgcgacuguggccucggcgacccucagguggcuuccgagcugcuucugaaaccccgggaagaggcgacaguucuccagccgccugugagcagacaacgcccccggagaaccgcccaggcuaaggccgggaaucugaugucugccaugcugcacgucgaagcucuugagcgccaacucuuccuggaaccuucccaggcccugggaccucccgagcccccggaggcgcgggugcccggcaaggcucagccugaaguggauacaaaagccgagcccagccauaccgccgcucucacggccgucgcucugaagccucccccgguugaacuugaggugaaccugcucacaccuggggccgugcccccuaccgucgugucuuuuggaacaguuaccacccccgcggacagacuggcccugaucggcgggcuugagggauuccucagcaaaauggcugaacaccggcagcagccugauauccgcacacugacgcugcucgccgagguggucgaauccggcucucccgcugagagccugcuucuggcccuccuggacgaacaucagguggaggcggaucugaccuuuuucaauacacuuguuagaaagaaauccaagcucggcgaccuggagggggccaaggcucugcucccggugcuggccaaacggggacuugucccuaaccugcaaaccuuuugcaaucucgcuauuggcugucacagacccaaggaugggcugcagcugcuuacagacaugaaaaagagccaggugacccccaacacgcacaucuauucugcccucauuaacgccgcuauccgcaaacugaauuacacauaucugauuuccauccucaaggauaugaagcagaaccgggucccugugaaugaaguugugauuagacaacuggaguucgcggcccaguacccgcccaccuuugaccgcuaucagggcaaaaacaccuaccuugaaaagaucgauggauucagagcuuauuacaaacaauggcugacagucaugccugccgaggaaacaccccauccuuggcagaaguuucggaccaaaccccagggggaccaggacacgggcaaggaggccgaugacggaugcgcucucggcgggcgcuga

SEQ ID NO: 74392 - RNA, 4344 nt, Artificial Sequence
  derived and/or modified sequence opt5 from PTCH1__Homo_sapiens__NP_000255
auggccagcgcuggcaacgccgcggagccccaggacagagggggaggcggguccggaugcaucggcgcuccugggcggccggccggaggcggccgcagacggcgcaccgggggacugagacgggccgcugcccccgaucgcgacuaccuccacagaccuucuuauugugaugcugccuucgcgcuggaacaaauuagcaagggcaaagccacagggcggaaggcuccccuuuggcugcgcgccaaauuucagagacuccuguucaaacuuggaugcuacauccagaagaauuguggcaaguuucugguggucgggcuccugauuuucggagcuuuugccguuggccugaaggcggccaaccucgagacgaauguggaagaacuguggguggaagucggcgggcgggugucccgcgagcuuaacuauaccagacagaaaaucggagaggaagcuauguucaauccucaacugaugauucagacacccaaggaggaaggcgccaacguucucaccacagaggcucugcuucagcaucuggacucugcccuccaggccagccgggugcacgucuacauguauaaucgccaauggaaacuggagcaucugugcuacaaguccggggaacucaucaccgagacaggauauauggaucagaucauugaauaccuguacccuugucuuaucauuaccccgcuggacugcuuuugggagggcgcuaaacuccagucugggacggcguaucugcuuggaaagcccccucugagauggaccaacuucgauccccucgaauuucuggaggagcugaagaaaaucaauuaccagguggacagcugggaagagaugcucaacaaggccgaaguuggccacggcuauauggaucggccuugucugaaucccgcugacccggauugcccugccacagcccccaacaaaaauuccaccaagccucuugacauggcucuggugcucaacgggggaugucauggccugagcagaaaauacaugcacuggcaagaggaacuuauugucgggggaacagugaagaauagcaccggcaaacugguguccgcccacgcgcuccagacgauguuccagcugaugacacccaagcaaauguaugagcauuuuaagggguacgaguaugucagccacaucaacuggaacgaagauaaagcugccgccauucuggaggcuuggcagcgcaccuacguugaaguggugcaucagucugucgcccaaaauuccacacagaaggugcucagcuucaccaccacaacgcuggacgacauccuuaaaucuuuuuccgauguuagcgugauccgggucgcuuccggcuaccugcucaugcuggccuaugcgugccugaccaugcuuagaugggacuguucuaagagccagggagccgugggccucgcugggguucugcugguggcccucuccgucgcugccggacugggccuuugcagccugauugggaucucuuucaacgcggccacaacccaggugcuccccuuccuggcucugggagucggcguggaugacguuuuucuucucgcccacgcuuucuccgagacagggcagaauaaacgcauuccuuuugaagaucggaccggcgagugccugaagagaacgggagccagcguggcccugacaucuaucagcaacgucaccgcuuucuuuauggcggcccucauuccgauccccgcucugcgcgccuucucccuucaagccgcugugguuguggucuuuaauuucgccauggugcugcucaucuuuccugcgauucugucuauggaccuguaccggagagaggaucgccggcuugacaucuucuguugcuuuaccagccccuguguguccagaguuauucaggucgaaccucaggcuuauacagauacccacgacaacacacgcuacucucccccgccucccuauucuucccauagcuucgcccacgagacgcagaucaccaugcaaucuacagugcagcuccggaccgaauacgauccucauacacacguguauuacaccacggccgagcccagauccgagauuagcguccagccugugaccguuacacaggacacccuguccugccaaucucccgaaagcacauccucuacccgggaccugcucagccaguuuuccgauagcucucugcauugucuugagccgccuugcacgaaguggacacuguccagcuucgcugaaaaacacuacgcccccuuccuccugaagcccaaagcgaagguggucgugaucuuucuguuccuuggccuccuggggguuucucuguauggaaccacacgcgugagagacggccucgaucugaccgacaucgucccucgggagaccagagaauacgauuuuauugcugcccaguucaaauauuuuuccuucuacaauauguauaucgugacacaaaaggccgacuacccgaacauucagcaccuucuguaugaucuccaucgcagcuuuucuaauguuaaguacgugaugcuggaggagaacaaacagcugcccaagauguggcuucacuacuuccgggacuggcugcaggggcuccaagaugcuuuugacagcgauugggaaacgggaaaaaucaugccuaauaacuauaagaauggcuccgacgaugggguccuggccuacaaacuccuggugcagaccggcagcagagacaagcccauugacaucucucagcuuacaaagcagcgccugguggaugcugacggaauuaucaacccuuccgccuucuauaucuaccucaccgcgugggucagcaaugaucccguugccuaugcugccucccaagcuaacauuagaccucaucggcccgagugggugcacgacaaagccgauuacaugccggaaacacgccugagaaucccugccgcugagcccauugaauaugcgcaguuuccuuucuaccugaacggccuucgggacaccucugauuuuguggaggccaucgagaagguccgcacgauuuguagcaauuacacaucccuggggcucucuagcuaucccaacggauacccguuccuguucugggaacaguauaucggccucagacacuggcugcuucuguuuaucuccgugguucucgcuugcaccuuccuggugugugccgucuuucugcuuaauccuuggaccgccgggauuaucgugaugguucuggcucucaugacaguggagcuguucggaaugaugggccucauugggaucaaacugucugccguccccgugguuauucuuaucgcgagcgugggcaucggagucgaauuuaccgugcauguggcucuggccuuccugacagccauuggcgacaagaaccggcgcgcuguccucgcccuggagcacauguuugcgccuguucuugauggggcuguguccacgcugcucggagugcugaugcucgccggcagcgaguucgacuuuaucgucagauacuucuuugccgugcuggcuauucuuaccauccuggggguucugaauggacucgugcugcuucccguccugcucucuuucuucggccccuauccugagguguccccggccaacggccugaaucggcuccccacaccuagccccgagccucccccuucuguugugcgcuuugcuaugccgcccgggcauacccacuccggaagcgauucuuccgacagcgaauacuccagccagacaaccgucucuggccugagcgaggaacuuagacauuaugaggcccaacagggggcgggaggcccugcccaccaggugauugucgaggcuacggaaaaccccguguucgcccacuccaccguugugcauccugagucucggcaccaucccccgagcaauccuagacaacagccccaccuggauuccgggucucugcccccuggacgccagggccagcaaccccggagagacccuccgcgcgaaggccucuggcccccucccuaccggccuagacgcgacgcuuuugagaucagcacagaagggcauuccggacccucuaaccgggccagauggggcccgcgcggggcccggagccacaauccuagaaaccccgcuuccaccgcgaugggaagcucugucccuggcuacugccagcccaucacaaccgugacagccuccgcuagcguuaccguggccguccacccucccccggugccugggcccggacggaauccccgcggcggccuguguccuggguauccggagacggaucauggacuuuucgaggacccccacgugccuuuucauguuagaugcgaacggcgcgauucuaaagucgaggugauugaacugcaggacguggagugcgaagagagaccccggggcuccagcuccaacuga

SEQ ID NO: 74393 - RNA, 2667 nt, Artificial Sequence
  derived and/or modified sequence opt5 from PTCHD1__Homo_sapiens__NP_775766
augcucagacaggugcuccaccggggccugagaaccugcuucagccgccuugggcauuuuaucgccucccaccccgucuucuuugcuucugccccuguucugauuagcauccuccugggagcguccuucucucgguaccaaguggaggaaagcguggagcaucuucuggcuccgcagcacucccucgccaagauugaacgcaaccuggucaauucucuguuucccgugaacagaagcaaacaucggcucuauuccgaccugcagacaccuggccgcuacgggagaguuaucgugacgagcuuccagaaggccaauaugcuugaucaacaccacaccgaccugauucucaaacugcaugcugccgucacaaagauccaggugccccggccuggauuuaacuauaccuucgcucacaucuguauucuuaauaacgauaaaacaugcaucguugacgauauugugcauguccuggaggaacucaagaaugcccgcgcgaccaacagaacaaauuuugccaucaccuaccccauuacgcaccugaaggacggccgggcuguguauaacgggcaccagcugggaggcgugaccguccauucuaaagaucgcguuaaguccgccgaggcuauccagcucacauacuaucugcaaagcauuaauucucuuaacgacaugguggccgagagaugggaauccagcuucugugauaccgugcggcuguuucagaaaucuaauuccaaggucaaaauguacccuuacacaagcuccucucuccgcgaggacuuccagaagaccagcagaguguccgaacgguaucugguuacgagccuuauccugguggucacaauggcgauccucugcuguucuaugcaggauugcgugagauccaagccguggcugggccugcucgggcugguuaccauuagccuugccacacugaccgcugccggaaucauuaaccucaccggcgggaaauacaauucuacauuucugggagugcccuucgucaugcuuggccacgggcuguauggaacguucgagaugcucagcuccuggcgcaagacccgggaggaccaacaugugaaagaaagaacagcugccgucuacgccgauucuaugcugagcuuuucccugaccacagcuauguaucucgugaccuucggcaucggcgcgagcccuuuuacgaacauugaggccgcucgcaucuucuguugcaacucuuguaucgccaucuuuuucaauuaccuguauguucuuuccuuuuacgggagcucucugguguucacaggauacauugaaaacaauuaucagcacuccaucuuuugccggaagguccccaaaccugaggcccuccaggaaaagcccgcuugguacagauuccugcugaccgcccgcuuuagcgaggacaccgcggagggcgaagaggcuaacacauaugaaucccaucuucucguguguuuccugaaacgguacuauugcgacuggauuaccaauacauacguuaagccguuugugguccuguucuaucucauuuacaucucuuucgcccugaugggguaccuucaagugagcgagggauccgaucugucuaacaucguggccacggcuacccagacaauugaauauaccacagcccagcagaaguacuuuagcaauuauuccccuguuaucggcuucuacauuuaugagagcaucgaguacuggaacaccucuguccaagaagacgugcucgaguauacgaaaggguuugugagaauuuccugguucgaaagcuaccugaauuaccugcgcaaacuuaacgucucuaccggacuccccaaaaagaauuuuacagauaugcugcggaacuccuuccugaaagcuccucaguuuagccacuuccaggaggacaucaucuuuucuaagaaguauaaugaugaaguggacguuguggccagcagaauguuccucgucgcgaaaaccauggagacaaaccgcgaggaacuguacgaucuucuggagacccuccggagacuguccgugacgagcaagguuaaauuuauuguguucaaucccucuuuugucuauauggaccgguacgccuccagccugggcgcuccccuucacaacuccugcaucucugcccucuuccugcuguucuuuagcgcuuuccucguggccgauucccugauuaacguuuggaucacacuuaccguggucucuguggaauuuggcgugauuggguucaugacacuguggaaggucgagcucgacuguaucagcguucugugccugauuuauggaaucaauuacaccaucgauaacugugcgccuaugcuuuccaccuuugugcucggcaaagacuucacacgcacgaagugggugaagaaugcccuggagguccaugggguggcuauucugcagucuuaucucugcuacaucguuggacugauuccgcuugccgcugugcccagcaaccugaccuguacacucuuuagaugccuguuccugaucgccuuugucaccuucuuucacuguuucgccauucuuccugugauccugacauuccugcccccuuccaaaaagaaacggaaggaaaagaagaaucccgagaacagagaagagaucgaaugcguugagaugguggacauugauagcacccgcgucguggaccaaaucacgacaguuuga

SEQ ID NO: 74394 - RNA, 2541 nt, Artificial Sequence
  derived and/or modified sequence opt5 from PTCHD4__Homo_sapiens__NP_001013754
augugcuuccugagacggcccggcgccccugcuagcuggaucugguggcgcaugcucagacaggugcugcggcgcgggcuucaauccuuuugucacagacugggacucugcgucucucggcauccgguuuucuuucugaccgugcccgccgugcuuacaauuacguucggccugagcgcgcucaaccgcuuucagccugagggggaccuggaaagacuggucgcucccucccacucucucgccaagaucgagcggagccuggccuccucucuuuucccucuggaucagagcaaaucccagcucuacagcgaccugcauacccccggacgcuauggcagagugauucuucugucuccuacaggggauaauauccuccugcaagcugaagggauucugcagacccaccgggccguucucgagaugaaggacggccgcaacuccuuuaucggccaucagcugggaggaguggucgaagugccgaauagcaaagaucagagaguuaagucugcucgggccauccaaauuacauacuaucuucagaccuacggcuccgcgacacaggaccugaucggggagaaaugggagaacgaguucuguaagcucauucgcaagcugcaggaagaacaccaagagcuucagcuguauagccucgccucuuuuucccuguggagagauuuccacaaaaccagcauccuggcucgguccaaggugcucgucucucuggugcuuauucugacgaccgccacacucagcuccagcaugaaagacugccugagaucuaagcccuuucuuggacugcucggcgugcugaccgucuguaucuccauuaucacagcugccgggaucuucuuuauuaccgauggaaaauacaauagcacgcugcucggcaucccuuucuucgcgaugggccaugggacaaagggaguuuuugagcugcuuucuggcuggcgccggaccaaggaaaaccugcccuucaaagacagaauugccgaugcuuauagcgacgugauggugacauacaccaugaccuccucucucuacuuuaucacauucgggaugggagccagcccuuuuacgaauauugaggcugucaagguguucugccagaacauguguguuuccauccugcugaauuauuuuuacaucuucagcuuuuucggcucuugccuuguguuugccgggcaacucgaacagaaccgcuaucacuccauuuucuguugcaaaauccccagcgccgaguaccuggaucggaagccggucugguuucagaccgugaugucugacggacaucagcaaacaucccaccacgaaaccaauccuuaucagcaucacuucauucagcauuuccugagagagcacuacaacgaguggaucacaaauauuuauguuaaacccuuuguggucauccucuaccugaucuacgcuagcuucuccuuuaugggcugucuucagauuucugacggcgcgaacaucauuaaucugcucgccagcgauuccccuucugugagcuaugcuaugguccaacagaaguacuucuccaacuauagccccgugaucggguuuuacguuuaugaaccccuggaguacuggaacucuuccgugcaggacgaucugcgccggcuuugcagcggauucaccgccgucucuuggguggaacaguauuaccaauuucucaaaguuuccaaugugagcgccaacaauaagucugacuucauuagcguccugcaguccagcuuucugaagaaaccugaguuccagcauuuuagaaacgauaucauuuucucuaaggcuggcgacgaauccaauaucaucgccagccgccucuaccugguggcgcggacguccagagauaaacagaaggagauuacagaggugcuugaaaaacugcgcccgcucucucugagcaaguccauccgguuuauuguuuucaaccccucuuucgucuuuauggaccacuauagccuguccgugaccgugccuguccuuaucgcuggguucggagugcuccugguucugauucucaccuuuuuccuggugauccacccccuuggcaauuuuuggcugauccucucugucacaagcauugagcugggggugcugggccuuaugacccucuggaacguugauauggacugcaucuccauucugugucugaucuacacacucaauuucgccauugaucauugcgccccucugcuuuuuacguucgugcuggcuaccgaacacacaagaacccaauguaucaagagcucucuccaggaccauggaacagccauccugcagaacgucaccuccuuucugauuggccuugugccccuccuguucguuccgagcaaucugacguuuacccucuucaaaugccugcuucugacagggggauguacccuccugcacugcuucgugauccugccugucuuucuuacauucuuucccccuucuaagaaacaccauaagaaaaagaagcgggcuaaacgcaaggagagagaagagauugaguguaucgaaauucaagagaaccccgaccacgugaccacgguguga

SEQ ID NO: 74395 - RNA, 771 nt, Artificial Sequence
  derived and/or modified sequence opt5 from PTCRA__Homo_sapiens__NP_001230098
auggccggcaccuggcugcuccugcuucuggcucucgggugccccgcccugccuaccggaccggugagcuuccccuccucuccugaggcggcuacgaccggccccaucugguuuagcgccgggaacggauccgcccuugacgcuuucacauacggcccuucucccgccaccgaugggacauggaccaaucuggcucaccucagccugccuuccgaggaacuggccucuugggaaccgcucgucugucauacaggacccggcgcggagggccacagcagauccacccagccuaugcaucugagcggggaagccucuacggcucggaccugcccccaagagccucuucgcggaacacccggcggggcccuguggcucggaguucugagacuucugcucuuuaagcugcugcucuuugaccugcuucugaccuguuccugccucugugauccggcuggcccucugcccagcccugccacaaccacgcggcuucgcgcgcuggggucucacagacuccaucccgccacagagaccggaggccgggaagcuacauccagcccccgcccucagccgagagaccggcgcuggggcgauacacccccugggagaaaacccggaucuccuguguggggcgagggguccuaucugagcuccuacccgaccugccccgcccaggcuugguguucucggagcgcccugcgcgccccuuccagcucucucggagcuuucuucgcgggcgaccugcccccuccccuucaggccggggcugccuga

SEQ ID NO: 74396 - RNA, 984 nt, Artificial Sequence
  derived and/or modified sequence opt5 from PTDSS1__Homo_sapiens__NP_001277154
auggaguacgccgugaacugccacgucaucaccugggaaagaauuaucagccauuucgacauuuuugcuuucggccacuuuugggggugggccaugaaggcgcugcucauccgguccuauggacuguguuggacaauuucuaucacgugggagcuuaccgaacuguucuuuaugcaucuccugcccaauuucgcugagugcuggugggaucagguuauccuugacauucugcucuguaacggcgggggaaucuggcugggcaugguggugugccgcuuucuggaaaugagaacauaccacugggccagcuucaaagauauucauaccacaaccgggaagaucaaacgggccguccuccaauuuaccccugcuuccuggacauaugugcgcugguucgacccgaagucuagcuuucagagaguugccggaguguaccuguucaugauuaucuggcagcuuacggagcugaauaccuuuuuccucaaacacauuuucgucuuucaggcuucccacccccugucuuggggccggauccuuuucaucggcgggauuacagccccuaccgugcgccaauauuacgcguaucugacagauacccaguguaagagaguuggaacgcagugcuggguguuuggcgucaucggguuccucgaggccauuguguguaucaaguuuggacaggaccuguucagcaaaacacaaauucuguacgugguccucuggcugcuuugcguugcuuuuaccacauuccugugucucuacggcaugaucugguaugccgaacauuacgggcaccgggagaagaccuauuccgaaugcgaggauggaaccuacagccccgagaucucuuggcaucaccgcaaaggcacaaagggcuccgaagacagcccucccaaacacgcugggaacaaugagucucauuccagcagacggcgcaacagacacucuaaguccaaggugacgaauggagugggcaaaaaguga

SEQ ID NO: 74397 - RNA, 1212 nt, Artificial Sequence
  derived and/or modified sequence opt5 from PTEN__Homo_sapiens__NP_000305
augaccgccaucauuaaggagaucgugagcagaaacaaacggcgcuaccaggaagacggcuucgaucuggaccucacauauauuuaccccaauaucauugcuaugggguuuccugccgagagacuggaaggagucuaucggaacaauaucgaugacguugugcgcuuccuugauuccaagcacaaaaaccauuacaagaucuauaaucugugcgcggagagacacuacgacacggcuaaauuuaacugucggguggcccaauauccguucgaagaucauaaucccccucagcucgagcugauuaagcccuuuugcgaggaccuugaucaguggcugucugaagacgauaaccacgucgccgcuauccauuguaaggccggcaaagggcgcaccggagugaugauuugcgcuuaccuccugcacagaggcaaguuccugaaagcccaggaggcgcucgacuuuuacggggaaguucggacacgcgauaagaaaggagugaccaucccuagccaaagacgguaugucuacuauuacuccuaucugcuuaagaaucaccuggacuaccgccccguggcccuccuguuccauaagaugauguuugagacaauuccuauguucucuggcggcaccuguaacccgcaguuuguugugugccagcuuaaagucaagaucuauagcuccaauucugggcccacaagacgggaggacaaauucauguacuuugaguucccucagccccugccuguguguggagauauuaagguggaguucuuucacaaacaaaacaagaugcucaaaaaggacaagauguuccauuuuugggucaauaccuucuuuauccccggcccggaagagacgagcgaaaaaguugagaacgggucccugugcgaucaggagaucgacagcauuuguucuaucgaacgcgcugauaaugacaaggaguaccuggugcucacccugaccaaaaacgaucuugacaaggccaacaaagauaaggcuaauagauauuucuccccuaacuuuaaggugaaacuguacuucacaaagacagucgaagaacccagcaauccugaagccucuuccagcaccucugugacgcccgacguuuccgauaacgagcccgaccacuaucgguacagcgacacaaccgauuccgacccugagaaugaaccguuugaugaggaccagcacacacagauuaccaaaguguga

SEQ ID NO: 74398 - RNA, 909 nt, Artificial Sequence
  derived and/or modified sequence opt5 from PTER__Homo_sapiens__NP_001248766
augagcucccugucuggcaaggugcagaccguccucgggcugguugagcccagcaaacuuggaagaacacugacgcacgaacaucucgccaugaccuucgacugcuguuacugcccuccgcccccuugucaagaggcuaucuccaaggaacccauugugaugaaaaaccuguauuggauccagaagaaugccuacucucacaaagagaaccuucagcugaaucaggaaacagaggcgauuaaggaggaacuccuguauuuuaaggcuaacggcgggggagcccugguggagaauaccacaaccggcaucagccgggauacacaaacccucaaacgccuggccgaagagacggggguccauauuaucuccggagcuggcuucuacguggacgccacccacucuagcgagacaagagcuauguccguugaacagcuuaccgaugugcugaugaacgagauccuccauggcgccgacgggacaagcauuaagugcggaaucauuggcgaaaucggguguucuuggccucugaccgaguccgaacggaaaguccuucaggcgacggcccacgcucaggcccaacugggaugccccgugauuauccacccuggccgcagcucuagagcuccguuucagauuauccggauccuccaggaggccggggcggauauuuccaagacaguuaugagccaucuggaccgcgugagacugcucgucgaggaaggaugugaggaucggauccugguggcccacgacauucauaccaaaacacgccuuaugaaguauggcggccacggguacucucacauccugaccaaugugguccccaagaugcuccugagaggaauuaccgaaaacguucuugauaaaauccugaucgagaauccuaagcaguggcucacauucaaauga

SEQ ID NO: 74399 - RNA, 987 nt, Artificial Sequence
  derived and/or modified sequence opt5 from PTF1A__Homo_sapiens__NP_835455
auggacgccgugcugcucgagcacuuccccggcgggcuggaugcuuuuccuagcuccuacuucgacgaagaugacuuuuucaccgaucagucuagcagagacccgcuugaggauggagacgaacugcucgccgaugagcaagcggaagucgaguuucugucccaucagcuucacgaguauugcuaccgggacggcgcuugucugcuccugcagcccgccccucccgccgcuccucuggcccucgcucccccuucuagcgggggacugggcgaaccggaugacgggggaggcggcggguauugcugugagacaggagcgcccccuggcggguuccccuacuccccuggaucucccccgagcugccuugccuauccuugugccggcgcugccguucugucccccggggcucgccucagaggacugagcggcgccgcggccgcugccgcucggcgcagacggcgcgugagaucugaagccgagcuucagcaacugcggcaggccgcuaacgugcgcgagagacggcgcaugcaguccaucaaugaugcguuugaaggccucagaagccauauuccuacgcugcccuacgagaagcggcugucuaaagucgacacccuccgccuggccaucggguauauuaacuuccuuuccgaacuggugcaggcugaccucccccugagaggaggcggggccggaggcugcgggggaccuggcggcgggggacggcuuggcggggauagcccgggaucucaagcccagaagguuaucauuugucacagaggcacacgcucccccagcccuuccgaccccgauuacgggcugccuccccucgcuggccauucucugagcuggaccgacgagaaacagcugaaggaacagaauaucauccggacagccaaaguguggaccccggaggauccuagaaagcucaacuccaagagcucuuuuaauaacauugagaaugaacccccuuucgaguuugucuccuga

SEQ ID NO: 74400 - RNA, 1188 nt, Artificial Sequence
  derived and/or modified sequence opt5 from PTGDR2__Homo_sapiens__NP_004769
augagcgccaacgcuacccugaagccccucugcccuauccuggagcagauguccagacuucaaucucacagcaauacauccauucgguacaucgaccaugccgcggugcugcuccacggccuggcuucucuucuggggcucgucgaaaacggaguuauucuguucguggugggcugucgcaugagacagacggucgugaccacauggguucugcaucucgcccugagcgaucuucuggccuccgcuucucucccguuuuucaccuauuuucuggccguggggcacagcugggagcuuggaacaaccuucugcaaacugcauuccagcaucuuuuuccucaauauguuugcuucuggcuuccugcuguccgccauuagccucgaccggugucugcaggucgugcgccccguuugggcgcagaaccacagaacaguggccgcugcccacaaggucugccuugugcugugggcucucgccgugcugaauaccgucccuuacuuuguuuuccgggauacgaucucucgccuugacgggagaaucauguguuauuacaacgugcugcuccugaaucccggaccugaucgggacgcgaccugcaacucccgccaaguggcccuggcugucagcaaauuucuccuggccuuccuugugccccuggcuauuaucgccucuucccaugccgcuguuagccucagacugcagcaccggggccgcagacggccuggccgcuuugugagacuugucgcggccgugguugcugccuucgcccuguguugggggccguaucauguguucucccuccuggaagcucgggcccacgcgaaucccggacugagaccucucgucuggcgcggccugcccuuugugacaucucuugcuuucuuuaacagcgucgccaauccugugcuguacguucugaccugccccgauaugcugcggaagcugagacgcucccuucggacagugcucgagagcguccugguggacgauucugaacucgggggagccggcuccagcagacgccggagaaccucuagcacggcucgcuccgccucuccgcucgcucuguguagccggccugaggagcccagagggccugcccgccuucugggauggcuccugggcuccugcgcggccagcccccagacaggcccccugaaccgggcucuuucuuccaccagcucuuga

SEQ ID NO: 74401 - RNA, 1080 nt, Artificial Sequence
  derived and/or modified sequence opt5 from PTGDR__Homo_sapiens__XP_005267948
augaaaagccccuucuacagaugccagaacaccacauccguggagaagggcaauucugccgucaugggagggguucuguuuagcacgggccuccuggggaaccuucuggcucucggacugcuugcccgguccggccuggggugguguucucgcagaccucuccggccgcugcccagcguguucuauaugcuggugugcggacucaccgucacagaccugcuuggcaagugucugcucuccccugugguucuggcggcuuacgcccaaaaucgcucucuuagagugcuggcccccgcucucgauaacagccugugccaggccuuugcuuucuuuauguccuucuuuggccugagcucuacccuccagcugcuugccauggcgcuggaauguuggcucucccuggggcacccuuucuuuuaucggcgccauaucacacuuagacugggagcccucgucgcucccgugguuagcgccuucucucuggcuuuuugcgcccugccuuucaugggcuuugggaaauucgugcaguacuguccgggaaccuggugcuucauucaaaugguccacgaggaaggcucccucagcgugcugggguauucugugcuuuacuccagccugauggcgcuccugguccuugccacaguucuguguaaucucggagcuaugcggaaccuguaugccaugcaucgcagacugcagcggcacccccgcuccugcaccagagacugugcugagccucgggccgauggccgcgaagccucuccccagccucucgaggagcuggaccaucuucugcuccuggcucugaugacggugcuuuuuaccaugugcagccuccccgugaucuacagagcguacuauggcgccuucaaggaugucaaagaaaagaaucggacauccgaggaagcugaggaccugagagcccugcgcuuucucagcgugauuucuaucguugauccguggauuuucaucaucuuucgguccccuguguucagaaucuuuuuccacaagauuuuuauucgcccccugcgguacagaagccgcugcucuaacagcaccaauauggaguccucucuuuga

SEQ ID NO: 74402 - RNA, 573 nt, Artificial Sequence
  derived and/or modified sequence opt5 from PTGDS__Homo_sapiens__NP_000945
auggccacccaccauacacuguggaugggccucgcucugcuuggggugcugggagaccuccaggccgcgcccgaggcucaagucagcguucagccuaacuuccagcaggauaaguuucugggcagaugguucuccgccgggcuugccucuaauagcuccuggcugcgggagaaaaaggcugcccucucuaugugcaaaagcgugguggcuccggccacggacggaggccugaaccugaccuccacauuucuccgcaagaaucaaugugaaaccagaacaaugcugcuucagcccgcggggucucugggaagcuacuccuaucggagcccucacuggggcucuaccuacuccgucagcgugguugaaacagauuaugaccaguacgcccuccuguauucucagggcuccaaagggcccggagaggauuuccgcauggcuacccuuuacagcagaacgcaaaccccucgggccgaacugaaggagaaguuuacagcuuucugcaaagcccagggcuuuaccgaggacacaaucguguuccucccccagaccgauaaguguaugacggaacaguga

SEQ ID NO: 74403 - RNA, 1209 nt, Artificial Sequence
  derived and/or modified sequence opt5 from PTGER1__Homo_sapiens__NP_000946
augagccccugcggcccucugaaccucucccuggccggggaggcuaccacaugugccgcgccgugggugcccaauacgucugcugucccucccagcggagccuccccugcccuucccaucuucucuaugacccugggcgcuguuagcaaccuccuggcccuugcucugcucgcccaggcggccgggagacugcggcgcagacgguccgcugccacauuucuccuguucguggcuucucugcuugccaccgaccuggcgggacacgugauuccuggcgcccucguccugcgccuuuacacagcugggagagccccggcuggaggcgccugccauuuucugggcggguguaugguguucuuuggacucugcccccugcugcucggcugugggauggccguugaacggugcgugggagucacccgcccucugcuucacgcugcgagagugagcguugcccgggcucgccuggcccucgccgcuguggccgcggucgcucuggccguggcccuucugccccucgcuagagugggccgguaugagcugcaauacccugggacaugguguuucaucggacuggggcccccgggcggcuggcgccaggcccuccuggcuggacuuuuugccucccugggccucgucgcgcugcuugccgcucugguuugcaauacccucagcgggcuggcccugcucagagcucgguggcgcagacggucuagacgcccucccccugccuccggacccgauagccggagacgcuggggcgcgcaugggccccggucugccuccgcuagcucugccuccagcauugcuuccgccucuacguucuuuggaggcagcagauccagcggcucugcccgccgggcuagagcgcacgacguggaaaugguggggcagcuggucggaaucauggugguuuccuguauuugcuggagcccuaugcuugugcuggucgcccucgcugugggcggguggucuagcaccucccugcagcgcccgcuguuccuugccguucggcucgccucuuggaaccaaauccuggaucccuggguguauauccugcucagacaggcuguccugcgccagcuucugcggcuccugccucccagagccggagcgaagggcgggccugcuggccugggacuuacacccagcgccugggaggccuccagccuccggucuucccgccauagcggccugucucacuuuuga

SEQ ID NO: 74404 - RNA, 1077 nt, Artificial Sequence
  derived and/or modified sequence opt5 from PTGER2__Homo_sapiens__NP_000947
augggcaacgccagcaaugacucccagucugaggauugcgaaaccagacaauggcugcccccuggggagagcccggcuaucuccucugugauguucagcgccggaguccucggcaaccugauugcgcuugcucugcucgcccggcgcuggagaggggacguuggauguuccgccggccggcgcucuagccugucccuuuuucacgugcuggugacagaacucgucuucacggaucugcuggggaccugccucaucagccccgugguucuggcuucuuacgccagaaaucagacacuuguggcucuggccccugagucccgggcguguaccuauuuugccuucgcuaugacauuuuucagccucgccaccaugcugaugcuuuuugcuauggcccuggaacgcuaccucucuauuggacaucccuauuucuaccagagacgggucucccgcagcggcggccuggcggugcugccuguuaucuaugccgugucucuccuguuuugcucccuuccccugcucgacuacgggcaguauguccaauacuguccuggaacauggugcuucauuagacacggccggaccgcuuaccugcagcuuuaugccacgcugcuccugcugcucaucgugagcgugcuggcuuguaacuuuuccgucauccuuaaucugauucgcaugcauagacggucucgcagaagccggugcgggccgucccucggaagcggcagagggggacccggcgcccgccggagaggcgagcgcguuucuauggccgaggaaaccgaucaccugauccuucuggcuauuaugacaaucaccuucgcgguguguucccucccuuuuacaauuuucgccuacaugaacgagaccagcucucggaaggaaaaaugggaccugcaggcucugagauuccucagcaucaauuccauuaucgaucccuggguguuugccauccugcgcccucccguccuucggcugaugagaucugugcucugcugucgcauuagccugcggacgcaggacgccacacaaaccuccugcagcacacagucugaugcuuccaagcaggccgaccuguga

SEQ ID NO: 74405 - RNA, 1257 nt, Artificial Sequence
  derived and/or modified sequence opt5 from PTGER3__Homo_sapiens__XP_011540111
augaaggagaccagaggcuacgggggagacgcccccuucugcacacggcugaaccacagcuauacgggcaugugggcuccugaacgcuccgccgaggcgagagggaaucucacccggccgcccggaucuggcgaagauugugggagcguguccgucgcuuuuccuaucacaaugcugcuuaccggauucguuggcaacgcccuggccaugcuccuggugucucgcagcuacagacggcgcgaguccaaaagaaagaaaucuuuucuucugugcauuggcuggcucgcucugacagaccugguggggcagcuccugaccacacccgucgugaucguuguguaucuuagcaagcaacggugggaacauauugauccuuccggacgccuguguaccuucuuuggccucacgaugaccgucuucgggcugagcucucuuuuuaucgccuccgcuauggccguggagagagcgcuggccauucgggcuccccacugguacgccagccauaugaaaacacgcgcuaccagagccguucuccugggaguguggcuggcgguccucgccuucgcucugcuuccugugcugggcguggggcaguauacaguccaguggccgggaaccuggugcuuuaucucuacgggccggggcgggaauggaacauccagcucucacaacuggggcaaucucuucuuugccuccgcuuucgccuuucuggggcuucuggcccucaccguuacauucagcuguaaccuggcuaccaucaaggcgcuggugucccgcugcagagccaaggcuaccgccucucagagcuccgcccaauggggacggauuacaacggagaccgcuauccagcucaugggcauuaugugugugcugagcgucugcuggucuccccuucugaucaugaugcucaaaaugauuuucaaucagacauccguggaacauuguaagacccacacagagaaacagaaggaaugcaacuuuuuccugaucgccguuagacuugcgagccugaaucaaauucucgacccuuggguguaccugcugcuccgcaaaauccugcuucggaaguuuugucagaugagaaagcgccggcugagagagcaggcuccccuccugccuaccucuacggucaucgaucccagccgcuucugcgcccagccguuucggugguuccuggaccuuuccuuuccugccaugucuagcucccacccccaacucccucugacacuggcuagcuucaaacuccugucuaaguga

SEQ ID NO: 74406 - RNA, 1467 nt, Artificial Sequence
  derived and/or modified sequence opt5 from PTGER4__Homo_sapiens__NP_000949
augagcacccccggcgugaacuccucugccagccuguccccugacagacucaauucuccggucacaauccccgcuguuauguucauuuuugggguggugggaaaccuggucgccaucgugguucuuugcaagagccggaaagagcagaaggaaacgaccuucuacacacugguguguggccucgcggucaccgaucugcuugggacacugcucguguccccuguuaccauugcuacauauaugaaaggacaauggcccggcgggcagccucugugcgaguacucuaccuuuauccuccuguucuuuagccuguccggacuuagcauuaucugugccaugucuguggaacgcuaucuggccaucaaucacgcuuacuucuauucccauuacgucgacaagagacucgccggccugacgcuuuuugcuguguaugccagcaacgugcuguucugcgcgcuccccaauaugggccuggggucuucccggcugcaguacccugauaccugguguuuuauugacuggacaaccaacgucacagcccacgcugccuacagcuauauguacgcuggauucucuuccuuucucauccuggccaccguucuuugcaaugugcugguguguggcgcgcuccugcgcaugcauagacaguucaugcggcgcacgagccuugggacagagcaacaccaugccgcugccgcugccuccgucgccucuagaggacacccggcugcgagccccgcccugccucggcucuccgauuuucgcagacggcgcagcuucagacggauugcuggcgccgaaauccagauggugauucugcugaucgccaccucucucguugugcugauuugcuccaucccccuugucgugcgcguuuucgugaaccagcuguaucagccuagccucgagagagaggucucuaaaaaucccgaccugcaagcuauccggauugccagcgugaacccgauccuugauccuuggauuuacauccugcucagaaagacaguccuguccaaggcgauugagaaaaucaagugucuguuuugccgcaucgggggaucucggagagaacgcagcggccagcacuguuccgacagccagcggaccucuuccgcuaugagcggccauucuagauccuucauuagccgcgaacucaaagagaucuccucuaccagccagacacugcuucccgaucugucccucccugaccugucugagaaugggcugggaggccggaaccuucuccccggggugcccggaaugggccuggcccaagaagauacgaccagccugagaacacuccgcauuuccgagaccagcgacucuucccaggggcaggauagcgaaucuguucugcuuguggacgaggccggaggcuccggccgggcugggccugccccgaagggaagcucucugcaagucacauuucccagcgaaacccucaaucuguccgagaaaugcaucuga

SEQ ID NO: 74407 - RNA, 1134 nt, Artificial Sequence
  derived and/or modified sequence opt5 from PTGES2__Homo_sapiens__NP_079348
auggaccccgccgcuagagugguccgggcccuguggccuggcgggugcgcgcucgcuuggcgccugggaggcagaccgcagccccuucugccuacccaaagccgggccggguucgccggagcugccggcgggcccuccccuguugcugccgcgcgcaagggaucucccagacuccugggcgccgcugcccuugcucugggcggggcccucggacuguaccacacagcgcgguggcaucugcgcgcccaggaucuccacgcugagagaagcgccgcucagcugucccuuucuagccggcugcagcucacgcuguaucaauacaaaaccuguccuuuuugcuccaaggugcgcgccuuccuugacuuucaugcccugccguaucagguggucgaagugaaccccguuagacgggcugagaucaaauucucuagcuaccgcaaggugccuauucucgucgcgcaggaaggcgaguccagccagcaacugaaugauucuuccgugaucauuagcgcccugaaaacauaucucguuucugggcagccccuggaagagaucauuaccuacuauccugcuaugaaggccgugaacgagcagggaaaggaagucacagaguuuggcaauaaauacuggcuuaugcugaacgaaaaggaggcccagcaaguguacgggggaaaagaggcuagaaccgaagagaugaaguggcggcagugggccgacgauuggcucgugcaccugaucucccccaaugucuaucgcacaccgaccgaagcgcuugcuagcuucgacuacaucguuagagagggcaaauuuggcgccguggaaggggccguggcuaaguauaugggagccgcugccauguaccugauuucuaagcggcucaaauccagacaucgccugcaggauaacguccgggaggaccuguaugaggcggccgauaaguggguggcugccguuggcaaagacagaccuuucaugggagggcaaaagcccaaucucgcugaucuggccguguacggcguccuucgcgugauggaagggcuggacgcguuugaugaccucaugcagcacacgcacauccagccuugguaucugcggguugagagagccauuaccgaagcuagccccgcccauuga

SEQ ID NO: 74408 - RNA, 483 nt, Artificial Sequence
  derived and/or modified sequence opt5 from PTGES3__Homo_sapiens__NP_006592
augcagcccgccagcgcuaagugguacgacagacgggauuauguguucaucgaguuuugcgucgaagacuccaaagauguuaacgugaauuucgagaagucuaaacugaccuuuagcugucucggcggguccgacaacuucaagcaccugaaugaaauugaucuuuuucauugcaucgacccuaacgauucuaaacacaagcgcacagacagaagcauucuguguugccuccggaagggagaguccggccaaucuuggccgcgccugacgaaagaaagagccaaacuuaauuggcugagcguggauuucaacaauuggaaggacugggaggaugacuccgaugaggacaugagcaacuuugaccgguucucugaaaugaugaauaacaugggaggggaugaggacgucgaucuccccgaaguggacggcgcggaugacgauucccaggacagcgaugacgagaagaugccugaucuggaguga

SEQ ID NO: 74409 - RNA, 459 nt, Artificial Sequence
  derived and/or modified sequence opt5 from PTGES__Homo_sapiens__NP_004869
augcccgcccacagccuggugauguccucuccugcucucccggccuuccugcuuugcagcacccugcucgucaucaagauguacguuguggcgauuaucacaggccaggugagacugcggaaaaaggcuuuugccaaccccgaggacgcccuucgccaugggggaccucaauauuguagauccgaucccgacgucgaacggugccugcgcgcucacagaaaugauauggagacgauuuacccuuuccucuuucugggcuucguguauucuuuucuggggcccaacccuuucguugccuggaugcauuuucucguguuccuggucggacggguggcucacaccguugccuaccuuggcaaacugcgcgcgccgaucagaagcgugacauauacccucgcccagcugcccugugcuuccauggcccuucagauucugugggaagcugcccggcaucucuga

SEQ ID NO: 74410 - RNA, 1161 nt, Artificial Sequence
  derived and/or modified sequence opt5 from PTGIR__Homo_sapiens__NP_000951
auggccgacagcugcagaaaccugaccuacgugcggggcuccgucgggcccgcuacaucuacgcucauguucguugccggaguggugggcaaugggcuggcgcuuggaauccugagcgcucgcagaccugcccggccguccgccuuugcuguccucgugaccggccuggccgcuacagaucuucuggggaccucuuuccucagccccgccguuuuuguggcguaugcccgcaacuccucucugcugggacucgcuagaggcggcccugcccugugugacgcuuucgccuuugcgaugacauucuuugggcuugccagcaugcugauucucuucgcuauggccgucgagcggugccuggcucuuucccaccccuaccuguaugcccagcucgauggaccucgcugugccagacuggcucugcccgcgaucuacgccuuuugcguucucuucugugcucugccucuucugggccucgggcaacaucagcaguauugcccgggaagcugguguuuucugcggaugcgcugggcccagcccggcggggccgcuuucucucuugccuacgcgggacugguggcucuccugguggccgccauuuuucugugcaauggcuccgucacccucagccuguguagaauguaucggcaacagaagcgccaccagggcucucuugggccuagaccccggacaggagaagacgagguggaucaucugauccuccuggcucuuaugaccguggucauggccguuugcucccugccucucacgauucgcuguuucacccaggcuguggcccccgacucuagcuccgaaaugggcgaucugcuggcguucagauuuuacgccuucaacccgauccucgacccuuggguguuuauccuguuccggaaagcugucuuucaaagacuuaagcugugggugugcugccucugucuggggcccgcccacggagauagccagacaccucugucccagcuugcuucuggccgccgggaccccagagcccccagcgcgccuguugggaaagagggauccugcgugccgcucagcgccuggggcgaaggccaggucgagccccugccucccacccaacagucuuccgggagcgcugugggaacaucuagcaaggccgaggcuuccguugccuguucucugugcuga

SEQ ID NO: 74411 - RNA, 1503 nt, Artificial Sequence
  derived and/or modified sequence opt5 from PTGIS__Homo_sapiens__NP_000952
auggccugggcugcccugcucggccugcuugcggcucugcuccugcuucugcuccugagcagacggcgcaccagacggcccggggagccuccgcuggaccucggauccauccccuggcugggcuacgcccuugauuucgggaaggacgccgcuucuuuucugacacgcaugaaagaaaagcacggagauauuuucacgauccucgugggcgggagauaugucaccguucugcuugacccucauagcuacgaugccguggugugggagccccggacacgccuggacuuucacgcuuaugccauuuuccucauggaaagaaucuuugauguccagcugccucauuacucccccucugacgagaaagcgcggaugaagcugacccuccugcaccgcgaacuucaagcccugacagaggcuauguauaccaaccuccaugccgugcugcuuggagaugcuacagaggccggcagcggcuggcacgaaauggggcugcucgacuucuccuacucuuuucugcugagagcgggauaucucacccuguacggcauugaggcccuuccucggacgcacgaaagccaggcucaggaucgcguucauuccgccgacguguuccacaccuuuagacagcuggaucggcuccugccgaaacuugcucgcgggagccugucugucggagacaaggaccauaugugcuccguuaagagcagacucuggaaacugcugucucccgcccggcucgccagacgcgcucaccgguccaaguggcuggagagcuaccuucugcaccucgaggaaaugggcgugucugaggaaaugcaagcgagagcccuggugcugcagcuuugggcuacacaggggaauaugggaccugccgccuucuggcuccugcuguuucuccugaaaaaccccgaggcucuugccgcgguccgcggcgaacuggaguccauccucuggcaggcugagcaaccugugagccagaccacaacccugccccagaaggugcuggauuccacgccgguccuugacucuguucucagcgaaucccugcggcugacagccgccccuuucaucaccagagaggugguggucgaucucgcuaugcccauggccgacggccgcgaauuuaaucugcggagaggggaucgccuucuccuguucccuuuccugagcccccagcgggaccccgagauuuauacagauccugaaguguuuaaauacaacagauuccugaauccggacggaucugagaagaaggauuuuuauaaagacggcaagcgccuuaaaaacuacaauaugcccuggggagcugggcauaaccacugucucggccgguccuaugccguuaauagcaucaagcaauucguguuucugguccuggugcaucucgaucuggagcuuauuaacgcggacguugaaaucccugaguucgaccugucuagauacggguuuggacucaugcagcccgaacacgaugugccuguccgguaucgcauuagacccuga

SEQ ID NO: 74412 - RNA, 906 nt, Artificial Sequence
  derived and/or modified sequence opt5 from PTGR1__Homo_sapiens__NP_001139581
auggugagaaccaagacauggacgcugaaaaagcacuucgucggcuaccccaccaacagcgacuuugagcucaaaacagccgaacugccuccgcuuaagaauggggagguucugcucgaagcucuguuccuuaccguggaucccuauaugcggguggccgcgaaacgccugaaggagggagacacaaugaugggccagcaagucgcuaaggugguugaauccaaaaacguggcccucccuaaggggaccaucguccuggccucucccggauggacaacccauagcauuuccgauggcaaagaccuggagaagcuccugacggaguggccugauaccaucccccuuucucuggcucucgggacagugggaaugccuggccugaccgccuacuuuggccuucuggaaauuugcgggguuaaaggaggcgagacagugauggucaaugcugccgcgggggccgugggaagcguggucggccagaucgcuaagcucaagggguguaaaguugugggagccgugggcuccgacgaaaaggucgcuuaucugcagaaacugggcuucgaugugguuuuuaacuacaagaccguggagucucucgaggaaacgcugaaaaaggccagcccggacggguaugauugcuacuucgacaaugucggaggcgaguuuuccaacacagugauugggcagaugaaaaaguucggaagaaucgcgaucuguggcgccauuagcaccuauaaucggacagggccccuuccucccggaccucccccggaaaucguuauuuaccaagagcugcgcauggaggcuuuuguggucuacagauggcagggcgaugcccggcagaaggcucucaaagaccugcuuaagugggugcuggaaaucaaacgcgagaacgaagaggauuga

SEQ ID NO: 74413 - RNA, 1800 nt, Artificial Sequence
  derived and/or modified sequence opt5 from PTGS1__Homo_sapiens__NP_000953
augagcagaucccugcuccugugguuccuucuguuucuccugcuucugcccccucucccggugcugcuggccgaccccggcgcuccuacccccgucaacccuugcuguuacuaucccugccagcaccaagggaucuguguucgguucggacucgaucgcuaccagugcgacuguacaagaacgggcuauucugggccuaauugcaccauuccgggacuguggacauggcuucggaacagccugcgccccuccccuucuuuuacccauuuccuccugacacacggcagaugguuuugggaguucgugaaugccaccuuuauccgggaaaugcuuaugcgccuggugcucacagucagaagcaaccugauucccuccccucccaccuacaauucugcgcaugauuauaucagcugggaguccuucagcaacgugucuuacuauacgcggauucugccguccguuccuaaggacugucccaccccuauggggacaaaaggaaagaaacagcuccccgaugcucagcugcuugcccgcagauuucugcuccggcgcaaguucauccccgacccucaaggcaccaaucugauguuugccuucuuugcucagcacuucacacaucaguucuuuaaaaccagcggcaagauggggccgggauucacgaaggcccuuggccacgggguggaucugggacacaucuacggcgacaaccucgaaagacaguaccaacugcggcuguuuaaagaugggaagcucaaauaucagguccuggacggagagauguaucccccuucuguggaagaggcucccguucuuaugcauuacccucgcggcauucccccgcagucccagauggccgugggccaagaggucuucgggcugcucccuggacugaugcuuuacgcgacacuguggcucagagaacacaaucgggugugcgaucugcugaaggccgagcaucccaccuggggcgacgaacagcucuuucagacaaccagacugauccuuauuggggagaccaucaaaauugugaucgaggaauauguccaacagcugagcggauacuuccuccagcugaaguuugauccugagcugcuuuucggcguucaguuucaauaucgcaaccggauugcuauggaguucaaucaccucuaccacuggcauccccugaugccugacucuuuuaagguggggucccaggaauacagcuaugaacaguuccuguuuaacacauccaugcucguggacuacggagucgaggcccugguggaugcuuucucuagacagaucgccggccgcaucggcgggggacggaauauggaccaccauauucuucacguugcgguggaugucaucagagagagccgcgaaaugcggcugcaacccuucaacgaguauagaaaacgcuuuggcaugaagccguacacguccuuccaggaacucgugggggagaaagaaauggccgcugagcuggaggaacuguauggagacauugaugcccuugaguuuuacccuggccuccugcuggaaaagugucaucccaauagcaucuucggggagucuaugauugaaaucggcgcucccuuuucccucaaaggacugcuuggcaacccuaucugcagcccggaguauuggaagcccucuaccuucgggggagagguuggcuuuaacauugugaaaacagccacccugaagaagcucgucugucugaauacaaaaaccugcccuuacgugagcuuccggguccccgacgccucccaggaugacgggccugcuguggaaagacccucuacggagcuguga

SEQ ID NO: 74414 - RNA, 1815 nt, Artificial Sequence
  derived and/or modified sequence opt5 from PTGS2__Homo_sapiens__NP_000954
augcuggccagagcucuccugcuuugcgccgugcuggcgcucagccacaccgcuaaccccuguugcucccauccuugucagaaucggggcgucugcaugucuguuggguucgaccaauacaagugugauugcacacgcacgggauuuuauggcgagaacuguagcaccccggaguuccugacaagaaucaaacuuuuucugaagcccaccccuaauacagugcacuacauucucacccauuucaaaggguuuuggaacguggucaauaacauccccuuccugcggaaugccauuauguccuaugugcugacaucucgcagccaccucaucgacuccccucccaccuacaacgccgauuauggauacaagucuugggaggcuuuuagcaaucuguccuauuacacgagagcccuuccuccgguucccgacgauugcccuacaccccugggcgugaaagggaagaagcagcucccugacagcaacgaaauugucgagaaacugcuucugcggcgcaaguucauccccgauccgcagggaucuaauaugauguuugcuuucuuugcccagcauuucacccaccaauuuuucaaaaccgaccacaagagaggcccugcguucacaaacggccucgggcauggaguggaucugaaucacaucuacggcgaaacccuggcccggcagcgcaaacucagacuguuuaaggacgggaagaugaaauaucagauuaucgauggagagauguaucccccuacgguuaaggacacacaggcugagaugauuuacccuccccaagugcccgaacaucuucgguucgccgucggccaggagguguuugggcuggugccgggacucaugauguacgcuaccaucuggcugcgcgaacacaacagagucugugauguucuuaaacaggagcaccccgaguggggcgacgaacagcuguuccaaacaucccggcucauucugaucggcgagaccauuaagaucgugaucgaagacuaugugcagcaucugagcggguaccacuuuaaacucaaguucgauccugagcugcuuuuuaauaaacaguuccaauaucagaaccgcauugccgcggaauuuaacacccuguaccauuggcacccccuccugccugacacauuccagauccaugaucagaaguacaauuaucaacaguuuauuuacaacaauucuauccuucuggagcacggaauuacgcaguucgucgaguccuuuaccagacagaucgccggccggguggcugggggaagaaacguucccccggccgugcaaaaggucagccaggcuucuaucgaccagucccgccagaugaaauaucagagcuucaaugaauaccggaagagauucaugcucaaaccuuaugaguccuuugaagaacugacaggcgaaaaggagaugucugccgagcuggaagcccucuacggggauauugacgcuguggagcuguaucccgcgcuucugguugaaaaaccucgccccgaugccaucuucggagagaccaugguggaagucggcgcuccuuuuagccucaagggccugauggggaacgugauuugcucccccgccuacuggaagccgagcacauucggaggcgaggucggguuucaaaucauuaauaccgccucuauccagucccugaucuguaacaaugugaaaggaugcccuuucacgagcuuuucuguucccgaccccgagcuuauuaagacagugaccaucaacgcuagcuccucucggagcggccucgaugacauuaauccuaccguccugcugaaagaaagauccacagagcucuga

SEQ ID NO: 74415 - RNA, 1782 nt, Artificial Sequence
  derived and/or modified sequence opt5 from PTH1R__Homo_sapiens__NP_000307
augggcaccgcucgcaucgcucccgggcuggcccuccugcuuugcuguccugugcugagcuccgcguacgcucucgucgacgccgaugacguuaugacaaaggaggaacagauuuuccugcuucaccgggcccaagcucagugcgagaaacgccugaaggaagugcuccagagaccggccucuaucauggagagcgauaaaggauggacguccgcuucuaccagcggcaagccccggaaagacaaggccuccgggaagcuguauccugaaucugaggaggauaaagaagcgcccacaggaagccgcuacagaggccggccuugucugcccgagugggaccauauucucugcuggccucugggggccccgggagaaguggucgcugugcccuguccugauuauaucuacgacuuuaaccacaagggccaugccuaucgcagaugcgaucggaauggcuccugggagcuuguucccgggcacaaccgcaccugggcuaauuacagcgagugugugaaauuccugacaaacgaaaccagagagcgggaagucuuugaccgccucggaaugauuuauacagugggcuacucuguuucccuggccagccuuaccguggcgguccugauccucgccuacuucagacggcugcauugcacgcgcaauuauauccacaugcaccuguuucucucuuucaugcugagagcuguguccauuuuugugaaggaugccguccuuuacagcggggcuacccuggacgaggccgaacggcucacagaggaggaacugagagccaucgcucaggcgccucccccgccugccaccgcugccgccggauaugcuggcugucgcguugccgugacauucuuucuuuacuuccuggcgaccaacuauuacuggauucucguggaggggcuguaucugcauucucucaucuuuauggcuuucuuuuccgagaaaaaguaccuguggggauucacggucuucggcuggggccuucccgccguguuuguugccgugugggucagcgugcgggcuacacuggccaauaccgggugcugggaucucuccucuggaaacaagaaauggauuauccaaguuccuauucuggcuagcaucgugcuuaauuucauccuguuuauuaacaucgucagagugcucgccacaaagcugcgcgaaaccaaugcgggccggugugacaccagacagcaguaccgcaaacugcucaaguccacacugguccuuaugccccuguucggggugcacuauauuguuuuuauggccacgcccuacaccgaagugagcggaacacucuggcagguccaaaugcauuaugagaugcuguucaacucuuuucagggcuucuuuguggcuaucauuuacugcuucugcaauggggagguucaggccgaaaucaaaaaguccuggagccgguggacccuggcucuugacuuuaaaagaaaggcccgcucuggaagcuccucuuauagcuacggcccuauggugucccacacaagcgucaccaacgugggcccgcggguggggcucggacugccccugucuccuagacuccugcccacggcgacaaccaauggccacccucagcuucccgggcaugccaagccgggaaccccugcucuggagacacucgaaaccacacccccugccauggcugcccccaaagaugacggcuuccugaacggguccuguagcggccuggaugaggaagccucuggaccugagagacccccggcccuucuccaagaggaaugggagacgguuauguga

SEQ ID NO: 74416 - RNA, 303 nt, Artificial Sequence
  derived and/or modified sequence opt5 from PTH2__Homo_sapiens__NP_848544
auggagaccagacaggugagccggucuccccgcgucagacugcuccugcuucugcuccugcuucugguugugccuuggggcgugcggacagccuccggggucgcucucccgcccgugggaguucugagccugcgcccucccggcagagccugggcggacccugcuacgccccggccucgcagaucccucgcccuggccgaugacgcugccuuccgggaacgcgcuagacuucuggccgcgcucgagcggcgccacuggcugaacucuuacaugcauaagcugcuugugcucgaugccccguga

SEQ ID NO: 74417 - RNA, 1653 nt, Artificial Sequence
  derived and/or modified sequence opt5 from PTH2R__Homo_sapiens__NP_005039
auggccggccugggggcuagccuccacguguggggauggcugaugcuuggcuccugccugcucgccagagcgcagcuggacucugaugggaccaucacaauugaggaacaaaucguccuuguucugaaggcuaaagugcagugugagcucaacauuacggcccagcugcaggaaggagagggcaauugcuuccccgaaugggacgggcugaucuguuggccucggggaaccgugggcaagauuagcgccgucccgugucccccuuacaucuaugauuuuaaccauaaaggcguggcuuuccgccacugcaaucccaacgggacaugggacuuuaugcauucccucaauaagaccugggccaacuacucugauugccugagauuccuucaaccugacaucagcauuggaaaacaggaguuuuucgagcggcuguauguuauguacacagugggcuauuccaucucuuuugggagccucgcugucgccauucugaucauuggauacuuccgcagacuucacuguacccggaauuauauccauaugcaccuguuuguguccuucaugcuccgcgcgacaagcauuuuuguuaaggauagagugguccacgcccauaucggcgugaaggaacuggagucucugaucaugcaggacgauccccagaacuccauugaagcuaccagcguggacaaaucucaauacaucgggugcaagauugccgucguuauguucaucuacuuucucgcuacgaauuauuacuggauucugguggagggacuuuaucugcacaaccucaucuucguggccuucuuuuccgauaccaaauaccuguggggcuucauccuuauuggcuggggguuuccugcggccuucgucgcugccugggcuguggcccgggccacacuggcugacgcgcgcuguugggagcucagcgccggagauaucaaguggauuuaucaggcuccgauccuggccgccauuggccugaauuuuauccucuuccugaacaccguuagagugcuugcuacaaaaaucugggaaaccaaugccgucgggcaugacacgcggaagcaguaccgcaagcuggcgaaaucuacacucgugcugguucuuguguuuggaguccacuauauuguguucgucugccugccccacuccuuuaccggccucgggugggagaucagaaugcauugugaacuguucuuuaacagcuuccagggauuuuucguguccauuaucuacugcuacugcaauggcgagguucaagcugaagugaagaaaauguggucucgguggaaccugagcgucgacuggaagcgcacaccucccuguggcuccagacggugcgggagcgugcucaccaccguuacacacucuacguccagccagucucagguggccgccagcaccagaaugguccugauuuccggaaaagcugccaagaucgcuucucgccaaccugauagccauauuacacuucccggcuaugugugguccaacagcgagcaggacugucugccgcacucuuuccaugaggaaaccaaagaggauuccgggcggcagggagacgauauccucauggaaaagccuagcagacccauggagucuaauccugacacagaaggcugccagggggagaccgaggaugugcuguga

SEQ ID NO: 74418 - RNA, 348 nt, Artificial Sequence
  derived and/or modified sequence opt5 from PTH__Homo_sapiens__NP_000306
augauccccgccaaggacauggcuaaagugaugauugucaugcuggccaucugcuuccucaccaagagcgauggcaaauccguuaagaaaagaucugugagcgagauucagcugaugcacaaccuugggaagcaucucaauuccauggaacggguggaguggcugcgcaagaaacugcaagacguccacaacuuuguggcgcuuggagcuccucuggccccgagagaugccggcucucagcggccccgcaagaaagaagacaauguucucguggagagccaugaaaagucccugggggaggcugauaaagccgacgucaacgugcugacaaaggcuaagucucaguga

SEQ ID NO: 74419 - RNA, 528 nt, Artificial Sequence
  derived and/or modified sequence opt5 from PTHLH__Homo_sapiens__NP_945315
augcagagacggcuggugcaacaguggagcgucgccguuuuccuccuguccuacgcugugcccucuugcggccgcagcguggaggggcuuuccagacggcugaagcgcgccgucucugaacaccagcuccugcaugacaaaggaaagagcauccaggaucuuagacggcgcuuuuuccugcaccaucucauugcggagauccacaccgcugaaauuagagccacauccgaggugucuccuaacagcaaaccgucccccaauacgaagaaccauccuguucgguuuggcagcgacgaugaagggcgcuaucugacccaagagacaaauaaaguggagaccuacaaggaacagccccugaagacaccuggcaaaaagaaaaagggaaaacccgggaagagaaaggagcaggagaaaaagaaacggcgcaccagaucugccuggcucgacuccggagucacaggcagcggccuggaaggggaucaccuuucugacaccuccacgaccagccuggagcucgauucucgguga

SEQ ID NO: 74420 - RNA, 2904 nt, Artificial Sequence
  derived and/or modified sequence opt5 from PTK2B__Homo_sapiens__NP_775267
augagcggcguguccgagccccugucuagagucaagcucgggacccugcggcgcccugaaggaccggccgagcccaugguuguggugccugucgacguggaaaaagaggauguuagaauccuuaaggugugcuucuacagcaacuccuuuaaucccggcaaaaacuucaagcuggucaaauguacagugcagacggaaauucgggagaucauuaccucuauccuccugagcgggcgcauuggaccuaauaucagacuugcugagugcuauggccugcggcucaagcacaugaaguccgacgaaauccauuggcugcacccccaaaugacaguuggggaggugcaggauaaauacgaaugucugcaugucgaggccgaguggcgcuaugaccuccagauuagauaccugccugaagauuuuauggagucucuuaaggaagaccggaccacacugcucuauuucuaccagcaacugcgcaacgauuauaugcagagauacgcgagcaaaguguccgagggaauggcccuucagcugggcugccucgaacugcggcgcuuuuucaaggacaugccgcacaaugcucuggauaaaaagagcaacuuugagcuccuggagaaggaagugggccuugaccuguucuuucccaaacagaugcaagagaaucucaagccuaaacaguucagaaagaugauccagcagaccuuucaacaguacgccucucugcgggaagaggaaugugucaugaaauucuuuaacacacuugcuggguucgccaauauugaucaggagaccuaucgcugcgagcugauccaaggauggaacauuacgguugaccucgugaucggccccaaggggauuagacagcugaccucccaggaugcuaaaccuacaugucuggccgaguucaagcagauccggagcaucagaugccucccccuggaggaaggacaagcggugcuucagcugggcauugagggggccccgcaggcucucucuaucaagaccuccagccuggccgaagcugagaauauggccgaccuuauugacggauacugucgccugcagggcgagcaucaaggcucucucaucauucacccucggaaagauggggaaaagagaaacucccugccccagaucccuaugcugaaucucgaggcgcgccggagccaccuguccgaaucuugcagcaucgaguccgacauuuaugccgagauccccgaugaaacacuuagacgccccggaggcccucaguacgggauugcucgggaggacgucgugcugaacagaauccucggagaaggcuuuuucggggagguuuaugaaggaguguacaccaaucauaaaggcgagaagauuaacgucgccgugaaaacguguaagaaggauugcacacuggacaacaaagagaaguuuaugagcgaagcuguuaucaugaaaaaucuggaucacccgcauaucgugaagcucauuggcaucauugaggaagaacccaccuggaucauuauggaacucuauccuuacggggagcugggacacuaccuggagcgcaacaaaaauucucucaagguccugacacuugugcuguauucccuccagaucugcaaggccauggccuaccuggaaagcauuaacuguguccaccgggacaucgcugugagaaauauccugguugcgucucccgagugcgugaaacuuggcgauuucgggcucagccgcuauauugaagacgaggauuacuauaaggccuccgucacccggcugccuaucaaauggaugucucccgaaagcauuaacuuuagacgguucaccacagcuuccgacguguggauguuugccguuuguaugugggagauccugagcuucggaaagcaaccguuuuucuggcucgagaauaaagacgugauuggcguccuggaaaagggggaucgccuuccuaagcccgaccugugcccucccgugcucuacacgcugaugaccagauguugggauuaugacccuucugaucggcccagauuuacagagcuggugugcucccuuagcgacguuuaccagauggaaaaagauaucgccauggagcaggagcgcaacgcucgguacagaaccccgaagauccucgaaccuacagccuuccaggagcccccucccaaaccgucucgccccaaguauagaccucccccucaaaccaaucugcuggcgcccaaacuccaguuucaggaagaggacuucauucaaccuuccagccgggaagaggcucagcagcugugggaggccgaaaaggucaaaaugcgccagauccuugauaagcaacagaagcagaugguggaggacuaccaguggcugagacaagaagagaaaucccucgaucccaugguguauaugaacgacaagucuccgcugacgccugaaaaagaggucggcuaccuggaguucacaggacccccucagaagcccccgcggcuuggcgcccagagcauucagccuaccgcuaaucucgaucgcaccgacgaccugguguaucugaacguuauggaacucgugagagccguccuggagcuuaaaaaugaacugugucaacuucccccugagggguacgugguuguggucaagaacgugggacugacacugcggaaacuuaucggcuccguugaugaccugcuccccucucugcccagcuccagccgcaccgaaauugaggggacacagaagcuccugaauaaggaucuugcugagcugaucaacaaaaugagacucgcccagcaaaacgcggugacgucucuguccgaagagugcaagcggcagaugcugaccgccagccauacacuugcugucgacgccaaaaaucugcucgaugcuguggaccaggccaaggugcuggcgaaccucgcccacccuccggcugaauga

SEQ ID NO: 74421 - RNA, 3198 nt, Artificial Sequence
  derived and/or modified sequence opt5 from PTK2__Homo_sapiens__NP_001186578
auggccgcugccuaccuggaccccaaccucaaucacaccccuaacagcuccacaaagacgcaucugggcaccgggauggagagaucuccgggagcgauggaacgggugcuuaaagucuuccacuauuuugagagcaauuccgaacccacaaccugggcuucuaucauucgccauggcgaugccacagacguuagagggaucauucagaagaucguggauagccacaaagugaagcaugucgccugcuacggauuccggcugucccaccuccgcucugaggaagugcacuggcugcauguugacaugggcgugagcuccgucagagagaaauaugagcuugcucacccucccgaagaguggaaguacgaacugcggauucgcuaucucccuaagggguuucugaaccaauucaccgaggauaaacccacacugaacuuuuucuaccagcagguuaagagcgacuauaugcucgagaucgccgaucagguggaccaagaaaucgcucugaaacuuggaugucuggagauuagacggucuuacugggaaaugcgcggcaaugcccucgagaagaaauccaauuacgaagugcuggagaaggaugucggccuuaagagauuuuucccuaaaagccugcucgacucugugaaggcgaaaacccugcggaagcugauccagcagacguuucgccaguucgccaaccucaauagagaggaauccauucugaaauuuuucgagauccuuagcccgguguaucgguuugauaaggaaugcuucaaaugugcucuggggucuuccuggauuaucagcgucgagcucgccauuggacccgaagagggcaucuccuaccugaccgacaaggggugcaacccuacacaucuugcugauuucacccaaguucagacaauccaguauucuaauagcgaggacaaggaccgcaaaggaaugcugcagcucaagauugccggcgcgcccgaaccucugaccgugacggcccccucccugacaaucgcugagaacauggccgaucucauugacggguacuguagacuggugaauggaaccagccaaucuuuuaucauucggccgcagaaagaaggcgagagagcccuuccuuccauccccaagcuggcuaacagcgaaaaacagggcaugcgcacacacgccgucucugugagcgagaccgaugacuaugcugagaucauugaugaagaggacaccuacacaaugccuuccacgcgggauuaugaaauccaaagagagcgcauugagcucgggcggugcaucggagaaggccaguucggggacguucaccagggaauuuacaugucucccgagaaucccgcgcuggccguggcuaucaagaccuguaagaacugcacaagcgauuccgucagagaaaaauuucuucaggaggcccugaccaugcgccaauucgaccauccucacaucgugaagcucauuggcguuaucacagaaaacccgguguggauuaucauggagcuguguacccugggggagcuccggagcuuucugcaggucagaaaauacucucuugaucuggccucccucauucuguaugcuuaccagcugagcacggcccuugcguaucucgaaucuaagcgcuucgugcaucgggacaucgcugccagaaauguccugguguccagcaacgacugcguuaaacugggagauuuuggccucucccgcuacauggaggacucuacauauuacaaggccagcaagggcaaacugcccauuaaguggauggcuccugaauccaucaauuuccggagauuuaccucugccagcgauguguggauguucggggucuguaugugggagauccuuaugcacggagugaaacccuuucagggcguuaagaacaaugacgugauugggcggaucgaaaacggagagcgccugccuaugcccccgaauugcccucccacccucuauucccugaugacaaaaugcugggcuuacgauccuagcagacggcccagauucaccgagcugaaggcccaacuuucuacaauucucgaagaggaaaaggcgcagcaggaggaacgcaugcggauggaguccagacgccaggccacggucagcugggacucuggcggguccgaugaggcuccucccaaaccgagcagaccuggcuaccccucuccccggagcuccgaaggauuuuauccuagcccgcaacauauggugcagaccaaccacuaccaggugucuggcuaucccgggucccacggaaucacagccauggcuggcagcauuuacccugggcaggccucccugcuggaccaaaccgauucuuggaaucaucgcccccaggagaucgcgauguggcagccuaacguugaagacagcacaguccucgaucugagaggaaucggccaagugcuucccacccaccugauggaggagcggcucauucgccagcagcaggaaauggaggaagaccaaagauggcuggagaaggaggaacgguuccugaaaccugaugugcgccuuuccagagggucuaucgaccgggaggacggcagccuccagggacccauuggcaaucagcauaucuaucagccggucgggaagccuggaaaagaagagaagaacugggccgaacgcaaucccgcugccccucccaaaaagccgccuagacccggcgcuccugggcaccugggaucccuggccucucucagcucccccgccgauagcuacaacgagggcgugaagcccuggcggcugcaaccucaggaaauuucuccgcccccuacggcuaaucuugacagauccaacgauaaaguuuaugagaacgugaccgggcuggucaaggcggugaucgagaugagcucuaaaauccagcccgccccucccgaagaguacguuccuauggugaaggaagucggccucgcucugcgcacacugcuugccaccguggacgagacaauuccgcuccugcccgccuccacccaccgggaaaucgagauggcucagaaacugcucaauagcgaucugggagagcuuauuaacaagaugaagcuggcccaacaguacguuaugacgucucuccagcaagaauauaaaaagcagaugcugacagcggcucaugcccuggccguggacgcuaaaaaucuucuggaugucaucgaccaggccagacucaagaugcugggccagacccgcccucacuga

SEQ ID NO: 74422 - RNA, 405 nt, Artificial Sequence
  derived and/or modified sequence opt5 from PTK6__Homo_sapiens__NP_001243287
auggugagcagagaccaggcccaccugggacccaaguacgucgggcucugggauuucaaaucccggaccgacgaggaacugucuuuucgcgcuggagauguuuuccauguggccagaaaggaggaacaaugguggugggcgacacuucuggacgaggcuggcggggccguggcccagggauaugucccucacaacuaccucgcugaacgggagacgguggagagcgaaccggccggccaugcugggugcgccgcgcugcaggaucuugccgcuugucgcggacccgccgcuccugagagaggcggcguucugccccagccugcccgggcgugcgaacucccccaagggccugagccggugccccgcccugccgcuggcagagcccugcccgaggcucgggccuga

SEQ ID NO: 74423 - RNA, 3237 nt, Artificial Sequence
  derived and/or modified sequence opt5 from PTK7__Homo_sapiens__NP_001257327
augggcagcuuccuguccggggagaagagacccucugccccuaccgugggaagcgcuauggaaaagaaggaguuuccgacacccccuggccgggucgggcccggaacgcagaccgccaucguuuucauuaaacaaccuuccucucaggacgcgcuccagggccgcagagcucugcuucggugcgaaguggaggcccccgggccugugcacgucuacuggcugcucgauggagccccggugcaggacacagaacgcagauuugcucaaggcagcucccugucuuucgccgcuguugaucggcuucaggacagcggcaccuuucaguguguggcccgcgaugacgucacaggggaggaggcgagauccgccaacgcuagcuucaauaucaaguggauugaagccggacccgugguucugaaacauccugcuucugaggccgaaauccagccccaaacccaggugacacuccggugccacauugauggccauccucgccccaccuaucagugguuuagagacgggacgccgcuguccgauggacagagcaaccacaccgucucuuccaaggagcggaaucugacacuccgcccugcgggccccgagcauagcgggcuguacucuuguugcgcccacuccgcuuucggacaagccuguagcucccagaacuuuacccuuucuaucgcugacgagagcuucgccagaguggugcuggccccucaggaugucguuguggcucgguaugaagaagcgauguuucacugccaauucuccgcccagcccccucccagccuccaguggcuguuugaggacgaaacaccgaucaccaaucgcucuagacccccucaucuucggagagcuacgguguucgccaacggcucccugcuccugacacagguccgcccccggaaugccggcauuuacagauguaucgggcaaggacagcgcggcccucccauuauccuggaggcuacccuccaccuggccgagauugaagauaugccgcuuuucgagccucggguguuuacagcggggagcgaagagagaguuaccugccugcccccuaagggacuccccgaaccuucuguguggugggagcaugcuggcguccgccugcccacccacgggcggguguaucagaaaggacacgagcuuguucuggccaacaucgccgaaagcgacgcuggcguguacacaugucaugccgcuaaucucgccggccagagacgccaagacgucaacauuacgguggcgaccgucccguccuggcugaagaaaccucaggauucucagcuggaggaagggaagcccggauaucucgacugccugacacaggccacccccaaaccuacagugguuugguaccggaaucaaaugcuuaucagcgaggauuccagauucgaaguguuuaagaacggcacccugcgcaucaauagcgucgagguguacgacgggacgugguaucgguguaugucuuccacaccggcuggaagcauugaggcccaggcuagaguucaggugcucgaaaagcugaaauucacacccccuccccagccucaacagugcauggaguuugauaaggaagccaccguccccugcucugcgaccggccgggagaaaccuaccaucaagugggagcgcgccgacggguccagccuucccgaaugggugacagauaacgcuggcacgcugcacuucgccagagugacccgggacgaugcuggaaauuacacauguauugccuccaacggcccgcaggggcaaaucagagcccauguucagcucaccgucgcuguguuuauuacauucaaaguggagccugaacgcaccacggucuaucagggacacaccgcgcugcugcagugcgaggcccaaggcgaccccaagccucucauccaguggaaagggaaggaucggauccuggaccccacaaaacuuggaccgagaaugcauauuuuucagaacggcucucuggugauccacgacguugcuccugaagauagcgggcgcuacaccuguauugccggcaauuccugcaacaucaaacacacagaggcuccccucuauguggucgacaagccugugcccgaggaaucugagggacccggcagcccuccgcccuacaaaaugauucagaccaucgggcuguccguuggagccgccguggcguauaucauugcuguccugggccuuauguucuacuguaagaaaagaugcaaggccaagcggcuccaaaaacagccugaaggggaggaacccgagauggagugucugaauggaggcccucugcagaacgggcagcccagcgccgaaauccaagaggaaguggcucucacgucucugggcuccggaccugccgcgacaaauaagcgccauagcaccucugauaaaaugcacuuuccgagauccagccuucagcccauuacaacccugggcaagucugaguucggggaaguuuuucucgcuaaagcccagggacuggaggagggcguggccgaaacccugguccuugucaagagccuccaauccaaggacgagcagcagcagcuggauuuccggcgcgaacuggagauguucgggaaacucaaccaugcuaauguggugagacugcuuggacugugccgggaggccgaaccucacuacaugguucucgaguauguggaccugggcgaucugaagcaauuucuucgcaucagcaaaucuaaggacgaaaaacucaagucccagccccugagcacaaagcagaaaguggcucuguguacgcaggucgcccucgggauggagcaccuguccaacaauagauucgugcauaaggaucuugcggcccggaacugccugguuucugcucaacgccaggugaaagucagcgcccucggccuguccaaggacguguacaauucugaauauuaccacuuuagacaggcuuggguuccucugcgguggaugagccccgaggccauucuugagggagauuucuccaccaaaucugacgugugggccuuuggcguccucaugugggaaguguucacacauggggagaugccgcacggaggccaggcugaugacgaaguucuggcggaccugcaagccgggaaggcuagacucccucagcccgagggaugucccagcaaacuguaucgccuuaugcagcggugcugggcccuguccccuaaggauagacccagcuuuucugaaaucgccuccgcucucggcgacagcaccguggauucuaagccuuga

SEQ ID NO: 74424 - RNA, 336 nt, Artificial Sequence
  derived and/or modified sequence opt5 from PTMA__Homo_sapiens__NP_001092755
augagcgacgccgcuguggauaccuccucugagaucacaacgaaggaccugaaagaaaagaaagaggucguugaagaggccgaaaacggcagagaugcgcccgcuaaugggaacgccgagaaugaggaaaacggagagcaggaagccgacaaugagguggaugaggaagaggaagagggcggggaagaggaggaagaggaagaggaaggagacggcgaggaggaagauggggacgaggaugaagaggcugaaagcgccaccggaaagcgggcugccgaggacgaugaggacgaugacguggacaccaaaaagcaaaagacagaugaagacgauuga

SEQ ID NO: 74425 - RNA, 309 nt, Artificial Sequence
  derived and/or modified sequence opt5 from PTMS__Homo_sapiens__NP_002815
augagcgagaaguccguggaagccgcugccgagcugucugcgaaagaccucaaggagaaaaaggaaaaagucgaagagaaggcuagcagaaaggagcggaaaaaggaaguuguggaggaagaggagaacggcgccgaagaggaagaggaagagaccgccgaggauggggaagaggaagacgagggagaagaggaggaugaagaggaagaggaagaggacgaugagggccccgcucugaaacgcgccgcugaagaggaagacgaggccgauccuaagagacagaaaacagagaauggggcguccgccuga

SEQ ID NO: 74426 - RNA, 507 nt, Artificial Sequence
  derived and/or modified sequence opt5 from PTN__Homo_sapiens__XP_005250572
augcaggcccaacaguaccagcagcaaagacggaaguucgcugccgcguuucuggcuuucaucuuuauucucgccgccguggacaccgcugaggccggcaaaaaggaaaaacccgagaagaaagucaaaaagagcgauugcggggaauggcagugguccguuugugugccuacaucuggagacugcggccuggggacgcgcgagggaaccagaacaggcgcugaauguaagcagaccaugaagacacagcggugcaaaaucccguguaacuggaagaaacaauucggggccgagugcaaguaucaguuucaggcguggggagagugugaucuuaauaccgcccugaagacacgcaccggcagccucaaaagagcucugcacaacgccgaaugccagaagacggugaccauuuccaaacccuguggcaaacuuacaaagccuaagccccaagcugagucuaaaaagaagaaaaaggaagggaaaaagcaggagaaaaugcuggacuga

SEQ ID NO: 74427 - RNA, 1251 nt, Artificial Sequence
  derived and/or modified sequence opt5 from PTOV1__Homo_sapiens__NP_059128
auggugagaccccggcgcgccccuuacagaagcggcgcugggggaccgcugggcgggcggggacggcccccuagaccccucgucguucgggccgugcgcuccagaucuuggccugcgagcccccggggcccucagccgccccgcaucagagcucgguccgccccucccauggagggggcccgcguguucggagcucugggcccuauuggccccucuagcccggggcuuacccugggaggccucgccgucuccgaacacagacugucuaacaaacuucuggcuuggagcggggugcucgaguggcaagaaaagcggcgcccuuauuccgacagcacagccaagcugaaaagaacgcugcccugccaggcguacguuaaucagggagagaaccucgaaaccgaucaguggccucaaaagcugaucaugcagcuuauuccccagcagcugcucacaacccugggcccccuuuuucgcaauucucaacuggcccaguuccauuuuacaaacagagacugugauucccucaaagggcugugccgcaucaugggaaauggcuucgcuggcuguaugcuguuuccucacauuagcccgugcgaggugcggguccucaugcugcuuuauucuuccaagaagaaaaucuucauggggcugauccccuacgaccagagcggauuugugucugccauuagacagguuaucaccacacgcaagcaagcugugggcccugggggagucaacuccggccccgugcagauugugaauaacaaauuccucgccuggagcggggucauggaguggcaggaaccucggcccgagccuaauuccagaucuaagcgcuggcugccgagccauguuuaugugaaccaaggagaaauccuucggaccgagcaguggcccagaaaacuguacaugcagcucauuccucagcaacugcugacgacccucgugccccuguuucgcaauucccggcuuguccaguuccacuuuacaaaggaucuggagacccucaagagccuguguagaaucauggacaacggcuucgcgggcugcgugcauuuuucuuauaaagccuccugugaaauucgcguucuuaugcugcucuacagcucugagaagaaaaucuucaucgggcugauuccucacgaucagggaaauuucgugaacggcauccggagagucauugcuaaucagcaacaggugcugcagcggaaccucgaacaggagcaacagcagcgcgggaugggaggcuga

SEQ ID NO: 74428 - RNA, 522 nt, Artificial Sequence
  derived and/or modified sequence opt5 from PTP4A1__Homo_sapiens__XP_011534414
auggccagaaugaaccggcccgcuccuguggaggucaccuacaagaauaugcgcuuccugaucacacacaacccgacgaaugccacccucaacaaauuuauugaggaacugaagaaauauggcguuacaaccaucgugagagugugcgaagcgacauacgacaccacacuugucgagaaggaagggauucaugugcuggauuggcccuucgacgauggagcuccucccagcaaucagaucguugacgauuggcucucccuggugaaaauuaaguuucgggaggagccuggcuguugcaucgccguccacuguguggccgggcuuggacgcgcucccguucugguggcccucgcucugaucgaaggcgggaugaaguaugaggacgccguccaauucauuagacagaaacggcgcggagcguuuaacucuaagcagcugcucuaccuggaaaaauauagaccuaagaugcggcuucgcuucaaagauagcaauggccauagaaacaauugcuguauccaguga

SEQ ID NO: 74429 - RNA, 447 nt, Artificial Sequence
  derived and/or modified sequence opt5 from PTP4A3__Homo_sapiens__XP_005250824
auggccagaaugaaccggcccgcuccuguggaggucagcuacaagcacaugcgcuuccugaucacccauaauccgacaaacgccacgcucuccaccuuuauugaagaccugaaaaaguauggcgcgacaaccguugugagagugugcgaggucacauacgauaaaacaccccuugaaaaggacgggaucaccgugguugauuggccuuucgacgauggagcucccccucccggcaaaguggucgaggacuggcugucucucgugaaggccaaguuuugugaagccccugggagcugcguugcugugcacugugucgccggacugggccggaaacgcagaggggcuauuaauuccaagcagcuuaccuaucuggagaaauaccggccgaagcaacgccucagauucaaagauccccauacgcacaagacccggugcugugugauguga

SEQ ID NO: 74430 - RNA, 456 nt, Artificial Sequence
  derived and/or modified sequence opt5 from PTPMT1__Homo_sapiens__NP_001137456
auggccgcuaccgcccugcucgaggcgggccuggcuagagugcuuuucuaccccacacugcucuauacgcuguuucgggggaaggucccuggacgcgcccacagagacugguaccaucggaucgauccgaccguucuucugggcgcccucccccugcgcagccugacaagacaggugucccgggcuggggaaccuggaccccucccucgccccagacggucugugccugucggcccgcuggggagcccucccucccuucugucucaccucuucgccagcgcugccggaaccggccgcgagagagcgcggggcgaccaucacgaacgcggggugagagaugagguucccgugcaacuguuuacaggagcccagauggaaucccggggcgggugcaaaucucaucgccaggacccugucauucacccccaccaggcuuggccggccggauguagcuga

SEQ ID NO: 74431 - RNA, 1782 nt, Artificial Sequence
  derived and/or modified sequence opt5 from PTPN11__Homo_sapiens__NP_002825
augaccagcagacggugguuccaccccaacaucaccggcguggaggccgaaaaucugcuccugacgcgcggggucgacggauccuuucuugcuagaccuucuaagagcaacccgggcgauuucacccuguccguucggcgcaauggggccgugacacauauuaaaauccagaacaccggagacuacuaugaucucuacggcggggagaaguuugcgacacuggcugaacuugugcaauauuacauggagcaccauggacagcugaaagaaaagaauggcgacgucauugagcucaaauauccccugaacugcgccgauccuaccucugagagaugguuccacggccaucugagcgggaaggaagccgagaagcuccugacagaaaaaggaaagcacggcuccuuucuugugcgggagucucagagccaccccggggacuucguucuguccgugcgcaccggagaugacaaaggcgagagcaaugaugggaagucuaaagucacgcaugugaugaucagaugucaggaacucaaguacgacguuggaggcggcgagcgguuugauucccugaccgaccuuguggaacacuauaagaaaaacccuauggucgagacacuggggaccgugcuccaacugaagcagccccugaauacaacccgcauuaacgcugccgaaaucgagagcagagugcgggagcucucuaaacuggcugaaacgacagauaaggucaaacagggauucugggaggaauuugagacccuucagcaacaggaaugcaagcugcucuacucccgcaaagagggccagagacaggagaauaagaacaagaaucgguacaaaaacauccugccuuucgaccauacacgcguugugcuucacgacggggauccgaaugaacccgugagcgacuauauuaacgccaacaucauuaugccugaguuugaaaccaaguguaauaacucuaaacccaagaaauccuacaucgcgacccaaggaugccugcagaauacagucaacgauuucuggagaaugguguuucaggagaauagccggguuauugugaugacgaccaaggaagucgagagaggcaaguccaaaugugugaaguauuggccugacgaguacgcccucaaagaauaugggguuaugcgcgugcggaacgucaaggagucugcugcccacgauuacacacugagagaacugaaacucagcaaggugggacaaggcaauaccgagcgcacagucuggcaguaucauuuccggaccuggcccgaccacggcgugccguccgauccugggggaguucuggacuuccuugaggaagugcaucacaagcaggagagcaucauggaugcuggccccgucgugguucauugcucugccgggauuggaagaacgggcacauuuaucgugaucgacauucugaucgauauuauccgcgaaaaaggggucgacugugacauugaugugccuaagaccauccagauggugcggucccaaagaagcggcaugguucagaccgaggcgcaguaccgcuucaucuacauggccguccagcacuauauugaaacacuccaacggagaaucgaggaggaacagaaaucuaagcgcaaaggacacgaguacaccaacauuaaguauagccuggcugaccagacauccggcgaucagucuccccuucccccuugcacgccgacacccccuugugccgaaaugcgggaggacagcgcuagaguguacgaaaauguggggcugaugcaacagcagaaguccuuucgguga

SEQ ID NO: 74432 - RNA, 1986 nt, Artificial Sequence
  derived and/or modified sequence opt5 from PTPN12__Homo_sapiens__NP_001124480
augaucugggaguacaacguggucauuaucguuauggccugcagagaguucgaaaugggccggaagaaaugugaacgcuauuggccccuguacggggaggacccuauuaccuuugcuccguucaagaucagcugcgaagacgagcaggccagaacagacuauuuuauucggacgcuccugcuugaguuccaaaaugaaucccgcagacuguaccaguuucacuaugugaacuggcccgaucaugacgugccuucuagcuucgauuccauccucgacaugaucucucugaugcggaaauaccaggagcacgaagauguccccauuuguauccauugcagcgcgggauguggccgcaccggggcuauuugcgccaucgacuauacauggaaucuucugaaggccggaaaaauuccugaggaguuuaacguguucaaucucauccaggaaaugagaacccaacggcacuccgcuguucagacaaaggagcaguacgaacuggugcaucgcgccauugcucagcuguuugagaagcaacuccagcuguacgaaauccacggcgcccagaaaaucgcggauggggucaacgagauuaauaccgagaacauggugucuagcaucgaacccgagaagcaggacuccccuccgcccaaaccucccagaacacggagcugucuuguugaaggagaugccaaggaggaaauucugcaaccucccgagccgcacccugugcccccuauccucacccccucucccccuuccgcuuucccgacggucaccacaguguggcaggacaaugaucgcuaucaucccaaaccugugcugcacauggucagcucugagcagcauuccgccgaccuuaacagaaauuacagcaagucuaccgaacugcccggcaagaacgaguccacaauugaacaaaucgacaaaaagcucgagcggaaucugagcuuugaaaucaaaaagguuccucugcaggagggccccaaauccuucgaugggaacacccuccugaaucgcggacacgcuauuaagaucaaaucugccagcccgugcauugcggacaagaucuccaagccucaggagcuuagcucugaucugaacgugggcgacacgucccagaacagcuguguggauugcucugucacacaaagcaauaaaguguccguuaccccucccgaagagucucagaacagcgacacacccccuagacccgaucggcucccgcuggacgaaaaggggcacgugaccugguccuuucauggaccugagaaugccauucccauccccgaucuuagcgagggcaacucuuccgacaucaauuaucagaccagaaaaacagucagccugacgccuucuccgaccacacagguggaaacccccgaucucguugaccacgacaacacauccccucuguuccgcacgccccugagcuucaccaauccucuccauuccgaugacucugauagcgacgagcggaacuccgauggggcugugacacaaaauaagaccaacauuucuaccgccagcgcuacagucuccgccgccaccagcacagaaucuaucuccacgagaaaagugcugcccaugagcauugcucgccacaauaucgcgggaaccacacauucuggcgccgagaaggacgucgauguguccgaagacagcccucccccgcuuccugagcggacccccgagucuuuuguucuggcuagcgaacacaacacaccugugagauccgaguggagcgaacuccagucucaggagcgcuccgaacagaagaaaagcgagggccugauuaccuccgagaaugaaaagugugaucaccccgccgggggaauccauuacgagaugugcauugaaugcccgccuacguucucugacaaacgggagcaaaucagcgaaaaccccaccgaggccacagauaucggcuuugggaauagauguggaaagccuaaaggcccccgcgaucccccuuccgaguggaccuga

SEQ ID NO: 74433 - RNA, 7401 nt, Artificial Sequence
  derived and/or modified sequence opt5 from PTPN13__Homo_sapiens__NP_006255
augcacgugagccuggccgaggcucucgaagugagaggcgggccccugcaggaggaagagaucugggccguucuuaaccaauccgcggaaucucugcaggaacucuuccggaaggugagccuggcugacccugccgcccuuggauuuauuaucuccccguggucucugcuccugcugcccagcggcuccgugucuuucaccgaugagaauauuagcaaccaggaccuccgcgcuuuuaccgccccugaaguccugcagaaucaaucccuuacgagccugucugauguggagaaaauccauauuuacucccucgggaugacccuguauuggggagcugacuaugaaguuccccagagccagccuaucaaacuuggcgaucaccugaacucuauccuccuggggaugugcgaggacgugauuuaugccagagucuccgugcggaccguucuggaugcguguagcgcccauauccgcaauucuaacugcgcucccuccuucagcuacgugaagcaccucgucaagcuggugcuuggaaaucuguccggcaccgaccagcucucuuguaacagcgagcaaaagccugauagaucccaggccauucgggaccgccugagaggcaaggggcuuccgaccggacggagcucuaccuccgaugugcuggacauccagaagcccccucucagccaucagacauuucugaauaaaggccugucuaagagcaugggguuccucuccauuaaagauacccaagacgaaaacuauuuuaaggacauccugucugauaauagcggacgcgaggacuccgaaaacacguucagccccuaccaguuuaaaaccucuggcccugagaagaagcccauuccggggaucgauguccuuuccaaaaagaaaaucugggcuagcucuauggaccugcucugcacagccgauagagacuucuccagcggagaaaccgcgacauaucggcgcugucacccugaggccguuaccgugagaacguccacaacaccccggaagaaagaggcucgcuacucugauggcagcauugcccuggacaucuuuggcccucagaagauggaucccauuuaccacacaagagaacuucccaccuccucugcuaucagcuccgcccuggaccggauuagagagcgccagaagaagcuccaggugcugcgggaagccaugaaugucgaggaaccugugagacgcuauaagaccuaccauggggauguuuucagcacaucuuccgagagcccgucuaucaucuccagcgagucugacuuuagacaggugcggcgcagcgaggcuagcaaacgguucgaguccucuuccggacugcccggcgucgacgaaacgcucagccaggggcaaucccagagaccuucucgccaguaugagacccccuucgaaggaaaccugauuaaucaggagaucaugcuuaagcggcaagaggaagaacugaugcagcuccaggcgaaaauggcccugagacagagccgccugucccuuuacccuggcgauacaauuaaggcuucuaugcucgacaucacccgggauccccugagagaaauugcccuggagacagccaugacccaacggaaacuccgcaacuuuuucgggccggaguuugugaagaugacgaucgaaccuuucaucagccuggaccuucccagauccauucugacaaagaaaggaaagaacgaggauaaucggagaaaaguuaacaucaugcuccugaauggccagcgccuggaacuuaccugcgacaccaagacaauuuguaaagauguguuugacauggucguggcucacaucggccucgucgagcaucaccuguucgcccuggcgacccucaaggauaacgaauacuuuuucguggacccugaucugaaacuuacaaaaguugcucccgagggguggaaggaggaaccuaaaaagaaaacgaaggccaccgugaauuuuacacuguucuuucggauuaaguucuuuauggacgaugucucucucauccagcacacccugacaugccaucaguacuaucugcaacuuagaaaagacauucucgaggaacgcaugcacugugacgaugagaccagccugcugcucgccucccuggcccuucaagcugaauacggagacuaccagcccgaggugcauggcguuagcuauuucagaauggagcacuaccugccggcucgggugauggaaaagcucgaucugucuuauaucaaagaggaacugccuaaacuucauaacacguacgucggggccuccgagaaagaaaccgagcucgaguuccugaaggugugccaacgccugacagaauauggagugcacuuucacagaguucaucccgagaaaaagagccagaccggcauccuccugggggucuguucuaagggcgugcuuguguucgaaguccacaauggagugcggacacugguucuccgcuuucccuggagagagaccaaaaagauuuccuucagcaaaaagaaaaucacgcugcagaacacaucugacggcauuaagcauggguuucagaccgauaauuccaagaucugccaauaccugcuucaccugugcagcuaucagcacaaauuccagcuccagaugcgggcgcgccaauccaaccaggacgcccaggauauugagagagcuagcuuucggucucugaaucuccaggccgaaagcgugcgcggauucaacaugggcagagcuaucuccacagggucucuggccagcuccacccuuaauaagcuggcgguccggccucucucugugcaagccgagauccugaaaagacugagcuguuccgaacuuucucuguaccagccgcuccagaacagcuccaaggagaaaaaugacaaggcuagcugggaagagaagccccgcgagaugucuaaauccuaccaugaucugagccaagccucucucuauccucaccggaagaacguuauugugaacauggaacccccuccccagaccgucgcugagcuggugggaaaaccuucccaucagaugagcagauccgacgccgaaucucuugccggcguuacaaagcugaauaacagcaaauccguggcuagccucaaucgcucucccgagcggagaaagcacgaauccgauagcucuagcaucgaggacccggggcaggcguacguccuggaugugcugcauaagcgcugguccauugugucuagcccugagcgggaaaucacgcuugucaaccugaaaaaggacgccaaauauggccucggauuucaaauuaucggcggggagaagaugggaagacuggaccucggcaucuucauuuccucuguugcucccgggggaccugccgaucuggacggcugccuuaaacccggggaucgccugaucagcgucaauuccgugagccuggaaggcgucucucaccacgccgcuauugagauccuccagaacgccccggaagacgugacccugguuauuucccagccuaaggagaaaaucagcaaggugcccuccacaccuguccaucuuaccaaugagaugaagaacuacaugaaaaagucuagcuauaugcaggauuccgcgaucgacucuagcuccaaagaucaccauuggagccggggaacacugagacacauuucugaaaauuccuuuggccccagcgggggacuccgggagggcucucuguccagccaagacucucgcaccgaaagcgcuucccucucucagagccaggugaacggguucuuugccucccaucugggagaucagacguggcaagagagccagcacggcucccccucuccuagcguuaucuccaaggccacagagaaagaaaccuucaccgacucuaaucagagcaagacaaagaaaccggggauuuccgaugugaccgacuacucugacagaggcgauagcgacauggaugaggcuacauauuccagcucucaggaccaccaaacgcccaagcaggaauccucuagcuccgucaacaccagcaauaaaaugaacuucaagacauuuucuuccagcccucccaaaccuggagauaucuucgagguggaacuugccaagaaugacaacucccugggcauuagcguuaccgggggagugaacacaucuguccggcauggcgggaucuacgugaaggcggugauuccccagggagcugccgagagcgauggccgcauccacaaaggcgacagaguccuggccguuaauggggugucccucgagggagcuacccauaagcaagccguggaaacgcugcggaacaccggccaggucgugcaccuucugcucgagaaagggcagucuccuacaagcaaggaacacguuccggugacaccccaguguacacuguccgaucaaaaugcucagggacagggcccugagaaagucaagaagaccacacaggugaaagacuacucuuuuguuaccgaagagaacacguucgaggugaagcucuuuaaaaauagcuccgggcugggauucucuuuuagcagagaagauaaccuuauccccgagcaaauuaaugccuccaucguccgcgugaagaaacuguucccuggccagcccgcggccgaaagcggcaagauugacgucggggaugugauccugaagguuaacggagcuucucucaaaggccugucccagcaggaggugauuagcgcccuucgggggacagcuccggaagucuuucugcuccugugcagaccuccgcccggagugcucccugagaucgacaccgcccugcuuacaccccugcaaucuccugcccagguucugcccaauuccagcaaggacuccucucagcccagcuguguggagcaauccacaagcucugaugaaaacgagauguccgacaaaagcaagaaacagugcaagucuccuagccgccgggauuccuauucugacagcuccggcucuggggaagaugaccucgucaccgcucccgcgaauaucagcaacuccacguggagcucugcccugcaucagacacuuuccaauauggugagccaggcucaaucccaccaugaggccccuaaaucucaggaggauaccauuuguacaauguucuacuauccccagaagaucccgaacaagccugaauuugaggacagcaaucccuccccucugcccccugauauggcccccggacagucuuaccaaccgcagagcgaauccgcuuccucuuccagcauggacaaauaucacauucaucacaucucugagccuaccagacaggaaaacuggacaccccucaagaacgaucuggagaaucaccuggaggacuucgaacucgagguggaacuucugauuacccugaucaaauccgagaagggcagccucggcuucacgguuaccaaagggaaccagcgcaucggaugcuacguccaugaugugauucaagaccccgccaagucugacggccggcugaagccuggggauagacuuaucaaagugaaugacacagaugucaccaacaugacacacaccgacgcggugaaucugcuccgcgcugccuccaagacgguuagacuggugauuggacggguccuggaacucccgcgcauccccaugcuuccucaucugcugcccgauauuacacucaccuguaacaaagaggagcugggcuuuagccuuugcgggggacacgacucucuguaucaggugguuuacaucagcgauauuaauccuagauccguggccgcuaucgaaggcaaccuccagcugcuggacgucauccacuacgugaauggcguuagcacacaggggaugacccucgaggaagugaaccgggcccuugauaugucccugcccucucugguccucaaggcgacccgcaaugaccugccuguggugccgagcuccaaaagaucugcugucagcgcccccaaguccacaaagggaaacggcucuuauagcguuggguccuguagccaaccugcccuuacgcccaaugauucuuucuccaccguggcuggagaggaaauuaacgagaucagcuacccuaaaggcaagugcucuacauaucagauuaaagggucccccaaucugacccucccgaaggagagcuacauccaggaagacgacauuuaugaugacucucaagaggccgaagugauccagucccugcuggaugucguggacgaggaggcucagaaccuccuuaaugaaaacaacgccgcgggauacagcugcggcccuggcacacugaaaaugaaugggaagcugucugaggaacggaccgaggauacggacugugauggaagcccccuccccgaauauuuuacagaggccaccaagaugaacggcugcgaggaauacugugaggaaaaaguuaagagcgagagccugauccagaaaccucaagaaaagaaaaccgacgaugacgagauuacaugggggaaugaugagcuucccaucgaaagaaccaaccaugaggacuccgauaaggaccacucuuuccugacaaaugacgaacucgcugugcugccugucgugaaaguucugccgagcggaaaguacacgggcgccaaccucaaguccgugauucgcguccuucgggggcugcuggaucagggaauccccucuaaagagcucgaaaaucugcaggagcuuaagccucuggaccagugccucauuggccaaaccaaagagaacagacgcaagaaucgguauaaaaacauccugcccuacgaugcuacaagagugccucugggcgacgaagggggauauaucaaugccagcuuuauuaagauccccgucggcaaggaggaguucguguacauugccugucaggggccgcucccuaccacaguuggagauuuuuggcagaugaucugggagcagaaauccaccgugauugcuaugaugacgcaagagguggaaggcgagaagaucaaaugccagcgguauuggcccaacauucuugggaagaccacaauggucucuaaucgccugagacuggcgcucguucggaugcagcaacugaaaggauucguggugcgcgccaugacccuugaagacauccagacaagagagguccggcauaucagccaccugaacuuuaccgcuuggccugaucaugacacacccucccagccugaugaccuccugacguucauuagcuacaugcgccacauccacagaucuggccccauuaucacccauuguuccgccggcauugggcggagcggaacacugaucugcaucgaugugguucucggccuuauuucucaggaccuggacuuugauaucuccgaccuggugcgcuguaugagacuccaacggcacgggaugguccagaccgaagaucaguauauuuucugcuaccaggugauccuguacguccuuaccagacugcaagccgaggaggaacagaagcagcagccgcaacuccugaaguga

SEQ ID NO: 74434 - RNA, 3564 nt, Artificial Sequence
  derived and/or modified sequence opt5 from PTPN14__Homo_sapiens__NP_005392
augcccuucggccugaagcucagacggacccgcagauacaacgugcugagcaaaaauugcuuugucacacggauccgccuucuggacuccaacguuauugaguguacgcucucuguggaaagcaccgggcaggagugccuggaagccguggcucaaagacuugagcugcgggaaacacacuauuucggacucugguuucuguccaagucucagcaggcccgcugggucgagcuggagaaaccucucaagaaacaucuggauaaguucgcgaaugaaccgcuucuguuuuucggcgugauguuuuacguucccaacgugagcuggcuccagcaagaggcuaccagauaucaguacuaucugcaggucaagaaagacgugcuugaagggcggcugcgcuguacacucgaucagguuaucagacuggccggacuggccgugcaagcugacuucggcgauuacaaucaguuugacucccaggauuuccuccgggaguauguccuguuuccuauggaccuugcccuggaggaagcugugcucgaggaacugacccagaagguggcccaagagcacaaagcgcauucugggauucuucccgccgaagcugagcugauguacaucaacgaggucgaacgccucgauggauucggccaggagauuuuuccuguuaaggacaaucacggcaacugcgugcaucuggggaucuucuucaugggaaucuuugugagaaaucggauuggccgccaggccgucaucuacagauggaacgauauggggaauauuacacacaacaaaagcaccauccugguggaacucauuaauaaggaggaaacggcucuguuccacaccgacgauaucgagaacgccaaguauauuucccggcuuuuugcgacaagacauaaauucuacaagcaaaauaaaaucuguaccgagcagagcaacucucccccuccgauccgccggcagcccacaugguccagaagcucucugccucgccagcaacccuauauucucccucccguucacgugcagugcggagaacauuacuccgagacccacacgagccaggacucuaucuuucacggcaacgaagaggcccuguauuguaauucccauaacagccuugaccugaauuaccucaacgggacagucaccaauggauccgugugcucuguucacagcgugaacucccugaauuguagccagucuuucauucaggcuuccccggucagcucuaaccugagcaucccuggcuccgauauuaugcgggccgacuauauccccucucauagacacagcgcuaucauugugccuuccuaccgccccacacccgauuacgaaaccgucaugcggcaaaugaagagaggcauccuccauaccgacagccagucucagucccugcgcaaucuuaacauuaucaauacacacgccuauaaccaaccugaggaucugguguacagccagccggagaugcgggaaagacaccccuauacgguuccuuacgggccccagggaguguauucuaauaaacucgucuccccuagcgaccagcgcaaccccaagaauaacgugguuccguccaaaccuggcgccucugcuauuagccauaccguguccacacccgagcuggcgaacaugcaacugcaggggucucacaauuacagcaccgcccauaugcuuaagaacuaucucuuucggccucccccucccuacccgagaccucggcccgcuacauccacccccgaucuggccagccaccgccacaaguacgucucuggauccagcccugaccuggugacgagaaaagugcagcucucuguuaagacauuccaagaagauuccagcccggucgugcaucagucucugcaggaggugagcgagccccuuaccgccaccaaacaccauggcacagucaauaagcggcacucccuggaagugaugaacagcaugguuagagggauggaggcuaugacccucaaaucucugcaucugccuauggcccgccggaauacacuuagagaacagggacccccugaggaaggcuccggcagccacgaggugccccaacucccucaguaucaccauaagaagacguuuuccgacgcgaccaugcugauccacucuagcgaguccgaagaggaagaggaagaggcucccgagucugucccgcagaucccuaugcugcgcgagaaaauggaauacagcgcccagcuccaagccgcucuggcccgcauucccaacaagccucccccggaauauccugggccccggaaauccgugucuaauggagcucuuagacaggaucaggccagccugccucccgcgauggccagagcucggguucuccgccauggccccgccaaggcuaucuccaugagcagaacagacccuccggccgugaacggggcgucucugggacccuccauuagcgagccugaccugaccucugucaaagaacgggugaagaaggagcccguuaaagagcgcccuguguccgaaauguucagccuugaggauucuaucauugaaagagagaugaugauccggaaucucgagaagcagaaaauggccggccuggaagcucaaaagcgcccccugaugcucgccgcucugaacgggcuuuccgucgccagagugagcggccgggaggaaaauagaguggacgccacacgcgucccuauggaugagcgguuuagaacccugaaaaagaagcucgaagagggaaugguuuucacggaguacgaacagauuccgaaaaagaaagcuaacggcaucuuuuccaccgcggcccugcccgagaaugcugaacgcagccggaucagagagguggugccuuaugaagagaaccgcgucgagcugauucccacaaaggaaaauaacaccggguacaucaacgccucucacauuaaagugguugugggaggcgccgaguggcauuauaucgcuacacaggggccucuuccccauaccugccacgacuucuggcaaauggucugggaacagggagugaauguuauugccauggugacggcggaggaagagggcgggcggacaaagagccacagauacuggccgaaacucggcuccaagcacucuagcgcuaccuacggaaaguucaaagucacaaccaaguuucgcaccgauuccguguguuaugccacaacgggccugaaaguuaagcaucugcucucugggcaggagcggaccguguggcaucugcaguacacagacuggccugaucacggaugccccgaagacguccaaggcuuccuuagcuaucuggaggaaauccaguccgugagacggcacaccaacucuaugcucgaggggaccaaaaaucgccaucccccuaucgugguccacugcagcgccggaguuggcagaacaggggugcugauucuguccgagcuuaugaucuacugucuggaacacaacgagaagguggaaguccccaugaugcuccggcugcuccgcgagcagagaauguuuaugauucagacgaucgcucaauauaaguucguguaccagguucugauucaguuucuucagaauagccggcugaucuga

SEQ ID NO: 74435 - RNA, 1062 nt, Artificial Sequence
  derived and/or modified sequence opt5 from PTPN18__Homo_sapiens__NP_001135842
augagcagaucccuggacucugcccggagcuuccucgagcgccuggaagcuagaggcgggcgggagggagccgugcuugcgggcgaauuuuccaagcgcugcgagagauacugggcucaggaacaagagccccugcagaccggacucuucuguaucacacugauuaaagagaaguggcuuaacgaagauaucaugcugcggacgcucaaagucaccuuucagaaggagucucgcagcguuuaucagcugcaauacauguccuggccugacagaggggugccgucuagccccgaucacaugcuggccaugguggaagaggcccggcgccuccagggcuccgggccugagccccugugcguccauuguagcgcuggaugcggcagaacaggcgugcuuuguaccguugacuaugugcggcagcugcuccugacacagaugauuccucccgauuucucucuuuuugacgucgugcugaaaaugcgcaagcaaagaccugccgcuguucagaccgaggaacaguaccgguuccucuaucacacaguggcccagauguuuugcuccacccugcaaaaugcgagcccgcauuaccagaacaucaaggaaaauugugcuccccuguaugaugacgcccucuuccugcgcacgccucaggcccuucuggcuauucccagaccucccgggggaguccuccggucuaucuccgugccgggcagcccugggcacgccauggcggauaccuacgccgugguccagaaaagaggagcucccgccggcgcugggucuggaacacaaaccggcacaggcaccgggacgggagcccgcuccgccgaggaagcuccucuguacagcaagguuacaccccgggcgcagagacccggcgcccaugcugaggacgcccgcgggacccuuccuggacgggugccggccgaucagucccccgcuggcucuggggccuaugaggacguggcgggaggcgcucaaacaggcgggcugggauuuaaccucagaaucggccgcccuaaagggccccgggauccucccgccgaauggaccagagucuga

SEQ ID NO: 74436 - RNA, 1089 nt, Artificial Sequence
  derived and/or modified sequence opt5 from PTPN1__Homo_sapiens__NP_001265547
auggaggaagcccagagaagcuacauccugacccaaggcccccucccuaacacaugcgggcacuucugggagauggugugggaacagaagucccggggagucguuaugcugaaucgcgugauggagaaaggcucucuuaagugugcucaguauuggccgcagaaagaagagaaggagaugauuuuugaagacacgaaccugaaacucacccugaucagcgaggauauuaaguccuacuauacagugagacaacuugaacuggagaaucucaccacacaggagacccgggaaauccugcauuuccacuacacaaccuggcccgacuuuggggucccugagucucccgccagcuuccugaacuuucucuucaaggugcgcgaauccggaucucugagcccugagcauggccccguugugguccacugcuccgcggggauuggaagaagcggcacguuuugucuugcugauaccugccugcuccugauggacaaacggaaggauccuucuuccguggacaucaaaaagguucuucuggaaaugcgcaaauucagaaugggccucauccagacagccgaucagcugcgguuuagcuaucuggccgugauugagggggcuaaguucaucaugggagacucuuccguccaagaucaguggaaggagcucagccaugaagaccuggagccgcccccugaacacauucccccucccccgcgcccucccaaaagaauccuugagccucacaauggcaagugucgggaauuuuuccccaaccaucagugggugaaagaggagacccaggaagauaaggacugccccauuaaagaggaaaaggggucuccucugaaugccgcuccguacggaaucgaguccaugagccaagauacagaagugcgcuccagagucguuggcgggucucuccggggagcccaggcggccagccccgcuaaaggcgagccuucccugcccgagaaggacgaagaccacgcccuuagcuauuggaagccuuuucuggugaacauguguguggcuaccguccucacggccggcgcguaccugugcuaccgcuuccuguucaauucuaacacauga

SEQ ID NO: 74437 - RNA, 3525 nt, Artificial Sequence
  derived and/or modified sequence opt5 from PTPN21__Homo_sapiens__XP_011534669
augccccugccuuucggccucaagcugaaaagaacccggcgcuacacagugagcuccaagucuugccuugucgccagaauccagcugcucaacaaugaguuuguugaguucacgcugagcguggaauccaccgggcaagaaucucuugaggcuguggcccagcggcuggaacuccgcgaggucacauauuuuagccugugguacuauaacaaacagaaucagagacgguggguggaccuggagaagccgcucaaaaagcaacuggauaaguacgcgcuugaacccaccguuuauuucggaguggucuuuuacgugccuuccguuucucagcugcagcaggagauuacacgcuaucaauacuaccuccagcugaaaaaggacauccuugaaggcagcauucccuguacccuggagcaggcuauccagcucgccgggcuggccgugcaagcugauuucggagacuuugaucaguaugagucccaggacuuccugcaaaaauuugcccucuucccugucggcuggcugcaggaugaaaaggugcuugaggaagcuacacagaaaguggcccugcuccaccagaaguacagagggcugaccgcgcccgacgccgagaugcuuuauaugcaagaagucgagcggauggauggauacggcgaggaaagcuauccugcuaaggacucucagggcuccgauauuagcaucggggccugccuggagggaaucuuuguuaaacauaagaacggccgccacccggugguguucagauggcaugacauugcuaauaugucucacaacaaauccuuuuucgcccucgaacuggcgaauaaggaggaaacgauccaguuccagaccgaggauauggagacagccaaauacauuuggcggcugugugucgcucgccauaaguuuuauagacucaaccaaugcaaucugcagacccagacagugaccguuaaccccauccggcgcagaucuagcucccggaugagccuuccuaaaccccagccuuacgugaugcccccgccuccccaacugcacuacaaugggcacuauacggaaccuuacgccuccucucaggacaaccucuucguccccaaucagaacggauauuacugucauagccagacaucccuggacagagcucaaauugaucuuaauggccgcauccggaacgggagcguguauucugcccacuccaccaacagccugaauaacccccagccuuaccuccagccgucucccaugagcuccaauccuucuauuacaggaagcgacguuaugagacccgauuaucugccuucccaucgccacagcgccgugauucccccgucuuaccggccuacccccgacuacgagaccgucaugaagcaacugaacagaggccucgugcacgcugaacgccagucccauagccugcggaaucuuaacaucggaucuuccuaugcguacagcagaccugccgcucuggucuauucccagcccgagauccgcgaacacgcccagcucccuucucccgccgcugcccauugcccguuuagccuguccuacucuuuccacagcccuucccccuaucccuacccugcggagcggagaccggugguuggggcugugagcguccccgagcugacaaaugcccaacuucaggcccaggauuauccuucucccaacaucaugcgcacccagguguaccggccucccccucccuacccgccucccagaccugcuaauuccacgcccgaccucagccggcaucuguauauuucuuccagcaacccggaucugaucacacgcagaguucaccacucugugcaaaccuuucaggaagacagccucccugucgcccauucccugcaggaggugagcgaaccccuuacagcugcccggcacgcgcagcugcauaagagaaauucuauugagguggccggacucucccacggccuggaggggcugcgccuuaaagaacggacccucagcgcuuccgccgcugagguugccccuagagcggucucugugggaagccaacccuccguguucacggaacgcacacagagagagggccccgaagaggccgaggggcugcgguacggacacaagaaaucucugagcgaugcuaccaugcucauccauuccucugaagaggaagaggacgaagauuuugaggaggaaagcggcgcccgcgcuccuccggccagagcccgggagccccgcccuggccuggcucaggaucccccugggugucccagaguccuucuggcgggaccucuccacauccuggaaccgaaggcccaugugcccgacgcugagaaacggaugauggacuccagcccuguucgcaccacagccgaagcccaaagacccuggcgggacggccugcuuaugccuucuauguccgagagcgaucucaccacaucugggcgcuauagagcucggagagacucccugaagaagcgccccgugagcgaucugcucucuggcaaaaagaacauugucgagggccugccgccucuugggggcaugaaaaagacgcggguggacgccaaaaagaucggaccccugaagcucgcggcucugaauggccugucccuuagcagaguuccccucccugaugaagggaaagagguggccacccgcgccacaaacgacgaacggugcaagauucuggagcagagacuggagcagggaauggucuucaccgaauacgagcgcauccucaaaaagcggcugguggauggcgaauguuccacagcuagacuucccgagaaugccgaacgcaaccgguuucaggacguucugccuuaugaugacgugagagucgagcucgugccgaccaaagagaacaauacgggguacauuaacgcgagccacaucaaggugucugucagcggaaucgaaugggauuauauugcuacccaaggcccccugcagaauacaugccaggacuucuggcagaugguuugggagcaagggaucgccauuaucgccauggugaccgcugaagaggaaggcggacgggagaaguccuuucgcuacuggccuagacugggcucucggcauaacacagugaccuacgggcgcuucaaaauuacgacaagauuucggaccgacagcggauguuaugccacaaccggccuuaagaugaaacaucugcucaccgggcaggagagaacagucuggcaucugcaguacacggauuggcccgaacacggaugcccugaggaccucaagggcuuccuguccuaucuugaagagauccagucugugcgccggcacaccaauagcacauccgauccccaaucuccgaacccuccccugcucguucacugcagcgcuggggugggcagaaccggagucgugauucuguccgaaaucaugaucgccugucuggagcacaaugagguucuugacauuccucgcgugcuggauaugcuccggcagcagagaaugaugcugguccagacacucugccaauacaccuucguguaucgcguucugauccaguuucuuaaaagcucucggcugauuuga

SEQ ID NO: 74438 - RNA, 1980 nt, Artificial Sequence
  derived and/or modified sequence opt5 from PTPN22__Homo_sapiens__XP_011539526
augcagcuggaguucggccccuuuagcguguccugcgaagccgagaagagaaaaucugacuacaucauucggacccucaaggucaaauucaacagcgaaacacgcacgaucuaucaauuucacuacaagaauuggccugaucaugacguuccguccucuauugaucccauccuggagcuuauuugggacgugagauguuaucaggaagaugacagcgugccuaucugcauccacuguuccgcugggugcggacggaccggcgucauuugugccaucgauuacacauggaugcugcucaaagacgggauuauccccgagaacuucucuguguuuagccugauucgcgagaugagaacccagcggccuucccuuguucagacacaagaacaguaugagcugguguacaaugcgguccucgaacuguucaagcgccagauggaugugaucagagacaagcauagcggaaccgagucucaggcuaaacacugcauucccgagaagaaccauacacugcaagccgauuccuauagcccuaaucucccgaaaucuaccacgaaggccgcuaaaaugaugaaccagcagcggaccaagauggaaaucaaggaguccagcucuuuugacuuccgcacauccgaaaucagcgccaaagaggaacugguucuucaccccgcuaaguccucuaccagcuuugauuuccuggagcucaauuacuccuuugacaaaaacgccgacacaaccaugaaguggcagacgaaagcguucccuauugugggcgagccccugcaaaagcaccagagccuugaucuggggucucuccuguuugaaggauguuccaauagcaaaccugucaacgccgcuggcagauacuucaauucuaaggugcccaucacacggaccaagagcacaccguucgagcugauucagcaacgcgaaaccaaagagguggacuccaaggaaaacuuuucuuaucucgagagccagccucaugauuccugcuucgucgagaugcaggcccagaaaguuaugcacgugagcucugcugaacugaauuacucccuucccuaugacagcaagcaucaaaucagaaacgccucuaaugugaaacaccacgauuccagcgcgcugggcgucuacuccuauauuccucucguggagaaccccuacuuuucuagcuggcccccuuccgggaccucuagcaagaugucccuggaccuuccggaaaagcaggauggaacaguuuuccccagcucucugcucccuacguccagcaccucucuguuuuccuauuacaacagccaugacucucugagccucaauucccccacaaacaucagcucucugcuuaaucaggaguccgccgugcuggcuaccgccccucggaucgaugacgaaauucccccgccucuccccgucuggacaccugagagcuucaucgugguugaggaagcuggcgaguuuucccccaacgugccuaaaucucugagcuccgccgucaaggugaaaauugggaccucucuugaauggggaggcacgagcgagcccaagaaauucgaugacuccgucauccugcgcccgucuaagagcgugaagcucagauccccuaaaagcgagcugcaccaggaccggucuuccccccccccuccgcugcccgaaagaacacucgagagcuuuuuccuggccgaugaagacuguaugcaagcucagucuauugagaccuacuccaccagcuauccugauacaauggaaaauucuaccuccagcaagcagacacuuaaaacgcccgggaaguccuuuacccgcagcaaaucucugaagauccuccggaacaugaagaaaagcaucugcaauuccuguccucccaacaagccugcggagucuguucagagcaauaacuccucuagcuuccugaauuuuggauucgccaacagauucuccaaacccaagggcccgcgcaauccucccccuacauggaacauuuga

SEQ ID NO: 74439 - RNA, 4533 nt, Artificial Sequence
  derived and/or modified sequence opt5 from PTPN23__Homo_sapiens__NP_001291411
augcugggcgccauggacaagagagugagcgaggaagggaugaaagucuccugcacccacuuccagugugcugccggagcguuugcuuaccuccgggagcauuucccccaagccuauucuguugauaugagccgccagauccugacacuuaacgugaaucugaugcucggccaggcccaggaaugccugcuugagaaguccaugcuggacaacagaaaaucuuuucucguggcucggauuagcgcccaagucguggauuacuauaaggaggcuugucgcgcccuggagaauccugacacggcgucccugcucgggagaauccagaaagauuggaagaagcugguucagaugaaaauuuacuauuucgccgcuguggcccaccuucauaugggaaagcaggcugaggaacaacagaaauuuggcgagcgggucgccuacuuccagucugcgcuggacaagcucaacgaagccaucaaacuggcuaaggggcagccggauaccgugcaagacgcccuucgcuuuacaauggauguuauuggaggcaaguauaauagcgcuaaaaaggacaacgauuucaucuaccacgaggccgugcccgcccuggacacccuccagccugucaaaggcgcuccccuggugaagccucugcccgugaauccuacagauccggcggucaccgggcccgacaucuuugccaaacucguuccuauggcugcccaugaggccuccagccuguacucugaagagaaggcuaaacuucugagagaaaugauggccaagauugaggacaagaacgaagugcucgaucaguucauggacuccaugcaacuggaucccgagacaguggacaaucuugaugcguauagccacaucccuccccagcugauggagaaaugcgcugcccucucuguccggccggacaccgugcgcaaccugguucaguccaugcaagugcugagcggagucuuuacggauguggaagccucucucaaggacauuagagaucugcuugaggaagacgagcugcucgaacaaaaauuccaggaggcuguuggccaggccggggcuaucuccauuaccagcaaggccgagcuggcggaagugcggcgcgagugggccaaauacauggaaguccacgagaaggcuuccuuuacaaauucugaacuucauagagccaugaaccugcacgugggaaaucuccggcugcugagcggcccucucgaucagguccgcgcugcccugcccaccccugcgcuuucccccgaggacaaggccgugcugcaaaaccucaaaagaauccuggcuaagguucaggagaugcgggaccagagagugagccuggaacagcaacuucgcgagcucauucagaaagaugacaucacagccucucuggucaccacggaucauuccgaaaugaagaaacuguucgaggagcagcucaagaaguaugaccagcugaaaguguaccuugaacaaaaucuggcugcccaggaucggguucucugugcccugacagaagcuaacgugcaguaugcggccgucagacgcgugcugagcgaccuugaucagaaguggaacucuacccuccagacacugguggcuagcuacgaagccuaugaggaccugaugaaaaagucccaggaagggcgggauuucuacgccgaccucgagucuaaaguugcugcccugcuugagagaacccaguccacaugccaagcgcgcgaagcugcccggcagcagcugcucgauagagagcugaagaagaaacccccuccgcgccccaccgccccuaagccccugcuuccucggagagaagagagcgaagcugucgaggccggagaucccccggaggaacuccgcagccugccucccgacaugguggcgggcccucggcugcccgacacguuucucggcucugcuaccccucugcacuuucccccguccccuuuccccagcucuacagggcccggaccucacuaccuuuccggcccgcugcccccugggaccuauagcggacccacacagcucauccaaccuagagcccccggcccucaugccaugcccguggcuccggggccugcccuguaccccgcuccugccuauacccccgagcugggacuugucccgcgguccucuccucagcacggcgugguuagcucccccuacgugggcgucgggccugcgccucccguggccggacuccccucugcuccgcccccucaguucagcggccccgaacuggccauggcuguucgcccugccacgacaaccguggacuccauucaggcccccaucccuagccauaccgcuccgagacccaauccuacacccgcgccucccccgccuuguuuucccgugcccccuccccaaccucugccgacccccuauacauacccugccggggcuaaacagcccauuccugcccagcaccauuucucuuccggaauccccgccggcuuuccggcuccucggauugggccccaaccucagccccacccucagccccacccgagccaggccuucggcccucaaccuccccagcagccccucccgcugcagcauccccaccuuuuuccuccccaagcgccuggacugcugcccccucagucuccguaucccuacgcuccucagcccggcguccuggggcagccucccccgccucugcauacgcaacuuuaccccggacccgcccaggauccucugcccgcccacuccggcgcucucccuuucccgagccccgggccuccccagccuccccacccgccucuggccuauggacccgcgccuucuaccagacccaugggcccucaggcugcuccccucacaauccgcgggccgagcuccgccggccaaagcaccccuucuccccaucugguucccuccccugccccgagccccggaccuggccccgugccuccccggccucccgccgcugagccgccucccugccuuagacgcggggccgcggccgcugaccugcucuccucuagcccugaaucccagcacggaggcacacagucucccgggggaggccaaccgcugcugcagccuaccaaggucgaugccgcugaggggagacggccccaggcccuucgccugaucgagagagaccccuacgaacauccugagcggcuccgccagcugcaacaggaacucgaggccuuuagaggccagcugggagaugugggcgcucuugacacgguguggcgggagcugcaggaugcgcaagaacacgacgcccgcgggagaagcauugcuaucgcccgguguuauucccucaaaaaccgccaucaggaugucaugcccuacgacucuaauagaguugugcugcggagcggaaaggaugacuauauuaacgccuccugcguggagggccugagcccuuacuguccgccccuugucgcuacccaggccccucugcccgggacagcggcugauuucuggcucauggugcacgaacagaaaguuucugugaucgucaugcugguguccgaggccgaaauggagaagcaaaagguugccagauauuuuccuaccgagcgcggacagcccauggugcacggcgcucucagccuggcccuuucuuccguccggagcacagaaacccauguggagagaguucugucucugcaguuccgcgaccaaucccucaaacggagccuggugcaccuucauuucccuacguggccggaacuggggcuccccgacuccccuagcaaucugcucagauuuauucaggagguccacgcgcauuaccugcaccagcgcccccuucacacaccuaucaucgugcauugcucuagcggcgugggacggaccggcgccuucgcucugcuguacgccgcuguccaggaaguugaggccgggaacggcauucccgagcucccgcaacuggugagacgcaugcggcagcagagaaagcacaugcuucaggaaaaacugcaucuccgguuuugcuaugaggcugugguccgccacguggaacaaguucugcagagacacggagugccuccucccuguaagccccucgccuccgcgucuaucagccagaaaaaucaucugccccaggauucccaagaccuuguccucgggggagaugugccuauuucuagcauccaggccacaauugcuaagcuguccauccggccgcccggcggccucgagucuccuguugccagccugcccgggccugcugaacccccgggacuuccucccgccucccugccugagagcacccccauuccgucuuccagcccuccuccccucucuagcccccugcccgaggccccucagccgaaggaggaacccccugugcccgaagcuccuuccuccgggcccccuucuagcucccucgagcugcuugcgagccugaccccggaggccuucucucuggacuccagccuccgcggcaaacagagaaugucuaagcacaacuuucugcaagcucauaauggacagggccuucgggccacaagacccagcgaugacccucugucccuccuggauccccuguggacgcucaacaaaaccuga

SEQ ID NO: 74440 - RNA, 1233 nt, Artificial Sequence
  derived and/or modified sequence opt5 from PTPN2__Homo_sapiens__NP_001193942
augcccaccacaaucgagagagaguucgaagaacuggacacgcagcggcgcuggcaaccucucuaccuggagauuagaaacgaaagccacgauuauccgcaucggguggccaaguuucccgagaaucgcaacagaaaucgguaccgcgacgucuccccuuaugaucacucuagaguuaaacuucagaacgcugagaaugacuacaucaacgccagccugguggauauugaagaggcgcagcgguccuauauccucacccagggcccccugccuaauacaugcugucauuucuggcuuaugguguggcaacagaagaccaaagcugucgugaugcugaaccgcauuguugaaaaggagucugugaaaugcgcccaguacuggcccacagacgaucaggagaugcucuuuaaggaaaccggguucagcgucaagcugcuguccgaggacgugaaaucuuauuacacaguucaccuccugcaacuugaaaauaucaacuacaucgagaaucuguggauuacccucuaucugaaacuucugaugcucgaugugaagagaagccugaaguccggagaaacgcggaccaucagccauuuucacuacacaaccuggccugacuucggcgucccggagucucccgccuccuuucugaacuuccucuuuaaagugcgcgagagcgggucucugaauccugaucacggacccgcugugauucauuguuccgccggcaucgggagaagcggaacauucucucuugucgauaccugccugguucucauggaaaagggcgacgacauuaacaucaaacaggugcugcuuaauaugcggaaguaucgcaugggccugauucagacgccugaccagcucagauuuuccuacauggcuaucaucgagggggccaaguguauuaaaggagauagcuccauccaaaagcgguggaaagaacugucuaaggaggaccugagccccgcguucgaucacuccccgaacaaaauuaugacagaaaaguauaacggcaauagaaucgggcucgaggaggaaaagcugaccggagaccgcugcacaggccuuagcucuaaaaugcaggauaccauggaggaaaacuccgagagcgcccugcggaagcgcauuagagaagaccggaaagcuaccacagcccagaaggugcaacagaugaaacagagacucaaugagaacgagcgcaagcggaagagaccucgccugacggauaccuga

SEQ ID NO: 74441 - RNA, 2607 nt, Artificial Sequence
  derived and/or modified sequence opt5 from PTPN3__Homo_sapiens__NP_001138840
augaccagcagacugcgggcccucggcgggcgcaucaacaauauuagaacauccgagcugcccaaggaaaagacgcggucugaggugaucugcagcauucacuuccuugacggagucguucagaccuuuaaggugacaaaacaagauaccggccaggugcugcucgacaugguccauaaccaccugggggugacagaaaaggaguacuucggacuucagcaugaugacgauuccguugacucuccucgcuggcuggaagcuagcaaagccaucagaaagcagcucaagggcggguuuccguguacccugcacuuccgggugcgcuuuuucauucccgauccuaauacacugcaacaggagcagaccagacaucucuauuuucugcagcuuaaaauggacaucugcgagggacggcugacguguccccucaacuccgcggucgugcuggcuucuuacgccguucaaagccacuucggcgauuauaauuccagcauccaccauccuggcuaccuuucugacucccacuuuauucccgaucagaacgaagacuuccugaccaagguggagagccuccaugaacagcacucugggcugaaacaguccgaggccgagagcugcuauaucaauauugcucgcacacuggauuuuuacggagucgaacuccacucuggcagagaccugcauaaccuugaccugaugaucgggauugccuccgcuggaguggccguguaucggaaguacaucuguaccagcuucuacccuugggucaauauucucaaaaucuccuuuaagcgcaagaaauucuucauccaccaaagacagaagcaggcggagucucgggaacauauuguugccuuuaacaugcugaauuaucgcagcugcaaaaaccuuuggaaguccuguguggagcaccauacauucuuucaagcuaaaaagcugcucccgcaggagaaaaaugugcugagccaguacuggaccaugggcucuagaaacacgaagaagcggucccccagacugcgccacgaaauccggaaaccuagacacagcucugccgauaaucucgcuaacgagaugacauauauuaccgaaacagaggacgucuucuacaccuauaaggggagccuggcuccccaggauuccgacucugaagugagccaaaaccgcuccccucaucaggagagccuuucugaaaauaaccccgcgcaguccuaccugacccagaaaucuagcuccagcguuuccccgucuagcaaugccccuggauccugcucucccgauggcguggaccaacagcuccuggaugacuuucaccgggucacaaagggcgggagcacggaggaugcuucccaguauuacugugacaaaaacgauaauggagacagcuaccuugugcugaucagaauuaccccugacgaggauggcaaguucggguuuaaccucaagggaggcguugaccagaaaaugccccugguggucucucgcaucaaucccgaauccccugccgauacaugcaucccgaagcugaacgagggggaccaaauugugcucaucaauggacgggauauuagcgaacauacccacgaccaggucgugauguucaucaaagccucuagagagucccacagccgcgaacuggcccuuguuauucggagacgcgccgugcggucuuuugcugauuucaagagcgaggacgagcugaaccagcucuuucccgaagcgaucuucccuaugugucccgagggcggcgauacacuggaaggguccauggcccagcugaaaaagggacuugagagcggcaccguccucauccaauuugagcagcuguauagaaagaaaccugggcuggcuauuacguucgccaagcucccccagaaucuggacaaaaaccgguacaaggaugugcuuccguaugacacaacccgcguucugcuccaaggaaaugaagauuacaucaacgccucuuaugugaauauggagauuccugcugccaaccuggucaacaaauacaucgcgacccagggcccccugccucauacaugcgcucaguucuggcaaguggugugggaccagaaacuuucccucauuguuaugcugaccacacugacggaaagagggcggaccaagugccaccaguauuggcccgacccucccgaugucaugaaucauggcggauuucacauccagugucagagcgaggacugcacaauugccuacguguccagagaaaugcucgugaccaacacacaaaccggcgaggagcauacggucacccaucugcaguacguggccuggccggaucacgggguuccugacgauucuagcgacuuccuugaauuugugaauuauguccgcucccugcggguggauucugagcccguucucgugcacuguagcgcuggaaucggcagaacagggguccuggugaccauggaaacagccaugugccugaccgagcgcaaccuucccaucuacccucucgacauuguuagaaaaaugcgggaucagcgcgcuaugauggugcagacguccucucaauauaaguucgucugugaagccauccugagaguguacgaggagggacuggugcagaugcucgacccgagcuga

SEQ ID NO: 74442 - RNA, 2781 nt, Artificial Sequence
  derived and/or modified sequence opt5 from PTPN4__Homo_sapiens__NP_002821
augaccagcagauuccggcugcccgccggccgcacauacaacgugagagcuuccgagcucgcccgggaccgccagcacacggaagucguuugcaauauccugcuucuggauaacaccgugcaagcguuuaaggugaauaaacaugaccaggggcagguccuccuggaugugguuuucaagcaccuugaccugacagagcaggauuauuuuggacuccaacuggcugacgauucuaccgacaacccuagauggcuggauccgaauaaacccauucggaagcagcucaaacgcggcagcccuuacucccugaacuucagagugaaguuuuucgucucugaccccaauaaacuucaggaagaguauacacgguaccaguauuuucugcaaaucaaacaggauauucucaccgggcgccugccuugucccagcaacacagccgcccuucuggcuuccuucgccgugcagucugaacucggagacuacgaucagagcgagaaucuguccggcuaucugagcgacuacucuuuuaucccuaaccaaccgcaggacuucgagaaggaaauugcuaaacuccaucagcaacacaucgggcugucccccgccgaggcggaauuuaauuaccuuaacaccgccagaacgcuggagcucuauggaguugaguuccauuacgcucgggaucagagcaauaacgaaaucaugauuggcgugaugucuggcgggauccugauuuauaagaaucgcgucagaaugaacaccuuuccuuggcuuaaaaucgugaagauuuccuucaagugcaaacaguucuuuauccagcugcggaaggagcuccacgaaagccgcgagacacugcugggauucaacauggugaauuacagagccuguaaaaaccucuggaaggcuugcgucgaacaccauaccuuuuuccggcuggacagaccccuuccuccccaaaagaacuuuuucgcccacuauuuuacacugggcucuaaguuccgcuacugugggcggaccgagguucaguccgugcaguauggaaaagagaaggcgaauaaggauagaguguuugcccgcagcccguccaaaccucucgcucggaagcugauggacugggaagucgugucuagaaauagcauuuccgaugaccgccuugagacgcagagccugcccucucgguccccucccggcacacccaaccauagaaauagcaccuucacacaagaagggacccgccuccggccuucuagcguuggacaccugguggaucacaugguccauaccuccccgucugagguguuuguuaaccagagaagccccuccagcacacaggccaauucuaucgugcuggaauccagcccuucucaggagacgcccggcgacggcaaaccucccgcucucccgccuaagcaauccaaaaagaacagcuggaaucagauccacuacucccauucucagcaggaucuggagagccacauuaacgaaaccuucgacauccccuccucuccugagaagcccacaccuaaugggggcauuccccaugauaaccuuguccugauccgcaugaaaccggacgaaaauggacgguuuggguucaacgugaagggaggcuacgaccaaaagaugccugucauugugagcagaguugcccccgggacccccgccgaucucugcgugccucggcugaacgagggagaccaggucgugcugaucaauggccgcgauaucgcugaacacacacacgaccagguugugcuuuucauuaaggcguccugugagagacauagcggcgagcucaugcugcugguccggccgaacgccguguaugaugugguugaagagaaacucgaaaaugagcccgacuuucaauacaucccugagaaggcuccccuggauucuguccaccaggacgaucauucccuuagagaaagcaugauucagcuggccgaggggcucaucaccggaacggugcugacacaguucgaccaacuguaucgcaagaaaccuggcaugaccaugucuugcgccaaacuuccccagaacauuuccaaaaaucgguacagagauaucagcccuuaugacgcuacccgcgugauccucaaggggaacgaagauuacauuaaugccaacuauaucaauauggagauucccucuagcuccaucauuaaccaguacaucgcgugucagggaccgcugccucacacaugcaccgacuuuuggcaaaugacaugggaacagggcagcucuauggucgugaugcugacgacccagguugagagagggcgggugaaaugucaccaguacuggcccgagccuacaggcuccagcuccuauggaugcuaccaagugaccugccauucugaagagggcaauacagcuuauauuuuccgcaagaugacccucuuuaaccaggaaaagaaugagagcagaccccugacgcagauccaauacaucgccuggccggaccacggggucccugaugacuccucugauuuccuugacuuuguuugucaugugcggaacaaacgcgccggaaaggaggaacccgucgugguucacugcagcgcuggcauugggagaaccggagugcugaucacaauggagaccgccaugugucucauugaaugcaaucagccugucuauccccuggauaucgugcggacaaugcgcgaccagagagcuaugaugauucagacccccucccaauaccgguucgugugugaggccauccugaaagucuaugaagagggcuuuguuaagccucuuacgacaucuaccaacaaauga

SEQ ID NO: 74443 - RNA, 1602 nt, Artificial Sequence
  derived and/or modified sequence opt5 from PTPN5__Homo_sapiens__NP_001265165
augaacuacgagggcgccagaagcgaacgggagaaucacgcugccgacgauuccgaagggggagcgcuggacaugugcuguucugagcgccuccccggccugccucagccgaucgugauggaagcucuugaugaggccgaggggcugcaagacagccagagagaaaugcccccucccccucccccuuccccgcccucugauccugcccagaagcccccuccccggggagcuggcagccauucccucaccguccgcucuagccugugccuuuucgccgcuucccaguuucugcucgagccgacagccuggcuggacagcgggacguggggaguuccuucucugcuccugguguuccuuuccgugggccugguccucgugaccacacugguuuggcaccuucugagaaccccucccgaaccucccacaccccucccgcccgaggaucggcgccaaagcgugucuagacagccuuccuuuaccuauagcgaguggauggaagagaaaauugaagacgauuuccuggaccuggaucccgucccugagacacccguguuugacuguguuauggauaucaagccggaagcggacccuaccucucucacggugaaauccaugggccugcaggagcggcgcgggagcaacgucucccuuacccuggacaugugcacacccggauguaaugaggaaggcuucggguaccucaugucuccuagagaggaaagcgcccgggaguaucugcuuuccgcuagccgcgugcugcaggccgaagaacuccaugagaaggcucuggaucccuuucugcuccaagccgaguucuuugagauuccuaugaacuucguggaccccaaagaauacgauaucccgggacuggucagaaagaaucgguauaagaccauucuuccuaacccccacucucgcguuugccugacaucccccgacccugaugacccgcucagcucuuacaucaaugcgaacuauaucagaggcuacgggggagaggaaaaaguguacauugccacccagggccccaucgugagcacggucgcugauuuuuggcggaugguguggcaggagcauacaccuauuaucguuaugauuaccaauaucgaggaaaugaacgagaaguguacagaauauuggcccgaggaacagguggccuacgacggcgucgaaauuaccgugcaaaaaguuauccacaccgaggauuauagacugcgccuuaucucccugaagucugggacagaggagcggggacucaaacacuacugguucacgagcuggccugaccagaagacccccgauagagcuccuccccugcugcaucucgugcgcgaagucgaggaggccgcccagcaagaaggcccgcacugcgcuccuauuaucgugcauuguuccgcggggauuggacggacaggcugcuuuaucgccaccagcauuuguugccagcagcugagacaggagggggucguggacauccuuaagacaaccugccaacugcgccaggaccggggaggcaugauccagacgugugaacaguaucaauucguucaccacgugaugucucucuacgagaaacagcugucccaucagagccccgaauga

SEQ ID NO: 74444 - RNA, 1788 nt, Artificial Sequence
  derived and/or modified sequence opt5 from PTPN6__Homo_sapiens__NP_002822
auggugagaugguuccaccgggaccugagcggccucgaugccgagacccugcuuaaggggcgcggaguccauggcuccuuucuggcuagacccucucggaaaaaccagggggacuucagccucuccguucgcgugggagaucaagugacacacauccggauucaaaauucuggcgacuuuuacgaucuguaugggggagaaaaguucgccacgcuuaccgagcuggucgaauacuauacacagcagcagggcgugcuccaggacagagauggcaccaucauucaucugaaauacccucugaacugcagcgacccgacauccgagcgcugguaucacgggcauaugucuggaggccaggcggaaacccuccugcaggcuaagggggagcccuggacauuucuuguuagagagagccugucccaaccuggagauuucgugcucagcguccugucugaccagcccaaagccggcccugggagcccccuucgggugacccacaucaagguuaugugugaaggaggccgcuacacggugggcgggcuggagaccuuugauucccucacagaccuggucgaacacuucaagaaaaccggaauugaggaggccucuggcgcuuuuguguaucugagacagccuuacuacgccacacgggugaaugcugccgauaucgaaaaccgcguccucgagcugaauaagaaacaggaauccgaggacaccgcgaaggccggguucugggaagaguuugagagccuucaaaaacaggaaguuaagaaccugcaucagagacucgagggacaacggccggaaaauaagggcaaaaaccgcuauaagaauauccugcccuucgaccacucuagagugauucuucaggggcgggauuccaacaucccuggaagcgacuacauuaaugcuaacuauaucaaaaaucagcugcucggccccgaugagaacgccaagacguacauugcuucccagggcugccuggaagccacagugaaugacuuuuggcaaauggcguggcaggagaacucuagagucaucgugaugaccacacgcgagguugaaaaagggcggaacaagugugugccuuauuggcccgaggucggaaugcagagagccuacggcccguauagcgugaccaauugcggggaacaugauaccacagaguacaaacugcgcacgcuccagguuuccccucuggacaacggagaucuuauucgggaaaucuggcacuaccaauaucugagcuggcccgaccacggcgugccuucugagcccgggggcguccucuccuuccuggaucagaucaaucagagacaggagagccuuccccaugcuggaccuauuaucgugcacuguucugccggcauugggcgcaccggaacaaucauugucaucgacaugcugauggaaaacaucagcaccaagggccucgauugcgacauugacauccaaaagacaauucagauggugcgggcucagagauccgggaugguucagaccgaggcccaauacaaauucaucuauguggccauugcucaguuuaucgaaacgacaaagaaaaagcuggagguccugcagucucaaaaaggacaggagagcgaauacggcaauaucaccuauccgcccgcgaugaagaacgcccaugcuaaggccucccgcaccagcucuaaacacaaggaggauguguacgaaaaucuccauacaaagaacaagcgggaggaaaaaguuaagaagcagagauccgccgacaaagagaaaagcaaagggucucugaagcgcaaauga

SEQ ID NO: 74445 - RNA, 1305 nt, Artificial Sequence
  derived and/or modified sequence opt5 from PTPN7__Homo_sapiens__NP_001186726
augaacagacugggcugcuggcccgcccggagccucccucgcuccgggagaggaucuggccagcggagccuggggcuuggaggccacccguccgggccccgccauccuggaacccccgcugccaagagaacaugggagucuccuggcgugcgggcgcgcgacuguccccugagcacguccuggcucucugaaccuccgcugggccccgcuccucaccuuagcaugguccaagcccaugggggaagaucccgggcccagccccugacccucagccugggcgcugccaugacacagccucccccggagaaaaccccugcuaagaaacacguucgccugcaggaaagacgggggucuaauguggcccucaugcuggaugugcgcucccuuggagcggucgagcccaucugcagcgugaacacaccuagagaaguuacccugcauuuccuccggacagccggccacccccugacccgcugggcccuucaaagacagcccccuucuccgaagcagcuggaggaggaauuucucaaaauucccuccaauuucgugagcccugaggaccuggauauccccgggcacgcuucuaaggaccgguacaagacgauucugccuaacccccaguccagagucugucucggacgcgcucaaagccaggaagauggcgacuauaucaaugccaacuacauucggggcuaugaugggaaagagaagguguacaucgcgacccagggaccgaugccuaauacaguuuccgacuuuugggagaugguguggcaggaagaggucucucugaucgugaugcuuacccaacugagagaaggcaaagagaagugcgugcauuauuggcccacagaagaggagaccuacgggccuuuccagauucgcauccaggauaugaaagaaugucccgaguauacgguccggcaacucacaauucaguaccaggaagagagacgcagcguuaagcacauccuguuuuccgccuggccugaccaucagacccccgaaagcgcuggaccgcuucugcggcucguggccgagguggaggaaucuccugagacagcugcccaccccggccccauugucgugcacugcuccgccgggaucggaagaaccggcuguuucauugcuacccgcaucggcugccaacagcugaaggcgagaggggaaguugauauccugggaauugugugucagcuccggcuggaccgcggcgggaugauccagacagccgagcaauaccaguuucuucaucacacgcuggcucucuaugccggacagcugccugaggaaccgagccccuga

SEQ ID NO: 74446 - RNA, 1782 nt, Artificial Sequence
  derived and/or modified sequence opt5 from PTPN9__Homo_sapiens__NP_002824
auggagcccgccaccgcuccuagaccggacauggcccccgaacugacaccugaggaagaacaggcgacgaagcaauuccucgaagagaucaacaaauggaccgugcaguacaaugucagcccccuguccuggaacguugcugugaaguuucuuauggcccggaaauucgaugugcugcgcgccauugagcucuuucacucuuauagagaaacacggcgcaaggagggcaucgucaaacugaagccucaugaagaaccccuuagaagcgagauucuguccgggaaguucaccauccucaaugugcgggacccuacaggagcuucuauugcccuguuuaccgcucgccugcaccauccgcacaaaagcguucagcaugugguccuccaggcccuguucuaccuucuggauagagcgguggacuccuuugaaacacaacggaacggccucguuuucaucuaugauaugugcgggucuaauuacgccaacuuugagcuggaccuuggaaagaaagugcugaaucuccugaagggcgcuuuccccgcccgccugaaaaagguccucaucgugggggcuccuauuugguuuagagugcccuauagcaucauuucccugcuucugaaggauaaaguccgggaacgcauccagauucucaagaccagcgagguuacgcagcaucugccuagagaaugucuucccgagaaccugggaggcuacgugaaaaucgaccucgccaccuggaauuuccaguuucugccgcaagugaacggccacccugaucccuucgacgagauuauccuguucucucucccucccgcgcuggauugggacuccguccacgugcccgggccucacgccaugacaauccaggaacuuguugauuaugugaaugcucggcagaagcagggaauuuacgaggaauacgaggacauccgcagagaaaacccggucggcaccuuucauugcagcaugucucccgggaaucuggagaaaaaccgguauggagacgugccuugucucgaucaaacaagaguuaagcugaccaaacgcuccggccacacgcagacagacuacauuaaugccagcuucauggauggguauaagcagaagaacgcuuacaucggaacccaaggcccccuugagaacacauaucgggacuuuuggcugauggugugggaacagaaaguccucgugauugucaugaccaccagauucgaggaaggcgggcgccggaagugcggacaguacuggccucuggagaaagauucuagaauccgcuuuggcuuccugacagugacgaaucucgggguugaaaacaugaaucacuauaagaaaaccacacuggagauccauaacaccgaggaacggcagaagagacaagugacacacuuucaguuccuuuccuggcccgacuacggagucccgagcuccgccgccucucugauugauuuucuccgcgugguucggaaucagcagagccuggcuguguccaacaugggcgcgagaagcaaggggcaauguccugagcccccuaucgucgugcauugcucugccggaauuggccgcaccggcacguucuguucccuggacaucugccuugcucagcucgaggagcuggggacacugaauguguuucagaccguuagccggaugagaacccagcgggccuucucuauucaaacacccgagcaguacuauuuuuguuacaaagccauccucgaguucgcugagaaggaaggaauggucagcuccggccagaaccugcuugccguggagucucaguga

SEQ ID NO: 74447 - RNA, 2409 nt, Artificial Sequence
  derived and/or modified sequence opt5 from PTPRA__Homo_sapiens__NP_002827
auggacagcugguucauccuggugcuccugggcuccgggcuuauuugcgucucugccaacaaugcuaccacaguugcccccagcgugggaaucacgagacugauuaacuccucuaccgcggagccugugaaggaagaggcuaaaacaagcaauccgaccuccucucucacaagccuguccgucgcccccaccuuuagcccuaacaucacacuuggccccaccuaccugacgaccguuaauucuuccgauagcgacaacgggacaacccggacagccucuaccaauuccauuggaaucacgaucagcccuaacggcacauggcuccccgauaaucaguucaccgacgcucgcacagaaccuugggaggggaacucuuccaccgccgcuaccacaccggaaacguuucccccuagcggaaauuccgauucuaaggacagacgggaugagacccccauuaucgccgugaugguggcgcugagcucccugcucgucauuguguucaucauuaucguucuguauaugcuucgcuuuaaaaaguacaaacaagccggcagccacucuaacuccuucagacugagcaauggccggacagaggacguggaaccucagucugucccccuccuggcucgcagcccguccaccaacagaaaguauccuccccuuccuguggauaagcuggaggaagagauuaaucggcgcauggccgacgauaacaaacucuuuagagaggaguucaacgcucugcccgccugucccauccaggcgacaugcgaagccgcuucuaaggaagagaauaaagaaaagaaccgguacgugaauauccugccuuaugaccauagccgcguccaccucaccccgguugagggggugcccgauuccgacuacauuaacgccagcuuuaucaauggauaucaggagaaaaacaaguucauugcugcccaaggcccuaaggaagagacggugaaugacuuuuggagaaugaucugggaacagaacacagccaccauugucauggugaccaaucugaaagagcggaaggaauguaaaugcgcucaguacuggcccgaucagggguguuggacauacggaaacauccgcguuucuguggaggacgucaccgugcuuguugauuauacagugagaaaguucugcauccaacaggucggcgacaugacgaaucggaaaccucagagacugauuacccaguuucauuucacauccuggcccgauuucggggugccguuuaccccuaucggaaugcucaaguuccugaaaaaggucaaggcguguaacccccaauacgccggcgcuauugugguucacugcagcgccggcguggggcgcacaggaaccuuugucgugaucgacgccaugcuugauaugaugcauacggagcggaaaguugacguguauggcuucgucucucgcauuagagcucagcggugucagauggugcaaaccgauaugcaguacguguuuaucuaucaggcccugcucgaacacuaccuguauggggacacagagcuggaaguuaccucccucgagacacaucugcagaagaucuacaauaaaauuccuggaaccagcaacaauggccuugaagaggaguucaagaaacugacguccaucaagauucaaaacgauaagaugagaacagggaaccuccccgcgaauaugaaaaagaaccgcguccugcagaucauuccuuacgaauuuaaucgggugaucauucccgugaaaagaggagaggaaaacaccgacuaugucaaugcuucuuucaucgacggcuaccgccagaaggauagcuauaucgccucccagggcccgcuucugcacacaauugaggacuuuuggcggaugaucugggaguggaaaucuugcagcauugugaugcucaccgaacuggaggaaagagggcaagagaagugugcccaguacuggccuuccgauggacugguuagcuauggcgacaucaccguggaacucaagaaagaggaggaaugcgagucuuacacaguccgcgaucugcuugugacgaacacccgggaaaauaaguccagacagauucggcaguuccacuuucauggguggcccgagguuggaauccccagcgacggcaaagggaugaucucuauuaucgcugccgugcaaaagcagcagcagcaauccggcaaccacccuauuacaguccacugcagcgcuggagccggccgcaccgggacauucugugcgcugucuaccgugcucgaaagaguuaaagccgagggaauccuggauguguuucagacggucaagagccugcggcuucagagaccgcauauggugcaaacacucgagcaguaugaguucugcuacaaggugguccaggaauacauugacgcuuucuccgauuaugccaauuuuaaauga

SEQ ID NO: 74448 - RNA, 6648 nt, Artificial Sequence
  derived and/or modified sequence opt5 from PTPRB__Homo_sapiens__NP_001103224
auggaggccgaguucuacauggugauccugaccugccucauuuuuagaaacagcgaaggcuuccagaucguccacguucagaagcagcagugucuguucaaaaaugaaaaggugguggucggguccugcaaccggacaauucagaaucaacaguggauguggacggaggacgaaaaacuucugcaugugaagucugcucucugucuggccaucuccaacuccucucgcggacccagcagauccgcgauucuugaucggugcucucaggcuccucgcuggaccuguuaugaccaggagggcuuccuggagguugaaaaugccagccucuuucugcaaaaacagggguccagaguggucgugaagaaggcccggaaauaccugcacagcuggaugaagaucgauguuaacaaagagggaaagcucgugaaugaaucucugugccuucagaaagcuggccugggggccgaggucuccgugcgcagcacaagaaacaccgcuccgccccagauccucacaaccuucaaugccgugccugacggacuggucuuucuuauucggaacacaaccgaggcguucauccgcaaugccgcugaaaacuauucucaaaauuccagcgagagacagcaucccaaccugcacaugacgggcauuaccgauacaucuuggguucucuccaccacacagccuuuuagcuccaccacggaagagacaggccuggccgaacccgagcgguguaauuucacccuggcugagucuaaggccagcucccauagcgugucuauccaauggcgcauucucggguccccuugcaacuuuagccugaucuacucuagcgacacacuuggagcggcccuguguccgaccuucagaauugauaacaccacauauggcugcaaucuccaggaccugcaggcugggacgaucuacaacuuucggaucauuucccuugaugaagaaagaaccgugguccugcagacagacccccucccucccgccagauucggagugucuaaggagaagaccacaagcaccucccugcacguuugguggacgccuagcucuggcaaggugacauccuaugagguccaacuguucgaugaaaauaaccagaaaauccagggggugcagauucaagagagcaccucuuggaaugaguacaccuuuuucaaccucacagcuggauccaaguacaauaucgccauuaccgccguuagcggcggcaaacgguccuuuucuguguauacaaacgggagcacgguccccuccccggugaaggacaucggaaucucuaccaaagcuaauagccugcuuauuuccuggagccacggcucugggaacgucgaaagauaccgccugaugcucauggauaagggaauccuggugcauggcgggguuguggacaagcacgcgacauccuaugccuuccauggacuuaccccuggcuaccuguauaaucucacagucaugaccgaggcugccggccugcagaacuaccgguggaaacuggugagaacggcccccauggaaguuagcaaucucaaggugaccaacgacgggucucugacaucccuuaaagucaaguggcagcgcccucccggaaauguggauagcuauaacauuacccugucucacaaaggcacaaucaaggagagccgggugcucgcucccuggauuaccgaaacgcacuuuaaggagcugguuccugggagacuguaccaggucacaguguccugugugagcggagagcuuucugcccagaagauggcggucggccgcaccuucccggacaagguggcuaaccucgaagccaauaacaaugggcggaugagaucccugguugugagcuggucucccccugccggcgauugggagcaguaccgcauccugcucuuuaacgacagcgucgugcugcuuaauaucacaguuggaaaagaagagacccaguaugugauggaugacaccggccugguccccgggcggcaguacgagguggaaguuauuguggagagcggaaaccucaaaaauuccgaaagaugccaaggccgcacagucccucuggcugugcugcagcuucgggugaaacaugccaacgagacgucucucagcaucauguggcagacccccgucgcugaaugggagaaguauauuaucucccuggccgauagagaccugcuccugauucacaagucucuuagcaaagaugcgaaggaguucacauuuaccgaccugguuccggggcggaaauacauggccacagugaccuccaucagcggagaucucaaaaauucuuccagcgugaaaggccgcacggucccugcucaagugacagaccugcauguugccaaccaggggaugaccucuucccuguucaccaauuggacacaggcucagggcgacguggaauuuuaucaaguccuucucauucacgagaacgugguuaucaagaaugaaagcaucucuuccgagaccagcagauacuccuuccauagccugaagucuggaagccuguauuccguggucgugacaacgguuucuggcgggauuagcucccggcaaguggucguggaaggaagaaccgugcccucuagcgucuccggcguuacagugaacaauucugggcgcaacgauuaccucagcguguccuggcugcuugccccuggagacgucgauaacuacgaggugacccugagccacgacggcaaaguugugcagucucucgucaucgcgaaguccgugcgggagugcagcuuuucuucccugacacccgggagacuguauaccguuacgauuaccacacgcagcggcaaauacgaaaaucacuccuucucucaggagagaaccgugccugauaagguccaaggagugagcgucuccaacagcgcccggucugacuaucuucgcguguccuggguucaugcuacaggcgauuucgaccacuacgaagugaccaucaaaaauaagaacaauuuuauucagacaaaaagcauccccaagucugagaacgaaugugucuucgugcagcucguuccggggagacuguauagcgugaccgucacgacaaaguccggacaguacgaggccaaugagcaaggcaacgggcggaccaucccugaacccgugaaagaucugacccuccgcaauagaucuacagaggaccugcaugugaccuggagcggagcuaacggcgauguugaccaguaugaaauucagcuucuguuuaaugauaugaaggucuuucccccuuuucaccucgugaacacggccacagaguaccgguucaccucccugacaccggggcgccaauacaaaauccuggugcuuaccauuucuggcgacguccagcagagcgccuuuaucgagggauucacagugcccuccgcuguuaagaauauucacaucagcccuaacggcgcgaccgacucucugacggugaauuggacccccgggggaggcgaugucgacuccuauacagugagcgccuuuagacauucccagaaaguugauucucaaaccaucccuaagcacguguucgaacauacauuucaccggcucgaggcuggggaacaguaccagauuaugaucgccagcgucuccggaucucugaagaaccagauuaacgugguuggccgcaccgugcccgccagcguccaaggcgugaucgcugacaaugccuauuccagcuacucucucauuguguccuggcagaaagcggcuggggucgccgagagauaugauauccugcuucugacggaaaacggaauccuccugcggaauacaagcgagccugccaccacaaagcagcauaaauucgaggaccugacccccggcaagaaauacaagauucagauccuuaccguuucugggggacuguuuuccaaggaagcucaaacagagggcagaacggugccggccgcggugaccgaucuccgcauuacagaaaacagcacccggcaccugucuuucagauggacagcuagcgagggggaacucuccugguauaauaucuuccuguacaacccugacggaaaucuucaggagcgcgcccaggucgauccccuggugcagucuuuuagcuuccaaaaccuccugcagggccggauguacaaaaugguuauugugacccacuccggcgagcugagcaaugaauccuuuaucuucgggagaacggucccugccucugugagccaucuucgcggauccaaccggaauacaaccgacucucugugguuuaacuggagccccgcuuccggcgauuucgacuuuuaugagcucauucuguacaauccgaacgggaccaagaaagaaaauuggaaggauaaagaccucacagaguggagauuccagggacugguuccuggccgcaaguaugugcuuugggucgugacccacucuggggaccugagcaacaaggucacagccgaaucccggacggcucccagcccucccucucugauguccuuugccgauaucgcgaauaccagccucgccaucacauggaaaggacccccugacuggaccgauuacaacgacuucgagcugcaauggcuuccgagagaugcucugacaguguuuaaccccuauaauaaccggaagucugagggccgcauuguuuacggccucagaccugggcgguccuaucaguucaaugugaaaaccgugagcggagacucuuggaagacguacuccaaacccaucuucggcagcguccgcaccaagccugauaaaauucagaaccugcauugcagaccccaaaauuccacagccaucgcuuguagcuggauuccuccggacucugauuuugacggguacagcaucgaaugccggaagauggauacccaagagguugaguucuccagaaagcucgagaaagagaagucucugcuuaacaucaugaugcuggugccccacaaacgcuaucuggugagcauuaagguccaguccgccggaaugacaucugaagugguugaggacagcaccaucacaaugauugaccggccucccccucccccgccucauaucagagugaaugaaaaagauguccucauuuccaagucuagcaucaacuuuacggugaauuguuccugguucagcgacaccaacggcgccgucaaguacuuuacagugguugugcgcgaggcugaugggucugacgaacugaaacccgagcagcagcacccccuuccuuccuaucuggaguaccggcacaaugcgagcaucagagucuaucaaaccaacuacuucgccucuaagugcgcugaaaaucccaacuccaauagcaaauccuuuaacauuaagcucggagccgagauggaaucucugggcggcaaaugugauccuacccagcagaaguucugcgacgggccgcucaagccccauacagccuaucgcaucagcauucgggcuuuuacgcagcuguucgaugaggaccuuaaagaauuuaccaagccucuguacuccgauacauucuuuagccugcccaucaccacagagucugagccucucuucggagccauugaaggcguguccgcggggcuguuccuuaucggaaugcugguugcuguggucgcccuccugauuuguagacaaaaagugagccacggccgcgagagacccucugcccggcucagcauccgcagagaccggccgcuguccgugcaucuuaaccuggggcagaagggaaaucgcaaaaccucuugcccuaucaagauuaaccaguuugaaggccacuucaugaagcugcaagcugauagcaauuaccuccuguccaaagaguaugaagaacuuaaggacguuggcagaaaccagucuugugauaucgcccugcuccccgagaaucgggggaaaaacagauacaauaacauucugccuuaugacgcgacgcgcgucaagcugagcaauguggacgaugaccccugcuccgauuacaucaacgcuagcuauauuccuggaaauaacuuucggagagaauacaucgugacacagggcccccucccggggaccaaagacgauuucuggaagauggucugggagcagaauguucacaacaucgugauggugacccaaugcgucgaaaagggacgcgugaaaugugaccauuauuggccugccgaucaggacucucuuuacuacggcgaucugauucugcagaugcucuccgagagcguucugcccgaguggacaauccgggaauuuaagauuugcggggaggaacagcuugacgcccacagacugauccggcauuuccacuauaccguguggcccgaucauggagucccugagacaacccaaucccucauucaguuugugcgcacgguuagagacuacaucaaucggucuccgggcgcuggccccacagugguccacuguagcgccggggugggacgcaccggcacauucaucgcucuggaucgcauucugcagcagcucgacuccaaagacucuguggauaucuauggggccguccacgaccuucggcugcaucgcguucacauggugcaaaccgaaugccaguacguguaucugcaucagugugucagagaugugcuccgggcgcgcaagcugagaagcgagcaggagaacccucuuuuucccauuuacgaaaacguuaauccugaguaucaccgggaccccguguacuccagacacuga

SEQ ID NO: 74449 - RNA, 621 nt, Artificial Sequence
  derived and/or modified sequence opt5 from PTPRCAP__Homo_sapiens__NP_005599
auggcccugcccugcacccucggccuggggaugcuucuggcucucccuggagcccugggcagcgggggauccgcggaggacucugugggcagcuccucugucacaguugugcuucugcuccugcugcuccugcuucuggcuacggggcucgcccuggccuggagacggcuuagccgcgauuccggaggcuacuaucacccggcuagacugggcgccgcucucugggggcggacccgcagacugcugugggccucucccccuggacgguggcuccaggcgcgcgccgaacugggcagcacagacaacgaucuugagagacaagaagacgagcaggauaccgacuacgaucauguggcugacgggggacugcaggccgaucccggcgaaggggagcagcaauguggagaggcuuccagcccugaacagguccccgugcgggccgaggaagcgcgcgacucugauacagagggcgaccucguucugggcuccccugggccggccagcgcuggaggcucugccgaggcccuucuguccgaucuccacgcuuucgccgggagcgcugcgugggacgacucugccagagcugccggaggccaggggcugcaugugaccgcccuguga

SEQ ID NO: 74450 - RNA, 4509 nt, Artificial Sequence
  derived and/or modified sequence opt5 from PTPRD__Homo_sapiens__NP_001035802
auggugcacgucgccagacugcuccugcuucugcucaccuucuuucugcggacagacgcugagacgcccccucgcuucaccagaacaccgguugaucagaccggcgugagcgggggaguggccuccuuuaucugccaagcgacaggcgacccccggccuaagauugucuggaacaaaaaggggaaaaaggugucuaaucagcgcuucgaaguuaucgaguuugaugacggaagcggcuccgugcuucggauucagccccugcggaccccucgcgaugaagcuaucuacgagugugucgccucuaacaaugugggggaaauuagcguuuccacaagacucaccgugcugcgggaggaccagaucccccgcggauucccuacgaucgauaugggcccgcaacugaaagucguggagagaacccggacagccaccaugcucugcgcugccucuggcaaccccgacccugaaauuacaugguuuaaggauuuccugcccguggacaccagcaauaacaaugggcgcaucaagcagcuuagauccggaggcacgccuauuagaggggcucugcagaucgagcagagcgaagagucugaucaaggaaaauaugagugugucgccacaaacuccgcgggcacccgcuacagcgcccccgcuaaucucuauguuagagaacugcgggaggugagacgcgugccgccucgguuuucuauucccccuacaaaccaugaaaucaugcccgggggauccgucaauauuaccugcguggccguuggcagccccaugccuuacgugaaguggaugcuuggcgcugaggaccugaccccggaagaugacaugcccaucgggagaaacguccucgagcugaaugacgugcgccagucugccaacuauacauguguugcgauguccacgcugggagugaucgaggccauugcucagaucaccgucaaagcccucccuaagcccccuggcacacccguggucaccgaaagcacagcuaccuccauuacgcugacaugggauucugggaauccggagccugugagcuacuauaucauucagcacaaacccaagaacuccgaagaacuuuacaaggaaaucgacggaguugccaccacccgguacagcguggccggccugucuccuuauuccgauuacgaguucagagucguggcuguuaacaauaucgggcgcggacccccuagcgagcccgugcucacacaaaccucugaacaggcgccgagcuccgccccucgggacguccaggcuagaaugcugucuagcacaacgauucuugugcaauggaaagagcccgaggagcccaacggccagauccagggcuaucgcguguacuauaccauggauccuacacagcauguuaauaacuggaugaagcacaaugucgccgacucccaaauuaccacaaucgggaaccuggugccgcagaaaaccuacagcgugaagguccucgccuuuacgucuauuggagauggcccccuguccagcgacauccaggugaucacccagacagggguuccuggacaaccccugaauuucaaagcugaaccugagucugagaccuccauucuccugagcuggacacccccucgguccgauaccaucgccaacuaugaacuuguguacaaggacggcgagcauggggaggagcagagaauuacgaucgagcccggcacaucuuaccgccugcagggacucaaaccgaauagccuguauuacuuucggcuugcggcuagauccccucagggccugggggccucuaccgccgaaauuagcgcucggacaaugcaauccauguucgccaagaacuuccacgucaaggcugugaugaaaaccagcguucuccugucuugggagauccccgaaaauuauaacuccgccaugccuuuuaagauucuguacgaugacggaaaaaugguggaggaagucgacggccgcgcgacccagaagcucaucgugaaucugaaacccgaaaagagcuauucuuucguucuuacaaacagagggaacuccgccggaggccugcagcaccgggugacggcuaagaccgccccggauguccucagaacaaaaccugcuuuuaucgggaagaccaaccuggacggcaugauuacagugcagcugcccgaggugccugccaacgaaaauaucaaaggauacuauauuaucauugucccccuuaagaaaagccgcggcaaguucaucaagcccugggagucuccugaugaaauggagcucgacgaacugcugaaagagaucagccggaagagacgcuccauuagauacgggcgggagguugaacucaaaccguacaucgcggcccauuuugaugugcugcccaccgaguucacgcuuggagacgauaagcacuauggcggguuuacaaacaaacaacugcagagcggacaggaauacguguucuuuguccucgcugugauggagcaugccgaaucuaagauguaugcuaccuccccuuacagcgaccccguuguguccauggaucuggacccucaacccauuaccgaugaggaggaaggccugaucugggucguggggccuguucuugccguggucuucauuaucugcaucgugauugccauccuccuguauaagucuaaaccggaccgcaagagagcugagagcgauucccggaaaucuagcauucccaauaacaaggaaaucccuucccaccaccccacagacccuguugagcugcgcagacucaauuuucagacccccggcauggcgucucauccgccuauucccauccuggagcuugccgaccacaucgaacggcugaaagcuaacgauaaucucaaguucagccaggaguacgaauccauugaccccggacagcaauuuacaugggagcauagcaaccuggaagugaauaaaccuaagaaccgcuaugccaaugucaucgccuacgaucacucuagagugcugcuuuccgcuauugagggcauccccgggagcgacuacgugaacgccaauuauauugauggauaccggaagcagaacgcguauaucgcuacgcagggcucucucccugagaccuucggggacuucuggcgcaugauuugggaacagagauccgccacagucguuaugaugaccaaacuggaggaacggagcagagugaagugugaucaauacuggccgucucgcggaacagagacccauggccuggugcaggucacgcuccuggacaccguggaacuugccacauauugcguucggaccuuugcucuguacaaaaauggguccagcgagaagagagaggugcgccaguuccaguuuacagccuggcccgaucacggcgucccugaacaccccaccccuuuccucgcguuucugcggagagugaaaacauguaaucccccggacgcuggaccuaugguugugcauugcuccgccggcgucgggcgcaccggauguuucaucgugaucgaugccaugcuggagcggauuaagcacgaaaagacggucgacaucuauggccaugugacacuuaugagagcucaacgcaacuacaugguucagaccgaggaucaguacauuuuuauccacgacgcccuccuggaagcugugaccugcgggaauacagagguccccgcccggaaccuguaugcguacauucaaaaacucacccagaucgagacgggagaaaaugugacaggcauggagcuggaguucaagagacuugccagcucuaaagcucacaccagccgguuuaucuccgccaaccugccuugcaauaaguucaaaaaccgccucguuaauauuaugcccuaugaaucuacaagagugugucugcagccuauccggggcgucgaggggagcgacuacauuaacgcuuccuuuaucgauggauaucgccagcaaaaggccuacauugccacccagggcccccuggcugaaacaaccgaggacuucuggagaaugcuuugggaacauaauucuacgaucguggugaugcugaccaagcuccgggagauggggagagaaaaaugccaccaguauuggccggcggagcgcagcgcccgguaccaguacuuuguugucgauccuauggcugaguauaacaugccccaauacauccugagagaguucaaggugacagacgcccgcgauggacagucccggaccgugagacaguuccaguuuacagacuggcccgaacaaggcgucccuaaaucuggggaaggauucauugauuuuaucggccaggugcauaagaccaaagagcaguucggccaggacgggccgauuagcguucacuguuccgccggagugggccgcacgggggucuuuaucacacucagcauugugcuggaacggaugagauaugagggaguuguggauaucuuccaaaccgucaagaugcuucgcacacagagacccgcuauggugcagaccgaggaccaauaccaguuuucuuaucgggccgcgcuggaauaccucggcuccuucgaucauuaugcuaccuga

SEQ ID NO: 74451 - RNA, 2103 nt, Artificial Sequence
  derived and/or modified sequence opt5 from PTPRE__Homo_sapiens__NP_006495
auggagccccugugcccucuccugcuugugggcuucagccugccgcucgccagagcucugcgggggaacgaaaccacagccgacuccaaugagacgaccacaaccucuggacccccugaucccggcgcgagccagccucuucuggcuuggcuccugcugccccuccugcuucugcuccugguccuucugcucgccgccuacuuuuuccgcuuuagaaagcaacggaaagcuguuguguccacaucugacaagaaaaugccuaacgggauccuggaagaacaggaacagcagcgcgugaugcugcucagcagauccccgucuggacccaagaaauauuucccuauucccgucgagcaccuggaggaagagauccggauucgcagcgccgaugacuguaagcaauuuagagaagaguucaauucccuuccuagcggccauauccaggggaccuuugagcuggcuaacaaggaagagaaucgggaaaagaaccgcuaccccaauauucucccgaacgaucacucuagagugauccugucccagcuugacggaaucccuugcagcgauuauauuaaugccucuuacaucgacggcuauaaggagaaaaacaaguucauugcggcccagggccccaaacaagaaacaguuaaugauuuuuggcggauggugugggagcagaaguccgcuaccaucgucaugcugacgaaccucaaggagcgcaaagaagagaagugucaucaguacuggccugaccaggggugcuggaccuauggaaauauuagaguguguguugaagauugcgugguccugguggacuacacaauccggaaauucuguauucaaccccagcugcccgauggcugcaaggccccucgccucgugagccagcugcacuuuaccucuuggccggacuucgggguccccuuuacaccuaucggaaugcuuaaauuccugaagaaaguuaagacccucaaccccgugcaugcuggcccuaucgugguccacuguuccgccggggugggaagaacgggcacauucauuguuaucgacgcgaugauggccaugaugcacgcugagcaaaagguggaugucuuugaguucgugagccggauuagaaaucagcgcccccagaugguucagaccgacaugcaauacacauuuaucuaucaggcccugcuugaguacuaucuguacggcgauaccgagcucgacguguccucucuggaaaaacaucugcagaccaugcacgggacaacgacccauuucgauaagauuggacucgaggaagaguuucggaaacugacaaacgucagaaucaugaaggaaaacaugcgcaccggcaaucuuccggcuaacaugaaaaaggcccgggugauccagauuaucccuuaugacuucaauagagucauucugagcaugaagcgcgggcaagaguacacagauuauaucaacgccuccuuuauugacggauaccggcagaaagauuacuucaucgcuacccagggcccccucgcgcacacgguggaggacuuuuggagaaugaucugggaauggaaaagccacacaauuguuaugcugaccgaggugcaggaacgcgagcaagauaaaugcuaucaguacuggccuaccgaggggucugucacacauggagaaaucaccauugagaucaagaaugacacacuguccgaagccauuagcauccgggacuuccuugugacgcucaaccagccccaggcuagacaagaggaacagguucgcgugguccggcaguuucacuuccauggcuggccugagauuggcauccccgccgaggggaaaggaaugaucgaucugauugccgcugugcaaaagcagcagcagcaaaccggcaaucacccgaucacagugcauuguucugccggggcgggaagaaccggcacauuuauugcucugagcaacauccucgaacggguuaaggccgaggggcugcuugacgucuuccaggccgugaaaucccugcgccuccagagaccucacauggugcagacccuggaacaauaugaguucugcuacaaggucgugcaggauuuuauugacaucuucucugauuaugcuaauuuuaaauga

SEQ ID NO: 74452 - RNA, 4338 nt, Artificial Sequence
  derived and/or modified sequence opt5 from PTPRG__Homo_sapiens__NP_002832
augagacggcugcucgagcccugcugguggauccuguuccuuaagauuaccagcuccgugcugcacuacgucguuuguuuuccugcccucacagaaggcuaugugggggcucugcaugagaaccgccacggaucugccgugcagaucagacggcgcaaagcgagcggcgacccguacugggcuuauuccggggccuacggacccgaacauugggucacgucuagcguguccugcggcgggagacaccaaucuccuauugauauccuugaccaguaugcccggguuggagaggaauaccaggagcugcagcucgauggcuucgacaaugagagcuccaacaagaccuggaugaaaaauacaggcaagaccguggcuauucugcugaaagaugacuauuuugucagcggggccggacuccccggccgcuucaaggcugaaaagguggaguuucauugggggcacucuaacggauccgccggcagcgaacacucuaucaaugggagacgguucccuguugagaugcaaaucuuuuucuacaaccccgaugacuuugauuccuuccagacagcgauuagcgagaaucgcaucauuggagccauggcuaucuuuuuccaggugucuccuagagacaacuccgcccuggauccgauuauccauggccuuaaaggcgucgugcaccaugaaaaggagaccuuucuggaccccuucgugcuccgggaucugcuuccugcuagccugggguccuacuaucgcuacacaggaucucucaccacgcccccuuguagcgaaauugucgaguggaucguuuucagacggcccgugccgaucuccuaucaccagcuggaagccuuuuacagcauuuucaccacagagcaacaggaccacgugaaaucugucgaguaucugcgcaauaacuuuagaccucagcagcggcuccaugacagagugguuuccaagagcgcggugcgcgauucuuggaaucacgacaugaccgauuuccuggaaaacccccuuggcacagaggccagcaaagucugcuccucuccucccauccauaugaaggugcaaccccugaaucagaccgcucuccagguuagcuggucccaaccugaaacgauuuaccacccgcccaucaugaacuauaugauuagcuacucuuggacaaagaaugaggacgaaaaagagaagaccuuuacaaaagauuccgacaaggaucugaaagccaccaucagccaugugucuccugacucccuuuaccuguuccggguccaggcuguguguagaaacgauaugcgcagcgacuuuucccagaccaugcuguuccaggccaacacaacgcggaucuuucaagggaccagaauugucaagacaggagugcccaccgccucuccugcuagcuccgcggauauggcccccaucucuagcggcuccagcacauggaccucuuccgggauuccguucagcuuuguuucuauggcuacgggaaugggcccuuccagcucuggcagccaggccacaguggccuccgucgugaccagcacccugcuggcugggcucggauucggcgggggaggcaucucuuccuuucccagcacaguuuggccuacccgccugcccacagccgcguccgcuucuaaacaggccgcccggccugugcuugcuacgaccgaggcccuggcuagccccgggccggacggcgacuccucuccuacaaaggauggagaaggcaccgaggaaggggagaaggacgaaaaauccgaguccgaggauggagaaagagagcacgaagaggacggcgagaaggauucugagaaaaaggagaaaagcggggucacacacgccgcggaagaacgcaaucagaccgaacccucccccacgccuagcucuccgaaccggaccgccgagggaggccaucaaacaauucccgggcacgagcaggaccauaccgcugugccuacagaucagaccggcggaagacgcgacgccggccccgggcucgauccugacauggugacguccacacagguucccccuaccgcuacagaggaacaauaugccggaagcgaucccaagcggccggaaaugccuucuaagaaacccauguccagaggcgaccgguucagcgaggauucucgcuucaucaccgucaauccugcggaaaagaacaccuccgggaugaucagcagacccgccccgggacggauggaguggauuaucccucugauugugguguccgcucuuacauuugucugccugauccuccugauugccgugcugguuuacuggagaggcuguaauaaaaucaagagcaaaggguucccccgccgguuuagagaggugccuucuagcggcgaacgcggagagaagggcuccagaaagugcuuccagacggcucacuuuuaugucgaagacucuagcagcccccgggugguucccaacgagucuauuccuaucaucccgauucccgacgauauggaagccaucccugugaaacaguucgucaagcacauuggggagcucuacagcaauaaccagcauggauuuuccgaggacuucgaagaggugcaacgcuguaccgccgauaugaauaucacagcugaacacucuaaccaucccgagaauaaacacaagaacagauauauuaauauccuggcguacgaccauagccggguuaaacuucgcccucugcccggcaaggauuccaagcacagcgacuauaucaacgccaauuacguggauggguacaacaaagcuaaggccuauauugccacccagggaccucucaaaucuacauuugaggacuucuggagaaugaucugggaacagaacaccggcauuaucgucaugauuacgaaucugguggagaaggggcggcgcaaaugcgaucaauacuggccgacagaaaacuccgaggaauauggcaauaucaucgugacccucaagagcaccaaaauucacgcuuguuacacagucagacgguuuucuauccgcaacaccaagguuaagaaaggacagaagggcaaucccaaagggagacagaacgagcggguggugauucaguaucauuacacacaauggccugacaugggaguccccgaguaugcccuuccugugcucacguucguuagacgcuccagcgcggcucggaugcccgaaaccggcccggugcugguccacugcuccgccggggugggaagaacaggcaccuacaucguuauugauucuaugcugcagcagaucaaggacaaaagcacagugaauguccucggcuuucugaagcauauccgcacccagcggaacuaccuugugcaaacggaggaacaguauauuuucauccacgaugcccugcucgaggcuauucuggggaaggaaaccgagguuuccagcaaucagcugcauucuuacgugaacuccauccuuauuccuggagucggcgggaaaacaagacucgagaagcaguucaaacuggugacccaaugcaaugccaaguauguggaauguuuuagcgcgcagaaagagugcaacaaggaaaagaaucgcaacucuagcgucguucccuccgagcgggcuagagugggacuggcuccccucccuggcaugaaagggacagacuacaucaaugccucuuauauuaugggauacuaucgcagcaacgaguucaucaucacccagcacccccugccucacacaaccaaggacuuuuggcggaugauuugggaucauaacgcucaaaucauugugaugcuuccggacaaucagucccuggccgaagaugaguucgucuacuggcccucuagagaagagagcaugaacugugaagccuuuacggugacacucaucuccaaagaccggcugugccugagcaaugaggagcagauuaucauccacgauuucauucuugaagccacccaggacgauuacguucucgaggugcgccauuuucaauguccuaaguggcccaacccugacgcgcccaucucuuccaccuucgaacugauuaaugucaucaaagaggaagcccugacaagagauggcccgaccauugugcacgacgaguauggcgcuguuagcgccgggaugcucugcgcucugacgacacuuucccagcagcuggagaacgaaaaugccguggaugucuuucagguggccaagaugaucaaccucaugcggccuggagucuucaccgacaucgagcaauaccaguuuauuuauaaggcuaugcugucucuggugagcacaaaagaaaauggcaacgggcccaugaccguugacaagaauggagcggugcuuaucgccgaugaguccgacccugcugaaucuauggagagccucgucuga

SEQ ID NO: 74453 - RNA, 2814 nt, Artificial Sequence
  derived and/or modified sequence opt5 from PTPRH__Homo_sapiens__NP_001154912
auggccggcgcugggggaggccuggggguguggggaaaccucguccugcuuggccugugcagcuggaccggggccagagcgcccgcuccuaauccgggacggaaccucacaguugagacgcagaccacauccucuaucagccuguccugggaagugcccgacggccuugauucucaaaauagcaacuacugggugcaguguaccggcgacgggggaacaaccgagacacgcaauaccacggccaccaacgucacaguggauggccuggggccuggaucccucuauaccugcucuguuuggguggaaaaggacggcgucaauagcuccguggggacaguuaccacggccacagcucccaacccugugagaaaucugaccgucgaggcccagacaaacagcucuauugcucugaccugggaagugcccgauggaccugacccgcaaaauuccaccuacggcguggaguauacaggcgaugggggacgggccggcacgcgcagcaccgcgcacacaaacaucaccgucgacagacucgagcccgggugucuguacguuuucucugugugggugggcaaaaauggaauuaacuccagccgggaaacacgcaaugccaccacggcuccuaaccccgucagaaaccuucauauggagacacagaccaauucuuccaucgcccugugcugggaagugccugaugggcccuauccgcaggacuacaccuauuggguugaguacacaggagauggcggcgggaccgagacacggaacacgaccaauacaagcgugaccgcugaacgccucgagccuggaacacuguacaccuuuuccgucugggccgaaaagaacggcgcgagagggucucggcagaaugugagcauuuccacgguucccaacgccgugaccagccuuucuaaacaggacuggacaaauuccaccaucgcucugcgcuggacagccccucaaggacccggccagagcucuuauagcuacugggucuccugggugagagaggggaugaccgauccccggacgcagucuacaagcggcaccgacaucacacucaaggaacuggaggcuggaucccuguaucaccucaccgucugggccgagcgcaacgaagugagaggcuacaauagcacccugacagccgcuacggcgccuaacgagguuaccgaccuucagaaugaaacacaaaccaaaaacucugugaugcugugguggaaggccccgggggauccccauucccagcucuaugucuacugggugcagugggcuagcaagggacacccucggagaggccaagacccccaggccaauuggguuaaccagacaucucgcaccaaugagacgugguauaaaguggaagcccuggagccugggacacuuuacaacuucaccgucugggcugagcggaacgauguggccuccagcacccagucccugugugcgucuacauaccccgacaccgugacaauuacgagcugcguuuccaccucugcuggauauggcgucaaucucaucuggagcuguccgcaagggggcuacgaagccuuugagcuggaagugggaggccagagagggucccaggaucgcagcucuugcggagaggccguguccguccugggccucgggccugcucggagcuaucccgccacaauuaccacaaucugggacggaaugaaggugguuucucauuccguggucugucacaccgaaagcgcuggcgugauugccggggcguucguuggcauccugcuuuuucugauucucgugggacugcuuaucuucuuucugaaaagacgcaacaagaaaaagcagcaaaagccugagcuccgggaucuggucuucucuagccccggcgacaucccugccgaggauuuugcugaccacgugcgcaaaaaugaaagagauuccaacugcggguucgccgacgaguaccagcagcugagccucguuggacauucucagucccaaaugguggcuagcgccuccgaaaauaacgcgaagaaucgguauagaaacguccugcccuacgacuggucucgcgugccgcuuaaaccuauucacgaggagcccggcagcgauuauaucaaugccuccuuuaugcccgggcuguggucuccucaggaguucauugcuacgcagggaccgcucccccagaccgugggcgacuuuuggcggcuggucugggagcaacagagccauacacugguuaugcuuaccaacuguauggaagccgggagagugaagugcgagcacuacuggccucucgauucccagcccugcacacacggccaucugcgggugacccuggucggagaagaggugauggagaauuggacaguucgcgaacuccugcuucugcaaguggaggaacagaaaacccucucugucagacaguuccacuaccaggcuuggccugaccauggcgugcccagcuccccugauacgcugcuggccuucuggcggaugcuuagacaauggcucgaccagacaauggaagggggacccccgaucguucacuguagcgccggcguggggcgcaccggaacccugauugcucuggauguccuccugcggcagcuucagucugaaggccugcucggcccuuuuuccuucgugagaaagaugcgcgagagcagaccccugaugguucaaacagaggcgcaguauguguuucugcaucagugcauccuucgguuccuccagcaaucugcccaggcuccugccgaaaaagagguccccuacgaagacguggagaaccugaucuaugaaaauguggccgcuauucaggcccacaagcuggaggucuga

SEQ ID NO: 74454 - RNA, 1620 nt, Artificial Sequence
  derived and/or modified sequence opt5 from PTPRJ__Homo_sapiens__NP_001091973
augaagcccgccgcuagagaggcccggcugccuccgcgcagccccggccucagaugggcgcugccucuucugcuccugcuucugcggcucgggcagauccugugcgcuggaggcacccccuccccuauucccgacccuucuguggccacagucgccacgggggaaaacggaaucacccaaauuagcuccacagcugagucuuuccacaaacagaauggcaccgggacaccgcagguugaaaccaacacaagcgaggauggagaauccucuggcgccaaugacagccugcgcacccccgagcagggcuccaacgggacggauggagcuagccaaaagaccccuucuuccacaggccccagcccuguguuugacaucaaagccgugucuauuucccccaccaaugucauccucacauggaaaagcaacgauaccgcggccucugaguacaaguaugugguuaagcauaagauggaaaaugagaaaacgaucacagugguccaccagccgugguguaacauuaccgggcugagaccugcuacauccuacguguucagcaucacccccggaauuggcaaugaaaccuggggagacccucggguuaucaaggugauuacagagcccauccccgucuccgaucuucgcguggcccugacgggggugagaaaagcugcccucucuuggagcaacggcaauggcaccgcguccugccggguccugcuugagagcauugggucucaugaggaacugacacaggacucccgccuccagguuaacaucagcggacugaagccuggcgugcaauauaauaucaacccguaccugcuccagucuaauaaaaccaagggggauccccugggaacagaaggcgggcuugacgccagcaacaccgagagaucccgggcuggaucuccuacggcccccgugcacgaugaaagccuggucggcccuguggaccccuccagcggccagcagucucgcgauacagagguucuccugguggggcuugagccgggaaccagauauaacgcuaccgucuacucccaagccgccaauggcacagaagggcagccucaggcuauugaguuucggaccaacgcgauccaaguguucgacguuacagccgugaauauuagcgcuacgucucugacccucaucuggaaggucuccgacaacgaaagcuccucuaauuauacauacaaaauucauguggccggagagaccgauagcuccaaccugaaugucucugaaccccgcgccgugaucccuggccugagaagcuccacauuuuacaacaucaccguuugucccgugcucggggacauugagggcacgccuggauuccugcagguccacacacccccggugccuguuagcgauuuucgggugaccgucgugucuaccacagagaucggccuugcuugguccagccacgacgccgaaucuuuccagaugcauauuacccaggagggggcgggaaauuccagaguggaaaucacgacaaaccaaagcauuaucaucggcgggcuguuucccggaaccaaguauugcuucgagauuguucccaaaggcccuaaugggacagaaggcgcuucucgcaccgucuguaaccggaccggauga

SEQ ID NO: 74455 - RNA, 4341 nt, Artificial Sequence
  derived and/or modified sequence opt5 from PTPRK__Homo_sapiens__NP_001129120
auggacaccacagccgcugccgcgcugcccgcuuucguggcccuccugcuucugagcccuuggccgcuccugggcuccgcccaggggcaauuuucugcuggaggcugcacguucgaugacgggcccggagccugugauuaccaccaggaccuuuaugaugacuuugaguggguccauguuagcgcucaggaaccucacuaccugcccccugagaugccccagggcuccuauaugaucguggauucuagcgaccaugauccuggggaaaaggccagacuccaacugccgaccaugaaagagaacgacacacacugcauugauuucuccuaccugcucuauucucagaagggacugaaucccggcacccuuaacauccuggugcgggucaauaaaggcccucucgcgaaccccauuuggaaugugacaggguuuaccggacgcgacuggcugagagccgaacuugcuguuagcacauucuggccuaacgaguaccaggugaucuuugaggccgaagucuccggcgggcggagcggauauauugcuaucgaugacauccaggugcugucuuaccccugugacaaguccccgcauuuccuccgccugggcgauguugaggugaaugccgggcaaaacgcgaccuuucagugcauugccacgggaagagacgcuguccacaauaaacuguggcuccagcggcgcaacggcgaagauaucccuguggcccagaccaagaauauuaaccacagacgguucgcugccagcuuucgccugcaagaggugacaaagaccgaccaggaucuuuacagaugugucacacagucugagcggggcuccgggguuagcaauuucgcccaacugaucgugcgcgaacccccuagacccauugcucccccucagcuccugggagugggcccgaccuaucuucugauccagcucaacgcgaauagcauuaucggggacggacccaucauucugaaagaggucgaauaccggaugacguccggcagcuggacagagacccaugccgugaacgcuccuacauauaagcuguggcaccucgaucccgacaccgaauacgagauccgcguucugcuuaccagaccuggggagggaggcacaggccugcccgggccgccucucauuacgcggaccaaaugcgccgaacccaugagaacaccuaagacccugaaaaucgccgagauucaggcucgccggaucgccguggauugggaaucccuuggauauaacaucacaagaugucauaccuuuaaugucacgauuugcuaccacuauuuccgcggccacaacgagucuaaggcggacugucuggauauggaccccaaggcuccucaacaugugguuaaucaccucccgcccuacacaaacgugagccugaaaaugauccugaccaauccugaagggcggaaggaguccgaggaaaccauuauccagacagacgaggauguccccggacccgugccugucaaaagccuccagggcaccucuuucgaaaacaagauuuuucugaauuggaaagagccgcuugaccccaacgggaucaucacacaguacgaaauuuccuauagcucuaucagaucuuucgauccugccgugcccguugccggcccuccccaaacgguguccaaucuguggaacucuacccaucacgucuuuaugcaucuccacccuggaacaaccuaccaguucuuuauucgcgcuagcacagugaagggcuucgggcccgccaccgcuaucaauguuacgaccaacauuuccgccccgacacugccugacuaugagggaguggaugcgagccugaaugagaccgccacaaccaucacgguccuucuccggcccgcucaggccaaaggcgcuccuauuucugccuaccagaucgugguggaagaacugcacccccauagaacaaagcgcgaagcgggggccauggagugcuaucaaguuccggucaccuaccagaacgcuauguccggaggcgccccuuauuacuuugcugccgagcugcccccugggaaucuccccgaacccgccccuuucacagugggcgacaaccggaccuaccagggauuuuggaacccgccccuggcuccuagaaagggcuauaauaucuacuuccaggcgaugagcucuguggagaaagaaaccaagacacaauguguccgcauugccacgaaagcugccgccaccgaggaacccgaggugaucccugaucccgcuaagcagacagaccggguugugaaaauugccgggaucuccgcgggcauucuugucuuuauccugcuccugcuggugguuauccuuauugugaaaaagagcaagcucgcuaagaaaagaaaggaugccaugggaaacacccggcaggagaugacacacauggucaaugccauggaccgcuccuaugcugaucaaucuacccugcaugccgaagacccucugagcaucacguucauggaucagcacaacuuuuccccgagauacgagaaucacucugcgacagcugaaagcucccggcuccuggacgugcccagauaucuuugcgaggggaccgaaagcccuuaccagaccggacagcugcaucccgccauucgcguugccgaccuccugcaacacaucaaccugaugaaaacaucugauuccuauggcuucaaggaggaguacgagagcuucuuugaggggcagucugcuuccugggacguggccaagaaagaucagaaucgggcuaagaacagauacggcaauauuaucgccuaugaccauagccgcgucauccuucagccuguggaagaugaccccucuagcgauuacauuaacgcgaauuauaucgacauuuggcucuacagagauggauaucaacggccgucccacuacaucgccacccagggcccugugcaugagacagucuaugacuucuggcgcaugauuuggcaggaacagagcgcuugcaucguuauggugacgaaccugguggaggucgggagagugaaauguuacaaguacuggcccgaugacaccgagguuuauggagauuuuaaagugacaugcgucgaaauggagccccuggccgaauacgugguucggaccuucacacucgagcgcagaggcuauaaugagauccgggaagugaagcaauuucacuucaccggguggccugaccacggaguccccuaccaugcuacgggccugcuuucuuuuauucgcagagugaagcuguccaacccuccgagcgccgggcccaucguugugcacuguuccgccggcgcuggacggaccggcugcuauauugucaucgacauuaugcucgauauggcggagcgcgaaggggugguggacaucuacaauugugucaaagcccugagaucucggagaauuaacaugguucagacagaggaacaguauaucuucauccaugaugcuauucuggaggccugccuuuguggagagaccgccaucccugugugcgaauuuaaggcugccuacuucgacaugauucgcaucgauagccaaacaaacuccucucaccucaaagacgaguuucagacccugaauagcgugacaccccggcugcaggcggaagauuguuccauugcuugccucccuagaaaccaugacaagaaucgcuucauggauaugcugcccccggaccggugucuuccuuuucugaucaccaucgauggcgagucuagcaacuacauuaaugccgcccucauggacuccuauagacagcccgcugccuucaucgucacgcaauacccucugcccaacacagugaaagacuucuggcgccugguuuaugauuacgggugcaccagcauugugaugcuuaaugaagucgaccugucucagggaugcccucaguauuggcccgaggagggcaugcuccgguacggcccgauccagguggaauguauguccugcagcauggauugugacguuauuaacagaaucuuucgcaucugcaaucugacccggccucaagagggguaucucauggugcagcaguuccaguaccugggaugggcgucucacagagaaguccccggcuccaagcggagcuuucuuaaacugauucuccaaguggagaaguggcaggaagagugugaggaaggggagggacgcacaaucauucacugccugaacggcgggggaagaucuggcauguucugugcuaucggcauugucguggaaaugguuaagcggcagaauguggucgauguguuucaugccguuaaaacccugcgcaacuccaagcccaauaugguggaggccccugagcaguacagauucugcuaugacgucgcucuugaauaccuggagagcuccuga

SEQ ID NO: 74456 - RNA, 4398 nt, Artificial Sequence
  derived and/or modified sequence opt5 from PTPRM__Homo_sapiens__NP_001098714
augagaggccuggggaccugccucgccacacuggcuggacuucugcucacggccgcgggcgagaccuucagcgggggaugucuguuugacgaacccuacuccacaugcggcuauucucagagcgagggggaugacuucaacugggaacaagugaauacccuuacaaagccuaccuccgauccguggaugcccucuggcagcuuuaugcuggucaacgcuuccggacggccugagggccagcgcgcccaccuccugcugccccagcucaaagaaaaugacacacauuguaucgauuuccacuacuuuguuucuagcaaguccaacagcccucccgggcugcuuaauguguaugugaaagucaacaauggaccucugggcaacccgauuuggaauaucucuggggaccccaccagaacguggaaccgggccgagcucgcuauuuccaccuucuggccuaauuuuuaccaggugaucuucgagguuauuacaagcggacaucaaggcuaucuggccaucgaugaagugaagguccuugggcaccccugcacccgcacaccucauuuucugagaauccagaacguggagguuaaugcuggacaguucgccaccuuucaguguucugcgauuggccggacgguggccggcgaccgccucuggcugcaagggaucgaugucagagacgcuccccugaaagaaauuaaggugacauccagccggcgcuucaucgccucuuuuaacguggucaauaccacaaagagagaugcuggaaaauaccggugcaugauucgcaccgagggcgggguuggaaucuccaacuaugccgagcucguggugaaggaaccgccuguccccauugcgccuccccagcuggccagcgugggcgcuaccuaccuuuggauccagcugaacgccaauuccaucaacggggacggacccauuguugcuagagagguggaauacuguacagccucuggcagcuggaaugaucggcagccugucgacuccacgagcuauaaaaucggccaccucgacccggauaccgaguacgaaauuucugugcugcuuacacgccccggggagggaggcaccggguccccuggacccgcccugagaacacggaccaagugcgcugacccuaugagaggcccccgcaaacucgagguuguggaagucaagagccggcaaaucacgauuagaugggagccguucggguauaacgugacacgcugucacucuuacaaucugaccguccauuauugcuaccaggugggcggacaggaacaaguucgggaggaagugagcugggauaccgagaacucccacccucagcauacaaucaccaaucugucucccuauacaaacgucagcgugaagcucauccugaugaauccugagggcagaaaagaaucccaggagcuuauuguucagacggacgaagaucugcccggggcggugccuaccgagagcauccaaggaucuacauucgaagagaagauuuuucuccaguggcgcgagcccacccagacauacggcgucaucacccuguacgaaauuacguauaaagccguguccagcuucgacccggagaucgaucuuucuaaccaguccgggcgggugagcaagcugggaaaugaaacccacuuucucuucuuuggccuguacccugggacaaccuauuccuucacaaucagagcuucuaccgccaaaggcuuuggaccucccgccacgaaccaauucacaaccaagauuagcgcucccuccaugccggccuacgagcuggagacaccccucaaucagaccgacaacaccguuacagucaugcugaaaccugcgcacucucgcggcgcucccgugagcguguaucagaucgucguggaagaggaacggccuagacgcacgaagaagaccacagagauucuuaaauguuaccccguuccuauccauuuucagaaugccucccugcucaacagccaauauuacuucgccgcugaauuucccgccgauucucugcaggcugcccagccguucaccauuggggacaacaagacauacaauggauauuggaacaccccucugcuucccuacaaauccuaucggaucuacuuucaggcggccagcagagcuaauggcgagacgaagauugauugcgugcaagucgccacaaaaggggcugccaccccuaagcccgugccggagccugaaaagcagaccgaccacacaguuaaaaucgcgggagugaucgccggcauucuccuguucgucaucauuuuccugggggugguucucgugaugaagaaacggaagcuggcuaaaaagcgcaaggagaccaugucuuccacaagacaggaaaugacggucauggugaacagcauggacaaaucuuaugccgagcaaggcaccaauugcgaugaggcuuuuagcuucauggacacacauaaccuuaauggacgguccgugagcucucccuccagcuuuaccaugaagacaaacacccuguccacgucugucccuaauagcuacuaucccgaucccuucguuccuaccgccauccucgugccgauuaacgacgaaacacacaccauggccuccgauacaucuagccuggugcagucccauaccuacaaaaagagagagcccgcugacgucccuuaccagacaggccagcugcaccccgcgauccgcguggccgaucuucuccaacacaucacccagaugaaaugugcugaaggguauggauuuaaggaggaauacgagucuuucuuugaaggccagagcgccccuugggacuccgccaagaaagaugagaaucggaugaagaacagauaugggaauauuaucgcuuacgaccauagccgcguuagacugcagacgauugagggagauacaaacucugacuauaucaauggcaacuacauugauggguaucaccggcccaaccauuacaucgccacccaaggcccuaugcaggaaaccaucuacgacuucuggcgcaugguguggcacgagaauacagcguccauuaucauggucaccaaccugguggaaguuggaagagugaaaugcuguaaguauuggccggacgauacggagauuuacaaagacaucaaggucacacucauugagaccgaacugcuugcugaguaugugauccggacauuugccguugaaaaacgcggcgugcacgagaucagagaaauucggcaguuccauuuuaccggguggcccgaucacggagucccuuaccaugccacaggccugcucggguucgugcgccaggugaaaagcaagucucccccuuccgcuggaccccuggucguucacugcagcgccggcgcgggcagaaccggguguuuuaucgugauugacaucaugcuggauauggcugagcgggagggaguggucgacauuuauaauugcgugcgcgaacuuagaucucggagaguuaacauggugcaaacggaggaacaguacgucuucauccaugaugccauucucgaggccugucugugcggcgacaccuccgugccggcuagccagguucgcucccuguauuacgauaugaauaaacucgacccucaaacaaacagcucucagaucaaggaagaguuccggacccugaauauggugacacccacccuuagagucgaggauuguagcaucgcccugcucccccgcaaccacgaaaagaaucggugcauggacauucugccucccgauagaugucugccuuuucuuaucacgauugacggggaguccucuaacuacaucaaugcugcccucauggacagcuauaagcagccguccgcguucauugugacacagcacccccugccuaacaccgucaaagauuuuuggcgccuggugcucgacuaccauugcacaucuguugugaugcugaaugaugucgaccccgcccaacuuugcccucaguauuggcccgaaaacggagugcaccggcauggcccgauccagguugaguucgugagcgcugaucuggaagaggacaucauuuccagaaucuuucgcauuuacaaugccgcucggccucaggauggguauagaaugguccaacaguuccaguuucucggauggcccauguaccgggacaccccugugucuaagcgcagcuuccugaagcugaucagacagguggauaaauggcaagaggaauauaacggcggcgaggggcggaccguuguccacugucuuaacggaggcgggcgcuccggaacauuuugcgccauuagcaucgugugugaaaugcugagacaucagcggacgguggacgucuuccacgccgugaagacccucagaaauaacaaacccaauaugguugaucugcucgaccaguacaaguuuugcuacgagguggcucuggaguaucuuaacucuggcuga

SEQ ID NO: 74457 - RNA, 3048 nt, Artificial Sequence
  derived and/or modified sequence opt5 from PTPRN2__Homo_sapiens__NP_002838
auggggcccccucugccgcuccugcuucugcuccugcuucugcuucccccuagagugcugcccgccgcuccuagcuccgucccccggggccgccagcugccuggaagacucggcugccugcuugaggaagggcuguguggagccucugaggcgugcguuaacgacggcguguucgggcggugucaaaaggugccggcuauggauuuuuaccgcuaugaagucagccccguggcccuccagagacugcggguugcccuucagaaacuguccggaaccggcuucacauggcaggacgauuacacgcaauaugugauggaccaggagcucgcugaucugccuaagaccuaccugcgcagacccgaagccucuagcccugcucggcccuccaaacacucugucggcagcgagcgcagauauucccgggaagggggagccgcgcucgccaaugcucugcgcagacaccuuccguuucuggaagcccucagccaggcuccugccucugacgugcuggcgcggacacacaccgcccaggauagacccccugcugagggcgacgaucgcuucuccgaaagcauccuuacauacguugcccauaccucugcucugacauauccucccgggucccggacccaacucagagaggaccugcugccccgcacgcucggacagcugcagccggaugagcuuagccccaagguggacucuggcgucgaucggcaccaucugauggccgcccucuccgcuuacgcggcccagagaccucccgcuccucccggggaaggaagccuggagccgcaauaccuucugcgcgccccuucccggaugcccagaccucuccuggcccccgcugccccucagaaauggcccucuccgcugggcgacagcgaagacccuuccagcaccggcgauggggcgcgcauucacacacuccugaaggaccuucagcggcaacccgcugaggugagaggacugucuggccucgaacuggaugggauggccgagcugauggccggacuuaugcagggcguggaccacggggucgcucgcggaucccccggccgggccgcucucggcgagagcggggaacaggccgauggaccuaaggcgacccugagaggcgacucuuuuccggaugacgggguucaggaugacgaugaccgccuguaucaagaggugcaucggcucagcgccacacugggaggccuucugcaggaccacggguccagacuccugcccggcgcucugccuuucgcccggccccuugauauggaacgcaaaaagucugagcauccugaaagcucccucagcucugaggaggaaaccgcuggaguggagaacgucaaaucccagacguacagcaaggaccugcugggccagcaaccccacucugaaccuggggccgcggccuuuggagagcuccagaaucagaugcccggcccguccaaagaggagcagagccugccugcuggggcccaagaggcucuuuccgauggacugcagcucgaagugcagcccucugaggaagaggccagaggcuauaucguuacagaccgggauccucugagacccgaggaagggcgccggcugguggaggacgucgccagacuucuccaggugccgagcuccgcuuucgcggauguugaagugcugggcccugccgucaccuuuaaggugucugcuaacguccaaaaugugacaaccgaggacguugaaaaggccaccguggauaacaaagacaagcuggaggagacaagcggacucaaaauucugcagacgggcgucggguccaagagcaaacuuaaguuccugcccccucaggccgaacaagaggauucuaccaaauuuaucgcucucacacuggugucccuggccugcauucuuggaguucuccuggcgagcggccugaucuacugucuccgccacucuucccagcauagacugaaggaaaagcucagcgggcugggaggcgaccccggggcugaugccaccgccgcuuaucaggagcucugccggcagcgcauggccacaagacccccugaccggccggaaggcccccacaccucucgcaucagcuccgugagcucucaauucuccgacggaccuauucccagcccuuccgcgagaucuagcgcuuccucuuggagcgaggagcccguccaguccaauauggauaucucuacgggccauaugauucugagcuacauggaagaccaccugaaaaacaagaaucggcuugagaaagaaugggaggcccugugugccuaucaggcugaaccuaacuccagcuuuguggcccagcgcgaggagaaugugccgaagaacagaucucucgcuguucugacauacgaucauucccggguccuccugaaagccgaaaauagccacucucacuccgacuacaucaacgcgagccccauuauggaucaugacccucgcaaucccgccuauaucgcuacccaagggccucuucccgccaccguggcugauuucuggcagauggugugggagucuggaugcgucgugauuguuaugcugacaccgcucgccgaaaacggcgugagacaguguuaccacuauuggccugacgagggguccaaccuguaccauaucuaugaggucaaucuggugagcgaacacaucuggugcgaggauuuccuuguucgguccuuuuaccugaagaaccuccagaccaaugaaacaagaacggugacccaauuccacuuucugagcugguaugaccgcggaguccccucuagcucccggucucuccuggauuucagacgcaaggugaacaaauguuaccggggcagaagcugccccauuaucguucauugcuccgacggggccggccgcucuggaacauacgugcuuauugauaugguccugaauaagauggcuaaaggcgcgaaggagaucgacauugccgcuacccucgaacaucugcgggaccagagaccugggauggugcagacaaaagagcaauuugaguucgcccugaccgccguggcugaagaggucaacgccauccuuaaggcgcugccccaguga

SEQ ID NO: 74458 - RNA, 2853 nt, Artificial Sequence
  derived and/or modified sequence opt5 from PTPRN__Homo_sapiens__NP_001186692
augagacggccccgcagaccuggcgggcugggaggcagcgggggacuccggcugcuucugugccuccugcuucuguccucucgcccgggcggguguagcgccguguccgcucacggaugccucuucgacagacggcuguguucucaucuggaggucugcauccaggauggccucuuuggccaaugucagguuggggugggacaggcccgcccccugcuucaggugaccagcccuguccugcaaagacuccagggcgugcugcggcagcuuaugucccaggggcugucuuggcacgacgaucucacacaauacguuauuagccaggaaauggagcgcauccccagacugcggccucccgaaccucgcccgagagaccgguccggacuggcgcccaagcgcccuggccccgcuggggagcuccugcuucaggauauuccuacgggaagcgcccccgccgcucagcauagacugccgcaaccucccgugggcaaaggcggggccggagcuucuuccagccucucuccucugcaggccgaacuucugccuccccuccuggagcaucugcuccugcccccgcagcccccucaccccucccuuagcuaugagccugcgcugcuccaacccuaccuguuccaccaguuuggcucucgggacggguccagagucagcgaaggauccccgggcauggugucuguugggccucuucccaaggccgaggcuccugcccuguucagccgcaccgcuuccaaaggaaucuuuggcgaucaccccggccauagcuauggggaccucccuggacccucuccggcccagcuguuccaggauuccggccugcucuaccuggcgcaagaacuuccugcccccagccgggcuagagugccccgccugccugagcaggggucuagcucccgggccgaggacucuccggaaggauaugagaaggaaggccucggggauagaggcgagaaacccgcuagcccugccguccagcccgacgccgcucugcagcgccuggcggccgugcuugcuggauacggcguggaacuccggcaacugacaccugagcagcuguccacccuccugacacuucugcagcuccugcccaagggggccggaagaaacccuggcggggucguuaaugugggagccgauauuaagaaaaccauggagggccccguggaagggcgcgacacagcugagcugccggcccggaccagcccuaugcccggccacccuacggcgucucccaccuccagcgaaguccagcaagugccgucuccuguuuccagcgagcccccuaaggcugccagaccucccgugacacccguccuucucgaaaagaaguccccgcugggacagucucagcccaccguggccggccagccuagcgcucgccccgccgcugaggaguauggguacaucguuacagaccaaaacguggucggaccugcccugaccuuucggaucagacauaaugaacagaaccucucccuggcggaugugacgcagcaagccggccuugucaaaucugagcuggaagcucagacagggcuccagauucugcagaccggagugggccaacgggaggaagccgcugccguucugccccagacagcgcacagcaccuccccuaugcgcagcgugcuucucacccuggucgcccuggcugggguggccggccuccugguugcucuugccguggcccugugcgucagacagcacgcucggcagcaagacaaggagagacucgcggcccugggaccggagggcgcucauggggauacaacguucgaauaccaggaccugugucgccagcacauggccaccaagucucuuuuuaaucgggccgagggacccccugaacccuccagagugagcucuguguccagccaguucucugaugcugcccaagcgagcccuuccagccauucuuccacacccagcuggugcgaggagccggcucaggccaacauggacaucuccaccggccacaugauucucgccuauauggaagaucaucugcgcaauagagaccggcuggcuaaagaguggcaggcccucugugcguaccaagcugaaccuaacacaugcgccaccgcccagggggagggaaauaucaagaaaaaccgccaccccgauuuucugcccuaugaccacgcuagaauuaaacuuaaaguugaaucuagcccuucccggucugauuacaucaaugccagccccauuaucgagcaugacccucgcaugccggcuuauaucgccacgcagggcccccugucccacacaauugcggacuucuggcagauggucugggagucuggguguaccgugaucgugaugcucaccccucuggucgaagauggcgugaagcaaugcgacagauacuggcccgaugagggagccagccuguaucauguuuacgaagugaaccuugucuccgagcacauuuggugcgaagacuuucuggugcggagcuucuaccucaaaaauguucagacacaggagacccgcacacugacgcaguuccacuuucucucuuggccugcugagggcacccccgccuccacaagaccgcugcuugauuuccggcgcaaggugaacaaguguuauagagggcggagcugcccuaucauuguccauuguucugacggagcuggcagaaccgggacauacauccugaucgauauggugcucaaucgcauggccaaaggaguuaaggaaauugacaucgccgcuacccuggagcacgugcgggaucaaagacccggccugguccgcuccaaagaccaguuugaguucgcgcuuacggccguggcugaagaagugaacgccauucugaaggcccucccucaguga

SEQ ID NO: 74459 - RNA, 3567 nt, Artificial Sequence
  derived and/or modified sequence opt5 from PTPRO__Homo_sapiens__NP_002839
augggccaucugcccaccgggauccacggagccagacggcuccugccucuucuguggcuguucgugcucuuuaagaacgcuacagccuuccacgucacgguucaggacgauaauaacauuguggugagccuugaggcguccgacgucaucucuccggcuagcguguacguugugaaaauuaccggcgaauccaagaauuacuuuuucgaguuugaagaguucaacucuacacugcccccucccgucaucuuuaaagccagcuaucaugggcucuauuacauuaucacccuggugguugugaauggaaacgucgugacaaagccuucccgcucuaucaccgugcugacaaaaccccucccugucaccagcguuuccauuuaugauuacaagccgagccccgaaacgggcgugcuguucgagauccacuauccugagaaguacaauguguuuaccagagucaacauuucuuacugggaagggaaagacuuccggacaaugcuuuauaaggacuuuuucaaaggaaagaccguguuuaaucauuggcugcccggcaugugcuacuccaacaucacauuccaacucguuagcgaggccaccuucaauaaaucuacgcugguggaauauuccggcgucagccacgagccuaagcagcaccgcacagcucccuacccgccucagaacauuucugugagaaucguuaaucuuaacaagaauaacugggaggaacaguccgggaacuuucccgaggaauccuucaugcggucccaagauaccauuggaaaagagaagcuguuucauuucacagaagagaccccugagauccccucuggcaauaucagcuccggguggcccgauuuuaacagcucugacuaugaaaccacaucccagccuuacuggugggauagcgccucugcugccccggagagcgaagacgaguucguguccguccuccccauggaauaugagaauaacucuacgcugagcgagaccgaaaaauccacaagcggaucuuuuuccuucuuuccugugcagaugauucugaccuggcugcccccuaagcccccgacagcguucgauggcuuucacauccauauugagcgcgaagagaauuucaccgaauaccucauggucgacgaggaggcccacgaauuuguggcugagcuuaaagaaccugggaaguacaaacugagcguuacgacauucucuuccagcggauccugugagaccagaaagucucagagcgccaagucccucucuuucuauaucagccccuccggcgaguggauugaggaacugaccgaaaaaccucaacacgugagcguccaugugcuuucuuccacaaccgcucugaugagcuggacaucuucccaggagaacuacaauagcacgaucguuucuguggucagccugaccugccagaagcagaaagaaucccaacggcucgagaagcaguauuguacacaggugaacagcucuaaacccaucauugagaaucuggugccuggcgcccaauaccagguugucaucuaucuccgcaaggggccccugauuggaccgccuuccgaucccgugaccuuugcgaucgugcccacaggcauuaaggaccuuaugcuguacccucucgggccgaccgccgucgugcugagcuggacgagacccuaucuuggaguuuuccggaaauacguggucgaaauguuuuacuucaacccugcuaccaugacauccgaguggaccacauauuacgaaaucgccgcuaccgugucucugacggccagcguucgcaucgccaaucuccugcccgcuugguauuacaacuuuagagugacaauggucaccuggggcgacccugagcuguccugcugugauucuagcacaauuuccuucaucaccgcgcccguggccccugaaauuaccucuguugaguauuuuaauagccuccuguacaucuccuggacauauggggacgauacgaccgaccuuagccacucucggaugcugcauuggaugguggucgcugagggaaagaaaaagauuaaaaaguccgugacacgcaacgugaugaccgccauccucagccugcccccgggcgauauuuacaaucugucugucacagccugcaccgaaagaggcuccaacacgagcaugcuucggcucguuaagcuggagccugcucccccuaaaucucuguucgccgugaacaagacacagaccuccgugacccuccugugggucgaagaggggguggcggacuuuuucgaaguguuuugucagcaaguuggaagcucccagaaaacaaaacuucaggagcccgucgcugugagcucucacguugugaccaucagcucccugcucccggccacagccuacaauugcucugucacgagcuucucccaugauucuccuagcgugcccaccuuuaucgcuguuuccacaauggugaccgagaugaacccuaaugucguggugauuucuguccuggccauccugagcacacuucucauuggccugcugcucguuacccugaucauucuuagaaagaagcaucugcagauggcucgcgaauguggggccggaacguucgugaacuucgcgucccucgagcgggacggcaagcugcccuauaauuggagcaaaaacgggcugaagaaaagaaaacuuaccaaucccgugcaacucgaugacuuugaugccuacaucaaagacauggcuaaggacucugauuauaaauucucccugcaguuugaggaacugaagcucaucggccuggacauuccucacuucgccgcugaucuuccgcugaaccgcugcaagaaucgguacacaaacauccuccccuaugacuuuagcagaguccgccuggugucuaugaaugaggaagagggagccgauuacauuaacgcgaauuauaucccuggcuacaacagcccccaggaauacauugccacccaggggccucugcccgagacacggaaugacuucuggaaaaugguucuucaacaaaagagccagaucaucgugaugcucacccaguguaacgaaaagagacgcgucaagugcgaucacuauuggccuuuuacagaggagccgauugcuuacggagacaucaccguggaaaugauuuccgaggaggaacaggaugacugggccugccggcacuucagaaucaacuaugcugaugaaaugcaggacguuaugcauuuuaauuacacggccuggcccgaucacggcgugccuacagccaacgcugcggagucuauucugcaguucguccacauggugcgccaacaggccaccaaaagcaaggggcccaugaucauccauuguuccgcuggagucggccggaccgggacauuuauugcccuggacagacuccugcagcacauccgggaccaugaguucguggauauucuuggccugguuagcgaaaugcgcucuuauagaauguccauggugcagaccgaggaacaauacaucuucauucaccagugcguccagcucauguggaugaagaaaaagcagcaauuuuguaucagcgacgugauuuaugagaauguuucuaaaagcuga

SEQ ID NO: 74460 - RNA, 6900 nt, Artificial Sequence
  derived and/or modified sequence opt5 from PTPRQ__Homo_sapiens__NP_001138498
auggacuuccugaucauuuuucuccugcuuuucaucggcaccagcgagacacagguggacguguccaacguugugcccgggacgagauacgacauuaccaucucuagcauuuccaccaccuauaccucuccugugacccggaucgucacaaccaaugugacgaagccgggacccccuguuuuucuggccggcgaacgcguggggagcgcuggaauccuccuguccuggaacacacccccuaaucccaacggcagaauuaucucuuacauugucaaguauaaggaggugugcccuuggaugcaaacaguuuacacccaggugcggagcaaaccggacucccuugaaguccugcucacaaaucugaaccccgggaccacguaugagaucaagguggccgcggaaaauagcgcuggaauuggcguguucucugacccuuuucuguuccagacagccgaguccgcccccggcaaagucguuaaccucaccguggaggcuuacaaugccagcgcugugaagcugaucugguaucuuccucgccagcccaacgggaagauuacaucuuuuaaaaucuccgucaagcacgccagaagcggaaucgugguuaaagacgugucuauucgggucgaagacauccugaccggcaagcucccggaguguaaugaaaacuccgagagcuuccugugguccaccgcgucuccuagccccacacuugggcgcgugacgccucccuccagaaccacacauagcagcuccacccugacacaaaaugagauuagcucuguuuggaaagaacccaucagcuuuguggucacccaccuccggccuuacacgacauaccuguucgagguguccgccgcuaccaccgaagccggauauauugauucuacaaucguccgcaccccggagagcgugcccgaaggcccuccccagaacugcguuacagggaauaucacgggaaaguccuuuagcauucugugggacccucccaccaucgugacaggcaaguucucuuacagagucgagcucuauggcccguccgggcggauucuggauaacagcaccaaagaccuuaaguuugcuuucacaaaccugaccccuuucacgauguacgauguguauaucgccgccgagaccucugccggaacaggccccaaauccaauauuagcguuuuuaccccucccgacgugccuggggcugucuucgaucuccagcuggccgaaguggaguccacacaggugcgcaucaccuggaagaaacccagacaaccgaacggaaucauuaaucaguaccggguuaagguccuugugccugaaacgggcaucauucuggagaacacacuccugaccgggaauaacgaauauaucaaugaccccauggcucccgagauugugaacaucgucgagccuauggugggacuguacgaaggcucugccgagaugagcuccgaccuccauucucuggccacauuuauuuacaauagccacccggauaaaaacuuccccgcucgcaauagagcggaagaccagaccuccccuguugugaccacacggaaccaguauaucacggauaucgccgcugagcaacuuagcuacgucauuagacgccuggugcccuuuaccgaacauaugaucucuguuuccgccuucacaauuaugggcgaggggccucccaccgugcucagcguccggacaagacaacaggugccuucuuccaucaagauuaucaauuauaagaacaucagcucuagcuccauucugcuuuacugggaucccccggaguauccuaauggaaaaaucacccacuacacgauuuaugccauggaacuggauacaaaccgcgcuuuucaaaucaccaccauugacaacagcuuccucaucacaggccugaagaaauacaccaaguacaaaaugcggguugccgcgucuacacacgugggggaguccagccuguccgaagagaaugauaucuuugucagaacgucugaggacgaacccgagagcuccccucaggauguggaagugauugacgucaccgcugaugagauccgccucaaguggucucccccggaaaagccuaacggaauuaucauugccuaugagguucuguacaaaaauaucgacacacuuuauaugaagaacaccagcacaaccgacaucauucugcggaaucucagaccccauacgcuguacaacaucuccgugcgcucuuauacccgguucggccacgggaaucaggugagcucccugcuuagcgucagaacaucugagaccgugccugauuccgcccccgaaaacauuacauacaaaaauaucagcucuggcgagauugaacucuccuuucugcccccuagcucuccgaacggaaucauucagaaguauaccaucuaccugaaacgcuccaauggcaacgaggaacggacaaucaauaccacgagccucacacaaaacauuaagguucugaagaaauacacccaguauaucauugagguguccgcuagcacccuuaagggggagggagucagaucugcccccaucagcauucugacagaagaggacgcuccugauucucccccucaggacuucucugugaaacagcucagcggcguuaccgugaagcuguccuggcaacccccucuggaaccgaaugggaucauccuuuacuauacggucuacguguggaaccggucuagccucaaaacaauuaacguuaccgagacaucccuggaacugucugaucucgacuauaauguggaguacagcgccuaugucaccgcguccacacgcuuuggagauggcaagaccagaagcaacaucauuucuuuccagacgcccgagggggccccuuccgaucccccuaaggauguguacuacgcuaaucuguccucuuccagcaucauucuuuucuggacacccccguccaaaccuaacggcaucauccaguauuacucuguguauuaccggaauacaagcggaaccuuuaugcagaacuucacacugcaugaagucaccaaugacuuugauaacaugacgguuuccacaauuaucgacaagcucaccauuuucagcuauuacacauuuuggcugaccgccucuaccuccgugggcaaugggaacaaaagcucugauaucauugagguguauacagaccaagacauccccgaaggauucgucggcaaucugacguacgagagcauuuccucuaccgcuaucaacgugagcuggguucccccugcccagcccaaugggcuuguguuuuacuaugucucccucauccugcagcagacaccuagacacgugcgcccgccccugguuaccuacgagcggucuauuuauuucgauaaccucgaaaaguacacagacuauauccugaaaauuaccccuagcacggagaagggauuuuccgauacauacaccgcgcaacuuuauaucaaaaccgaagaggacgugcccgaaacaagcccuauuaucaauaccuucaagaaccugucuuccacaagcguccuccuguccugggaucccccggugaagccuaacggcgccaucauuucuuacgaccugacgcuucaggggcccaaugagaacuacagcuuuaucaccuccgauaauuauauuauccucgaggaacugucuccuuucacacuguacagcuuuuucgcugccgcuagaacccgcaaaggccucggacccuccagcauucuguucuuuuauacagacgagucugucccucuugcgcccccgcagaaccugacccucaucaauuguacguccgauuucguguggcugaaguggagcccuucuccccugcccggcgggaucguuaaaguguacuccuuuaagauucacgaacaugagaccgacacaaucuauuacaaaaacauuagcggauucaagaccgaagccaaacuugucggccuggagccugugucuacauauagcaucagaguuuccgcuuuuaccaaaguggggaauggaaaccaauucucuaaugucgugaaguuuacaacgcaggagagcgugccggauguuguccagaacaugcagugcauggcgaccuccuggcaaagcgugcucgugaaaugggaucccccuaagaaagccaauggcauuaucacacaguacauggucaccguggaacggaacuccaccaagguuucuccccaggaucacauguacacauucauuaagcugcucgcuaauacgagcuauguguuuaaaguccgcgccuccaccucugccggggagggcgacgaaagcacaugucauguguccacccugccugagacaguucccucugugccuaccaacaucgcuuucagcgacguccaguccacgagcgccacacuuaccuggaucagaccggauaccauucugggauacuuucaaaauuauaagaucacaacccagcuccgggcgcagaaaugcaaggaaugggagucugaggaauguguggaguaccagaaaauucaauaucuguacgaagcucaccugacagaggagaccguuuauggccuuaagaaguuccgcugguacagauuccagguggccgccuccacgaacgcuggguacggaaaugccagcaacuggaucucuacaaaaacccugcccggcccucccgacgggccucccgaaaacguccaugugguggcgacauccccguuuagcauuucuaucuccuggagcgagccugcugucaucaccggacccacgugcuaucucauugauguuaaguccguggacaaugaugaguucaacaucagcuuuauuaaaucuaaugaggaaaacaagaccaucgagauuaaagaccuggagaucuucacacgguacagcguggucaucaccgccuuuacaggcaauauuuccgccgcuuauguggaaggcaagucuagcgccgagaugaucguuaccacacucgaauccgcucccaaagauccucccaacaauaugaccuuccagaagauuccugacgaggugacgaaguuucaacugacauuccuuccgcccucucagccuaacgggaauauccaggucuaccaggcccugguguaucgcgaagaugaccccaccgcgguucaaauucacaaccucagcaucauucagaaaaccaauacauuugugaucgccaugcuggagggacugaagggcgggcacaccuacaacaucuccgucuaugcugucaauucugccggagcuggcccuaaaguccccaugagaauuacaauggauaucaaggccccggcccggccuaaaacgaagcccaccccuauuuacgacgcuacagggaaacuucuggugaccagcacaaccaucacgauucgcaugcccaucuguuacuauuccgacgaucauggaccuaucaaaaacguucaggugcucgugaccgagacaggcgcgcagcacgacggcaaugucaccaagugguacgaugccuauuucaacaaagcuagacccuacuuuacaaacgaaggguucccgaauccucccugcaccgagggaaagacgaaauuuagcggcaacgaagagauuuauaucauuggggccgacaaugccuguaugauccccggaaacgaagauaagauuugcaauggcccucugaagccgaaaaagcaauaccucuucaaauuccgggcuacaaacaucauggggcaguuuaccgacucugauuauuccgaccccguuaagacacugggagagggccuuagcgagagaaccguggaaaucauucugucugugacccugugcauccucuccauuauccugcuuggcacagccauuuucgcguuugcucgcauccggcagaaacagaaggaagggggaacguacagcccucaagaugccgaaauuaucgacaccaagcugaaacucgaucagcugaucacagucgccgaccucgagcugaaggaugagagacuuacccgccugcuguccuaccggaaaucuauuaagcccaucagcaaaaaguccuuccuccagcauguggaggagcuguguacaaauaacaaucuuaaguuucaggaagaguucagcgaacugccuaaauuucuccaagaccugucuuccaccgacgcugaucuccccuggaacagagccaagaaucgcuucccuaacauuaaacccuauaauaacaaucggguuaagcugaucgcggacgcuagcgugccgggcucugauuacauuaacgccagcuauaucuccggguaccuuugcccuaacgaguuuaucgccacgcagggaccccugccuggcacagucggggacuucuggagaauggugugggagacccgcgcuaaaacccuggucaugcucacacaguguuuugaaaagggacggauuagaugccaccaauauuggcccgaggauaauaaaccggugaccguuuucggcgacaucgugauuacaaagcugauggaagauguccagaucgacuggacgauucgggaucuuaagaucgagcgccacggcgacuguaugaccgugagacagugcaacuuuacagccuggccugaacaugggguucccgaaaauucugcuccccugauccacuucgugaaacucguccgggccagccgcgcgcaugauaccacaccuaugauugugcacuguuccgccggagugggcagaaccgggguuuucaucgcucuggaccaucucacgcagcacauuaacgaucacgacuuugucgacaucuacggacugguggccgagcuucggucugaaagaaugugcauggugcaaaaucuggcucaguauauuuuccugcaucaguguauccucgaucugcuuagcaacaagggcuccaaucagcccaucugcuuugucaacuacagcgcccugcagaagauggacucucucgaugccauggagggggacguugaacuggagugggaagagaccacaauguga

SEQ ID NO: 74461 - RNA, 1638 nt, Artificial Sequence
  derived and/or modified sequence opt5 from PTPRR__Homo_sapiens__NP_001193944
augcagagcaucuccaagcaaacccugcagauggacgugaacaaacucaauauuacacugcuuagaaucuuccggcagggcgucgccgcugcccuggggcuccugccccagcaaguucacauuaaccgccuuaucggaaagaaaaauucuauugagcuguuugugagcccuaucaacagaaagacgggcaucuccgaugcgcucccgucugaagaggugcugcggagccugaauauuaacguccuccaucagucccugucucaguucgggaucaccgaagugagccccgagaaaaauguucuucagggacaacacgaagcugacaagauuugguccaaggagggcuuuuacgccguggucaucuuccugagcauuuuugugaucauuguuacaugccucaugauccuguaucgccuuaaagagagauuccagcugucucuccggcaggauaaggagaaaaaccaggaaauccaucuguccccuauuacccugcaacccgcccucagcgaagcuaagacagugcacucuaugguccagccugagcaggcccccaaagugcugaauguggucguugacccucaagggcgcggagcuccggagaucaaggccaccacagcgaccuccgugugucccagcccuuuuaagaugaaacccauuggccuucaggaaagacggggcucuaacgugucccugacgcucgauaugagcucccuggggaauaucgagccuuucgucucuauucccaccccgcgcgaaaagguggccauggaguaccuucagagcgcuuccagaauccugacacggagccagcuccgcgacguuguggccucuucccaucugcugcaaagcgaauuuauggagaucccuaugaacuucgucgaucccaaagagauugacaucccuagacacggaaccaagaaucgguauaaaacaauucuccccaacccccugucucgcgugugccuuagaccuaagaauguuaccgauagccuguccacguacaucaacgcuaacuauauucggggcuacucugggaaagaaaaggccuuuaucgcgacacagggaccgaugaucaauaccguggacgauuucuggcagauggucuggcaggaggacagccccgugauugucaugaucacaaagcucaaagaaaagaacgagaaaugugugcuguauuggccugaaaagagaggcauuuacgggaaaguugaggugcuugucaucuccgugaaugagugcgauaacuacaccauucgcaaucugguucucaagcaaggaagccacacccagcaugugaagcacuauugguacacaucuuggcccgaccauaaaacgccugacuccgcccagccccugcugcagcucaugcuggaugucgaagaggaccggcuugcuagccaaggcagaggcccgguggugguucacuguucugccgggaucggacgcaccggcugcuuuauugcuacauccaucgggugucagcagcugaaggaagagggagucguggaugcccucagcaucgugugccagcugcggauggacagaggcgggaugguccaaaccuccgaacaguaugaguucgugcaccaugcccugugucuuuacgagucucgccucagcgcugaaacaguucaguga

SEQ ID NO: 74462 - RNA, 5847 nt, Artificial Sequence
  derived and/or modified sequence opt5 from PTPRS__Homo_sapiens__NP_002841
auggcccccaccuggggcccugggauggugagcgucguuggaccgaugggccugcucguggugcugcuugucgggggaugcgcugccgaggaacccccuagauucaucaaggagcccaaagaccagauuggcguguccgggggaguugcgucuuuugugugucaggcuaccggcgauccuaagccccgggucacguggaacaaaaagggcaaaaaggugaauagccagcgcuucgaaaccaucgaguuugacgaauccgccggggccguucugagaauccagccucuccggacaccgcgcgaugagaacguguacgagugcgucgcucaaaauucugugggagaaaucaccgugcacgccaagcugacaguccuuagagaggaccaacugcccagcggcuucccuaacauugauauggggccccagcucaaaguuguggaacggacccgcacagcuaccaugcugugugccgccuccggaaauccugaccccgagaucacgugguuuaaggauuuccugccgguggacccuucugccagcaacggcagaaucaaacagcuccgguccgagaccuuugaaagcacacccauucgcggggcucugcagaucgagucuuccgaagagaccgaucaaggaaaguaugaaugcgucgccacaaauagcgcuggcgugagauacucuuccccugccaaccuuuauguucgggagcugcgcgaggugagacgggucgcgccccgcuucagcauucuccccaugucucaugaaaucaugccuggcgggaaugugaacauuaccuguguugccgugggauccccgaugcccuacgucaaauggaugcagggcgcugaggaccugacgccugaagaugacaugcccguggggagaaauguccuugagcugacagaugugaaggacagcgccaacuauaccugcguugcuauguccucucucggagugaucgaagccgucgcccagauuacagugaagucccugccuaaagcucccggcaccccgaugguuaccgagaauacagcgacguccaucaccaucacaugggacagcgggaacccugaucccgugucuuacuaugucauugaguacaaguccaaaagccaggacggaccuuaccaaaucaaggaagauauuaccacaacccgguauucuaucggcggccugagccccaauuccgaguacgaaauuugggugucugccgugaacagcaucgggcagggaccucccuccgagagcguugucacgagaacaggcgaacaggcuccggccucugccccucgcaacgugcaagcucggaugcucuccgccaccaccaugaucgugcagugggaggagcccgucgaacccaaugggcugauuagaggauaucgcguguacuauacaauggagccugaacacccgguuggcaacuggcagaaacauaauguggacgauagccuucugaccacagucgggucucuccuggaggacgagacguacaccgugcggguucuugcguuuacauccgugggcgauggaccccugagcgacccuauccaggucaagacccaacagggcgugcccgggcagccuaugaaccucagagcugaagcccgcuccgagacaucuauuacccugagcuggucucccccucggcaggaaagcaucauuaaauaugagcuccuguucagagaaggagaucacggccgcgagguugggcggacguuugaccccaccacaagcuacguggucgaggaucugaagccgaauaccgaauacgccuucagacuugcugcccgcuccccucaaggacugggcgcuuuuacacccguggugcggcagagaacccuccagagcaagccuucugcgcccccgcaggacgucaaauguguuuccgugcggagcacggcgauccuggugucuuggcgcccucccccucccgagacacauaacggggcccuugucggcuauuccgugagauaccggccccugggaagcgaagacccugagccgaaggaaguuaauggcauucccccuaccacaacccaaauucuccuggaggcucuggagaaauggacccaguauagaaucacaacgguggcccacaccgaagucgggcccggaccugagucuagccccgugguugugcgcacagaugaagacgucccuuccgcuccgccccggaagguggaggccgaagcgcucaacgccaccgcuauuagaguucuguggcgcagcccugcccccggcagacagcacgggcagauccggggauaccaagugcauuauguccgcauggagggcgcugaggccagagggccuccccggauuaaagaugugaugcuugccgacgcucagugggaaacagaugacaccgcggaguacgaaauggugaucacgaaucugcagccggagacagccuauucuauuaccgucgcugccuacaccaugaagggcgauggagcccgcuccaagccuaaaguuguggugacaaagggcgcuguccucgggagacccacccugagcgugcaacagacacccgagggaucccugcuugcccggugggaaccucccgcgggcacggcugaggaccagguucucggguaccgccugcaguucggaagagaagauucuaccccucuggccacacucgaguucccgcccagcgaagaccgguauaccgccuccggcgugcacaaaggggcuacauacgucuuucgccuggccgcgagaucucggggcggacuuggcgaggaggcugccgaagugcugagcaucccugaggauacccccagagggcauccucaaauccucgaagccgcuggaaacgccuccgcuggcacgguucugcugcgcuggcuucccccggugccugccgagcggaauggggcgauugucaaguauaccguggccgucagagaagcuggagcccucggccccgcucgcgagacagagcugccugccgccgcugaacccggcgcggagaacgcccugacccuccaggggcugaaaccugacacagcuuacgaucuucaggugcgggcccacaccagacgcggacccggcccguucucuccucccguucgguauagaacauuucugcgcgaccaggugagccccaagaauuucaaggucaaaaugaucaugaagaccuccgugcuccugagcugggaauuuccugacaacuacaauucuccgacgcccuauaaaauucaauacaacgggcugacacuugauguugacggacggaccaccaagaaacucaucacacaccugaagccucauaccuucuacaacuuugugcugacgaauagaggcuccagccucgggggacugcagcagacagucaccgccuggacagcuuucaaccuucugaauggcaagcccucuguggccccuaaacccgaugcggacggcuuuauuaugguguaucucccugaugggcaguccccgguucccguccaaagcuacuucaucgugauggugccucugcggaagucucgcggaggccaguuucugacaccccuuggguccccugaggacauggaucucgaggaacugauccaggacauuagcagacugcaacggcgcucccucagacacagccggcagcuggagguccccagaccguauaucgcugcccgcuucucugugcuuccucccacauuucaucccggagaucagaaacaguacggcggguucgacaaccggggacuggaaccuggccacagauauguucucuucgugcuggccguccugcaaaagagcgagcccaccuuugcugccuccccuuucucugauccguuucagcuugacaaucccgauccucagcccauuguggacggcgaagaggggcugaucuggguuauuggaccugugcucgcggucguguucaucaucugcauuguuaucgcuauucugcucuacaaaaacaagcccgacagcaaacgcaaggauuccgagccgcggacgaagugucugcuuaauaacgccgaccuggccccucaucaccccaaagauccuguggaaaugagacgcaucaauuuucagacccccgacucuggccuccggagcccucugagagagcccggguuccacuuugaauccaugcugucucauccgccuauucccaucgcugauauggccgagcacacagaacgccuuaaggcuaacgacagccugaaacucucccaagaguaugagagcaucgaucccggacagcaguucaccugggaacauucuaaucuggaggucaacaagccuaaaaauagauacgccaacgugauugcguacgaccacucccgggugauccuccagccgauugaaggcaucauggggagcgauuauauuaaugccaacuacgucgacggauaucgcugccaaaacgcuuacaucgccacacagggcccccugccugagaccuuuggcgauuucuggagaaugguuugggaacagcggucugcuacgauugugaugaugacacgccuugaggagaaguccagaaucaagugugaccaguauuggcccaaucgggggaccgaaacauacggauuuauccaagugacccugcucgacaccauugagcuggccacauucugcgucagaacguuuagccugcacaaaaacggcuccucugaaaagcgcgaggugcggcaguuccaguucaccgccuggccugaucaugggguucccgaauauccuacacccuuucuugcuuuccugagacgcgugaaaaccugcaauccgccugacgcgggacccaucgucgugcacuguagcgccggcguugggcggacaggaugcuuuauugugaucgaugcuaugcucgagagaauuaagccugagaaaaccgucgacguguacggccaugucacgcugaugcggucccaacgcaacuacauggugcagacagaagaucaguauagcuucauccacgaggcccuccuggaagccguuggcugugggaauaccgaggugcccgcuagaucucuuuacgccuauauccagaagcuggcgcaaguggagccgggagaacaugucaccggcauggagcuggaauuuaagcggcucgcuaacuccaaagcccacacaagccgcuucauuucugccaaucugccuugcaacaaguuuaaaaauagacuuguuaacaucaugcccuacgagagcacccgggugugucugcagcccauucgcgggguggaaggauccgacuauaucaaugcuucuuucauugauggcuacagacagcagaaggccuauaucgcgacacaagggccucucgccgagacgaccgaggacuuuuggcggaugcugugggaaaacaauagcacaaucgucgugaugcucaccaaacugcgcgagaugggaagagaaaagugccaccaguacuggcccgcugagcgguccgccagauaccaguauuucguuguggauccuauggcugaauacaacaugccgcaguauauucuucgcgaguuuaaggucacagacgcccgggauggccaaucuagaaccgugcgccaguuccaguucacggacuggcccgagcaaggcgucccuaaaagcggggaaggauuuaucgauuucauuggccaggugcauaagaccaaagagcaguuugggcaggacggacccaucuccguucacuguagcgcuggcguggggcggacaggagucuucauuacccugucuaucgugcuggaaagaaugcgcuacgagggcguuguggacauuuuucaaacagucaagaugcuccggacccagagaccugccauggugcagacagaagaugaguaucaguucugcuaccaagcggcccuggaguaucuuggcuccuuugaccauuacgcuacguga

SEQ ID NO: 74463 - RNA, 4326 nt, Artificial Sequence
  derived and/or modified sequence opt5 from PTPRT__Homo_sapiens__NP_008981
auggccagccuggcugcccucgcgcugucccuucugcucagacugcagcuucccccucugccgggcgcucgggcccaaucugccgcugggggaugcagcuucgacgagcacuacuccaacuguggcuauucuguggcccucgggaccaauggauuuacaugggaacagaucaacacgugggagaagcccaugcuggaucaggcugucccuaccggcagcuucaugaugguuaauuccucugggcgcgccagcggacagaaagcgcaucugcuccugcccacacuuaaggaaaacgacacccacugcauugauuuucauuacuauuucuccagcagagaccggucuuccccuggcgcccugaauguguacgugaaagucaacggcgggccccaaggaaauccuguguggaacguuagcggcguggucacagaggggugggugaaggcugaacucgccaucucuaccuuuuggccgcacuucuaucagguuauuuuugaguccgugagccugaaaggacaucccggcuacaucgcugucgaugaggugcgcgugcuugcccacccuuguagaaaggcgccccacuuccugcggcuccagaaugucgaaguuaacguggggcagaaugccacauuucaaugcauugcuggaggcaaguggucucagcaugacaaacuguggcugcagcaguggaacggccgcgauaccgcccucauggugacgagagucgugaaucaccggcgcuucuccgcuaccguuagcguggccgacacagcccaaagauccgucucuaaguaucggugugugauccgcagcgaugggggauccggcguuagcaacuacgcugagcugaucgugaaagaaccucccaccccgauugcgccucccgagcuucuggccgucggggcuacauaccucuggaucaagccuaaugccaacucuauuaucggagacggccccauuauccugaaagagguggaauauagaaccacgacagggaccugggccgagacacauauugucgauucccccaacuacaaacuuuggcaccuggacccugauguggaauaugagauccggguucuccugacccgcccgggagaaggcggcaccgggcccccuggacccccucugacaacgagaaccaagugcgcugaccccgugcacggcccgcagaaugucgagaucguggacauucgggccagacagcucacacugcaaugggagccuuuuggguacgcgguuacccgcugucauagcuauaaccuuacagugcaguaccaguaugucuucaaucagcaacaguacgaagcugaggaagugauccagaccucuagccacuacacgcugcggggacucagacccuuuaugacaauucgccugcggcuucugcucuccaacccugagggcagaauggaaucugaggagcuggugguucagaccgaagaggauguccccggggccgugccucuggaaagcauccaaggcggacccuucgaggaaaagauuuauauccaguggaagccgccuaaugagaccaacggcgugaucacacucuacgagauuaauuauaaagccgucgggucccuggaccccagcgcugaucuuucuucccagcgcggaaagguguucaaacugcggaacgaaacccaucaccucuuuguuggccuguaccccgggacaacguauagcuucaccaucaaggccucuacagcuaaaggauuuggcccuccggugaccacaagaauugccaccaagaucuccgcgcccagcaugccugaguacgacacggauacaccccugaaugaaaccgacaccacaauuaccgucaugcuuaagccugcccagucccgcggggcucccgugucuguuuaucaacucguggucaaagaggagcggcugcagaaaagcagacgcgccgcugauaucaucgaaugcuucuccgugccuguuucuuaccggaacgccagcucccuggacagccuccauuacuuugcggccgagcugaaacccgcuaaucuuccggugacgcagccuuucacagucggcgauaacaagaccuauaauggauacuggaaucccccucugucuccccucaaauccuauagcauuuacuuucaggcccugucuaaggcuaacggcgaaacaaagaucaacugugugagacuggccaccaaaggggccuccacccaaaacagcaauacaguggagccggaaaagcaggucgacaacacgguuaaaauggcuggagugauugcgggccuucucauguucaucauuauccugcugggggugaugcucaccauuaagcggcgcagaaaugccuauucuuacagcuauuaccugaaacuugcuaagaagcagaaagagacacaauccggagcccagcgggagaugggcccugucgccagcgcugauaagcccaccacaaaacugucugccuccagaaacgacgaaggguuuagcuccucuagccaggacgugaauggcuucaccgauggaucccgcggcgagcucucucagccuacgcugacaauccaaacccaccccuaccggaccugcgaccccguugaaaugagcuauccuagagaucaguuucagccggcgauccgcguggcugaccugcuucagcacauuacacaaaugaagagagggcagggauacggcuucaaagaggaauaugaggcccuccccgaggggcagaccgccuccugggauacagcuaaggaagacgagaaccggaauaagaaccgcuacggaaauaucauuucuuaugaucauagcagaguccggcugcuggugcucgacggcgauccucacuccgacuacaucaacgccaauuauauugauggguaccaucgccccagacacuacaucgcgacgcagggcccuaugcaagaaaccguuaaagacuuuuggcggaugaucuggcaggagaacagcgcuucuauugugauggucacaaaucugguggaaguuggacgcgugaagugugucagauauuggcccgaugacaccgagguguacggcgacaucaaagugacacuuauugagaccgaaccucuggccgaguaugucauccggacguucaccguucagaagaaaggguaccacgaaauucgcgagcucagacuguuccauuuuacauccuggccggaucacggagugcccugcuaugccaccggccugcuuggguucgugcggcaagucaaguuucucaacccucccgaggcuggaccuaucgugguucauugcagcgccggcgcuggcagaacaggguguuucaucgccauugacaccaugcuggauauggcggaaaaugagggaguggucgacaucuuuaacugcgugcgcgaacugcgggcccagagaguuaaccucgugcagacagaggaacaguacgucuucgugcacgaugcuauucuggaggccugucuuugcggcaauaccgcuauccccgucugugaguuucgcucucuguauuacaacauuucccggcucgacccgcaaacgaauagcucucagaucaaagaugaguuccagacacugaacaucgugaccccuagaguucgccccgaagacugcuccauugggcugcuuccccggaaucaugauaagaacagaagcauggacgugcugccucucgaucgcugucugcccuuucucaucuccgucgacggagaaagcucuaauuacauuaacgccgcccugauggauagccacaagcagccugcugcguucgugguuacccaacacccgcuucccaauacaguggccgacuuuuggcggcuggucuucgacuauaacugcuccucuguggugaugcucaaugagauggauaccgcucaguuuuguaugcaguacuggccugaaaagacgagcggcugcuaugggcccauccagguugaguucgucuccgccgacauugaugaggacaucauucauagaaucuuccggaucuguaacauggcccgcccucaagauggauacagaauugugcagcaucugcaguauaucggcuggcccgcuuaccgggacacaccgccuucuaagcgcagccugcuuaaaguggucagacggcuggaaaaguggcaggagcaauaugauggcagagaagggcgcaccgugguucacugccucaauggaggcgggcgguccggaacauuuugcgccauuuguucugugugcgagaugauccagcagcaaaacauuaucgacgucuuccacaucgugaaaacccugagaaauaacaagagcaacaugguugaaacacucgagcaguacaaguuuguguacgaggucgcgcuggaauaucuuuccagcuucuga

SEQ ID NO: 74464 - RNA, 4347 nt, Artificial Sequence
  derived and/or modified sequence opt5 from PTPRZ1__Homo_sapiens__NP_001193768
augagaauccugaagcgguuccucgccugcauucagcugcuuugugugugccgccuggacugggcuaacggcuacuauagacaacagcggaaacucgucgaggaaaucggguggagcuacaccggagcccugaaucagaagaacuggggcaaaaaguaucccacauguaauuccccuaaacagucuccgauuaacaucgaugaggaccuuacgcaaguuaaugugaaccugaagaagcucaaauuucaggggugggauaagaccagccuggaaaauacauucauucacaacaccggaaaaacaguggagaucaaucugaccaacgacuaccgcgucuccggcggggugucugaaaugguuuuuaaggcgagcaaaaucacauuccauuggggaaagugcaauauguccucugauggcagcgagcacucccucgagggccagaaguuuccccuggaaaugcagauuuauuguuucgacgcugauagauuuagcucuuucgaggaagccgugaaagggaagggaaaacuucgggcccuguccauccucuuugaggucggcaccgaggaaaaccuggacuucaaggcuauuaucgaugggguggagagcguuucucgcuuuggaaaacaagccgcucuugacccuuucauucugcucaaucugcugcccaacuccacggauaaguacuauaucuacaauggcagccucaccucuccucccugcacagacaccguggauuggauugucuuuaaagacacaguguccaucagcgaaucccagcuggccguguucugugagguccuuaccaugcagcagucuggguacguuaugcugauggacuaucuccaaaacaacuucagagaacagcaguacaaguuuagccggcaaguguucuccagcuauacgggaaaggaggagauccaugaagcggugugcagcuccgagccugaaaauguccaggccgauccggagaacuacacaagccugcuugugaccugggaacgccccagaguuguguaugacacaaugauugagaaauuugcuguccuguaccagcagcucgauggcgaggaccaaaccaagcacgaguuccugaccgauggcuaucaggaccugggggccauccucaauaaccugcuuccuaauaugucuuacgugcugcagauuguugcuaucuguacaaacggacucuacggcaaauauagcgaucagcugauuguggacaugcccacggauaauccugaacuugaccuguuucccgaacucaucgggaccgaggaaaucauuaaggaggaggaagagggaaaagauaucgaagagggcgccauugucaacccggggcgggacuccgcgacaaaucaaauccgcaagaaggagccucagauuucuaccacaacccauuacaacagaaucggaacgaaauauaaugaagccaagacaaaccggagccccacccgcggcuccgaguucagcggcaaaggggacgugccuaauaccucucugaacuccacaagccagcccgucaccaagcuggcuacagaaaaagauaucucucucacgucccagaccgugacagagcugcccccucacaccguugaaggaacaagcgccucccuuaaugacggcucuaagaccgugcugagaagcccgcacaugaaccucuccgggacggcugagucucugaacaccgucagcauuacagaguacgaagaggaaucccugcuuaccagcuuuaagcucgauacaggagccgaggacucuuccggcagcucucccgccaccuccgcuaucccuuucauuagcgaaaauaucucucaaggguauauuuuuagcuccgagaaccccgagacgaucacauacgaugugcugauuccugaaagcgcgcggaaugccucugaggacuccaccagcuccggcucugaagagagccugaaagaucccuccauggaaggaaacguuugguucccgucuagcacagacaucaccgcucagccugaugugggcuccgggagagagucuuuucuccagaccaauuauacagagauccgcgucgacgaaagcgagaagacgaccaaauccuucagcgccggacccgugaugucucagggcccuuccgugacagaucuggaaaugccccauuacagcaccuuugccuacuucccuacagagguuacgccccacgcuuucaccccgucuucccggcaacaggaccuugucagcacagugaacguggucuauucucagaccacccaaccuguguacaaugaggccuccaacagcucccaugaaagcagaauugggcuggcggagggacucgaaucugagaagaaagcuguuaucccccuggugauugucagcgcccugacauuuaucugccuugugguucucgugggcauucugaucuauuggcgcaaguguuuccagaccgcccacuuuuaccuggaagauuccacaucuccccgggucaucagcacgccuccgacccccauuuucccuaucuccgacgacgugggggcuauucccaucaagcacuuuccuaaacauguugccgaucuccacgcuucuagcggcuucacagaggaguuugaagaggugcaguccugcaccgucgaccugggaauuacagccgauucuagcaaucaucccgacaacaagcacaaaaauagauauaucaacaucguggcguacgaucauucccgcgugaaacuugcccagcuggcugaaaaagacggcaagcucaccgauuauauuaaugccaacuacgucgacggguacaaucggccuaaggcuuauaucgccgcgcaaggaccccugaagucuacggccgaggauuucuggagaaugauuugggaacacaacguugaggugaucgugaugauuaccaaccuggucgagaagggccgccggaaaugcgaccaguacuggccggcugaugggucugaagaguauggaaauuuucuugugacacagaaguccguucaggugcucgccuacuauaccgucagaaacuucacacugcgcaauaccaaaaucaagaaaggcagccaaaaggggcggccuucuggcagagugguuacacaguaccacuauacccaguggcccgacaugggagugccugaauacucccugcccguccucacguuugugcggaaggcugccuacgccaaacgccaugcuguuggcccgguggucgugcacuguagcgcgggggugggaagaacaggcaccuauaucguccuggauuccaugcuucagcaaauucagcaugaggggaccguuaacaucuucggauuucugaagcacauucggucucagagaaauuaccucgugcaaacagaggaacaguauguguucauccacgacacccuggucgaggccauucugagcaaagaaacggaggugcuugacucccauauccacgcuuacguuaacgcccuccugauuccuggccccgccgggaagacaaaacuggaaaagcaguuccagcuccugagccaaucuaauauccagcaguccgauuauagcgcugcccuuaagcagugcaaccgcgagaaaaaucggaccucuagcaucauuccuguggagagaucccgcgucggcaucucuagccuguccggagaaggcacagacuacauuaacgcgucuuauaucaugggguacuaccaaagcaaugaguuuauuaucacccagcauccccuccugcacacaaucaaggauuucuggagaaugauuugggaccauaacgcucagcuggugguuaugauccccgauggacagaauauggccgaagacgaguuuguguauuggccuaacaaagaugaaccgauuaauugugaguccuucaaggucacccuuauggccgaggaacacaaaugccugagcaacgaggaaaagcucaucauucaagacuuuauccuggaggcuacgcaggaugacuacgugcucgaaguccggcacuuccagugucccaaguggccuaaccccgauucuccuaucuccaaaaccuuugagcugauuagcgugaucaaggaggaagccgcgaaucgcgacggccccaugauuguucaugacgagcacgggggagugacagcuggcaccuucugcgcccuuacaacccugaugcaucagcucgaaaaagagaacuccgucgauguguaucaaguugccaagaugaucaaucugaugagaccuggcguguuugcugacauugaacaguaccaguuccuguauaaagucauccuuucucuggugagcacgcggcaagaggagaacccguccacaucucucgauagcaauggggccgcucugcccgacggaaacauugccgaaucccucgagagccugguguga

SEQ ID NO: 74465 - RNA, 1173 nt, Artificial Sequence
  derived and/or modified sequence opt5 from PTRF__Homo_sapiens__NP_036364
auggaggaccccacccuguacaucguggaaagaccucucccgggcuaucccgaugccgaggcuccugaacccagcuccgccggggcgcaggcugccgaggaaccuucuggagccggcagcgaggagcugauuaaguccgaccaagucaacgggguucuugugcugucucuccuggauaaaaucauuggagcuguggaccagauccagcuuacacaggcccaacuggaggaacggcaggcugaaauggagggcgccguccagagcauucagggggagcucuccaagcugggaaaagcgcacgccacgaccucuaauacagugagcaagcugcucgaaaaaguucgcaagguguccgucaacgugaagaccguuagaggcagccuggagcggcaagcuggccagaucaaaaagcuggaagugaaugaggccgaacuucuccgcagacggaacuucaaagucaugaucuaccaggaugaggugaagcugcccgcuaaacuuucuauuuccaagagccugaaggagucugaagcccucccugagaaagaaggggaggaacugggagagggcgagcgcccggaagaggacgcggccgcucuggaacucuccagcgaugaggccguggaagucgaggagguuaucgaagagucuagagcugaacggauuaagcgcuccgggcugagacggguggacgauuuuaaaaaggccuucagcaaagagaagauggagaaaacaaaggugcgcaccagagaaaaucuugagaagacacggcugaaaaccaaggaaaaccucgagaaaacgcgccauacccuggaaaagagaaugaauaaacuuggaacacggcugguccccgccgagagacgcgagaagcucaagaccucccgggacaaacugagaaagucuuuuacaccugaucacgugguuuaugcucgcagcaaaaccgcgguguacaaggugcccccuuucacguuucaugucaaaaagauccgggaaggccagguugaggugcugaaggccacagaaauggucgaggugggggcugacgaugacgaaggaggcgccgagagaggcgaggccggggaccuccgccggggauccagccccgauguccacgcucugcuugaaauuaccgaggaaucugacgccgugcugguugauaaauccgacagcgauuga

SEQ ID NO: 74466 - RNA, 645 nt, Artificial Sequence
  derived and/or modified sequence opt5 from PTRH1__Homo_sapiens__NP_001002913
augagacccggcggguuccugggagccggccagcggcucagccgcgcuauguccagaugcgugcuggagccucggccgcccgggaagcgcuggauggucgccggacuuggcaacccugggcugcccggaaccagacacucuguuggcauggcggugcucggccaacuggcucggcgccuugggguggccgaaagcuggacaagagaccggcauugugccgcugaucuggcccucgcuccucugggagacgcccagcugguccuccugcgccccagacggcuuaugaaugcgaacggccgcuccguggccagagcugccgagcuguuugggcucacggcugaagagguuuaccuggugcacgaugaacuugacaaaccucugggacggcucgcccugaagcugggcgggucugcgcgcggacauaauggcgucagaagcugcaucuccugucucaacucuaaugccaugccgcggcugagagugggcauugggcgccccgcucacccugaggccguucaggcucaugugcuuggaugcuucagccccgccgagcaggaacugcucccucugcuucuggaucgggccaccgaccucauccuggaucacauuagagagcgcucccaaggccccagccuggggccguga

SEQ ID NO: 74467 - RNA, 540 nt, Artificial Sequence
  derived and/or modified sequence opt5 from PTRH2__Homo_sapiens__NP_057161
augcccagcaagucccuggugauggaguaccucgcccacccuucuacccugggccuugcugucgggguugccugcggaaugugucugggcuggagccucagagugugcuucgggaugcugccgaaauccaagacaucuaaaacgcauaccgacacagaaagcgaggcguccauccuuggagauucuggcgaauauaagaugauucuggugguccggaacgaccucaaaauggggaagggaaagguggcugcccaguguagccacgccgcuguuuccgccuacaaacaaauccagcgcagaaaucccgagaugcugaagcagugggaauauugcggccagccuaaaguggucgugaaggcucccgaugaggagacccugauugcccuccuggcgcaugccaaaaugcuuggccugacaguuagccucauccaagacgcugggcggacccagauugccccuggaucucagacagugcugggcaucgggcccggaccugcugaucuuaucgacaaggucaccggccaccugaagcucuacuga

SEQ ID NO: 74468 - RNA, 423 nt, Artificial Sequence
  derived and/or modified sequence opt5 from PTRHD1__Homo_sapiens__NP_001013685
augcacagaggcguggggcccgccuuccgggucguucgcaagauggcugccagcggagcggagccucaggugcuggugcaauaccucguccugagaaaagaccuuucccaggcuccguuuucuuggcccgccggcgcccugguggcucaggccugccaugcugccaccgcggcccuccacacacaucgggaucacccucauacggcugccuaucugcaggaacuugggcgcaugagaaagguugugcuggaggcucccgacgaaaccacacucaaagagcuggccgaaacccugcaacagaagaacaucgaucacaugcucuggcuggagcagccugagaauauugcgacauguaucgcccuucggcccuacccuaaagaagaggucggacaguaucugaagaaguuccgccucuuuaaauga

SEQ ID NO: 74469 - RNA, 438 nt, Artificial Sequence
  derived and/or modified sequence opt5 from PTS__Homo_sapiens__NP_000308
augagcaccgagggcgggggaagacggugccaggcccaagugucccgcagaaucucuuucagcgcuucccaccggcuguacucuaaguuucucagcgacgaagagaaccugaaacuuuucggcaaguguaauaaccccaaugggcauggacacaacuauaaagucguugugacagugcauggcgaaauugauccugccacggggauggucaugaaucuggcggaccucaagaaauacauggaggaagcuaucaugcagccgcuggaucacaagaaccuugacauggaugugcccuauuuugccgacguuguguccaccacagagaaugucgccguguacauuugggauaaccugcagaagguucucccugugggaguccuguauaaagugaagguguacgagaccgacaauaacaucgucguuuauaaaggcgaauga

SEQ ID NO: 74470 - RNA, 609 nt, Artificial Sequence
  derived and/or modified sequence opt5 from PTTG1__Homo_sapiens__NP_001269312
auggccacccugaucuacguggacaaggagaacggcgaacccgggacaagagucguugcuaaagauggacucaagcugggcagcgggccuuccauuaaagcccuugacggacggucucaggugagcacgccgcgcuucggcaagaccuuugaugcgcccccugcucugcccaaagccacaagaaaggcccucgggaccgugaaucgggcuacagagaaguccgucaaaaccaagggaccucugaaacaaaagcagcccucuuucagcgccaaaaagaugacagaaaagaccgugaaagcuaaguccucuguuccugccagcgacgaugcguauccggagaucgaaaaauuuuuccccuuuaacccucuugacuucgaguccuuugaucugcccgaggaacaccagauugcccaucucccucugagcggcgugccccugaugauccucgacgaggaacgcgagcuggagaaacuuuuccagcugggcccgccuucucccgucaagaugccuuccccucccugggaaagcaaucuccugcaaucucccuccagcauucuuucuacgcuggauguggagcucccgcccguuugcugugacaucgauaucuga

SEQ ID NO: 74471 - RNA, 429 nt, Artificial Sequence
  derived and/or modified sequence opt5 from PTTG1IP__Homo_sapiens__NP_001273751
auggcccccggcguggcuagagggccuaccccguacuggcggcugcgccucggaggcgccgcgcugcuucugcuccugauccccgucgcugccgcccaggagccucccggggcugccugcucccaaaacacaaauaagacgugugaagagugccuuaaaaacguuuccgcuugucugaagaaaaagaccagaaugcucgaccugaaaacaaccaaggcccugcagcacauuucuccugaugcgagcugcgaagugcaugcuccccagccuuccccggccggacggccccgcggccacugugggcuccugacacuugccucugagccugcuagccugcccggacaggccgcgggcgaacucccucugaaggacagcccccuugugcugcaaaccggcgaucuccuguucccgguccaucugugcuuuuga

SEQ ID NO: 74472 - RNA, 576 nt, Artificial Sequence
  derived and/or modified sequence opt5 from PTTG2__Homo_sapiens__NP_006598
auggccacccugaucuacguggacaaggagauuggcgaacccgggacaagagucgcugccaaagauguucucaagcuggagagccggccuuccaucaaagcgcuugacggaauuucucaggugcugacgcgcagauucggcaagaccuaugaugcuccgagcgcccuccccaaagccacacggaaggcucuggggaccgugaaccgcgccacagaaaaguccgucaaaaccaauggaccuagaaagcaaaaacagcccucuuuuagcgcuaagaaaaugacagagaagaccgugaagacgaaauccucuguuccugccagcgacgaugcguaccccgaaaucgagaaguucuuuccuuucaaccuucuggacuuugaguccuucgaucucccggaggaacggcagauugcccaucugccccugagcggcgugccucucaugauccuggacgaagagggggagcuugaaaaacuguuucagcucggacccccuucucccgucaagaugccguccccucccugggagugcaaucuguucgcugugagcuuuaaacacucuguugauccuggcuguuga

SEQ ID NO: 74473 - RNA, 1146 nt, Artificial Sequence
  derived and/or modified sequence opt5 from PTX3__Homo_sapiens__NP_002843
augcaucugcucgccauccuguucugcgcucuuuggagcgccgugcuggcggagaacuccgacgauuacgaccucauguaugucaaucuggauaacgaaauugacaauggccuucaccccaccgaggauccuacaccgugugcuugcgggcaggaacacucugagugggacaagcuguuuaucaugcucgaaaacagccaaaugagagagcggaugcugcugcaggccacggaugacguucuccgcggagagcugcagagacuucgggaagaacugggccgccucgccgaaucccuggcuagacccugugccccuggggcucccgccgaggcgcggcuuaccucugcccuggaugagcuccugcaggcuacacgcgacgccggaagacggcuggcucgcauggaaggcgccgaggcgcaaagaccugaagaggccgggcgggcucucgccgcugugcuggaggagcuucgccagaccagagccgaucugcaugccgugcagggaugggcugcgcggagcuggcuccccgccggcugcgagacagcuauucuguucccuaugcgcuccaaaaagaucuuuggcucuguccacccggugagacccaugcggcuugagagcuucuccgccuguauuuggguuaaagccaccgacgugcugaauaagacaauccucuuuagcuacgggaccaaaagaaacccuuaugaaauccagcuguaccugucuuaucaauccauugucuucgugguuggaggcgaagagaauaagcucguggcugaagccauggucagccuggggcgcuggacgcaucuuugcggaaccuggaacucugaggagggccugacaucccucugggugaauggggaacuggcggcuaccacaguggagauggccaccggacacaucguccccgaaggcggcauucuucagaucgggcaggagaagaacggauguugcguuggcgggggauuugaugaaacgcuggccuucagcggccggcucacaggguuuaauauuugggacucugugcuguccaacgaggagaucagagaaaccggaggcgcugagagcugucacauucgcggcaauaucgugggguggggagucacagaaauccagccucauggcggggcccaauacguguccuga

SEQ ID NO: 74474 - RNA, 1551 nt, Artificial Sequence
  derived and/or modified sequence opt5 from PUF60__Homo_sapiens__NP_001129505
auggagaacggccagagcaccgccgcuaagcuggggcugcccccucucacaccggaacaacaggaggcccuucagaaagcgaagaaauacgcuauggaacaguccaucaagucugugcuggucaaacaaacgauugcccaccagcagcagcaacucaccaaucugcagauggccgcuguuacaaugggauucggcgacccccuuagcccucugcaguccauggccgcucagagacaacgggcccucgcgaucaugugccgcguguauguggggucuauuuacuaugagcugggagaagauaccaucagacaggccuuugcucccuucggcccuauuaagagcaucgacauguccugggauucugucacaaugaagcauaaaggguuugccuucguggaguacgagguucccgaagcugcccagcuggcgcucgagcaaaugaacagcgugaugcugggaggccggaauaucaaggucggccgcccuuccaacauugggcaggcccagccgaucauugaccagcuugcugaagaggccagagcuuuuaaucggaucuauguggccagcguucaccaagaucugucugacgaugacauuaaauccguguucgaggccuuuggaaagaucaaaagcuguacccucgcucgcgaucccacaaccggcaagcauaagggguacggauucauugaauaugagaaagcgcagucuucccaggacgccgucagcucuaugaaccuguuugaucuuggcgggcaguaccugagagugggaaaggcugugacgccucccaugccucuccugacccccgccacaccgggcggccugccucccgccgcugccgucgcggcugccgccgcuaccgccaaaaucacagcucaagaagccguugcgggggccgcugugcucggaacccugggcacgccugggcuugugucccccgcccugacacucgcucagccccugggaacccuuccucaggccgucauggcggcccaggcuccgggcgugaucacagggguuacccccgcccggccucccauuccugugaccauccccagcgucggagugguuaauccgauucuggcuuccccucccacacucggccugcuggagccuaagaaagaaaaggaggaggaagaacucuuccccgagucugagcgcccugaaaugcugagcgagcaagagcacauguccaucagcgggucuuccgccagacauauggugaugcagaaacuucugcggaagcaggaaagcacggucauggugcuccgcaacauggucgaccccaaggauauugacgacgaucuggagggcgaagugaccgaggaaugcggaaaauuuggcgccguuaauagagugaucaucuaccaggagaagcaaggggaggaagaggacgcugaaauuaucgucaaaauuuucguggaguuuucuaucgcgagcgagacacacaaggccauucaggcucuuaacggacggugguucgccggccgcaaaguuguggccgaagucuaugaucaggagagauucgacaauuccgaucugucugcuuga

SEQ ID NO: 74475 - RNA, 3027 nt, Artificial Sequence
  derived and/or modified sequence opt5 from PUM2__Homo_sapiens__NP_001269681
augagccagcccaucauggugcaaagacgguccggccagggguuccacggaaacucugaggucaaugccauucugagcccucgcuccgaaucuggcgggcucggaguuagcaugguggaguacgugcuguccucuagcccggcugacaaacuugauuccagauuucggaagggcaacuucgggacccgcgacgccgaaacagauggacccgagaagggcgaccagaaaggcaaggcgagcccuuuugaagaggaucagaauagagaccugaaacaaggggaugacgaugacucuaagaucaacggacggggccuccccaaugggauggaugcugacugcaaggauuucaaccgcacgccuggauccagacaggccagccccaccgaggucguggaacggcugggcccuaauacaaacccgucugaggggcuuggaccccugccuaaucccaccgccaacaaaccucucguugaagaguuuuccaaucccgagacacagaaccuggacgcuauggaacaggugggccuggagagccuccaauucgacuauccgggcaaucaggucccuauggauucuuccggggccaccgugggacuguuugacuacaacagccagcagcaacuuuuccagcgcacaaaugcucugaccguucagcaacucacggccgcgcagcagcagcaauaugcccuggcugccgcucagcagccccauauugccggcguguuuuccgcggggcuugccccugcugccuucguccccaaccccuacaucauuucugcugccccuccgggaaccgaucccuauacagccgcuggccuggcggccgcugccacccucgccgggccugcuguggugcccccucaguacuauggaguccccuggggcguuuacccggccaaccuguuucaacagcaggcggcugccgccgcuaauaacacagccagccagcaagcugccucccaggcgcagccuggccagcaacaggugcugagagccggggcuggacagcggccccucaccccuaaucaaggccagcaggggcagcaagccgaaagccuggcugccgcggccgcugccaaccccacgcuugcuuucggacagggccuggccacagggaugccuggcuaccaggugcucgcccccaccgcuuauuacgaccagacaggagcgcuggucgugggcccgggggcccgcaccggacuuggcgcuccuguuagacugauggcccccacccccgugcucaucucuuccgccgcugcccaagcggcugccgccgcugccgcugggggaacagcuagcucucugacgggcagcaccaaugggcuguuucggccuaucggcacacagccgccccagcagcaacagcagcaaccuuccaccaaccuccagucuaauagcuucuauggauccagcucucugacaaacuccagccagucuuccagccuuuucucccacggccccgggcagccuggaucuaccagccugggcuuuggguccggaaauucucucggcgccgccauugggagcgcucuguccggcuucggaagcucugucggcuccagcgccucuuccagcgcuacgcgcagagagucucuuagcacauccagcgaucuguacaagcggucuuccagcucccucgcccccaucgggcaaccuuuuuauaacucucugggauucagcuccucucccagcccgauuggcaugccucugcccucccagaccccugggcauucucucacacccccgccuagccuguccagccacggaucuuccagcucucuucaucugggcgggcucaccaauggcuccggaagauacaucagcgcggcccccggcgcugaagccaaauaucgcucugcuuccagcaccuccagccuguuuucuagcuccucucagcuguucccucccagccggcuuagauacaaccgcuccgacauuaugcccucugggcggagcagacuccuggaggauuuucgcaauaaccgguucccuaaucugcagcucagagaccugaucggacacauuguggaguuuucccaagaucagcacggcucucgcuucauccagcagaaacuugaacgggccacaccggccgagagacaaaugguuuuuaacgaaauccugcaggcugcguaccagcucaugacggacguguucgggaacuaugucauucagaaguuuuucgaguucggaagccuggaucaaaagcuggcccuugcuacccgcauccggggccaugugcucccccuggcccugcagauguacggcuguagagucauucagaaggcccucgaauccaucagcucugaccaacaguccgagauggugaaagagcuggacgggcacguucuuaagugcgugaaagaucagaauggaaaccaugucgugcagaaguguauugaaugcguucaaccucagagccugcaguuuaucaucgacgcuuucaaaggccagguguuuguccucucuacacaccccuaugggugucgggugauucaacgcauccuggagcacugcaccgccgaacagacacugccuauucuugaggaacuccaucagcacaccgagcagcuggugcaagaucaguacggaaauuauguuauccagcauguccuggagcacggcagacccgaagacaaguccaaaauugugagcgagauccgggggaaggugcucgcgcugucccaacauaaguucgcuucuaacgucguggaaaaauguguuacgcacgccagcagagccgagcgcgcgcuucugaucgaugaggugugcugucagaaugacggaccucacuccgcccucuacaccaugaugaaggaucaguaugcgaacuacgucgugcagaaaaugauugacauggcugaaccggcccaacggaagaucauuaugcauaaaaucagaccccacauuacaacccugcgcaaguacacauauggcaagcauauccuggccaaacuugagaaguacuaucucaaaaauagcccugaucugggccccauugggggaccucccaacggcaugcuguga

SEQ ID NO: 74476 - RNA, 969 nt, Artificial Sequence
  derived and/or modified sequence opt5 from PURA__Homo_sapiens__NP_005850
auggccgacagagauagcggcuccgagcaagggggagcugcccugggcucugggggaagccucggccaccccggguccggaucuggcagcggcgggggaggcgggggaggcgggggaggcggcggguccggaggcgggggaggcggggcgccuggaggccugcagcaugaaacccaggagcuugcuucuaagcggguggacauccagaacaaacgcuucuaccuggaugucaagcagaaugccaaaggcagauuucucaagauugccgaaguuggggcuggaggcaacaaaagccggcugacacuuuccaugagcguggccguggaguuccgcgacuaucugggggauuuuaucgaacacuacgcucaacucggaccgucucagcccccugaccuggcccaggcgcaggaugagcccagacgggcccugaaguccgaguuccucguccgcgaaaauagaaaguauuacauggaccugaaagagaaccaacggggccgcuuucuuagaauuagacagacggugaaucgcgggccuggccugggaagcacccagggccagacaaucgcucuccccgcccaagggcugauugaguucagagaugcucuugccaagcugaucgacgauuauggaguugaagaggaaccugcggagcucccggaaggcaccucucugacaguggacaacaaacgguuuuucuuugaugucggguccaauaaguacggaguguucaugcgcguuagcgaggugaaacccaccuauagaaacucuaucacagucccuuacaaggugugggccaaguuuggccauaccuucugcaaauacuccgaagagaugaagaaaauucaggagaagcagcgggaaaaacgggcugccugugagcaacugcaccagcagcagcaacagcagcaggaagagacggcugccgccacccuccugcuucaaggggaagaggagggcgaagaggacuga

SEQ ID NO: 74477 - RNA, 939 nt, Artificial Sequence
  derived and/or modified sequence opt5 from PURB__Homo_sapiens__NP_150093
auggccgacggcgauagcggguccgagagaggaggcgggggaggccccugcggguuccagccugcuucucggggaggcggcgaacaagagacccaggaacuggccagcaagcgccucgacauccagaacaaaagauuuuaccuggaugugaagcagaaugcgaaagggcgguuccuuaagauugcugaggucggagccggcggguccaaaucucgccugacacucagcauggccguugcugccgaauuuagagacucccugggagauuucaucgagcacuaugcucaacuuggcccgucuagccccgagcagcuggccgcgggggccgaagagggaggcggcccucggcgcgcucucaaguccgaauuucuggugagagagaaccggaaguacuaucuggaccucaaagagaaucagcgcgggagauuccugcggauucgccagacggugaacagaggaggcgggggauuuggcgccgggcccggaccuggcggccuucaaagcgggcagaccaucgcucugcccgcccagggacucauugaguuccgggaugcgcuggccaaacuuaucgacgauuacggcggggaagacgaugaacuggcuggaggcccugggggcggagccggcgggccgggaggcgggcucuauggagagcugcccgaaggcacaucuaucaccgucgacuccaagcgcuuuuucuuugaugugggguguaauaaguacggcguuuuccugagagugagcgaggucaaaccuucuuaucggaacgcuauuacagugcccuuuaaggccuggggaaaguucggcggggccuucugcagauacgcugacgagaugaaagaaauccaggagcgccaacgggacaagcucuacgaaagacgcggaggcggguccggaggcggggaggaaagcgagggcgaggaaguugaugaggacuga

SEQ ID NO: 74478 - RNA, 1590 nt, Artificial Sequence
  derived and/or modified sequence opt5 from PUS10__Homo_sapiens__XP_011530879
auguucccccugaccgaggaaaacaagcacguggcccagcuccugcuuaauacaggcacgugcccuagauguaucuuucgguucugcggggucgacuuucaugcuccguacaaacugcccuauaaggagcuccugaacgaacuucaaaaauuccuggagaccgaaaaggaugagcucauucuggagguuaugaauccucccccuaaaaagauccgccugcaggaacucgaggacagcauugauaaccugucccagaauggagaaggcagaaucucugugagccacgugggguccacagccucuaagaacagcaaucuuaacgucuguaaugugugccugggcauucuccaggaguuuugugagaaagacuucaucaagaaaguuugccaaaagguggaagcguccggauuugaguucaccucucuggucuuuagcguguccuuucccccucagcuuagcguucgggaacaugcugccuggcugcucgugaaacaggagauggggaagcagucucugucccugggacgcgaugacaucguccaacucaaggaagccuacaaauggauuacacacccgcuguucagcgaggagcuuggcgugcccaucgauggcaagucucuguucgaaguguccgucguuuuugcucauccugagaccguggaagacugucacuuccucgccgcuauuugccccgauuguuucaaaccugccaagaacaaacagagcguguuuacaagaauggcggucaugaaggcccugaauaaaaucaaggaggaagacuuccuuaagcaguuucccugcccgccuaacucucccaaagcugugugugccguucuggagauugagugcgcucacggggccguguucgucgcgggacgguauaauaaguacucccgcaaccucccucagacccccuggaucauugauggcgaaagaaaacuggagagcuccguggaagaacugaucucugaccaucuccuggccguuuuuaaggcugagagcuucaauuuuuccagcucugggcgggaggauguggacguccgcacgcuuggaaacggcagacccuucgccaucgagcuggugaacccucaccggguccauuuuaccucccaagaaauuaaagagcuccagcagaagaucaauaacagcucuaauaagauucaagugcgcgaccugcagcuuguuacaagagaagcuaucgggcacaugaaagagggagaggaagagaagaccaaaacauauagcgcccugauuuggaccaacaaggccauccagaaaaaggauaucgaguuccucaaugacauuaaggaucugaaaaucgaccagaagacgccgcugcgggugcuccaccgcagaccccuggcuguccgggcgagagugauucauuuuauggaaacacaauacguugaugaacaccauuuccgccuucaccugaaaacccaggccggcacauauaucaaggaguuugugcauggcgacuucgggcggaccaaaccuaacauuggaucccucaugaaugucaccgcugauauccuggagcuggacguggaaucuguggauguugacuggcccccugcccuugaugacuga

SEQ ID NO: 74479 - RNA, 1200 nt, Artificial Sequence
  derived and/or modified sequence opt5 from PUS1__Homo_sapiens__NP_001002019
auggccggcaacgcugagcccccuccggccggggcggcuugcccccaggacagacggagcuguuccggacgcgccggcggggauagagugugggaagacggagagcacccugccaagaaacugaagucuggcggggaugaagaacggcgcgaaaaacccccuaagagaaaaaucguccuccugauggcuuacagcggaaagggcuaucauggcaugcaacggaauguuggguccucucaguucaagaccauugaggacgaucuugugagcgcccuggugcgcuccggaugcauccccgagaaccacggcgaagacaugagaaaaaugucuuuucagcggugugcucgcacagauaagggggucagcgccgcgggacaggugguuucccucaaaguguggcugauugacgauauccuugagaagauuaauagccaucugccuucucacaucagaauccucggccugaaacgggucaccgggggauucaacuccaagaaucgcugcgacgccagaacguacuguuaucugcucccgacauuugcuuucgcccauaaggaucgggacgugcaagaugaaaccuaccgccugagcgcugagacacuucagcagguuaacagacugcucgccugcuauaaaggcacccacaauuuucacaacuucacaucucagaagggcccccaagacccuuccgcgugucgguacauucuggagauguauugcgaggagcccuuugugagagaagggcuugaguucgccgucauccgcgugaaaggacagagcuuuaugaugcaucagauucggaagauggugggccuggucguugcuaucgugaaaggguacgccccugaaucugugcucgagagauccuggggaaccgagaaggucgacgugcccaaagcuccgggccuggggcugguucucgaacgcgugcacuucgagaaguacaaucagcgguuuggaaacgauggccugcaugaaccucuugacugggcccaagaggaaggcaaggucgccgcuuucaaagaggagcacauuuaucccacgaucauugggaccgaaagagaugagcgcagcauggcgcaguggcuguccacacucccuauccacaauuuuucugccaccgcucugacagccggaggcaccggggccaaggugcccagcccccuugaaggauccgagggcgacggggauacggacuga

SEQ ID NO: 74480 - RNA, 324 nt, Artificial Sequence
  derived and/or modified sequence opt5 from PVALB__Homo_sapiens__XP_011545203
augagcaugaccgaccugcucaacgccgaggauaucaagaaagcugugggcgccuucuccgcgacagacucuuuugaucacaagaaauucuuucagauggucgggcugaagaaaaagagcgcugacgauguuaagaaaguguuccauaugcuugacaaggauaaauccggauuuauugaagaggacgaacugggcuucauccucaagggguuuucucccgaugccagagaccugagcgccaaagagacgaagaugcuuauggcugccggagauaaggacggcgaugggaaaauuggaguggacgacccugcugaugucgacuga

SEQ ID NO: 74481 - RNA, 1119 nt, Artificial Sequence
  derived and/or modified sequence opt5 from PVR__Homo_sapiens__NP_001129240
auggccagagcuauggccgcggcuuggccccugcuccugguggcccuucugguccucagcuggccuccgcccggcaccggggacguuguggugcaggccccuacacaaguccccggauuccugggcgauuccgugacgcuuccuugcuaccugcagguucccaacauggaggugacccacgucucucagcucacaugggcucggcauggggaaagcggauccauggccguguuucaccagacccaaggcccuucuuauagcgaguccaagcgccuggaguucguugcugccagacugggggcggaacuccggaaugccucucugcgcauguuuggacuuagaguggaagacgagggcaacuacacaugucuguucgucaccuuuccgcagggcagccgguccguggauaucuggcuccgcgugcuggcuaaaccccagaauacagccgagguccagaagguucaacuuaccggggaaccugugcccauggcuagaugcgugagcacgggaggccggccucccgcccagauuaccuggcauucugaccucgggggaaugccgaacacaucccaggucccuggcuuccucagcgggaccgugacaguuaccucucuguggauccuggugcccuccagccaggucgauggcaaaaaugugacguguaagguugagcacgaaucuuuugagaaaccucaacuccugacagugaaccuuaccgucuauuacccucccgagguguccauuagcggauaugacaauaacugguaccugggccagaaugaagcgacacugaccugcgaugcccgcuccaaccccgagccgaccggguauaauuggucuacaacgaugggaccccugccucccuucgcugucgcccagggcgcucaacuucugaucagaccuguggacaagcccauuaacaccacacucaucuguaauguuaccaacgcccugggggcccggcaggcugaacugacagugcaggucaaggagggaccgccuagcgaacauuccggcaccgagcacgcgagcgccucugcuaaugggcacguguccuacagcgccguuucucgcgagaacagcuccucucaggauccccaaacggaaggaacaagauga

SEQ ID NO: 74482 - RNA, 1554 nt, Artificial Sequence
  derived and/or modified sequence opt5 from PVRL1__Homo_sapiens__NP_002846
auggccagaaugggccuggcuggggccgcgggacggugguggggccucgcucuggggcuuaccgccuucuuucugcccggagugcacagccaggucguucaagugaacgacuccauguacggcuucaucgggacagaugugguccuccauugcucuuuugccaauccucugccgagcgugaagauuacgcagguuaccuggcagaaauccacaaacggaucuaagcagaauguggcuaucuauaaccccagcaugggcgucuccgugcuugccccuuaccgcgagagaguugaguuccugcggcccucuuuuaccgacggcacaauucgccucagcagacuggaacuggaagaugaggggguguauaucugugaguucgcuaccuuuccuacaggaaaucgggaaucccaacucaaccugaccgucauggccaaacccacgaauuggauugagggcacccaggcggugcuucgcgccaagaaagggcaggacgauaaggugcuggucgcuacaugcaccagcgccaacggaaagccuccgucuguuguguccugggaaacaagacucaaaggcgaggcugaauaccaggagauccggaaucccaacgggaccgugacggucaucagccgcuauagacuggugccuucucgggaggcccaccaacagucccuugcguguauuguuaauuaccauauggaccgcuucaaggaaagccugacacucaacgugcaguaugagcccgaagucaccaucgagggauuugauggcaauugguaccugcagagaauggacgugaaacugacaugcaaggccgaugcuaacccucccgccaccgaauaccacuggaccacacucaauggcucucugccgaaagggguugaggcucaaaaccggacgcuuuucuuuaagggaccuauuaacuauucccuggccggcaccuacaucugugaggccacaaaucccauugggacccgcagcggacagguggaagucaacaucacagaguucccuuauacccccucucccccugaacauggcagacgggcugggccggugcccacggcgauuaucggaggcgucgccggcuccauccuccuggugcuuauuguugucgggggaaucgugguggcucugagacgccggagacacacauuuaagggcgacuacagcaccaaaaagcacguuuaugggaauggauacuccaaagccggcauuccucagcaucaucccccuauggcccaaaaccuccaguaucccgaugacagcgaugacgagaagaaagcugggccgcugggcggaucuuccuacgaagaggaggaagaggaagaggaaggcgggggaggcggggagcgcaaggugggaggcccucaccccaaauacgacgaggaugccaagcggccuuauuucaccgucgacgaagcggaggcuagacaggauggguacggcgaccgcacacugggauaucaguacgaucccgaacaacucgaccuggccgagaauauggugagccagaacgauggcucuuucaucagcaagaaagagugguauguguga

SEQ ID NO: 74483 - RNA, 1617 nt, Artificial Sequence
  derived and/or modified sequence opt5 from PVRL2__Homo_sapiens__NP_001036189
auggccagagcugccgcgcugcuccccagccgguccccuccgacaccccugcuuuggccucugcuccugcuucugcuccuggagaccggcgcucaggacgugcgcguccaaguucugcccgaagugagagggcagcucggaggcacgguggagcugccuugccaccuucugcccccugucccggggcucuacaucucucuggugaccuggcagcggcccgaugccccugccaaccaucagaauguugcugccuuccaccccaagaugggaccuagcuuucccuccccgaaaccuggcucugaacgccuuagcuucguguccgcuaagcaaucuacagggcaggacaccgaggccgaacugcaggaugcgacacucgcccugcauggacugaccgucgaggacgagggcaacuauacaugugaauuugcuaccuuccccaaaggcagcgugagagggaugacguggcuccggguuauugccaagccuaaaaaucaggcugaggcccaaaaggugaccuuuucccaggaucccacaaccgucgcgcugugcaucagcaaggaaggaagacccccugcccgcauuucuuggcuuuccagccuggacugggaggcuaaagagacacaggugucuggcacccucgccgggacggugacagucaccucccgguucacacugguuccgagcggacgcgcugauggcgugaccgugaccuguaaggucgaacacgagucuuuugaggagcccgcccuuaucccugugacacuguccguuagauaucccccugaagugagcauuuccggguacgacgauaacugguaccucggacggacggacgccacccugucuugcgauguccgcagcaaucccgagccgacaggcuaugacugguccaccacaagcggcaccuucccuacgucugcuguggcgcaggggucccaacugguuauccaugccguggauagccucuuuaacacaaccuucgucuguaccgugacaaaugcugucggaaugggcagagccgaacaggugaucuuuguucgggaaacccccaacacagccggggcuggagccacgggcgggauuaucggaggcauuaucgcggcuauuaucgccaccgccguggcugccacaggcauucugaucugccgccagcaaagaaaagagcagacccuucagggggcugaagaggacgaagaccuggagggaccucccucuuacaagccucccacaccgaaagccaagcucgaggcgcaggaaaugccuagccaacuguucacccuuggcgccuccgagcacucuccccugaagacgcccuauuuugaugcuggggccagcuguaccgaacaggagaugccucgguaccacgaacucccgacacuggaggagagauccggaccccugcauccuggcgcuaccagccucgggucucccaucccugugcccccuggacccccggccgucgaagacguuucccuggaucuugaggacgaagagggcgaggaagaggaagaguaccuggauaaaauuaauccuaucuaugacgcgcucagcuacucuucccccagcgauuccuaucagggcaagggguucgugaugucucgcgccauguacgucuga

SEQ ID NO: 74484 - RNA, 1101 nt, Artificial Sequence
  derived and/or modified sequence opt5 from PVRL3__Homo_sapiens__NP_001230215
auggccagaacccugcggcccagcccucucugcccgggcgggggaaaggcucagcuguccucugccagccuucugggcgcggggcuccugcuucaacccccuacacccccuccccugcuccugcuccuguucccucugcuucuguuuucccgccucuguggagcucuggccggcccgaucauuguggagccccacgucacggccguuugggggaaaaacgugucucuuaagugccugaucgaagugaaugagaccauuacacagaucagcugggagaaaauucauggaaaguccucucagaccgucgcugugcaccauccucaguacggcuucagcguucaaggcgaauaucaggggagagugcucuuuaaaaacuacucccugaaugacgccacaaucacccugcacaacaucggauucagcgauucuggcaaguauauuuguaaggcugucacauuuccccucgggaaugcccaguccagcaccacggugaccguucugguggaaccuacagucucucuuaucaaaggacccgacucccugauugauggcgggaacgagaccguggcggccaucugcauugcugccacaggaaagccgguggcucauaucgacugggagggcgaucucggcgaaauggagagcaccacgacaucuuucccuaaugaaaccgccacaauuaucucccaguacaaacuguuucccacccgguucgcgcgcgggagacggaucaccugugucguuaagcacccugcccuugagaaagacauucgcuauagcuuuauccuggauauucaauacgcucccgagguguccgugacaggauaugacggcaacugguucgucgggagaaagggagugaaucucaagugcaacgccgaugcuaaucccccuccguuuaaaucuguuuggagccggcuggacggccaguggcccgaugggcugcucgccuccgacaacacgcugcacuucgugcauccucuuaccuuuaauuacagcggagucuacaucuguaaggugacaaacucucugggccagcgcuccgaucagaaaguuauuuauaucagcgccuacaauucuguggcuagccucaacugcuga

SEQ ID NO: 74485 - RNA, 1533 nt, Artificial Sequence
  derived and/or modified sequence opt5 from PVRL4__Homo_sapiens__NP_112178
augccccugagccucggcgccgagaugugggggccugaggcuuggcugcuucugcuccugcuucuggccuccuucaccggaagaugcccggcgggcgagcucgaaacaucugacguggucacgguugugcuggggcaggaugcuaagcugcccuguuuuuaccggggagacagcggcgagcaaguggggcaggucgccugggcccgcguggaugcuggagaaggcgcccaggagcucgcucugcuucacuccaaauauggccugcauguuucuccugccuacgaggggagaguggaacagcccccucccccucggaacccgcucgacggaagcguccugcuucgcaaugcggugcaagccgaugagggcgaauaugagugcagaguuuccaccuuccccgcugggucuuuucaggcccggcugcgccucagagugcuggucccuccccugccuagccucaaccccggaccggcucuggaggaaggccaggggcuuacacuggccgcguccuguaccgccgagggaagcccugcucccucugugacaugggacaccgaagugaagggcacaaccuccagccggucuuucaaacacucccgcagcgccgcugucacgucugaguuucaucucguuccuuccagaagcaugaauggccagccccugaccugcguggugucccaccccgggcuucugcaagaucagcggaucacacauauucuccacgucucuuuccuggccgaagccagcgugcgcggacuggaggaccagaaccucuggcacaucggcagagagggggcuaugcugaagugucuuuccgaaggacagccuccgcccagcuacaauuggacccggcuggauggcccucuccccucugggguucgcguggacggagauacacugggcuuuccuccccuuaccacggagcauuccggcauuuaugucugccacgugagcaacgaguucucuagcagagacucccaaguuacaguggauguccuggacccgcaggaagacucugggaaacagguggaucucgucagcgcguccgugguuguggucggagugaucgccgcucugcuguuuugucuccugguuguggucguggugcuuaugagccgguaccauagacgcaaggcccaacagaugacccagaaguaugaagaggagcugacacucacccgggaaaauucuauuagacgccugcacucccaccauaccgacccucggagccagcccgaggaaucuguuggccugagagccgaggggcacccugauucccuuaaagacaacagcuccugcucugucaugagcgaagaacccgagggacgcuccuacucuacacucacgaccgugcgggaaaucgagacacaaaccgaacugcugagcccuggcuccgggagagcugaggaggaagaggaucaggacgaaggcaucaagcaggccaugaaucauuucgugcaggagaacggaacacuccgcgcgaaacccaccggcaaugggauuuacaucaacggacggggccaccuggucuga

SEQ ID NO: 74486 - RNA, 2760 nt, Artificial Sequence
  derived and/or modified sequence opt5 from PWP2__Homo_sapiens__NP_005040
augaaguucgccuacagauuuagcaaccugcucggcaccguguaucggcgcgggaaucugaacuucacaugcgacggaaauuccgucaucucucccguuggcaacagagugacgguguuugaucuuaaaaauaacaagagcgacacccugccucucgcuacacgguacaaugucaaauguguggggcuguccccggauggacgccuugccauuaucguugacgagggcggggaugcgcugcucgugucucuggucugcagaagcgugcugcaccauuuccacuuuaagggauccguucauucugugagcuucucccccgacggccggaaauuugucgugaccaagggcaacauugcucagauguaucacgccccugggaagaaacgcgaauuuaaugccuuugugcucgauaagacauacuucggacccuaugacgagaccacauguaucgauuggaccgacgauagcagaugcuuugucguuggcucuaaagacauguccacguggguguucggggcugaacggugggauaaccugauuuacuaugcccuuggaggccauaaggacgcuaucguggccuguuucuucgagagcaauucucuggaccucuacucccugagccaagaugggguccuuugcauguggcagugugacaccccucccgaaggacugcgccucaaaccuccggcgggcuggaaggccgaucugcugcagagagaggaggaagaggaagaggaggaagaccaggagggcgaucgggaaacaaccauccgcgggaaggcuacacccgccgaggaagagaaaaccggaaaggugaaauacucuagacucgcuaaguauuucuuuaacaaagagggcgacuucaauaaccugacggccgcggccuuucacaagaaaucccaccuucugguuacaggguucgcuagcggaauuuuucaucuccacgaacugccugaguucaaucuuauccauucccugucuauuagcgaucaauccaucgccagcguggcuauuaacucuuccggcgacuggaucgccuuugggugcagcggacucggccagcugcuggucugggaauggcagucugagagcuacgugcucaagcagcaaggccacuucaacuccaugguugcccuggcuuauucucccgaugggcaguacauugugaccggaggcgacgaugggaaggucaaaguguggaauacacuuagcggauuuuguuucgucaccuuuaccgaacacuccagcggcgugacagggguuacguucaccgcgacaggcuauguggucgugaccucuuccauggacggaacaguucgggccuuugaccugcaucgcuacagaaacuuccggaccuucacgagcccuagacccacacaguuuucuugcguggcugucgaugccuccggcgagaucgugagcgccggggcucaggacuccuucgagaucuuuguguggucuaugcaaaccggacgccuccuggauguucuuagcggccacgaagggccgauuuccggacuguguuucaauccuaugaagucuguccucgccagcgcguccugggacaaaaccgugcggcugugggauauguuugacagcuggagaacaaaggagacccuggcucucacaucugaugcccuggccgugacguuccgccccgacggcgcugaacuugccgucgcuacccugaacucccagaucacauuuugggauccugagaaugccgugcagaccgggagcauugaaggccggcaugaccucaaaacaggaagaaaggagcuggauaagaucaccgcgaaacacgccgcuaagggcaaagccuucacggcucugugcuauucugccgacgggcauuccauucuugcgggaggcaugagcaaguuuguuugcaucuaccacgugcgcgagcaaauccucaugaaacgguucgaaauuucuuguaaccugagccuggaugccauggaggaauuucucaauagacgcaagaugaccgaguucgggaaccuggcucuuaucgaccaggacgccggacaggaggauggcgucgcuauuccccugcccggggugcggaagggcgacauguccagcagacacuuuaaaccugaaauccgcguuacaucucuccgguucuccccgaccggaagaugcugggccgccacaaccacggagggccugcugauuuacagccuugauacacgggugcuguucgaccccuuugaacuggauaccuccgucacaccugggcgcgugagagaggcucugcggcagcaagacuucaccagagcgauccucauggcccugcgccuuaaugaaucuaagcugguucaggaggcucucgaggccgugccccggggagaaaucgaggucgugaccagcucccugccugaacuguauguggagaaaguccuugaauuucucgccucuagcuucgagguuuccagacaucuggaguuuuaccugcucuggacacacaagcugcuuaugcugcauggccagaaacucaagucucgcgcugggacgcugcugcccgugauucaguuccuucaaaagagcauccagagacaccucgaugaccuguccaaacuguguagcuggaaccacuauaauaugcaguacgcccucgcggugucuaagcagcggggaaccaaacgcucccuggauccgcuuggcagcgaagaggaagcugaggccucugaagacgauucccugcaucuccucgggggcggaggcagagacagcgaggaggaaaugcuggccuga

SEQ ID NO: 74487 - RNA, 1500 nt, Artificial Sequence
  derived and/or modified sequence opt5 from PWWP2B__Homo_sapiens__NP_001092107
auggagcccagagccggcugccggcugccugugcgcgucgaacagguugugaacggggcucucguggucaccgugagcuguggagagagauccuucgccggcauccugcuugacugcacaaagaaaucugggcuguuuggacucccgccccuggcgccucuuccccaaguugaugaaagcccugugaaugacucccacggccgggcucccgaggaaggggaugccgaggucaugcagcugggaucuagcuccccuccgcccgcccgcggcgugcagccucccgagacgaccagaccugaacccccgccuccccucguuccuccccugcccgcuggcucucugccuccguaucccccuuacuucgagggggcccccuuuccucauccccucuggcugcgggacacauacaagcucugggugccgcagccucccccucgcaccauuaaaagaacacggcgcagacugagccggaaccgcgaucccggaagacucauccuguccaccauucggcuucgcccuagacaaguccugugugaaaagugcaaaagcacacucucucccccggaggcuuccccuggcccucccgccgcgccccgggccagacgccggcuggggagcggaccggacagagagcugcgcaagcccgaggaaccugaaaauggcgagcccaccgcugccgcuacggcccggagaucuaagcgcgaacggagagaggaggaucgcgcgccugccgaacaggugccccgguccccugugaucaaaauuagcuauucuacaccccaggggaagggagaggucguuaaaaucccguccagagugcacggcagccucgaaccuuuccgcccccagcaagcuccucaggacgauggcucccaggaccccgaggugcuggaucgggaaucuagagaccggccgagcugugccccuuccgcuagcauccccaaacuuaagcugacccgcccuguccccgccggggccgaucuucccccuccgaagauuagacugaagccccaucggcuuggagacucugagcacgagccuguguacagagcugaacugguuggcgagcucaacggguaucugcgcgacuccagccccgcgccuugcgccgauggacccgcuggcgggcuggccgaccucucuagcggauccucuggcgaagaugacgauuuuaaaagcuguccucagggcccgcaagggcgggagggacuggccuuccuuguguccugccccgaaggcagagcugacugugccagcgagucugcgugcuccagcgauucucuggacgaggcucgcuccagcggguccgaaggaaccccugccgauacaggcgaccucucucccgggcauggcgccagcgcuccuuccgucucuagagaggcccggcagaccgugcccccgcugacgguucgccuucacacacagagcguguccgaauguaucaccgaggauggaagaacagucgcugugggcgacauugucugggggcaccggcgcuga

SEQ ID NO: 74488 - RNA, 4440 nt, Artificial Sequence
  derived and/or modified sequence opt5 from PXDN__Homo_sapiens__NP_036425
auggccaagagaagccggggccccgggcgcagaugccugcucgcucuggugcuuuucugugccuggggaacccuggcggucguugcucagaaaccuggcgccgggugcccgucccggugucucugcuuucgcacaacggugagauguaugcaucugcuucuggaggccgugcccgcugucgccccucaaaccucuauccucgaccugcgguucaaccgcauuagagaaauccagcccggagcuuuucggcgccugagaaaucucaacacacugcuucugaauaacaaucagauuaagcggaucccuagcggcgccuucgaggaucucgaaaaccugaaauaccuuuaucuguacaagaaugagauucaguccaucgaccgccaagcguuuaaagggcucgccucucuggaacagcuguaucuccacuucaaccagaucgagacccuggaucccgacagcuuucagcaccuuccuaagcuggagagacucuuccugcauaauaaccggauuacacaccuugugccgggaaccuuuaaucaucuggaauccaugaagcgccucagacuggauucuaacacacugcacugcgacugugagauccucuggcuggcugaucuucugaaaaccuacgccgaaagcggcaaugcucaagccgcggccauuugcgaguauccccggagaauccagggccgcuccguugcuacgauuaccccugaggaacucaacugugagcggcccagaaucacaagcgaaccucaggacgccgaugugaccucugggaauacagucuacuuuaccugccgcgcugagggaaaccccaagccggaaauuaucuggcugcggaacaauaacgagcuuuccaugaaaacggacagcagacugaaucuccuggaugacggcacacugaugauccagaacacccaagagacagaucaggggauuuaucaguguauggccaagaauguggccggagaaguuaaaacccaagaggugacccuccgcuacuucggcucuccugcucggcccacauucgucauccagccucagaacacggaagugcuggugggggaguccgucacccuugaaugcagcgcgacaggacacccuccgcccagaauuucuuggacccgcggcgaccggacaccccugcccguugacccuagagugaauaucacccccuccggcgggcucuacauucagaacgugguccaaggagauagcggcgaguaugccugcuccgcuacgaauaacaucgacucugugcaugccacagccuuuaucauuguucaggcucugccucaguucaccgugacaccccaggaucgcgucgugaucgaggggcaaaccguugacuuccagugugaagccaagggaaauccgccucccgugauugcguggaccaagggcgggagccagcuguccgucgaucggagacaccuugugcucagcucuggaacacugcggaucuccggcgucgcucugcaugaccagggccaauacgagugccaggccgugaacauuaucgggagccagaaaguuguggcccaccucacgguccagccucgcgugacccccguuuuugcuucuaucccuagcgauacaaccguggaagucggagccaaugugcaacugcccuguuccucucagggcgagccggaaccugcuauuacauggaacaaggacggggugcagguuaccgagagcggaaaauuccacaucucccccgagggcuuucuuacgauuaaugaugucgggcccgccgacgcgggcagauaugaaugcguggcccggaacaccaucggaagcgcuucuguguccaugguccugagcgugaacguuccugaugugucuagaaauggcgacccguucgucgccacauccauuguggaggcuaucgccaccguugaccgcgcgauuaacagcacacggacccaucucuuugauuccagaccccgcucuccuaaugaccugcuggcccuuuucagauacccccgggauccuuauacgguggaacaagcucgcgccggggagaucuuugagagaacacuccagcugauccaggaacacguccagcauggacugaugguggaccucaacggcaccagcuaccacuauaaugaucugguuucuccccaauaccuuaaccugauugcuaaucucuccggguguacagcccaucggcgcgugaacaauugcagcgacauguguuuccaccagaaguacagaacccacgauggaaccugcaacaaucugcagcauccuauguggggcgccucccugacagcuuuugagcggcuucucaaaagcgucuaugaaaacggguucaauacgccccgcggcaucaacccgcacagacuguacaauggacaugcgcugccuaugccccggcucgugucuaccacacugauuggcaccgagacagugaccccugacgaacaguuuacgcacaugcuuaugcaaugggggcaguuccuggaucacgaccucgauuccacagucguugcccugagccaggcucgcuuuucugacggacagcauuguuccaacgugugcagcaacgaucccccguguuucucugugaugaucccucccaaugacagcagagcccgguccggcgccagaugcauguucuuuguccgcagcucuccugugugcggguccggaaugaccagccugcuuaugaacuccguuuauccccgggagcaaauuaaucagcucaccucuuacaucgacgcuagcaacguguauggcuccacagagcacgaagccagaucuauccgcgaucuggcgagccaucgggggcugcucagacagggcauuguccaacgcuccggaaagccccugcuuccuuucgcuaccggcccgcccacagaguguaugcgggacgaaaaugagucuccuauccccugcuuucuggccggggaucacagagccaacgaacagcucggacugacgagcaugcauacccugugguuccgcgagcacaaucggauugcuacagagcuucugaaacucaacccucacugggacggcgauaccaucuacuaugaaacaagaaagauugugggggccgagauccagcauaucaccuaccagcacuggcugcccaagauucucggagaaguuggcaugcggacgcugggggaguaccauggcuaugacccuggaaucaaugcgggcauuuuuaacgcuuucgccaccgccgcuuuucgcuucgggcacacacuugugaauccgcugcucuacagacuggaugaaaacuuucaacccaucgcccaggaccaucugccucuucacaaggcuuucuuuucccccuuccggauugucaaugagggaggcaucgauccucugcuccgcgggcuguuuggaguggccggcaaaaugagaguucccagccagcuccugaacaccgagcuuacagaacggcuguucucuauggcgcacaccguggcccucgaccuggcugccaucaauauucagagaggccgcgaucaugggaucccgccuuaucacgacuaccgggucuauuguaaccuguccgcugcccauacauucgaggaucuuaaaaacgaaauuaagaaucccgagaucagagagaaacugaagcgccucuacggaagcacccugaacauugaccucuuucccgcccuggugguggaagaccuugucccuggcucucggcuggggcccacgcugaugugccuccuguccacacaauucaagagacuucgcgauggagaccggcugugguaugagaauccuggcguuuuuagcccggcucagcucacccagaucaaacagaccucucuggcgcgcauucucugugauaacgccgacaauaucacaagagugcaauccgauguguucagagucgcugaauuuccccacggguacggaagcugcgacgagaucccucggguggaucugcgcguuuggcaggacuguugcgaagauuguagaacccggggccaguucaacgccuuuuccuaccacuuccgcggcagacggagccuugaguuuucuuaucaggaggacaagcccacgaaaaagacaagaccucgcaaaauucccagcguggggcggcaaggagaacaucuguccaauucuaccagcgccuucuccacaagaucugaugcuagcggcaccaacgacuuucgcgaguucguccuggaaaugcagaagacaaucaccgaccuccggacgcagauuaagaaacuggaguccagacuuucuaccacagaaugcguggaugccgggggagagagccacgcgaauaacaccaaguggaaaaaggacgcuuguacaaucugcgagugcaaagauggccaaguuaccuguuucguggaagccugcccgccugccacgugugcuguccccgugaauauuccuggggccugcugucccgucugccugcagaagcgggcggaggaaaagccuuga

SEQ ID NO: 74489 - RNA, 4392 nt, Artificial Sequence
  derived and/or modified sequence opt5 from PXDNL__Homo_sapiens__NP_653252
auggagcccagacuguucugcuggaccacacucuuucugcuugccggcuggugucugccugggcucccgugccccagccggugucugugcuucaaguccacggugcgcuguaugcaccuuaugcuggaccauaucccucaggucccccaacagaccacaguucucgaucugagauuuaaccggauucgcgaaaucccuggaucugcuuucaaaaagcugaaaaaucucaacacccugcuucugaauaacaaucacauuagaaagaucagccggaacgccuuugagggccucgaaaaucugcuuuaccuguaucucuacaaaaacgagauucaugcgcuggacaagcagacauucaaggggcugaucucccucgaacaccuguauauccauuuuaaucagcuugagaugcugcaacccgagaccuucggagaucuccugcgccuugaaagacuguuucuccacaacaauaaacugucuaagauuccugcuggcagcuucuccaaccuggacucucucaaacggcugcgccuugauagcaaugcccuggugugcgacugugaucucauguggcugggggagcuucugcagggauuugcccagcacggccauacacaggcugccgcuaccugcgaauacccgagacggcuccacggccgcgccguggcguccgucacgguggaggaguucaacugucaaagccccagaaucaccuuugaaccucaggacguugaggugcccucugggaauacagucuauuuuaccugccgggccgaaggaaacccuaagcccgagauuaucuggauucauaacaaucacucccuggaucuggaagacgauacacgccucaacguguucgacgauggcacccugaugaucagaaauacgcgggagagcgaccaggggguuuaccaguguauggcuagaaacucugccggagaggcuaaaacacaauccgccaugcuucgcuauagcucucugccggcgaagccuuccuucgugauucagccccaggacaccgaaguccucaucggcacaagcaccacccuggagugcauggccacagggcacccucauccccugaucacguggacccgggauaauggacuugaacucgacggcuccagacacguggcuacaucuagcggccuguaccugcaaaacauuacccagcgcgaucaugggcgguucacaugccacgccaauaacucccauggaaccgugcaggcugccgccaauaucauuguccaggcucccccucaauuuacgguuacaccgaaggaccagguggugcucgaggaacacgcggucgaguggcugugugaggccgauggcaaucccccucccgugaucguuuggaccaaaaccgggggacagcuuccuguggaaggccagcacacaguccugagcucugggacccucagaauugaccgcgcugcccaacaugaucagggacaguacgagugccaggccguguccagccugggcguuaagaaagugucuguccaacugacagugaagcccaaagcucuugccgucuucacgcagcucccgcaggacaccagcguggaaguuggcaagaacaucaacaucuccugucacgcgcagggggagccucaacccauuaucacauggaauaaagaaggagugcagauuaccgagucuggcaaguuucaugucgaugacgaggggacacugaccaucuaugaugcuggauucccugaccagggccgguacgaaugcguggccagaaacagcuuugggcuggccguuacgaauauguuccucaccgugacagcuauucaaggccgccaggccggagacgauuuugucgaguccagcauccuggacgcugugcagcggguggauucugccaucaacuccaccagacgccaccuuuucagccagaagccccacacaucuuccgaccugcucgcgcaauuucauuauccucgggauccccugauuguugaaauggccagagcuggcgagaucuucgagcacacccugcagcuuauucgggaacgcgucaaacaggggcucacgguggaccuggagggaaaggaauuuagauacaacgaucuggugagcccgcggucccucucucugaucgccaaucuuagcggcuguacagcuagacgcccucugcccaacugcuccaaucgguguuuccaugccaaauauagagcgcacgacgggaccugcaacaaucuccagcaacccacauggggagccgcucugaccgccuucgcucgccugcuucagccugccuacagagauggcauucgggccccgcgcgggcucggccugcccgucggaucuagacagccucugcccccuccccggcucguggcuaccguuugggcgcgcgccgcugccgugacaccugaccauagcuauacgagaaugcugaugcacuggggcugguuucuugagcacgaucuggaccauaccguccccgcccucuccacagcucgguucagcgaugggcgcccguguucuuccgugugcaccaacgacccucccuguuuuccuaugaauacaagacacgccgacccccggggaacccaugcgccgugcaugcuguucgcucgcagcucuccugccugcgccuccggcagacccagcgcuacgguugauucuguguacgcccgggaacagaucaaccaacagacagcguacauugacgggagcaaugucuauggauccagcgagagagagucucaggcucugcgcgauccuuccgugccccggggccuucugaagaccggguuucccuggccuccgagcggcaaaccccuccugccuuucuccaccggacccccuacagaaugugccagacaagagcaggaaucucccugcuuucucgccggcgaccaccgcgcuaacgagcaucuggcccuugcugccaugcacacccugugguuccgggaacacaauagaguugcgacagagcucagcgcccugaacccucauugggaggggaauacgguguaccaggaagcucgcaagaucgucggagccgagcugcagcacaucaccuauucccauuggcuuccgaaggugcugggcgaucccgggacacggaugcucagaggauaccgcggcuauaacccuaaugugaacgcugggauuaucaacucuuuugccaccgccgcuuuccgguuuggccacacacugauuaaucccauccucuacagacugaacgcgacccuuggagaaauuagcgagggccaccuuccuuuccauaaagcccucuuuucccccucucggaucaucaaggaagggggaauugacccgguccugcgcggccuguucgggguugcugccaaauggagagccccuagcuaucuucugucccccgagcucacgcaacggcuguucagcgcugccuacucugcggcuguggauuccgccgccaccaucauucagcgcggaagagaccacggcauucccccuuacguggauuuucgggucuucuguaaucucacaagcgugaagaacuuugaggaccugcagaaugaaaucaaagauucugagaucagacagaagcugcgcaagcuguauggcucccccggggacaucgaucuguggccugcucucaugguugaagaccugauuccgggaacccgggugggccccacacuuaugugccuguucgucacccaauuucagagacuccgcgacggggaucgguucugguacgagaacccuggaguguuuacacccgcccagcugacccagcucaaacaagcgagccugucuagaguucuuugugacaauggcgauuccauccaacaggugcaggcugacgucuucgugaaggccgaguauccucaggauuaccugaacugcagcgaaauucccaaaguugaccugcgcguguggcaggauuguugcgccgacugucgguccagagggcaguuucgcgcugucacgcaagagagccagaagaaaagaucugcccaguauagcuacccgguggauaaggacauggaacucucccaucugcggucucgccagcaagauaagaucuaugugggagaggacgcuagaaaugucacaguucuugccaaaaccaaguucagccaggacuuuuccaccuucgcggccgaaauucaggagacaaucaccgcucugcgggagcagaucaacaaacucgaagcccgccugagacaagcuggcugcacggaugugcggggcgugccuagaaaggccgaggaacgcuggaugaaagaggacuguacacacugcauuugcgaaucugggcaggucaccugugugguugagaucugucccccugcccccugcccuagccccgagcucgugaagggaacaugcuguccggucugccgggauagaggcaugccuuccgacucucccgaaaaacgcuga

SEQ ID NO: 74490 - RNA, 1638 nt, Artificial Sequence
  derived and/or modified sequence opt5 from PXK__Homo_sapiens__NP_001276025
auggccuucauggagaagcccccugcuggcaaagugcugcucgacgauaccgucccgcugacagccgcgaucgaagcuagccagucccuucaaucucacacgauugccgggcugagccucccccugccucccaagaaacuuaucggaaacauggacagagaguuuauugccgaacggcagaagggccugcagaauuaccucaacguuaucaccacaaaucauauucuguccaacugcgagcuggugaaaaaguuccucgauccuaauaacuauucugcuaauuacaccgaaaucgcccugcagcaagugagcauguuuuuccgcuccgagcccaagugggaggucguggaaccucuuaaagacaucggguggcggauuagaaagaaauauuuucugaugaagaucaaaaaccagccgaaggagcgccucguucugucuugggcugaucuuggacccgacaaguaccugagcgauaaagacuuccagugucucauuaagcugcugccuuccugccuccaccccuauaucuacagagugacauuugccaccgcgaaugaaagcucugcccugcuuauucggauguucaacgagaaaggcacacugaaggaucucaucuauaaagcuaagccuaaagaccccuuucugaagaaguacuguaauccgaaaaagauucaggggcuugagcugcaacagaucaaaaccuacggacgccagauccucgaaguccugaaguuccugcaugauaaaggcuuuccuuauggccaccuccaugccuccaacgugaugcuggacggggauacgugcagacuucuggaccucgagaauagccugcuuggacugcccucuuucuaccgguccuauuuuagccaguuccgcaagauuaacacccucgaaucuguugacgugcacuguuucggccaucugcuguacgagaugacauaugggagaccucccgauuccguccccguggacagcuuuccuccggcucccuccauggccguggucgcgguucucgaaucuacccugagcugcgaggccuguaagaauggaaugccuacaaucucccggcuucugcaaaugccccucuucagcgaugugcugcugaccacgucugagaaaccucaguuuaagauucccacaaaacuuaaggaagcucuccgcaucgccaaagagugcauugaaaagagacugaucgaggaacagaagcaaauccaccagcaccggcgccugaccagagcucagucccaucacggcagcgaggaggaacggaaaaagagaaaaauucucgcccgcaagaaaucuaagcggagcgcccuggagaacuccgaggaacacucugcuaaguacagcaacuccaauaacagcgcggggucuggagccuccagcccgcuuacaucuccuuccagccccaccccucccuccaccucuggcaucagcgcucugccucccccgccucccccucccccgcccccugccgcuccccucccucccgccuccacagaagccccugcgcagcugucuagccaagcugugaauggcauguccagaggggcccugcuuagcucuauucagaacuuccagaaaggaacgcuccgcaaggccaaaaccugugaccauuccgcucccaagaucggcuga

SEQ ID NO: 74491 - RNA, 588 nt, Artificial Sequence
  derived and/or modified sequence opt5 from PXMP2__Homo_sapiens__NP_061133
auggcccccgcugccagcagacugcgggcggaggcuggccucggggcccugccucgcagagcccuugcucaguaccuccuguuccugcggcuuuauccggugcugaccaaggccgcuaccuccggaauccucucugcccugggcaacuuucuggcgcaaaugauugagaaaaagcgcaaaaaggaaaauagcagaucccucgacgucgggggaccccugcgguacgccguuuauggcuucuuuuucacggggccucuuucucacuuuuucuacuuuuucauggaacauuggauucccccugaggugccccuggcuggacuccgcagacugcuucuggaucggcucguguuugccccugcuuuccugaugcuguuuuuccucaucaugaacuuucuggaaggcaaagacgccagcgcguucgccgcuaagaugcgcggcggguucuggccggcccuuagaaugaauuggcgggucuggacaccccugcaguuuaucaacauuaauuaugugccucucaaguuccgcguucuguuugcuaaccuugccgcccuguucugguacgcuuaucucgcgucccugggaaaauga

SEQ ID NO: 74492 - RNA, 1776 nt, Artificial Sequence
  derived and/or modified sequence opt5 from PXN__Homo_sapiens__NP_001074324
auggacgaucuggacgcccuccuggcugaucuugagagcaccacaucccacaucucuaagagacccguguuccugagcgaagagacgccuuacuccuauccgaccggcaaccauacauaccaggaaauugccguucccccucccgucccucccccuccgucuagcgaggcgcucaaugggaccauccuggacccccuugaucaauggcagccuuccucuagccgguuuauucaccagcagccccaauccagcucuccuguguauggauccagcgcuaaaacaucuuccgugagcaacccccaggacucugucggcuccccgugcagccgcgugggggaagaggagcauguuuacuccuucccuaauaagcagaaaucugccgaacccagcccuaccgugauguccacaagccugggaucuaaccucuccgagcuggauagacugcuccuggaacuuaaugccguccagcacaacccucccggcuuucccgcugacgaggccaauagcucuccgccccugccuggggcucucagcccccuguauggagugccugagaccaacagcccccuuggcggcaaggccgggccgcugacgaaagaaaagccuaagcggaauggaggccgcgggcucgaggauguuagacccucuguggaaagccugcuggacgagcucgaauccagcgucccuucucccgugccugcgaucaccgugaaccaaggagagauguccagcccccagcgggucacaucuacccagcagcaaacacgcauuuccgccagcuccgcuaccagagagcuggaugaacuuauggccucucugagcgacuucaaaauccagggccucgagcagcgggcugauggggaacgcuguugggccgcgggauggccgagagacggcggccgguccucuccugggggacaagacgagggcggguuuauggcccagggaaagacgggcagcuccagcccucccgggggacccccgaaacccggcucucagcuggauuccaugcuuggcagccugcagucugaccucaauaagcuggggguugcuacaguggccaaaggagugugcggcgcuuguaagaagccuaucgccgggcaagucgugaccgccaugggaaaaacauggcaucccgaacacuucguuugcacccacugucaggaggagauuggcucccgcaacuuuuucgaaagagaugggcagccuuacugcgagaaggacuaucauaaucuguuuagcccccgguguuacuacugcaacggcccuauccucgauaaaguggucaccgcucuggaccgcacauggcaccccgaacauuucuuuugugcgcagugcggagccuucuuuggcccggagggguuccacgaaaaggauggaaaggcuuauuguagaaaagacuacuucgauauguuugccccuaaaugcggcgggugcgcccgggcuauucuugagaauuauaucucugcccugaacacgcucuggcaccccgaguguuucgugugcagagaauguuuuaccccuuucguuaacggauccuuuuucgagcaugacggccaacccuacugcgaagugcacuaucaugagcgccgggggucccuguguagcggcugccagaagccgauuacaggaagauguaucaccgcgauggcuaagaaauuucacccugagcauuucgucugcgccuuuugucuuaagcagcugaauaaaggcacauucaaggaacagaacgauaaacccuacugccaaaauuguuuucucaagcuguucugcuga

SEQ ID NO: 74493 - RNA, 420 nt, Artificial Sequence
  derived and/or modified sequence opt5 from PXT1__Homo_sapiens__XP_011512702
augaagggcaaaaacaugaagaaaaagcacgacgggaucguguacgagaccaaagaaguccugaaucccagcccuaagguuacacauugcuguaagucccucuggcugaaauauucuuuccagaaggccuacaugacgcaacuugugagcucccagccggugcccgcuaugucuagaaacccugaucacaaucugcucagccagcccaaagagcauuccauuguccagaagcaccaucaagaagagaucauucacaaacuggccaugcagcuucggcacaucggagacaacauugaucaucgcauggugagagaagaccugcagcaggauggccgggacgcgcucgaucacuuuguuuucuuuuucuuucgcagagugcaaguccugcugcauuucuuuuggaauaaccaccuccuguga

SEQ ID NO: 74494 - RNA, 588 nt, Artificial Sequence
  derived and/or modified sequence opt5 from PYCARD__Homo_sapiens__NP_037390
augggcagagcccgggacgcuauccuggaugcccucgagaaccugaccgcggaggaacuuaagaaauucaagcugaaacuccugagcgugccccuucgcgaaggguacggacggauuccuagaggcgcucugcucuccauggacgcccuggaucugacagacaagcucgucucuuuuuaucuggagacguacggggccgaacuuaccgcuaauguucugcgcgauaugggacuccaggagauggccggccaacugcaggcugccacacaccaggggagcggagcggccccggcuggcauccaggccccuccucaauccgcugccaaacccggccuucauuucauugaccagcacagagcggcccugaucgcucgggugaccaacguggaguggcuccuggaugcccuguaugggaagguccucacagacgaacaguaccaggcugugcgcgccgagccuaccaaucccucuaagaugagaaaacuguuuagcuucacacccgccuggaacuggaccugcaaggaucuucugcuccaagcucugcgggaaucccagucuuaucuuguugaggaccuggagcgcagcuga

SEQ ID NO: 74495 - RNA, 867 nt, Artificial Sequence
  derived and/or modified sequence opt5 from PYCR1__Homo_sapiens__NP_001269208
augagcgugggcuucaucggggccggacagcuggcuuuugcccucgcgaagggcuucaccgcugccgggguccuggccgcucacaaaauuauggccuccucucccgacauggaucuugcuacaguuagcgcccugagaaagaugggagugaaacucacgccucauaacaaggagaccgugcaacacuccgacguccuguuucuugcggugaaaccgcauaucauucccuucauccuggaugaaauuggcgccgacaucgaggaucggcacaucguugugucuugcgcugccggggucacaauuagcuccaucgaaaagaagcucucugcuuuucgcccugcccccagagugauucgguguaugaccaauacaccuguugugguccgcgagggagcgaccguguacgccacaggcacccaugcucagguggaagacggcagacugauggagcagcugcucagcuccgucggguucugcacggagguugaagaggaucugaucgacgccgugaccggacuuagcggcucugggcccgcuuauggagccgccaaaaugcugcuccacuccgaacagcacccuggccaacugaaggauaacgugagcucucccgggggagcuacaauucaugcgcuucacguccuggaguccggcggcuuucggagccuccugaucaaugccguggaggcuucuuguauucgcaccagagaacugcaguccauggccgaccaggagcagguuagcccggccgcuaucaaaaagacaauccucgauaaagugaagcuggacuccccugccgggaccgcgcuuucucccagcggacauacgaagcugcucccucggucccuggcucccgccggcaaagauuga

SEQ ID NO: 74496 - RNA, 270 nt, Artificial Sequence
  derived and/or modified sequence opt5 from PYDC1__Homo_sapiens__NP_690865
augggcaccaagagagaggccauccugaaagugcucgaaaaccugacacccgaggaacuuaagaaauucaagaugaaacuggggacggucccucuccgggagggauuugaacgcauuccgagaggcgcucuggggcagcuugacaucguugaucugaccgacaagcucguggccagcuacuaugaggauuacgcggcugagcugguggucgccgugcugcgggacaugcgcaugcucgaagaggccgcuagacugcaacgggccgcuuga

SEQ ID NO: 74497 - RNA, 294 nt, Artificial Sequence
  derived and/or modified sequence opt5 from PYDC2__Homo_sapiens__NP_001076777
auggccagcuccgcugagcuggacuucaaccuccaggcccugcuugaacaacugucucaggaugagcucagcaaguuuaaaucccugaucagaaccauuucucuuggcaaggaacugcagacagugccccagacggaggucgacaaagcgaaugggaagcaacucguugaaaucuucaccagccacuccugcucuuacugggcuggaauggccgccauucagguguuugagaaaaugaaccagacacaucugagcggccgggcugaugagcacugugugaugccuccgcccuga

SEQ ID NO: 74498 - RNA, 2532 nt, Artificial Sequence
  derived and/or modified sequence opt5 from PYGB__Homo_sapiens__NP_002853
auggccaagccccugaccgacagcgagaaaagaaagcagaucuccgugcgggggcucgcugggcugggagaugucgccgaaguucgcaaaucuuucaacagacaccuucauuuuacacuggugaaggaccggaauguggcgacgccucgcgauuacuucuuugcucucgcccacaccgucagagaccaucuggugggccgguggauucgcacacaacagcacuauuacgagagagauccgaaacggaucuauuaccuuagccuggaguucuauauggggcgcacccuccagaacacaaugguuaaucugggacugcagaacgccugcgacgaggcuauuuaccaacucggccuggaucuugaagaacuggaggaaaucgaggaagacgccgggcucggaaauggcggccuggggagacuugcugccuguuuucuggauuccauggcgacccucggacuggccgcuuauggcuacgggauucgguacgaguucggaaucuuuaaccagaagaucgugaauggcuggcaggucgaggaagccgacgauuggcugcgcuaugggaaccccugggagaaggcuagaccugaauacaugcuccccgugcauuucuauggacggguugagcacacaccugacggcgugaaauggcuggauacccaggucgugcuugccaugcccuacgacacgccugugccgggcuauaagaauaacaccgucaauacaaugcgccuguggucugcgaaagcccccaacgacuuuaagcuccaagauuucaauguuggggacuacauugaagcugugcuggauagaaaccuugccgagaauaucagccgggugcuguauccuaacgacaacuuuuucgagggaaaagaacucagacugaagcaggaguacuuugucguggcugccacccugcaggauauuauccgccgguucaaguccucuaaauucggcugcagagaccccguucgcacauguuuugaaaccuucccugauaagguggccauucagcucaaugacacgcaccccgcucugagcaucccggagcuuaugcggauucuggucgauguggaaaaaguugacugggauaaggcgugggagaucaccaaaaagacaugcgccuacacaaaccauaccgugcucccugaggcucuggaaagauggcccgucuccauguuugagaaacuucugccucgccaccucgaaaucauuuaugccaucaaucaacggcaucuggaccacguggccgcucuguuccccggggacgucgauagacuccgccggaugagcgugauugaggaaggagacuguaagagaaucaacauggcccaccugugcguuauuggcucucaugcggugaauggggucgcucgcauccacuccgagaucgugaagcagagcguuuuuaaagauuucuacgagcuugaacccgagaaguuucagaacaaaaccaauggaauuacaccucggagauggcugcuccuguguaacccgggccuggccgacacgaucguggaaaagauuggcgaggaguuccuuaccgaucucucucaacugaaaaagcugcucccccuggucuccgacgaaguguuuauccgggauguggccaagguuaaacaggagaauaaacuuaaauucagcgcuuuucuggaaaaggaguauaaagucaagauuaacccuucuuccauguucgacgugcaugugaagcgcauccacgaauacaaaagacagcuccugaauugccugcaugucgugacacuuuauaaccggaucaagagagaucccgccaaggcuuuuguuccucgcaccgugaugauugggggaaaggccgcgcccggcuaccacauggccaaacucaucauuaagcuggucacaagcaucggggacgugguuaaucacgauccgguggucggagaccggcugaaggugauuuuccucgagaacuauagaguuucccuggcugagaaagugaucccugccgcugaucuuucucagcaaauuagcaccgccggcacggaagcguccgggacaggcaauaugaaguucaugcugaacggagcccucaccaucggcaccauggacggggcuaacgucgagauggccgaagaggcuggagccgaaaaucuguuuaucuucggccugcgcguggaggacguggaggcccuugauagaaaaggguacaacgcucgggaauacuaugaccaucuccccgagcugaagcaggcggucgaucagauuagcucuggauuuuucuccccuaaagaacccgacuguuuuaaggauaucguuaauaugcugaugcaccaugaccgcuucaaaguguuugccgauuacgaggcuuauaugcagugccaagcccagguggaccagcucuacagaaacccuaaggaauggacaaagaaagucauucggaauaucgccuguagcggcaaguucucuagcgaucgcaccauuacagaguaugcuagagagaucuggggcguggaacccuccgaccugcagaucccgccucccaacauuccccgggauuga

SEQ ID NO: 74499 - RNA, 2442 nt, Artificial Sequence
  derived and/or modified sequence opt5 from PYGL__Homo_sapiens__NP_001157412
auggccaagccccugaccgaccaggagaaaagacggcaaaucagcauucgcggcaucgugggggucgaaaacguugcugagcucaagaaauccuucaauagacaccuucauuuuacacuugugaaggaucggaacguggccacgacccgcgacuacuauuucgcgcuggcucacacagucagagaucaucucgugggacgguggauucgcacccagcagcacuacuaugacaaaugcccuaagcugggccuugauaucgaagaacuggaagagauugaggaagacgccgggcucggaaauggcgggcugggaagacuggccgcuuguuuucucgauucuauggccacacugggccuugcugccuacggcuaugggauccgguacgaguauggaaucuucaaccagaagauucgcgacggcuggcaaguugaagaggcggaugacuggcugagauacgggaauccgugggagaaaagccggcccgaauuuaugcucccugugcauuucuacggaaaggucgagcacaccaacacaggcaccaaauggaucgauacccaggugguucuggcccuucccuaugacaccccugugcccggguacaugaauaacacagucaauaccaugcgccugugguccgcuagagccccuaacgauuuuaaucuccgggacuucaacgugggagacuauauucaggcugugcuggaucgcaaucuggccgaaaacaucucuagaguccucuacccgaaugacaacuuuuucgagggcaaggaacugcggcuuaaacaggaguauuuuguuguggcggccacacugcaagauauuaucagacgcuucaaggcuagcaaguuuggcuccaccagaggggccggaacgguguucgacgcuuuccccgaucaggucgccauucagcucaacgacacacacccugcccuggcuauccccgagcuuaugcggaucuuuguggauauugaaaaacugccuuggucuaaggcgugggagcucacccagaaaacauucgccuacaccaaucauaccguucugcccgaagcucuggagcgcuggccgguggaccucgucgaaaagcugcuuccucggcaccuggagaucauuuaugagaucaaccaaaaacaucucgauagaauuguggcccuguuucccaaggacguugaucgccuucggagaaugagccugaucgaagaggaaggcuccaaacgcaucaauauggcccaccucugcauuguggggagccacgcugucaacggaguggccaagauccauucugacauugucaagacaaaaguguucaaggacuuuuccgagcuggaaccugauaaauuccagaauaagacgaacggcaucacgccccggagauggcugcuccuguguaaucccgggcuugcggagcugauugcugagaaaaucggagaagacuacguuaaggaucucagccagcugacaaagcugcacucuuuucuuggcgacgauguguuccuccgcgagcuggccaaagucaagcaagaaaacaaacugaaguuuucccaguuccucgagaccgaguacaaagugaagaucaauccuagcucuauguuugacguucaggugaagcggauucaugaauauaaaagacagcugcuuaacugccugcacgucaucacaauguacaaucggauuaagaaagauccgaagaaacucuucgugccccgcaccgugaucauuggcgggaaggccgcuccuggauaucauauggccaagaugaucauuaaacugaucacguccguugcugacgucgugaacaaugaucccauggugggcagcaagcugaaagucaucuuucuugagaacuacagagugucccucgccgaaaagguuauuccugcgacagaccugucugagcaaaucagcaccgccgggaccgaggcuuccggaacaggcaauaugaaauucaugcugaacggggcccucaccauuggcacaauggauggagcuaacguggagauggccgaggaagcgggcgaggaaaaucuguucaucuuugggaugcggauugacgaugucgccgcucuugacaagaaaggauaugaggccaaggaauacuaugaggcucugcccgagcucaagcuggugaucgaccagaucgauaacggcuucuuuagcccgaaacagccugaccuguucaaggauauuaucaauaugcuguuuuaccacgacagauucaaaguuuuugccgauuacgaagccuaugugaagugucaggacaaagucucucaacucuacaugaaccccaaggcuuggaauacgauggugcugaagaacauugcggccuccgggaaauucagcucugaucgcaccaucaaggaguaugcucagaauauuuggaacguugaaccuagcgaccugaaaaucucccucucuaaugagagcaacaaggugaauggaaacuga

SEQ ID NO: 74500 - RNA, 2265 nt, Artificial Sequence
  derived and/or modified sequence opt5 from PYGM__Homo_sapiens__NP_001158188
augagcagaccccuguccgaccaggagaagcggaaacaaaucucugugcgcggccucgccggggucgaaaacguuaccgagcugaagaaaaauuucaacagacaccuucauuuuacacuggugaaggaucggaauguggcuacgccucgcgacuacuauuucgcccucgcgcacaccgucagagaucaucuggugggacgguggauucgcacacagcagcacuacuaugaaaaagacccgaagaagaucagcggcggguggcagauggaggaagcugaugacuggcuuagauacggaaaccccugggagaaagcccggccugaguuuacccugcccguucauuucuauggccacguggaacacacaucccaaggggccaagugggucgauacccaggugguucucgcuaugccuuacgacacacccgugccuggauaucgcaauaacgucgugaauaccaugagacuguggucugccaaagcuccgaacgauuuuaaucugaaggacuucaacgugggcggcuacauucaggccguccucgaucggaaucuggcggagaacaucagccgcguucuuuaccccaaugacaacuuuuucgaagggaaagagcugagacucaagcaggaguauuuugugguggccgcuacgcugcaagauauuauccggcgcuucaaguccucuaaauuuggaugcagagacccuguccggaccaauuucgacgccuuucccgauaagguggcuauccagcuuaacgacacacauccuagccuggccauucccgaacucaugagaauccugguugaucuggagcgcauggacugggauaaagcgugggacgugaccguccggacaugugccuacaccaaccacacggugcucccggaagcucuggagagauggccuguucaucuucuggaaacacuccugccccgccaccuucagauuaucuaugagauuaaucagcgguuccugaacagaguggccgcugccuucccuggcgaugucgaccgccuccggagaaugucccugguggaggaaggggccgucaagcgcaucaauauggcucaccugugcauugcgggaagccaugccgugaacggcguugcucggauccacucugagauccucaaaaagaccauuuuuaaagauuucuacgaacuggagccccauaaguuucaaaauaagacaaacgggaucacccccagacgcuggcuugugcuguguaauccuggacucgccgaagucauugccgagcggaucggcgaggacuucauuuccgaucuggaccagcuuagaaaacugcucagcuuuguggacgaugaggcuuucauccgggacguugccaaggugaaacaggaaaacaagcugaaauuugcggcuuaucuggaacgcgaguacaagguccacaucaauccgaacucucucuucgauauucaagugaagagaauccaugaauauaaacggcagcugcuuaauugccugcacgugauuacccucuacaacagaaucaagcgcgagcccaauaaauuuuucguuccucggacagucaugauuggcgggaaggccgcccccggauaccacauggcuaaaaugaucaucagacuggugacggccauuggcgacguggucaaccaugauccugcugugggggaccgccugagaguuaucuuucuugagaauuaucgggugucccucgccgaaaaggucauucccgcggccgaucugagcgagcagaucucuaccgcuggaacagaagccuccggcaccgggaacaugaaguucaugcugaacggagcucucacaauuggcaccauggacggcgccaauguggagauggcggaggaagccggggaggaaaacuuuuucaucuucggaaugcgcguugaggauguggacaaacuggaucagagaggcuacaaugcucaagaauauuacgaccggauuccggagcuucgccaggucaucgagcagcugagcuccggguuuuucucuccuaagcagcccgaucucuuuaaagacaucgugaacaugcugaugcaccaugacagauucaagguuuuugccgauuaugaagacuacauuaaaugucaagagaaggugagcgcucuguauaagaauccucgggaauggacgcgcauggucaucagaaacauugccacauccggaaaauucagcucugaucggaccaucgcccaguacgcucgcgagauuuggggcguggaacccuccagacagcggcuuccugcgcccgacgaggccaucuga

SEQ ID NO: 74501 - RNA, 1260 nt, Artificial Sequence
  derived and/or modified sequence opt5 from PYGO1__Homo_sapiens__NP_056432
augcccgccgagaacagcccugcuccggccuacaagguguccucucacggcggggacagcggacuggauggccucgggggacccggcguccagcugggguccccugacaaaaagaaaagaaaggcgaauacccaaggacccucuuucccuccccuuagcgaauaugcuccuccgcccaacccuaauuccgaucaucugguugccgccaaccccuuugacgauaauuacaacacaaucucuuauaaaccucuccccagcuccaauccguaccugggcccuggcuaucccggguucggaggcuacagcacguuucggaugccuccccacgugcccccucgcaugucuuccccguauugcgggcccuacagccuuagaaaccagccucaucccuucccucagaauccccugggaaugggcuuuaaccggccgcacgcuuucaauuuugggccucaugacaacucuuccuucggaaaucccagcuacaacaaugcccucucucagaacgugaacaugccuaaucaacacuuucgccagaaccccgcugagaauuucucccagauuccuccccagaacgccagccaagucuccaauccggaucuggcgucuaacuuugugccuggcaauaacagcaauuucaccagcccccuggaauccaaccacucuuuuauucccccuccgaauacauucggccaggccaaggcucccccucccaagcaggacuucacccagggggccaccaaaaacacaaaucaaaacuccagcgcucauccuccccaccucaauauggaugacacaguuaaccagucuaacaucgagcugaagaaugugaacagaaauaacgccgucaaucaggaaaacagccgguccucuagcaccgaggcgacgaauaacaauccugccaacggaacccaaaauaaaccccgccagccgagaggcgcugccgaugcuuguacaaccgagaaguccaacaaaagcucucuucauccuaaucggcacgggcacuccagcucugaccccguguauccuugcggaaucuguacaaacgaaguuaaugaugaccaggacgccauucugugcgaggccuccugucagaagugguuucaucgcaucugcaccggcaugacggaaacagcuuacgggcuccugaccgcggaggccagcgcuguguggggaugugauacaugcauggccgacaaggauguccaacuuaugagaacccgggagaccuucggccccuccgccgugggcucugacgcuuga

SEQ ID NO: 74502 - RNA, 1221 nt, Artificial Sequence
  derived and/or modified sequence opt5 from PYGO2__Homo_sapiens__NP_612157
auggccgcuagcgcucccccuccgcccgacaagcuggagggcgggggaggcccugcgcccccucccgcuccuccguccaccgggagaaaacagggaaaggccggccuccaaaugaaaucucccgaaaagaaacggcgcaagagcaacacacaggggccugccuacucccaccugacggaguucgcucccccucccaccccgaugguggaucaucuugucgccucuaauccuuuugaagacgauuucggagcucccaagguuggcguggccgcgccucccuuucugggcagccccgugccuuucgggggauuuagaguccagggcgggauggccggacaggugccgcccggcuauuccacagggggaggcggcgggccucaaccccuccggcgccagccucccccguucccucccaacccuaugggacccgcuuuuaauaugccuccccagggcccgggguacccuccucccggaaacaugaauuuccccucucagccguuuaaccaaccccugggccagaauuucagcccucccuccgggcagaugaugccuggacccguuggcggcuuugggccuaugaucagccccaccaugggacagccgccuagagccgagcuugggcccccuucucugucccaacgguucgcucagcccggcgccccguuuggaccuagcccccuccagcgcccuggccaagggcugcccucucugcccccuaacacauccccguuccccggcccugaccccggauucccuggccccgggggagaagauggcgggaaaccucucaauccgcccgcgagcaccgccuuuccucaggagccccacucuggauccccugcugccgcugugaacggcaaucagcccagcuucccgccuaacuccucugggagaggcggaggcacacccgacgccaauagccuggcucccccugggaaggccggaggcggguccggaccccagccuccgcccggccuugucuauccuugcggggcgugucggagcgaggugaacgaugaccaagaugccauucugugcgaagccucuugucagaaaugguuucaucgcgagugcaccggcaugacggaauccgccuacggacuccugaccacagaggccagcgcuguuugggccugugaccuuugccugaagaccaaagagauccagucuguguauauuagagaaggcauggggcagcucgucgcggcuaaugauggauga

SEQ ID NO: 74503 - RNA, 1479 nt, Artificial Sequence
  derived and/or modified sequence opt5 from PYHIN1__Homo_sapiens__NP_689714
auggccaacaauuacaagaaaaucgugcugcucaagggccuggaggucauuaacgacuaucacuucagaaucguuaaaagccuucuguccaaugaucucaagcugaaccccaaaaugaaggaagaguacgacaagauucagaucgcugaucuuauggaagagaaauuuccuggggacgccggacugggcaagcucauugaguucuuuaaagaaaucccgacccugggggaucuggcggagacacucaagcgggaaaaacugaagguggcuaauaagaucgagucuauucccgugaaaggaaucauuccuagcaagaaaacgaagcaaaaagaagucuaucccgccaccccugccugcacacccuccaaccgccuuaccgcuaagggcgccgaggagacacuggggccucagaaaagaaagaagccgucugaagaggaaaccggaacaaaacggagcaagauguccaaagagcagacccgccccucuuguagcgcuggcgccuccacgagcaccgcgaugggcagaucuccucccccucagacauccagcucugcucccccgaauaccuccagcacagaaucucucaagccucuggccaaccggcaugccaccgcuuccaaaaauaucuuccgcgaggaccccauuaucgccauggugcuuaacgcgacgaagguuuuuaaguacgagagcuccgaaaaugagcaaagacggauguuccacgccacaguggcuacccagacacaguuuuuccaugucaaagugcugaacauuaaucucaagcgcaaauuuaucaagaaaagaaucauuaucauuucuaacuauagcaagcgcaauucccugcuggaaguuaacgaggccagcucuguguccgaagcugggccugaucagaccuucgagguccccaaggacaucauucggagagccaaaaagauccccaaaaucaacauucuccacaagcaaaccagcggauacaucguguauggccuguuuaugcuucauacaaaaauugugaaucggaagacgaccaucuacgagauucaggauaagacagggucuauggccgucguuggaaaaggcgaaugccacaacaucccuugugagaagggggacaaacugcgccucuucugcuuuagacugcggaagagagaaaauaugagcaaacuuauguccgagaugcacucuuucauccagauucagaagaacaccaaucaacgcagccaugauucccggagcauggcucugccgcaggaacagucucaacaccccaaaccuuccgaggcgagcacaacccuccccgagucucaucugaagacgccucagaugcccccgacaaccccuuccagcuccucuuucaccaagaaagacgaaacacaccccggagcccagagcuccccugcuaacuuuagaaucaccucucccacaguggccccuccccugagcuccgauacgagcaccaaucgccacccggccgugccuuga

SEQ ID NO: 74504 - RNA, 1503 nt, Artificial Sequence
  derived and/or modified sequence opt5 from PYROXD1__Homo_sapiens__NP_079130
auggaggccgcuagacccccuccgaccgccggcaaguucguggucguugggggaggcaucgcgggggugacaugcgcugaacagcuggccacgcacuuucccagcgaggacauucuccuggugaccgccuccccugucaucaaagcugugacaaacuucaagcaaauuucuaaaauccuugaagaguuugauguugaagaacagagcuccaccaugcugggaaagcgguuccccaauauuaaagugaucgagucuggcgucaagcagcucaagagcgaggagcauuguaucgugacagaagacgggaaccagcacguuuacaaaaagcugugccuuugugccggagcuaaaccuaagcugauuugcgagggcaaucccuaugugcucggcauccgcgauaccgacuccgcccaagaguuucagaaacagcugacaaaggcgaagagaauuaugaucauugggaacggaggcaucgcccuggaacucgucuacgagauugaagggugugaggugaucugggcuaucaaagauaaggccauuggaaauaccuucuuugacgcuggcgccgcggaguuccugacgucuaaacuuaucgccgaaaagagcgaggcuaaaauugcccauaagcggacccgcuauacaaccgaagggcggaaaaaggaggcuagauccaagagcaaagccgauaacgugggaucugcccugggcccugacuggcacgaaggccucaaucugaaggggacaaaagaguuuucccauaagauccaccuugaaaccaugugcgaggucaaaaagauuuaccugcaggaugaguuccgcauccucaagaaaaagagcuuuacguucccgagagaccacaaaucuguuacagcugauaccgaaauguggcccguguauguggagcugacaaacgaaaagaucuacggaugugacuuuauugucuccgcgaccggcgugaccccuaauguugagcccuuccugcaugggaacagcuucgaucucggagaagacggcgggcugaaaguggacgaucacaugcauacaucucuuccugacaucuaugccgcuggagauauuugcacgaccuccuggcaacugagccccgucuggcagcagaugcggcucuggacacaggcccgccaaaugggcugguacgccgcuaaguguauggccgcggcuuccucuggcgacagcaucgauauggacuuuuccuucgagcuguuugcccacgugaccaaguucuuuaauuacaaaguugugcuucuggggaaguauaacgcccagggacucggcagcgaucacgagcugaugcugagaugcacaaaagggcgggaauacauuaaggucgugaugcagaauggacgcaugaugggcgcuguccucaucggggagaccgaccuggaagagacguucgagaaccuuauccugaaucaaaugaaccucucuuccuauggcgaagaucugcuugacccgaacauugauaucgaggacuacuuugacuga

SEQ ID NO: 74505 - RNA, 294 nt, Artificial Sequence
  derived and/or modified sequence opt5 from PYY__Homo_sapiens__NP_004151
augguguucgucagacggcccuggccugcccugaccacaguucuccuggcccuucuggugugccucggcgcucugguggacgcguacccgaucaagcccgaggcuccuggggaagaugccagccccgaggaacuuaaccgcuauuacgccucccugagacacuaucucaaucuggucacgcggcagcgcuacggaaaaagagacggcccugauacccugcucucuaagacauuuuuccccgacggggaggaucggccugugcgcagcagauccgaaggaccggaccugugguga

SEQ ID NO: 74506 - RNA, 4449 nt, Artificial Sequence
  derived and/or modified sequence opt5 from PZP__Homo_sapiens__NP_002855
augagaaaggaccggcugcuccaccugugccuugugcugcuccugauccuucugagcgccuccgauucuaacagcaccgagccccaguacaugguccucguuccuucccugcugcauacagaagcuccgaaaaagggcugugugcuccugucucaccuuaaugagacggugaccgucagcgccucccuggaaucugggcgcgagaacagaagccucuucacagaccugguggcggaaaaagaucuuuuucauugcguuuccuucacccugccccggauuagcgcuucuuccgagguggccuuucucagcauccaaauuaagggaccuacacaggacuuccgcaaaagaaauaccguccuggugcugaacacacagucucucguuuuugugcagaccgauaagcccauguauaagccuggccaaacgguccgguuccgcgugguguccgucgacgagaauuuuagaccccggaacgaacugaucccucuuauuuaccuggagaauccgcgcagaaaccggaucgcccaguggcagagccucaaacuggaagcugggaucaaucagcuuucuuucccccuguccagcgagccuauucaaggauccuaucgcguuguggugcagaccgagucuggcgggagaauccagcaccccuuuacagucgaagaguucgugcucccuaaguuugaaguuaaagugcagguccccaagauuaucagcauuauggaugagaaagugaacaucaccguuuguggagaauacacauauggcaagccggugccuggccuggccaccgucucccugugccggaagcucagccgcgugcugaauugugacaaacaagaggucugcgaggaguucucucagcagcuuaacuccaauggguguauuacgcaacaggugcauacaaagaugcugcagaucaccaacacaggauuugaaaugaaacucagaguugaagcucggaucagagaggaaggcaccgaucuggaggugaccgccaaucgcauuagcgagaucacaaacauugucucuaagcugaaauucgugaagguugacagccacuuccggcaggggauccccuuuuucgcgcaagugcugcucgucgauggaaaaggcgugccuauucccaacaagcuguuuuucaucuccgugaaugacgccaacuacuauucuaaugcuacgaccaacgaacaggggcuggcccaguuuagcaucaauacaaccuccauuagcguuaacaaacucuucgucagaguguuuacagugcaccccaaucugugcuuccauuacucuugggucgcugaggaucaccagggagcccaacauaccgcgaaccgcguguuuucccuuagcggcucuuacauccaccuggaaccuguugccggcacgcucccgugugggcacacagagaccauuaccgcucauuauacacugaaucggcaggccaugggagaacuguccgagcuuagcuuccacuaccucaucauggcuaagggcgugauugucagauccgggacccauacacugcccguggagucuggagacaugaagggcagcuuugcccuguccuucccuguugaaucugacguggcccccaucgcucgcauguuuaucuucgcgauucucccugauggggaggucgugggagacagcgaaaaauucgagaucgagaacugccuggccaauaagguugaucuuuccuuuagccccgcucagucuccgccugccucccacgcccaucuucagguggcugccgcgccccaaagccucugugcucugcgggccgucgaccagucugugcugcuuaugaaaccugaagccgagcucuccgugagcucugucuauaaccugcugacgguuaaggaucucaccaauuuccccgacaacguggaucagcaggaagaggaacaaggccacugcccuagacccuuuuucauucacaauggcgcuaucuacgugccgcugagcuccaacgaggccgacauuuauagcuuucuuaaggggaugggacugaaagucuucacaaacucuaagauccgcaaaccuaaguccugcagcgugauucccuccguuucugcuggcgccguggggcagggauacuauggcgcggggcucggcgucguggagcggcccuacguuccucagcugggaaccuacaaugugaucccgcugaacaaugaacaaagcuccggccccgucccugagacagugagaucuuauuuucccgaaaccuggaucugggagcuuguugccgugaacagcuccggggucgcugaagugggagugacggucccugauaccauuacagaguggaaagccggcgcuuucugucucucugaggacgccgggcugggaaucagcuccaccgcgagccugcgcgccuuucagcccuucuuuguugaacucacaaugccuuacucugugauucggggcgagguguucacccugaaggcuacgguccuuaauuaucugcccaagugcaucagaguguccguucagcucaaagccagcccggcuuuucuggccucucagaacacaaagggggaagaguccuacuguauuugcggcaaugaacggcaaacccugagcuggacagugaccccuaaaacccuuggaaacgucaauuucucuguguccgccgaggcuaugcagagccucgagcuguguggcaacgaaguuguggagguccccgaaaucaagcgcaaagauacagugaucaagacgcugcucgucgaggcggaggggauugaacaggagaagaccuucuccagcaugacaugcgccucuggagcuaaugugagcgaacagcugucccuuaaacugccuucuaacguugugaaggagagcgccagagccuccuuuucuguccucggcgacauccuggggagcgcuaugcaaaauauucagaaccugcuucagaugcccuauggauguggcgaacagaauauggugcuguucgccccgaacaucuacguucucaacuaucugaaugagacccaacagcucacacaggagauuaaagcgaaggcugugggguaccugaucaccggcuaccaacggcagcuuaacuauaaacaucaggacggauccuacucuacguuuggcgaaagauaugggcgcaaucagggaaacacauggcugaccgccuucguccucaagaccuuugcccaagcucggagcuacaucuucauugaugaggcccacaucacacagucccugaccuggcugagccagaugcagaaagacaauggcugcuuuagaucuuccgggagccuucugaacaaugcgauuaagggaggcguggaagaugaggcuacacucucugccuaugugacgaucgcccugcucgaaauuccucugcccguuaccaacccuaucguccgcaaugcucuuuucugucuggaguccgccuggaacguggcuaaggaggggacacauggcagccacguguacaccaaagcccuccuggcguaugccuuuucccugcuuggaaagcaaaaucagaacagagaaauccucaauucucuggacaaagaggcugucaaggaagauaaccuggugcacugggagcggccccagcgccccaaagccccuguuggccaucucuaccagacacaagcuccgagcgccgaaguggagaugaccuccuacguccugcuugccuaucugacggcucagcccgcgccuaccagcggggaccugacaucugccaccaauauugugaaguggaucaugaagcagcagaacgcucaaggaggcuucuccagcacacaggauaccguuguggcccuccacgcccugucuagauacggggcugccacauuuacccggacggagaaaacagcgcaggucaccgugcaagacagccagaccuucuccacaaacuuccagguugauaauaacaaucuucugcuccugcagcaaauuucucuccccgaacugccuggagaguaugugaucaccgucacgggcgaacgcugcguguaccuucagacaagcaugaaguauaacauucugcccgagaaagaggacuccccuuuugcucugaaggugcagaccgucccgcagacaugugauggccauaaagcccacaccucuuuccaaaucagccucacaauuuccuacaccgggaauagacccgccagcaacaugguuaucguggacgugaagauggucucuggauuuaucccucugaagcccacggugaaaaugcuugaacgguccagcuccguuucucgcaccgaggugagcaauaaccauguccugauuuauguggaacagguuacaaaucagacccucuccuucucuuuuauggugcugcaggauaucccugucggcgaccucaagcccgcuauugugaaagucuacgacuacuaugagacagaugaaagcgugguugccgaguacaucgcgccgugcuccaccgacacggagcacgggaacguguga

SEQ ID NO: 74507 - RNA, 2295 nt, Artificial Sequence
  derived and/or modified sequence opt5 from QARS__Homo_sapiens__NP_001259002
auggccgcucuggacagccucucccuguucaccucucuuggccugagcgagcagaaggccagagaaacacucaaaaacuccgcgcugucugcucaacuucgggaggccgccacgcaggcucagcagacccuggggagcacaaucgauaaggccaccggcauucuccuguacggacuggcuucccgccucagagacacacggcgccugucuuuucuugugagcuauaucgccaccgcgcuggaauacgucagaucccacccccucgauccuauugacacaguugauuucgagcgggaaugcggggugggagugaucgucaccccggagcaaauugaggaagccguggaggcugccaucaaucgccauagaccccagcugcuuguugaacgguaucacuuuaacaugggccugcucaugggggaggcucgcgccgugcugaaaugggcggacggaaagaugaucaaaaaugaggucgauaugcaagugcugcaucuccugggcccuaagcuggaagccgaccuggagaagaaauucaagguugcuaaagccagacucgaagagacggaucggcgcaccgcuaaggacguggucgaaaacggcgagacagccgaucagacccugagccuuauggagcagcugagaggggaagcccucaaauuucacaagcccggagagaauuacaagacaccuggcuauguggugacgccccauaccaugaaccugcugaaacagcaccucgaaauuacagggggacagguccggacccgcuucccuccggagcccaauggcauccugcacauugggcaugcuaaggcgaucaacuuuaauuucggauacgccaaagcuaacaauggcauuuguuuucuuagauucgacgauacaaacccugaaaaggaggaggccaaauuuuucaccgccaucugcgacaugguugcuuggcugggcuauacccccuacaaggugacauacgccucugacuauuuugaucagcucuacgcgugggcuguggaacugauucggagagggcuugccuaugucugucaccaacgcggagaggaacugaaaggccauaauacgcucccuucccccuggcgggacagaccgauggaggaaagccugcuucucuucgaggccaugcgcaaggggaaguucucugagggagaagcuacccugcggaugaaacuugugauggaggauggcaagauggacccuguugccuacagagugaaauauacaccccaccaccgcaccggggauaaguggugcaucuacccuacauaugacuacacccauugucugugcgauuccaucgaacacauuacgcauagccucuguacaaaagaguuucaggcucggagaucuuccuacuucuggcugugcaacgcccuggacgucuauugucccgugcagugggaguacggacgccuuaaucuccacuaugcgguugugagcaagcggaagauccugcaacuggucgccaccggcgcugugagagauugggacgauccccgccucuuuacccugacagcccuucggagacggggcuucccuccggaagcuauuaacaacuuuugcgcccgcgucggggugaccguugcgcagacaacgauggagccccaucugcucgaagccugugugagagacguccugaaugacaccgcuccucgggccauggcugugcuggagucccuuagaguuaucauuacaaacuuccccgccgccaaaucucucgauauccaggugccuaauuuucccgcugacgaaaccaagggauuccaccaggucccguuugcgccuaucguguucauugagcgcacagauuuuaaagaggaacccgagccuggcuucaagcggcuggccugggggcaacccgugggacugagacacaccggcuacguuaucgaacuccagcaugucgugaaagggccuagcggcugcguggagucccuggaagucacgugccgcagagcugacgccggagagaagcccaaggccuuuauucacugggugagccagccgcuuaugugugagguucggcuguaugaacgccucuuccagcauaaaaacccugaggaucccaccgaagugcccggcggguuccugucugaccugaaucuugcuucccuccacgucguggaugccgcgcugguugacugcagcguggcucuggccaagccuuuugauaaauuccaauuugagagacucggauacuucucugucgacccggauagccaccagggcaagcugguguuuaaccggacaguuacccuuaaagaagaccccgggaagguguga

SEQ ID NO: 74508 - RNA, 735 nt, Artificial Sequence
  derived and/or modified sequence opt5 from QDPR__Homo_sapiens__NP_000311
auggccgcugccgcggcugccggcgaggccagacgggugcuggucuacgggggacgcggcgcucucgggagcagaugcguucaggccuuccgggcucgcaacugguggguggccuccguggacgucguggaaaaugaggaagcgucugccagcaucauuguuaagaugaccgauuccuuuacagagcaagcugaccaggugacggccgaagucggaaaacugcuuggcgaggagaagguggaugcuauccuguguguugccgggggaugggcgggcggcaacgccaaaucuaagagccucuucaaaaauugcgaccugauguggaagcaguccauuuggaccucuacaaucagcucccaccuugcuaccaagcaucugaaagaagggggacuccugacacuggccggcgcuaaggccgcccucgaugggacccccggaaugauuggcuaugggauggcuaaaggagcggugcaccagcugugucaaagccuugccggcaagaacucuggcaugccuccgggggcugccgccaucgcuguccugcccgugacacucgacaccccuaugaauagaaaauccaugcccgaggccgauuuuagcucuuggacgccucuggaguuccuuguggaaaccuuucaugacuggaucacaggaaagaaccggcccuccagcggcucucugauucaggucguuaccacagaggggcgcaccgaacucacgccugcguacuucuga

SEQ ID NO: 74509 - RNA, 1002 nt, Artificial Sequence
  derived and/or modified sequence opt5 from QKI__Homo_sapiens__NP_001288014
auggugggcgagauggaaaccaaggagaaacccaagccuacaccggacuaccugaugcagcucaugaacgauaaaaagcugaugagcucccuucccaauuucugcgggaucuuuaaccaccuggaaagacuccuggacgaggaaauuucucggguccgcaaagauauguauaaugacacgcuuaacggaagcaccgagaagagauccgccgagcugccugaugcuguuggccccaucgugcaacuccaggaaaagcuguacgugccugucaaagaguaucccgacuucaauuuuguggggcggauucugggaccucgcggccucacagccaagcagcuggaagcggagaccggguguaaaaucaugguuagaggaaagggcucuaugcgggauaaaaagaaggaggaacagaaccgcggcaaaccgaauugggagcaucuuaacgaagaccugcacgugcucauuacagucgaggaugcucaaaauagagccgaaaucaagcugaaacgggccguggaggagguuaagaaacuucuggugcccgcugccgaaggggaggacagccucaagaaaaugcagcugauggaacuggcuauccucaacggaaccuaccgcgaugccaauauuaaguccccuacagcgcaggccgcucccagaaucauuaccggcccugcccccguccugccgccugcugcccuucggacgcccaccccugcggggcccacaaucaugccccugauucgccagauccaaaccgccgugaugccuaacggaacaccgcaucccaccgcugccauugugccucccggcccugaggcugggcucaucuauacgcccuacgaauauccguacacacuggccccugccaccucuauccuugaguaccccauugagccuagcggaguccugggcgcuguugcgacaaaggugagacggcacgacaugcgcgugcaucccuaucagagaaucgucaccgccgaucgggcugccaccggcaauuga

SEQ ID NO: 74510 - RNA, 1086 nt, Artificial Sequence
  derived and/or modified sequence opt5 from QPCT__Homo_sapiens__NP_036545
auggccggcgggagacaccggcgcguggucggaacccugcaucuccugcuucugguugcugcccuccccugggcgagcagaggcguguccccuucugcuagcgccuggccggaggaaaagaacuaccaccagcccgccauccugaauagcucugcucugcggcaaauugccgaggggacaagcaucuccgaaauguggcagaacgaccugcagccucuccugauugagcgcuaucccggaucuccuggcagcuacgcugccagacagcauaucaugcaacggauucagcgccugcaggcggauugggugcucgaaaucgacacguuccugucccagacccccuauggguacagauccuuuucuaauaucauuuccacacuuaacccuaccgccaaacggcaccugguccucgcuugccauuaugauagcaaguacuucucucacuggaauaaccgcguguuuguuggagccacagacuccgcugugccgugugccaugaugcuggagcuugcgagagcccuggauaaaaagcuccugagccugaaaaccgucucugacuccaagcccgaucucagccugcaacuuaucuucuuugacggcgaggaggcuuuccugcacugguccccucaggauucucucuauggcagccggcaucuggccgcuaagauggccuccacaccccacccucccggggcccgcggaaccagccagcuucauggcauggaccugcucgugcugcuggaucucauuggggcuccgaauccuacguuucccaacuucuuuccuaauucugcgagaugguucgaacggcugcaggccaucgaacacgagcuucacgagcugggacuccugaaagaccauucccuugaaggccgcuacuuucaaaacuacagcuaugggggaguuauucaggaugaccacauccccuuccugagacggggcgugcccguccuccaucugauuccuucuccguuucccgagguguggcacaccauggacgauaaugaagagaaccuggacgaaagcacaaucgauaaucucaacaagauccuucagguguucguccuugaguaccugcaucucuga

SEQ ID NO: 74511 - RNA, 867 nt, Artificial Sequence
  derived and/or modified sequence opt5 from QPCTL__Homo_sapiens__NP_001156849
augagaagcggcgggcggggacgccccagacugcggcucggcgagcgcgggcugauggaaccucuucugccgcccaagagacggcuccugccucgcgugagacuucugccccuccugcuggcccucgcugucggauccgccuucuacaccaucuggucuggcuggcaccggcgcacagaggaacugccucuugggagagagcugcggguuccccucauuggaagccugccugaagcgcgccuuagacggguggugggccagcuggacccgcaacgccucugguccacguaucugagaccccugcucgucgugcggaccccuggcucucccgggaaccugcagguuagaaaagcugccccugugacacuucagcugcucuuucuggauggagaggaggcccuuaaggaauggggccccaaagacagccuguacgggucccgccaucucgcucagcugauggagucuaucccgcacagcccuggacccacccggauucaagccaucgaacuguucaugcuccuggaucuucugggcgcuccuaaucccacauuuuauucccauuuccccagaaccguccgcugguuucaccggcucagaagcauugagaagcgccugcaucggcuuaaccugcuccagucucacccucaggaggugauguacuuccagccgggggaacccuuuggauccguugaggacgaucacaucccuuuccugagacgcggcgugcccguccugcaucucaucagcacaccuuuucccgccguguggcacaccccggcggacacggaagugaaucugcauccucccaccguccacaaccuuugccggauucuggccguuuuccucgcugaguaucugggccuguga

SEQ ID NO: 74512 - RNA, 894 nt, Artificial Sequence
  derived and/or modified sequence opt5 from QPRT__Homo_sapiens__NP_055113
auggacgccgagggccuggcucuccugcuucccccugugacccuggccgcgcucgucgauagcuggcugagagaagacugcccggggcuuaacuacgcugcccugguuuccggagccggccccucucaggcugcccucugggcuaagagcccuggggugcuggccggacaacccuucuuugaugcgaucuucacacagcugaauugucagguguccugguuucucccugagggcucuaaacugguccccguggcccggguugcugaagugcgcgggccugcccacugccuucugcucggagagagagucgcucugaacacgcuugcccgguguagcggcauugcguccgccgcugccgcugccguggaagccgcucgcggcgcgggguggaccggacauguugccggcacaagaaagaccacaccgggguuccggcugguggagaaauauggacuccuggucggcggggcugccucucaccgcuacgaccugggaggccucgugauggugaaggauaaucaugucguugccgcuggcgggguggagaaagccgugagagcggcucggcaggccgccgacuuugcucugaaggucgaaguggagugcagcucccuucaagaagccguucaggcugccgaggcgggagccgaucuggugcuccuggacaacuucaagcccgaggaacuucacccuaccgcuacaguccugaaagcccaguuucccagcguggcuguugaggccucuggcgggaucacccucgauaaucugccucaguucuguggaccccauauugacgugaucuccaugggcaugcugacgcaagcggccccggcucucgauuuuagccugaaacuuuucgccaaggaagucgcuccugugcccaagauucacuga

SEQ ID NO: 74513 - RNA, 411 nt, Artificial Sequence
  derived and/or modified sequence opt5 from QRFP__Homo_sapiens__NP_937823
auggugagacccuacccucugaucuauuuccucuuucugccgcuuggcgccugcuucccccugcucgaccggcgcgagccuaccgaugcuaugggagggcugggcgccggggaaagaugggcggaccuugcuaugggaccccggccucacagcgucuggggcuccucucgcuggcugagagccagccagccccaagcccuccugguuauugcucgggggcugcagacauccggacgcgagcaugccggcuguagauuucgguucggccgccaggaugaagggucugaggcuacgggauuucucccugccgcgggcgaaaagaccagcgggccgcugggaaaccuugccgaggagcugaauggcuacuccagaaagaaagggggauucucuuuucgguucggccgcagauga

SEQ ID NO: 74514 - RNA, 1296 nt, Artificial Sequence
  derived and/or modified sequence opt5 from QRFPR__Homo_sapiens__NP_937822
augcaggcccugaacaucacccccgagcaauucagcagacuccugcgggaccacaaucuuacacgcgaacaguuuauugcucuguacagacuccggccucugguguauacgccggagcuucccggccgcgccaagcuggcgcucguccugaccgggguucugaucuucgcucucgcccuguuuggaaacgcccuuguguucuacguggucacaagauccaaagcuaugcggaccgugacaaauauuuuuaucugcucucuggcccucagcgaucugcuuauuaccuucuuuuguaucccuguuacaaugcugcagaacaucuccgacaauuggcucggcggggcuuucauuugcaagauggugcccuuuguccagucuaccgccgugguuacggaaauccugaccaugacauguauugcgguggagcgccaucaaggacugguccacccuuucaaaaugaaguggcaguauaccaacagacgggccuuuacaaugcucggcgugguguggcuggucgcuguuaucguggggagccccauguggcaugugcagcagcuugaaauuaaauacgauuuccuguaugagaaggagcacaucugcugucucgaagaguggaccuccccuguccaucaaaagauuuacacgacauuuauccuggugauccuuuuccugcucccgcugaugguuaugcugauucucuauucuaaaaucggauacgaacuguggauuaagaaacgcgugggcgacggcagcguccuuagaaccauccacgggaaggagauguccaaaauugcccggaagaagaaacgcgcugugaucaugaugguuacaguggucgcccuguucgcggugugcugggcccccuuucacgucgugcauaugaugaucgaguacagcaauuucgaaaaggaguaugaugacguuaccauuaaaaugaucuuugcuauugugcagaucauuggauucucuaacuccaucuguaauccuaucgucuacgccuuuaugaacgaaaauuucaagaaaaacgugcucagcgcuguuugcuauuguauugugaauaagaccuuuucucccgcccagagacacggcaacuccgggaucacaaugaugcggaaaaaggccaaguucagccugcgcgagaauccugucgaagagacgaaaggagaggcuuuuucugauggcaacauugaagugaaacuuugcgagcagaccgaagagaagaagaaacugaagagacaucucgcgcuguuccgguccgaacuggccgagaacagcccccucgacuccgggcacuga

SEQ ID NO: 74515 - RNA, 1587 nt, Artificial Sequence
  derived and/or modified sequence opt5 from QRSL1__Homo_sapiens__NP_060762
augcugggcagaagccuccgggagguguccgccgcucugaagcaggggcaaaucacccccacagaacuuugccagaaaugucugucucucauuaagaaaacgaaguuccugaacgccuacaucaccgucagcgaggaaguugcgcuuaaacaggcugaggaauccgagaagcgcuauaagaauggacagucucugggcgaccucgaugggauuccuaucgccgugaaagacaacuuuagcacauccggaauugagaccacaugcgccucuaauaugcugaagggcuacaucccgcccuauaacgcuaccgugguccaaaaacugcucgaucagggggcccugcuuaugggaaagacaaaucuggacgaguucgcuaugggcagcggcuccaccgaugggguguuuggaccuguuaaaaaccccuggagcuacucuaagcaguauagagaaaagcggaaacagaauccucacuccgaaaacgaggacagcgauuggcucaucacgggcgggucuuccggaggcagcgccgcggccgugucugcuuucaccuguuacgccgcucugggguccgacacaggaggcagcacccgcaaucccgccgcgcauugcggccuugucggguuuaagccuuccuauggacuggugucuagacacggccucauuccgcugguuaacagcauggaugugcccgggauccugacacggugugucgacgaugccgcuauugugcucggagcccuggcuggcccugacccccgcgauuccaccacggugcaugagccuaucaauaaacccuucaugcuuccgagccuggccgacgucucuaagcucugcauugggaucccuaaagaauaccugguucccgagcuuuccagcgaagugcaaucucuguggagcaaggccgcugaccucuuugaguccgaaggagcgaaagugauugaggucucucugccucacacaagcuacuccaucguguguuaucauguucugugcaccagcgagguggccucuaacauggcuagauucgauggccuccaguacggccaccggugugacaucgaugucuccacagaagccauguaugccgcuacccgcagagagggguuuaaugacgugguucggggacgcauucugagcggcaacuucuuucuucugaaggaaaauuacgagaacuauuucgugaaggcccagaaagucagacggcucaucgcgaacgauuuugugaaugcuuucaacucuggggucgacgugcugcuuacccccacaacgcuguccgaagccguucccuaccucgaguucauuaaggaggauaaucgcaccagaagcgcccaggacgauaucuuuacacaagcugugaacauggccggacugccugcugucuccauuccgguggcccugucuaaucagggccuccccaucgggcugcaguucaucggccgggcguuuugcgaccaacagcuucugaccguugccaaaugguucgaaaagcaagugcaguuuccugucauucagcuccaggagcugauggaugacuguagcgcugugcuggaaaacgagaaacuugccuccgugucucucaagcaguga

SEQ ID NO: 74516 - RNA, 1815 nt, Artificial Sequence
  derived and/or modified sequence opt5 from QSOX1__Homo_sapiens__NP_001004128
augagacggugcaacagcggcuccgggcccccuccgucucugcuccugcuucugcucuggcugcuugccgugcccggagcuaaugccgcgccucgcagcgcucuguauucccccucugacccucucacccugcugcaggccgauacagucagaggcgccguucucgggagccgguccgcuugggccguggaguucuuugcuucuugguguggacacugcaucgccuucgcgcccacguggaaggcccuggcugaagacgugaaagccuggcgcccugcucuuuaucuggccgcgcucgauugugccgaggaaaccaacagcgcugucugcagagacuuuaauauuccgggcuuccccacagugcgguuuuucaaggccuuuaccaaaaacggguccggagcuguuuucccuguggccggcgccgauguccaaacacugcgcgagagacuuaucgacgcucuggaaagccaucacgauaccuggcccccugcgugucccccgcucgagccugccaagcuggaggaaauugacggcuuuuucgcucggaauaacgaggaauaccuggcccucaucuuugagaaagggggaucuuaucugggccgcgagguggcccuugaucugucccagcauaaggggguugcugugagacggguccucaauacagaagccaacguggugcgcaaguucggagucaccgacuuucccagcugcuaccugcuuuucagaaauggcucuguuucccgggugccugugcugauggagagccgcucuuucuauacggcguaccuccagagacuguccgggcugacccgggaagcugcccagacaaccgucgcccccacaaccgcuaacaaaauugcccccacgguguggaagcucgcugauagaagcaaaaucuauauggccgaccuggaguccgcgcuucacuacauccugcgcauugaaguuggacgguuuccugugcucgagggccaaagacuggucgcccuuaagaaauucguggcuguucuggccaaguacuuuccgggccgcccccucgugcagaauuuccugcauucugucaacgaguggcugaagcggcagaaaagaaauaagaucccuuauagcuuuuucaaaacagcucucgaugaccgcaaggaaggggccgugcuggcgaaaaaggucaacuggauuggaugucagggcuccgagccccacuuucggggguucccuugcagccuuugggugcuguuucacuuccucaccguucaagccgcuagacagaauguggaccauucucaggaagccgcuaaagccaaggagguccugcccgccauccgcggauacgugcacuacuuuuucggcugucgggauugcgcuucccauuuugaacagauggcggccgcuagcaugcacagaguugggucuccgaacgccgccgugcuguggcuuuggagcucccacaaccgcgucaaugcucggcucgccggagcgccuucugaggacccccaauucccuaaggugcaguggcccccuagagagcuguguagcgcuugccauaacgaacggcuggaugugcccguuugggacgucgaggccacacucaauuuccugaaagcccacuuuuccccgagcaacauuauccuugauuucccugcugccggcucugcggcucgcagagacgugcagaauguggccgccgcucccgaacuggccaugggcgcucucgagcuggaaucccggaacagcacccuggaucccgggaagccugagaugaugaaaucuccgaccaauacaacgccccaugucccugccgagggacccgaacuuauuuga

SEQ ID NO: 74517 - RNA, 2097 nt, Artificial Sequence
  derived and/or modified sequence opt5 from QSOX2__Homo_sapiens__NP_859052
auggccgcugccggcgcggcuguggccagaagccccgggaucggagccggcccugcucugcgggcccgcagauccccgcccccucgggcugcccgccuccccagacugcuuguccugcucgcggccgcugccguugggccuggagcuggcggggccgcgcggcuguaccgcgccggagaggacgcugugugggugcuugauucuggcagcgucagaggcgccaccgcuaacuccucugccgccuggcuggugcaguucuauagcuccuggugcgggcacuguauuggauacgcucccacauggcgggcgcucgccggcgacguucgcgauugggcuucugccaucagaguggccgcucuggacugcauggaagagaagaaucaagccgucugucaugauuaugacauucacuuuuacccuacguuccgguauuuuaaagcguucaccaaggaauuuacaaccggggagaacuucaaaggaccggaucgcgaacugagaacagugcggcagaccaugaucgacuuucuccagaaucauacagagggcagcagacccccugcuugccccagacuggauccuauucagcccuccgacguucuuagccugcucgauaaccgggggucucacuacguggccaucgucuucgaguccaauagcucuuaucugggaagagaagugauccuugaccugauuccguacgaguccaucguggucacccgcgcccucgauggcgacaaggcuuuucuggaaaaacugggcguuagcucugugccuuccuguuaccucauuuaucccaacgggagccauggacugaucaauguggucaagccucuucgggccuucuuuuccucuuaccuuaagagccuccccgacgugcgcaaaaagucccugccccuuccugagaaaccgcacaaggaggaaaacagcgagauuguuguguggcgcgaguucgauaaaucuaagcuguauacggucgaccucgaauccggccugcacuaccugcuccggguggaacuggcugcccauaagagccuugcgggggccgagcugaaaacccucaaggauuuuguuacagugcuggcuaaacuuuuccccggaagaccucccgucaagaaacugcucgagaugcugcaagaauggcuggccucucucccucuggaccgcauccccuauaaugcugugcuugaucuggucaacaauaagaugcggauuagcggcaucuuccucaccaaccacaucaaauggguggggugccagggauccagaucugagcugcgcggcuacccguguagccuguggaagcuguuucauacacucaccguugaagccuccacgcacccugacgcgcuggugggcacaggguucgaggaugacccccaggccguccugcagaccaugcggagauaugugcacacauuuuucggaugcaaggaauguggcgagcauuuugaggaaauggcuaaagagagcauggauucuguuaagaccccugaccaagccauucucuggcuguggaaaaagcacaauauggugaacgggcgccuugcuggacaucuguccgaagauccccgguucccuaaacuccaguggcccaccccggaccugugcccugccugucacgaggaaaucaagggccuggccagcugggacgaggggcauguccuuacauuucucaagcagcacuacggcagagauaaucugcuggacacguacucugcugaucagggagacuccagcgagggcgggacccucgcgcggggagaagaggaagagaaacgccugacaccucccgaggugucccacggcgauagagacacccaaucugugcggcccccgggggcccuuggacccagaccugcucugcccgaaagccuccaucacucccuggauggcaagcugcagucucuugacgggccuggcgcccauaaagagguuggaggcgccgcucccuuccucggggucgauuuuagcucccuggacaugagccugugcguggugcucuaugucgccucuucccuguuccuuauggugauguacuuuuucuuucgcguucggagcagacgcuggaaggugaaacaccaccauccugcggucuga

SEQ ID NO: 74518 - RNA, 1212 nt, Artificial Sequence
  derived and/or modified sequence opt5 from QTRT1__Homo_sapiens__NP_112486
auggccggcgcugccacccaggcgagccuggaguccgcucccagaaucaugcggcucguggccgaaugcucucgcagcagagcccgggcuggggagcuguggcuuccucacggaacagucgccacgccgguuuucaugcccgugggcacccaagcuacaaugaaggggauuaccacagaacagcuggacgcccucggaugucgcaucugccugggcaacaccuaccaucuugggcugagaccuggacccgagcucauucagaaagcgaauggccugcacggcuuuaugaacuggccucauaaucugcucacagauuccgggggauuccagauggugucucuggucagccuuuccgaagugaccgaggagggcguucgguuucgcucucccuaugacgggaacgaaacgcugcucagcccugagaaguccgugcaaauccagaaugcccugggaagcgauauuaucaugcagcuugacgaugucgugucuuccaccguuacaggcccgagaguggaagaggcuauguaccggagcauccgcuggcuggacagauguauugccgcucaccagcggcccgauaaacaaaaccucuucgccaucauucaagggggacuggacgcggaucugcgcgcuaccugccucgaggaaaugacaaagagagacgucccuggcuuugccaucggcgggcugucuggaggcgaguccaaaagccaguucuggcggaugguggcccuuucuaccucccgccugcccaaggauaagccuagauaucucaugggggugggauacgcuacggaccuggucguuuguguggcccuuggcugcgauauguuugacuguguguuccccacacggaccgccagauuugggagcgcucuggucccgacaggaaaucuccagcugcgcaaaaagguguucgaaaaagacuuuggcccuauugaucccgagugcaccuguccuaccugccagaagcauucccgggcguuccugcacgcccuccugcacucugacaacacagcugcccuucaucaccugacgguucauaauaucgccuaucagcuccagcugaugagcgcugugagaaccuccauugucgaaaaacgcuuucccgauuucgugcgggacuucaugggcgccauguacggggaucccacacuuuguccuaccugggcgacagacgcucuggccagcguuggaaucacccucggcuga

SEQ ID NO: 74519 - RNA, 1323 nt, Artificial Sequence
  derived and/or modified sequence opt5 from R3HCC1__Homo_sapiens__NP_001129580
auggcccugcucugccuggacggcguguuccuuagcuccgcugagaacgauuuuguccacagaauccaggaagaacuggaccgguuccuccugcaaaagcagcuuucuaaaguucugcucuuucccccucugagcucccgccugagauaccucauucaucggaccgccgaaaauuucgaucugcuuucuagcuuuuccgugggggagggauggaagcgcagaacagugaucugucaccaggacauucgggucccgucuagcgauggccuguccgggcccugccgcgcgccugcuagcugucccucuagauaucauggaccucggcccaucuccaaccagggcgccgccgcugugccucgcggggccagagcuggacggugguaccgcggcagaaaaccggaccaaccccucuauguuccucgggugcugcgcagacaggaagaguggggccuuacgagcaccucuguccugaagcgggaggcccccgcggggagagauccugaggagcccggagacgugggcgccggggauccuaauuccgaccagggacucccgguucugaugacacagggcaccgaagaucugaaagggcccggacaacgcugcgagaacgagccucuccuggaccccgugggccccgaaccucuuggcccggagagccagucugggaagggagauauggucgaaauggcuacacgguucggcuccacccugcagcucgaccuggagaaggggaaagaaagccuucuggagaagagacucguggccgaggaagaggaagacgaggaagagguggaggaagauggacccuccucuuguagcgaggacgauuacuccgaacugcugcaggagauuacagacaaucucaccaaaaaggaaauccaaaucgagaaaauucaccuggauacgagcucuuuugucgaggaacuuccuggcgagaaggaccuggcucauguuguggaaaucuaugauuucgagcccgcccucaagaccgaggaccugcuugcgacauuuuccgaguuccaggaaaaaggguuucgcauucaguggguggaugacacccacgcccugggaaucuucccuugccucgcuagcgccgcugaagcccugacacgggaguuuucuguccugaagauuagaccccucacccaaggcacgaaacagagcaagcugaaagcccuucagcgcccgaagcugcuccggcuggugaaagaaagaccucagacaaacgcuaccguugcgcgccggcugguggccagagcucuuggccuccaacacaagaagaaagagcgccccgccguccgggggccucugcccccuuga

SEQ ID NO: 74520 - RNA, 2379 nt, Artificial Sequence
  derived and/or modified sequence opt5 from R3HCC1L__Homo_sapiens__NP_001243548
augcagcaagagagcgaaagaugccgggugcgcgccagacggcccgacauggcucuguacgucccuaaggcccgcagaggcgcgguucuccugaaaaccggggaugaggaagaguccuguggaucuccgaacagcguggugaaggaaaaacagaaggaguccucucuuagccagaaagaggucuucaaggacaagcccgaagcucggcgccugaauaucaacccugauagaaaagagcacaauugccgggaagagaagaaauccucuacaaagcuccgcauggacacgugucugcagaaaaccaacagagugugcagcaagcggggcacaaccgaguccaaggaaguucuuagccaagggcagcagcagggagcccccaaugccggcgugauuacaaacgcuccucugcaacgccauuuuaaacccaagaaagucgagugucucgaaguggagaccacagauguuaccgggcacgaaagaauccugcugucucaggccugccucgagauuuccgaggcucaggugccuagcaagccguuccagaaugucgaauuuugugacuucucucggcaugagcccgauggagaagccuuugaggacaaagaucuggaaggccgcaucgagacggacaccaaggugcuugagauucuguaugaauuuccuagaguguuuuccagcgucaugaaacccgagaacaugaucguuccuaucaagcucucuuccgauagcgaaauugugcaacaguccaugcagacaucugacggcauccugaaucccagcuccgggggaauuaccacaaccagcgugccgggcucuccugauggggucuucgaccaaacgugcguggacuuugagguugaauccgugggaggcaucgcgaacagcacaggguucauucuugaucagaaggacaccgauucuauccccgccacaaugggacacauuagccuguccgagucuaccaaugacaccgucagcccugugaugauccgggagugugagaaaaacgauuccacagcugacgagcuccauguuaagcacgaaccucccgauacggccgugcuggcucacgagacccauagagacagcggcuuuaaaaaugucggcgauaucacaaacaaggccugcaugauggacaccacagggaugucuuguuccgaucacgugaccgucgacagccccuacgugguugcggugcgcauugccgacgagacgucuaucaauacacgguccuucagcaaauuugucggaauguccgcugaugccaccccgcugcauguggcuagaucuggcaacgacaccgaagauuucagcaaccccuccgccugcucugacauuuauggggagagcaucuccagccacuucacagaaucuaccggaaagcucauugagucccugagcgauugcgccucuucccuuccuaucaagaaaaucgcuggcagcaauuacaacacauuucuggacucugaacucagcaugcugaaugggacgaagguucuuuccgauagcgcggugggaauugaccugggcucuaccggcgauacaaccgaggcccuccacgagcugcgcacagcugaagaguucaaaaccgaagaacaggacgauuccgggagcaucgaauuuggagucuccuuccccgaccgggagucuagcuccauggagacgucuauugaaccuaaggccaccgagacaagccauaccgaaggcaucacagccauugaggaauccugggagucuauguuuaacgaugacggggacugucuggaucccagacuccugcaggagggaauccuuaugcacaucaaaccggaaaaucauugcagcaagcuguccggcaacaccaagagccgcgagucuauucaagaaccucgguccgacuauuacaaucacgaggugcccgauaucgaccucagcgauugugaguucccucaugugauugaaaucuaugacuuuccccaggaguucagaacggaagaucugcuucgcguuuucugcucuuaccagaaaaagggguucgacauuaaaugggucgaugacacacacgcucugggcguguuuuccagcccuaucaccgcccgggaugcgcucggaauuaagcacacaauggugaaaaucagaccccugucucaggcuacccgcgccgccaaggcuaaggcccgggcuuacgccgaguuccugcaaccggcgaaagaaagaccugagaccuccgccgcucucgcccggcgccuggucaucagcgcucuuggcgugagauccaagcagagcaaaacagagcgggaagccgagcugaagaaacuccaggaagcgagagagcgcaagcggcuggaagccaaacagagagaggacauuugggaggggcgcgaucaaucuacgguuuga

SEQ ID NO: 74521 - RNA, 2916 nt, Artificial Sequence
  derived and/or modified sequence opt5 from R3HDM1__Homo_sapiens__NP_001269728
augagaaugagcgacaccgugacagucaaggaugagacggccaccaugaaagaccuggaagcugagguuaaggauacaacccggguggaaaaccucaucaaauccgagaauuacggcaagauucugguggagaaaaacgagcacugcaucgagaauaacauugaccuucaggaaaagauccaaauucagcugacacagucuuucgagaaggaagagaaacccagcaaggaugaggccgaaaaagagaaggcguccgacaaacucccucgcaagaugcugucuagagauagcucccaggaauauaccgacucuacagggaucgaucuucaugaguuucuggucaauacccucaagaacaauccgcgggaccgcaugaugcugcugaaacucgaacaagagauccuggauuucauuggaaacaaugagagccccagaaagaaauuuccucccaugacguccuaccaccggaugcuucugcaucgcguggcugccuauuucggccucgaccacaacguugaucagagcgggaagucugugaucgucaauaaaaccuccaacacacggauuccugaccagaaguuuaaugaacauaucaaagacgauaagggagaggacuuccagaagagauacauucugaaacgcgauaacagcucuuuugacaaggaugacaaucaaaugagaauccggcuuaaagaugaccgcagauccaagagcauugaagaacgggaagaggaguaucagcgcgccagagaucggaucuucucucaggacucccuguguagccaggaaaacuacaucauugauaaaagacuccaagacgaggacgcuuccucuacccagcagcgccggcaaaucuuuagagugaacaaggaugccagcggccgcuccacaaauagccaccagucuuccaccgaaaacgagcugaaguauagcgaaccccggccuuggucuagcacggacuccgauucuagccugagaaaucucaaaccggcuguuacaaaggccuccagcuucucugggauuuccgugcugacccgcggagacagcucuggcuccagcaaauccaucggccggcuuucuaagacagggcagcccuuuauuaacccugauggaagccccgucguguacaauccucccaugacccagcaaccggugagaucccaggucccugggcccccucagccuccccugcccgcgccgccccagcaaccugccgcuaaccacaucuucucucagcaggacaaucucggcagccaguuuucccauaugagccuggcccgccaacccucugcugauggauccgacccucacgccgcgauguuccagagcaccguugugcuucagucuccccagcaauccggcuacaucaugacagccgcuccgccuccccauccucccccucccccgccucccccucccccgcccccuccccugccucccgggcagccugugcccacggccggauauccggcuagcggccacccugucucucagcccgugcuccaacagcagggcuacauucagcaaccuagcccccagaugccggccugcuauugugccccugggcacuaccauuccagccagccccaguaucggccuguucccucugugcacuacaacucccaucugaaucaaccccugccucagccggcucagcagaccggauaucaagucauccccaaccagcagcaaaauuaccagggcauuguggggguucagcagccucaaagccagucccucgugucuggacagcccaacagcaucggcaaucagauucaaggggucgugaucccuuacacauccguccccaccuaucaggugucucugccucagggaagccagggcaucccgcaccaaacauaccagcagcccguuauguucccuaaccaguccaaucaaggcucuaugcccaccacggggaugccuguguauuacagcgucauucccccgggacagcagaacaaccuuuccagcucugugggcuaucugcaacauccuggguccgagcagguucaguuucccagaacaaccagccccuguucuucccagcaacuccagggacaccagugcaccgcgggcccucccccuccgcccgggggcggaauggugaugaugcagcugagcgucccuaauaacccccaaucuugcgcccacuccccuccccaguggaaacagaauaaguacuauugugaucaucagcgcggccaaaagugcguggaguucagcuccguggacaacaucguucagcacagcccgcagcuuucuagcccuauuaucucccccgcucaaucuccugcccccgcccagcugagcacacucaaaaccguccggccuuccgggcccccgcugucuauuaugccucaguuuagcagacccuucgugcccggacagggcgauucccgguacccucugcucgggcaaccgcugcaguacaaucccccugcugugcuucauggacacauccccaaccagcagggccaaccugggucucgccacggcaauagaggacggagacaggccaagaaagcggcuagcacagaccugggcgccggggaaacggucgugggaaagguucucgagauuaccgaacugcccgauggcaucacacgcauggaggccgagaaacuguuuggggaacuuuucaagaucggagcuaagauucgguggcucagagacccucagucccagccgcgcagacauccccuguguugcggcagcggggacaacaccgccaauccugagcggucuaaacccuccgaucuggcuagcacauauaccgugcucgccacguuuccuucuaucuccgcggcccaaaacgcucugaagaaacagauuaauagcgucaacaaguucaaacuucgcaccuccaagaaacacuacgacuuucauauccuggaaagagccucuagccaguga

SEQ ID NO: 74522 - RNA, 762 nt, Artificial Sequence
  derived and/or modified sequence opt5 from R3HDML__Homo_sapiens__NP_848586
augccccugcucccuagcaccgugggccuggccgggcuucuguucugggcuggacaggccgucaacgcgcucaucaugccgaaugcuacacccgccccugcccaacccgaguccacggcuaugagacugcuuucuggccuggaaguuccucgguaccgcagaaagcggcacauuagcgugcgcgacaugaacgcccuccuggauuaucauaaucacaucagagcuuccguguaucccccugccgcgaacauggaguacauggucugggacaaacggcuggcccgcgcugccgaggcuugggccacccagugcauuugggcgcaugggccgucucagcucaugagauacgugggacagaaucugagcauccacuccggccaauaucggucuguuguggaucuuaugaagucuugguccgaagaaaaauggcauuaccuguuucccgccccucgcgacuguaacccccacugcccuuggagaugugaugggcccacaugcagccacuauacccagauggucugggcuucuuccaaucggcucggaugugccauucauacaugcagcucuaucuccguguggggcaacaccuggcaccgcgcugccuaccugguuuguaauuacgccaucaagggcaacuggauuggggagagcccguauaaaaugggaaagccuugcagcuccugucccccuagcuaccagggcuccugcaauucuaacauguguuucaaggggcuuaaaagcaauaaguuuacaugguucuga

SEQ ID NO: 74523 - RNA, 468 nt, Artificial Sequence
  derived and/or modified sequence opt5 from RAB11A__Homo_sapiens__NP_001193765
augggcaccagagacgaugaguacgacuaucuguucaaggugguccucaucggggauagcggaguuggcaaauccaaccugcuuucucgguuuacacgcaaugaguucaaccuggaaagcaaguccacgauugggguggaauuugccaccagaucuauccagguggacggaaaaacaauuaaggcucaaaucugggauaccgccggccaggagcgguaccgcgcgauuacaagcgcuuauuacagaggggccgucggagcccuccugguguaugacaucgcuaaacaccuuaccuacgaaaauguugagcgguggcugaaggagcuccgcgaucaugccgacuccaacaucgugauuaugcuggucggcaauaagucugaucugagacaccuccgggcugugcccacagacgaagcccgcgcguucgccgagaaaaacgaagcuaauguuagacagacccggaaguga

SEQ ID NO: 74524 - RNA, 657 nt, Artificial Sequence
  derived and/or modified sequence opt5 from RAB11B__Homo_sapiens__NP_004209
augggcaccagagacgaugaguacgacuaucuguucaaggugguccucaucggggauagcggaguuggcaaauccaaccugcuuucucgguuuacacgcaaugaguucaaccuggaaagcaaguccacgauugggguggaauuugccaccagaucuauccagguggacggaaaaacaauuaaggcucaaaucugggauaccgccggccaggagcgguaccgcgcgauuacaagcgcuuauuacagaggggccgucggagcccuccugguguaugacaucgcuaaacaccuuaccuacgaaaauguugagcgguggcugaaggagcuccgcgaucaugccgacuccaacaucgugauuaugcuggucggcaauaagucugaucugagacaccuccgggcugugcccacagacgaagcccgcgcguucgccgagaaaaacaaucugagcuuuaucgaaaccuccgcucuugauagcacgaacguugaggaggccuucaagaauauucugaccgaaaucuauagaauugugucucagaaacagaucgcugaccgggccgcgcaugaugaguccccuggcaacaaugucguggacauuagcgugccgcccacaaccgacgggcaaaagccuaacaaacuccagugcugucagaaucuguga

SEQ ID NO: 74525 - RNA, 3852 nt, Artificial Sequence
  derived and/or modified sequence opt5 from RAB11FIP1__Homo_sapiens__NP_001002814
augagccugaugguguccgccggcagagggcucggagcugucuggucucccacccacguucaggugacagugcugcaagcccggggccuucgcgcgaaggggccuggaggcacgagcgacgcuuacgccgucauccagguggggaaagagaaguaugccaccuccguuucugaaagaagccugggagcuccgguguggcgggaggaagccacauucgagcuccccucccugcuuucuagcggcccugcugccgcggccacccugcagcucacaguccugcaucgcgcucugcucggccuggauaaauuucuugggagagccgaaguggaccugcgggaucuccaccgcgaccagggaagacggaagacccaaugguacaaacugaaguccaagcccggcaaaaaggauaaagagcgcggggagauugaaguugacauccaguucaugagaaacaauaugacagcuagcauguuugaucuuucuaugaaggacaaaucccggaacccuuucggaaagcugaaggauaaaauuaagggcaaaaauaaggacagcgggucugauaccgccuccgcgaucauucccagcacgaccccuucuguggacuccgaugacgagagcgucgugaaagacaagaaaaagaaguccaaaaucaagacacuccugucuaaaagcaaccugcagaagaccccgcucucccagagcaugucugugcugcccacauccaaaccugaaaagguccuucugcgccccggagauuuucaaagccagugggacgaggaugacaaugaggaugaaucuagcuccgccucugacguuaugagccauaagagaaccgcuuccacggaucucaaacagcugaaccaggugaauuucacacuuccuaagaaagagggccugagcuuucucggcgggcugcggucuaagaacgacgugcugucccgcagcaaugucugcaucaacggaaaucacguguaucucgaacaacccgaggccaaaggcgaaauuaaggauucuuccccgagcuccucuccuagccccaagggguuccggaaaaagcaucuguuuuccucuaccgagaaccuugcugccggaagcuggaaagagccugccgaaggcgggggacuguccagcgacagacagcucucugaguccagcacaaaggauucucugaaauccaugacccuucccagcuacagacccgcuccucugguuucuggcgaccuccgcgaaaauauggcgccggccaacagcgaggcuaccaaggaagccaaggaguccaaaaagcccgagagccggagaucuucccugcugagccucaugacaggcaaaaaggacguggccaaaggguccgaaggagagaauccucugacgguccccggccgcgaaaaggaggggaugcuuaugggagugaaaccuggcgaagaugcuucugggcccgccgaggaccugguucggagaagcgagaaggauaccgcggcuguggucucccgccagggcucuagccucaaccuguucgaagacgugcaaaucacagagccggaagccgagccugaguccaagucugaaccccggccucccauuagcuccccuagagcuccccagacccgcgccgucaaaccgcggcuggaggugagcccugaagcccagcccacagcuagacuucccucuccuaccgauuccccgagcucucugcccccucuccccuccagcucuggacaggccuccguuccuagcgagcugggccacggggcggacacgcaauccagcgaaucucccagcguguuuuccucucucagcuccccuaucgccgcucccauuucuacaagcaccccgaucgaguccuggccucuggucgaucgcggacaggccaagucugagggacccccucuucugcccaaagcugaacuccagaccgagagccugacaccggugccuaacuccgggagcucugcccugggaucccuuuucaagcagcccagcuuuccugcgaauaaaggcaccgaagacucucucauggggcggacaagagagacgggcaccgaaaagaacacauccagccuggagcuggaggaaucccuccccgagcaacccgaaaccggacggcaggaggaggaacugccucgcuucccguguaagaaacaggauuauucucccagcuccggcgaggcccaggaaguuccuuucgcucuuagccugucuuccgacggggccgugagccccgucggagagcucgcugccggcggggauagagaccuggaaucucaagccggaagccugguggaguccaaggcucgggaugcggccgaggaaguggcuccuccccuuccuaugggcgccucuguuccgagcauugacuccaugaugagaaaacucgaggaaauggggcugaaucugcgcaaggaccagaaaaagacaaagaaacgggucucuuuuagcgagcaacucuucaccgaagaggccguggcuggcgccgcgcugcuuguggagggacacuccagcugcccccaggaacugaacccugcuuggucugucgccggcaaugccuccgauggggagcccccugaaagcccccaugcugaggacuccgaaagagagucugugacgaccccgggaccugccacauguggcgcgcccgcuagccccgccgaucaccuccugcugccuucccaggaggaaucuuuuagcgagguucccauguccgaagccagcucugcuaaggacaccccucuuuuccgcauggagggggaagaugcccucgugacacaguaccaguccaaagcuagcgaccaugagggacugcugucugauccgcucuccgaccugcaacuugucagcgauuuuaagucucccaucauggccgaccugaaccucagccugccuuccauccccgagguggcgucugaugacgaaagaauugaucagguugaggacgacggcgaucagguggaagacgauggggagaccgccaaaagcuccacgcuggacaucggcgcucuuagccugggacucgucgugccuugccccgagcggggcaaggggccguccggagaagccgaucgccugguucucggcgaggggcugugugacuucagacuucaggcuccucaagccucugugacagcccccagcgaacagaccacagaguuuggcauucacaagccucaccugggcaaauccucuagccucgauaagcagcugcccggcccuuccgggggagaagaggagaaacccaugggcaaugggucuccgagcccuccucccggaaccucccuggacaaccccgucccgagccccucuccuuccgaaaucuuccccgugacccauagcuuuccuucuuccgcucacagcgauacacaucacacgucuaccgcggagucccagaagaaagccacagcugaaggcagcgccgggcggguggagaauuucggaaagcgcaaaccccuucugcaagccugggucuccccuagcgaaacccauccgguuucugcucagcccggcgccggcacagggagcgcgaagcacagacuccacccugugaagcccaugaacgcuauggccaccaaaguggccaauugcucccugggaacggcuacaauuaucucugagaaccucaauaacgaggucaugaugaagaaauauagcccuuccgaccccgccuuugcguacgcucagcugacccaugaugaacuuauccagcuggugcucaagcaaaaagagaccauuucuaagaaggaguuccagguucgggaacuggaagacuacaucgacaaucugcuugugcgcgucauggaggagacaccgaacauucugagaaucccuacccaggugggcaaaaaggccgggaaaauguga

SEQ ID NO: 74526 - RNA, 1539 nt, Artificial Sequence
  derived and/or modified sequence opt5 from RAB11FIP2__Homo_sapiens__NP_055719
augaugcugagcgagcaggcccaaaagugguuccccacccacgugcaggucacaguucuccaggcuaaagaccugaagccuaaaggcaaguccgggacgaacgauaccuacacaaucauucagcuuggaaaagaaaaguauucuaccagcguggccgagaagacacuggaaccgguguggaaagaggaagcguccuuugagcuccccggccugcuuauccaagggucuccugagaaguacauucuguuccucaucgucaugcauagaagccuggugggacuggacaaauuucucggccagguugcuauuaaucugaacgauaucuucgaagacaagcagcggcgcaaaaccgagugguuuagacuugaauccaagcaggggaagcggaucaaaaaucgcggagagauuaaggugaacauccaauucaugagaaauaacaugacagccucuauguuugaucugagcaugaaagacaagacccggucccccuucgccaaacucaaggauaaaaugaagggccgcaagaaugacggcacguuuagcgauaccucuuccgcuauuaucccuagcacacacaugcccgacgccaacucugaguucuccagcggggaaauucagaugaaaucuaagccuaaaaagccguuucugcuuggaccccagagacuguccagcgcucauuccaugucugaucucagcggcucccacaugagcucugagaaacugaaggccgggaccaucggacagacacaucugcucggccaccaacuggacuccuucgggaccgucccugaaagcggaucucuuaagagcccccaccggcgcacgcuguccuuugauacaucuaaaaugaaucagccugacagcauuguggacgagggcgaacucugcuucggcagacagaacgaucccuucaccaauguuacagcgucccugccgcaaaaguuugccacccuuccucggaaaaagaaccccuucgaggagagcucugaaaccugggacuccagcaugaaucuguuuucuaaaccuaucgagauccgcaaggaaaacaagagagagaaacgggaaaaggugucccucuucgagcgcgucacagggaaaaaggauagcagacgguccgacaaacugaauaacggaggcucugauagccccugugaccugaagucccccaacgcuuuuucugagaauagacaggauuauuucgacuacgaaagcacgaacccuuuuaccgccaaguuccgcgcuuccaauauuaugccgucuagcuccuuucauaugagccccacaucuaacgaggaucuccggaaaaucccugacuccaaucccuucgaugccaccgcgggguauagaagccugacauacgaagaggugcuucaggaacuggugaagcacaaagagcuccugcgccggaaggacacccauauuagagagcuugaagacuauaucgauaaccugcucguccgcguuauggaggaaacgccuucuauucugcgggugcccuacgagccgagcagaaaagccggaaaguuuuccaauagcuga

SEQ ID NO: 74527 - RNA, 1383 nt, Artificial Sequence
  derived and/or modified sequence opt5 from RAB11FIP3__Homo_sapiens__NP_001135744
augcccuuccugaaggccaacgaggugaccgacagcgcuuacaugggcuccgaaucuacauauagcgagugcgaaacguuuaccgaugaggacacauccacccucguccacccugaacugcagccggagggggaugccgacucugcgggaggcagcgcuguucccuccgagugucuugaugccauggaagaaccugaccauggggcccugcuccugcuucccggaagaccucacccccauggccaaucugugaucacagugauugggggagaggagcacuucgaggauuacggcgaaggcagcgaggcugaacuguccccugagacccucugcaaugggcagcugggauguagcgacccggccuuucugacacccucuccuaccaaacggcucuccagcaagaaagucgcucgcuaucugcaucagucuggcgcccuuacgauggaagcgcuggaggaucccuccccugagcucauggaagggcccgaggaagacaucgccgauaaggugguuuuccuggagagacgggugcuugaacuggagaaagacaccgcugccacaggagagcagcacagccgccucagacaagaaaaccugcagcugguccaccgggcuaaugcccucgaggaacagcugaaggagcaggaacuucgcgcgugcgagauggugcuggaggaaaccagacggcaaaaggagcuccuguguaaaauggaacgcgagaagucuauugagaucgaaaaccuucagacaagacugcagcagcucgaugaggaaaauuccgagcugcggagcugcaccccgugucugaaagccaacauugaacgccucgaggaggaaaagcaaaaacugcuugacgagaucgaaucccugacgcucagacugucugaggaacaggagaauaagcggcgcaugggcgacagacuuagccaugagcggcaccaguuucaaagagauaaggaagcuacacaggagcugaucgaagaccuccgcaaacagcuggagcaucugcagcuccugaaacuugaagccgagcaacggagagggcgcuccagcucuaugggacugcaggaguaccacucccgggcuagagaaagcgagcucgaacaggagguucgccggcugaagcaggauaacagaaaucugaaggagcaaaacgaggaacuuaauggccagauuaucacccucucuauucagggcgccaaaagccuguucuccacagccuuuucugaaagccuggcugcggagaucuccagcgugucucgcgacgaacucauggaggccauucagaagcaagaggaaaucaacuuccggcugcaggauuauauugacagaaucaucgucgcuauuauggagaccaauccuuccauccuugaagugaaauga

SEQ ID NO: 74528 - RNA, 1914 nt, Artificial Sequence
  derived and/or modified sequence opt5 from RAB11FIP4__Homo_sapiens__NP_116321
auggccggcggggcuggauggagcggcgcccccgcggcucugcucagauccgugcggcgccugagagaggucuucgaaguuugcgggcgggacccugauggauuucuucgcguggagagaguggccgcccugggccuccgguucgggcagggagaagaggucgaaaagcuggugaaauaccuugacccgaacgaucugggccgcaucaauuuuaaggacuucuguagaggcguuuuugcuaugaaagggugcgaggagcuccugaaggaugugcugucugucgaaagcgccggaacccuccccugugcuccugagauucccgacugcguggaacaaggcuccgagguuacagggccuacguucgccgauggagagcugaucccccgggaaccuggcuuuuucccggaggacgaagaggaagcgaugacccuugcucccccugaggggccccaggagcuguauacagauucuccuauggaaagcacccagucccucgagggaucugugggcagccccgccgaaaaagacggcgggcugggaggccuuuuucugccggaggauaagucccucguccacacaccuagcaugaccacaucugaccuguccacccauagcacgaccucucugauuuccaacgaggaacaguucgaggauuacggggaaggagacgacguggauugugcccccagcucuccuugccccgacgaugagacacgcaccaauguguauuccgaccucggcagcuccgucucuagcuccgcugggcaaacacccagaaagaugcggcacguuuacaacagcgaacugcuugauguguauuguucucagugcuguaaaaagaucaaucugcucaacgaccuggaggcccgccuuaaaaaucugaaggcgaacuccccuaauagaaaaauuagcucuaccgccuuuggacggcagcucaugcauagcuccaacuucucuagcuccaauggcagcacggaagaucuguuucgcgacucuaucgauuccugcgacaacgauaucacagagaaggugagcuuccuggagaagaaagucaccgaacucgagaaugacucucugacaaacggcgaccuuaaguccaaacugaagcaggaaaauacccaacucgugcacagaguucaugagcuggaggaaauggugaaagaucaggagaccacagcugaacaggcccuugaggaagaggcucggagacaccgcgaggccuacgggaagcuggaacgggagaaagccacggaagucgagcuccugaacgcuagagugcagcaacuggaagaggagaacaccgaacuccgcacaaccguuacacggcuuaagagccagaccgagaagcuggacgaagagagacagcgcauguccgaucggcuggaagacacgucucucagacugaaagaugagauggaccuguauaagcgcaugauggauaaacuucggcaaaauagacucgaguuccagaaggaacgcgaggcgacacaggaacugauugaggaccugcggaaagagcucgaacaccuucagauguacaagcuggauugugagagaccgggacggggccgcagcgccuccucugggcugggagaauuuaacgcuagagcccgggagguggaacucgagcaugaggucaagagacugaaacaagaaaauuacaagcugcgcgaccagaacgaugaccuuaauggccagauccucagccugucccuguaugaggccaaaaaccucuucgcugcccagaccaaggcgcaaagccuggcugccgaaauugauaccgccucucgggacgagcuuauggaagcucugaaagagcaggaggaaaucaauuuuagacuccgccaguacauggacaagauuauccuggccauucuggaucacaaccccuccauccuugagaucaagcauuga

SEQ ID NO: 74529 - RNA, 1962 nt, Artificial Sequence
  derived and/or modified sequence opt5 from RAB11FIP5__Homo_sapiens__NP_056285
auggcccuggugagaggcgcugagcccgccgcggggccuagccgguggcucccgacccacguccagguuacagugcugcgcgcuagaggacuucggggcaaguccucuggggccggaagcacguccgacgccuacaccgugauccaagucggccgcgaaaaauauucuacaagcgugguugagaagacccaugggugccccgaauggagagaggaauguuccuucgagcugccucccggagcucucgauggccugcuucgggcccaggaggcugacgccggcccugcgcccugggccgcuucuagcgccgcugccugcgaacuggugcucacaaccaugcaccgcucccugaucggggucgauaaauuucugggacaggcgacaguggcccucgacgagguuuucggcgcugggagagcccagcauacccaaugguacaagcugcacagcaaaccuggaaagaaggaaaaagagcggggcgagaucgaagugacgauucaguuuacccgcaacaaucuuucugcuuccauguucgaucugagcaugaaggacaaaccgagaucucccuuuuccaagauccgggauaaaaugaaggggaagaaaaaguaugaccucgagagcgccucugccauucugccuuccagcgcuaucgaagaucccgaccuuggaucccugggcaaaaugggcaaggcgaaaggguucuuucuccgcaacaagcugagaaaaucuagccugacacaguccaauaccagccucggaucugauuccacacugagcucugccagcggcucccuugcuuaccaggggccuggagccgagcugcucacccggucucccagccgcuccagcuggcugucuacggaaggcgggagagacuccgcccaaagcccgaaacuuuucacacauaagcggaccuauucugaugaggcuaaccagaugagagucgccccuccccgcgcgcugcucgaccugcagggacaccuggacgcugccucccggagcucccucugugugaauggcucucacaucuacaacgaggaaccucagggccccgugagacaucgcagcuccauuucugggagccugcccuccagcggaucucuucaagccgucuccagccgguuuucugaggaaggcccuagauccacagaugacaccuggccgcgcgggagccggucuaauagcuccagcgaggcuguucugggacaggaggaacucucugcccaggcuaaggugcuggcccccggcgcgucccacccuggggaggaagagggcgccagacuucccgaaggaaagccugugcaagucgcuacccccaucguggccagcuccgaggcuguugccgaaaaagagggcgcgcgcaaggaggaacggaaaccgagaauggggcuguuccaucaccaccaucagggacucucucgcagcgagcugggccggagauccucucugggggaaaagggaggcccuauucucggggccagcccccaccauuccucuagcggcgaggagaaggcuaaauccagcugguuuggacugcgggaagccaaggauccuacacagaaacccucuccucaccccgugaagccgcuuuccgcugccccugucgagggcagccccgaccgcaaacagucuagauccagccugucuaucgcccucuccagcgggcuggaaaagcugaagacggugaccuccggaagcauucaacccguuacacaggcuccucaggcgggccagaugguggauaccaaacggcuuaaggacucugccguccucgaucaaagcgcuaaauauuaccaucugacacacgacgagcugaucucccuccugcuucagagagaacgcgagcugucucagcgggaugagcacgugcaggaacucgagagcuacauugacagacugcugguccgcaucauggaaaccuccccgacgcuucuccaaauucccccugggcccccuaaguga

SEQ ID NO: 74530 - RNA, 735 nt, Artificial Sequence
  derived and/or modified sequence opt5 from RAB12__Homo_sapiens__NP_001020471
auggaccccggcgccgcucugcagagacgggccgggggaggcgggggacucggcgcggggagcccugcucuguccggaggccaaggccgcagacggaagcagccgccccgcccugccgauuucaaacuucaggugaucauuaucgggucuagaggagucggcaagaccagccugauggagcgguuuacagacgauacguucugcgaagccuguaaauccaccguugggguggacuuuaagauuaaaacaguggagcuccgcggaaagaagaucagacugcagauuugggauaccgcuggccaagaacgguucaacucuaucacaagcgccuacuaucgcuccgcuaaagggaucauucuugucuacgacaucaccaagaaagagacauuugaugaccugcccaaguggaugaaaaugauugauaaguaugccucugaagacgcggagcuccugcuggugggaaauaagcucgauugcgagaccgacagagaaaucacgcggcagcagggcgagaaauucgcccagcaaauuaccggcaugcgcuuuugugaagcuagcgccaaggauaacuucaauguugacgagaucuuucugaaacuuguggacgauauucugaagaaaaugccucucgacauccugagaaacgagcuuuccaauagcauccugucucuccagcccgaaccugagauuccgcccgaacugccucccccucggccccacguccgcugcuguuga

SEQ ID NO: 74531 - RNA, 648 nt, Artificial Sequence
  derived and/or modified sequence opt5 from RAB14__Homo_sapiens__NP_057406
auggccaccgcucccuacaacuauagcuacaucuucaaguauauuaucauuggcgacaugggggugggaaaauccugccugcuccaccaguuuacagagaagaaauucauggccgauuguccucauacgaucggcgucgaauuugggaccagaauuaucgagguuucuggacaaaagaucaaacugcagauuugggacacagcgggccaggaacgguuccgcgcugugaccagaagcuacuaucgcggggccgccggagcucuuaugguguacgauaucacacggagauccaccuauaaucaccugucuagcuggcucacagacgcccggaaccugaccaauccgaacacggucauuauccuuauuggcaauaaggcugaucuggaggcccagcgcgacgugaccuacgaagaggcgaagcaauuugccgaggaaaacggccuccuguuccuggaggcuuccgccaaaacaggggaaaauguugaggaugcuuuucucgaggccgcgaagaaaaucuaccagaacauucaggacggaucucuggaucuuaaugccgcugaaagcggcgugcagcauaagcccuccgccccucaagggggaagacugaccagcgagccccagccucagcgggaaggcugcggguguuga

SEQ ID NO: 74532 - RNA, 627 nt, Artificial Sequence
  derived and/or modified sequence opt5 from RAB15__Homo_sapiens__NP_941959
auggccaagcaguacgacgugcuguucagacuccugcuuaucggcgauagcggggucggaaaaaccugccugcucugucgguuuacagacaacgaguuccacuccucucauauuagcacgaucggcguugauuuuaagaugaaaaccauugaaguggacgggaucaaggugcgcauucaaaucugggauacagcuggacaggagagauaucagaccaucacaaaacaguacuaucggcgcgcccaaggcauuuuccuggucuacgacaucuccucugaaagaagcuaucagcacauuaugaaguggguguccgauguugacgaggugggggaugcgaccucucuucccggaugcggcgaaggcgcuagcccugggaaggcccggcgcggaccggacggcaaagccaaugcuuccagaaagcugugucucccccagccuuggaugaaaacaagcgggacccaucagaaggccucucggcgcucccugcugggaaucagacucaugcggagccgcaacggcagaugggaggagucuaaaggguccagcuggcggcgcucuauggcuuggacguccaugaagcaaguccccgccccuaccagcacacugaagucccacucuagaguguga

SEQ ID NO: 74533 - RNA, 708 nt, Artificial Sequence
  derived and/or modified sequence opt5 from RAB18__Homo_sapiens__NP_001243339
auggacgaggaugugcugaccacacucaagauccugauuaucggcgaaagcggggucggaaaauccucucuucugcucagauucacggacgauaccuuugaccccgagcuggccgcuacaauuggcguugauuucaaggugaaaaccaucagcguggacgggaacaaggccaaacuugcgauuugggucacacugcaccagcaaaccgcuaacuuuuuccucaagucccagaucggaaauucuccuauccugaagugggccauguggcaguacgauacagccggccaggaacgguuucgcacccugacgccgagcuauuacagaggggcucaaggagugauucucguuuaugacgugacccggcgcgauacauucgucaaacuggacaauuggcuuaacgagcuggaaaccuacugcacaagaaaugauaucgugaacaugcucguuggcaauaagauugacaaagagaaccgggagguggaucgcaaugaaggccugaaguuugccagaaaacauuccaugcuuuucaucgaggcuucugccaagaccugugacgggguccagugcgcguuugaggaacugguggagaagauuauccagacgcccggacucugggaaagcgagaaccagaauaaaggcgugaagcugucccaccgggaagaggggcaaggaggcggggccuguggaggcuauugcagcguccuguga

SEQ ID NO: 74534 - RNA, 618 nt, Artificial Sequence
  derived and/or modified sequence opt5 from RAB1A__Homo_sapiens__NP_004152
augagcuccaugaaccccgaguacgacuaucuguucaagcuccugcuuaucggcgauucuggggugggaaaaagcugccugcuccugagauuugccgacgauaccuacacagaauccuauauuucuacgaucggcgucgacuucaagauucggaccaucgagcuugaugggaaaacaauuaagcugcagaucugggacaccgcuggacaagaacgcuuuagaacaaucaccagcuccuacuaucggggcgcccacgggauuaucguuguguacgaugugacagaccaggagucuuucaauaacgucaaacaguggcuccaggaaauugaucgcuaugcgagcgagaaugugaacaagcugcugguuggaaauaagugugaccucaccacgaaaaagguggucgauuacaccacagcuaaagaguuugccgacucccugggcaucccuuuccuugaaaccagcgccaagaacgcuacaaauguggagcaaucuuuuaugaccauggccgcugaaauuaaaaagagaaugggcccgggggccacggcgggaggcgccgagaaguccaacguuaaaauccagagcacacccgugaagcagucugggggaggcugcuguuga

SEQ ID NO: 74535 - RNA, 606 nt, Artificial Sequence
  derived and/or modified sequence opt5 from RAB1B__Homo_sapiens__NP_112243
augaaccccgaguacgacuaucuguucaagcuccugcuuaucggcgauagcggggugggaaaauccugccugcuccugagauuugccgacgauaccuacacagaaucuuauauuagcacgaucggcgucgacuucaagauucggaccaucgagcuugaugggaaaacaauuaagcugcaaaucugggacaccgcuggacaagaacgcuuuagaacaaucaccuccucuuacuaucggggcgcccacgggauuaucguuguguacgaugugacagaccaggagagcuaugcgaaugucaaacaguggcuccaggaaauugaucgcuacgcuuccgagaacgugaauaagcugcugguuggaaacaagucugaccucaccacgaaaaagguggucgauaauaccacagccaaagaguucgccgacagccugggcaucccuuuucuugaaaccuccgcuaagaacgccacaaauguggagcaggcuuucaugaccauggccgcggaaauuaaaaagagaaugggcccgggggccgcuagcggaggcgagcggcccaaccugaagaucgauucuacgccuguuaaacccgccgggggaggcuguugcuga

SEQ ID NO: 74536 - RNA, 705 nt, Artificial Sequence
  derived and/or modified sequence opt5 from RAB20__Homo_sapiens__NP_060287
augagaaagcccgacagcaaaaucgugcugcucggcgauaugaacgucgggaagaccucccugcuucagcgguacauggagcgcagauucccugacacaguuucuacggugggaggcgccuuuuaucugaaacaauggcggagcuacaauauuuccaucugggauaccgcugggcgcgaacaguuccacggacucggcucuauguauugcagaggggccgcggcuauuauccugacauacgacgugaaccaucggcagagccuugucgagcuggaagaucgcuuucucggacugaccgacacagccuccaaggauugucuguucgccauugugggcaauaaaguugaccucaccgaggaaggcgcucuggccgggcaggagaaggaggaaugcucuccgaacauggaugcuggagacagagugagcccccgggccccuaagcaaguccagcuugaggaugcgguggcccuguauaaaaagauccucaaauacaagaugcuggacgaacaggauguucccgcugccgagcagauguguuuugagacauccgcuaaaaccggcuauaauguggaccuucuguucgaaacgcucuuugaccuggucgugccuaugauccugcaacagcgcgccgagagacccagccacaccguggauauuucuucccauaagccuccgaagcggacacgcagcgggugcugugcguga

SEQ ID NO: 74537 - RNA, 678 nt, Artificial Sequence
  derived and/or modified sequence opt5 from RAB21__Homo_sapiens__NP_055814
auggccgcugccggcgggggaggcgggggagcggcugccgccggcagagcuuacagcuucaaggugguccugcucggggagggaugcguuggcaaaaccucccuggugcuucgguauugcgaaaacaaguuuaaugacaaacacaucacaacgcugcaggccucuuuccucaccaagaaacugaacauuggcgggaagcgcgugaaucuugcuaucugggauacagccggacaagagagauuucaugcgcugggccccauuuacuaucgggacagcaacggggccauccucgucuacgauauuaccgacgaagauuccuuccagaaggugaaaaauuggguuaaggagcugcgcaaaaugcugggaaacgaaaucugccucuguaucgugggcaauaagauugaccuggagaaagagagacacgucucuauccaggaagcugagagcuaugccgaauccgugggggcuaagcauuaccacacaucugccaagcagaacaaaggaauugaggagcuuuuucuggaucucugcaagcggaugaucgaaaccgcgcaaguugacgagcgcgccaaaggcaauggcagcucccagccugggacagcuagacggggagugcagauuaucgaugacgaaccgcaggcccaaaccagcggcgggggauguuguucuuccggcuga

SEQ ID NO: 74538 - RNA, 585 nt, Artificial Sequence
  derived and/or modified sequence opt5 from RAB22A__Homo_sapiens__NP_065724
auggcccugagagagcucaaggugugccugcuuggcgacaccggggucggaaaaagcuccaucguuuggcgguucguggaagauucuuuugaccccaacauuaauccuacaaucggcgcuagcuucaugacgaagaccgugcaguaccaaaacgagcugcacaaauuucucauuugggauacagccgggcaggaacgcuucagagcgcuggcuccgauguauuaccggggauccgccgccgcuaucauugucuaugacaucaccaaggaggaaacauuuucuacccuuaaaaauugggugaaggagcugcgccagcaugggcccccuaacaucguuguggccauugcuggcaauaagugugaucucaucgacgucagagaggugauggaacgggaugccaaagacuacgcggauagcauucacgccaucuucguugagacauccgcuaagaacgccauuaauaucaacgaacuguuuauugagaucucucgcagaauccccagcaccgacgcuaaucugccuuccggaggcaaaggcuucaagcuccggcgccagcccagcgagccuaaaagaucuugcuguuga

SEQ ID NO: 74539 - RNA, 714 nt, Artificial Sequence
  derived and/or modified sequence opt5 from RAB23__Homo_sapiens__NP_001265595
augcuggaggaagacauggagguggccaucaagauggucguugugggcaacggggcugugggaaaaagcuccaugauucagagauacugcaagggcaucuucaccaaagauuauaagaaaacaauuggggucgacuuucucgaacggcaaauccaggugaaugaugaggacguucgccugaugcuuugggauacggccggacaggaagaguucgacgcgauuaccaaggcuuacuauagaggcgcccaggccugugugcuggucuuuucuacaaccgaucgggagagcuucgaagcuguguccucuuggcgcgagaagguuguggccgaagucggggacauccccacagugcucgugcaaaacaaaaucgaucugcuugacgauagcugcauuaagaaugaggaggcugaagcccuggcgaaaagacucaagcugcgguuuuaccgcaccuccgucaaagaggaccugaacguuaaugaaguguucaaguaucucgccgagaaguaccugcagaaacuuaagcagcagaucgcugaagauccugagcugacacacucuagcuccaacaaaauuggaguguuuaauaccagcggcggcucucauuccgggcaaaacagcggaacgcucaauggcggggacgucaucaaccugagaccgaauaagcagcggaccaaaaagaaccgcaaucccuucucuuccuguagcauuccuuga

SEQ ID NO: 74540 - RNA, 612 nt, Artificial Sequence
  derived and/or modified sequence opt5 from RAB24__Homo_sapiens__NP_570137
augagcggccagagaguggacgucaagguugugaugcuggggaaagaguacgugggaaagaccucccucgucgaacgguaugugcacgaucgcuuccugguuggccccuaccaaaacacaaucggggccgcuuuuguggccaaagucaugucugugggagacagaacgguuacccuuggcauuugggauacagcggggagcgagcgguaugaagcuaugucccgcaucuacuauagaggagccaaggccgcuauugugugcuacgaccugaccgauucuagcuccuucgagcgggccaaauuuugggucaaggaacuccgcucucuggaggagggcugucagaucuaucuuugcggcacaaagagcgaccugcucgaagaggauagacggcgcagacggguggacuuccaugaugugcaggacuacgcugauaauauuaaagcccagcuguuugaaaccuccagcaagacagggcaaucugucgacgagcuguuccagaaaguugcggaggauuacguguccguggccgcuuuucaggucaugaccgaagacaagggaguggaccucggccagaaaccuaacccguauuucuacagcuguugccaccauuga

SEQ ID NO: 74541 - RNA, 642 nt, Artificial Sequence
  derived and/or modified sequence opt5 from RAB25__Homo_sapiens__NP_065120
augggcaacgggaccgaggaagacuacaauuucguguuuaaggucguucugaucggagagagcggcguggggaaaacaaaccuccuguccagauucacgcggaaugaauuuucucacgauagccgcaccacaauuggaguggaguucuccaccagaacagucaugcuuggcaccgccgcugugaaggcccagaucugggacacagcggggcuggaacgguaucgcgcuauuaccucugccuacuauagaggagccguuggcgcucuccugguguuugaucuuacgaaacaucaaaccuacgccgucguggagcgguggcugaaggagcucuaugaccacgcugaagccacaaucguugugaugcuggucggcaacaaaagcgaucugucccaggcgcgcgaggugcccaccgaagaggccagaauguucgcugagaauaacgggcuccuguuucuugaaacaucugcccuggacagcaccaauguggagcucgcuuucgaaacgguccugaaggagauuuuugccaagguuuccaaacagcggcagaacagcauccgcacaaaugcgaucacccuuggaucugcccaagcuggccaggaaccugggccgggagagaagagagccugcuguauuucccuguga

SEQ ID NO: 74542 - RNA, 666 nt, Artificial Sequence
  derived and/or modified sequence opt5 from RAB27A__Homo_sapiens__NP_899059
augagcgacggcgauuacgacuaucugaucaaguuccucgcccugggggauuccggagugggcaaaaccucuguccuuuaccaguauacagacgggaaguuuaacagcaaauucauuacgaccguuggaaucgauuuuagagagaagcgggugguguaccgcgcuuccggccccgacggggccacaggaagaggccaacggauucaucugcagcucugggauaccgcgggccaggaacgcuucagaucucugacaaccgcuuucuuccgggacgccaugggguuucuucugcucuuugaucugacaaaugagcagagcuuucugaacguccgcaauuggaucucccaacuccagaugcacgccuauugcgaaaacccugacauugugcuguguggaaauaaaucugaucuugaggaccagagaguugugaaggaagaggaggcuaucgcccuggcugaaaaguacggcaucccguauuucgagaccagcgccgcgaacgggacgaauauuucccaggccaucgaaaugcuccuggaucuuauuaugaaacggauggagcgcugcgucgacaagagcuggauccccgagggagugguuagaucuaacggccacgcuuccaccgaccaacugagcgaagagaaagaaaagggggccuguggaugcuga

SEQ ID NO: 74543 - RNA, 657 nt, Artificial Sequence
  derived and/or modified sequence opt5 from RAB27B__Homo_sapiens__XP_005266790
augaccgacggcgauuacgacuaucugaucaagcuccuggcccuuggggauagcggagugggcaaaacaacguuccuguacagauauaccgacaacaaguuuaaucccaaauucauuacaaccgucgggaucgauuuucgggagaagcgcguuguguacaacgcucagggaccuaauggcuccucugggaaagccuucaaggugcaccuccaacugugggacacagcgggacaggaaagauuucggagccuuaccacagcuuucuuucgcgaugccaugggcuuccugcucauguuugaccugaccucccagcagucuuuccugaacgucagaaauuggaugagccaacuccaggccaacgcuuauugcgagaauccggauauugugcugaucggcaacaaggccgaccuucccgaucagcgggaaguuaaugagcgccaggcuagagaacuggccgacaaauacgggauuccuuauuuugagacguccgcggccaccggacaaaacguggagaaggcugucgaaacacuccuggaucuuaucaugaaacggauggagcaguguguggaaaagacccagauccccgacacaguuaauggcgggaacucuggaaaucuggacggcgagaaaccucccgagaagaagugcauuuguuga

SEQ ID NO: 74544 - RNA, 666 nt, Artificial Sequence
  derived and/or modified sequence opt5 from RAB28__Homo_sapiens__NP_001017979
augagcgacuccgaggaagagucucaggauagacaacugaagaucgugguccucggcgacggggccagcggaaaaaccucccugacaacgugcuucgcucaggaaaccuuuggcaagcaguacaaacagacaauugggcuugauuucuuucugcggcgcaucacccuccccggaaaccugaauguuacacuucaaauuugggacaucggcgggcagaccauuggaggcaagaugcuggauaaauauaucuacggcgcccagggggugcuccugguguaugacaucacaaacuaccagucuuucgagaaucuggaagauugguauaccgucgugaagaagguuagcgaggaguccgaaacgcaaccucucguggcgcuggucggaaacaaaauugaccuugagcacaugagaaccaucaagccggaaaaacaucugcgguuuugucaggagaauggcuucucuagccacuuuguguccgcuaagacaggggauagcguuuuccucugcuuucagaaaguggccgccgagauucugggaaucaaacuuaacaaggcugaaauugagcagucucaacgcgucgugaaggccgacaucgugaauuacaaccaggaacccauguccagaaccgucaauccuccccggagcucuaugugugcuguucaguga

SEQ ID NO: 74545 - RNA, 540 nt, Artificial Sequence
  derived and/or modified sequence opt5 from RAB29__Homo_sapiens__NP_001129135
augggcagcagagaccaccuguucaaggugcucgucguuggggaugccgcugugggaaaaaccucccuggugcagcgguacucucaagacagcuuuuccaagcauuauaaaucuacagucggcgggcaggagcgcuucacgagcaugaccagacuuuacuaucgggaugccuccgcgugcgugaucauguuugacguuacaaacgcuaccacauucucuaauagccagcgcuggaagcaggaucuggacuccaaacucacccugcccaacggagaaccugugccgugucuucugcucgccaauaagugcgaucugagccccugggccgucucuagagaccaaauugaucgguuuuccaaggagaacggcuucacaggguggaccgaaacgagcgugaaagagaauaagaacaucaaugaagcuaugcgcguucugauugagaaaaugaugagaaacucuaccgaggacaucaugucccucagcacacagggagauuacauuaaucugcagaccaagucuuccagcugguccuguugcuga

SEQ ID NO: 74546 - RNA, 567 nt, Artificial Sequence
  derived and/or modified sequence opt5 from RAB2A__Homo_sapiens__NP_001229573
auggccuacgcuuaucuguucaaguacaucauuaucggcgacaccgggguggaguuuggagccagaaugauuacaaucgauggcaaacagauuaagcuccagaucugggacacggcggggcaggagagcuuccgguccaucacccgcucuuauuacagaggagcugccggcgcccugcuugucuaugauauuacacggcgcgacaccuuuaaccaccugacaaccuggcucgaagaugcuagacagcauagcaauuccaacaugguuaucaugcugauugggaauaaaucugaccuugaaagccggcgcgaggugaagaaagaagagggagaggccuucgcuagagaacacggccugaucuuuauggagacauccgccaagaccgcgucuaacguggaagaggccuucauuaauacggcuaaggagaucuacgagaaaauucaggaaggcgucuuugauaucaacaaugaagccaacgggaucaagauuggaccccaacaugcugccaccaaugcgacacacgccggcaaccaagggggacagcaggcuggcgggggaugcuguuga

SEQ ID NO: 74547 - RNA, 588 nt, Artificial Sequence
  derived and/or modified sequence opt5 from RAB31__Homo_sapiens__NP_006859
augauggccaucagagagcugaaggugugccuccugggcgacaccggggucggaaaaagcuccaucguuugucgguucgugcaggaucacuuugaccauaacaucucucccacaauuggcgcuagcuucaugacgaagaccgugccuugcgggaaugaacuucacaaauuucugaucugggauacagccggacaagagcgcuuccauucccucgcgccgauguacuauagaggcucugcugccgccgucauuguguacgacaucaccaagcaggauagcuuuuauacacugaaaaaguggguuaaggaacuuaaagagcacgggcccgaaaacaucgugauggcuauugccggaaauaagugugaccuguccgauauccgggaggucccucucaaagacgcuaaggaguacgccgaaucuauuggcgcgaucgugguugagaccagcgccaaaaacgcuauuaauaucgaggaacuguuccagggcauuucccgccagauucccccucuggauccccaugagaacgggaauaacggaacaaucaagguggaaaagccuaccaugcaagccagcagacggugcuguuga

SEQ ID NO: 74548 - RNA, 678 nt, Artificial Sequence
  derived and/or modified sequence opt5 from RAB32__Homo_sapiens__NP_006825
auggccggcgggggagcuggcgaccccgggcugggagccgcggcugccccugccccggagaccagagaacaccucuucaaggugcuggucaucggcgagcuugggguuggaaaaacaagcauuaucaagcgguacgugcaucagcuguuuucccaacacuaucgcgcuacgauuggcguggauuucgcccucaaaguccugaacugggacucuagaacccuugugcggcugcagcucugggauaucgcuggccaggaacgcuuugggaauaugacaagaguuuacuauaaggaggccgugggagcguucgucguguuugacauuagccgguccucuaccuucgaagccguucugaaauggaaaagcgaucuggacuccaaggugcaucuccccaacggcucuccuauccccgcuguccugcuugccaauaaaugcgaucagaacaaggacagcucccaaagcccuucucagguggaucaguuuuguaaagagcacggguucgcuggaugguuugagacauccgccaaggacaauaucaacauugaagaggcggcccgcuuccugguggaaaagauccucgucaaucaucagagcuuucccaacgaggagaaugauguugacaagauuaagcuggaucaagaaacccuuagagcugagaacaaaucucagugcuguuga

SEQ ID NO: 74549 - RNA, 690 nt, Artificial Sequence
  derived and/or modified sequence opt5 from RAB33B__Homo_sapiens__NP_112586
auggccgaggaaauggagagcucccuggaggcuucuuucagcuccucuggcgccgugagcggggcguccggauuucugcccccugcuagaucucggaucuucaagauuaucgucauuggcgacagcaacguugggaaaaccugccucacauaccgcuuuugugccggaagauucccggaucggacggaagccaccaucggcguggacuuucgcgaaagagcuguggagauugauggggagcggaucaagauccagcuuugggacacagccggacaagaacgcuucagaaaauccaugguccagcacuauuaccggaaugugcaugcuguuguguuugucuaugauaugaccaacauggccagcuuccacucucugcccuccuggauugaggaaugcaagcagcaucuccuggcgaaugacaucccucgcauucuugugggcaacaaaugugaucugagaagcgccauccagguucccacagaccucgcucaaaaguuugccgauacccacucuaugccucuguucgagacauccgcuaagaaucccaacgacaaugaucauguggaggccauuuuuaugacccuggcgcacaaacucaagagccacaaaccucugaugcuuucucagccgcccgacaacggcaucauucugaagccugaacccaaaccugccaugacgugcugguguuga

SEQ ID NO: 74550 - RNA, 927 nt, Artificial Sequence
  derived and/or modified sequence opt5 from RAB34__Homo_sapiens__NP_001136096
augagccaccuucccggccucgagcugagacgggaagccccuccgcuucuggggccccuccuguccccuuucccccuuccugcuggaucuuggcaucgccagaugcugagaagcucccuccgguuucccaucaccaacucugccggcgcgccuugcaaggcugccgggcgcaugaauauucuggccccggugagacgggaccgcguccuggcugagcucccccaaugucugagaaaagaagccgcucugcacggacauaaggauuuccacccucggguuacaugcgccugucaggagcaucgcacgggcaccgugggguuuaaaaucagcaaggugauugucgugggagaccuguccguuggcaaaacaugccucaucaacagauucuguaaggauaccuuugacaagaauuacaaagcgacaauuggcguggauuucgaaauggagcgguuugagguccuggggauccccuucucucuucagcugugggacaccgccggacaggaacgcuuuaagugcaucgcuagcacauauuacagaggcgcccaagcuauuaucauuguguucaaccucaaugauguugccucccuggagcacaccaaacaguggcuggcggacgcccucaaggaaaacgauccuagcucugugcugcuuuuucugacgcccgcucaguaugcccucauggagaaagacgcucugcaggucgcccaagagaugaaggccgaauacugggcuguguccagccuuaccggggagaaugugcgggaguucuuuuuccgcgucgcggcccugacauucgaagcuaacguucucgccgaacuggagaagucuggagccagacggaucggcgauguggugagaauuaauuccgacgauagcaaccuguaucucaccgcuucuaaaaagaaaccgacauguugcccuuga

SEQ ID NO: 74551 - RNA, 459 nt, Artificial Sequence
  derived and/or modified sequence opt5 from RAB35__Homo_sapiens__NP_001161078
auggccagagacuacgaucaccuguucaagcuccugaucauuggcgacagcggggugggaaaauccucucuucugcuccgguuugcugauaacaccuucagcggcuccuauaucacaacgauuggggucgacuuuaagauccgcaccguugagauuaauggagaaaaagugaagcugcagaucugggauacagccggccaagagagauuccggaccaucacaucuaccuacuaucgcgggacacauggagugauugucguguacgacguuaccagcgcggaauccuuugugaacgucaaaagauggcuucacgagaucaaucagaacugcgaugacgugugucggauucuggauguucagcuccaucacggcgcugggcccccuucuaaggaacgccagccgggcaagacggccgccgcuaccacagagagaugcggagaggcccaugaggaacaauga

SEQ ID NO: 74552 - RNA, 1002 nt, Artificial Sequence
  derived and/or modified sequence opt5 from RAB36__Homo_sapiens__NP_004905
auggugaucgccggcgcuagcuggaugcuggggagagccgcggcuucccccacccagacaccuccgacgaccucuacaauucgggucgcccgcagaagccggguugcccucguggcuauggugaucgccgcugccggauccggcgggcccggacgcgcggagccucaacugucucagcccagccuugacugcggcagaaugcgguccucucugaccccucucgggcccccugucagccgcgauagagugauugccuccuucccgaagugguacacacccgaggcuugucugcagcuucgggaacacuuucauggacagguuagcgccgcuugccaacgcagaaacaccggcacagugggccugaaacucucuaaggucgugguugugggggaccuguaugucggaaaaaccucccugauccaccgguucuguaagaauguguuugaucgcgacuacaaagccacgauuggcguggauuucgaaaucgagagauuugaaaucgcggggauuccuuauagccuccagaucugggacaccgccggacaggagaaguucaagugcauugcuucugccuacuaucggggcgcucaggucaucauuacagccuuugaucugaccgacguucaaacacuugagcauacccgccaguggcuggaagaugcccucagagagaacgaagcuggguccuguuucaucuuucuggugggaacgaaaaaggaccuucugagcggcgcggccugcgagcaggcugaggccgaugccgugcaccucgcucgggaaaugcaggccgaguacuggucugucuccgcgaaaacaggcgaaaaugugaaggcuuucuuuagcagaguugccgcccuggcuuucgagcaauccgugcugcaggaccucgaacgccagucuagcgcccggcugcaagucgggaacggagaucuuauucagauggagggcuccccucccgagacccaggaaagcaaaagacccucuucccugggguguugcuga

SEQ ID NO: 74553 - RNA, 672 nt, Artificial Sequence
  derived and/or modified sequence opt5 from RAB37__Homo_sapiens__NP_001006639
augaccggcacacccggggccguggcuacgagagacggagaggccccugaacggagcccgcccugcuccccuucuuacgaucugaccggcaaggucaugcuccugggggacacaggaguuggcaaaaccuguuuccuuauccaguuuaaggauggggcguuccugagcggaacauuuauugcuaccgugggcaucgacuuccgcaacaaaguggucacaguggauggcguuagagugaagcuccaaauuugggacaccgccgggcaggagcgguuucgcuccgucacgcacgccuauuacagagaugcucaggcccugcuucugcucuaugacaucaccaauaaaucuagcuucgauaacauucgggcuuggcugacagaaauccaugaguacgcccagcgcgacgugguuaucaugcugcucggaaauaaggcggauauguccucugaaagagugauucggagcgaggacggcgagacccuggcccgcgaauaugggguccccuuucuugagacauccgcuaagaccggaaugaacguggaacuggccuuccucgcuaucgccaaagagcugaaguacagagcgggccaccaagccgaugagccuagcuuucagauucgggacuauguggaaucucagaaaaagcgcuccagcugcuguucuuucauguga

SEQ ID NO: 74554 - RNA, 636 nt, Artificial Sequence
  derived and/or modified sequence opt5 from RAB38__Homo_sapiens__NP_071732
augcaggcuccccacaaggagcaucuguacaaacuccuggugaucggcgaccuuggggucggaaagaccagcauuaucaaaagauauguucaccaaaacuucuccucucauuaccgggccacaauuggcguggauuuugcccugaaggugcuccacugggacccugaaacggucgugcgccugcagcuuugggauaucgcggggcaggagagauucggaaauaugacccggguuuauuaccgcgaagcuaugggcgccuuuauuguguucgacgucacaagaccggccaccuuugaggcuguggccaaauggaagaacgaucuggacagcaagcucucccugcccaaugggaaaccuguuucugugguccugcucgcuaacaagugcgaucagggaaaagacgugcugaugaauaacggccuuaagauggaucaauucuguaaagaacauggcuuuguggggugguucgagacaagcgccaaggagaauaucaacaucgacgaagcgucccggugccuggucaagcacauucucgccaaugagugugaucugauggaaucuaucgagcccgacguugugaaaccucaccuuaccagcacaaagguggcuuccugcagcggaugugccaaaucuuga

SEQ ID NO: 74555 - RNA, 654 nt, Artificial Sequence
  derived and/or modified sequence opt5 from RAB39A__Homo_sapiens__NP_059986
auggagaccaucuggauuuaccaguucagacugaucgugauuggcgacagcacagucgggaaguccugccuccugcaccgguuuacgcaaggacgcuuccccggccuuagaucuccugccugugauccgaccguugggguggacuuuuucagccggcugcucgaaaucgagcccggaaaacgcauuaagcugcagcuuugggauacagcuggccaggaaagauuucgguccaucacccgcucuuauuacagaaacagcgucgggggauuccugguguuugacaucacaaaucggcgcuccuucgagcaugugaaagauuggcucgaagaggccaagauguauguucagccuuuuagaauuguguuccugcuggucggccacaaaugcgaccucgcgucucaacgccaggugacccgggaggaagcugagaagcugagcgccgauuguggcaugaaguacaucgaaacauccgccaaagacgcuaccaacguugaggagagcuuuacgauucuuaccagagauaucuaugaacugauuaagaaaggggagaucugcauucaggacggaugggaaggcgugaagucuggguucguccccaauacagugcauuccagcgaggaagccgugaaaccucggaaggaguguuuuugcuga

SEQ ID NO: 74556 - RNA, 642 nt, Artificial Sequence
  derived and/or modified sequence opt5 from RAB39B__Homo_sapiens__NP_741995
auggaggccaucuggcuguaccaguucagacucauugugaucggcgacagcaccgucgggaaguccugccugauucggcgcuuuacagaaggaagauucgcucaaguuucugaucccacggugggcguggacuuuuucagccggcuugucgagaucgaaccugggaaacgcauuaagcugcagaucugggauaccgccggacaggagagauuucgguccaucacacgcgcguauuacagaaacucugugggcgggcuccugcuuuucgacauuaccaaucggcgcagcuuucagaacguucacgaauggcuggaggagacaaaagugcauguccaaccguaucagaucguguucguucucgugggacacaagugugaucuggacacccagagacaggucacacggcaugaagcugagaaacuggccgccgcuuacggcaugaaguauauugaaaccuccgcccgcgaugcuaucaauguggagaaggccuuuacggaccucaccagagauauuuacgagcuggugaaacggggcgaaaucacaauucaagaggggugggaaggagucaagucuggcuucguucccaacguggugcacagcuccgaggaagucgugaaaagcgagcgcagaugccuuuguuga

SEQ ID NO: 74557 - RNA, 663 nt, Artificial Sequence
  derived and/or modified sequence opt5 from RAB3A__Homo_sapiens__XP_011526466
auggccagcgcuaccgacuccagauacggccagaaggagucuagcgaucaaaacuucgacuauauguuuaaaauccugauuaucgggaauagcucugugggaaagacauccuuccucuuucgguacgccgaugacuccuucacgcccgcguuugucucuaccguuggcauugauuucaaagugaagacaaucuaucgcaacgacaaaagaauuaagcugcagaucugggauaccgcugggcaggaacgguaccgcacaaucaccacagccuauuacagaggagccaugggcuuuauucuuauguaugacaucaccaaugaggagagcuucaacgcugugcaggauugguccacgcaaauuaagaccuacagcugggacaaugcccagguccugcucguggggaacaaaugcgauauggaagacgaacggguugugucuuccgagcgcggaagacagcuggcugaucaccuuggcuuugaguucuuugaagccagcgcgaaggacaauaucaacgucaaacagacauucgagcggcugguggacguuauuugugaaaagaugucugagucccucgauaccgccgacccugcugugacaggcgccaaacaagggccgcagcugagcgaucagcaggucccuccccaucaagacugcgcuuguuga

SEQ ID NO: 74558 - RNA, 660 nt, Artificial Sequence
  derived and/or modified sequence opt5 from RAB3D__Homo_sapiens__NP_004274
auggccagcgcuggcgacacccaggccgggcccagagaugcggcugaccaaaacuucgauuacauguuuaagcugcuccugaucggaaauuccucugugggcaaaacaucuuuccuuuuucgguaugccgacgauuccuucacgccugccuuugucucuaccguugggauugacuucaaggugaaaacaguguaccgccacgauaagagaaucaaacugcagauuugggacaccgcuggacaggagcgguaucgcacaaucaccacagccuacuauagaggcgcuaugggguuucuccugauguacgauauugccaaccaggagagcuucgcggccguccaagacugggcuacccagaucaagacguauuccugggauaaugcccaggugauccuuguuggaaacaagugcgaccuggaagaugaacggguggucccggcugaggacggccgcagacucgccgacgaucugggcuuugaguucuuugaagcgucugccaaagagaauauuaacgugaagcagguuuucgaacggcugguggacgucaucugugagaaaaugaaugaaagccucgagcccuccagcagcuccgggagcaacggaaagggcccugcugugggggaugcccccgcuccucaacccucuuccugcagcuguuga

SEQ ID NO: 74559 - RNA, 2967 nt, Artificial Sequence
  derived and/or modified sequence opt5 from RAB3GAP1__Homo_sapiens__NP_001165906
auggccgcugacagcgagcccgaauccgagguguucgaaaucaccgauuuuacaacggccucugagugggaaagauucauuagcaaggucgaggagguucugaacgacuggaaacucaucggcaauucccuggggaagccucuugaaaaaggaauuuuuaccucuggcacaugggaggaaaagagcgaugagaucuccuucgcggacuuuaaauucucugugacccaccauuaccuggugcaggagagcacagauaaggaagggaaggacgagcuccuggaagaugucgugccgcaauccaugcaggaccuucugggaaugaacaaugauuuucccccucgggcucacugccucguucgcugguauggccugagagaguucguggucauugcccccgccgcucauagcgacgccgugcugucugaauccaaauguaaccuccugcuuagcucuguuuccaucgcucuggggaauaccggaugccaggugccucucuuuguccagauccaccauaaguggcggcgcauguacgugggcgagugucaaggccccggggugagaacagauuucgagaugguccaucugcggaaaguuccuaaccaguauacccaccuuagcggacugcucgacauuuuuaagucuaaaaucggcugcccgcugacgccccugccucccguguccauugccauccgcuucaccuacgugcuccaggauuggcagcaauauuuuuggccucagcagcccccggacauugacgcgcuggucgggggagaagugggcgggcuugaguucggaaagcugccuuucggcgccugugaagaucccaucagcgagcuccaccuggcuacaaccuggccucaccuuacagaaggcauuaucguugacaaugauguguacuccgaccuggaucccauccaggcuccccauuggucugucagagugcggaaggccgagaacccucaaugccuccugggggacuuuguuaccgaguucuuuaaaauuugucgcagaaaggaaagcacggaugagauccugggacgguccgccuucgaagaggaaggcaaagagacagcggacauuacccacgcccucagcaagcugacagagccggcuucugugcccauccacaaacuuuccgucagcaauauggugcauaccgccaagaaaaagauucgcaagcacagaggggucgaagagucuccucugaacaaugaugugcucaacaccauccugcuuuuucuguuccccgacgcuguuagcgaaaaaccucucgauggaacaacguccaccgacaauaacaaucccccgucugagagcgaggacuauaaccuguacaaccaguuuaaguccgccccuagcgauucucugacauacaaacucgcccugugccuuuguaugaucaauuucuaucauggcgggcugaagggaguggcucaccucuggcaggaauuuguccuggagaugcgguuccgcugggaaaacaauuuucugauucccggccuugcguccggcccucccgaccucagaugcugucugcugcaucaaaaacuccagaugcugaacugcugcaucgagcggaagaaggccagagaugaagggaaaaagaccagcgcuucugacgugacaaauauuuacccuggagaugccggcaaagccggggaccagcuuguucccgauaaccugaaggagaccgacaaagagaagggagaagugggcaaguccugggauagcugguccgacucugaggaagaguucuuugaaugucucagcgauacggaggagcugaaagggaauggccaggaauccggaaagaaaggcgggccgaaggagauggcuaaccugcgcccugaaggacggcuuuaucaacacggcaaacucacacugcugcacaauggggagccccucuacauccccgucacccaggaaccugccccgaugaccgaggaccugcuugaggaacagucugaggugcuggcgaagcucggaacaagcgcugaaggcgcccaucugagagcccgcaugcaguccgcuugccugcuuagcgauauggagucuuucaaggccgcuaaccccggguguucccucgaggacuucgugcggugguauagcccuagagacuacauugaagaggaaguuaucgaugagaaaggcaaugucgugcugaagggagaacugucugcccgcaugaaaauccccuccaacauguggguggaggcgugggagaccgccaagccuauucccgcucggagacaacgccggcucuuugacgauacaagagaagccgagaaaguccugcacuaucuugcuauccagaagccugccgaccuggcgcgccaucuccugcccugcgugauucacgccgcuguucugaaagugaaggaagaggaaagccuugagaauaucucuagcgucaagaaaauuaucaagcagauuaucucccacagcucuaaagugcuccauuucccgaacccugaggauaagaaacuggaagagaucauucaccagaucacgaauguugaagcccugauugcucgggccagaucccucaaggccaaguuuggcaccgagaaaugugaacaagaggaggaaaaggaggaccuggaacgguucgugagcugccuucuggagcagcccgagguccucgugacaggggcuggacgcggccaugcggggagaaucauucacaaacuguuuguuaacgcccagcggcugaccgaauccucugaugaggcugccgccaugacaccucccgaagaggaacuuaagagaaugggaagcccggaggagcgccggcagaacuccgugucugacuucccucccccugcuggcagagaauuuauccugcgcaccacgguccccagacccgccccuuacagcaaagcgcucccgcaacggauguacuccgugcugaccaaggaggauuuccgccucgcuggggccuuuucuagcgacacauccuucuuuuga

SEQ ID NO: 74560 - RNA, 4182 nt, Artificial Sequence
  derived and/or modified sequence opt5 from RAB3GAP2__Homo_sapiens__NP_036546
auggccugcagcaucgugcaguucuguuacuuucaagaccugcaggcugccagagauuuccucuuuccccaucugcgggaggaaauucuuuccggcgcgcugcgcagagacccuucuaagagcaccgauugggaggacgauggguggggagcuugggaagagaacgaaccgcaggagcccgaggaagagggcaauacaugcaaaacgcagaagaccuccuggcuccaagacuguguccugucucuuagcccuacaaacgaucugaugguuaucgcccgggaacagaaagccguguuccucgugcccaaguggaaauauuccgacaaggggaaggaggagaugcaguuugcugucggauggucuggcagccugaauguggaagagggggaaugcguuaccuccgcccuguguauuccucucgcuagccagaaaagaucuuccacaggacgccccgauuggaccugcaucguggucggcuucacaagcggcuacgugcgguuuuauaccgagaacgggguucugcuucuggcccaacuccugaaugaagacccugugcuucagcugaagugucgcacguacgagauuccgagacaccccggagucaccgagcagaacgaagaacucucuauccuguauccugcggccaucgugacaauugauggcuucucccuguuucagagccuccgggcuugccgcaaucaaguggccaaagcugccgcgucugggaacgaaaauauccagcccccuccccuggccuacaagaaauggggacuucaggacauugauaccaucauugaccacgcuuccgucggcaucaugacacugagcccguucgaccaaaugaagaccgccuccaacauugggggauuuaaugcugccaucaagaacucuccucccgccaugagccaguauaucacgguuggcuccaauccuuucacaggcuuuuucuacgcucucgaggggagcacccagccccugcuuucucauguggcgcuggccguggcuuccaaacucacaagcgcccuguucaacgccgcuucuggauggcugggcuggaaaagcaaacacgaagaggaggccguccagaagcaaaaacccaagguggaaccugcgaccccgcucgcuguuagauuugggcugcccgauucccggcgccauggagagucuauuugucuuagcccuugcaauacccuggccgccgugacagacgauuucggcagagucauccuccuggacguggcucgggggauugccauccgcauguggaaaggauacagagaugcucagauuggcuggauccagacgguugaagaccuucacgagcgggugcccgaaaaggccgauuuuuccccuuucggcaacagccaggggcccucuagagucgcgcaauuucuggugaucuaugccccgcgccggggcauucucgaggucugguccacccagcagggaccuagagugggggcuuucaacguuggaaagcacugucgccugcuguaccccggcuauaaaaucauggggcucaauaacgugacaagccagucuuggcaaccucagaccuaccagauuugccuggucgaccccguguccggcagcguuaagacagugaaugucccuuuucaucuugcccuguccgauaaaaagucugagcgggcuaaagacaugcaccucgugaagaagcuggccgcgcugcuuaaaaccaagagccccaaccucgaucugguggaaacggagaucaaagaacugauucucgacaucaaguauccggccacaaagaagcaggcucuggaguccauccuugccucugagagacugccuuucagcugccuccgcaauauuacccaaacccugauggacacacugaagucccaggaacuugagagcguugaugaaggacuccugcaguuuugugcuaacaaacugaagcuccugcaacuuuacgagucugucucccagcugaauagccucgacuuccaucuggauacccccuuuucugacaacgaucuggcccuucuccugcggcuggacgaaaaagagcuccugaagcugcaggcccugcucgagaaauauaagcaggaaaauacaagaacgaacgugcgcuucuccgaugacaaggauggcgugcugcccgucaaaaccuuucuggaguaccuugaauacgagaaggacgugcucaauaucaaaaagauuagcgaagaggaguauguugcucuggggucuuucuucuuuuggaaaugccugcacggagaaagcuccacagaggauaugugucacacccucgaaagcgcgggccugucuccucaacuucugcucucccugcugcuuagcguguggcuguccaaggagaaagacauccucgauaagccgcagucuauuugcugucugcauacaaugcucagccugcuuuccaagaugaaagucgccaucgacgaaaccugggacucucagagcgugucccccugguggcagcaaaugcggacggcuugcauucagucugagaacaauggggccgcccugcucagcgcucacguuggacauuccguggccgcgcagaucagcaacaauaugaccgagaagaaauucucucagacaguccugggcgcugauuccgaagcccugaccgacagcugggaggcccuuucucuggauacagaauacuggaagcuccugcucaaacaacuggaggacugucuuauccugcagacccuccugcacuccaaggggaacacgcagacaagcaaggugucuucccugcaagcugagccucuucccagacugagcguuaaaaagcuccuggaaggcggaaaaggcgggauugccgauuccguggcgaaguggaucuuuaaacaggacuucagcccugagguccucaagcuggcuaacgaggagcgcgaugccgaaaaucccgacgagccuaaggagggagugaaccggucuuuucuugaagugagcgagauggaaauggaucugggcgccauucccgaccugcuccaucuggcuuaugagcaguucccgugcucccuugaacuggauguccuccacgcccacuguugcugggaguacguugugcaguggaauaaagacccugaggaagcuagauuuuucgugcggucuaucgagcaucugaagcaaauuuuuaacgcccacguccagaaugggaucgcgcucaugauguggaacaccuuccuggugaaacgcuuuagcgccgcuacauaucuuauggauaagguuggaaaaucccccaaggacagacugugucggagagacgugggcaugucugauaccgccaugaccagcuuccugggguccugccucgaccugcuucagauccugauggaagcugaugucucucgcgacgagauucaggugccuguucucgauacagaagacgccuggcugagcguggagggccccaucuccauugucgagcucgcccuggaacaaaagcauauccacuacccgcuuguggagcaccauagcauucugugcucuauccuguaugcuguuaugcgguuuucccucaaaacggugaagccucugagccuuuucgauucuaaaggaaagaaugcguucuuuaaagaccugaccuccauccagcuccugcccagcggcgaaauggauccuaacuucauuuccgucagacagcaguuucuccugaagguggugucugccgcuguccaagcccagcacagcgccacaaaaguuaaggaccccaccgaggaggcuacacccaccccuuucgggaaggaucaggacuggccggcccuugcgguggaccuggcucaucaccuucagguguccgaagaugucgugcgcagacauuacguuggagagcucuacaauuauggcguggaccaccugggggaagaggccauccuucaaguccacgauaaagaagugcuggccagccagcuccugguucugacgggacagcggcucgcucaugcccuucugcacacacaaaccaaggagggcauggagcugcucgcgcgccugcccccuacccuuuguacauggcugaaagcuauggacccccaggaucuccagaacaccgaagugccuauugccacaacggccaagcuggucaauaaagugaucgagcugcuccccgaaaagcaugggcaguacggccuugcucugcaccugauugaggccgucgaagcuaucucucucccuucccuguga

SEQ ID NO: 74561 - RNA, 1071 nt, Artificial Sequence
  derived and/or modified sequence opt5 from RAB3IL1__Homo_sapiens__NP_001258615
auggacagcuccgaggaacacgccggcugccccgcuagagggaccuguccuguguuccuggccaugucugcgggaacaguccgguacgcuccgagcggccucugccccguucuggaggggaaccuucgcgaagaaccuuggggaacggauucucccccucagcccgaccaaggccugccuccgccccucgccgccgugccugugcccuggaaguccaccgauccuugucaggggcauagagaaagccccggagcucuggucgagacauccgccggcgaggaagcucagggccaggaggggccggccgcggcccaacuugacgugcugcggcuccgcucuagcuccauggaaaucagagagaaaggaagcgaguuucugaaggaagaacugcaccgggcucagaaagaacucaagcugaaagaugaggaaugcgagcgccuuucuaagguuagagagcagcuggaacaggagcucgaggagcugaccgccucccuuuucgaagaggcucauaagauggugcgggaggccaauaugaaacaagcggccagcgaaaagcagcugaaagaggcucgcggcaaggucgacacaauucucuuugccgaguuccaggcuuggagagagucuccuacccuggauaaaacaugucccuuucuggaacggguguaucgcgaggacguugggccuugccucgauuucaccaugcaggagcuguccgugcuugucagagccgccguggaagacaacacgcugaccaucgagcccguggcuagccaaacacuccccaccgucaagguugcggaaguggauuguucuuccacaaauaccugcgcccugagcggacuuacgcggacaugucgccaccggauuagacugggcgacuccaagucucauuacuauaucagcccuuccagcagagcucgcauuaccgccgugugcaacuuuuucacauacauccgguauauccagcaggggcucgucagacaagaugccgagccgauguuuugggagauuaugcgccugcggaaagaaaugucucuggcuaagcucggauucuuuccccaggaggccuga

SEQ ID NO: 74562 - RNA, 765 nt, Artificial Sequence
  derived and/or modified sequence opt5 from RAB3IP__Homo_sapiens__NP_001019818
auggugagagaggccaacaucaagcaggcuaccgccgaaaaacaacugaaggaggcgcagggcaaaauugacguccuccaggcugaaguugccgcccugaagacacuugugcugagcuccucucccacgagcccuacccaggagccgcuccccgggggaaaaacaccuuucaagaagggccacacccggaauaaauccacaucuagcgcuauguccgggucucaucaagaucugagcgugauccagcccauugucaaggacugcaaagaagccgaucuuucccuguacaacgaguuucgccucuggaaggacgagccuaccauggauagaacaugucccuuccuggacaaaaucuaucaggaagauauuuuuccuugccugaccuucagcaagucugagcucgcuuccgccgugcuggaagcgguugagaauaacacgcuuagcaucgagccggugggacugcagcccauccgguuugucaaggccucugcuguggaauguggcgggccuaaaaagugcgcccucaccggacaauccaaaagcuguaagcaccgcauuaaacugggcgacucuuccaauuacuauuacaucagccccuucugcagauaucggauuacauccguuuguaacuuuuucaccuacauccgcuauauucagcagggccuugugaagcagcaagaugucgaccagauguuuugggaggugaugcagcugagaaaagaaaugucucucgcuaagcugggguacuucaaggaggaacuguga

SEQ ID NO: 74563 - RNA, 837 nt, Artificial Sequence
  derived and/or modified sequence opt5 from RAB40AL__Homo_sapiens__NP_001027004
augagcgcccccggcuccccugaccaggcuuacgauuuccugcucaaguuucugcuugugggggacagagaugucggaaaaucugagauccuggaaagccuccaagacggcaccgccgaguccccguauucucaccuugggggaauugauuacaagacaacgaccauccugcuggacggccagcggguuaaacucaagcugugggauacaagcgggcagggacgcuucugcaccauuuuuagauccuauucucggggcgcgcagggcgugauccugguguacgacauugcuaaccgcuggagcuucgaagggauggauagauggaucaaaaagaucgaggaacaugcccccggagucccuaagauucucgugggcaaucggcugcaccuugccuuuaaacgccaaguucccagagagcaggcucaggccuaugcugagcggcugggggugacauucuuugaagucuccccucucuguaacuucaauaucauugagagcuuuaccgaacuggcccgcaucgugcuucugagacaucggcucaacuggcugggacgccccucuaagguucugucccuccaggaccugugcuguagaacaauugugagcugcaccccuguccaccuuguggauaaacugccgcuccccaucgcgcugcggucucaucuuaaguccuucagcauggccaaaggccugaaugcucgcaugaugagagggcucucuuacucccugacgaccagcuccacacacaagcggucuagccuguguaaggugaaaauugucugcccuccccaauccccucccaagaacuguaccagaaauagcugcaaaaucucuuga

SEQ ID NO: 74564 - RNA, 837 nt, Artificial Sequence
  derived and/or modified sequence opt5 from RAB40B__Homo_sapiens__NP_006813
augagcgcccugggcucccccgugagagcuuacgacuuccuccugaaguuucuucuggucggggauucugacguuggaaaaggcgagauccucgccagccugcaggauggggcggcugaauccccuuauggacacccggccggcauugacuacaagaccacaacgauccuucuggaugggcggcgcgugaaacuccaacugugggacaccucuggacagggcagauucugcacaauuuuucggagcuauucccgcggcgcccagggggugauccuggucuacgauauugcuaacagauggucuuucgacggaaucgaucgguggaucaaggagauugacgaacaugcccccggcgugccuaaaauccucguugggaaucgccugcaccuugcuuuuaagagacaggugcccaccgagcaagcccaggcguaugccgaacggcugggagucacauucuuugaggugagcccucucuguaacuucaauauuaccgaguccuuuacagaacuggcucgcaucguucuucugagacauggcauggaucggcucuggcgccccagcaaggugcugucucugcaggaccucugcuguagagccgucguguccugcaccccugugcaccuggucgauaaacuuccgcugcccauugcucuccggagccaucugaagucuuucuccauggccaacgggcuuaaugcgcgcaugaugcacggaggcagcuacucucugacgaccuccagcacacacaaaagauccucucuccggaagguuaaacuggugagaccuccccagagcccucccaagaacuguacccgcaauuccugcaagaucagcuga

SEQ ID NO: 74565 - RNA, 846 nt, Artificial Sequence
  derived and/or modified sequence opt5 from RAB40C__Homo_sapiens__NP_001166136
augggcagccaggggucccccgugaagucuuacgacuaucugcucaaauuccugcuugucggagauagcgacguuggcaagggggagauccuggaaucccuccaagauggagccgcugagucuccuuacgccuauagcaacggcauugacuacaaaaccacaacgauccugcuugaugggagacgggugaagcuggaacucugggacaccuccggacagggccgcuuuugcacaauuuucagaucuuauagccggggcgcgcaggggauccugcugguguacgauauuaccaaucgcugguccuuugacggaaucgauagauggaucaaagagauugacgaacacgcuccgggcgucccccggauccucguggggaaccgccugcaucuugccuucaagagacagguuccuacagagcaagcccgggcuuaugccgagaagaauuguaugaccuuuuucgaagugagcccccugugcaacuuuaaugucauugagucuuucacagaacucucccgcaucgugcugaugagacacggaauggagaaaauuuggcggccuaaccgcguuuuuagccuucaggaucuguguugcagagcuaucgugucuuguacccccguccaucucauugacaagcugccucugccggugacgaucaaaucccaccucaagagcuucucuauggccaauggcaugaacgcggugaugaugcaugggcgguccuacagccuggccuccggagcuggcggcgggggaucuaaaggcaauagccuuaagcgcuccaagagcaucagacccccucagucucccccucagaacugcucccggagcaauuguaaaauuucuuga

SEQ ID NO: 74566 - RNA, 657 nt, Artificial Sequence
  derived and/or modified sequence opt5 from RAB4A__Homo_sapiens__NP_004569
augagccagaccgccauguccgagacauacgacuuccuguuuaaguuccucgugaucggcaacgcugggacgggaaaaucuugccugcuucaccaauuuauugaaaagaaauucaaggaugacagcaaucauaccaucggcgucgaguuuggguccaaaauuaucaacguuggaggcaaguaugugaagcugcagauuugggauacagccgggcaggaaagauuccggucugugacccgcagcuacuauagaggagcggcuggcgcccuccuggucuacgacaucacaucccgggagaccuauaaugcccuuacaaacuggcugaccgaugcucgcaugcucgccucucagaauaucgugauuauccuguguggcaacaaaaaggaccuggaugcugacagagaaguuacguuucucgaggccagccgguucgcgcaagagaaugaacugauguuucuugagaccuccgcccugacaggggaaaacguggaggaggcuuucguccagugcgcccgcaaaauucucaauaagaucgaaagcggagagcuggaucccgaaagaaugggcucugggauucaguacggagacgcugcccuucggcagcugcgcuccccuagacgggcgcaagccccgaacgcucaggaguguggcugcuga

SEQ ID NO: 74567 - RNA, 642 nt, Artificial Sequence
  derived and/or modified sequence opt5 from RAB4B__Homo_sapiens__NP_057238
auggccgagaccuacgacuuccuguuuaaguuccucgugaucggcagcgcugggacaggaaaauccugccugcuucaccaguuuauugaaaacaaguucaaacaagauucuaaucauacgaucggcgucgaguuugggagcagaguugugaacgugggaggcaagaccgucaaacugcagauuugggacacagccgggcaggaacgguuccgcuccgugaccagaucuuauuaccggggagcggcuggcgcccuccugguuuaugauaucacaagccgcgagaccuacaauucccuugccgcuuggcugacagacgccagaacccucgcuucucccaacauuguggucauccuguguggcaauaagaaggaucuggacccugaacgggaggugacguuucucgaggccagccgcuucgcgcaggaaaacgagcugauguuucuugaaaccuccgcccugacaggggagaauguugaggaggcuuuccucaaaugcgccagaaccauccugaacaagauugauagcggagaacuugacccggaacggaugggcucugggauccaauauggagaugcuucccugcgccagcucagacagccccggagcgcccaggcgguggccccucaacccuguggcugcuga

SEQ ID NO: 74568 - RNA, 606 nt, Artificial Sequence
  derived and/or modified sequence opt5 from RAB5A__Homo_sapiens__NP_001278977
auggccagcagaggcgcuacccggcccaacgggccuaauacaggaaacaagaucugccaguucaaacuggugcuccugggcgaguccgccgucgggaagucuagccuuguucugcgcuuugugaaaggacaauuccacgaauuucaggaguccacgauuggcgugaaguucgaaaucugggacaccgcggggcaggagagauaccauucucucgcuccgauguauuaccggggagcccaggccgcuauugucguguaugauaucacaaaugaagagagcuuugcccgcgcuaaaaacuggguuaaggagcugcaaagacaggccucccccaauauugugaucgcgcuuucuggcaacaaggccgaccuggcuaauaaacgggccgucgauuuccaggaagcucagagcuacgccgacgauaacucccuccuguuuauggagaccagcgcgaagacaucuaugaaugugaacgaaaucuucauggccauugcuaaaaagcugccuaaaaaugagccccaaaacccuggcgccaauuccgcucgcgggagaggaguugaccucaccgagcccacacagccuacccggaaccaguguugcagcaauuga

SEQ ID NO: 74569 - RNA, 525 nt, Artificial Sequence
  derived and/or modified sequence opt5 from RAB5B__Homo_sapiens__NP_001238966
augaccagcagauccacagcccggcccaacggccagccucaggcuucuaagaucugccaauucaaacuggugcuccugggggagagcgccgucggaaaguccucucuuguucugcgcuuugugaaaggccaguuccacgaauaccaggagagcacgauuggggcggcuuuucucacccaauccgugugucuggacgauacaaccgucaaguucgaaaucugggacacagccggacaggagagauaucauucucuugccccgauguacuaucggggcgcucaggccgcuauugugguuuacgauaucaccaaucaggaagcccaagcguaugccgacgauaacagccugcucuuuauggagacauccgcuaaaaccgccaugaaugugaacgaccuguuccuggcuauugccaagaagcuccccaaaagcgagccucagaaucuugggggagcggccggccgcucuagaggcgucgaucugcacgaacagucccagcaaaacaagagccagugcuguucuaauuga

SEQ ID NO: 74570 - RNA, 750 nt, Artificial Sequence
  derived and/or modified sequence opt5 from RAB5C__Homo_sapiens__NP_001238968
auggagcugagcuggagaucccccucuccucucagcgccucccugcacucuaccagcccgcauccccacgcucuuuggacaacgaccgccggccgggcgauggcugggcgcggaggcgccgccagaccuaacgggcccgcugccggaaauaagaucugccaguucaaacuggugcuccugggcgaauccgcugucgggaagucuagccuuguucugcgguuugugaaaggacaauuccaugaguaccaggaauccacaauuggcgccgcguuucucacccagacagugugucuggacgauaccacagucaaguucgagaucugggacaccgccggccaggaacgcuaucacagccuggcuccuauguacuauagaggggcccaagcugccauugugguuuacgauaucacgaacaccgacacauuugcgcgggccaaaaauugggugaaggagcuccagcgccaggcuucucccaacauugucaucgcccuggcuggaaauaaggccgaucuugccuccaaaagagcuguggaguuccaggaagcgcaagccuaugcugacgauaacagccugcucuuuauggagaccucugccaagacagccaugaauguuaacgaaaucuucauggcuauugccaaaaagcugccuaaaaaugagccgcagaacgcgaccggcgcucccgggcggaaucgcggaguggaccuucaggagaacaauccugccuccagaagccagugcuguucuaacuga

SEQ ID NO: 74571 - RNA, 315 nt, Artificial Sequence
  derived and/or modified sequence opt5 from RAB6A__Homo_sapiens__NP_001230647
augagcaccggcggggacuucggaaacccccugagaaaguuuaaacucguguuccugggcgagcaguccgucgggaagacaucucuuaucacgcgguuuauguacgauagcuucgacaauaccuaucaagccacaauuggaaucgauuuucuguccaaaaccauguaccucgaggaccgcacacuguucagacggguugcugccgcgcuuccuggcauggagucuacccaggaucgcagcagagaagacaugauugauaucaagcuggagaaaccgcaggaacagcccguguccgaagggggaugcucuuguuga

SEQ ID NO: 74572 - RNA, 627 nt, Artificial Sequence
  derived and/or modified sequence opt5 from RAB6B__Homo_sapiens__NP_057661
augagcgccggcggggacuucggaaacccccugagaaaguuuaaacucguguuccugggcgagcaguccgucgggaagaccucucuuaucacacgguuuauguacgauagcuucgacaauacguaucaagcuaccauuggaaucgauuuucuguccaaaacaauguaccucgaagaccgcaccguuagacugcagcuuugggauacagccggccaggagcgguuccgcucucugauuccuagcuauaucagagacuccaccguggcgguggucguguacgauauuacaaaccucaauucuuuucagcaaaccagcaaguggaucgacgauguucggacggaacgcggguccgacgugaucauuaugcuggucggaaacaaaaccgaucuggcugacaagagacagaucacaauugaggaaggcgagcagcgggccaaggagcucagcgugauguucaucgaaaccucugccaaaacaggcuauaauguuaagcagcuguuucgcagaguggcuuccgcccuuccggggauggagaacguccaagagaaaagcaaggaaggaaugauugauaucaaacuggacaagccccaggagccucccgcuucugaaggcgggugcuccuguuga

SEQ ID NO: 74573 - RNA, 765 nt, Artificial Sequence
  derived and/or modified sequence opt5 from RAB6C__Homo_sapiens__NP_115520
augagcgcuggcggggacuucggaaacccccugagaaaguuuaaacucguguuccugggcgagcaguccgucgcuaagaccucucuuaucacacgguuucgcuacgauagcuucgacaauacguaucaagccauuaucgggauugauuuucuguccaaaaccauguaccucgaagacggaacaaucggccugagacuuugggauaccgcggggcaggagcggcugcgcucucucauuccuagauauauccgggacagcgcugccgccguugugguguacgauaucacaaacgucaauuccuuccagcagaccacaaaguggauugacgaugugcgcaccgaaagaggaucugacguuaucauuacgcuggugggcaaccggaccgaucuggcugacaaacgccaagucagcguggaggaaggcgagagaaaggccaaggggcucaauguuacauuuaucgagacccgggcuaaagccggauauaacgugaagcagcuguuccgcagagucgcggccgcccuuccgggcauggaauccacacaggaugggagccgggaggacaugucugacauuaaacuggaaaagccccaggagcaaaccguguccgagggaggcugcagcuguuacucuccuauguccagcucuacgcucccccagaaaccucccuauuccuuuaucgauugcagcgugaauauugggcugaaccuuuucccuucccugaucacauuuuguaauucuagccuccugccggucuccuggcgcuga

SEQ ID NO: 74574 - RNA, 624 nt, Artificial Sequence
  derived and/or modified sequence opt5 from RAB7A__Homo_sapiens__NP_004628
augaccagcagaaagaaagugcugcucaaggucaucauucugggcgacuccgggguuggaaaaacaucucuuaugaaccaguacgugaauaagaaauucagcaaccaauauaaggccacgaucggcgcugauuuucugaccaaggaggugauggucgacgaucggcucgugacaaugcagauuugggacaccgccgggcaggaacgcuuccagucccugggaguugcguuuuacagaggcgcugauugcugugugcuugucuucgacgugacagcccccaauaccuuuaaaacacuggauucuuggcgggacgaguuccucauccaagccagcccucgcgauccggaaaacuuucccuucguugugcuggggaauaagauugaccuggagaacagacaggucgcuaccaaacgggcccaggcuuggugcuauuccaagaauaacaucccuuacuuugaaacgucugccaaagaggcgaucaauguggagcaggccuuccaaaccauugcucgcaacgcccucaagcaggaaacagagguggaacuguauaaugaguuucccgagccuaucaaacuugauaagaacgacagagcuaaggccagcgcggaauccuguagcugcuga

SEQ ID NO: 74575 - RNA, 624 nt, Artificial Sequence
  derived and/or modified sequence opt5 from RAB8A__Homo_sapiens__NP_005361
auggccaagaccuacgacuaucuguucaaacuccugcuuaucggcgauagcggggugggaaagacaugcguccuguuuagauucuccgaggacgcuuuuaacucuacguucauuagcaccaucggcauugauuuuaaaauccggacaauugaacucgacgggaagcgcaucaaacugcagaucugggauaccgccggacaagagagauuccggacaauuaccacagcguacuaucgcggcgcuauggggaucaugcuuguuuacgacauuaccaaugaaaaguccuuugauaacaucagaaauuggauucggaacaucgaggaacacgccucugccgacguggagaagaugauucugggaaauaaaugugaugugaacgacaagcgccaggucagcaaagagagaggcgaaaagcucgcucuggauuauggcaucaaauucauggagacguccgccaaggcuaauaucaacguggaaaaugccuuuuucacccuggcgcgggacauuaaggccaaaauggauaagaaacucgaggggaacucuccccagggaagcaaucagggcguuaagaucacaccugaccaacagaaacgcuccagcuuuuucagaugcgugcugcuuuga

SEQ ID NO: 74576 - RNA, 624 nt, Artificial Sequence
  derived and/or modified sequence opt5 from RAB8B__Homo_sapiens__NP_057614
auggccaagaccuacgacuaucuguucaaacuccugcuuaucggcgauagcggggugggaaagacaugccugcucuuuagauucuccgaggacgcuuuuaacacgaccuucauuucuacaaucggcauugauuuuaaaauccggaccauugaacuggacgggaagaaaaucaaacuucagaucugggauacagccggacaagagcgcuucagaaccauuacaaccgcguacuaucggggcgcuauggggaucaugcuggucuacgacauuacgaaugaaaagagcuuugauaacaucaagaauuggauucgcaacaucgaggaacacgccuccucugacguugagagaaugauucucggaaauaagugugauaugaacgacaaacgccaggugagcaaggagcggggcgaaaaacuggccaucgauuauggcaucaaguuccuggagaccuccgcuaagucuagcgccaauguggaagaggccuuuuucacacucgcuagagacauuaugaccaaacugaaccggaagaugaaugauuccaacagcgcgggggccggaggccccgucaaaaucacagagaaucgcucuaagaaaaccuccuuuuucagaugcagccuucuguga

SEQ ID NO: 74577 - RNA, 606 nt, Artificial Sequence
  derived and/or modified sequence opt5 from RAB9A__Homo_sapiens__NP_001182257
auggccggcaagagcucccuguucaaagugauccuccugggggacggaggcgucgggaagucuagccuuaugaacagauacguuaccaauaaauuugauacacagcuguuccacacgauuggaguggaguuucucaacaaggaccuggaaguggauggccauuucgucaccaugcaaaucugggacacagcugggcaggagcgguuucgcucccuuagaacccccuucuaucggggaucugauugcugucugcucacauuuagcguggacgauucccagucuuuccagaaucugagcaacuggaaaaaggaauuuauuuacuaugccgacguuaaggagccugaauccuucccguuugugauccugggcaauaaaauugauaucagcgagcgccaagucucuaccgaggaagcgcaggcuuggugcagagacaacggcgauuaccccuauuucgagacauccgccaaggacgccaccaauguggcugccgcuuuugaagaggccguucggcgcgugcucgcgacggaggauagaagcgaccaccugauccagaccgacacagucaaccuucaucggaaaccuaagcccucuuccagcuguugcuga

SEQ ID NO: 74578 - RNA, 558 nt, Artificial Sequence
  derived and/or modified sequence opt5 from RABAC1__Homo_sapiens__NP_006414
auggccgcucagaaggaccaacagaaagaugccgaggcggaaggccugagcgggaccacacuccugcccaaacuuaucccuuccggagcuggcagagaguggcuggaacggcgcagagccacgauucggccguggucuaccuucguggaccagcagcgcuuuagcagaccccggaaccucggggagcugugccaacgccuugucagaaauguugaauacuaucaguccaacuacguguucguguuucugggacucauccuguauugugucgugacaucuccuaugcugcucguugcccuggcuguguucuuuggcgccugcuacauucuuuaucugcggacccucgagagcaagcugguccuuuucgggcgcgaggugucccccgcucaccaguacgcccuggcgggaggcaucucuuuuccuuucuuuuggcucgccggcgcugggagcgccguuuucugggugcugggagcuacacuggucgugauuggcucccaugccgcguuucaccagaucgaagccguggauggggaggaacuccaaauggagcccgucuga

SEQ ID NO: 74579 - RNA, 2490 nt, Artificial Sequence
  derived and/or modified sequence opt5 from RABEP1__Homo_sapiens__NP_001077054
auggcccagcccggcccugcuagccaaccggacgugucccugcagcagagagucgccgagcucgaaaagaucaacgcggaguuccugcgggcucagcaacagcuugaacaggaguuuaaucagaaacgcgccaaguucaaagaacuguaccucgccaaggaggaggaucugaaaagacaaaacgcuguucuucaggccgcucaggacgaucuggggcaccuccggacccagcugugggaagcccaagcggagauggaaaauauuaaggccaucgcuacagugucugagaacacgaagcaggaggccauugacgaagugaaacgccaguggagagaggaagucgcuagccugcaagccgugaugaaggagaccguucgggauuaugaacaucaguuucaccuccgccuggagcaggagagaacacagugggcgcaauaccgggaauccgccgagcgcgaaaucgcugaccuuagacggcgccugucugagggacaggaagaggagaaucucgaaaacgagaugaaaaaggcccaggaagaugcugagaaacugagaagcguggucaugcccauggaaaaggagauugccgcccuuaaggacaaacugaccgaggcugaagauaagaucaaagagcucgaagcguccaaggugaaagagcugaaucauuaucuggaggccgaaaagucuugccggacagaccucgagauguacguugcugugcugaacacccagaaaagcguccuucaagaagaugccgagaagcugcgcaaggaacuccacgaggugugucaucugcuugagcaggaaagacagcagcacaaucaacugaaacacacauggcagaaggccaacgaccaguuccucgagucccagcggcugcugaugagagauaugcaacgcauggaaaucgugcucaccagcgagcagcugcggcaggucgaagaacuuaaaaagaaagaccaagaggacgaugaacagcagagacugaauaagcgcaaggaccauaaaaaggcugauguugaggaagagauuaaaaucccuguggugugcgcccucacgcaggaagagucuuccgcgcaacugagcaacgaggaggagcaccuugacucuacccggggcuccguccauagccuggaugcugggcuccugcugcccucuggagacccuuuuuccaagagcgauaaugacauguucaaagauggccucagacgcgcccaguccacagacucucuggggaccagcggaucccuucagagcaaggcccugggcuauaacuacaaggcuaaaucugccggcaaucucgaugaauccgacuuugggccccuggugggagcugacagcguuucugagaacuucgauacagccagccugggcucccuucagaugccuucuggguuuaugcucaccaaggaccaagagcgggcgauuaaagccaugacgccggaacaggaggaaacagcuagccugcuguccagcgugacccagggaauggagucugccuaugucucccccagcggcuacagacucgugucugaaacagaguggaaccugcuucagaaggagguucacaaugcugggaacaaacugggacgccggugugauaugugcuccaauuacgaaaagcaacuccagggcauccagauucaagaggccgaaaccagagaccaggugaagaaacugcagcugaugcuucgccaggcgaacgaucaacucgagaagaccaugaaagacaagcaggaacuggaggauuucaucaaacagagcuccgaggacucuagccaccagauuuccgcccugguccuccgggcucaagccucugaaauccugcuugaggaacugcagcagggccucagccaggcuaagagagaugugcaagagcagauggccguccugaugcagucccgggaacaggugagcgaggagcugguucgccuucaaaaagacaaugauucucuccaggggaagcauucccugcacgugagccugcagcaagccgaagacuuuauccucccugauacaacggaggcucugagagaacuuguccugaaguaucgggaggacauuaucaacgugagaaccgcggccgaccauguugaggaaaaacucaaggcugagauucuguuccugaaagaacagauccaggccgagcagugucuuaaggaaaaucucgaggagacacugcaacuggaaauugagaacugcaaagaagagaucgccucuaucuccagccucaaggcugaacuggagcgcauuaagguggagaaaggacaggccaccgucgaacagcuuauguuugaggaaaagaauaaagcgcagcggcugcaaacagagcucgaugugucugaacaggugcagagagacuucguuaagcugagccagacccugcaaguccagcuugagcgcaucagacaggcugauucccuggagcggauucgcgccauccucaacgacacgaaacugacagauauuaaucaacuccccgaaaccuga

SEQ ID NO: 74580 - RNA, 1710 nt, Artificial Sequence
  derived and/or modified sequence opt5 from RABEP2__Homo_sapiens__NP_079092
auggccgcugccgcgcccguggcugccgacgaugacgagagacggcgcagaccuggcgccgcucuggaagauagccggucccaggagggggccaacggagaagcugagucuggcgaacucagccgccugagagccgagcuugcgggggcccuggcugagauggaaaccaugaaggccgucgcugagguuuccgaaucuacaaaagccgaggcgguggccgcugugcaacggcagugccaggaggaagucgccagccuccaggcuauccugaaggacuccauuucuagcuacgaggcccaaaucacggcccuuaaacaggaacgccagcagcaacagcaggauugugaggaaaaggagagagagcugggacggcucaaacagcugcugucccgcgcuuauccgcucgacagccuggaaaagcaaauggagaaggcgcacgaagauucugagaaacuuagagaaauugugcugcccauggagaaggagaucgaagaacucaaagccaagcugcuucgggcugaagaacugauucaggaaauccagcgcagaccucggcaugcccccucccuccacggcagcaccgagcugcugccucucucucgcgaccccuccccuccgcuggagccccuugaggagcugagcggggauggaggcccugccgcugaagccuucgcgcauaauugcgacgauucugcuuccaucagcuccuuuucucucggcgggggaguuggcagcuccagcucucugccccaauccagacaggggcuuagcccugagcaggaggaaacagccucucuggugagcaccggaacacucguccccgagggcauuuaccugccgccucccggguaucagcuggugccugacacccaaugggaacagcuccagacagagggacggcagcugcaaaaagaucuugaauccguuucuagagagcgcgacgagcugcaggaaggccuccggagaagcaacgaggacugugccaagcagaugcaagugcugcuugcucagguccaaaauuccgaacagcugcuccgcacccugcagggcacggugagccaggcccaggagcgggugcagcugcaaauggcugaacucgucaccacacacaagugccugcaucacgagguuaaaagacuuaacgaggaaaaucaggggcugcgcgccgagcagcuccccucuuccgcgccccagggaagccaacaggaacagggcgaggaagagucucugccuuccagcgugccggagcugcagcaacuucucuguugcacccggcaggaagccagagcucgccugcaggcccaggagcacggggcugaacggcugagaaucgagauugugacacuccgcgaggcccuggaagaggaaaccgucgcgcgggccucccuugagggacaacugagagugcagcgggaagagacggagguucucgaggcuucucuguguagccugcgcacagagauggaaagagugcagcaagagcaguccaaggcccagcuucccgaucuccugucugaacagcgggcuaaaguccugagacuccaagccgagcuggagaccagcgaacaggugcagcgcgacuucguucggcuuucccaggcccugcaagugagacucgagcgcaucagacaggcugaaacacuggagcagguccggagcauuauggaugaagcgccucugaccgacgugcgcgauaucaaggacaccuga

SEQ ID NO: 74581 - RNA, 1119 nt, Artificial Sequence
  derived and/or modified sequence opt5 from RABEPK__Homo_sapiens__NP_001167623
augaagcagcugcccgugcucgagccuggcgacaaaccgagaaaggccaccugguacacacugacgguccccggggauagcccuugcgcucggguuggacacuccuguucuuaucuucccccugugggcaacgccaaacgcgggaagguguucaucgucggaggcgcgaaucccaaccggagcuuuuccgacgugcauaccauggaucuggggaaacaccaaugggaccucgauacaugcaagggacugcuuccuagauacgaacaugcuucuuucauuccgagcuguacccccgaccgcaucuggguuuuuggcggcgccaaucaguccgggaacagaaauugccuccaggugcugaacccugagacacggaccuggacaacccccgaagucacgucuccucccccgagcccucgcaccuuccacacauccagcgccgcuauuggaaaucagcuguauguguuuggcgggggagagagaggcgcccaacccguucaggauaccaagcugcauguguucgacgcuaacacacucaccuggucucagccugaaacgcuggggaauccucccuccccucggcacggacacgucaugguggccgcgggcacaaaacuuuuuauccauggcgggcuggccggagaucgcuucuacgacgaucuccacuguauugacaucagcgauaugaaguggcagaaacugaacccgaccggcgcugcccccgcugggugcgccgcgcauucugccguggcuaugggaaagcacgucuauaucuuuggcgggaugacacccgccggagcucuugacaccauguaccaauaucacaccgaggagcagcauuggacacugcucaaauucgacacgcugcugcccccuggcagacucgaucacuccauguguauuauccccuggccgguuaccugcgccagcgaaaaggaggacucuaauucccugacacuuaaccaugaagccgagaaggaggauagcgcugacaaagugaugucccacucuggcgauagccaugaagagucccagaccgcgacacugcucugucugguguuugggggaaugaauaccgaaggcgagauuuacgacgauugcaucgucacggugguugacuga

SEQ ID NO: 74582 - RNA, 219 nt, Artificial Sequence
  derived and/or modified sequence opt5 from RABGAP1L__Homo_sapiens__NP_001230692
augauggaggaaaucagcauuaugguggccuacgacgcucacgucuucucccagcugcaugaugaggacuuucucaccucucugguugccaucagcaagcccagauccauggugccuacaaagaaacuuaaaaaguaugaaaaagaguaccaaacgaugcgggaaucucagcugcagcaggaggauccgauggaccgcuauaaguucguguaccucuga

SEQ ID NO: 74583 - RNA, 900 nt, Artificial Sequence
  derived and/or modified sequence opt5 from RABGEF1__Homo_sapiens__NP_001273989
augcagaccagaggcaaggugcccccugagcgggucgagaaaaucauggaccaaauugaaaaguacaucaugacacgccuguauaaauacguuuucugcccggaaacgaccgaugacgagaagaaagaucucgccauucagaagagaauccgggcucugcgcugggugacaccccagaugcuuugugugccugucaacgaagacauucccgaggugagcgauaugguugugaaggccaucaccgacaucauugagauggauuccaaaagagucccucgggacaagcuggcgugcaucacaaaauguucuaagcacauuuuuaaugcuaucaaaauuaccaagaacgaacccgccagcgccgaugacuuccucccuacacugaucuauauugugcuuaaggggaauccgccccgccugcaguccaacauccaauacaucaccagauuuugcaauccuucucggcucaugacgggagaggauggcuauuacuucaccaaccuguguugcgcuguugccuuuauugaaaaacuggacgcucagagccucaaucugucccaggaggauuucgaccgcuauaugucugggcagacaagccccagaaagcaagaggccgaauccuggagcccugacgcgugucuuggagugaaacagauguacaagaaccuggaucuccugucucagcuuaaugagcggcaggaacgcaucaugaacgaggccaaaaagcuggaaaaagaccucauugauuggaccgacggcaucgcuagagagguccaagauauuguggagaaguacccccuggaaaucaagccgccuaaucagccccuggccgcuaucgacuccgagaacguggaaaaugauaaacucccuccuccccugcagccccaagucuaugccggguga

SEQ ID NO: 74584 - RNA, 372 nt, Artificial Sequence
  derived and/or modified sequence opt5 from RABIF__Homo_sapiens__NP_002862
auggagcccgccgaacagccuagcgagcugguguccgcugaaggcagaaaccggaaggccguccucugccaacgcugugggucuagaguucugcagccgggaaccgcgcuuuucagccggcgccagcuguuucuccccuccaugcggaaaaagccugcucugucugacggcagcaaucccgauggggaccuucugcaggagcacuggcucguggaagauauguucaucuuugagaacgugggauucacaaaagacgucggcaauauuaaguuucuggugugcgccgauugugagaucgggccuauuggauggcauugccuggacgauaaaaacuccuucuacguugcccucgaaagagugucucacgaguga

SEQ ID NO: 74585 - RNA, 2193 nt, Artificial Sequence
  derived and/or modified sequence opt5 from RABL6__Homo_sapiens__NP_001167459
auguucagcgcccugaagaaacucgugggcuccgaccaggcucccgggagagauaagaacaucccugccggacugcaaucuaugaaucaggcgcuucagcggcgcuuugcuaaaggcguccaguacaacaugaagauuguuaucagaggggaccggaauaccggaaaaacagcccuguggcaccgccuccaaggcagaccguucguggaggaauauauucccacgcaggagauccaggugaccagcauucauugguccuacaagacaaccgaugacaucgucaagguggaaguuugggauguggucgacaaagggaagugcaaaaagcggggagauggccugaaaauggagaacgacccucaggaagccgagucugagauggcucuugaugccgaauuucuggacguguauaagaauuguaacggcguugugaugauguucgauaucacaaagcaauggaccuuuaauuacauucuccgcgagcugcccaaagucccuacacacgugcccgugugcguccuggggaacuauagagacaugggagaacaucggguuauccucccugaugacgugcgcgacuucauugauaaucuggacagcagaccgcccggcuccucuuacuuucgguaugcugagagcuccaugaagaacagcuucgggcuuaaauaccugcacaaguuuuucaauaucccuuuucuccagcugcagcgcgagacccuucugagacagcucgaaacgaaccaacuggauauggacgccacccuggaggaacucucugugcagcaggagacagaagaucaaaauuacggaauuuuccuggagaugauggaggcgcggucccgcggccaugccagcccccuugcugccaacgggcagucuccuucccccggaagccagucuccggucgugccugcuggcgccguuuccaccggcagcuccucucccgggacaccucagcccgcgccccaacugccucucaaugccgcuccgcccagcuccgugccucccgucccucccagcgaagcccugccgccucccgcuuguccuucugcccccgccccuagacgguccaucauuagcagacuuuuuggaaccucucccgcuacggaggcggccccgccuccucccgaacccgugccggcugccgagggccccgccacaguucagagcguggaagacuucgucccugaugaccgccuggaucgguccuuccucgaggacaccacacccgcuagagaugagaaaaaggugggggccaaagcggcucagcaggacucugacagcgauggagaagcccugggcgggaacccuauggucgccggauuucaagacgauguggaccuggaggaucagccccgcggcuccccuccccucccggcuggcccuguucccagccaggacaucacccugucuuccgaagaggaagccgagguggcugccccuaccaaggggcccgcgccggccccucagcaaugcagcgagcccgaaacaaaguggucuuccaucccugcuagcaaaccccggagaggaacggcccccacccgcacagcugccccuccguggcccggcggggucuccgugcggaccggaccugagaagagaucuagcacacggcccccugcggaaauggagcccggcaaaggggagcaggccuccucuagcgaauccgauccugagggcccgauugcugcccagaugcuuagcuucguuauggacgaucccgacuuugaaucugagggauccgauacccagcgcagagcugacgauuucccugugcgcgacgaccccagcgaugucacggacgaagaugagggcccugccgagcccccgccuccucccaagcugccccuccccgccuuucggcugaaaaacgacucugaucuuuucgggcugggacucgaagaggcuggcccuaaggaauccagcgaggaagggaaggagggaaaaacaccgucuaaggagaaaaagaaaaagaagaaaaagggcaaagaagaggaagagaaggcggccaaaaagaaaagcaagcacaagaaauccaaggacaaagaagaggggaaggaggaaagacggcgcagacaacagcggcccccuagaagccgcgagcggaccgcugccgaugaacuggaggccuuucugggcggaggcgcucccgggggaagacacccuggcgggggagacuaugaggaacucuga

SEQ ID NO: 74586 - RNA, 579 nt, Artificial Sequence
  derived and/or modified sequence opt5 from RAC1__Homo_sapiens__NP_008839
augcaggccaucaagugcguggucguuggcgacggggcugugggaaaaaccugucugcucauuagcuacacaacgaacgccuuccccggcgaguauaucccuaccguguuugauaauuacuccgcgaacgucaugguggacgggaagccgguuaaucugggacuuugggauacagcuggccaagaagacuaugauagacugcggccccucucuuacccucagaccgacguguuccugauuugcuuuagccuugucucccccgccucuuucgagaacgugcgcgccaaaugguauccugaaguuagacaccauugucccaauacaccuaucauucugguggggaccaagcucgaucugcgggacgauaaagacacaaucgagaagcugaaggagaaaaagcucaccccgaucacguacccccagggacuggcuauggccaaagaaauuggcgcugucaaguaucuugagugcagcgcccugacccagcgcggccucaaaacaguguuugaugaagcgaucagagccgugcuguguccucccccugucaagaagcggaaacgcaagugccuucugcucuga

SEQ ID NO: 74587 - RNA, 579 nt, Artificial Sequence
  derived and/or modified sequence opt5 from RAC2__Homo_sapiens__NP_002863
augcaggccaucaagugcguggucguuggcgacggggcugugggaaaaaccugucugcucauuagcuacacaacgaacgccuuccccggcgaguauaucccuaccguguuugauaauuacuccgcgaacgucaugguggacucuaagccgguuaaucuggggcuuugggauacagcuggacaagaagacuaugauagacugcggccccucagcuacccucagaccgacguguuccugauuugcuuuucccuugucucucccgccagcuaugagaacgugcgcgccaaaugguucccugaaguuagacaccauugucccuccacaccuaucauucuggugggcaccaagcucgaucugcgggacgauaaagacacaaucgagaagcugaaggagaaaaagcucgcuccgaucaccuacccccaggggcuggcccuugcuaaagaaauugauucugucaaguaucuggagugcagcgcccucacgcagcgcggacugaaaaccguguuugacgaagcgaucagagccgugcuuuguccucaacccacacggcagcagaagcgcgcuugcucccugcucuga

SEQ ID NO: 74588 - RNA, 579 nt, Artificial Sequence
  derived and/or modified sequence opt5 from RAC3__Homo_sapiens__NP_005043
augcaggccaucaagugcguggucguuggcgacggggcugugggaaaaaccugucugcucauuagcuacacaacgaacgccuuccccggcgaguauaucccuaccguguuugauaauuacuccgcgaacgucaugguggacgggaagccgguuaaucugggacuuugggauacagcuggccaagaagacuaugauagacugcggccccucucuuacccucagaccgacguguuccugauuugcuuuagccuugucucccccgccucuuucgagaacgugcgcgccaaaugguauccugaaguuagacaccauuguccccacacaccuauccugcucguggggaccaagcuggaucugcgggacgauaaagacacaauugagcgccucagagauaagaagcuggcuccgaucaccuacccccagggacuugccauggcucgggaaaucggcagcgucaaauaucuggagugcuccgcccucacgcagcgcggccugaagaccguguuugacgaggcgauuagagccgugcuuuguccucccccugucaaaaagcccgggaaaaagugcacaguuuucuga

SEQ ID NO: 74589 - RNA, 1935 nt, Artificial Sequence
  derived and/or modified sequence opt5 from RACGAP1__Homo_sapiens__NP_001306935
augagcugccccuguuucugcccuguggcccugagaauggacaccaugaugcucaacguccggaaucuguuugagcagcuuguucgcagaguggaaauccuguccgagggcaacgaagugcaauucauucagcucgcuaaggauuuugaggacuuccggaaaaaguggcagcgcacagaucacgaacuggggaaauacaaggaccuucugaugaaagccgagacggagagaucugcgcucgaugucaagcugaagcaugcucggaaucagguggacguugaaaucaaacgcagacaacgggccgaggccgauugugaaaagcuggagcgccagauucagcucaucagagagaugcugaugugcgacaccagcggauccauucagcuuucugaggaacagaaaagcgcucuggccuuucucaaccggggccaaccguccucuagcaaugcugggaacaagcgccuguccacaaucgaugaaagcggaucuauccuuuccgacauuagcuucgauaaaaccgacgagucucuggauugggacuccagccucgugaagacauuuaagcugaaaaagagagaaaaacggcgcucuaccuccagacaguucgucgacgggcccccuggccccgugaagaaaacacggagcaucggauccgccguugaucagggcaaugagucuauuguggcgaagaccacggucaccgugccuaacgacggcgggcccaucgaggccgugagcacaauugaaaccgucccuuauuggacaagaucccgccggaaaaccggaacgcugcaaccguggaauagcgauucuacacucaacuccagacagcuggagccccgcaccgaaacagacagcguuggcaccccucagucuaaugggggaaugcggcuucacgauuuugugagcaagaccgugaucaagcccgaguccugugucccuugcggcaaaagaauuaaguucgggaaacugucucucaagugucgcgacugccgggugguuagccaucccgaauguagagaucgcugcccgcugccuuguauccccacacuuaucggaacgccugugaaaauuggcgagggcaugcuggcugacuuugucucccaaaccagccccaugauccccucuauugugguucacugcgugaacgagaucgaacagcgggggcucacagagaccggacuguacagaauuuccggcugcgaucgcacagucaaggaacugaaggagaaauuccuccgggugaagaccgucccucugcuuagcaaaguggacgauauccaugccaucuguucucugcucaaggacuuucugagaaaucuuaaagaaccgcugcucacguuccggcugaaccgcgcuuucauggaggccgcggagauuacagacgaagauaauuccaucgccgcuauguaucaggccguuggggagcugccccaggcuaacagagacacccucgccuuucugaugauucaccuucaacggguggcccagagcccucacaccaagauggaugucgcuaaccuggcgaagguguucggacccacaaucguugcccaugcugugccuaaucccgacccggucaccaugcuccaggauauuaaaagacagccuaaggugguggaacgccugcugucccuuccccucgaguacuggucucaauuuaugaugguugagcaggaaaacaucgacccucugcacgucaucgagaauagcaacgccuucuccacaccccagacgccugauauuaaagugucucugcucggccccgugaccacaccggaacaucagcugcuuaagaccccuagcuccagcucucugucccaacgggucagaagcacacucaccaaaaauacgccccgcuuugggucuaaguccaagagcgccaccaaccugggaagacagggcaauuucuuugcuucucccaugcugaaauga

SEQ ID NO: 74590 - RNA, 2046 nt, Artificial Sequence
  derived and/or modified sequence opt5 from RAD17__Homo_sapiens__NP_579917
augagcaagaccuuccugagacccaaaguguccucuacaaaggucacggacuggguugauccuagcuuugacgauuuccucgagugcuccggcgugucuaccaucacagccaccagccugggggugaacaauuccucucaccggcgcaaaaacggaccgagcacacuugaauccagcagauuucccgcucggaagcgcggcaaucugucuucccucgagcagauuuacgggcuggaaaacagcaaagaguaucuuucugaaaaugagccuugggucgacaaguacaagcccgagacccaacaugaacuggccgugcacaaaaagaaaaucgaggaaguugagacauggcucaaggcucaggugcuggagagacagccuaaacagggaggcuccauucugcucaucaccgggcccccuggauguggcaagacgaccacacugaagauucuuagcaaagaacauggcauccaaguccaggaguggaucaacccggugcugcccgauuuccagaaggacgauuuuaaagggauguucaauaccgaaucuuccuuucacauguucccuuaucagagccaaauugcgguuuuuaaggaguuccuccugcgggccacaaaauacaacaaacuucagaugcugggagacgaucuccgcaccgacaagaagaucauucugguggaagaucugcccaaucaguuuuauagagacucccauacgcuccacgagguccugcggaaguacgugcgcaucggcagaugcccucuuauuuucaucauuucugauagccuguccggggacaacaaucagcggcuccuguuucccaaagagauccaagaagaguguagcaucucuaacauuuccuucaauccgguggccccuacaaucaugaugaaguuccuuaaccgcauugucaccaucgaagcuaauaaaaacggaggcaagauuacaguucccgacaaaaccagccuggagcuccugugccagggguguucuggagauaucagaagcgccaucaacucccugcaguuuucuagcuccaagggcgaaaauaaccuccggccucgcaagaaaggcaugagccugaagucugacgcugugcuuuccaaaagcaagagacggaaaaagcccgauagaguguucgagaaucaagagguccaggccauugggggaaaggacgugucucuguuucucuuccgcgcgcugggcaaaauccuuuauugcaagcgggccucccugaccgaacucgauagccccagacugccuucccaccugucugaguacgaacgcgacacacuccugguugagccggaagagguggucgagaugagccauaugcccggggaucuuuuuaaccuguaccuccaccagaauuauauugacuucuuuauggaaaucgaugacauugugcgggcuuccgaguuccugucuuuugccgauauccugagcggagacuggaacacgagaucccuucuccgcgaauacagcaccucuaucgcuacacggggcguuaugcauuccaauaaagccagaggguaugcgcacugucagggaggcggcagcucuuuccgcccucugcacaagccccaaugguuucugauuaacaaaaaguaccgggagaauugccucgccgcuaaggcccuguucccugacuuuugucuucccgcucugugccuccagacccagcugcugccguaucuugcccuccugacaaucccuaugagaaaccaggcccaaauuuccuucauccaggauauugggcgccugccccucaaacggcauuucggaagacugaagauggaggcucuuaccgaccgggaacacggcaugaucgauccugacagcggggaugaggcgcagcugaauggaggccauucugccgaagagagccucggggaacccacgcaggcuacagugccugagaccuggucccugccccugagccaaaacucugccuccgagcuuccggccagccagccucagcccuuuuccgcucagggcgacauggaagagaauauuaucaucgaagauuacgagucugacggaaccuga

SEQ ID NO: 74591 - RNA, 1488 nt, Artificial Sequence
  derived and/or modified sequence opt5 from RAD18__Homo_sapiens__NP_064550
auggacagccuggccgaguccagauggcccccuggccucgcugugaugaagaccaucgaugaccugcuucggugcgggauuuguuucgaauacuuuaacaucgccaugauuaucccgcagugcucucacaauuauuguagccugugcauucgcaaauuccucuccuacaagacacaaugucccacgugcugugucaccguuacagagccugaucugaaaaacaauagaauccuugacgaacuggugaagucucucaacuuugcgcggaaucaucugcugcaguucgcucucgagagccccgccaaauccccugccucuagcuccagcaagaaccuggcugugaaggucuauacccccguggccucucgccagucccuuaaacagggaagcagacugauggauaauuuucucauccgggaaaugucuggcuccacaagcgagcugcuuauuaaggagaacaaaucuaaguucuccccucaaaaagaagcuagcccggccgcgaagaccaaggagacacgcuccguugaagagaucgcccccgacccuucugaggcuaaaagacccgaaccucccagcaccuccacgcugaaacaggugaccaaggucgauugcccggugugugggguuaauauuccugagagccacaucaacaagcaucucgacucuugccugucccgggaagagaaaaaggaaagccugcgcucuagcgugcacaaaagaaagccccucccuaagacagucuacaaucugcuuuccgaucgggaccugaaaaagaaacucaaggagcauggacugucuauucagggcaacaaacagcaacuuaucaagcgccaccaggaguuugugcacauguauaaugcccagugugaugcucugcaucccaagagcgccgcggaaauugugagagagaucgaaaacaucgagaaaacccggaugcgccucgaagccuccaagcugaaugagagcgucaugguuuucacaaaagaccagaccgagaaggaaauugaugagauccacucuaaauacagaaagaagcauaaauccgaauuucaacugcucguggaccaggcucggaagggguauaaaaagauugccggaaugagccagaaaacggugacaaucaccaaggaggacgaaucuacagagaagcuguccagcgucugcaugggccaagaggauaacaugaccuccgugaccaaccacuucucucagagcaaacuugacucccccgaggaacuggaaccugauagagaggaggacucuagcuccugcauugauauccaggaaguucucucuagcuccgagagcgacucuuguaauuccagcucuagcgauaucauucgcgaccugcuugaagaggaagaggcuugggaggccucccacaagaacgaucugcaggacacagaaaucagcccgcggcaaaauagacgcacgcgggccgcugagucugcggaaauugagcccagaaacaaacgcaaucggaacuga

SEQ ID NO: 74592 - RNA, 849 nt, Artificial Sequence
  derived and/or modified sequence opt5 from RAD1__Homo_sapiens__NP_002844
augccccugcucacccagcaaauccaggacgaggaugaccaguacagccugguggccucccuugauaacgucagaaaucugucuacaauucucaaggcuauccacuuccgggaacaugccacgugcuuugcgaccaaaaacggcauuaagguuacaguggagaaugcuaaaugugugcaggccaacgccuucauccaagcugggauuuuucaggaguucaagguccaggaagaaagcgugaccuuucgcaucaaucugacaguucuucuggacugccucuccaucuucggaucuagcccuaugccgggcacccugacagcccugagaauguguuaucagggguacggauauccccucaugcuguuucuugaggagggcgggguggucaccgugugcaaaauuaacacgcaagaaccugaggaaacccuggauuucgacuuuuguuccacaaauguuaucaacaagauuauccuccagucugagggacugcgggaggcuuucagcgaacuugauaugaccuccgaggugcugcagauuacaaugagccccgacaagccuuacuuucgccucucuaccuucggcaaugccggcuccagccaccuggauuaucccaaagacucugaucugauggaagcguuucauugcaaccagacgcaagucaauagauacaagaucucccuccugaaaccuagcacaaaggcccuugugcugucuuguaaaguguccauucggaccgacaaccgcggguuccucagccugcaguauaugaucagaaaugaggauggacagaucugcuucgucgaauacuacuguugcccggacgaggagguucccgaauccgagucuuga

SEQ ID NO: 74593 - RNA, 1896 nt, Artificial Sequence
  derived and/or modified sequence opt5 from RAD21__Homo_sapiens__NP_006256
auguucuacgcccacuuugugcugagcaagagaggcccccucgcuaaaaucuggcuggccgcgcauugggacaagaaacuuaccaaggcucacgucuucgagugcaaccuggaauccucuguugagagcauuaucuccccuaaagugaagauggcccuccggacaucugggcaucugcuucugggagugguccgcauuuaucacagaaaggccaaauaccuccuggcugauuguaaugaagccuuuaucaagauuaaaauggcuuuccggccgggcgugguugaccugcccgaggaaaaccgcgaggccgcguauaaugccaucacgcucccugaggaauuucaugauuucgaccagccccugccugaucuugacgauaucgacguggcucaacaguuuagccugaaccaguccagagucgaggaaauuaccaugcgggaggagguggggaauaucucuauucuccaggaaaacgauuucggagacuuuggcauggaugaccgcgagaucaugagagaagggagcgccuucgaggaugacgacaugcugguuuccacaaccacaagcaaucuucugcucgaaucugagcaauccaccagcaaccugaaugagaagauuaaccaccuggaauacgaggaucaguauaaagacgauaauuuuggagaaggcaacgacggcgggauccucgaugacaagcugauuucuaauaacgauggaggcaucuucgacgaucccccugcucuuuccgaggccggggugaugcugccggaacagcccgcgcacgacgauauggacgaggacgauaaugucagcaugggaggcccugacucucccgauuccguggacccuguggagcccaugccgacaaugaccgaucagacgacccucgucccuaacgaagaggaagccuuugcucuggagcccaucgacauuacaguuaaggaaaccaaagccaagcggaaacgcaaacuuaucguggauagcgugaaagagcuggacuccaagacaauuagagcucaacucucugauuacagcgacaucgucaccacgcuggaucuggccccucccacaaagaagcucaugauguggaaggagaccgggggaguggaaaaacuguucucccuucccgcccagccucuguggaacaaucggcuccugaaacuuuucacacgcugccugaccccgcucguucccgaggaccugagaaagcggcgcaagggcggcgaagcugauaaccuggacgaguuucucaaagaguucgaaaauccugaggugcccagagaagaccagcagcaacagcaucagcaacgggaugucauugacgagccuaucaucgaagaacccagcagacugcaggagucugugauggaagcgucccgcaccaacauugaugagagcgccaugccgccucccccuccccaggggguuaagcggaaggcuggacagaucgacccugaacccgugaugccgccucaacaggucgagcagauggaaauuccucccguggagcuucccccggaggaacccccuaauaucugucagcugauucccgagcucgaacugcugccugagaaagaaaaggagaaagagaaggaaaaagaggaugacgaagaggaggaagaugaggacgccucuggcggggaucaagaccaggaagagagacgcuggaacaagcggacacagcagaugcuucacggacuccaaagagcccuggcuaagacgggcgccgaaagcaucucccugcucgagcugugccgcaauaccaaccggaaacaggcggcugccaaguuuuauucuuuccuuguccugaaaaagcagcaggccaucgagcucacacaagaggagcccuacagcgauauuaucgcuaccccugggcccagauuucauauuaucuga

SEQ ID NO: 74594 - RNA, 1671 nt, Artificial Sequence
  derived and/or modified sequence opt5 from RAD21L1__Homo_sapiens__NP_001130038
auguucuacacccacgugcugaugagcaagagaggcccccucgccaaaaucuggcuggcugcccauugggagaagaaacuuacaaaggcgcacgucuuugaaugcaaccuggagauuacgaucgaaaagauucucuccccuaaaguuaagaucgcucugcggaccucugggcaucuucugcucggaguggugcgcauuuauaauagaaaagccaaguaccugcuggccgacuguagcgaggcuuuccucaaaaugaagaugacauuuugcccgggccuggucgaucuucccaaagaaaacuucgaggccuccuauaaugcuaucacccugccugaggaauuucacgacuucgauacacagaacaugaaugccaucgacgugucugagcauuuuacccaaaaccagagccggcccgaagagauuacacuccgcgagaauuucgauaacgaccugaucuuucaggcggaauccuucggggaggaaucugagauucuuagacggcacagcuuuuucgaugacaauauccugcucaacuccagcggaccucugauugaacacucuuccggcagccugaccggggagcgcucucucuuuuacgauuccggagacggcuucggcgaugagggggccgcuggagaaaugaucgacaaucugcuucaggaugaccaaaacauucugcucgaggacaugcaucugaauagagaaaucagccuucccucugagccuccgaacucccuggccguugaacccgauaauagcgaguguaucugcgugccugagaacgaaaagaugaacgagacgauucuccuguccaccgaagaggaaggcuucacacuggaccccaucgauauuucugacaucgcugagaagcggaaagggaagaaacgcagacuccugauugauccuaucaaggagcuuagcuccaaagucauccacaagcagcugaccagcuuugccgacacacucauggugcuggaacuugcgcccccgacccagcggcugaugauguggaaaaagcgcggaggcguucauacgcuccugucuacagccgcucaggaucugauucacgccgagcucaagaugcuguucaccaaauguuuucuuuccagcggguucaagcugggaagaaaaaugauccaaaaggaaucugugcgggaggaggucggcaaucagaacauuguggaaacaagcaugaugcaggagccuaauuaucagcaagaacucuccaaaccccagaccuggaaggacgugaucggcgggucucagcacagcucccaugaggauaccaacaagaauauuaacagcgaacaagacaucgucgagaugguuucucuggcugccgaggaauccagccugaugaaugaucuuuuugcccaggagaucgaauacucuccuguggagcucgaaucccugagcaacgaggagaauauugaaacagagcgcuggaacggaagaauccugcagaugcucaaucggcugagagaauccaacaaaaugggcaugcagucuuucagccuuaugaagcugugccgcaauuccgaccggaaacaagcugcggccaaguuuuauucuuuccucgugcugaaaaagcagcuggcuauugagcuuagccaguccgcccccuacgccgacaucauugcuacgauggggcccauguuuuacaacaucuga

SEQ ID NO: 74595 - RNA, 927 nt, Artificial Sequence
  derived and/or modified sequence opt5 from RAD23A__Homo_sapiens__NP_001257292
auggccgugaccaucacacugaagacgcuccagcaacagaccuucaaaauuagaauggagcccgacgaaacagucaagguucugaaagagaagaucgaagcugagaaaggccgggaugccuuuccuguggcggggcagaaacuuauuuacgcuggaaagauccugagcgacgaugugccgauucgcgacuauagaaucgaugaaaagaacuucgucgugguuauggugaccaagacaaaagccggccaggggaccuccgcucccccugaggcuucucccacagccgcuccugagagcuccaccucuuuucccccugccccgacgagcggaaugucccaucccccucccgcggcccgggaagacaagucuccuagcgaggaauccgcucccaccacaagcccggagucugucuccggcagcgugccuucuuccgggagcucuggacgcgaggaagaugccgcuuccacccucguuacaggcagcgaguacgaaaccaugcugacggagaucauguccaugggcuaugaaagagagcggguggucgccgcgcuucgcgccucuuacaauaacccccacagagcuguggaguaucugcucacagggauuccuggaagccccgaacccgagcacggcuccgugcaagaaagccaggucucugagcagccugccaccgaagcugccggggagaauccgcuggaguuccugcgggaccagccccaauuucagaacaugcgccagguuauccagcaaaauccugcccuccugcccgcccuucugcagcagcucggacaagaaaacccucagcugcuucagcugaaagcgcucggcuuccccgagucccuggugauucaggccuacuuugcuugcgaaaagaaugagaaccuggccgccaauuuccuccugagccaaaacuuugaugacgaauga

SEQ ID NO: 74596 - RNA, 1167 nt, Artificial Sequence
  derived and/or modified sequence opt5 from RAD23B__Homo_sapiens__NP_001231642
auggugaaggcccugaaagagaagaucgaaagcgagaaaggcaaggacgcuuuccccgucgccgggcagaaacucauuuacgcgggaaagauccugaacgaugacaccgcucuuaaggaauauaaaauugaugagaagaauuuuguuguggugauggucacaaaaccuaaggccguguccacgccggcccccgcuaccacacaacagucugccccugcuagcaccacagccguuaccuccucuacaaccacgaccguggcgcaggcccccacaccuguccccgcucuggccccuaccagcacaccggcuuccaucacccccgccucugcgacggccagcuccgaaccugcucccgccagcgcugccaaacaggagaagccugccgagaagcccgcugaaacaccgguggcgaccucuccuacagccaccgacuccaccagcggcgauucuuccagaagcaaccucuucgaggacgcuacaucugcccugguuacggggcaauccuacgaaaauauggugaccgagauuaugagcaugggauaugagcgggaacaggucaucgccgcccuucgcgcuuccuuuaacaaucccgauagagcgguggaguaccugcucaugggcaucccuggggaccgggaaucucaggcuguggucgauccuccccaggccgccagcacaggagcuccccaauccagcgccguugcugccgcggccgcuaccacaaccgccacgacaaccaccacaucuuccggcggccacccgcuggaguuccugcgcaaccagccccaguuucagcaaaugagacagauuauccagcaaaauccuagccuccugcccgcccuucugcagcagauugggcgggaaaacccucagcuccugcaacagaucucucagcaucaggagcacuucauucaaaugcuuaaugagcccgugcaggaagcuggaggccaagggggaggcgggggaggcggcagcgggggaaucgcggaggccggcuccgggcauaugaacuauauucaggugaccccgcaggaaaaagaggcuaucgaacgccugaaggcccucggauuuccugagggccuggucauccaggcuuacuucgccugcgagaaaaaugaaaaccuggccgcuaauuuucuccugcagcagaacuucgacgaggauuga

SEQ ID NO: 74597 - RNA, 3939 nt, Artificial Sequence
  derived and/or modified sequence opt5 from RAD50__Homo_sapiens__NP_005723
augagcagaaucgagaagauguccauucugggcgugcggucuuucgggaucgaagacaaagauaagcagauuaucaccuuuuucagcccccucacaauucuggucggaccuaacggcgccgggaaaacgaccaucaucgagugccuuaaguacauuuguacaggagacuuuccgcccggcaccaaagggaauacauucguucacgauccuaagguggcucaagaaaccgacgugcgcgcccagaucagacugcaguuucgggaugucaacggagagcucauugcggugcagcgcuccaugguuugcacacaaaagucuaaaaagaccgaauuuaaaacgcuggagggcgugaucaccagaacaaagcauggcgagaaagucagccuuuccucuaagugugcugaaauugaccgggagaugaucagcucccugggggugagcaaggccguucucaauaacgugauuuucugccaccaggaagauucuaauuggccccuguccgagggaaaagcccugaagcagaaauucgacgagaucuuuagcgcuacccgcuauaucaaggcccucgaaacacugagacagguccggcaaacccagggccagaaagugaaggaguaccagauggaacuuaaauaucugaagcaauacaaggagaaggcuugugaaauucgcgaucagaucacgucuaaggaggcccagcucacauccagcaaagagauugugaagucuuaugaaaacgagcuggacccucuuaaaaauagacugaaggaaaucgagcauaaccucuccaagauuaugaaacuggauaaugaaaucaaggcgcuggacagccggaaaaagcaaauggagaaagauaacuccgagcucgaagagaagauggaaaaggucuuccaggggaccgacgagcagcugaaugaccuuuaccacaaccaucagcgcacaguuagagaaaaagagcggaagcugguggauugccaccgcgagcucgaaaaacugaauaaggagucuagacuucugaaccaagagaaaagcgagcuccugguggagcagggacggcugcagcuccaggccgacagacaccaagaacauauccgcgcucgggauucccugauucagagccuugccacccagcuggagcucgacggcuuugaaagagggcccuucucugagcgccagaucaagaauuuucacaagcugguccgggaaagacaagagggagaggcuaaaaccgccaaccagcuuaugaacgauuucgcggaaaaggagacacugaaacagaagcagauugacgaaauccgcgauaaaaagacgggccucggccggauuaucgagcugaaauccgaaauccugagcaagaagcaaaaugagcucaaaaacgugaaguaugagcugcagcagcuugaagggucuagcgaccgcauucuggagcucgaucaagaacugaucaaagccgagagagaacuguccaaggcugagaaaaauucuaacguugagacccuuaagauggaagugauuagccuccagaaugagaaggccgaccuggaucggacacugagaaaacucgaccaggaaauggagcagcugaaccaucacaccacaacccgcacgcaaauggagaugcuuacaaaggacaaagcugauaaggacgaacagauccggaaaauuaaguccagacacagcgaugagcugaccucucuccugggauacuucccuaauaagaaacagcuggaagacuggcuucauuccaagagcaaagagaucaaccagacccgggaucgccucgccaagcugaauaaagaacuggccucuuccgagcaaaacaagaaucacauuaacaaugagcucaagagaaaagaagaacagcugagcuccuacgaagacaaacuuuuugaugucuguggcucucaggacuucgagagcgaucuggaccggcucaaagaagagaucgagaaguccucuaaacagagagcuaugcuggcgggggccacagcuguguauagccaauuuaucacccagcugacagaugaaaaccaguccugcuguccgguuugccaacgcguguuccagacggaggccgaacuucaggaggucauuagcgaccuccagucuaagcugcggcuggcccccgauaaacucaaguccaccgaaagcgagcugaagaaaaaggagaaaagacgcgacgaaaugcuuggacuggugccuaugagacaaucuaucauugaccucaaggagaaagaaauccccgagcugcggaauaagcugcagaacgucaaccgcgauauucagagacuuaagaaugacaucgaggaacaggagacacuccugggcaccaucaugccugaagaggaauccgcuaaagugugucugacagauguuaccauuauggagcgguuucaaauggagcucaaggacguggaacgcaaaaucgcccagcaggcggcuaagcugcaggggauugaucuugacagaacgguccaacaggugaaccaggagaaacaggaaaagcaacauaagcuggauaccguuagcucuaaaaucgagcucaaucggaagcugauucaggaccagcaagaacagauccagcaccugaaaagcacaaccaacgagcuuaaguccgagaaacugcagaucagcacaaaucuccaacgcagacagcagcuggaggagcagaccguggaacucucuacggagguccaaucccuguaccgggaaauuaaggaugccaaggaacaggugagcccccuugagacaacccuggaaaaauuccagcaggagaaggaggaacucaucaacaaaaagaauacauccaacaaaauugcccaagacaagcugaaugauaucaaggagaaagugaagaacauucauggauauaugaaagacaucgaaaauuacauccaggauggcaaggacgacuauaaaaagcagaaagagaccgaacugaacaagguuauugcucaacuuucugagugcgaaaagcacaaagagaagaucaaugaggauaugcgccugaugagacaggacauugauacccagaaaauccaggaacgguggcuccaagacaaccugacacucagaaagcgcaaugaggaacugaaagaggucgaagaggagcggaagcagcaccuuaaggaaaugggccagaugcaagugcugcagaugaaaagcgagcaucagaagcucgaagagaacauugauaacaucaaaagaaaucacaaccuggcccuggggcgccagaagggauacgaagaggagauuauccauuuuaaaaaggaacuucgggagccgcaguucagagacgcugaagagaaguaucgcgagaugaugaucgugaugcggacgaccgaacuggucaauaaagaucucgacauuuacuacaagacacuggaucaagccaucaugaaauuucacuccaugaagauggaggaaauuaacaaaaucauuagagaccucuggcgcucuaccuaucggggccaggauaucgaguacaucgaaauuagaagcgacgcggacgagaauguguccgccucugauaagcggcgcaacuauaauuacagaguugugaugcugaagggggacacagcucuugauaugcggggacgcugcagcgccggccagaaaguccuggcuucccugaucauuagacucgcccuggcggagaccuucugucuuaacugcgggaucauugcccuggacgaaccuacgacaaaucucgaucgggagaacaucgaaagccuggcucacgcccucguggagaucauuaagucuagaucccagcaacgcaauuuucagcugcuuguuaucacccaugacgaagauuucguggagcugcugggccggagcgaguaugucgaaaaauuuuacagaauuaagaaaaacaucgaccaguguucugagauugugaagugcuccguuagcucucucggauucaaugugcacuga

SEQ ID NO: 74598 - RNA, 1059 nt, Artificial Sequence
  derived and/or modified sequence opt5 from RAD51AP1__Homo_sapiens__NP_001124334
auggugagacccguccggcacaagaaaccuguuaacuacagccaguucgaccauuccgauucugacgaugacuuugugagcgccaccgugccgcugaauaagaaaucccgcacagcucccaaggagcucaaacaagauaagccuaagcccaaccugaauaaccuuagaaaagaagagaucccuguccaggaaaagacgcccaaaaagcggcugccugagggcaccuucucuauuccggccagcgcggugcccugcacaaaaauggcucucgacgauaagcuguaucagcgcgaccuugaaguugcccuggcccucuccgugaaggagcugccuaccgucacaaccaaugugcagaacucucaagauaaaagcaucgagaagcacggguccagcaaaauugaaacaaugaauaagucuccccauaucuccaacuguagcguugcuucugacuaccuggaucucgacaaaauuaccguggaggaugacgucggaggcgugcaggggaagagaaaagccgcuuccaaggccgcggcccagcagcggaagauccugcuugaaggaagcgacggcgauucugcuaaugacacggagccugauuuugcccccggggaggacuccgaagaugacagcgauuucugcgaguccgaagacaacgaugaggacuuuucuaugcgcaaaagcaaggugaaagaaaucaagaaaaaggaggucaagguuaaauccccgguggagaagaaagaaaagaaaagcaagucuaaguguaaugcucuggugaccuccgucgauagcgccccugcggccgugaaaucugagagccaaucccuccccaagaaaguuucucugagcuccgacacaaccagaaagccucuugaaauucggagccccucugcugaguccaaaaagcccaagugggugccuccggccgcuagcggaggcucucgcuccagcuccucuccccuggucgugguuagcgugaaauccccuaaccagucucucagacugggccugagccggcucgcccgcgucaagccccugcacccuaaugccacauccaccuga

SEQ ID NO: 74599 - RNA, 1053 nt, Artificial Sequence
  derived and/or modified sequence opt5 from RAD51B__Homo_sapiens__NP_002868
auggggagcaagaaacugaagagaguggggcucucccaagagcugugcgaccggcuuucucgccaccaaauccugaccugucaggauuuccucugccugagcccccuugaacugaugaaagucacaggacucuccuacagaggcguucaugagcugcuguguauggugucucgggccugcgcuccuaagaugcagacggccuaugggauuaaagcgcagcgcagcgcugacuuuuccccggccuuccucucuaccacacugagcgcccuugaugaagcucugcacggaggcguggccugugggucccucaccgagaucacaggacccccuggcugcggcaagacccaauuuuguauuaugaugagcauccuggcuacacuucccaccaacaugggagggcuggaaggcgccgucguguacauugacacggagucugcguucuccgccgagagacucguugaaaucgcugagagccgguuuccucgcuauuucaauaccgaagagaagcugcugcucacaucuuccaaagugcaucuguacagagagcuuaccugcgaugaaguccugcagcggaucgagagccucgaagaggaaauuaucucuaaggggauuaaacuggugauccuugacuccguugccagcgugguccgcaaggaguuugaugcucagcugcagggaaaccucaaagagagaaauaaguuccuggcccgggaagcguccucucugaaguaucucgccgaggaauuuagcauucccgugauccugacaaaccaaauuaccacgcaccuuuccggcgcucuggccagccaggcugaccucgugucuccugccgaugaccugucccuuagcgaggggacaucuggaagcuccugugucaucgccgcucugggcaauaccuggucucauagcguuaacacacgccucauccugcaguaccuggauuccgaaagacggcagauucucaucgcgaaaagcccgcuggcccccuucaccucuuuuguguauaccauuaaggaggagggccuugugcugcaggcuuacggcaauuccuga

SEQ ID NO: 74600 - RNA, 408 nt, Artificial Sequence
  derived and/or modified sequence opt5 from RAD51C__Homo_sapiens__NP_002867
augagaggcaagaccuuccgguuugagaugcagcgcgaccuggugagcuucccccucuccccugccgucagaguuaaacuggugucugcuggguuucaaacagccgaggaacuucuggaagugaagccgagcgagcucuccaaagaagucggaaucucuaaggcggaggcucuggagacgcuucagauuauccggcgcgaaugccugaccaacaaacccagauacgccggcacaagcgagucccacaagaaguguaccgcccucgaacugcuggagcaggagcauacacagggguucauuaucaccuuuugcucugcucucgaugacauucugggaggcggggugccucuuaugaaaacaaccgaaaucuguggagcccccggcguuggcaagacgcaacugugguga

SEQ ID NO: 74601 - RNA, 1047 nt, Artificial Sequence
  derived and/or modified sequence opt5 from RAD51D__Homo_sapiens__NP_001136043
augggcgugcugagagucgggcucugccccggacugaccgaggaaaugauccagcuucugcggagccaccgcauuaagacaguuguggaccucguguccgccgaucuggaggaagucgcucaaaaauguggccuuucuuacaagacguggagagcccauagcuccgggaaccugggaggccuccagcugccucaggugccggcggggcggucuuggagcggaguucgcaaugcucugaaaaaggccggccucggccacgggggaaccgacggccugucccuuaacgccuucgaugagagagggacagcugugucuaccagccggcuggacaaacuccuggaugccggacuuuauacaggcgaagucaccgagaucguugggggacccggcuccggcaagacacaggugugccuguguauggcugccaauguggcgcaugggcuccaacagaacguccuguacguggacagcaauggaggccugaccgccucucgccuccugcagcuucugcaggcuaagacgcaagaugaggaggaacaggccgaagcucucagacggauucaggugguccacgccuuugacaucuuccagaugcuggauguucuucaagagcugcgcgggaccguggcgcaacaggugacaggauccagcggcaccgucaaagugguuguggucgacucugugacagccguuguguccccucuccucgggggacagcagagagagggccuggcucugaugaugcagcuggcccgggaacuuaagacccuggcucgcgaucucggcauggccgucguggucacgaaccauauuacaagagaccgggauagcgggcgccugaaacccgcccuuggaagaucuugguccuuugugccuagcacccggauccugcucgacacaaucgagggcgcuggggcguccggaggcagacgcauggccugccuggcuaagucuagccggcagcccaccggguuccaagaaaugguugacauuggcaccuggggaacauccgagcagagcgccacgcugcagggcgaucagaccuga

SEQ ID NO: 74602 - RNA, 843 nt, Artificial Sequence
  derived and/or modified sequence opt5 from RAD51__Homo_sapiens__NP_001157742
auggccaugcagaugcaacuggaggcuaacgccgacaccagcguggaagaggaauccuucggcccccagccuaucucuagacucgagcagugcgggauuaaugcgaacgaugucaagaaacuggaagaggcuggauuucacacaguugaggccguggccuacgcuccgaagaaagaacuuaucaauauuaagggcaucagcgaggccaaagcugacaagauucuggccgaagcggccaagcucgugcccaugggguucacgaccgcuacagaguuucaucagcggcgcuccgagaucauccaaauuaccacaggaucuaaagaacuggauaaacuucugcagggcgggaucgagaccggaagcauuacagaaauguucggcgaguuuagaaccggcaagacgcagaucugucacacccucgccgucacaugccagcugccuauugaccgcgggggaggcgaagggaaggcuauguauaucgauaccgagggaacauuccggcccgagagacugcucgccguggcggaacgguacggccuguccgggucugacguucuugauaacguggccuaugcucgcgccuuuaauaccgaccaucaaacgcagcugcucuaccaggcuagcgccaugauggucgaguccagauaugcccugcuuauuguggauagcgcuacagcgcuguaccggaccgacuauucuggacgcggcgaacucuccgccagacagaugcaccuggcucgguuccugcgcaugcuccugagacuugccgaugagaucguuagcgaggaacggaaacgcggcaaccaaaaucugcagaaccucagacugucucuuuccagcuga

SEQ ID NO: 74603 - RNA, 1257 nt, Artificial Sequence
  derived and/or modified sequence opt5 from RAD52__Homo_sapiens__NP_001284348
augagcggcaccgaggaagccauccucgggggaagagacucccaccccgcugccggcgggggaucugugcugugcuucggccagugucaauacacagcggaggaauaucaggcuauucagaaggcccugcggcagcgccuugggccugaguacaucagcuccagaauggccggaggcggccaaaaagucugcuauauugaagggcaucggguuaucaaccuggcuaaugagauguuuggauacaacggcugggcccacucuauuacgcagcagaauguggauuucguggaccucaacaaugggaaguuuuaugucggagugugugcuuucguucgcgugcagcugaaagauggcagcuaccaugaggacgucggguauggaguguccgaaggccuuaagucuaaagcccugagccucgagaaggcgagaaaggaagccguuaccgauggccugaaacgggcucugcgcuccuuugggaacgcccucggaaauugcauccuggacaaggauuaccuuagaagccugaacaaacucccgcggcaacugccccuugagguggaccugacaaaggcuaaacgccaggaucucgagccuucugucgaagaggccagauacaauuccugucggcccaacauggcgcugggccacccucagcugcagcaagugaccagccccucucgcccuucccaugccgugaucccggcugaccaggauugcagcucuagaucccucagcuccucugccgucgaaagcgaggcuacacaccagcggaagcugcgccaaaagcagcuucagcagcaauucagagaacggauggagaaacagcagguuagaguguccacccccagcgccgagaagucugaagccgcuccucccgcgccucccgugacacacuccaccccggucacggugagcgagccucugcucgaaaaagacuuucuggccgggguuacccaggagcuuauuaagacacuggaagauaauucugagaaaugggcugugacccccgacgccggagacggcgucgugaagccuagcucccgcgccgaucccgcucaaacaucugacacccucgcccugaacaaucagaugguuacgcagaaccggacaccccauagcgugugucaccagaaaccucaagcgaaguccgggagcugggaucugcagaccuauucugcugaccagagaacaaccggaaauugggagucccaucgcaagagccaggauaugaaaaagcggaaauacgacccgucuuga

SEQ ID NO: 74604 - RNA, 354 nt, Artificial Sequence
  derived and/or modified sequence opt5 from RAD54B__Homo_sapiens__NP_001192191
augagacggagcgccgcucccucccagcugcaaggcaacucuuucaagaaaccuaaguuuaucccgcccgggcgcagcaauccuggacucaacgaggaaauuaccaaacugaaucccgacaucaaacuuuucgagggcguggccauuaacaauacauuucugccuucccagaacgaucucagaaucugcucucugaaucuucccagcgaagaguccacgcgggaaauuaacaaucgcgacaacuguucugggaaguacugcuucgaggcgccuacccuggcuacacucgauccgccccacaccguccagacauggaugagacggcaucgccugguuccugugcacuauagauga

SEQ ID NO: 74605 - RNA, 1176 nt, Artificial Sequence
  derived and/or modified sequence opt5 from RAD9A__Homo_sapiens__NP_004575
augaagugccuggugaccggcgggaacgucaaaguucucggaaaggccgugcacagccuguccagaaucggcgacgagcuuuaccuggaaccccucgaggaugggcugucucuucggacagugaauagcucccgcucugcuuaugccuguuuccuguuugcgccucucuucuuucagcaauaccaggcugccacgccgggacaggaccugcugagaugcaaaauucucaugaaguccuuccugagcgucuuucggucucuugccaugcuggagaaaaccguggaaaaguguugcaucagccucaacggccgcuccagcagacugguugugcagcuucauuguaaguucgggguccggaaaacacacaaucugucuuuucaagauugcgaaucccuccaggcuguguucgaccccgccagcuguccucauaugcugcgcgcucccgccagaguucugggagaggcggugcucccuuuuucucccgcccuggcugaggucacccuuggcauuggccgggggcgcagagugauccugcgguccuaucacgaagaggaagccgauagcacagcuaaggccauggugaccgagaugugccucggagaggaagacuuccagcagcugcaagcgcaggagggcgucgccauuacauuuugucuuaaagaguuccgcgggcugcucucuuuugcugaauccgccaaccugaaucugagcauccauuucgaugcuccuggaagaccggccaucuucaccauuaaggacucccuccuggauggccacuuuguucuugccacgcugucugacaccgauagccacucccaggaccucgggagccccgaacggcaucagccugugccccaacugcaggcucacucuacaccucaucccgaugacuucgcgaacgacgauaucgacuccuacaugauugccauggagaccacaaucggaaaugagggcagccgcgugcuuccgucuauuagccuguccccuggcccccagccucccaaaucucccgggccucacagcgaagaggaagaugaggcugaaccguccaccguccccggaacgccucccccuaagaaguuuagaagccucuucuuuggcucuauccuggcccccgugcgguccccgcaagggccuagccccguucuggccgaggacucugagggagaaggcuga

SEQ ID NO: 74606 - RNA, 1038 nt, Artificial Sequence
  derived and/or modified sequence opt5 from RAD9B__Homo_sapiens__NP_001273461
augagcgagaacgaacuggacaccacacuccaccugaagugcaaacuuggcaugaaguccauccugcccauuuucagaugucucaauucucuggagcggaacaucgaaaaaugccgcauuuuuacgagaagcgauaaguguaaaguggucauccaguucuuuuaccggcaugggauuaagcgcacccacaauaucugcuuccaagagucccagccucuucagguuaucuuugacaagaacguguguacaaauacccugaugauucagccgagacuccuggccgaugcuaucgugcuguucacaucuagccaagaagaggucacccucgccgugacaccccugaacuuuugccuuaaauccucuaaugaggaaagcauggaccuguccaacgcgguucauagcgagauguucgugggaucugaugaauuugacuucuuucagauuggcauggauaccgagaucacguucuguuuuaaggagcucaaagggauucugaccuucuccgaagcuacacacgccccuaucagcauuuauuucgacuuucccggaaagccucuugcccugucuaucgaugacaugcucgucgaggcuaauuucauccuggccacccuggcugaugaacagucccgggccagcucuccccagucccucugccugagccaaaaacgcaagagauccgaccuuauugagaagaaagcgggcaagaacgugacagggcaggcccuggaauguaucucuaaaaaggcugccccucggcgccucuacccgaaagagacccugacgaauauuagcgcucuugagaacugcggaucccccgccaugaagagaguugauggcgacgugagcgaagucucugaguccagcgugucuaauacagaagaggugccuggcagccugugucuccggaaauuuuccugcauguucuuuggggcggucucuagcgaccagcaggaacauuucaaccaccccuuugauucccuggcccgcgcuagcgacucugaggaggauaugaauaacggauccuucagcaucuuuuga

SEQ ID NO: 74607 - RNA, 1221 nt, Artificial Sequence
  derived and/or modified sequence opt5 from RAE1__Homo_sapiens__XP_005260640
auggcccccgcugaggccgaacugccuccgggcagcgcgcuccugagagacgcuggggcccgggccggacuucugaccaagcuccgcuacugggcucuggaggccagauucaaaaugucccuuuuuggcacaacgucuggguucggaaccagcggcacauccauguuugggucugcuaccacagauaaccacaaucccaugaaggacaucgaagugaccagcuccccugaugacucuauuggaugccugagcuucuccccucccacacuccccggcaacuuucugaucgccggcagcugggcgaaugauguccgguguugggagguucaggacucugggcaaaccauuccuaaagcccagcagaugcauacgggaccggugcuggaugugugcugguccgacgauggcagcaaggucuucaccgcuucuugugacaaaacagccaagaugugggaucucuccagcaaccaggcuauccaaauugcccagcacgacgcgcccgugaagaccauccauuggaucaaagccccuaauuauucuugcguuaugacaggguccugggauaagacccugaaauuuugggacacgcgcagcuccaaccccaugauggugcuucagcugccugaaagauguuacugcgcugacgucauuuaucccauggccgugguugcuacagccgagcggggacucaucguguaccagcuggagaaucaaccgucugaguuccgcagaauugagagcccucuuaagcaccagcaucggugugucgccaucuuuaaagauaagcagaacaagcccaccggcuucgcucugggguccauugaaggacgcguggcgauccacuauauuaauccucccaaccccgccaaagacaauuuuacauucaagugccacagaagcaacggcaccaauaccucugcuccucaggauaucuacgccgugaacggcaucgccuuucauccgguccacgggacacucgcuacgguuggauccgacggccgguucagcuucugggauaaagacgcccgcaccaagcugaaaacaucugagcaacuggaucagcccauuagcgcguguugcuuuaaucauaacgggaacaucuucgcuuaugccuccucuuacgacuggagcaagggacacgaguuuuacaauccucagaaaaagaacuauauuuuccucagaaaugccgcugaagaacugaagccccggaacaaaaaguga

SEQ ID NO: 74608 - RNA, 684 nt, Artificial Sequence
  derived and/or modified sequence opt5 from RAET1E__Homo_sapiens__NP_001230254
augagacggaucagccugaccuccucucccgugcgccuccugcuuuuccugcuccugcuucugauugcccucgagaucauguacaacagcgacaauaacauggucaagccucugggccugcucgggaaaaagguuuaugcuacauccacguggggagaacugacccagacacuuggcgagguggggagagaucugcggaugcuccugugcgacauuaaaccgcaaaucaagaccucugaucccagcacacuucagguggaaauguuuugucagcgcgaggccgaaagaugcaccggagcguccuggcaguucgcuacaaauggcgagaaaucucugcucuuugacgccaugaacaugaccuggacggucauuaaucacgaggccagcaagaucaaggaaaccuggaaaaaggaucgggggcuggagaaauacuuccgcaagcuguccaaaggagacugugaucauuggcucagagaauuucugggccacugggaggcuaugccugagcccacagugagcccuguuaacgccucugacauccauugguccucuagcucccuucccgaucgguggauuauccugggcgcuuucauucuccuggugcuuauggggaucguccugauuugcgugugguggcaaaauggagaauggcaggccggccucuggccucugcgcaccagcuga

SEQ ID NO: 74609 - RNA, 741 nt, Artificial Sequence
  derived and/or modified sequence opt5 from RAET1L__Homo_sapiens__NP_570970
auggccgcugccgcgauccccgcucugcuccugugccuuccucugcuguuccugcuuuuuggcuggagcagagcccggcgcgacgauccgcacucccuguguuacgacauuaccgugauccccaaguucagaccugggccccgguggugcgccguccagggacaaguugaugagaaaacauuucuccauuaugacuguggcaacaagacggugaccccugugucuccccuggggaaaaagcugaaugucacaauggcuuggaaagcccagaacccugugcuccgcgaaguuguggauauucugaccgagcagcuucuggacauccagcucgaaaauuacacaccgaaggagccccugacccuucaagcuagaaugagcugcgaacagaaggccgagggacacuccucuggcagcuggcaguucuccauugaugggcagacauuucuccucuucgacucugagaaacggauguggaccacgguccauccuggagcgcgcaagaugaaagaaaagugggagaacgauaaagacguggccaugagcuuucacuauaucuccaugggcgauuguaucggcuggcuggaagacuuccugauggggauggauagcacccucgagcccucugcuggagccccucuggcuauguccagcggcacaacccaacuuagagccacagcgaccacgcugauucucugcugucugcuuaucauucugcccugcuuuauccucccggggauuuga

SEQ ID NO: 74610 - RNA, 1947 nt, Artificial Sequence
  derived and/or modified sequence opt5 from RAF1__Homo_sapiens__NP_002871
auggagcacauccagggcgccuggaagaccauuagcaacggguucggauuuaaagacgcuguguucgauggcuccucuugcaucagccccacaauuguccaacaguuuggguaccagagacgggccuccgacgauggaaagcugacggacccuucuaaaaccagcaauacaauccgcguuuuccucccgaacaagcagagaaccguggugaauguccggaacggcaugucccugcaugauugucuuaugaaagcgcugaaggugcgcgggcuccaacccgaaugcugugcuguuuuuagacugcuucacgagcauaagggaaagaaggcccggcuggacuggaauacagaugccgcuucucucauuggcgaagaacuccagguggacuuccuggaucacgucccucugaccacacauaacuuugcccgcaaaaccuuccugaaacuugcuuuuugcgacaucugucagaaauuccugcucaauggcuuuagaugccagacguguggguauaaguuccacgaacacugcagcaccaaggugcccacaauguguguugauugguccaacauccggcaacugcuucuguuuccuaauagcaccauuggagacucuggcgugcccgcccucccuucccugacaaugcgcagaaugcgggagagcgucucucgcaugccgguguccagccagcauagauacucuacgccccacgcguucaccuucaacacauccagcccuuccucugaggggagccugucccagcggcagcgcagcaccucuacacccaaugugcauauggucuccaccacccucccuguugauagcagaaugaucgaagacgccauucggucucacagcgaguccgcuucucccagcgcccuguccagcucuccgaacaaucuuuccccuacaggauggagccaacccaaaacgccugugcccgcucagagagaacgcgcccccgugucuggcacccaggagaagaacaaaauccggccuagagggcaacgcgacuccagcuauuacugggagauugaagcguccgaggucaugcugucuacacggaucggaagcggcuccuuuggcaccguguauaaggggaaauggcacggagauguugccgugaagauucucaaagucguggacccgacacccgaacaguuccaggcuuuuagaaaugagguugccgugcugcgcaagacccggcaugucaacauccuucuguucaugggcuacaugacgaaggauaaccucgcuaucgugacacaguggugcgaagggucuagccuguauaaacaucugcacguccaagagaccaaguuucagauguuccagcucauugacaucgccagacagaccgcccaaggaauggauuaccugcacgcuaaaaauauuauccaucgcgacaugaaguccaacaauauuuuucuucacgagggccugacagugaaaaucggggauuucggacucgcgaccguuaagagccgguggucuggcucccaacagguggaacagccuacaggcagcguccuguggauggcccccgaggugaucagaaugcaggacaacaauccuuuuucuuuccaguccgauguuuacagcuaugggauugugcuuuacgaacugaugacgggagagcuccccuauucucacaucaacaaucgcgaccagauuaucuuuauggucggccggggguacgcuagcccggaucuguccaagcuguauaaaaacuguccuaaggccaugaaaagacucguggccgacugcgugaagaaaguuaaggaggagcggccccuguucccucagauucuuagcucuaucgagcugcuccaacauucccugcccaagaucaaucgcagcgcuuccgaaccuucucugcacagagccgcgcauaccgaggacauuaacgcuugcacacuuaccacaagcccccggcucccggucuuuuga

SEQ ID NO: 74611 - RNA, 3132 nt, Artificial Sequence
  derived and/or modified sequence opt5 from RAG1__Homo_sapiens__XP_005253098
auggccgcuagcuuucccccuacccugggccucuccucugccccggacgagauccagcacccccauauuaaguucagcgaauggaaauucaagcuguuuagagugcgguccuucgagaaaacaccugaagaggcgcaaaaggagaaaaaggauucuuuugaagggaagcccagccuugagcaguccccugcuguccuggacaaagccgauggacagaagcccguuccuacgcagccgcuccugaaagcccaccccaaguucucuaaaaaguuucaugacaacgaaaaggcucgcggcaaagccauccaccaagcuaaucuuagacaucugugccggauuugugggaacagcuuccgcgccgaugagcacaauagacgguacccugugcacggacccguggacggcaagacccucgggcugcugcgcaaaaaggaaaagagagcgacauccuggccugaucucaucgccaaagucuuucggauugacgugaaagcugauguugacagcauccaucccaccgaguucugccacaacuguuggucuaucaugcaucgcaaguuuuccagcgccccgugcgagguguauuucccuagaaaugucacaauggaauggcacccccacaccccuucuugugauauuugcaacacagcucggcgcggacugaagagaaaaucccuucagcccaaucugcagcucagcaagaaacugaagaccgugcuugaccaggcccggcaagcgcgccagcauaaaagacgggcccaggcuagaaucucuuccaaggauguuaugaagaaaauugccaacuguagcaagauccaccuguccacgaaacuccuggcuguggacuuucccgagcauuucgucaagucuauuagcugccagaucugugaacacauucuggccgacccuguggagaccaauugcaaacauguguucugucgcgucugcauccuccggugccugaagguuaugggcuccuacuguccgagcugcagauaucccuguuuuccuacagaucuugaaucucccgugaaguccuuccugagcgugcucaacucucugauggucaaaugcccugccaaggaguguaaugaggaagugagccuugagaaauacaaccaccacaucuccucucauaaggaaagcaaagagauuuuuguucacaucaauaagggcgggcgcccccggcaacaucugcucucccugaccagacgcgcucagaagcaccggcugagagaacucaaacuucaggugaaggcguucgccgacaaagaggagggaggcgaugucaagagcgugugcaugacacuguuucugcucgcucugcgcgcccggaacgaacacagacaagccgacgagcuugaagcuauuaugcaggggaaaggaucuggccugcagccggccguuugucucgcgauccgcgugaauaccuuccuguccugcagccaguaucauaagauguaccggacggucaaagcuauuacagggagacaaaucuuucagccucugcacgcccuccggaacgccgagaaggugcugcuucccggauaucaucacuucgaauggcagccuccccugaagaacgucucuuccagcaccgaugugggcaucauugacggccucuccgggcugucuagcuccguugaugacuacccuguggauacaaucgcuaaacgcuuuagauacgacucugcccuggucagcgcucuuauggauauggaggaggacauucucgaaggaaugcggucccaggaccuggaugacuaucugaauggccccuucaccgugguugugaaggagagcugugaugggaugggagacgucucugaaaaacauggcuccgggccgguggugccugagaaggccguuagauuuagcuucaccaucaugaaaauuacaaucgcgcacucuucccaaaacgucaagguguuugaggaagccaagcccaauagcgagcucugcuguaaaccccugugccuuaugcuggcugaugaaucugaccacgagacgcucaccgccauccugagcccucugauugcugaacgcgaggccaugaaguccagcgagcuuaugcucgaacugggaggcauccugcggacauucaaauucauuuuuagaggcaccggguacgaugagaagcucgugcgcgaagucgagggacuggaagcgucuggcuccguguauaucugcacacuuugugacgccaccagacuggaggcuagccagaaccucguuuuccauuccauuacgcggucucacgccgagaaucuggaacgcuacgagguguggagaagcaacccguaucaugaauccgucgaggaacugcgggaucgcgugaaagggguuucugcuaagcccuuuaucgagacagugccuagcauugacgcccuucacugcgauaucggaaaugccgcugaguucuacaagaucuuucagcucgaaauuggcgaggucuauaaaaaccccaaugcguccaaggaagagagaaaacgguggcaggccacccuggacaagcaucugcgcaaaaagaugaaccucaagccuaucaugagaaugaaugggaacuucgcucggaaacugaugaccaaggagacaguggaugccguuugugaacuuauucccucugaggaacgccacgaggcccugagagaacucauggaccuguaccugaaaaugaagccuguguggcggagcuccugccccgcuaaagaguguccggagagccuuugccaauacucuuuuaauucccagagauucgccgaacuccugagcaccaaguuuaaauaucgcuacgagggcaagaucacaaacuauuuccacaagacgcuggcgcaugucccugaaauuaucgagcgggacggaucuaucggcgcuugggccuccgaagggaaugagagcggaaacaaacucuuuagacgcuuccggaagaugaacgccagacagucuaaauguuacgagauggaagaugugcugaagcaccauuggcuuuauaccuccaaauaccugcagaaguuuaugaaugcucacaacgcccucaagacaagcggcuucaccaugaauccccaagcgucccugggggacccucugggaauugaggauagccuugaaucucaggacagcauggaguucuga

SEQ ID NO: 74612 - RNA, 1584 nt, Artificial Sequence
  derived and/or modified sequence opt5 from RAG2__Homo_sapiens__NP_001230714
augagccugcagauggugaccgucuccaacaauaucgcccucauucaacccggcuucucucugaugaacuuugacgggcagguuuucuuuuucggacagaagggcuggccuaaaagaagcugcccgacagggguguuucaccuugaugugaagcauaaucacgucaaacugaagcccacgaucuucuccaaagacucuuguuaccucccuccccugcgguauccugcuaccugcacauuuaagggaagccuugaguccgaaaagcaucaguacauuauccacggcgggaaaacccccaacaaugaggugucugauaagauuuauguuaugagcaucguguguaaaaacaauaagaaagucacauuccgcugcaccgaaaaggaccuggugggagauguuccugaggccagauacggccauuccaucaacguggucuauagccggggcaagucuaugggggugcucuuuggaggccgcuccuacaugccgagcacacacagaaccacggaaaaauggaacucuguggcggacugucugcccugcgucuuccugguugauuuugaguucgggugugcuaccuccuauauucucccugagcugcaagacggacuuagcuuucacgugucuaucgccaagaaugauacaauuuacauccugggcgggcauucccucgccaauaacauucggcccgcuaaucuguaccgcaucagaguggaccuuccucugggaagccccgccgucaacugcaccgugcucccgggcggcauuuccguuucuagcgcuauccugacacagaccaauaacgaugaguucgugaucgucgggggauaucagcuggaaaaccagaaacggaugauuuguaauaucauuucccucgaagacaacaagaucgagauucgcgagauggaaacgccugauuggacacccgacaucaaacacagcaagaucugguucggcucuaauauggggaacggaaccguguuucugggcauuccuggggacaauaaacaaguuguguccgagggauucuacuuuuauaugcuuaagugcgccgaagaugacacaaacgaggaacagaccaccuucacaaauagccagacgucuaccgaggaucccggcgacagcacacccuuugaggauuccgaagaguucuguuuuucugcggaagccaacagcuucgacggcgaugacgaguuugauaccuacaaugaagacgaugaggaggacgaauccgagacaggguauuggauuaccugcugcccuacgugugacgucgauaucaacacaugggugccguucuacagcaccgaacugaauaagcccgcuaugaucuauugcucucauggagacggccacuggguccacgcccaguguauggaucucgcugagagaacccugauucaucuuuccgccgggagcaacaaauacuacugcaaugaacacguggagaucgcgcgggcccugcauacaccucaacgcguucucccccugaagaaaccucccaugaagucucugcggaaaaagggauccggcaagauccucaccccggcuaaaaagagcuuucugagacgccuuuucgacuga

SEQ ID NO: 74613 - RNA, 2943 nt, Artificial Sequence
  derived and/or modified sequence opt5 from RAI14__Homo_sapiens__NP_001138992
augaaaagccugaaagccaaguucagaaaauccgacaccaacgaguggaauaagaacgaugaccggcuccugcaggcuguggaaaauggcgaugccgagaaagucgcgucucuucuggggaagaagggagcuagcgccacaaaacacgacuccgaaggcaagacggccuuucaccucgcugccgcuaaagggcacguugagugccugcgcgugaugaucacccauggaguggaugucacagcccaagacaccacaggccacucugcgcuucaucuggccgcuaagaacagccaccacgaauguauuagaaaacuccugcaguccaagugccccgccgagucuguggauagcuccgggaagaccgcucugcauuacgccgcggcccagggaugucuccaggcuguucaaauccugugcgagcacaaaagcccuauuaaucuuaaggaccuggauggcaacaucccgcuccugcuugccgugcagaauggccauucugaaauuugucacuuccugcucgaccacggggcugaugucaacucccggaauaaaagcggacgcacagcccugaugcuggccugcgagaucggcagcuccaacgcuguggaagcgcucaucaagaaaggggccgaccugaaucuuguugauagccugggauauaacgcucuccauuacucuaagcuguccgagaaugccggcauucagagccuucugcucuccaaaaucucucaggacgccgaccugaagacccccacgaagccuaaacaacacgaucaggugagcaagauuuccagcgagagaucugggacccccaaaaagcggaaagcuccucccccuccgaucucccccacacagcugagcgacgucucuagcccucgcuccauuaccucuacaccccucagcggaaaggaauccguguuuuucgccgagccucccuuuaaggcggaaaucagcucuauuagagagaacaaagaucggcuguccgacagcaccacgggcgcugauucucuucuggacaucuccagcgaagccgaucagcaagaccuccugucccuucugcaggccaagguggcuucucucacacugcauaauaaagagcugcaggauaagcuccaagccaaaagcccgaaggaggcugaagccgaccuguccuucgauucuuaucacagcacccagacagaccuuggcccuucccuggggaagcccggagagaccagcccucccgacucuaaauccagccccucuguccucauccauucccugggcaagagcaccacagauaacgacguucgcauucagcagcugcaagaaauccuucaggaucuccagaaaagacuggagucuagcgaagcggagcggaagcagcugcaaguggagcuccagucccgcagagccgaacuggugugucuuaacaauacggagauuagcgaaaacucuuccgaccugagccagaaacucaaggagacccaguccaaguacgaagaggcuaugaaagagguccugucugugcaaaagcagaugaaacuggggcuuguuagcccugaauccauggauaauuauucucacuuucacgagcuccgggugacagaagaggagaucaacguccugaagcaggaccugcagaaugcccucgaagagagcgaacgcaacaaagagaaggugagagaacuggaggagaaacuuguugaacgggagaagggaaccgugauuaagccgcccgucgaagaguacgaagagaugaaauccucuuauugcagcgugaucgagaauaugaacaaggaaaaggcuuuccuguuugagaaguaccaagaagcccaggaggaaaucaugaaacucaaggauacacugaagucccagaugacccaagaggcgagcgacgaggccgaagauaugaaagaggcuaugaauagaaugauugacgaacugaacaagcaggucucugagcuuucccagcucuacaaagaggcccaggcugaacuggaggauuaucgcaagcggaaaagccuggaagacgugacggccgaguacauccauaaggccgaacacgagaagcucaugcaacugacaaauguuucuagagcuaaagcggaggaugcccuuuccgaaaugaaaagccaguauucuaaggugcugaacgagcucacccagcugaagcagcuggucgacgcucaaaaagaaaauuccgugagcauuaccgagcaucuucagguuaucacaacccuccgcacagccgccaaggaaauggaggagaagauuuccaaccugaaagaacaccuggcuagcaaggagguggaagucgccaaacucgagaagcagcugcuugaagagaaagcggcuaugacggacgccauggugccucggucuagcuacgagaagcugcaguccucucucgaaagcgagguguccguucuggccucuaaacugaaggaaagcgucaaggagaaagagaaggugcacuccgaagugguccaaaucagaucugaggugagccagguuaaacgcgaaaaggagaauauccagacccuucugaaauccaaggaacaagaggugaacgagcuccugcagaaguuccagcaggcucaagaggaacucgccgaaaugaaacgguaugcggagucuucuuccaagcuggaagaggauaaagacaagaaaauuaacgagaugagcaaggaagucacaaagcugaaagaggcucuuaauucucucucccagcugagcuacuccaccucuagcuccaagagacagagccagcaacuggaagcccuucagcaacaggugaaacagcugcagaaccagcucgccgaguguaagaaacagcaucaagaaguuaucucuguguaucgcaugcaucugcucuacgcuguccagggccagauggaugaggacgugcaaaagguucugaagcagauucuuacaaugugcaaaaaucagucccagaagaaauga

SEQ ID NO: 74614 - RNA, 5721 nt, Artificial Sequence
  derived and/or modified sequence opt5 from RAI1__Homo_sapiens__NP_109590
augcagagcuucagagaacggugcggcuuucacgggaagcaacagaacuaccagcagacaucccaagaaacaucucgccuggagaauuauagacagcccagccaggccggacucuccugugaccggcagcgccugcuugcuaaagacuacuauaacccucaaccguaccccucuuaugaaggcggggccggaacgccuagcggcaccgcggcugccguggccgcugacaaguaccacagaggguccaaagcccugcccacacagcagggacuccagggccggccugcuuuccccggcuaugggguccaagauucuagcccuuacccgggacgcuacgccggcgaggaaucccugcaggcguggggagcuccccagccucccccuccccaaccgcagccucuucccgcuggaguugccaaguaugacgagaaucugaugaaaaagaccgcugugccucccagcagacaguacgccgagcagggcgcgcaagugcccuuucggacacacucucuccauguccagcagccuccgcccccucagcaaccccuggccuauccuaagcugcagcgccagaaacuccagaacgauaucgcuagcccccugccguucccucaagggacccacuuuccccagcauagccagucuuucccuacauccagcaccuacucuuccagcgugcagggaggcggccaaggggcccacuccuauaagucuugcacggcucccaccgcccagccucacgacagaccccuuacagccagcuccagccuggcuccgggacagcggguucaaaaucuccaugcguaccagucuggccgccuguccuaugaucagcagcaacagcagcagcaacagcagcagcaacagcagcaagcccuucagagcagacaccaugcucaggaaacccugcacuaccagaaccucgccaaauaccaacacuaugggcagcagggacagggcuacugucaaccugacgccgcugugcggacacccgagcaguauuaccagaccuuuucucccagcuccucucauagcccugcccgcuccgucgggagaagcccgucuuauuccagcacgcccucuccucugaugcccaaucuggaaaacuucccuuacucccagcaaccccucagcacaggagcguuuccugcuggcauuaccgaucacucccauuucaugccccugcuuaauccgucuccuacagacgccaccagcuccguggauacccaggccggcaacugcaagccccugcagaaagacaagcucccugagaaucugcuuucugaucugagccuccagucccugacagcucugacgagccaaguugagaacaucucuaauaccgugcagcagcuccugcuuuccaaggccgcugucccccagaaaaagggggugaaaaaccuggugagccggacaccggaacagcacaagucucagcauuguuccccugagggaagcggcuauucugccgaacccgcggggaccccucucagcgagccgcccuccagcacaccucagucuacccacgccgaaccgcaagaggcugacuaccuguccggaagcgaggacccccuugaaagauccuuucuguacugcaaucaggcccgcggcucuccugcucgggucaacagcaacuccaaagccaagcccgagucuguuagcacguguuccgugacaucuccugaugacaugagcaccaaauccgaugacagcuuccagucucuccacgggucccugccccuggauagcuuuucuaaguucguggcgggcgaaagagacugcccucgccuccugcuuuccgcccuggcucaggaggaucucgccagcgaaauucugggacugcaagaggcuaucggcgagaaggccgacaaagccugggcugaagcgccgucucuugucaaggauuccagcaaacccccuuucucccucgagaaucauagcgccugucuggacucuguggcuaagagcgccuggccccggccuggggaacccgaggcccugccggauucccuccagcuggacaaaggaggcaacgcuaaggacuuuucuccugggcuuuucgaagaucccagcguugccuuugcgacccccgacccuaagaaaacaaccggaccccuguccuucggcacaaagccuacgcucggggugccggcucccgauccuaccacagccgccuuugacugcuuccccgauaccacagcugccucuagcgcggacuccgcuaauccuuuugccuggcccgaggagaaccugggcgaugccuguccgagauggggacugcacccuggcgaacuuaccaaagggcucgagcagggaggcaaggcuucugacgggauuagcaaaggagauacgcaugaagccuccgcuugccugggcuuccaggaggaggaucccccuggggaaaaggucgccagccugcccggcgauuuuaagcaagaggaagugggaggcguuaaagaggaagccgggggccuccugcagugcccugagguggccaaggcugaccgcuggcuugaggauucucggcacuguugcuccaccgccgacuucggcgaccugccccuccugccgccuacaagcagaaaagaagaucuggaggcugaagaggaauauucuucccuuugugagcuccuggggagccccgagcagcgccccggaaugcaagacccucuguccccgaaggcgccccucaucugcaccaaagaagaggucgaagaggugcuggauucuaaggccggcugggggagcccuugucaccuuuccggcgaaagcgucauccugcucggacccacagugggcaccgagucuaagguucaguccugguuugagagcucucugagccauaugaaaccuggggaagagggacccgacggcgaacgggcuccuggggauuccacgacaucugacgcgagccuggcccagaagccgaauaaacccgcugugccugaggcccccauugccaagaaagagccuguccccagaggaaagucccuucgcucucggagagugcaccggggccucccggaagcugaggauagcccuugccgcgcccccguucugcccaaagaccugcuccugccugaauccuguaccggacccccucaggggcaaauggagggagcgggcgcuccggggagaggagccagcgaaggccuuccccggaugugcacaagaucucugaccgcccucuccgagccucgcacccccgggccucccggacugacaacgaccccggcuccucccgauaagcugggcggcaagcagcgggccgcguucaaaagcgggaagagagugggaaaaccuucccccaaggcugccucuagcccuuccaaccccgccgcccuucccgucgcuucugacagcuccccuaugggcagcaaaacaaaggagaccgauucucccuccacacccgggaaggaccagcgcagcaugauccugagaucucggaccaaaacgcaggaaauuuuucauuccaagcgcagacggccuagcgagggacgccucccgaauuguagagcuaccaaaaagcugcucgauaacucucaucugcccgccaccuucaaagugagcuccucuccucaaaaggaaggccgggugagccagcgcgcgagaguucccaagccuggggccggauccaaacuuagcgaccggccccugcaugcucucaagcgcaaauccgccuucauggcuccuguccccaccaagaaaagaaaucuggugcugcggucuagaagcuccucuagcuccaacgccucuggcaauggcggggacggaaaggaggaacgcccggagggcagcccuacacuuuuuaagcggauguccagccccaaaaaggccaaaccuaccaaggggaacggagagcccgcuacaaaacugccgccucccgaaacgcccgaugcgugccucaagcuggccucuagagcugccuuccagggcgccaugaaaaccaaggugcucccuccccgcaaggggcggggacugaaacuugaggcuaucguccagaagauuacauccccuagccugaaaaaguuugccuguaaagcgccgggcgcuucucccggcaauccucucucccccagccugucugacaaggauagagggcugaagggagccggcggguccccugugggaguugaagagggccuugugaacgucgggaccggacaaaaacugcccacaagcggcgccgacccucucugccgcaauccgaccaaccggucccugaagggcaaacucaugaacagcaagaaacugucuagcacggauugcuucaagaccgaggcuuuuacaucccccgaggcccuucagccugggggaaccgcgcuggcccccaagaaaagaucucgcaagggccgggcuggggcccacggacugagcaaaggcccucucgagaagagacccuaccuggggccggcccuucugcucacaccucgggaccgcgccuccggaacccagggcgcuucugaagauaauagcggcgggggaggcaaaaagcccaagauggaggaacuggggcucgccucccagcccccugagggaagacccugucaaccucagacacgggcgcagaaacaaccgggccacaccaacuauucuagcuacuccaagcgcaaaagacugacgcgggggagagccaagaauacaaccagcucucccugcaaaggacgcgcuaagcggagacgccagcaacaggugcuuccucuggaccccgccgagccugaaauccggcugaaguauauuuccagcuguaaaagacuccgcucugauucccggacccccgcuuucagcccguuuguuagaguggagaagcgcgacgccuucacaaccaucugcacggucgugaacuccccuggcgaugcccccaaaccucauagaaagcccucuagcuccgcuuccucuuccagcucuagcuccucuuuuagccuggacgcggccggcgcuucccuugccacacugccgggcgggucuauccuccaaccucggcccagccugccccucuccagcaccaugcaccuggggccuguugugucuaaagcccuuuccacaagcugucuggucugcugucugugccagaaucccgcuaacuucaaggaccucggggaucuguguggaccuuacuauccggaacauugccuucccaaaaagaagccuaaacugaaggagaaagugcgccccgaaggcaccugugaggaggccucccucccucuggaaagaacacucaaggggcccgagugcgcggccgcugccaccgcuggcaaaccuccgcggcccgacggaccugccgaucccgcgaagcagggcccucugcgcacgucugccagagggcuuagccggagacugcaguccugcuacuguugcgacggacgcgaagauggcggggaggaagcugcccccgcugacaagggacggaaacacgaguguucuaaggaggccccggcugaaccuggcggggaggcccaagaacauugggugcacgaggcgugcgccgucuggaccggcggaguuuaccugguggcuggcaaacucuuugggcugcaggaagccaugaagguggcugucgauaugauguguagcuccugccaggaggccggagccacaauuggcuguugccacaaagggugucuucauaccuaucacuaccccugcgcgagcgacgcuggauguaucuucauugaggaaaauuuuucucugaagugccccaagcauaaaagacucccuuga

SEQ ID NO: 74615 - RNA, 1443 nt, Artificial Sequence
  derived and/or modified sequence opt5 from RAI2__Homo_sapiens__NP_001166203
auggacgaucugcagagccaaaaccucuccauggacaugaccgauucucccccugcccuggcuaauaacagacuugagaauggcauggcccagcugaucacaacggaagcguggaacauuaauagcaccgaccucguggagggguccucugcuccggaacugaaccccaauggaaacgccacauacgucaugaccacacagggcccuguucagcuucccguggugcuggagcaacacgucuuccagcaucucaauagcccucuggugcugccccaggaagccccuugcuccucuagcaccauccacaacaaucucuuucagggggcugaggauccggaggcccaaccccagcugcuugaccugcggauuccuucccagccccaggaaccuacacuccccuucgaggcuguucugcaaaaccuuuuuccgagccagggaacccugggcccucccccuugucagcccccucccggguaugccccggugcccccucaacccuucucuuccccucucagcccccuggucccgccugcgacgcugcucgugcccuacccuguuaucgugccccugccuguccccgugccgauuccuauccccauccccgugccucagucuuccgaaagcaaguuuucuuccagcuucccgaaacccccuuccucuuuuggacuucaucccuucaagggcacccagacaccucuggagaaagaugagcucaagcccuuugacauucugcagccuaaagaauauuuccaacuuagccgccacaccgucaucaagaugggcuccgagaaugaagcccuggaucucagcaugaagucuguucccuggcugaaagcuggggagguguccccgccuauuuuucaggaagacgccgcucuggaucucagcguggccgcgcauagaaagucugagcccccucccgagacacuguacgacagcggagccuccgucgauucuagcggccacaccgugauggaaaaacuuccguccgggauggagaucagcuucgcuccugccacgucucacgaagcucccgccaugauggacucccauauuucuagcuccgacgccgcuacagagaugcugagccagccuaaccaccccuccggagaaguuaaggcggagaauaacaucgagauggugggcgaaucucaggccgcuaaagucauugugagcguugaggaugccgugcccaccaucuuuugcgggaagaucaagggacucuccggcgucucuaccaaaaacuucagcuucaagcgggaagacuccgugcugcaaggcuaugauauuaauagccagggggaggaaucuaugggaaacgccgagccucuucgcaaaccgaucaagaauagauccauuaaacugaagaaagucaacagccaggagauccauaugcuccccauuaagaagcagcggcuggcuacauuuuucccucgcaaauga

SEQ ID NO: 74616 - RNA, 621 nt, Artificial Sequence
  derived and/or modified sequence opt5 from RALA__Homo_sapiens__XP_006715825
auggccgcuaacaagcccaaaggccagaauagccuggcccuccacaaggugaucauggucggguccggaggcguugggaaaucugcgcugacccuucaauucauguacgacgaguuuguggaagauuaugagccuacaaaggcugacagcuaccggaaaaaggugguccuggauggagaagaggugcagauugacauccucgauacggccggccaggaagacuaugccgcuauuagagauaacuacuuccgcuccggggagggauuucugugcguuuucucuaucaccgagauggagagcuuugccgcuacagccgacuucagagaacagauucuucgggugaaggaagaugagaaugucccguuucugcucgugggcaacaaauccgaccuggaggauaagcgccaaguuucuguggaagaggcgaaaaauagagccgaacaguggaacgucaauuauguggagaccagcgcuaagacacgggccaacguggacaaagucuucuuugaucugaugcgcgaaaucagagcucggaagauggaggacuccaaggagaaaaauggcaagaaaaagcgcaaaagccucgccaagagaauccgggaacgcuguugcauucuguga

SEQ ID NO: 74617 - RNA, 621 nt, Artificial Sequence
  derived and/or modified sequence opt5 from RALB__Homo_sapiens__NP_002872
auggccgcuaacaagagcaaaggccaguccucucuggcccuccacaaggugaucauggucgggagcggaggcguugggaaauccgcgcugacccuucaauucauguacgacgaguuuguggaagauuaugagcccacaaaggcugacucuuaccgcaaaaaggugguccuggauggagaagaggugcagauugacauccucgauacggccggccaggaagacuaugccgcuauucgggauaauuacuuccgcagcggggagggauuucugcuuguuuucuccaucaccgagcaugaaucuuuuacagccaccgcugaguucagagaacagauucugcgggugaaggccgaggaggacaaaaucccucuccuggucgugggcaacaagagcgaucuggaagagagaagacaaguuccgguggaagaggcgcgguccaaagccgaagaguggggcguccaguauguggagacaagcgcuaagacccgcgccaauguggacaaagucuuuuucgaucucaugagagaaauccggacaaagaagaugucugagaacaaagacaagaaugggaaaaaguccagcaaaaacaagaaaucuuuuaaggaacgcugcugucugcuuuga

SEQ ID NO: 74618 - RNA, 1968 nt, Artificial Sequence
  derived and/or modified sequence opt5 from RALBP1__Homo_sapiens__NP_006779
augaccgagugcuuccugcccccuacaagcuccccgucugaacacagacggguggagcauggcagcgggcucacgcgcacccccuccucugaagagaucagcccuacaaaguuucccggacuguacagaaccggcgaaccuucucccccucacgacauucuucaugagccgcccgaugucguuuccgacgaugagaaagaccacgggaagaaaaagggaaaauucaagaagaaagaaaagcggacagagggcuaugccgcuuuucaggaagauagcuccggggacgaggccgagagcccuucuaaaaugaagcgcuccaaaggaauccauguguucaagaagcccagcuuuucuaaaaagaaagaaaaggauuucaaaauuaaggagaaaccuaaggaagagaagcacaaagaagagaagcacaaagaggaaaagcauaaagagaagaaguccaaagaccugaccgcggcugauguggucaagcaauggaaagaaaagaaaaagaagaaaaagcccauccaggagccggaagugccucagauugacguucccaaccucaaaccuaucuuuggcaucccccuggccgaugccguggagagaacaaugauguacgacggcauucggcuucccgcugucuuccgcgaguguaucgauuauguggaaaaguacgggaugaaaugcgagggaauuuauagaguuagcggcaucaagucuaagguggacgaacugaaagccgcuuacgaccgggaggaauccaccaaucucgaggauuaugagccuaacacggucgccagccugcugaagcaguaccuccgcgaccugccggaaaaucuucugaccaaagagcucaugcccagauuugaagaggcgugugggcggacaaccgagacagaaaaggugcaagaguuccagcgccugcuuaaagaacugccugagugcaacuaccuccugauuuccuggcugaucgugcacauggaucaugucauugccaaggaacucgagaccaaaaugaauauccagaacaucucuauuguucugagccccacggugcagaucuccaauagagugcuuuaugucuuuuucacacacgugcaagagcuguuuggaaacguugugcucaagcaggucaugaagccucugcgguggagcaauauggcuaccaugcccacacuuccggaaacccaggccggcauuaaagaggaaauccgcagacaggaguuccugcucaacugucugcaccgggaccugcaagggggaauuaaggaucucucuaaagaagagagacugugggaggugcagcgcauccuuaccgcucugaagcggaaacucagagaagccaagcgccaggagugcgaaacaaagaucgcgcaagagauugccucccugagcaaagaagacguuucuaaggaggagaugaaugaaaacgaggaagugaucaauauucuucuggcucaggagaacgagauccucacggaacaggaggaacugcuggccauggagcaguuccuccggagacaaauugcuagcgaaaaagaggagaucgaacgccugcgggccgagaucgccgaaauucaguccagacagcagcauggccgcucugagaccgaagaguacagcuccgagagcgaaucugaguccgaagaugaggaagaacuucaaaucauucuggaggaccuccagcggcagaaugaggagcuggaaaucaagaacaaccaccugaaucaggcuauucaugaggagagagaagcgaucauugagcuucgcguccaacuccggcugcugcagaugcagagagccaaagcugaacagcaagcccaggaggaugaggaaccugaguggcggggcggggccgugcagcccccucgcgacggaguccucgaacccaaggcugccaaggagcaaccuaaagcgggcaaggaacccgcuaaaccgagcccuucuagagaucggaaggagacauccaucuga

SEQ ID NO: 74619 - RNA, 6150 nt, Artificial Sequence
  derived and/or modified sequence opt5 from RALGAPA1__Homo_sapiens__NP_001269972
auguucagcaagaaaccccacggagacgugaagaaauccacacagaagguccuggauaccaaaaaggacgcccucacgcggcugaagcaccuucggaucguuauugagaacgcugaaucuaucgaucugaaacaauuuuucgaccagcacuuuagccauauuuacuauguguucuuugagaauuucgugaccaucgaagccucccucaagcagaaagggcacaagucucagagagaggaacuggaugccauucuuuuuaucuucgagaaaauccugcaacuccugccugagcgcauucaccagcgguggcaguuucacagcaucggacugauucucaagaagcugcuucacacaggcaacucccugaaaauccgcagagaaggggucagacucuuccugcuuuggcugcaggcucuccaaaauaacugcucuaaggagcagcuguggauguuuagcugucugauuccgggauucuccgcgccccaaagcgaacauggcccucgcacccucgacaaucugaucaaucccccucuuaaucugcaggagacacaagugaccauugaggaaaucacaccccucguuccuccgcagucuggggauaaaggacaggaggaccugaccuccuacuuucuugaagcccugcucaaguauaucgugauucaagucaaaagccuggaguggaagaacaaagaaaaucaggagagaggcuucucuuuccuguuuucccacuucaagaaguacuaucuccccuacaucuuuccuaacauuugcaaagagaauagccuguaucaucccauccuugauauuccucagaugcggcccaagccgcacuacgugguuaucaaaaaggacgcugaaacgaacgaggccaucuacuguaccaaagaaccuuucauuaaggcucgcgugaucgucauuagauggcuggugucuuuuuggcucgagcccaagccucacacaggcccccauauccccgggauggaaggagaggugcugccuaaaaauauucagcgggccgccgccucccuugucagccgcgaggaauccaagaacgauaaugcugacaaaaccgauagaacaaccgagccggaacaaucucacagcaacacguccacacugaccgagcgggaacccuccucuuccagccucugcucuaucgacgaggagcaucugacagacaucgaaauuguucgcagaguguucagcuccaagcggucuaacgugaauuuugucaccgagaucuucagacaggccuuucugcucccuauuugugaagcugccgcgaugcgcaaagugguuaagguguaucaggaguggauccagcaagaggaaaagccccuguucaugcaggagccugaagagauugucaucaccagcuccgaucuucccugcauugaaaacgugacagaccacgauaucagcauggaggagggcgaaaaacgggaggaagagaaugggacgaacaccgccgaccauguuagaaauucuuccugggcuaagaacggaagcuaccagggcgcccugcacaaugcuucugaagaggccacagagcagaacauccgcgccgggacccaagcugugcuccaggucuuuauuaucaauuccagcaacauuuuccugcuggaaccggcgaaugagaucaaaaaccuucucgaugaacacacagacauguguaagcggauucugaauaucuauagauacauggugguccagguguccauggauaaaaagaccugggagcagaugcugcucguucugcuucgcgugacggaaucuguccugaagaugccuagccaagccuuucuccaguuccagggcaaaaagaacaugacacuggcuggccggcuggccggcccccuuuuccaaacccucaucguggccuggauuaaagcuaaucugaacguuuauaucuccagagagcugugggacgaucuccugucugugcuuagcucccugaccuacugggaggaacucgccacagaguggagccugaccauggaaacacugacgaagguccuugcgcgcaaccucuauucucuggaccuguccgaucucccucuggacaaacuuagcgagcagaagcagaaaaagcauaaggggaaaggagugggccacgaguuucagaaggugucuguugacaaauccuucagccggggguggucuagagaucaacccggacaggcuccuaugcgccagcggagcgccaccacaaccggcucccccgggacagaaaaggccagaagcauuguccggcagaaaaccguggacaucgaugacgcucaaauucugccgcgcucuacgagagugcggcauuuuucccagagcgaggaaaccggaaaugaggucuucggcgcccucaacgaagaacagccucugcccagauccucuagcacauccgauauccuggagcccuuuaccguggaacgcgcuaaggaggccgaacagaaugcgacacggggcucuaccgaggggagcguucaauccugcaacggacuuuucuggaaggaaucuuguagcgacaucggcggguccagcgccaaugugccugaucucauggacgaguuuauugcugagagacugcgcucuggaaacgccuccacgaugacaagacggggcagcucuccggggucccuggaaauccccaaagaucucccugacauucugaauaagcagaaccagaugcgccccaucgaugacccuggcguccccagcgaguggaccucuccugcuuccgccggaagcuccgaucuuauuagcucugacagccacuccgacucuuucagcgcguuucaauacgauggcagaaaauucgacaauuuuggguucggaacagauaccggcgugaccuccucugccgacguugauagcggguccggacaccaucagucugcugaagaacaggaaguggccagccugacaacgcuccacaucgacuccgagaccagcucucugaaccagcaggcuuuuuccgccgaggucgccacaaucaccggcagcgaaucugcuucccccgugcauagcccgcuggggucccggucucagacaccuagccccuccacccuuaauauugaucacauggagcagaaggaccugcagcucgaugaaaaacugcaucacagcguucuccaaacgccugacgaucuggagaucucugaguuccccuccgaaugcuguagcgugauggcgggcggaacacuuaccggcuggcacgccgacgucgcuaccgugauguggcgcagaaugcuggggauucucggagaugugaacucuaucauggacccggagauucaugcccaggucuucgacuaccugugcgaacuguggcagaaucuugccaagauccgggauaaccugggcauuagcacagacaaucucaccuccccuucucccccuguucugaucccuccccuccgcauccugacacccuggcuuuuuaaggcuacgaugcugaccgauaaauauaagcaggggaaacuccacgccuacaagcugauuugcaacacaaugaaaagacggcaagacgugagcccgaaccgcgauuuccugacccauuuuuauaauaucaugcacuguggacuucugcauauugaccaggauaucgugaacacaauuaucaagcacugcagcccccaguucuuuucucucggccugccuggggcgaccaugcucaucauggacuucauugucgcugccggcagaguggccagcuccgcuuuucugaaugcgccccggguugaggcccaggugcuucugggaagccuggucuguuucccuaaccucuacugcgaacugcccucucuucacccuaauaucccggauguggcuguuucccaauuuacggacgugaaggagcugauuaucaaaaccguccucagcuccgccagagaugagcccucuggcccugcccgcuguguggcucugugcagccucgggauuuggaucugugaggaacugguucaugaaucccaccauccccagaucaaggaggcccuuaacgugauuugcgucucucugaaauucacaaauaagaccguggcucacguggccuguaacaugcugcacaugcucguccauuauguuccucggcugcagaucuaccaacccgacagcccgcuuaaaauuauccagauucugaucgcgacaauuacccaccuccugccuuccacagaagccagcucuuaugagauggacaagagacucguggugucccugcuucugugccugcucgauuggaucauggcucugccccuuaaaacccugcuccagcccuuucaugccacgggagcugagagcgacaagacagaaaagucuguccugaauuguaucuacaaagugcuccacggcugcguuuacggggcccagugcuucuccaacccucgcuauuuccccaugagccugucugaucuugccagcguggacuacgauccuuuuaugcaucuggagucccugaaggaaccggagccccuccacucuccugacagcgaacgguccagcaaacugcaacccgucaccgaggugaagacccagaugcagcacggacuuauuuccaucgcugcgagaacaguuauuacccaucuggugaaucaccucggccauuauccuaugucugggggccccgccaugcugacgagccaggucugugagaaccacgauaaucacuacuccgaaucuacagagcugagcccggaacucuucgaguccccuaacauccaauuuuucgugcuuaauaacaccacacuggucucuugcauucagauccgcagcgaggaaaacaugcccggaggcgggcuguccgcuggacucgccagcgccaauucuaacgugcggaucauuguuagagaccuguccggcaaauauagcugggauucugcuauccuuuacgggccucccccuguguccggacugagcgagcccaccucuuuuaugcucucccugagccaucaggaaaagccggaggaaccucccacauccaaugagugucuggaggacauuaccgucaaggauggccucagccuucaguucaaacgcuuucgggaaacggugcccaccugggacacaaucagagaugaggaagacguucuggacgagcugcuccaauaucugggcgugaccucuccugaaugccuucagcggacagggauuagccugaacaucccggcgccccagccugucuguaucuccgagaagcaagagaaugaugugauuaacgcgauccucaaacagcacaccgaagagaaggaguucguggagaaacauuuuaaugaccugaacaugaaggcuguugaacaggaugagcccauuccucagaagccccaaucugccuucuacuacugccgccugcuccuuagcauccugggaaugaacuccugggacaaaagacggucuuuucaucugcucaagaaaaacgagaagcugcuucgcgaacugagaaaucucgauagccggcaguguagagagacgcauaaaauugccgucuucuauguggcugaaggccaggaggacaagcacuccauccugacaaacaccgggggaucucaggccuacgaggauuuuguggcgggccuggggugggaagucaaucucacaaaccacugcggauucaugggcggccuucaaaagaauaaaagcaccgggcugaccacaccuuauuucgcuacguccaccguggagguuauuuuucaugugagcacacgcaugccgucugacuccgaugacagccugaccaagaaacuccggcaccugggaaacgaugaaguccauaucguguggucugagcacacaagagacuaccgccggggcaucauucccaccgaguucggggauguucuuaucgugauuuauccuaugaagaaucacauguuuuccauccagauuaugaaaaagcccgaggucccuuucuuuggaccccuguucgacggcgccaucgugaacgggaagguucucccgaucauggugagagccacggcuauuaacgccagccgcgcucugaaaucccugaucccucucuaccagaauuuuuaugaggaacgggccagauaccuucagacaauuguccaacaucaccuggagcccaccaccuucgaagacuuugcggcccagguguucucucccgcuccuuaccaucaucugcccagcgaugccgaccauuga

SEQ ID NO: 74620 - RNA, 5622 nt, Artificial Sequence
  derived and/or modified sequence opt5 from RALGAPA2__Homo_sapiens__NP_065076
auguucagcagacggucccacggcgacgugaagaaaucuacccagaagguccuggaucccaaaaaggacguucucacacgccugaaacaucuuagagcccugcucgauaacguggacgcuaaugaucugaagcaauuuuucgagacgaacuacagccagaucuauuuuauuuucuacgaaaauuuuaucgcccuugagaacucccugaagcucaaagggaauaacaagucucagcgggaagagcuggacagcauucuguuccucuuugaaaaaauccugcaguuccuuccugagcgcauuuuuuucagauggcacuaucaauccaucggaucuacccugaagaaacuccugcauacaggcaauagcaucaagauucggugcgaggggauccgccuuuuucugcucuggcugcaggcgcugcagaccaacugugcugaagagcaggugcucauuuucgccugccuggucccgggauuucccgccgugauguccagcagaggcccuuguacacuugaaacccugaucaaucccucuccuuccguugcugaugugaagauuuaccccgaggagaucacaccucuccugccggccauuagcggggaaaaaaucgcugaggaccaaaccugcuucuuccuucagauccugcucaaguauauggucauucaggccgcgucucuggaauggaaaaacaaggagaaucaggauacgggauuuaaauuccuguuuacccucuuccggaaguacuaucugccccaccuuuuuccuuccuucacaaaacugaccaacaucuacaagcccgugcucgacauuccucaucugcgccccaagccgguuuacaucacaaccacgagagauaaugaaaacauuuauagcacaaaaaucccuuacauggccgcucggguggucuuuaucaaguggauugugaccuucuuucuugagaaaaaguaucugacagccacccaaaauaccaaaaacggcguggacguccuccccaagaucauucagacaguuggcgggggagcugugcaggagcgcgccccugaacuggauggcgggggacccacggagcaagacaagucucacuccaacagcuccacccugucugacagacggcucagcaauuccagccuguguucuaucgaagaggaacaccgcaugguguacgagaugguccagagaauucuucuguccacacggggcuaugugaacuucguuaaugagguguuucaucaggcguuccuccugcccagcugcgaaaucgccgucaccagaaaagugguucagguguaccgcaaguggauccugcaagauaaaccugucuuuauggaggaaccggaccggaaggauguggcucaggaggacgccgaaaaacuuggguucucugagacagauagcaaggaggcuuccucugaaagcuccggacacaagagaagcucuuccuggggccgcaccuauagcuucacgucugccaugucccggggcugugucacagaggaagagaacaccaaugugaaagccgggguucaggcucuccugcagguguuucugaccaacagcgcgaauauuuuccuccuggagcccugcgccgaagucccugugcuucugaaggagcaaguugacgcuuguaaagccgugcucaucauuuuuagacgcaugaucauggaacugacaaugaacaagaaaaccugggagcagaugcugcagauucuucuccggaucacagaagccgucaugcagaagcccaaggauaaacaaauuaaggaccuguucgcucagucccuggccggacuccuguuuagaacgcuuaugguggcguggauccgcgcuaaucugugcguguacaucucucgggagcucugggaugacuuccugggcguucugagcucccuuaccgagugggaagagcucauuaacgaaugggccaauaucauggauucucugacagccguccuggcuagaaccguguacgggguggagaugacaaaccucccucuggacaaacuuagcgaacagaaggagaaaaagcagcgcggaaaaggcuguguccuggacccccaaaaggggaccacggugggacgguccuuuagccucucuuggagaucccauccggauguuaccgagccuaugcgguuccgcagcgccacaaccucuggcgcucccggcguggaaaaggccagaaauauuguccggcagaaagcgacagagguggaagagugccagcaauccgaaaacgccccugcugccgggagcggacaccugaccguuggccagcagcagcaagugcugagaucuagcuccacgagcgacauccccgagccucuuugcucugauuccagccaggggcagaaggcugagaauacacagaacuccucuagcuccgaaccccaaccgauucaggagaacaaaggacacgucaagcgcgaacaugagggcaucaccauccucgugcggagaucuagcuccccugccgagcuggaccugaaagaugaccuccagcagacacaagggaagugucgcgaaagacagaagucugagagcaccaauuccgauaccacacugggcugcacgaacgaagcggagcuuagcaugggacccuggcagaccugugaagaggaccccgagcugaauacaccuaccgauguuguggccgacgcugaugcccggcacuggcuccaacugucuccgacagacgcuuccaaccugaccgauagcucugaaugccuuacggacgacuguuccauuaucgccggcgggagccugacaggauggcaucccgauucugccgcuguccucuggcgcagagugcugggcauucucggggacgugaauaacauccaguccccuaaaauucacgcgcgggucuuuugcuaucuguacgagcuuugguauaagcuggccaaaauccgcgauaaucucgcuaucagccuggacaaccaguccagccccucuccucccguucugauuccuccccuuagaauguucgccagcuggcuguuuaaggccgcuacccucccgaaugaauacaaagagggaaagcugcaggccuaucggcucaucugugcgaugaugacccgcagacaagaugugcugccuaacuccgacuuccuugugcauuuuuaccuggucaugcaccucggccugacaucugaagaucaggacauucugaauaccaucauucggcacugccccccucgcuucuucagccuuggguuucccggcuucuccaugcuggugggagauuuuaucacagcugccgccagaguucucucuacggacauccugaccgcuccgcggagcgaggccgugacaguccucggcucccugguguguuucccuaacaccuaucaggagauuccccuucugcagucuguuccugaagugaaugaggcgaucacagggaccgaagaugucaagcauuaccugauuaacauccuccugaaaaaugcuacggaggaacccaacgaguacgccagaugcauugccguguguagccuuggaguuuggaucugcgaggaacuggcucaaugcaccucccacccccaggugaaggaggccauuaacgucaucggcgugacacucaaauuuccuaauaagaucguggcucaggucgccugugacguucugcagcuccuggugagcuauugggaaaaacuucaaauguucgagaccucucugccgcgcaagauggcggagauucugguggccacagucgcuuuucuccugcccuccgccgaauacagcucuguggagaccgauaagaaauucaucguuucccuucugcucugccugcucgacugguguauggcucugccugugagcguccuucugcaucccguguccacagccguucuggaagagcagcacucugcccgggcuccucuccuggacuauauuuacagagugcuucacugcugugucugcgggagcuccaccuauacgcagcagagccauuacauccugacacucgcggaucugucuuccaccgacuaugaucccuuucucccucuggccaacgugaagagcucugaaccgguccaauaccacagcuccgcugagcuuggaaaucugcugaccguggaggaagagaaaaagcgccggucucucgaacugauuccccuuacagccagaaugguuauggcccaucuggugaaccaccucggccauuacccucugagcgggggccccgcuauccugcacucccucgucucugagaaucacgacaacgcccauguggaaggaagcgagcuuuccuucgagguuuuucgcagcccuaaucugcagcuguucguguucaacgauucuacccucaucuccuaucugcagacgcccacagaaggcccggucgggggaagcccugugggcucccuuucugacgugcggguuauugucagagauaucagcgggaaauacuccugggacggaaaggugcuguauggcccccucgaggggugucuggcgcccaauggccgcaacccuucuuuucugauuagcuccuggcaccgggauaccuucggaccccaaaaagacagcucucagguggaagagggcgaugacguccucgacaagcuucuggaaaauaucgggcauacauccccugagugccugcucccgagccagcugaaccuuaaugagcccucucugaccccuuguggaaugaacuacgaucaggaaaaggagauuaucgaagugauccucagacaaaaugcucaggaggacgaguauauucagucccacaacuuugauagcgccaugaaaguuacaucucagggccaacccagcccuguggaaccccgggggccguucuacuuuugccgccugcugcucgacgaucuuggaaugaacuccugggacagacggaagaauuuccaucugcugaaaaagaacucuaaacuccugcgcgagcuuaagaaucuggauagcagacagugucgggaaacccacaagaucgccgucuuuuauauugcugagggccaggaagacaaaugcuccauccucagcaacgagagaggcucccaggccuacgaggauuucguggcggggcugggaugggaaguugaccugucuacgcacugcggcuuuauggggggacuccaacgcaauggcagcaccgggcagacagcuccuuacuaugccaccuccacaguggaggucauuuuccaugugucuacccggaugcccagcgauuccgacgauucucuuacgaagaaacugagacaccugggaaacgacgaaguucauaucguguggagcgagcacucccgcgacuaccggagaggcauuaucccuacagccuuuggcgaugucagcaucauuaucuaucccaugaagaaucacauguucuuuauugcuaucaccaaaaagccugaagugcccuucuucgggccgcucuuugacggagccauugugucuggcaagcugcuuccuucccuggucugugcuacaugcaucaacgccagccgcgcgguuaaaugucucaucccccuguaccagucuuucuaugaggagcgggcccuguaccucgaagcuauuauccaaaaucauagagaggugaugaccuuugaagauuucgccgcucagguguuuucccccagcccuucuuauucccuuagcgggaccgacuga

SEQ ID NO: 74621 - RNA, 4476 nt, Artificial Sequence
  derived and/or modified sequence opt5 from RALGAPB__Homo_sapiens__NP_001269847
auguacagcgaguggagaucccugcaccucgugauccagaacgaccaaggccauaccucuguccugcacagcuaucccgaauccguugggcgggagguggccaaugcugugguccgcccucuuggacaggugcugggcacaccgucuguugccgggagcgaaaaccuccugaagacggauaaagaggugaaguggaccauggaagucauuugcuacggacuuacacugccccucgacggcgagaccgugaaauauuguguugauguguacacagacuggaucauggcgcugguccugccuaaggauuccauuccccucccugugaucaaagagcccaaucaguaugugcagaccauucugaagcaucuucaaaaccuguucgucccuagacaggaacaggggucuagccagauccggcucugccugcaaguucuucgcgcuauccagaagcuggccagagaguccagccucauggcccgggaaacaugggaggugcugcugcucuuucugcuucagauuaaugacauccugcucgcuccgcccaccgugcagggaggcauugccgagaaccuggcugaaaaacuuaucggcguccuguucgagguguggcuccuggccuguacgcgcugcuuuccuacacccccuuacuggaagaccgcgaaagaaaugguugccaauuggagacaccaucccgcuguggucgagcaauggucuaaggugauuugugcccugaccucccggcuccugcgcuucacauaugggccgagcuuuccugcuuucaaaguucccgaugaagacgccucucuuaucccucccgagauggauaacgagugcguggcgcagaccugguuuagauuccugcacaugcucuccaaucccgucgaccugagcaacccugccauuaucucuuccacgccgaaguuucaggaacaauuccuuaaugugagcggaaugccccaggagcugaaccaguacccuugucucaagcaucugccccagaucuuuuuccgggcuaugcgcggcauuuccugccuggucgaugccuuucucgggaucucuagaccucggagcgacuccgcucccccgacaccugugaaucgccugagcaugccccaaucugccgccguuuccaccacaccuccccacaacagacggcacagagcugugaccgucaauaaagcgaccaugaagacaagcacggugucuaccgcccaugcuagcaaaguucagcaccagacauccucuaccagcccucuuuccagccccaaccagacaucuuccgaaccgcgcccucugcccgcuccccggagaccuaaggugaacagcauucucaaucuguucggaucuuggcuguucgaugccgccuuuguccacuguaaacuucauaacggcaucaaucgcgacuccagcaugaccgccauuacgacacaagcguccauggaguuccggagaaaggggucucagaugagcaccgacaccaugguguccaacccgauguuugaugcuucugaguuccccgacaauuacgaagccggacgcgccgaggcuugcggcacacucugucggaucuuuugcagcaaaaagaccggcgaagagauccugccugccuaucuguccagauucuacaugcuccugauucaggggcuucagaucaacgauuaugugugccaccccguucuggcuagcgucauucucaauucuccuccccuguuuuguugcgaccugaagggaaucgaugugguggucccuuacuucauuuccgcccuugaaacaauccuccccgaccgcgagcugagcaaauuuaagucuuaugugaacccgacggaacugcggagauccagcaucaauauucuccugucucuucugccucucccccaucacuucggcaccguuaaaagcgaggugguccuggaggggaaguuuuccaacgaugacucuagcuccuacgauaaaccuaucacauuccugagccuuaagcuccgccuggugaauauucugaucggagcgcuccaaaccgaaacagaccccaacaauacccagaugauucugggcgccaugcuuaacaucguucaggauuccgcucugcucgaggccauugggugucagauggaaaugggaggcggcgagaauaaccugaagucucauagccggacgaacuccgggaucucuagcgcuuccggaggcucuaccgagccgacaaccccugacagcgaaagacccgcccaagcgcugcuucgggacuaugauuccgccgcugggcuccugauccgcagcauucaccuggugacacagagacucaauucucaguggcggcaagacauguccaucagccuggccgcucuugagcugcucucuggacuggccaaagucaaggugaugguugauuccggcgacagaaaacgcgccauuagcucugugugcaccuacaucgucuaccaguguucccggccugcuccccugcacagcagagaucuucauuccaugauuguggcggccuuucagugccuguguguguggcucacggaacaccccgacaugcuggaugagaaggacugccucaaagaaguccuggagaucguugagcuugggaucagcggcucuaagagcaagaacaaugaacaggaggugaaauauaagggagauaaagaaccuaacccggcuuccaugcgcgugaaggacgccgccgaggcuacacugaccuguauuaugcaacuccugggcgccuuccccucuccuagcgggcccgcguccccuugcucucuggucaaugaaacaacccuuaucaaauacagcagacugcccaccauuaacaagcauuccuuccgguauuuugugcucgauaauucuguuauccuggcuaugcucgagcagccucugggaaacgagcagaaugacuucuuuccgagcgugacaguccuugugcgcggcauguccgggagacuggccugggcccagcaacucugucugcugccccggggagcuaaggccaaccagaaacuuuucguuccugaaccccgcccugugcccaagaaugaugucggcuuuaaauacagcgugaagcacagaccguucccugaggaaguugacaaaauucccuuugugaaggcggaccugucuauccccgaucuccacgagaucgucacggaggaacuggaggaacggcaugagaaacuccgcuccgggauggcucagcagauugccuaugaaauccaccuggagcaacagagcgaggaggaacuucagaagagaucuuucccugaccccgugaccgauugcaagccuccgcccccugcccaagaauuucagacagcucggcuguuccugucccauuuuggcuuccucagccuggaggcccuuaaagaacccgcuaacucccgccugccuccccaccucauugcccuggacucuaccaucccgggauuuuucgaugacauuggcuaccucgaucugcuuccuugcagacccuucgacacaguguuuaucuucuauaugaagccugggcagaaaaccaaucaggagauccugaagaacgucgagagcucccggacgguucaaccccauuuucuggaguuccuccugagccuuggauggucuguggaugugggcagacacccuggguggacaggacacgucuccaccagcuggucuauuaauuguugcgacgauggcgaagggagccagcaggaagaggugaucuccucugaagacauuggcgcgagcaucuuuaacggacagaaaaagguucuguacuacgccgaugcucucaccgagauugccuucgugguccccuccccgguggagucucugacagacagccucgaauccaacaucagcgaccaagauucugacuccaauauggaucugaugccuggcauucuuaagcagcccagccugacccuggagcucuuucccaaccauacagacaaucugaacuccucucagcgccuuagcccuuccucucggaugagaaaacugccgcaggggcgccccguuccuccccucggaccugaaacgcgggugagcgucgugugggucgagagauaugaugacaucgaaaauuucccccuguccgagcucaugaccgagaucagcacaggcguggaaaccacagcuaacucuuccaccagccugcgcucuacgacccuugagaaggaaguuccugugauuuuuauccacccgcugaauacagggcuguuccggauuaaaauccaaggagccaccggcaaguuuaacauggucauuccccucguggaugggaugaucguuuccagacgcgcccugggcuuccuugugcggcagacagucaucaauauuuguagacggaaacgccuggagagcgacucuuacagcccuccccaugugagacggaagcagaagaucaccgauauugugaacaaauaucgcaauaagcagcucgagccugaguucuacacaucccuguuucaagaaguuggacugaaaaacugcucuagcuga

SEQ ID NO: 74622 - RNA, 2580 nt, Artificial Sequence
  derived and/or modified sequence opt5 from RALGDS__Homo_sapiens__NP_001035827
augaugguggacugccagagcuccacccaagagaucggcgaggaacugauuaacggggucaucuacucuauuagccucagaaagguucagcugcaccauggaggcaauaaagggcagcgguggcuuggauaugaaaacgaguccgcccugaaucucuacgaaacauguaaggugcgcacggugaaagcuggcacccuggagaaacuugucgagcaccuggugcccgccuuccaggggucugaucucagcuauguuacaaucuuucugugcaccuacagagcguucacaaccacacaacaggugcuggaccuccuguuuaaacgguauggacgcugugaugcucuuaccgccuccucuagauacggcugcauucugccuuauagcgacgaagauggcgggccgcaggaccagcucaagaacgccaucuccagcauccugggaacguggcuugaucaauacucugaggacuucugucagcccccugauuuucccugccugaagcagcucgucgcuuacgugcagcugaauaugccuggcuccgaccuggaacggcgcgcccaucuccugcuugcucaacuggagcacagcgagcccauugaagccgagccugaagcgcucucuccgguucccgcccugaaaccuacccccgagcuugaacuggcucucaccccugccagagcucccuccccggugccugcccccgcgccugagcccgagcccgccccuacaccggcucccgggagcgaacuggaggucgccccugcucccgccccugaacugcagcaggcccccgagccggcugugggacucgaaucugcgccugcccccgcucuggagcuugagccugcccccgaacaagauccugcccccucccagacacuggagcucgaaccggcuccugcccccgugcccagccugcagccuuccuggccgucucccgucguugcggagaacggccuuagcgaagagaagccucaucugcucguguuucccccugaccugguggcugagcaguuuacccugauggaugccgaacucuucaaaaaggucgugcccuaucacugucugggguccaucuggagccaacgggacaaaaagggaaaggagcaccuugccccuacgauucgcgcuacaguuacccaguuuaauucuguggccaacugcgucaucacaaccugucugggcaauagauccaccaaagcucccgaccgggcccgcgugguugaacauuggauugagguggcgagagagugccggauccucaagaacuucagcucucuguacgccauucugagcgcccuucaguccaauucuauccaccgccucaaaaagacaugggaagaugucagcagagacuccuuucggaucuuccagaaacugagcgagauuuucucugaugaaaacaauuauucccugagcagagagcuccugaucaaggaaggcacgucuaaauucgcuacccuugagaugaacccgaagcgcgcucaaaagcggccuaaagagacagggauuauccagggaaccgugcccuaccugggcacauuccucaccgaccuggucaugcuggauacggccaugaaggacuaucuuuacgggagacucauuaauuuugaaaaacgccggaaggaguucgaagugaucgcgcagaucaaacugcugcaguccgccuguaacaacuauagcauugcuccugaugagcaauuuggagccugguucagagcuguugaacgccucuccgagacagagucuuacaaucugagcugcgaacuugagcccccguccgaaucugccagcaacacccugcggaccaagaagaauacagccaucgugaaaagaugguccgaccgccaggcuccuagcaccgagcucucuacauccggcagcucucauuccaagagcugcgaucagcugcggugugggcccuaccugucuagcggagacauugcggaugcccuuuccguccacagcgcuggcagcuccagcuccgacguggaagagaucaacauuucuuuuguuccugagagccccgacggccaggaaaagaaguucugggaguccgccucucaaagcucccccgaaacgucugggaucagcuccgccucuucuuccaccucuagcuccagcgcuucuacaaccccuguggccgcgacaagaacccacaaacgcuccgucagcggacucugcaauuccagcucugcucugccgcuguauaaccaacaggugggcgauuguugcaucauucgggugagccucgacguugauaaugggaacauguacaaguccauccuggucacgucucaggacaaggcccccgccgugauuagaaaagcuauggauaagcauaaucuugaggaggaggaaccugaagacuaugagcugcuccagauccugagcgaugaccggaaacugaagauucccgaaaacgccaauguguuuuacgcgaugaacuccaccgcuaauuaugauuucguccuuaaaaagcgcacauuuaccaagggagugaaaguuaagcacggcgccucuagcacacucccuagaaugaaacagaaggggcugaaaaucgccaagggcauuuucuga

SEQ ID NO: 74623 - RNA, 1590 nt, Artificial Sequence
  derived and/or modified sequence opt5 from RALGPS1__Homo_sapiens__NP_001177657
auguacaagagaaacggccugauggccagcgugcucgucaccuccgcuacaccccaggggucuagcuccucugacagccuggagggacaauccugcgauuaugccucuaaaagcuacgacgcgguuguguucgaugugcuuaaggucacgccugaagaguuugcuucccagaucacccugauggacauuccgguguucaaagccauccagcccgaggaacucgccagcuguggcuggucuaagaaagaaaagcacucccuggcuccuaauguuguggccuuuacacggcgcuucaaccaggucagcuuuugggugguuagagagauucuuaccgcucaaacacugaagauccgggccgagauucucucucauuucgugaaaaucgcgaagaaacugcuggaacucaauaaccugcacucccuuaugagcgucgugucugcccugcaguccgcucccaucuuucgccucaccaagacaugggcccugcuuaauagaaaagauaagaccacguucgagaagcuggacuaucucaugagcaaagaagauaacuacaagcggacccgcgaguauauuagaucccugaaaauggugccuucuauccccuaccuggggauuuaucuccuggaccuuaucuacauugauagcgcuuacccugccuccggaagcaucauggagaaugaacagcggucuaaccagaugaauaacauucugcgcaucaucgcggaccuccaagucuccugcagcuaugaucaucugacaacccuuccgcacguucagaaguaccugaaaucugugagauauauugaggaacuccagaaguuuguggaggacgauaauuacaaacugagccugcggaucgaacccggcuccucuagcccucgccucgucuccagcaaggaggaccuggccgggcccucugcuggauccggcagcgccagauucucucggcgcccuacaugucccgacaccuccguggcuggcagccuuccgacgccucccguuccuagacaucggaagucccacucucuggggaacaauagaggacgccucuaugccacacugggccccaacuggcgggugcccgucagaaauagcccucgcacccgguccugcguguacucuccgacagggcccuguauuugcagccuuggaaacuccgccgcuguuccuaccauggagggcccccugagacgcaaaacccuccugaaggaagggcggaaaccugcgcugagcucuuggacaagauauugggugauccucuccggaagcacgcugcuuuacuacggcgccaagucucugcgcggcaccgaucggaaacacgucuccauugugggguggaugguccagcuccccgacgauccggagcauccugacaucuuucaacugaacaaucccgauaagggaaacguguauaaguuccagacaggcagcagauuucacgcuauccuguggcauaaacaccuugacgaugccuguaagucuaaucgcccucaggaagccggggcugcccccggaccuaccggcacagacagccacgagguugaucaucucgaagggggagcgggcaaagaggcuggccccugcgccuga

SEQ ID NO: 74624 - RNA, 873 nt, Artificial Sequence
  derived and/or modified sequence opt5 from RALY__Homo_sapiens__NP_031393
augagccugaagcuccaggccuccaacgugaccaauaaaaacgaccccaagucuaucaauagcagagucuucauuggcaaccugaauacagcucuuguuaaaaaguccgauguggagacgaucuuuucuaaauacgggcggguggccggaugcagcguccacaagggcuaugcguucgugcaauacuccaacgaacgccaugcuagagccgccguucugggggagaauggacgggugcucgcuggccagacccuggacauuaacauggccggggaaccuaagccggaucgccccaaaggacuuaagagagcugccucugcgaucuaucggcuguuugacuaccgcggcagacucagcccuguccccgugccucgggccguucccgugaaacgcccuagagucacagugccgcuggugcggcgcgucaagaccaauguucccgugaaacuguucgcuagauccacagccgugaccacaagcucugcuaagauuaagcucaaauccagcgagcugcaggccaucaagaccgaacuuacgcagaucaaaucuaacauugaugcgcugcucucccggcuggagcaaaucgccgcugagcagaaggccaauccugacggcaaaaagaaaggggauggaggcggggcuggaggcgggggaggcggcgggggaagcggcgggggaggcucugggggaggcggcgggggaggcuccagcagacccccugcuccccaggaaaacaccacauccgaggccgggcuuccgcagggagaagcccgcacccgggacgauggcgacgaggaggggcugcucacacacucugaagaggaacuggagcauagccaagauaccgacgcggaugacggcgcccugcaguga

SEQ ID NO: 74625 - RNA, 915 nt, Artificial Sequence
  derived and/or modified sequence opt5 from RALYL__Homo_sapiens__NP_001093861
augagcaagagacggcgccugaaacagggcgagcccaucaugaccgggaagacacaaacguccaacgugaccaauaaaaacgacccuaagucuauuaauagcagagucuucaucggaaaccucaauacagccauuguuaaaaagguggauaucgaagcuaucuuuuccaaguacggcaaaauuguggggugcucuguccacaagggauaugccuucgugcaguacaugagcgagcggcaugcgcgcgcugccguugccggcgaaaacgcuagagugaucgccgggcagccgcuggacauuaauauggcuggagagcccaaaccuuaucggcccaagccuggcaacaaacgcccccuuuccgcccuguacagacucgaaucuaaggagccuuuucugagcgucggcggguauguguucgauuacgacuauuaccgggaugacuuuuacaaucgccuuuucgauuaucacggaagaguuccgcccccuccccgggcggugaucccucugaagcgccccagagucgccgugaccacaacccggcgcggcaaagggguguuuuccaugaagggaggcagcagaucuacagcuuccgggagcaccggaucuaaacucaaguccgacgagcugcagacgauuaaaaaggaacugacccaaaucaaaacaaagauugauagccuccugggccggcuugagaagaucgaaaaacagcagaaggccgaggcugaggcccagaaaaagcaacuggaagagucucucguccugauucaggaagaguguguuuccgaaaucgcggaccauagcaccgaggagccggccgaaggcgggccugaugcugacggagaggaaaugacagauggcaucgaggaagacuucgacgaggaugggggacacgagcuuuuucugcagauuaaauga

SEQ ID NO: 74626 - RNA, 447 nt, Artificial Sequence
  derived and/or modified sequence opt5 from RAMP1__Homo_sapiens__NP_005846
auggccagagcucugugccggcucccccgcagaggccuguggcuucugcucgcccaccaucuguucaugaccacagcgugucaggaggcuaacuacggggcccuucugcgggaacucugccugacgcaauuucagguggacauggaggccgucggagaaacccuguggugugacuggggccgcacaaucagaagcuaucgggagcucgcugacugcaccuggcacauggccgaaaagcugggguguuucuggccuaaugcugagguugaucgcuuuuuccuugccgugcauggaagauacuuucgguccugcccgauuucuggccgcgcggugagagaucccccugggagcauccuguaucccuucauugucgugccuaucacaguuacccuccuggugacagcccuugucguguggcaguccaaacggaccgagggaauuguuuga

SEQ ID NO: 74627 - RNA, 528 nt, Artificial Sequence
  derived and/or modified sequence opt5 from RAMP2__Homo_sapiens__NP_005845
auggccagccugagaguggagcgggcuggcgggccccgccucccuagaacccgggucggacgcccggccgcgcugagacuucugcuccugcuuggcgcuguucugaacccccacgaagcccucgcccaaccucugcccacaacggggaccccuggauccgagggcgggacagugaagaauuacgaaaccgcugugcaauucugcuggaaccauuauaaagaccagauggaucccaucgagaaggacuggugugauugggccaugauuucucggccuuacagcacacugcgcgacugccucgaacacuuugcugagcuguucgaucuuggauuuccgaauccccuggccgagagaaucauuuucgaaacccaucagauccacuuugcgaacuguucccucguccagccuacauucucugaucccccugaggacgugcugcuugccaugauuaucgcucccaucugccugauuccguuucucaucacccugguuguguggcggagcaaagacuccgaagcccaggcuuga

SEQ ID NO: 74628 - RNA, 447 nt, Artificial Sequence
  derived and/or modified sequence opt5 from RAMP3__Homo_sapiens__NP_005847
auggagaccggcgcccugagacggccccagcuccugccucuucugcuccugcuuugcgggggauguccgcgcgcuggcgggugcaacgaaacaggaaugcuggagagacucccccuguguggcaaggccuucgcggacaugauggggaaaguggaugucuggaaguggugcaaucugagcgaauuuaucguuuacuaugaguccuucacgaacuguaccgaaauggaggcuaauguggugggaugcuacuggccuaacccccucgcccaaggcuuuauuacaggcauccaccggcaguucuuuucuaauuguaccgucgaccgcgugcaucuggaggauccucccgacgaaguucuuauuccucugaucgugauuccggucgugcucacaguugccauggcugggcugguggucuggagaagcaaacggaccgauacacuucuguga

SEQ ID NO: 74629 - RNA, 1863 nt, Artificial Sequence
  derived and/or modified sequence opt5 from RANBP10__Homo_sapiens__NP_065901
auggccgcugccaccgcggaccccggcgcugggaacccucagccgggagauagcuccggcgggggagccggcgggggacugcccucuccuggcgagcaagaacucagcagacggcugcagcgccuuuaccccgccgugaaucagcaggagacaccucugcccagauccuggucuccuaaggacaaauauaacuacaucggccucagccaagggaaucugcggguccacuauaagggacauggcaaaaaccacaaggaugcugccuccguucgcgcuacgcauccgauucccgccgcgugcgggaucuacuauuucgaagugaaaauugugucuaagggaagagacggcuacauggggaucggacuuagcgcccagggcgucaauaugaaccggcugccuggcugggauaagcacuccuauggguaccauggagacgauggccacagcuuuuguucuuccgggaccggacagcccuacggcccuacauucaccacaggggacgugauuggaugcuguguuaaucucaucaacggcacaugcuuuuauaccaaaaauggccacagccuggggaucgcuuucaccgaucugcccgccaaccucuacccgacggugggacugcagaccccuggcgagauugucgacgcuaauuuugggcaacagcccuuccuuuuugauaucgaagacuauaugcgcgaguggagagccaaggugcagggaacaguucauuguuucccuauuucugcgcggcugggcgaguggcaggccgugcuccaaaacauggucuccagcuaccuggugcaccauggguauugcgcuaccgccacagcuuuugcccgcaugaccgaaacgcccauccaggaggaacaggccucuauuaaaaauagacaaaagauccagaaacuugugcuggagggccgggucggagaggcuauugaaacaacccagcgcuucuaccccggccuccuggagcacaacccuaaucugcucuuuaugcugaaguguagacaguucguugaaauggugaacgggacagauuccgaggugcggagccuuuccucucgcagcccgaagucccaagacagcuaucccggaucuccuucccugagccccagacacggcccuucuagcucccauaugcacaacaccggggcggacucucccagcugcuccaauggagucgccagcaccaaaucuaagcagaaccauuccaaauacccggcuccuagcagcuccagcuccucuagcuccucuagcuccucuucuucccccagcucugugaauuacuccgaaagcaacucuacagauagcacgaagucccagcaccauagcucuaccuccaaucaggagacaagcgacuccgagauggaaauggaggccgaacacuauccuaacggcguucucgggucuaugagcacccggaucgugaauggcgccuacaaacacgaggaucugcaaacagacgaauccucuauggaugacagacauccccgccggcagcuuuguggaggcaaccaggcugccaccgagagaaucauucuguuugggcgcgagcuccaggcgcugagcgaacaacugggacgggaguauggcaagaaucucgcucacacggaaaugcugcaggaugccuucucccuucuggccuacucugacccuuggagcugccccgucgggcagcagcucgauccgauccaaagagagccugugugugcugcccugaacuccgcuauucuugaaagccagaaucugcccaaacagcccccucucaugcuggcccugggacaagcgucugagugccuccgccugauggcccgggcuggccuuggguccugcagcuucgccagaguugacgauuaucugcauuga

SEQ ID NO: 74630 - RNA, 3267 nt, Artificial Sequence
  derived and/or modified sequence opt5 from RANBP17__Homo_sapiens__NP_075048
auggcccugcacuuccagagccucgcugagcuggaagugcuuugcacccaucuguacaucggcacagaccucacgcaaagaauugaggccgaaaaggcgcugcuugagcugaucgauucccccgaaugucucucuaaaugccagcugcugcucgagcaggggaccacaagcuaugcucagcugcuugccgccaccugucuguccaagcucgucucucggguuagcccucugccgguggagcaacgcauggacauuagaaacuacauccuuaauuauguggcuucccagcccaaacuggccccuuuugucauucaggcucucauccaggugaucgccaagauuacaaaacugggaugguucgaaguucaaaaggaucaguuuguguuccgggagaucauugcggacgucaagaaauuucugcagggcaccguggaacacugcaucauugggguuaucauucucucugagcugacacaggagaugaaccuuguggauuacagccgccccuccgccaagcauagaaaaaucgcuaccagcuuccgggacacgucucugaaggauguccucgugcuggccuguucccuucugaaagaaguguuugcuaagccucucaaucugcaagaccagugccagcaaaaccuggucaugcagguucucaagcuggugcuuaauugucugaacuucgauuuuaucggaagcucugccgacgaguccgcggaugaccucugcaccgugcagauucccacaaccuggcgcacaaucuuccuggaaccugagacccuugaucuguuuuucaaucucuaucacagccugccgccccugcucucucagcuggcccuuuccugucugguccaauuugcuagcacgagacggucccucuucaacucuccugaacgcgccaaauaccugggcaaucugauuaagggggugaaaagaauccuugagaacccccagggacucagcgacccuggcaauuaucaugaguucugccgguuucuggcucgccugaagacaaacuaccagcucggcgaacugguuauggugaaagaguaccccgaagucauuagacuuaucgccaauuucaccaucacaucccugcagcacugggaguuugccccgaacagcgugcacuaucuccugacccuguggcaacggaugguugcuucugugccuuucgucaaguccaccgaaccccaucuucucgacacauacgcgccugagauuacgaaagccuuuaucaccagccgccuggauucuguggcuauugucgugagagaccaccuggaugacccccucgaugacacagccaccguuuuccagcagcuggagcagcuuuguacagugagccggugcgaauaugagaagaccugcgcccugcucguccaacuguuugaucagaaugcucagaacuaccagaagcugcuucaucccuauuccggggugacgguugacaucacaauucaagaaggaagacucgccuggcugguguaccuggucggcaccgugguugggggacgccucaccuauacaucuaccgaugagcacgacgcgauggauggcgaacugagcugucggguguuccagcuuaucucccugauggacacagggcucccuagaugcuguaacgagaaaaucgagcuggcuauucugugguuucuugaccaguuccgcaagacguacgucggagaucaacuccagcggaccagcaaaguguacgccagaaugucugaagugcugggcaucacagacgauaaucacguccuggagaccuuuaugacaaagauugugaccaaccucaaauauuggggccgcuacgaaccgguuaucucccggacgcugcaguuccuuaaugaccugagcgugggguauauucuccugaagaagcuggucaaaaucgaugccgugaaguuuaugcuuaaaaaccauaccucugagcacuuccccuuccugggaauuuccgacaaucauagccucuccgauuuuagaugccgcacaaccuucuacacagcucugacccggcuccugaugguugaccuuggcgaggaugaagacgaguuugaaaacuucaugcugccucucacgguggccuuugagacaguccugcagaucuucaauaacaauuuuaagcaagaagaugugaaaagaaugcugaucgggcuugcucgcgaccugcggggaauugccuucgcgcucaacaccaagacaucuuauaccaugcuguuugauuggauguaccccaccuaucucccucugcuucagaaugccguugagagaugguacggcgagcccacauguacgaccccgauccugaagcucauggcugaacugaugcagaaccggagccagcgccugaauuucgacguguccucuccuaacgggauucuucuguuuagagaggccagcaaaauggucugcacauacggaaaucaaauccucucccugggcagccucucuaaggaccagauuuaucccaugaaacugaagggcaucuccaucuguuacagcgcucuuaaaucugcccugugcgggaacuauguguccuucggaguguuuaagcuguacggcgauaaccacuucgacaauguccuccaggcguucguuaagaugcugcuuagcgugucucauagcgaucugcuccaguaucggaaacugucccaaagcuacuauccucuccuggaaugucuuacccaggaccacaugucuuuuauuaucaaccuggagcccccugugcugauguacguccucacauccauuagcgaagggcugaccacgcuugauacagugguuuccucuagcugcuguaccucccuggacuacaucgugaccuaucucuucaagcacauugccaaagagggaaagaaaccccugagaugccgcgaggcuacacaggccggccaacggcuccugcauuuuaugcagcagaauccggauguccuucagcaaaugaugucugugcugaugaacaccaucguuuucgaagacugcagaaaucaguggagcgugucccgcccucugcucgggcugauccuucugaacgagaaguacuuuucugaacucagagcuagccugauuaauucccagccccuccccaaacaggagguccuggcccaauguuuccggaaccuuauggaaggcguggagcagaaucugagcguuaagaaccgcgauagauuuacacagaaucugucuguguuccggcgcgacgucgccgaggcucucagauccgauggaaacacggaaccuugcagccuggacaugaugucuuga

SEQ ID NO: 74631 - RNA, 606 nt, Artificial Sequence
  derived and/or modified sequence opt5 from RANBP1__Homo_sapiens__NP_002873
auggccgcugccaaggacacccacgaggaucaugacacaagcacggaaaacaccgaugaguccaaucacgacccccaguucgaaccuaucgugucucugccggagcaagaaauuaaaacacucgaggaggaugaagaggaacuguuuaagaugagagcgaaacuuuuccgguuugcuagcgagaacgaccugcccgaguggaaggaacgcggaaccggggaugucaaacuccugaagcauaaggagaaaggagccaucagacuucugaugcggcgcgacaagacacucaaaauuugcgccaaucacuacaucaccccuaugauggaacugaagcccaacgcuggcuccgauagagccuggguuuggaauacacaugcugacuucgccgaugaguguccuaaacccgaacugcucgcgauucgguuucugaacgccgagaaugcucagaaguucaagaccaaauuugaggaaugccgcaaggagaucgaagagagagagaaaaaggccgggucuggcaaaaacgaccacgcugaaaagguggccgagaaacuugaagcgcugagcgugaaggaggaaacgaaggaggaugccgaagagaaacaguga

SEQ ID NO: 74632 - RNA, 9675 nt, Artificial Sequence
  derived and/or modified sequence opt5 from RANBP2__Homo_sapiens__NP_006258
augagacggagcaaggccgacguggaaagauacauugcuuccguccagggaucuacccccagcccuagacaaaaguccaugaagggguucuauuuugccaaacuguacuaugaagccaaggaguacgaucucgcuaaaaaguauauuugcaccuacaucaacguucaggaacgggaccccaaggcccaccgcuuccugggacuucuguaugagcucgaagagaauacggauaaagccguggaguguuacagacggucuguggaacugaaccccacccagaaggaccuuguccugaaaauugcugagcuccugugcaagaaugaugugacagacggccgcgccaaauacuggcuggaaagagcugccaagcucuuuccugggagccccgcgaucuauaagcugaaagagcagcuucuggauugugagggagaagacggcuggaacaagcuguucgaucugauucaauccgagcuuuacguucggccugacgaugugcaugucaauauccgccugguggaaguuuauagaucuaccaaacggcucaaggacgccguggcucacugccaugaggccgaacgcaacaucgcucugagaagcucccuggaguggaauagcugugucgugcagacacucaaagaguaccuggaaucucuucagugccuggaguccgauaagagcgacuggcgggccaccaacacagaccuccugcuugcguaugccaaucugaugcuccugacccugucuacgcgcgaugugcaggaauccagagagcuccugcagagcuuugacucugcccuucaguccgucaaaagccucgggggaaacgaugaacucuccgcuaccuuccuggagaugaagggccacuuuuacaugcaugcuggcucucuucugcucaagauggggcagcacagcuccaauguucaguggcgggcccugagcgagcuggccgcucucuguuaucugauugcguuccaagugcccagaccuaaaaucaaacuuauuaaaggagaagccggccagaaccugcucgagaugauggcuugcgaccgccugucucaguccgggcacaugcugcuuaaucucagccggggaaagcaagauuuucugaaagaaaucguggagacauucgccaacaagucuggccagagcgcccuguacgacgcucucuuuuccucucagagccccaaggauaccuccuuccuggggagcgacgauauuggaaauaucgacgucagagaacccgagcuugaggaucugacacgcuacgacgugggcgccauucgggcgcauaacggcucucuccagcaccugaccuggcuggggcuucaauggaacucccucccugcucugcccggaaucagaaaauggcugaagcagcucuuucaucaucugccucacgaaacgagccgccuugagacaaaugcccccgaaucuaucuguauucuggaccucgagguuuuccugcugggcguggucuauaccucccaucuucagcucaaagagaagugcaacagccaccauuccucuuaccagccgcugugucugccucuccccgugugcaaacaacugugcacagaacggcaaaagagcuggugggaugccguuuguacccuuauccacagaaaggcugugccugggaaugucgccaaacugcgccuccuggugcagcaugagauuaacacccugcgggcucaggaaaagcacggacuucaacccgcccuccugguccacugggcggagugccugcagaaaacaggcuccgggcucaauucuuucuaugaccagagagaauacaucggacgcagcgugcauuauuggaagaaaguucugccccuucugaagauuaucaagaaaaagaacuccaucccugagccgauugauccccucuuuaaacacuuccauagcguggacauccaggccucugagauugucgaauacgaggaagaugcucacaucacguuugccauucuggacgcugugaauggcaacaucgaggaugccguuaccgcguucgaauccaucaagagcguggucucuuauuggaaucuggcccuuauuuuucaccggaaagcugaggacaucgagaacgaugcccuguccccugaagaacaagaagaguguaagaauuaccucagaaaaacacgggacuaccugauuaagaucauugaugacagcgauucuaaccucagcguggugaagaaacugcccguuccucuugaauccgucaaggagaugcugaauagcgugaugcaggagcucgaagacuauucugagggcgggccccuguacaaaaacggaucccugcgcaaugcugacagcgaaaucaagcauuccaccccgucuccuacaagauauagccuuucccccucuaaaagcuacaaguauuccccuaagaccccgccucggugggccgaggaucagaacucucugcucaaaaugauuugccaacagguggaggccaucaagaaagaaaugcaggagcugaagcucaacagcuccaauagcgcuucuccccacagauggccgacggaaaacuacggcccugacuccguccccgauggguaucagggaagccaaacauuccauggcgcgccccugaccguggccaccacagggccuucuguuuacuacucccagagcccggcuuauaauucucaguaccuucugcgccccgccgccaacgugaccccuacaaaaggccccgucuauggaaugaaucggcucccuccccagcaacacaucuacgcuuauccucagcagaugcauacgcccccggugcaguccagcuccgccuguauguuuagccaagagauguacggcccucccgcgcugagauucgaaucuccugcuaccgggauucugagcccccgcggagacgauuauuuuaacuacaauguucagcagacauccaccaacccgccucuucccgagccuggcuacuucacaaagccgcccaucgccgcccacgcuucuagaagcgccgaguccaagaccauugaauuugggaaaacgaauuucgugcaaccuaugccgggagagggccugcggcccucucucccuacccaggcgcacacaacccagcccacaccuuuuaaguucaacagcaauuucaaauccaacgacggggauuuuaccuucucuagcccccaggucgugacgcaaccuccgcccgcugccuauuccaauagcgaaucucugcucggccugcuuacauccgacaagccucugcagggagauggcuacagcggggccaaacccaucccuggaggccagaccauugggccccgcaacacauuuaauuucggaucuaagaacguuuccggcaucagcuuuaccgagaacaugggguccucucagcaaaagaauagcggcuucagacgguccgacgauauguuuaccuuccauggaccgggcaaaagcguguuugggacaccuacgcuggaaaccgcuaacaagaaucacgagacagacggaggcucugcccauggggaugacgacgaugacggaccccacuucgagcccgucgugccucuccccgauaaaaucgaagugaagaccggcgaggaagacgaggaagaguuuuucugcaaccgcgcuaaacuguuuagauucgaugucgaguccaaggaauggaaagagcgggggauuggcaauguuaagauccuucgccauaagacaagcggaaaaauuagacugcucaugcggcgcgaacaggugcugaagaucugugccaaccacuauauuucuccugacaugaaacucaccccgaaugcgggcagcgauagauccuucguguggcacgcccuggacuacgcugaugagcuucccaagccugagcagcuggccauccgguuuaaaacgcccgaagaggcugcccuguucaagugcaaguuugaagaggcccagucuauccucaaagcuccugggacaaacgucgcgauggccagcaaucaagcugugagaauuguuaaggaacccaccucccaugacaacaaagauaucuguaagucugacgccggaaaucugaacuucgaguuucagguggccaaaaaggagggcagcugguggcacugcaauuccuguagccuuaagaacgcuucuaccgccaaaaagugcgucuccugccagaaucugaacccgagcaacaaagaacucguggggccuccccuggcggagacaguuuucaccccuaagacaucccccgaaaaugugcaggaccgcuuugcucucgucacgccuaaaaaggagggacauugggauuguucuauuugccuggugcggaacgaacccaccguuagcagauguaucgccugccaaaauacaaaguccgccaacaaaucuggcagcuccuucgugcaccaggcuagcuuuaaguucggccagggggaccuuccgaaaccuauuaauucugauuuucgcuccgucuucagcaccaaggagggacaaugggacuguucugccugccuggugcagaacgagggcuccagcacaaaaugugcggcuugccagaauccccggaagcagucucugcccgccaccagcaucccuacgccggccuccuucaaguuugggaccucugaaacaagcaaaacccucaaguccggauucgaggauauguuugcuaaaaaggaaggccaaugggacuguagcuccugccuggugagaaacgaggccaaugcuacacgcugugucgccugccagaaccccgauaaaccuucucccagcaccuccguuccugcgcccgccucuuucaaguuugggacaagcgaaaccuccaaagcuccuaagucuggauucgagggcauguuuacgaagaaagagggccagugggacugcagcgugugucuugugcggaaugaagccuccgcuacaaagugcaucgccugucagaacccggggaaacaaaaucagaccaccagcgccgucucuacacccgcuuccagcgagaccucuaaggcgccuaaauccggauucgaaggcauguuuacgaagaaggaggggcagugggauugcagcgugugucugguuagaaacgaggccucugcuacaaaaugcauugccugucagaaucccggaaagcaaaaccagaccacauccgccgugagcaccccugcuuccagcgaaacaucuaaagcccccaagagcggcuucgaggggauguuuaccaaaaaggaaggacagugggacugcuccgucugucucgugcgcaaugaggcgucugcuacgaagugcaucgccugucaaugcccgagcaaacagaaccagaccacagccauuuccaccccugcuucuagcgaaaucuccaaggcccccaaaucuggcuucgagggcauguuuauucggaaggggcagugggauugcagcguuuguugcgugcaaaacgaguccagcucucugaaaugugucgcgugcgacgccuccaagcccacacacaagccuaucgcugaagcccccagcgcuuucacccucggaucugagaugaaacugcaugauuccagcggcucccagguggggacgggauucaagucuaauuuuagcgaaaaagccuccaaguucggcaacacagagcagggguuuaaauucggacacgucgaccaggaaaauagcccuucuuuuauguuccaaggcuccagcaacaccgaguuuaagucuacaaaagagggcuucagcauuccgguguccgcugacggguuuaaguucggaaucucugaacccggcaaucaggagaagaaaagcgaaaagccucuugagaacgggaccggauuucaggcccaggauaucuccggccagaagaaugggagaggaguuauuuucggccagaccucuagcacauuuacguucgcggaccuggccaaguccaccagcggcgaaggguuccaguuuggcaagaaggaucccaacuucaagggcuuuucuggggcuggagagaaacuguucuccagccaguauggcaagauggccaauaaagcuaacacauccggggacuuugagaaggaugacgaugccuacaaaaccgaagacucugaugacauccauuucgagccugugguccaaaugcccgaaaagguggagcucguuacaggagaggaagaugagaaggugcuguauagccagcgggucaaacuuuuucgcuucgacgccgaagugucccaguggaaggagagaggccugggcaaucucaaaauucugaagaacgaagugaaugggaaacugcggaugcucaugcgcagagagcaaguucuuaaggucugugcuaaccacuggaucaccacgacaaugaaucugaagccgcugucuggaagcgaucgggcguggauguggcucgccuccgacuuuagcgacggcgaugcuaaacuggagcagcuugccgccaaguucaaaaccccugaacuggcugaggaauuuaagcagaaauucgaggaaugccagagacuccugcuggacauuccccuccaaaccccucauaaacuuguggauacagggcgcgccgcgaaacugauccagcgggccgaggagaugaagucuggacugaaggacuuuaaaaccuuccucacaaacgaucagacgaaggugaccgaagaggaaaacaaaggcuccgggacaggagcugccggcgcuagcgacaccacaaucaagcccaauccugagaacaccggccccacgcuggaaugggauaauuacgaccuuagagaggaugcccuggacgauucugucuccuccucuagcgugcacgcgagcccgcucgccucuagcccuguucgcaaaaaccuguuccgguuuggggaguccaccacaggauucaauuuuagcuucaaguccgcucugucucccagcaagucccccgccaaacucaaccagucuggcaccagcguggggacagacgaagaguccgacgucacccaagaagaggagagagauggacaguacuuugaaccugugguuccgcuucccgaccugguggaggucucuagcggcgaagagaaugaacaggugguuuucucccaccgcgcuaagcuguaucgguacgauaaagacguggggcaguggaaggagagaggcauuggagauaucaaaauucuccaaaacuaugacaauaagcagguccgcaucgugaugagacgggaucaggugcugaaacuuugugccaaccaucgcauuacaccugacaugacgcugcaaaauaugaaaggcaccgagagagucuggcucuggacagcuugcgauuuugccgacggggaacggaagguugagcaccuggcggugcgcuucaaacugcaggauguggccgacagcuuuaagaaaaucuucgaugaagcuaagaccgcccaggagaaggacucucucaucacaccccacgucuccagaagcucuacaccucgggaaucccccuguggaaaaauugcuguggccguucuugaggagacgaccagagaacgcacagacgugauccagggcgaugacgucgccgaugcgaccagcgagguggaaguuucuuccacaagcgagaccacgccuaaggcuguggucucucccccgaaauuuguguucggguccgaaagcgucaagagcaucuuuuccucugagaaaagcaagccuuucgccuucggaaacuccucugcuacaggcagccuguuuggguucuccuuuaaugcgccccugaagucuaacaauagcgagaccuccagcguggcccaaucuggcuccgaaagcaaaguugagccuaagaaaugcgaacucucuaagaacuccgacaucgagcagagcuccgauucuaaagugaagaaccuguucgcuagcuuucccaccgaggaauccucuauuaauuacacauucaaaaccccggagaaggccaaggagaagaagaaaccugaggacagccccuccgaugacgaugugcuuaucgucuaugaacugacacccaccgcggagcagaaggcccucgcuacgaaacugaagcugccucccacauuuuucuguuacaagaaccggccugacuauguuagcgaggaagaggaagaugacgaggacuuugaaaccgccgugaaaaagcucaauggaaaacuuuaccuggauggcucugagaagugcagaccgcuggaggaaaacacagcugacaaugagaaagaaugcauuaucgugugggagaagaagcccaccgucgaagagaaagccaaggcggauacgcucaaacugccucccaccuucuuuuguggggugugcuccgacacagaugaggacaacggaaauggcgaagauuuccagagcgagcuucaaaagguucaggaagcccagaaaucucagaccgaggagaucacaagcaccacagacuccguguacaccgggggaacggaagucauggugccuucuuuuuguaagagcgaggaacccgauuccauuacaaagagcaucucuuccccuagcgucuccucugagaccauggacaaaccgguggaucugagcacccgcaaggaaauugacacagauuccaccucucaaggcgagagcaaaaucguuuccuucggguucggcucuagcacaggacucuccuuugcugaccuggccagcucuaacuccggcgacuucgcuuuugggagcaaggauaaaaauuuccagugggccaacacgggagcugccguguuuggcacccagucugucgggacacaauccgcgggaaaggugggcgaggacgaagauggcagcgacgaggaaguugugcacaaugaggauauucacuucgaacccaucgucucucugccugagguggaggugaaaagcggggaagaggacgaagagauccucuuuaaggaacgggccaaacuuuauagaugggaucgggacguuucccaguggaaagagcgcggagucggcgauauuaagauccuguggcauaccaugaaaaacuacuaucgcauucugaugcggcgcgaccagguguucaaggugugcgcuaaucacgucaucacaaaaaccauggagcucaagccccugaacguuagcaauaacgcccuuguguggacggcuuccgauuacgccgacggggaagccaagguggagcagcuggcggucagauuuaaaaccaaggaaguggcugauuguuucaaaaagacauuugaggagugccaacagaaccucaugaaacugcagaagggacauguuucucuggccgccgaacucagcaaggagaccaauccuguggucuucuuugacgugugugcugacggcgaaccccuugggcggauuacaauggagcuguucuccaacaucguuccgcgcaccgccgaaaauuucagagcucugugcacgggagagaaaggcuuuggcuucaagaacucuaucuuucaccgggugauuccugauuucgucugucaagggggagacaucacaaaacaugauggcaccgggggacaaagcauuuauggcgacaaguuugaggaugaaaauuucgacgugaaacacacagggcccggacuccuguccauggccaaccagggccagaauaccaacaauucucaguuugugaucacccuuaagaaggcggagcaccuggauuucaaacaugucguuuuuggcuucgugaaggacgggauggauacagugaaaaagauugagagcuuuggaucccccaaaggcagcgucugccgcagaaucacgauuaccgagugugggcaaaucuga

SEQ ID NO: 74633 - RNA, 1689 nt, Artificial Sequence
  derived and/or modified sequence opt5 from RANBP3__Homo_sapiens__NP_003615
auggccgaccuggcuaacgaggaaaagcccgccaucgcgccuccgguguucgucuuucagaaagauaagggccaaaagagccccgcugagcagaagaaucucuccgacucuggggaggaaccuagaggagaagccgaggcuccccaccauggcaccgggcacccugagagcgccggagaacaugcccuggagcccccugcuccggccggcgcguccgccucuacacccccucccccugcucccgaagcccagcuuccgccuuucccccgggagcuggcugggcgcagcgccggaggcuccucuccugagggcggggaagauagcgacagagaggauggaaacuacugcccucccguuaaacgggaacgcacguccagccucacccaguuucccccgucucaauccgaggaaagaagcucuggcuuccggcugaagcccccuacacuuauucacgggcaggcgcccuccgccggacugccuagccagaagcccaaagagcagcaacgcucugugcucagaccggcugugcugcaggccccucagcccaaggcucugucccagaccgucccuagcuccggcacaaauggggugucucuccccgccgacuguaccggagccguuccugcugcgagccccgauacagccgcuuggcgguccccgagcgaggccgccgacgaagagaaagaaccucaaaagaacgagucuuccaaugcuagcgaagaggaggccugcgaaaagaaggaucccgcgacccagcaggcuuuuguguucggccaaaaccugcgcgacagagucaaacuuaucaaugagucuguggaugaagccgacauggagaacgccggccaucccagcgcugauacgccuaccgccacaaauuauuuucugcaguacauuuccucuagccucgaaaacuccaccaauagcgcugacgccucuuccaacaaauucguuuuugggcagaauaugagcgagcgggugcugucuccgcccaaacuuaacgaggucuccagcgacgcgaaucgcgaaaacgccgcugccgaguccggaucugaaagcuccucucaggaggcuacaccugagaaagaaagccuggccgaguccgcggccgcuuauaccaaggccacggcuagaaaaugucuccuggaaaagguggaggugaucacaggcgaagaggccgagagcaacguccugcaaaugcagugcaaacucuucguuuuugauaagaccucucaguccuggguggaacgggggcgcggacugcuuagacugaaugacauggccagcacagaugacggcacccuccagucucggcuggugaugagaacccaagggucccuucgccugauucucaacacaaagcugugggcucagaugcagaucgauaaagcgagcgagaagucuauccggauuacggccauggacaccgaagaucagggagucaaaguguuccugaucagcgcuuccagcaaggacacaggccaacucuacgccgcccugcaccaccgcauucuugcucugagaucucggguugagcaggaacaggaggccaaaaugcccgcgccugagcccggcgcugccccuuccaaugaagaggaugacagcgaugacgacgaugugcucgcccccuccggggcuaccgccgcgggagcuggcgacgaaggggauggacagacaaccggcucuacguga

SEQ ID NO: 74634 - RNA, 1473 nt, Artificial Sequence
  derived and/or modified sequence opt5 from RANBP3L__Homo_sapiens__NP_001154901
augaccacaauccccagaaagggcagcucccaucugccugggucucuccacacgugcaaacugaaacuucaggaggaccggcgccaacaggaaaagagcgugauugcccagccgaucuucgucuuugagaagggagaacagaccuucaaaagacccgcugaggauacacuguacgaagccgcggagccugaguguaacggcuuucccaccaagcggguucgcuccucuagcuucacauuucacauuaccgacucccaaucucagggggugagcacacucucccagaagcagaugagaugcagcucugugaccaaucugccuacguucccccauuccggaccuguccggaaaaacaauguguuuaugaccagcgcucuuguucaaucuuccguggauaucaagagcgccgaacagggcccggucaaacacucuaagcaugugauucgccccgccauccugcagcucccucaggcuagauccugugccaaaguucggaagacauucgggcacaaggcucuggagagcugcaaaaccaaggagaaaacaaacaauaagaucuccgaaggaaacucuuaucugcucagcgagaaucugucccgcgccagaauuagcgugcaacuuucuaccaaccaggacuuucugggcgcgacguccgucggcugucagcccaaugaagauaaaugcagcuucaagucuuguagcuccaacuuuguguucggggagaauaugguggaacggguccucggaacacaaaaacugacccagccucagcuugagaacgacucuuacgccaaggaaaagcccuuuaaaagcaucccgaaguucccuguuaauuuccuguccagccgcacagauucuauuaaaaacaccucccucaucgagagcgcugccgcuuuuucuucccagcccagcagaaagugccugcuggagaaaauugacgugaucaccggcgaagagacagaacacaaugugcucaagauuaacuguaagcuguucaucuuuaacaaaacgacccaauccuggaucgagcgggggcgcggaacacuuagacugaaugauaccgccucuacagacugcggcacccuccagagccggcugauuaugagaaaccaggggucccuucgccugauccucaauucuaagcugugggcgcagaugaaaauucaacgggccaaccauaagaaugucagaaucacggcuacagaucuggaagacuauagcauuaaaaucuuccucauccaggccuccgcucaggauaccgccuaccuguaugccgcuauucaccaucgccuuguggcgcugcagagcuuuaacaagcaacgggacguuaaucaggccgagucucucuccgagaccgcucagcagcugaacugugaaagcugcgacgagaaugaagaugacuucauccaagugacaaagaacggaucugauccuuccagcuggacccacagacagucugucgccugcagcuga

SEQ ID NO: 74635 - RNA, 3318 nt, Artificial Sequence
  derived and/or modified sequence opt5 from RANBP6__Homo_sapiens__NP_036548
auggccgcuaccgccagcgcgggcgugcccgcuacagucuccgagaagcaggaguucuaccaacugcucaaaaaccugaucaauccuucuugcaugguuagacggcaggccgaagaaauuuaugagaacaucccggggcuuuguaagacgaccuuucugcucgacgccgugcgcaauagacgggcuggauacgaagugcgccagauggccgcugcccugcuuagacggcugcucagcuccggcuucgaggaggucuaucccaaccugccugcggaugugcagcgcgacguuaaaauugaacugauccucgccgugaagcuggagacacacgcuucuaugagaaagaaacuuugcgauauuuuugccguccuggcucggaaucucaucgacgaagaugggaccaaccauuggcccgagggacugaaguuccuuaucgacagcauuuacuccaaaaaugugguucugugggagguggcccuccacgucuuuuggcauuucccuggcaucuuugggacacaagaacgccacgaucuggacauuaucaagagacugcucgaucaguguauucaggaccaggagcaucccgcgauccggacccugucugcccgcgcugccgcugccuucgugcuugccaacgaaaauaacauugcucuguuuaaagauuucgcggaccuccugccuggaauccuucaagccgugaaugauagcugcuaucaggacgacgauuccguccuggagagccucguugaaaucgcugacacagugccgaaguaccugggccccuaucuggaggauacccuccagcugucucuuaaacuguguggcgacuccagacucagcaaccugcagcggcaacuugcccuggaggugauugucacgcucucugaaaccgccacaccuaugcugaagaagcacaccaauaucauugcucaggccgugccccacauccuggcgaugaugguugaucuccaggacgaugaggacugggugaacgcugaugaaauggaggaagacgauuuugacuccaaugccgucgccgcugagagcgcccuggaccgccuugcuugcgggcugggaggcaaagugguucucccuaugacaaaggagcauauuaugcaaaugcugcagucucccgauuggaaauacagacacgccgggcugauggcgcuuuccgccaucggagaaggcugucaucagcagauggagagcauccucgacgaaaccgugaacuccguccugcuguuccuccaagauccgcacccucgggugagagcugccgcuugcacgacacuggggcagauggccaccgacuuugcgcccaacuuccagaagaaauuccacgagacagucauugccgcccuucugcgcaccauggaaaaucagggaaaccaacgggugcagucucaugcugcuagcgcccucaucauuuuuaucgaggauuguccuaagucccugcugguucuuuacguggacagcauggucaaaaaucuccacucugugcugguuauuaagcugcaggagcucaucagaaacggcaccaagcuggcccuugaacagcuggugacaacgaucgcuuccgucgcggauaccauugaggaaaaauucgugcccuauuacgacaucuuuaugcccagccucaagcauauuguggagcuggccguucaaaaagagcugaaacuucuccgcggcaaaacaaucgaaugcauuucucacaucgggcuggcugucggaaaggagaaguucaugcaggaugccagcaaugugaugcagcugcuccugaaaacccaguccgaccuuaacaauauggaagaugacgauccucaaacaucuuauauggugagcgccugggcucggauguguaagauucugggcaaagacuuucagcaguaccucccgcuggucaucgagccccugaucaagaccgccuccgcgaaaccugacguggcccuucucgauacgcaagacguugaaaacaugagcgaugacgauggguggcaguucgugaaucugggagaccagcagucuuuuggcauuaagacauccgggcuggaggcuaaggccaccgcuugccaaaugcucgucuauuacgccaaagagcugagagaaggauucguggaguauaccgaacagguugugaaacuuauggucccccugcucaaauuuuacuuccaugauaacgugcgcguugcggcugccgagagcaugccuuuucugcuggaaugcgcccggaucagaggccccgaguaccuugcucagauguggcaguucauuugugacccgcugaucaaggccauuggcacagagccugauaccgacgugcucucugaaaucaugaacuccuuugcuaaaagcaucgaggucaugggggauggaugccugaaugacgaacaccucgaggaacugggcgggauucuuaaggccaagcuggagggacacuucaaaaaucaagagcuccgccaggugaagcggcaggaagagaacuaugaucagcaaguggaaaugucccugcaggacgaggacgagugugaugucuacauccugacaaaaguuucugacauucuucauagccuguucuccacguauaaggaaaagauccuccccugguuugagcagcugcucccucugauugugaaucuuaucugcucuagcagacccuggccugaucgccaauggggccuguguaucuucgacgauauuaucgaacacugcucccccaccagcuuuaaguacguggaguauuuccgguggccgaugcuccugaacaugagagacaacaauccugaaguccggcaggcggccgcuuacgggcugggcgugauggcccaguuuggaggcgaugacuaucgcucucuuuguuccgaggcuguuccccugcucgugaaagucauuaagugcgccaacagcaagacaaagaagaaugugaucgccaccgagaacuguauuucugcuaucgggaaaauccugaaguucaaacccaauugcguuaacguggaugaaguccucccucauuggcuguccuggcuuccgcugcacgaggacaaggaagaggcgauucagacacugagcuuucucugugaucugaucgaaucuaaucaccccgugguuauuggaccuaacaauagcaaccuucccaagaucauuuccaucauugccgagggcaaaaucaaugagaccaucaacuacgaagacccuugcgcuaagagacuggccaaugugguccggcaagugcagacgagcgaggaccucuggcuggaaugcgugucucagcucgaugacgagcagcaagaagcccugcaggagcuucugaacuucgcuuga

SEQ ID NO: 74636 - RNA, 2190 nt, Artificial Sequence
  derived and/or modified sequence opt5 from RANBP9__Homo_sapiens__NP_005484
augagcggccagcccccuccgcccccuccccaacagcagcagcaacagcagcagcuguccccucccccuccggccgcucucgcccccgugucuggggucguucugccugcgcccccugcugugagcgccggauccucucccgccggcagccccgggggaggcgcugggggagagggccuuggcgccgcugccgcggcccugcuccugcacccucccccucccccgcccccggcuaccgccgcucccccucccccucccccgccucccccucccccugccuccgcggccgcucccgccucugggccgccugcuccucccggacuugccgccggcccugggccggcuggaggcgcgcccacacccgcccugguggcugggagcuccgccgccgcucccuucccucauggagacagcgcccucaacgaacaagagaaggaacugcagagacggcugaaacgccucuaccccgcggucgaugagcaggaaacgccucugcccagaucuugguccccgaaggacaaauuuagcuauaucggccuuucucagaauaaccugcgggugcacuacaagggccaugggaaaaccccuaaggaugcugccuccguucgcgccacacaccccauuccugcugccugcggaaucuauuacuucgaggugaagauugucagcaaaggcagagacggguauaugggaaucggccucucugcucaaggggugaauaugaaccggcugcccggaugggauaagcauuccuacggcuaucacggcgacgaugggcacagcuuuuguuccucuggaaccggccagccguacgggccuacauucaccacaggagacguuauuggcugcugugugaaucuuaucaacaauaccugcuuuuacacgaaaaacgggcauagccugggcaucgccuucaccgaucugcccccuaaucucuaucccacagucggacugcagacccccggcgaggugguggacgcgaacuuugggcaacacccuuucgucuuugauauugaagacuacaugcgcgaguggagaacaaagauccaggcccagauugaucgguucccgaucggagaccgcgaaggcgaguggcagaccaugauucagaaaaugguuuccagcuaucucgugcaucacggguacugugcuacggccgaggcuuuugccagaucuacagaccagaccgugcuggaggaacuugcguccaucaagaaucggcagcgcauucagaagcugguccucgccggaagaaugggcgaagcuaucgagacaacccaacagcuguaucccagccuucuggaacggaacccuaaucuccuguucacccugaaagugcgccaguuuaucgagaugguuaacgggacagauucugaggugagaugccucggcggacggagccccaagucccaggacucuuacccugucagccccagaccuuucuccagcccgucuaugucccccagccacggcaugaauauucauaaccuggccucugggaaaggauccacggcucacuucagcggcuuugaauccuguucuaacggggugaucagcaauaaggcccaucaauccuauugccacucuaacaaacaucagagcuccaaucuuaacguuccugagcugaauagcauuaacaugucucgcucccaacaggugaauaacuucaccagcaaugaugucgacauggaaacagaucacuacucuaacggagugggcgagaccuccagcaauggguuucucaacggcucuagcaagcacgaccaugaaauggaggauugugacacagagauggaagucgauuccagccaacugcggagacagcuuugcggaggcucucaggccgcuaucgagcgcaugauucacuucgggcgggaacugcaagcgauguccgagcagcucagacgcgacuguggcaaaaauaccgccaacaagaagaugcugaaagaugcuuuuagccugcucgccuacuccgaccccuggaacucuccugugggaaaucagcuggaccccauccagcgggaaccgguuugcagcgcccuuaacuccgcuauccuggagacgcauaaucucccuaagcaaccuccccuggcccuggcgauggggcaggcuacacagugccuuggacucauggccagaucuggcauugggagcugugccuucgcuaccguggaggauuaucugcacuga

SEQ ID NO: 74637 - RNA, 1764 nt, Artificial Sequence
  derived and/or modified sequence opt5 from RANGAP1__Homo_sapiens__NP_001265580
auggccagcgaggacaucgcuaagcuggccgaaacccucgcgaaaacacagguggcuggcgggcaacuguccuucaagggaaaaucucuuaagcugaacacggccgaggaugccaaagacgucauuaaggaaaucgaggauuuugacagccucgaagcucugagacuugagggcaauaccguugggguggaggccgcucgggugauugccaaggcgcuggagaaaaaguccgaacucaaacgcugccacuggucugauauguucacaggaagacugcggaccgaaauucccccugcccugaucagccucggcgaggggcugaucacagcuggagcccagcuugucgagcuggaccucuccgauaacgcuuuuggcccggacggcgugcagggguucgaagcccugcuuaagucuagcgcguguuuuacccugcaggagcucaaacugaauaacugcggaaugggcaucgggggaggcaagauucuggccgcugcccucacagaaugucaucgcaaguccagcgcucaagggaaaccccuggcccuuaagguuuucguggccggaagaaaucggcuggagaacgauggcgcuaccgcgcucgccgaggcuuuucgcgucaucggcacgcuggaagaggugcacaugccucagaaugggauuaaccaucccggaaucaccgcccuugcccaggcuuucgccguuaauccucugcucagagugauuaaccugaaugacaacacauuuaccgaaaaaggcgcggucgcuauggccgagacacugaagacccuccgccagguggaagugaucaauuucggggauugccugguccggucuaaaggagccguugcuauugccgacgcuaucagaggcgggcuucccaagcugaaagagcucaaccuguccuuuugugaaaucaagcgggaugccgcgcuugccguggcugaggccauggcugacaaggccgagcuggaaaaacucgaccugaauggaaacacgcugggcgaggaaggcugcgagcaacuccaggaagugcuggagggguucaacauggcgaagguccuugccagccugucugaugacgaggaugaagaggaagaggaggaaggagaggaagaggaagaggaggcugaagaggaagaggaagaggacgaggaagaggaagaggaagaggaggaagaggaagaggaggaaccucagcagcgcggccaaggggagaaauccgccacaccgagcagaaagauucucgaucccaauaccggagaaccugcucccgugcugucuuccccucccccggccgacguuagcacauuucuggccuucccuucccccgagaaacuucuccggcugggcccuaagucuagcgugcugaucgcucagcagaccgauaccuccgaccccgaaaaggucgugagcgcguuccucaaaguuucuuccguguuuaaggaugaggccacaguccgcauggcugugcaagacgccgucgaugcccugaugcagaaggcuuucaacagcucuagcuuuaauuccaacacguuccuuaccagacugcucgugcacauggggcugcugaaaucugaggacaaaguuaaggccauugcgaaucuuuacggcccccucauggcucugaaccauauggugcagcaggacuauuuuccuaaggcccuggccccgcuccugcuugcuuucgucacaaaacccaauagcgcccuggaauccuguagcuuugcgcggcacucucuccugcaaacccuguacaagguguga

SEQ ID NO: 74638 - RNA, 441 nt, Artificial Sequence
  derived and/or modified sequence opt5 from RANGRF__Homo_sapiens__NP_001171272
auggagcccaccagagacugcccucuguucggcggggccuuuagcgcuauccucccgaugggagccauugauguguccgaccugcggcccgucccugauaaccaggaaguuuucugucaccccgugacagaccaaucucuuaucguggagcugcucgaacugcaggcgcauguccgcggcgaggcugccgccagauaccacuuugaagauguugggggagugcagggcgcucgggccgugcaugucgagagcgugcagccucuuucccuggagaaucucgcucugcgcgggagaugccaagaagccuggguucugucuggaaagcagcagauugcgaaagagaaccagcaaguggccaaggacgucacgcuccaccaggcucugcuucggcugccccaguaucagaccgaucuccugcuuacauucaaucaaccuccguga

SEQ ID NO: 74639 - RNA, 387 nt, Artificial Sequence
  derived and/or modified sequence opt5 from RAN__Homo_sapiens__NP_001287725
auguucgacgugaccagcagagucacauacaagaacguucccaauuggcaccgggaucuggugcgcgugugcgagaacaucccuauuguccucuguggcaauaaaguggacaucaaggauagaaaaguuaaggccaaauccauuguguuucaucggaagaagaaccugcaguauuacgacaucucugcuaaaagcaauuauaacuucgaaaagccguuucuuuggcuggcccgcaaacucauuggggaucccaaucuggaguucgucgcgaugccugcucuugcucccccugaagugguuauggaccccgcccuggccgcccaauacgagcacgaucucgaaguggcucagacgaccgcccugccugacgaggaugacgaucuguga

SEQ ID NO: 74640 - RNA, 555 nt, Artificial Sequence
  derived and/or modified sequence opt5 from RAP1B__Homo_sapiens__NP_001010942
augagagaguacaagcuggugguccucggcagcgggggaguuggcaaauccgcccugaccgugcaguucgugcaagggaucuuugucgaaaaguaugaccccacaauugaggauucuuacagaaaacagguggaaguugacgcucagcagugcaugcuugagauccuggauacggccggaaccgaacaauucacagcgaugcgcgaccucuauaugaagaacggccagggguuugcucugguguacagcauuaccgcccaguccacauucaaugaucuucaggaccugagagagcaaauccuccgggucaaagauaccgacgaugugccuaugauucugguuggaaacaagugugaccuggaggaugaacgcguggucggcaaggagcagggccagaaucucgccagacaguggaacaauugcgcuuuucuggaaucuagcgccaaauccaagaucaacgugaaugagaucuucuaugaccuugugcggcaaauuaaccgcaaaacaccgguccccgggaaggcucggaaaaagucuagcugucagcugcucuga

SEQ ID NO: 74641 - RNA, 2148 nt, Artificial Sequence
  derived and/or modified sequence opt5 from RAP1GAP2__Homo_sapiens__NP_001093868
auguucggcagaaagcggagcguguccuuugggggauucggcuggaucgacaaaaccaugcuggccucucucaaggucaaaaagcaggagcuggcuaacagcuccgaugccacacuucccgaccgcccucugucuccgccccucacggcgccucccaccaugaaaagcuccgaauuuuucgagaugcuggaaaagaugcaagaugacuacauuccuuaucccucuaucgaugagguuguggaaaaagggggaccuuacccccaggugauucuuccccaguuuggcggguauuggaucgaggacccugagaaugucggaacacccaccagccugggcuccagcauuugcgaagaggaagaggaggauaaccucucuccuaauacauucggcuacaaacuggaauguaagggggaggcuagagccuaucggcgccacuuucugggaaaagaccaucucaacuucuacugcaccggcuccagccuggggaaucuuauccugucugugaagugugaagaggccgaaggaaucgaguaucucagaguuauucugcgguccaaacuuaagacagugcacgagcgcaucccccuggcuggccucagcaagcugccgucugucccucagauugccaaggcuuuuugcgaugacgccguggggcugagauucaaccccguucucuacccuaaggcgucccaaaugaucgugagcuacgaugaacaugaggucaauaacaccuuuaaauucggagugauuuaucagaaggcccggcagacgcuggaagaggaacuuuuuggcaauaacgaggagucccccgcuuucaaagaguuccuggaccuccugggcgauaccaucacacuucaggacuuuaagggguuccgcggaggccuggacgugacccacgggcaaacaggagucgaaucuguuuacaccacguuuagagaucgggaaauuauguuccaugugagcacaaaacuccccuuuaccgacggcgaugcccagcagcugcagcgcaagagacacaucgggaaugacaucguggcuauuaucuuccaagaggaaaacacaccuuuugucccggauaugauugccuccaauuuccugcacgcguauaucgugguucagguggagacccccggaaccgagacaccuagcuacaaggucucugugacggcccgggaagacguucccaccuuuggcccuccccucccguccccucccguguuccagaaaggcccugaguuucgcgaguuccugcuuacaaagcugaccaacgcugaaaaugccuguugcaaaagcgauaaguuugcuaaacucgaggacagaacacgggccgcccugcuugauaaccugcaugacgaacuccacgcucauacccaagcgaugcuggggcugggacccgaggaagauaaguucgagaacggcgggcacggaggcuuccucgaaucuuuuaagagagccauucgcguccggagccacuccauggagacgauggucgggggccagaaaaagucucauagcggaggcaucccugggucccugagcggaggcaucucucacaauuccauggaggugacaaaaaccaccuucagcccgccggugguugcugccacagugaagaaccagucuagauccccuauuaaacgccggagcgggcuuuuucccagacugcauaccggauccgaaggccagggggacucucgcgcccggugugacagcacauccucuacgcccaagaccccugauggcggacacagcucccaagagaucaagagcgaaacaucuuccaauccgagcucucccgagauuugcccuaacaaagaaaagcccuucaugaaacucaaggagaauggcagagcuaucucccgcagcucuagcuccaccagcucugucuccagcacagccggggagggagaagcgauggaggaaggcgacuccgggggaucucagccuagcaccacgucccccuuuaaacaggagguguucguuuauucuccuagccccuccucugaaagcccgucccugggcgcugccgccaccccuauuaucaugagccggucucccacagaugcuaaguccagaaacagcccucgcucuaaucugaaguuucgguucgacaaacuuucccaugccagcucuggggcuggccacuga

SEQ ID NO: 74642 - RNA, 1827 nt, Artificial Sequence
  derived and/or modified sequence opt5 from RAP1GDS1__Homo_sapiens__NP_001093896
auggccgacaaccugagcgauacccucaagaaacugaagaucacagcuguggacaaaacggaggauucccuugaaggcugccuggacugucuccugcaggcccuugcgcaaaauaacaccgagacaucugaaaagauucaggcuagcgggauccugcagcuguucgccucccugcugacaccccagucuagcugcaaagccaaggucgcuaauauuaucgccgagguugcuaagaacgaauuuaugcggauuccuuguguggaugccggacucaucuccccgcuggugcaacuucucaauucuaaagaccaggagguccuccugcagaccggcagagcgcuugggaacaucugcuacgauagccacgagggacgcuccgccguggaccaggcuggcggggcccaaauuguuaucgaucaucugagaagccucuguucuauuaccgaccccgcuaaugaaaagcugcugacaguguucugcggaaugcucaugaacuauuccaaugagaacgauagccugcaggcccagcuuaucaauaugggcgucauuccuacccuggugaaacuccugggcauccacugucagaacgcggcccuuacggaaaugugccugguugcuuuugggaaucucgccgagcuggagucuuccaaggaacaauucgcuagcaccaacauugccgaggaacuggugaaacucuuuaagaagcagaucgagcaugacaaacgggaaaugaucuucgagguccuggcuccccuugccgagaaugaugcgauuaagcugcagcucguggaagccggacugguggagugucuucuggaaaucguccaacagaaaguugacucugacaaggaggaugacauuacagaacucaaaaccggcuccgaucugauggugcugcuccugcuuggggacgagagcaugcagaagcuguuugagggaggcaaaggguccguguuccagcgcguccucucuuggaucccuagcaacaaccaccaacugcagcuggcuggagcccuugccauugcuaauuuugccagaaacgaugcgaauugcauccauaugguggacaacggcaucguugaaaagcucauggaucugcuggaccggcacguggaggauggcaaugucacagugcagcacgcugcccucuccgcccugcgcaaccuugcuauucccguuaucaauaaggccaaaaugcugagcgcuggggugaccgaagccguccucaaguuccugaaaucugagaugccuccggugcaguuuaagcugcuuggaacgcucagaaugcugauugacgcgcaagccgaagcugccgagcagcugggcaaaaacgucaagcucguggagcggcugguugaauggugugaggcuaaggaucaugccggggugaugggagaauccaaucgccuucugagcgcgcucaucagacacucuaaaagcaaggacgucauuaaaacaaucgugcaguccggcgggaucaagcaucugguuaccauggccacaucugagcacgugauuaugcagaacgaggcucuggucgcccuugcucucaucgccgcccuggaacugggaaccgcugagaaagaccucgaaagcgcgaagcuggugcaaauucuucaccggcugcucgccgaugagcgcuccgcucccgaaaucaaguacaauagcauggugcugauuugcgcccugaugggcucugagugccuucauaaagagguucaggaccucgccuuccuggaugucguguccaagcugagaagccacgaaaacaaaucuguggcucagcaggccucccucaccgagcaacggcugacagucgaaagcuga

SEQ ID NO: 74643 - RNA, 552 nt, Artificial Sequence
  derived and/or modified sequence opt5 from RAP2A__Homo_sapiens__NP_066361
augagagaguacaagguggucguucugggcagcgggggagugggcaaauccgcccucaccgugcaguucgucacagggacguuuaucgaaaaguaugaccccaccauugaggauuucuaccggaaagaaaucgagguggacucuagcccuuccguucuggaaauucuugauacagcuggaaccgagcaauuugccucuaugcgcgaccuguauaucaagaacggccagggguucauucucguguacagccuggucaaucagcaguccuuucaagauaucaaaccgaugagagaccagaucauucgggugaagcgcuaugagaagguucccgugauccuugucggaaacaaaguggaucuggaaucugagagagaagugagcuccagcgagggccgggcgcucgcugaggaauggggcugcccuuucauggagacaucugccaaguccaaaaccauggucgacgaacuguuugccgagauuguucgccagaugaauuacgcugcccagcccgauaaggacgauccuuguugcagcgcuuguaacauccaauga

SEQ ID NO: 74644 - RNA, 552 nt, Artificial Sequence
  derived and/or modified sequence opt5 from RAP2B__Homo_sapiens__NP_002877
augagagaguacaagguggucguucugggcagcgggggagugggcaaauccgcccucaccgugcaguucgucacagggucuuuuaucgaaaaguaugaccccacgauugaggauuucuaccggaaagaaaucgagguggacagcuccccuucuguucuggaaauucuugauaccgcuggaacagagcaauuugccagcaugcgcgaccuguauaucaagaacggccagggguucauucucguguacucccuggucaaucagcagucuuuucaagauaucaaaccgaugagagaccagaucauucgggugaagcgcuaugagagaguucccaugauccuugugggaaacaaggucgaucuggaaggcgagcgggaagugagcuacggcgaggggaaagcgcucgcugaggaaugguccugcccuuucauggagaccagcgccaagaauaaagccucuguggacgaacuguuugcugagauuguccgccagaugaacuaugccgcucagcccaauggagaugaaggcuguugcuccgccuguguuauccuguga

SEQ ID NO: 74645 - RNA, 3285 nt, Artificial Sequence
  derived and/or modified sequence opt5 from RAPGEF1__Homo_sapiens__NP_001291204
augagcggcgggcugggacucagacggucccccgaaaugucuggcaagaucgaaaaagccgacagccagcgcucccaccugucuagcuucaccaugaaacuuauggauaaauuucauuccccuaagauuaaaagaacaccgucuaagaaggggaaacccgcugaggugagcgucaagaucccugaaaaacccguuaacaaggaggccacggaccgguuccugccugaaggauacccccucccucuggaucuugagcaacaggcgguggaguuuauguccaccagcgcuguggccucucgcucccagagacagaaaaaucugagcuggcucgaagagaaggaaaaggaggucgugucugcccugcgguauuucaaaacaauuguugacaagauggcuaucgauaaaaaggugcuggagaugcucccgggcuccgccagcaaaguccuggaagcuauucuuccccuggugcaaaacgacccucgcauccagcacucuuccgcccucagcuccugcuacucuagaguuuaucagagccuggcgaaucuuauccggugguccgaucaggugaugcuggagggggucaacagcgaagacaaggagauggugaccacagugaaaggagucauuaaggccguucucgauggcgugaaggaacuggugcgccugaccaucgagaaacaaggcagacccucuccuacaucccccgucaagccgagcucuccugcuagcaaacccgacgggccugccgagcucccccugaccgaucgggaaguggagauucuuaauaagacgaccggaaugucccagucuacagaacugcuccccgacgcuaccgaugaggaaguugccccuccgaaacccccucugcccggcauccgcguggucgacaacagcccucccccggcgcuuccucccaagaagagacaguccgccccuagccccacacggguggcuguuguggccccuaugucucgcgcuaccuccgggagcucucugcccgucggaauuaauagacaggacuuugauguggacuguuacgcccaacggagacucuccggcgggagccauuccuauggaggcgagucuccgcgccugagcccuugcuccucuaucggcaaacugagcaaguccgaugagcagcucagcucucuggaccgggauuccgggcaguguagcagaaacacgucuugcgaaacacuugaccacuacgaucccgacuaugaguuccugcaacaggaucucuccaaugccgaccagauuccccagcaaaccgcuuggaaccugagcccucuuccggaaucucugggagagagcggcucccccuuucucgggccucccuuccagcugccucugggaggccauccccagccugaugggccccucgcgccgggacagcaaacagacaccccucccgcccugccugaaaagaagcgccggagcgcugccucucagaccgccgacggcuccggcuguagagucagcuacgagcgccaccccucccaguacgauaauaucucuggggaggaccuucagagcacagcuccgaucccuuccgugcccuaugccccuuuugcggcuauucugcccuuccaacacggaggcucuagcgcccccguugaauuugugggggauuucacggccccugaguccaccggagacccggaaaaacccccuccccucccugagaagaagaacaaacauaugcuggcuuacaugcagcugcuugaggauuauucugaaccccagccuagcauguuuuaccagacaccgcaaaaugagcacaucuaucagcagaagaacaaacuccugauggaagucuacggcuucuccgacagcuucucugggguggauuccguucaagagcuggcucccccucccgcccucccucccaagcagcggcagcuggaaccgccugccggcaaagacggacaucccagagaucccagcgcggugucuggcgucccugggaaggacucccgcgauggaagcgagcgggcccccaagucuccugacgcucuugaguccgcccagagcgaagaggaaguggaugagcugucccucauugaccacaaugaaaucaugagcagacugacccugaaacaagagggcgacgaugggccggacgugcgcggaggcucuggggauauucuucucguucacgcuacagagaccgaccggaaggaucugguccuguauugcgaagccuuucucacgacauacagaaccuucaucagccccgaggaacugaucaaaaagcugcaguaccgguaugagaaauuuuccccuuucgcggacaccuuuaagaaacgcgugucuaagaacacauucuuugugcuugucagagugguugaugaacucugucugguggagcugaccgaggaaauucuuaagcuccugauggagcuggucuuccggcucgugugcaacggcgaacugagccuugccagaguucugcgcaaaaauauccucgacaagguggaucagaaaaagcugcugcggugugcuacauccucucagccccuugccgcuagaggagucgccgcccgcccuggcacgcuccaugacuuucacagccaugagauugcugagcaacugacccugcucgaugcggaacuguucuacaaaaucgagauucccgaagugcuucugugggccaaggagcagaacgaagagaaguccccgaaucucacacaguuuaccgagcacuucaacaauaugucuuauuggguuagaagcaucaucaugcugcaggaaaaagcucaagaccgggagcgccugcuucugaaguuuauuaaaaucaugaagcaucucagaaaacugaacaauuucaacuccuaccucgccauucugagcgcccuugauucugcuccuauccggcgccuggaauggcagaagcagacauccgaggggcucgccgaauauugcacccugauugacucuagcuccagcuucagagcguaccgggcugcccuguccgagguggagcccccuuguauccccuaucuuggacugauucuccaagaccugacguuuguccaccucggcaauccugauuacaucgacgggaaggugaacuucucuaaacgcuggcagcaguuuaauauccuggauagcaugagaugcuuccagcaagcccacuacgacaugcggcgcaacgaugacauuaucaacuuuuucaaugauuuuuccgaccaucuugcugaagaggcccugugggaacucagccugaagauuaaacccagaaauaucacccggagaaagacagaucgcgaggagaaaaccuga

SEQ ID NO: 74646 - RNA, 4500 nt, Artificial Sequence
  derived and/or modified sequence opt5 from RAPGEF2__Homo_sapiens__NP_055062
augaagccccuggccaucccugcuaaccacggcgugauggggcagcaagagaaacauagccucccggccgacuucaccaagcugcaccuuacagauucccugcauccccaggucacgcacguuucuagcucccauucuggaugcagcauuaccuccgacucuggcagcuccagccucucugauaucuaccaggcgacagaauccgaggcuggggacauggaucugagcggacuuccugaaaccgccguggacucugaggaugacgaugacgaagaggauauugagagagccuccgacccccugaugagccgggauaucgugcgcgacugucucgaaaaagacccuauugauagaacagacgaugacaucgagcagcugcuggaauuuaugcaccaacuccccgcuuucgccaauaugaccaugucuguccggcgcgagcugugcgcugugaugguuuuugccguggucgagagagcgggcacaaucgugcuuaacgauggggaggaacuggacuccuggagcguuauucucaauggauccguggaagucaccuauccugauggcaaggccgagauccuguguaugggcaacucuuucggggugagcccgacgauggacaaagaauacaugaagggagugaugcggaccaaggucgaugacugccaguuuguuuguauugcucagcaggauuauugccgcauccuuaaucaaguggagaaaaacaugcagaagguggaggaagagggcgaaauugucauggugaaagagcacagagaacuggaccggacagggacccgcaagggacauaucguuauuaaaggcacauccgagagacucaccaugcaccugguggaggaacauagcgucguggaccccacguucaucgaggauuuucugcucacauaccggaccuuccugucuuccccuauggaaguugggaagaagcugcuggagugguuuaaugaccccagccuccgcgauaaagugacaagagucgugcugcuuugggucaacaaucacuucaacgacuuugaaggagauccugccaugacccgguuccuggaggaguuugaaaauaaccucgagcgcgaaaagaugggcggccaccugagacugcucaauaucgcuugugccgcgaaagccaagcggagacugaugacccuuacaaaacccucucgcgaggcuccgcugccuuucauucuccuugggggaagcgagaagggcuucgggaucuuuguggacuccguugauucuggaagcaaagccacggaagcuggccuuaagagaggggaccagauucuggaggugaacggacagaauuucgaaaacauccaacucuccaaggccauggagauucugagaaacaauacccaucugagcaucacagucaaaaccaaccucuuuguguucaaggaacugcuuacacgccugucugaggagaaacggaauggcgcuccccaccucccuaagaucggcgauauuaaaaaggccuccagauauagcauccccgaccuggcgguugauguggaacaggucauugggcuggagaaggugaacaaaaagucuaaagccaauaccgugggaggccgcaacaaacuuaagaagauccucgacaagacgcggauuuccauccugccccagaaaccuuacaaugauaucgggauuggacaaagccaggacgacuccaucguuggccugagacagacaaagcauauuccgaccgcucuccccgucucugggacccugagcuccucuaacccugaucuucugcagagccaccaucgcauccucgacuuuuccgccacacccgaucugccugaccaagugcugcggguguucaaagccgaucagcagagcagauauauuaugaucucuaaggacaccacagcuaaagaagucgugauucaggccauccgcgaguuugcgguuacggcuacccccgaucaauacucccuuugcgaagugagcgucacaccggagggcgugaucaagcagcggagacucccugaccagcugucuaagcuggccgaucggauucagcucuccggacgcuacuaucugaaaaauaacauggagaccgaaacacuuuguagcgacgaggaugcccaagaacugcucagagagucucagaucagccugcugcagcuuuccaccguugaaguggcuacgcagcucagcaugcggaauuucgagcuguuuagaaacauugagcccaccgaauacaucgacgaucuguucaagcuccgcucuaaaacauccugcgccaaucugaagcgguuugaggaagucauuaaccaagagaccuucuggguggcuagcgagauccuuagagaaacaaaucagcugaaacgcaugaagaucauuaaacacuuuaucaagauugcccuccacuguagagagugcaagaacuucaacuccauguucgcgaucauuucuggccugaaucuggccccuguugcucggcuucgcaccacgugggaaaaacuccccaacaaguaugagaaacuguuucaggaccugcaagaccucuucgauccuagcagaaauauggccaaguaccggaacgugcuuaauucccagaaccuucagcccccgaucaucccucuguuucccgucauuaaaaaggaccucacauuccugcaugaagggaaugauucuaagguggacggacuggugaacuuugagaaacuucgcaugaucgcuaaggagauuagacacgucggccggauggccagcguuaauauggaucccgcgcugauguuccgcacccggaaaaagaaauggcggucccucgggucucugagccagggauccacaaacgccaccgugcucgacguggcucaaaccggcgggcauaagaagcgcgucagacggagcucuuuucugaaugccaaaaagcuguaugaagaugcucagauggccagaaaagugaagcaguaccuguccaaccucgagcuggaaauggacgaggaaagccugcagacacuuucucugcaaugcgagccugccacgaauacccucccgaaaaaccccggcgauaagaagccuguuaaauccgagacaagccccguggcuccucgcgcgggaucucagcagaaggcccagucccugccccaaccucagcagcaacccccgccugcucacaaaaucaaucagggccuccagguccccgccgugagccuguauccuucccggaagaaaguucccgugaaggaccuuccgccuuucgggauuaacagcccccaggcccugaaaaagauccucucucugagcgaagagggaucccuggaaagacacaagaaacaagcugaggauaccaucucuaacgccagcucccagcuuucuagcccucccacaucuccccaguccagcccucgcaagggcuacacccuggcgccguccgggacggucgacaauuuuagcgacucuggacauuccgaaauuagcucucgguccagcaucguguccaacucuagcuucgauuccguucccgugagccuccacgacgagagacgccagcggcauucugucuccauuguggagacaaaucugggcauggggagaauggaacgccggaccaugaucgagccugaucaauacagccucggcucuuaugcucccaugagcgaaggaagaggccuguacgccaccgccacagugauuuccucuccuagcaccgaggagcuuucccaggaccagggggaucgggcuucucuggacgccgcggauagcggacgcggcuccuggacaagcuguucuuccgggagccacgacaacauccagacgauucaacaucagagauccugggaaacccugcccuuuggacacacacacuucgauuauucuggcgacccugcugggcucugggccagcuccucucauauggaucagaucauguuuagcgaccacuccaccaaauacaaucggcagaaccaaagccgcgagucucuggaacaggcccaguccagagcuagcugggccucuuccacaggcuauuggggagaggauagcgaaggcgacaccgggacgaucaagcggagaggaggcaaagacgucucuauugaggcugagagcuccucucuuaccagcguuacaaccgaagagacaaagccggugcccaugccugcccauaucgcgguggccuccagcaccacaaaggggcugauugcucgcaaagaaggacgguacagagagcccccucccaccccgccuggcuauaucggcauucccaucacggauuuccccgaagggcacucccauccugcccgcaagcccccugacuacaaugucgcucuccaacggucuagaaugguggcccgcagcuccgauacagccggaccgucuagcguucagcagccccacggccacccuaccuccucucggcccgugaacaaaccucaguggcauaagcccaaugagagcgacccgagacuggcuccuuaccaaucccagggguucagcaccgaggaagaugaggacgaacaggucucugcgguguga

SEQ ID NO: 74647 - RNA, 2772 nt, Artificial Sequence
  derived and/or modified sequence opt5 from RAPGEF3__Homo_sapiens__NP_001092001
augaaggugggcuggcccggggagagcugcuggcaggucggacuggccguugaagacuccccugcucucggcgccccgagagugggggcgcugcccgauguggucccugagggaacccuucugaacauggugcuccggcgcaugcacagaccccggucuuguagcuaccaacugcuucuggaacaucagcgcccuuccugcauccagggccucagauggacaccccugaccaauucugaggaaagccuggacuucuccgagucucucgagcaggcuagcacggaacggguucugcgcgccgggagacaacuucaccggcaucugcucgccacauguccuaaccugauucgcgauagaaaauaucaccuucggcuguaccgccagugcuguuccggaagagagcucguggacggcauccuggcucugggccucgggguccauagccggucucaggugguuggaauuugccaggugcugcuugaugaaggcgcccugugucacgucaagcacgacugggcuuuucaagaucgcgacgcccaguucuauagauuuccggggcccgagccugagcccgugggaacccaugaaauggaggaagaacucgcggaagccguggcucugcuuucccagcggggcccugaugcccugcucacagucgcucugagaaaacccccggggcagcgcaccgacgaggagcuggaucucaucuucgaggagcugcuucacauuaaggccguugcgcaucugagcaauucugugaaacgggaacucgccgcugugcugcuuuuugagccucacuccaaggccggaacaguccuguucagccaaggcgacaagggcaccucuugguacaucaucuggaaaggguccgugaacguugugacgcacggaaagggccucgucaccacacugcaugaaggggaugacuuuggacagcuggcucucgugaaugacgcccccagagccgcuaccauuauccugcgcgaggauaacugccacuuccuucggguugacaaacaggauuuuaauagaauuaucaaggacguggaggcgaaaacaaugcgccuggaggaacauggcaaggucgugcucguccuggaacgggccagccaaggggcuggaccuuccagaccucccacccccggccgcaaccgguauacggugaugucuggcacaccggagaagauucuggaacuucuccuggaggccauggggcccgauagcuccgcccacgacccuaccgagacauuccugagcgauuuucuccugacccauagaguuuucaugcccucugcucagcuuugugccgcgcugcuccaccacuuucauguggaaccugcuggaggcuccgagcaggaacgcagcaccuacgucugcaauaaacggcagcaaauccugagacuggugucucaguggguugcccuuuaugggagcaugcuccacacagaccccguggccacguccuuccugcagaagcugucugaucucgucggacgggacacccgccugagcaaccuucugagagagcaguggccggagcggagacgcugucaucggcucgaaaauggcugcgggaacgcuuccccucaaaugaaagccagaaaucugcccguguggcugccuaaccaggaugagccccuuccuggcagcucuugcgcuauucaggugggagacaagguucccuacgacaucugucgcccggaucacuccguccucacacugcagcugccugugaccgccagcgugagagaagucauggcggcccucgcucaagaggacggcuggacaaaaggacaggugcugguuaaggucaauucugccggggaugcuaucggccuucagcccgacgcccgcgggguggcgaccucccugggacucaacgaacggcuguucgugguuaacccccaggaggugcacgagcugauuccucauccggaucaacuuggccccacggucgggagcgccgaaggccucgaccugguguccgcuaaagaucuggccggacagcucacagaccacgauuggucucuguuuaauagcauccaucagguugagcuuauucacuacgugcugggcccucaacaucucagagacgucaccaccgcuaaccuggaacgguucaugcgcagauuuaaugagcugcaguauuggguggccacagaacuuugccugugucccgugccugggccccgggcccagcuccugcgcaaguucaucaagcucgcugcgcaccugaaagagcagaagaaccuuaauuccuuuuucgccgucauguuuggacugucuaacagcgcuauuuccagacucgcccacaccugggagcggcugccucauaaaguucgcaagcuguacagcgcccuugaaagacugcucgaucccucuuggaaucaccggguguauagacuggcucucgccaaacuguccccgccugugauccccuucaugccucuucugcucaaggacaugacauuuauccaugagggcaaccacacgcuggucgaaaaucugauuaacuucgagaagaugcgcaugauggcgcgggcugccagaaugcuucaucacugccgcagccacaaucccgugccgcugucuccucuccgguccagaguuagccaucugcacgaagauucucaaguggcccgcaucagcaccuguuccgagcagagccucucuacacggucccccgcuagcaccugggccuacguccagcagcugaaagugauugacaaccaaagagagcuuucccgccugucucgggaacuggagccuuga

SEQ ID NO: 74648 - RNA, 2604 nt, Artificial Sequence
  derived and/or modified sequence opt5 from RAPGEF4__Homo_sapiens__NP_001093867
augcuguacaagaaauauagacaguacauggccggccuccuggcucccccuuauggggugauggagaccggaagcaacaaugaccggaucccggauaaggaaaacacaccccuuauugagccucacgucccccugcgcccugccaauacgaucaccaaaguucccuccgaaaagauucucagagcgggcaaaauccugcggaacgcuauucuuucucgcgccccucauaugaucagagaccggaaguaccaccugaagacauaucgccaaugcuguguggggaccgagcucguggauuggaugaugcagcagacaccgugcguccauagcagaacccaggccgugggaauguggcaaguucugcuggaagacggcgugcucaaucacgucgaucaggagcaucacuuccaggacaaauaccuguuuuaucgguuccuugaugacgagcacgaagaugcuccccugccuacagaggaagagaagaaagagugugacgaggagcuccaggauaccaugcugcuucugucccaaauggggcccgacgcccauaugcgcaugauccucagaaagccucccggacagcggacgguggaugaccuggaaauuaucuacgaggaacugcuccacauuaaagcucugucucaucuuagcaccacaguuaagcgcgagcuggccggcgugcucaucuuugagucccacgcgaagggcgggaccguccuguucaaccagggagaagagggcacaucuugguacauuauccuuaaagggagcgugaauguggucauuuauggaaagggcguugugugcacccugcacgaaggggacgauuuuggaaaacucgcccuggugaacgacgcuccgagagccgcuuccaucguccugcgggaggauaauugucauuuccuccgcguggacaaggaagauuuuaacagaauccugcgggacguugaggccaauacggugagacuuaaagagcacgaucaggacguccuggugcucgaaaagguuccugcgggcaaccgcgccagcaaucaaggcaacucucagccccagcaaaaauacacagugauguccgggaccccugagaagauucuggaacauuuccuugagacaauccggcuggaagcuacccucaaugaggccaccgauagcguccugaacgacuuuauuaugaugcacugcguguucaugcccaacacacagcugugucccgcucucgucgcccauuaucacgcccagccuucucagggaacggagcaagaaaagauggauuacgcucugaauaacaaaagacgcgugauccggcuuguucugcagugggcggccauguauggcgaccuccugcaggaggacgauguguccauggcuuuucuggaagaguucuacgucagcgugucugacgaugccagaaugauugccgcucuuaaggagcagcucccggaacuggagaaaaucguuaagcaaaucuccgaagacgccaaagcgccccagaagaagcacaaagugcugcuccagcaguuuaauaccggggaugagcgcgcucaaaagcggcagccuauuagaggaagcgacgaaguccuguucaaaguguauugcauggaucauacauacaccacaauccgcgugcccguugccaccuccgucaaggaggugauuucugccguggcugacaaacuuggcagcggggagggacugaucauugucaagauguccagcggcggcgaaaaggugguucucaaaccuaacgaugugucugucuucacgacacugaccaucaaugggcggcuguuugccugucccagagagcaguucgacucccuuaccccgcucccugaacaggagggacccacagugggcaccguugggacauuugaacugaugagcucuaaggaucuggcuuaccaaaugacgaucuaugacugggaacucuucaacugcgugcacgagcuggaacuuauuuaccauaccuuuggacgccacaauuucaaaaagacaaccgccaaccuggaucucuuucugcggagauucaaugagauccaguuuugggucgugacagaaauuugucugugcagccagcuuuccaaacggguucaacuccugaagaaguucaucaaaauugcggcccacugcaaggaguauaaaaaccugaauagcuuuuucgcuaucgugaugggccucucuaacgucgccgugucccgccuggcucuuaccugggaaaagcugccuagcaaauuuaagaaauucuacgccgaguucgagucucucauggaccccuccagaaaucaucgggcguauagacugacgguggccaagcuggaaccuccccuuauuccguuuaugccucuccugaucaaggacaugaccuucacacacgaggggaacaaaaccuuuaucgauaaucuggucaacuucgaaaagaugcgcaugauugcuaacacagcccggaccguuagauacuaucgcagccagcccuuuaaucccgacgcugcccaggccaacaaaaaucaucaggaugugagaucuuacgugcggcaacucaacgucaucgacaaucagcgcacgcugucccagaugagccacagacuugagccucggcgcccguga

SEQ ID NO: 74649 - RNA, 2193 nt, Artificial Sequence
  derived and/or modified sequence opt5 from RAPGEF5__Homo_sapiens__NP_036426
auggccaucggcguguggcagcugcuccuggacauggggauuaugcuuagcgucgaucaacaccuguacuuccaggacaccuauguguuuuaccaguucuccucugaugagugcagcuaucucuacugugaauuugagagagaagaggaauggcagaacggaguuaagcugcuucugcaacucgugccccugaucccugcucggggcgggauuugcgagcugucccaucagaaaaucgaggacucugaagagagcuccgaugaaauucucguccgccugacaucugccgugcagagagagcuugcggcuguuaucgcccugaaggcccggaaaagcgcuaucgagcaggacgaagagaauaacgauaagcacguggccgucacggaagcugaguccgugccggacagccaagccggaguuauguguaaacuccaggaacgcgaugagauuggcagaaucgagcuggugcagaaacuugcgaaggaaaauuaucaguuccugcaaaccgacaaaaaggagcaggaaaaaucugagcaucaggaugacgaagucacaaccgugcaagugaaggagcaggaucaguccguccucguucugaaaaaggugcagugcugugggcccgccccuacagcuggaagcgccgagucucacuggcgguacguggucguguccggcacccccgaaaagauucuggagcaucuccugaacgaccuucaccuggaagagguucaagacaaagaaacagagacccuccuggaugacuuucuucugacguauaccguguucaugacaaccgaugaccucugccaggcucugcugcgccacuacagcgccaagaaauaccagggcaaggaggaaaauucugaugucccuagacggaaacgcaaggugcuccaucugguuucccaguggaucgcgcuuuauaaagacuggcugcccgaggaugaacacagcaagauguuucucaagacaauuuacagaaacgugcuggacgaugucuaugaguacccuauccuugagaaagaacugaaggaguuccagaaaauucucgggaugcaucggcgccacaccguggacgaauauuccccgcaaaagaaaaauaaggcccuguuucaccaguucucucugaaggagaacuggcuccagcauagaggaacggucacagaaaccgaggagaucuuuugucacguguacaucacagaacauagcuauguuuccgugaaagcuaaggucagcucuauugcccaagagauccugaaagugguugcugaaaagauucaguacgccgaggaagaucuugcccugguggcuaucaccuucuccggcgagaaacacgagcuccagcccaaugaccuggucauuagcaagucucuggaagcgagcgggcggaucuacguguaucgcaaggaccuugccgauacccucaacccuuuugcugagaaugaagagucccagcaaagaucuaugcggauccugggaaugaacacaugggaccuggcccucgaacugaugaauuucgauuggagccuuuucaacuccauucaugagcaggagcugaucuacuuuacguucagcagacagggcucuggggaacacaccgccaaucucucccugcugcuucaacgcugcaacgaggugcagcucuggguugcuacagaaauucugcuguguagccagcucggaaaacggguccagcuggugaagaaauuuaucaagauugccgcgcacugcaaagcucaaagaaaccuuaauucuuucuuugccaucgugaugggccugaacaccgccuccgucagccgccucucccagacaugggagaagauccccggcaaguucaaaaagcuguuuucugagcuggaaagccuuaccgacccuucccucaaucauaaggcuuaucgggaugccuucaagaaaaugaagcccccgaaaauuccuuuuaugccccugcugcucaaggacgugacguucauccacgaggggaacaagacauuucuggauaaucuuguuaacuucgaaaaacugcauaugauugcugacaccgugagaacccuccgccacugucggacaaaucaguuuggagaucugucuccuaaggagcaccaggaacugaaaagcuacgucaaccaucuuuaugugaucgacucccaacaggcccucuucgagcugagccacagaauugagccccgcguuuga

SEQ ID NO: 74650 - RNA, 1935 nt, Artificial Sequence
  derived and/or modified sequence opt5 from RAPH1__Homo_sapiens__NP_976241
auggagcagcugagcgacgaagagaucgaucacggcgccgaagaggacuccgauaaggaagaccaagaucucgacaaaauguucggggcuuggcugggagagcuugauaagcugacccagucucucgacagcgauaaacccauggagccugugaagagauccccgcugcggcaggaaacaaacauggccaauuuuucuuaccgcuucagcauuuauaaccuuaaugaggcgcugaaccagggcgaaacggucgaccucgaugcucugauggccgaccugugcuccaucgagcaagagcucucuagcauuggguccggaaauagcaaaagacagaucaccgaaacaaaggccacccagaagcugcccguuucucggcauacacuuaaacacggcacccugaaggggcucuccucuagcuccaaccgcauugcuaaaccuagccaugccucuuacucccuggaugacgugacagcucagcuugagcaagccagccuguccauggacgaagcggcccagcagucugugcucgaggauaccaagccccuggucacgaaucagcacagacggaccgcuagcgccggaacaguguccgacgcugaaguucauagcaucucuaacuccagccacucuagcaucaccuccgccgcgucuagcauggauucccuggacauugauaaagugacacgcccucaagagcucgaccugacccaccagggccagcccaucacggagcaugccauuagccuuagauguucuuccaagcaagcuaagcggcacaucgauuuuacagaagaacaggccgaacugaccccucauagcuaucucgaccgcgagacaucucugcuucugagaaauauugcuggcaaaccgucccaccuccugaccaaggaggagcaggccgccaaacugaaggcugagaaaauccgggucgcgcucgaaaagauuaaagaggcccaggugaagaagcugguuauccgcgugcacaugagcgaugacuccucuaaaaccaugauggucgaugaaagacaaacagugcgccaggugcuugacaaccugauggacaagagccauugcggguacucccucgauuggucucuggucgagacgguuagcgaacuucagauggagcggaucuucgaggaccacgaaaaucugguggagaaccuccugaauuggaccagagauucccagaacaaacugauuuuuauggaacggaucgagaaguaugcucucuucaaaaauccccaaaacuaccugcuuggaaagaaggagacagccgaaauggccgacagaaacaaagaggugcugcucgaagaguguuuuugcggcagcucugucaccgugccugaaauugaggggguucuguggcugaaggaugacggcaaaaaguccuggaaaaagcgcuauuuccuucuccgggcuagcggaaucuacuacgugcccaaggggaaagccaaggucucuagagaucugguguguuuucugcagcucgaccauguuaauguguauuacggacaggauuaucgcaacaaauacaaggcgccuacagacuauugccugguccuuaaacacccccagauucaaaagaagucccaguacaucaaauaucuguguugcgaugacgugcggacccuccaucagugggucaauggcaucagaauugcuaaguacggcaaacagcuguacaugaacuaucaagaggcccugaagcgcacggaaagcgccuacgauuggacaucucuuagcuccagcucuaucaaauccgggagcuccucuagcuccauuccggagucucagagcaaucacuccaaccagucugacagcggaguguccgacacccaaccugcuggccacguucggagccagucuaucguguccagcgucuucucugaagccuggaagagagggacccagcucgaggaauccagcaaauga

SEQ ID NO: 74651 - RNA, 1239 nt, Artificial Sequence
  derived and/or modified sequence opt5 from RAPSN__Homo_sapiens__NP_005046
augggccaggaccaaaccaagcagcagaucgagaaagggcugcagcucuaccaaagcaaccagacagaaaaggcccuucagguguggacgaaaguccuggagaaguccucugaucugaugggaagauuccggguucucggcugccuggugaccgcucacagcgaaauggggcgcuauaaagagaugcuuaaguuugccgugguccagauugacacagcgagagaacuggaggaugcugacuuccuccuggaguccuaccugaaucucgcccggucuaacgaaaagcugugugaguuucauaaaaccaucagcuauugcaagacaugucuuggacugcccggcacccgcgccggggcucaacucggaggccaggugucccugucuaugggcaaugccuuccuugggcugagcguuuuucagaaagcucucgaauccuucgagaaggcccugagauacgcgcacaacaaugaugacgccaugcuggagugccggguguguugcagccucggaucuuuuuaugcucaggucaaagauuacgaaaaggcccuguucuuuccuuguaaggcugccgagcuugugaacaauuauggcaaaggguggucccugaaguaccgcgcgaugagccaauaccauauggccguugcuuauagacuccugggacggcuuggcucugccauggaaugcugugaggaauccaugaaaauugcucugcagcacggggaccgcccgcuccaggcccugugccugcucuguuucgccgauauccauagaagccggggagaccuggagacagcuuuuccccgcuacgauucugcgauguccauuaugaccgagaucggcaacagacuuggccaagugcaggcccugcucggggucgcuaagugcuggguggcccggaaagcccuggacaaggcucuugaugccaucgaacgcgcgcaggaccuggcugaggaagugggaaauaaacucagccagcugaagcugcacugccucuccgagucuauuuauagaagcaagggccugcaacgggaacuuagagcccacgucguucgcuuccaugaguguguggaggaaacggagcuguacugcgggcucuguggagaauccaucggcgagaaaaacagccggcugcaggcccugccuugcucucacauuuuucaucuuagaugucuccagaauaacgggacccgcuccugccccaauugucggagaagcucuaugaagccuggauucguguga

SEQ ID NO: 74652 - RNA, 1374 nt, Artificial Sequence
  derived and/or modified sequence opt5 from RARA__Homo_sapiens__NP_001019980
auguacgagagcguggaagucggcgggcccaccccuaacccguuccugguuguggacuuuuauaaucagaacagagccugccuccugcccgagaagggacuuccugcucccggcccuuacuccacaccccugcggacgccucucuggaaugggucuaaccacagcaucgaaacccaauccucuagcuccgaggaaauugugccgucucccccuagccccccuccccugccgcgcaucuauaaaccuuguuucgucugccaggauaaguccagcggauaccauuauggcgugucugccugugaggggugcaaaggauuuuucagacgguccauucagaagaauaugguuuacacaugucaccgcgacaaaaacugcaucauuaauaaggugaccagaaaccggugucaguauugccgccuucaaaaguguuuugaggucggcaugagcaaagaaucugugagaaaugaucggaacaagaaaaagaaagagguucccaagccugaaugcuccgagagcuacacacugacccccgaggugggcgaacucaucgagaagguccgcaaagcgcaucaggaaacauuccccgcucugugucagcuggggaaguacaccacgaauaacucuuccgagcagagagugagccucgacaucgaucugugggacaaauuuuccgaacuuucuaccaagugcauuaucaaaacaguggaguucgccaagcaacugccuggauuuaccacacucaccauugccgaucagaucacgcugcuuaaagcugccugccuggacauucucauccugcggauuuguacacgcuauaccccggagcaggauacaaugaccuucagcgacggccugacccucaauagaacacagaugcacaacgcuggguuuggaccccugacggaucuugucuucgccuuugcgaaucaacugcucccucuggaaauggacgaugccgagaccggccuucuguccgcuaucugccucaucuguggggaccggcaggaccuggaacagcccgaucgcguugacaugcugcaagagccucuccuggaagcccuuaagguguacgugagaaagcggagacccagccgcccgcauauguucccuaaaaugcugaugaagauuacagaucuccggucuaucuccgcuaaaggagccgagagagucauuacccugaagauggagauccccggcagcaugccuccccuuauucaggaaaugcuggagaacucugaaggccucgacacacugagcgggcagccuggaggcgggggacgcgauggcgggggacuggcgcccccgccuggcuccugcucucccagccucucccccagcucuaaccgguccagcccugccacccacucuccguga

SEQ ID NO: 74653 - RNA, 1347 nt, Artificial Sequence
  derived and/or modified sequence opt5 from RARB__Homo_sapiens__NP_000956
auguucgacugcauggaugugcugagcgucucccccggccagauccucgacuuuuacaccgccucuccuagcuccuguaugcugcaagagaaggcucuuaaagccugcuucucugggcugacacagacggaauggcagcacagacauaccgcgcagagcauugagacacaauccaccucuagcgaagaacucguuccguccccucccagcccccugccucccccucggguguauaagccguguuuugugugccaggauaaaucuuccggauaccacuauggcgucagcgcuugugaagggugcaagggauucuuucgcagaucuauccagaaaaacaugauuuacacaugucaucgggacaagaauugcgugaucaacaagguuacccgcaauagaugucaguauugccggcuucaaaaauguuucgaggugggcauguccaaggagagcguccgcaacgauagaaauaaaaagaaaaaggaaacaucuaagcaggagugcaccgaauccuacgagaugacggccgagcuggacgaucucaccgagaaaauucggaaggcccaccaggagacauuucccagccugugccagcuggggaaauauaccacaaacuccucugcugaccaucgcgugagacucgaucugggacuuugggacaaguucagcgaacuggccaccaaauguaucaucaagauuguugaguuugcuaaacggcucccuggcuucacgggccugacaaucgccgaucaaauuacccuucugaaggcggccugccucgacauccugauucugcgcaucuguacaagauacacccccgaacaggauaccaugacauuuuccgacgggcucacgcugaaucggacccagaugcacaacgcuggauucggcccucuuacagaccugguguuuaccuucgccaaucaacuccugccccuugagauggaugacacagagaccgggcugcucagcgcuauuugccugaucuguggagaucgccaggaccuggaggaaccgacgaaggucgauaaacuccaggaaccucugcuugaggcccugaagaucuacauuagaaaacggagacccucuaagccucacauguuccccaaaauccucaugaagauuacagaccugcgcuccaucagcgcgaagggcgccgaacgggugauuacccuuaaaauggagauccccgggucuaugccuccgcugauccaggagaugcucgaaaacagcgagggacaugaaccccugaccccuuccucuagcggcaauacagcugagcacucccccagcauuucuccuuccagcguggaaaacucuggcgucucccaaagcccccugguucaguga

SEQ ID NO: 74654 - RNA, 1332 nt, Artificial Sequence
  derived and/or modified sequence opt5 from RARG__Homo_sapiens__NP_001036193
auguacgacugcauggagaccuucgcccccggcccuagacggcuguauggggcugccggaccgggcgcggggcugcugcgcagagcuacaggaggcagcuguuuugccgggcuugaauccuucgccuggccccagccugcuucucugcaaagcguggagacgcaguccaccucuagcgaagagaugguccccuccucuccuagcccucccccgcccccucggguuuacaagcccugcuuuguguguaacgauaaauccagcggauaucacuacggcgugucuuccugcgaaggcuguaagggguucuuucgcagaagcauccagaaaaauauggucuauacaugccaucgggacaagaacuguauuaucaauaaagugacccgcaacagaugccaguacugucggcuccaaaagugcuucgagguuggaaugucuaaggaggccgugcgcaaugauagaaacaaaaagaaaaaggaagucaaagaggaaggcuccccugacagcuaugagcugucuccccagcuugaggaacugauuacaaagguguccaaggcucaccaggagaccuuuccgagccucugucagcuggggaaauacacaaccaauuccucugccgaucaucggguucaacuggaccucggacugugggauaaguucagcgaacuugcgacgaaaugcaucauuaagaucguggaguuugccaaacgccugccuggcuucaccgggcucuccaucgcugaccagauuacacugcuuaaggccgcuugccuggauauccucaugcugagaauuuguacccgguacacacccgaacaggacaccaugacguuuagcgauggacugacacucaaccgcacccagaugcacaaugccggcuucggcccucugacagaccuugucuuugcguucgccgggcaacugcucccccuggagauggaugacaccgagaccggacuucugucugcuaucugccucauuuguggcgacagaauggaucuggaggaacccgaaaaaguggacaagcugcaggagccucuccuggaagcccuucggcuguaugcuagacgccggagaccgucccagcccuacauguucccucgcaugcucaugaagaucacagaucugcgggggauuagcacgaaaggagccgagagagccaucacccuuaagauggagauccccggcccuaugcccccgcugauucgcgaaaugcucgagaacccugaaauguuugaggacgauucuagccaacccgggccucaucccaaugcuuccucugaagacgaggugccuggaggccagggcaaagggggacucaagagccccgcguga

SEQ ID NO: 74655 - RNA, 687 nt, Artificial Sequence
  derived and/or modified sequence opt5 from RARRES1__Homo_sapiens__NP_002879
augcagcccagacggcaacgccugccugccccguggagcggccccagagggccucggcccaccgcuccucuccuggcccuucugcuccugcuugcgcccguggcugccccugccggauccggcgacccggaugaccccgggcagccucaggaugcuggagucccccgcagacugcuccagcaagccgcucgggccgcgcugcacuucuuuaacuuccgcucuggcagcccuuccgcccugagaguucucgcugaggugcaggaagggcgggccuggaucaaucccaaggagggaugcaaagugcaugucguguuuucuacagaacgcuacaacccggagagccugcuucaggaaggcgagggcagacuggggaaguguuccgcucggguuuucuuuaaaaaucagaagccucgccccacgauuaacgugaccugcacaagacucaucgagaaaaagaagcggcaacaggaagacuaucugcuuuacaaacagaugaagcagcugaaaaauccucucgagauugucucuauccccgauaaccacggacauauugaccccagccugcgccugaucugggaucucgccuuccugggcuccagcuaugugaugugggaaaugaccacacaaguuucucacuacuaucuugcgcagcugaccuccgugagacaguggguccggaagacauga

SEQ ID NO: 74656 - RNA, 492 nt, Artificial Sequence
  derived and/or modified sequence opt5 from RARRES2__Homo_sapiens__NP_002880
augagacggcugcucaucccccuggcccuuuggcugggcgcugugggggucggaguugccgagcucaccgaagcgcagcgcagaggccugcaaguggcucuugaggaguuccacaagcauccuccggugcagugggccuuucaggaaacaagcgucgaauccgccguggacacgcccuucccugcugggauuuuuguucggcuggaguucaaacuccagcaaaccucuugccgcaagagagauuggaaaaagcccgaguguaaagugcggccuaacggacgcaagagaaagugccuggccuguaucaaacugggcagcgaagacaagguccucgggcggcuggugcacugccccauugagacacagguucuucgcgaagcugaggagcaucaggaaacccagugucugagagugcaacgggccggagaggauccucacuccuuuuacuucccgggccaguuugcguucucuaaagcccucccccgcagcuga

SEQ ID NO: 74657 - RNA, 495 nt, Artificial Sequence
  derived and/or modified sequence opt5 from RARRES3__Homo_sapiens__NP_004576
auggccagcccccaccaggagccuaagccgggcgaccugaucgaaauuuucagacucggguacgagcauugggcucuguauaucggagauggcuacgugauucaccuugcgcccccuuccgaauaucccggggccggaucuagcuccgucuuuucuguucugagcaacuccgcugaggugaaacgggaacgccucgaggacguggucggcgggugcuguuacagagugaauaacucucuggaucaugaguaucaaccucggcccguugaagugaucauuagcuccgccaaggagauggucggacagaaaaugaaguacagcaucgugucucgcaauugcgaacacuucguuacccagcuuagauauggcaaaucccgguguaaacagguggagaaggccaaggucgaggugggcguggcuacagcccuggggauccucgucguugcuggaugcagcuuugccauucgcagauaccaaaagaaagcgacggccuga

SEQ ID NO: 74658 - RNA, 1737 nt, Artificial Sequence
  derived and/or modified sequence opt5 from RARS2__Homo_sapiens__NP_064716
auggccugcggcuucagacgggcuaucgccugucagcugagccgcgugcucaaccugcccccugagaaucuuauuaccuccaucucugcggucccgauuagccaaaaggaagagguugcugacuuucagcuguccguggauucucuccuggaaaaagacaacgaucacagcagacccgacauccaggugcaggccaagcggcuugccgagaaacugcgcugcgauacagucguguccgaaauuucuacggggcaaagaaccguuaauuucaagaucaaccgggagcuccugacaaaaaccgugcugcagcaggucaucgaggacggaagcaaguacggccucaaguccgaacuguuuagcgggcuuccucagaaaaagauugugguugaguucucuucccccaauguggcuaaaaaguuucaugucggacaucugcgcagcacaaucauuggcaacuucaucgccaaucucaaagaagcucuggggcaccaagugauuagaaucaacuaucuuggagauuggggcaugcaguuuggccugcucgggaccggauuccagcuguuuggcuacgaggagaagcugcagucuaauccucuccaacaccuguucgaaguguauguccagguuaacaaggaggccgcggacgauaaauccguggccaaggcugcccaggaauuuuuccaacggcuugagcugggggacgugcaggcucucagccuguggcagaaauuucgcgaucuuucuauugaagaguacaucagagucuauaagcggcugggaguguacuucgacgaguauuccggcgagagcuucuaccgcgaaaaaucccaggaaguucucaagcugcuggagucuaaagggcuccugcuuaagacaaucaagggaaccgccguggucgaucugagcggcaauggcgaccccuccagcauuuguacggugaugagaucugacgggaccucccucuacgcgacacgggaucuggccgcugccaucgaccgcauggauaaauauaacuuugacaccaugauuuacguuacagauaagggacagaaaaagcauuuccaacagguguuucagaugcuuaaaaucaugggcuaugacugggcugaaagaugccaacacgucccuuucggggugguccagggaaugaagacccggagaggcgaugugacguuucuggaggacguucucaaugagauucagcugcgcaugcugcagaacauggccagcaucaagacaaccaaagaacucaagaauccgcaagagacagccgaacggguggggcuggcugcgcuuaucauucaggauuucaaaggacugcuccugucugacuacaaguuuagcugggauagagucuuccagucccgcggcgacaccggcguguuucugcaguauacccacgcccggcuucauucucucgaggaaacauucggguguggauaccugaacgacuuuaacacggcuugccugcaagagccccagagcguuuccauccuccagcaucugcuuagauucgaugaggugcuguauaaaagcucucaagacuuucagccucgccacauugucuccuaccuccugacccugagccaccuugccgccguggcucacaagacacuccagaucaaggauucucccccugaaguggccggcgcgcggcugcaucuguucaaagcuguuagauccguccucgccaaugggaugaagcugcuuggaauuacccccgugugucgcauguga

SEQ ID NO: 74659 - RNA, 1983 nt, Artificial Sequence
  derived and/or modified sequence opt5 from RARS__Homo_sapiens__NP_002878
auggacgugcuggucagcgagugcuccgccagacuccugcagcaagaagaggaaaucaagucucuuaccgcugagauugaucggcugaaaaacuguggcugccucggggccagccccaaucuggaacagcuucaggaggagaaccugaagcucaaauaccgccugaauauccugagaaagucccuccaggcggaacggaacaaaccuacaaagaauaugauuaacaucauuucucgccugcaagagguuuucggacacgcuaucaaggccgccuauccggaccuugaaaaucccccucugcucgugacgcccagccagcaggcuaaauuuggcgauuaccaguguaacuccgccauggggaucucucaaaugcugaagaccaaagagcagaaggugaauccuagagagauugcugaaaacaucacaaaacaucuucccgacaaugagugcauugaaaaggucgagaucgccggaccuggcuucauuaacgugcaccugagaaaggauuuuguuagcgaacagcucaccucccugcuggugaaugggguccagcucccggcgcugggagagaacaaaaaggugaucguugacuucagcucucccaauauugccaaagagaugcaugugggccaccuucgcuccacaaucaucggcgaaagcauuucuagacuguuugaguucgcuggguaugauguccuccggcugaaccaugugggagacuggggcacccaauuugggaugcuuaucgcccaccuucaggauaaguucccugacuaccucacaguguccccucccauuggagaucugcaggucuuuuauaaagaaagcaagaaacgcuucgacaccgaggaagaguuuaagaagagagcuuaccaauguguugugcugcuccagggcaaaaaccccgauaucacgaaggccuggaaacugauuugcgacgugucucggcaggagcuuaauaagaucuaugacgcgcuggaugucucccucaucgaacgcggggagagcuucuaccaggacagaaugaacgauauugugaaagaauuugaggaccggggauucguucaaguggaugacggccgcaagaucgucuucgugccgggcuguuccauuccucugaccaucguuaagucugaugggggauacacauaugacaccagcgaucuugccgcuauuaaacagagacuguuugaagagaaggccgacaugaucaucuacguggucgauaauggccaguccgugcacuuccagacaauuuuugcugccgcccaaaugaucgggugguaugaccccaaagucacccggguguuccaugcuggauuuggcguugugcucggggaggacaagaaaaaguucaagacgagaagcggagaaacaguccgccugauggaucugcucggcgagggccugaaacggucuauggacaagcugaaagaaaaggagagagauaaagugcugaccgcggaggaacucaacgccgcucagacauccguugccuacgggugcauuaaguaugccgaccugagccacaaucgccugaacgauuacaucuuuucuuucgacaagaugcuugaugaccggggaaauaccgcugccuaucuccuguacgcguuuacccggauucgcagcaucgcucggcuggccaacauugaugaggaaaugcuccagaaagccgcuagagagacaaagauccugcuugaccaugaaaaagaguggaagcugggccgcuguauccuccgguucccugagauucugcagaaaauccuggaugaccuuuuucuccacacgcugugcgauuacauuuaugaacuggccaccgcuuucacagaguuuuacgacuccuguuauugcguggaaaaggacagacaaaccgggaaaauccucaaggucaauauguggcgcaugcugcuuugcgaggccguggcggccgugauggcuaagggauucgauauucugggcaucaaacccguucagcggauguga

SEQ ID NO: 74660 - RNA, 3144 nt, Artificial Sequence
  derived and/or modified sequence opt5 from RASA1__Homo_sapiens__NP_002881
augauggccgcugaggccggcagcgaagaagggggacccgugaccgcgggcgcugggggaggcggggccgccgcuggauccucugccuacccugcugucugcagaguuaagaucccggccgcgcugcccguggccgcugccccuuaucccggccucguggagacaggcgucgcugggacgcugggaggcggggccgcgcuuggaagcgaguuccugggcgccggguccguggcuggagcccucggcggcgcugggcugaccggaggcgggacagccgccggaguugcuggcgcggccgcugggguggccggagccgcugucgccggcccuucuggcgacauggcgcuuaccaaacugcccacaagccuccuggcugaaacccuggggccuggaggcggguuuccgccccucccucccccucccuaccugccgccucuuggagccggccuggggacaguggaugagggcgacucccucgauggacccgaguaugaagaggaagagguugccauuccucugaccgcuccucccacgaaccagugguaccacggcaagcuggaccggaccaucgccgaggaacgccugagacaagcugggaaaucuggaagcuaucucauucgggaguccgaucgcagacccggcagcuucgugcugucuuuucugucccagaugaaugucgugaaccauuuccggaucauugccauguguggggacuacuauaucggaggccgcagauuuagcucucucuccgaucugaucggguacuacagccacgugucuugccuucugaagggcgaaaaacuccuguauccggucgcgcccccugagcccguugaagaccggcgcagagugcgggccauucuuccuuacacaaaggugcccgauaccgacgagaucuccuuccugaagggagauauguuuauuguccauaaugagcucgaagacggcuggaugugggugacaaaccugcgcaccgaugagcaggggcugaucguugaagaccucguggaggaagucggaagagaggaggacccgcacgaaggcaaaauuugguuccaugggaagaucagcaaacaggaggcuuauaaucugcuuaugacggugggacaaguuuguuccuuucuggugcggccuucugauaacacacccggcgacuacagccucuauuuccgcaccaaugaaaacauucagagauuuaagaucugcccuacacccaauaaccaguucaugaugggcgggcgguacuauaauuccaucggagauauuaucgaccacuacagaaaagagcagauugucgaaggcuacuaucugaaggagccugugcccaugcaagaucaggagcagguccuuaacgacaccguggaugggaaggaaaucuacaauaccauucgccggaaaacaaaggacgccuuuuauaaaaacaucguuaagaaaggauaccugcucaagaaaggcaaggggaagagauggaaaaaucuguauuucauccuggagggaagcgaugcucagcucauuuacuucgaaucugagaagcgcgccacgaaaccgaagggccugaucgaccuuuccguguguagcgucuaugugguucacgauucucuguuugggcggccuaacugcuuccaaauugugguccagcauuuuagcgaggaacacuacaucuucuacuuugcgggcgagacccccgaacaggccgaggacuggaugaaaggacuccaggcuuucuguaaccugagaaaguccucucccggcacaagcaauaagcgccugcggcaaguguccagccuugugcuccauauugaagaggcccacaaacugccuguuaagcacuuuaccaacccguauugcaauaucuaccugaacucuguccagguggcuaaaacacaugccagagaggggcagaaucccgugugguccgaagaguucgucuuugacgaucucccucccgacaucaaccgcuucgaaauuacccugagcaauaagacgaaaaagucuaaggauccugacauccuuuuuaugcggugucaacuguccagacuccagaaaggacacgccacagaugagugguuccugcugagcucccauauuccccuuaagggcaucgaaccugggucucuccgcgugcgggcuagauauagcauggagaaaauuaugcccgaggaagaguacuccgaauuuaaggagcugauccugcagaaagaacuccacguuguguaugcgcugucucaugucugcggacaggaccggacccuucuggccagcauucuccugcgcaucuuccugcacgagaaacuugagucccuccugcuguguacccucaacgauagagaaaucagcauggaggacgaagcuacaacccuguuccgggccacaacgcuugccucuacccugauggagcaauacaugaaggcuacagccacccaguuugugcaccaugcgcucaaggauuccauucugaagaucauggagagcaaacagucuugcgaacuguccccgagcaaacuugagaagaaugaagacguuaacacaaaucucacccaccuucugaacauucucucugagcugguggaaaagaucuucauggcuagcgagauucuuccucccacgcugagauauaucuacggcugccuccagaaauccguccaacauaaguggccuaccaauacaaccaugcgcacacgggugguuagcggcuuuguguuccugagacugaucugucccgccauucuuaacccgcgcauguuuaauaucauuucugauuccccuagccccaucgccgcuagaacccugauucucgucgccaaguccgugcagaaccuggcgaaccucguggaguucggggcuaaagaaccuuacauggagggagucaaucccuuuaucaagucuaacaaacaccggaugaucauguuccuggacgaacuuggcaauguucccgagcugccugauacgacagaacacagccgcaccgaccucuccagagaccuggccgcccugcaugagauuugcguggcucacucugaugagcuucggacacugagcaacgaacgcggggcccagcagcaugugcucaagaaacugcucgcuaucaccgagcugcuucaacagaagcagaaucaauauaccaagacaaacgacgucagauga

SEQ ID NO: 74661 - RNA, 2553 nt, Artificial Sequence
  derived and/or modified sequence opt5 from RASA2__Homo_sapiens__NP_001290174
auggccgcugccgcgcccgcugccgccgcugccagcuccgaggcuccugccgcgucugccaccgcugaaccggaggccggcgaccaggauagcagagaagugcggguccugcaaucccuccgcgggaagaucugcgaggcuaaaaaccugcuucccuaccugggaccucacaagaugagagacuguuucugcacaauuaaucucgaucaggaagagguuuaucggacccaggugguggagaaaucucugagccccuuuuucuccgaagaguuuuacuucgaaaucccucgcacguuucaguaucuuucuuucuacgucuaugacaagaacgugcugcaaagagaucuccggauuggcaaaguugccaucaagaaggaggaccuguguaaucauagcgggaaagagacaugguuuucccugcagcccguggauagcaacucugaaguccagggaaaggugcaccucgagcugaaacuuaaugaacugauuaccgagaacggcacaguuugccagcaacucgugguccauaucaaggcgugucacgggcugccucuuaucaauggacaguccugcgacccguacgccaccgugagccuggugggccccucucgcaacgaucagaaaaagacaaaggucaaaaagaaaaccuccaauccucaguucaacgaaaucuuuuauuucgagguuacgagauccucuuccuacacccggaaaagccaauuucagguggaggaagaggacauugaaaaacucgagauucgcaucgaucuguggaauaacggcaaucuggugcaggacgucuuccucggggaaauuaaggugcccguuaacgugcugagaacagauuccucucaucaggcuugguaccuucugcaaccucgggacaauggaaacaaaagcuccaagaccgacgaucucggcagccugcgccuuaacaucuguuauacagaggacuacguccugcccucugaguauuacgggccgcucaagacccugcugcucaaauccccugaugugcagcccauuagcgccucugcugccuauauccugagcgaaaucugcagagacaagaaugaugccguucuuccucuggugcggcuccugcuucaccacgacaaacugguccccuuugcuacggcgguggccgagcucgaucugaaggacacacaggaugcuaacaccauuuuccgcggaaauucccuggccacaagaugucucgacgaaaugaugaaaaucgucggcgggcauuaccugaaggugacccuuaagcccauucuggaugagaucugcgacucuagcaaauccugugaaauugacccuaucaagcucaaagagggagauaacguugagaauaacaaggaaaaucugcgguauuacguggacaaacuguucaacaccaucgucaagagcucuauguccugcccgacagugaugugcgauaucuuuuacagccuuagacaaauggccacgcagcgcuuccccaaugacccucacguucaguauucugcuguguccagcuuugucuuccuccgguuuuucgccguggcggugguuagcccccauaccuuucaccugagaccucaccaucccgaugcucagacaauucgcacccugacacucauuucuaagaccauccaaacgcugggcagcuggggcucccuuucuaaaagcaaguccagcuucaaagagacauuuaugugugaguucuuuaagauguuccaggaagagggguacauuaucgccgucaaaaaguuucuggacgaaaucucuuccaccgagaccaaggaaagcucuggaacauccgagccggugcaccucaaagaaggcgagauguauaagcgggcccaggggagaacccgcauuggaaagaagaacuucaaaaagcggugguucugccugacaagcagagagcugacguaccauaaacagccuggcucuaaggaugcuaucuauaccauucccgugaagaauauccuugccgucgaaaaacucgaggaaagcuccuuuaacaagaaaaauauguuccaagugauucacacagagaagccucuguacguucaggcuaacaauuguguggaagccaacgaguggaucgacguccugugccgcgugagccgguguaaccagaauagacucucuuuuuaucaucccuccguuuaccugaacgggaauuggcuuugcugucaggagaccggagaaaacacacugggcugcaaaccuuguaccgcgggcgugcccgccgauauucaaaucgacaucgaugaggaccgcgaaacggagcggauuuacagccucuucacccugucccugcuuaagcuccagaagauggaagaggcuugcgggacaaucgccgucuaucagggaccgcaaaaagagccugaugacuacucuaauuuugugauugaagacagcguuaccacauucaagaccauccagcagauuaaauccaucaucgagaagcuggaugaaccccacgagaaauauagaaagaagcggucuagcuccgcuaaauacggcucuaaggagaaccccauuguggggaaagccagcuga

SEQ ID NO: 74662 - RNA, 2421 nt, Artificial Sequence
  derived and/or modified sequence opt5 from RASAL1__Homo_sapiens__NP_001180449
auggccaagagcuccucucugaacgugagagucguugagggccgggcucuccccgccaaagacgugagcggguccucugauccuuacugccuggugaaggucgacgaugaagugguugcgcgcaccgcuacaguguggagaagccuuggaccguucuggggcgaggaauauacgguccaucugccccucgacuuucaccagcuggccuucuacgugcuugaugaggacaccguugggcacgaugacaucauuggaaaaaucucccugucucgggaagccauuacagcugauccucgcggcaucgacagcuggauuaaucucuccagaguggaucccgacgccgagguccaaggggagaucugucugagcgugcagaugcuggaagauggacagggccggugccuccgcugucaugugcugcaggcuagagaccuugccccucgggacaucucuggcaccuccgaucccuuugcgcgcgucuucugggggagccaaucucuggagacauccaccauuaagaaaacaagauuuccucacugggacgaaguucucgagcugcgggagaugccgggagcccccagcccucuucgcguggaacugugggauugggacauggugggcaagaacgauuuccucgggauggucgaguuuucucccaagacccugcagcagaaaccucccaagggaugguucagacugcucccguuuccucgggcugaagaggacuccggcgggaaucugggagcccuucgcgugaaaguuagacugaucgaagaucgggugcuccccagccagugcuaucaaccucugauggagcuucugauggaguccguccagggccccgcugaagaggacacggccucuccccucgcgcugcuggaggaacucacccugggcgauuguagacaggaccuugccacaaagcuggugaaacucuuccuggggcgcggacuugcuggccgguuucuggauuaccucaccagacgcgaaguugcccggacaauggacccuaacacccuguucagaagcaauucccuggcuagcaagucuauggagcaguuuaugaagcucguggggaugccguaucugcaugagguccuuaaacccgugauuucccgcgucuucgaagagaagaaauacauggaacuggacccuugcaagauggaucucggacggacgagacgcaucagcuucaaaggcgcccugucugaggaacaaaugcgggagacaagccuggggcuucucaccggauaucugggccccauuguggacgccaucguuggcuccguggggagauguccucccgcuaugcgccuggcguuuaagcagcuccaccggagagucgaggaacgguucccgcaggccgagcaccaacaggaugugaaauaccuggcuauuucuggauuucuuuuccugcgcuuuuucgccccugccauccucacacccaagcuguuugaccugagagaucagcaugcugacccucagaccagccggucccuucuccugcuggccaaggcgguucaaagcaucggcaaccucgggcagcagcugggacagggcaaagaacuuuggauggcuccccugcacccuuuccuccugcaaugcgugucuagaguccgcgauuuucuggaccggcuuguggauguggacggggaugaggaggccggcguucccgccagagcucucuucccgccuuccgccauuguccgcgaaggauaccugcugaagagaaaagaggaacccgcuggccucgccacccgguuugcguucaagaaacgcuauguguggcugagcggggagacacuuucuuuuuccaagagccccgaauggcagaugugucauuccaucccugugucucacauuagagccgucgagcggguggacgagggagcuuuccagcugccgcacguuaugcaaguggucacgcaggauggcaccggggcccuccauacaaccuaccugcagugcaagaaugugaacgaacugaaucaguggcuuagcgcucuccgcaaagccuccgcgcccaacccuaauaagcuggccgcuugucaccccggagccuucagaucugcucgguggacaugcugccugcaggccgagcgcagcgccgcuggcuguuccagaacccauagcgcgguuacgcucggggacuggucugacccucuggaucccgacgccgaagcucaaacaguguaucggcagcuucugcucggccgcgaucagcugagacugaaacuucuggaggacuccaacauggauaccacccucgaagccgacacaggagccugcccugagguccuggcucggcaaagagccgcgaccgcucgccuccuggaggugcuugccgaucuggaccgggcccacgaagaguuucagcagcaggaaagaggcaaggcugcccucgggccccugggaccguga

SEQ ID NO: 74663 - RNA, 3420 nt, Artificial Sequence
  derived and/or modified sequence opt5 from RASAL2__Homo_sapiens__NP_004832
augcagacccccgaggugccugccgaaagaagcccgcggcgcagauccaucucuggcacaagcacguccgagaagcccaacucuauggacaccgcuaauacaagcccuuucaagguccccggguuuuucuccaagcggcugaaaggaucuauuaagcgcaccaaaagccaauccaagcucgauagaaacaccagcuuucggcugccuucucuucgcuccaccgacgauagaagccggggccugcccaagcucaaagaaucucgcucccacgagagccugcuuucuccuugcuccacaguugaaugucuggaccucgggagaggagagccggugagcgugaagccccugcauuccucuauccugggccaggauuucugcuuugaggucaccuaccucagcggguccaaauguuucagcugcaauucugccuccgaacgggacaaguggauggagaaccugcgcagaacggugcagccuaauaaagauaacugucggcgcgcggaaaauguucuuagacuguggauuaucgaggcuaaggaccucgcccccaagaaaaaguauuuuugcgagcugugucuugaugacacccuguucgcccggacaaccagcaaaacaaaggcugauaacaucuuuuggggagaacacuucgaguuuuucucucucccuccccugcauagcauuaccgugcacaucuacaaagacgucgaaaagaaaaagaagaaagauaagaauaacuaugugggccugguuaauauuccgacggccuccgugacaggcagacaguuugucgagaaaugguacccugugucuacccccacaccuaacaaggggaaaaccggaggccccagcauccgcauuaagucccgguuccaaaccaucacaauucuccccauggaacaguauaaggaguucgcugaguuugugacgagcaauuacaccaugcugugcucuguccuugaaccuguuaucuccgugagaaacaaagaggaacuggccugugcgcucgugcauauucugcagagcacagggcgcgccaaggacuuccuuaccgaccuggucaugucugagguggaucggugcggagaacacgacguucucaucuuuagagagaauacaaucgcuaccaaauccauugaggaauaucugaagcuggugggccagcaauaccuccacgaugcccugggggaguucaucaaagcucuuuacgaaagcgacgagaacugugaagucgauccguccaagugcucuagcuccgagcugauugaccaucagucuaaccucaagaugugcugugagcuggccuuuugcaaaaucauuaauagcuauuguguguucccccgcgaacuuaaggagguuuuugcguccuggaaacagcagugccugaaccggggaaagcaagauaucagcgaaagacucaucucugccucccuguuccugcgcuuucucuguccugcuauuaugagccccucucuguucaaucuuaugcaggaguacccugacgaucggacguccagaacacugacccucaucgccaaagugauucagaaccuggcuaauuuugccaaguucggcaacaaggaggaauauauggccuuuaugaaugacuuccuggagcacgaauggggcgggaugaaacgcuuccuucucgagaucagcaaccccgauaccauuucuaauacaccgggauuugacggcuacaucgaccuggggcgggaacugagcguccuccauucccugcuuugggagguggucagccaacuggauaagggagagaacucuuuccuccaggcuaccguggcgaaacugggcccucugcccagaguucuugccgacaucacaaagucccucacgaauccuacccccauucagcagcaacugcggcgcuuuacagaacacaacagcuccccuaaugugucugggagccuguccucuggacuccagaaaaucuucgaggaucccaccgacagcgaucugcacaaacuuaaguccccgucucaggacaacacagauagcuauuuuagaggcaagacccugcuccugguccagcaagccuccagccagucuaugacguacuccgaaaaggacgagcgggaaagcucucugccuaauggcagauccgugagccuuauggaucuccaggacacccaugccgcccagguugagcacgcuucugugaugcuggauguccccauucgccugacagggucccaacucagcaucacccagguggccuccauuaaacagcugcgggagacacagagcacaccccaaucugcgccucaggugagacgcccgcuucaucccgcucugaaccagccuggaggccuccaaccccugagcuuccagaacccuguuuaucaccugaauaaccccaucccugccaugcccaaggccuccauugacucuagccuugaaaaucucuccacggcuucuagcagaucccagucuaacagcgaggauuuuaaacuguccgggccgagcaauucuuccauggaagacuucacaaagcggagcacccagucugaggacuuuucccgcagacauacagucccugaucggcacaucccccuggcccucccucgccaaaacagcaccggacaggcucagaucagaaaaguggaccagggcgggcugggcgcccgggcgaaggcucccccgucccuuccucacucugcuagccugcgcuccaccggaagcaugucuguggucuccgccgcucucguggccgaacccguucaaaauggcagcagaucucggcagcagagcuccucuagccgcgaguccccugugcccaaggucagagcgauucagcggcaacagacacagcaagugcagucucccguugauagcgccacgauguccccuguggagagaaccgcugccuggguccugaacaaugggcaguacgaagaggacguggaagagacagagcagaaccuggaugaagcuaaacaugccgagaaguacgaacaagagaucaccaaacuuaaggaacgccugcggguuagcucuagacgccucgaggaguaugaacggagacugcucgugcaggagcagcagaugcaaaaacugcuucuggaauacaaggcccgccucgaggacuccgaggaacggcugagacgccagcaggaggaaaaggauagccagaugaaauccauuaucucucggcugauggcugucgaggaggaacuuaagaaagaccacgcggaaaugcaagccgugauugaugcuaagcagaaaaucaucgacgcccaggagaagagaauugugagccuggauuccgccaauacacggcucaugucugcucugacccaggucaaggagcgcuauagcaugcaaguuagaaacggaaucuccccgacgaaucccacaaaacucagcauuaccgaaaacggcgaguucaaaaauucuuccugcuga

SEQ ID NO: 74664 - RNA, 369 nt, Artificial Sequence
  derived and/or modified sequence opt5 from RASD1__Homo_sapiens__NP_001186918
augaagcuggccgcuaugaucaaaaagaugugccccagcgacuccgagcucucuauuccugccaaaaacuguuacagaauggugauccugggcagcuccaaggucgggaaaaccgcgauuguuucucgguuccuuacaggacgcuuugaagaugcuuauacgccgaccaucgaggacuuccacagaaaguuuuacagcauucggggcgaaguguaucagcuggauauccucgacacauccgggaaucaucccuucccugccaugcgcagacugucuauccuuaccgauccccggcaccaagugcugccucaggagcagaaccagggagaacgcggcagagcccccgggcaucuccggcaacagggauga

SEQ ID NO: 74665 - RNA, 801 nt, Artificial Sequence
  derived and/or modified sequence opt5 from RASD2__Homo_sapiens__NP_055125
augaugaagacccugagcuccggcaacugcacacucucugugcccgccaaaaauagcuacagaauggucguucugggggcuucccgggugggaaagucuagcaucgugucccgcuuccuuaacggcagauuugaggaccaguauacgccuaccauugaagauuuccaccggaaagucuacaauauccgcggggacauguaucaacuggauauucucgacacaucuggaaaccauccguuucccgccaugagacggcugagcauccuuaccggcgauguguucauucugguguuuucccucgacaaucgcgagagcuucgaugaaguuaagagacugcagaaacagauccuggaggucaagucuugucucaagaacaaaacaaaggaagcggcugagcugccuauggugaucugcgggaauaaaaacgaccacggagagcuuugucggcagguucccaccacagaagccgagcugcucguguccggcgaugaaaauugcgccuacuuugaggucagcgcuaagaaaaacaccaauguggacgagauguucuaugugcuguuuucuauggccaaacuuccucaugaaaugucccccgcucugcaccgcaagauuagcguccaauacggcgaugccuuccauccuagaccguuuuguaugcggcgcguuaaggagauggacgcguaugggauggugucucccuucgccagacggccuuccgugaacagcgaucucaaguacaucaaagcuaagguccugcgcgaaggacaggccagagagcgggacaaaugcacgauucaguga

SEQ ID NO: 74666 - RNA, 2223 nt, Artificial Sequence
  derived and/or modified sequence opt5 from RASEF__Homo_sapiens__NP_689786
auggaggccgacggcgauggggaagaacuggcuagacuccggagcguguucgccgcgugcgacgcuaaccgcuccggaagacuggaacgggaggaauuucgcgcccuuuguaccgagcugagaguccggcccgccgaugcugaggccguuuuccagcgccucgacgcugauagagacggcgccaucacauuucaagaguucgcgcggggguuucugggaucucuucgcggcgggagacggcgcgauuggggaccucuggacccggcccccgcugugagcgaggccggcccugaaacgcacgauuccgaggaggacgaaggcgaugaggacgcugccgcggcccucgcuaccucuugcgggcccgccagcccuggcagagcuuggcaggauuuccaggcccggcugggagacgaagccaaguuuauuccccgcgaggaacagguguccacacuguaccaaaauaucaaccucgucgagccuagacugauucagccguaugagcaugugaucaaaaauuucauucgggaaaucagacuucagucuaccgagauggaaaaccuggcuaucgcgguuaagcgcgcccaggacaaagcugccaugcaacucagcgagcuggaagaggagauggaucagcggauucaggccgcugaacacaagacaagaaaagacgagaagcgcaaggccgaagaggcgcuuuccgaucugcggagacaguacgaaaccgaggugggggaccuccaagucacaaucaaaaagcugcgcaaacuggaggaacagagcaagcgggugucucagaaagaggauguugcugcccucaagaagcaaauuuaugaccuguccauggaaaaucagaaagugaagaaagaucuucuggaggcccagaccaacaucgcuuuucuccagagcgagcuggacgcccuuaagucugauuacgcugaccaaucccugaauacggaaagagaucucgagauuauccgcgccuauaccgaagaccggaacagccuggagagacagauugaaauccugcagacagcgaaucgcaaacuccaugacucuaacgauggacugcgguccgcccuugagaauagcuacuccaaguucaacagaucucugcacaucaauaacauuagccccggcaauaccaucucccggagcucuccuaaauuuauugggcauagcccccagccucucggauaugaccgcuccucuagaagcuccuacgucgaugaggacugugauucucuggcucuuugcgacccccugcaacggacaaacugugaaguggauagccucccggaguccugcuucgacagcggccugucuacccugagagauccuaacgaauacgacuccgagguggaauauaagcaccagcgcggcuuucagcggagccacgggguccaggagucuuucggaggcgaugccuccgacacggauguucccgacaucagagacgaggaaacauucgggcucgaggauguggcuagcgugcuggacuggaagccucaaggauccgucucugaaggcagcauuguguccucuagccgcaaacccaucuccgcccuuagcccccagaccgaucugguugacgauaaugcgaagucuuuuuccagccagaaagccuacaagaucgugcucgcuggggacgccgcugucggaaaaucuuccuuccugaugagacuguguaagaacgaguuucgggaaaauauuagcgccacacuuggcguggauuuccagaugaagacccucaucguugacggcgagcgcaccgugcugcaacugugggauacagccgggcaggagagauuucggucuauugcuaaaagcuauuuccgcaaggcggacggaguccuccugcuuuacgaugugacgugcgaaaaauccuuucugaacaucagagagugggucgacaugauugaagaugccgcucaugagaccgugccuaucaugcucguuggcaauaaggccgacauccgggacacagccgcuaccgaggggcagaaaugugugccgggacacuucggcgaaaagcuggccaugacauauggggcgcuguuuugcgagaccagcgcuaaggauggcucuaacauugucgaagccgugcuucaucucgcccgcgagguuaaaaagagaacggacaaagaugacucccggagcaucacaaaucugaccggaaccaacuccaagaaaucuccccaaaugaagaauuguugcaacggcuga

SEQ ID NO: 74667 - RNA, 1470 nt, Artificial Sequence
  derived and/or modified sequence opt5 from RASGEF1A__Homo_sapiens__NP_001269791
auguuccuggagccccaggaaaccaugccucaaacaagcguggucuuuuccucuauccucggcccgagcugcuccgggcagguucagcccggaaugggcgagagagggggaggcgccgggggaggcucuggcgaccugauuuuccaggaugggcaccuuaucagcggaucccuggaagcucucauggagcaucuggugccuacgguggacuacuaucccgaucggaccuacauuuuuacauuccuucugucuagccgcgucuuuaugccuccccacgaccuccuggccagagugggccaaaucuguguugaacagaagcagcagcuggaggcggggccugagaaagcuaagcucaaauccuucagcgccaagauugugcaacugcuuaaagaauggaccgaggccuuuccguaugauuuccaggacgaaaaggcuauggccgagcugaaggcuaucacacaucgggucacccagugcgaugaggaaaacggaacagugaaaaaggccaucgcgcagaugacccaaucucuccugcuuucccuggccgcucgcagccagcuccaggagcugagagaaaaacugcggcccccugccguugacaagggccccauucucaaaacgaagccucccgcugcccaaaaggauauccuggggguguguugcgacccgcuuguccuggcgcagcagcucacccacauugagcuggaucgcgugucuuccaucuacccugaagaccuuaugcagauugugagccauauggauucucuggacaaucacagaugucggggagaccucacaaaaaccuauucccuggaggccuacgauaacugguuuaauugccugagcaugcucgucgcuacagagguuugucgcguggugaagaaaaagcacagaacccggaugcuggaguucuuuaucgacgucgcccgcgaaugcuucaacauuggcaauuuuaacuccaugauggcuaucaucucuggcaugaaucuuagccccguggccagacugaaaaagacgugguccaaaguuaagacagccaaguucgaugugcucgaacaucacauggacccuagcucuaacuucuguaauuaucggaccgcucugcaaggggcgacacagcgcucccagauggccaacagcucuagagagaaaauugucauccccguguuuaaucuuuucguuaaggauauuuacuuucugcauaaaauccacaccaaccaccuccccaauggacauauuaacuucaagaaauuuugggaaaucagccggcagauccacgaguucaugaccuggacacaaguggagugcccuuuugaaaaggacaagaaaauucaguccuaccugcugacggcuccgaucuauucugaggaagcccucuucgucgccagcuuugaguccgaaggccccgagaaucauauggagaaggauagcuggaaaacccugagaacaacccuucugaaccgcgcuuga

SEQ ID NO: 74668 - RNA, 1401 nt, Artificial Sequence
  derived and/or modified sequence opt5 from RASGEF1C__Homo_sapiens__NP_778232
augccccagacccugagcgccuccgacauggugacaccuggcucucucagcccgcccccuacggagcccaccgauggggaacaagcuggacagccucugcuugacggcgcccccuccucugcgagccuggagacacucauccagcaccuggucccuaccgcugauuacuauccggaaaaggccuacauuuucacauuucuucuguccucuagacucuucaucgagccccgggaacugcuggcccgcguuugccaucucuguauugagcagcaacagcuggacaaaccugugcuugauaaggcuagagugcggaaauuugggcccaagcugcuccagcugcuugccgaguggaccgaaacauucccucgcgacuuucaggaggaaagcaccaucggacaccugaaagaugucgugggcagaauugcucccugcgacgaggccuaucggaagcgcaugcaucaacuccugcaggcgcugcaccagaagcucgccgcucugagacaggggccggagggacuuguuggcgccgauaaaccuaucuccuaccggacgaagcccccugcuagcauccaucgcgaacugcucggcguguguucugaccccuauacccuggcccaacagcuuacacacgucgagcuggaaagacuccggcacauugggcccgaggaauuugugcaggcguucguuaacaaagauccucuggccuccaccaagccgugcuucagcgacaaaacaucuaaucuggaggcuuacgugaagugguuuaaccgccucuguuaucuggucgccaccgagaucugcaugcccgcuaagaaaaagcaaagagcccaggugauugaguucuuuaucgauguggcccgggaauguuucaauauuggaaacuuuaauucccuuauggcuaucauuagcggcaugaacaugucuccugucucccgccugaaaaagacgugggcgaaaguuagaacagccaaguucuucauccucgaacaucagauggaccccaccgggaauuuuugcaacuaccggacagcucugagaggagccgcccaccgcagccuuaccgcucauuccucucgggagaaaaucgugauuccuuucuuuagccugcucaucaaggacauuuacuuccugaaugaaggcugugccaacagacugcccaaugggcacgugaacuuugagaaguuccucgagcuggcgaaacaggucggagaauuuaucaccuggaagcaaguggagugcccguucgaacaggaugcuuccauuacacacuaucuuuacacggccccuaucuuuagcgaggacggccuguaucucgccucuuacgaauccgagagccccgagaaucagaccgaaaaagagcgcuggaaggcucugcggucuagcauccugggcaaaacauga

SEQ ID NO: 74669 - RNA, 3774 nt, Artificial Sequence
  derived and/or modified sequence opt5 from RASGRF1__Homo_sapiens__NP_001139120
augcagaagggcaucagacugaacgacgggcacguggccagccucggacugcuugcucggaaagauggcacccgcaagggguaccuguccaaaagaucuagcgacaauacaaaguggcaaacgaaaugguucgcccuccugcagaaccuucuguuuuauuucgaguccgauucuagcucccggcccucuggacucuaccugcuggaaggcugcgucugugaccgcgcgccuagcccgaagcccgcucucuccgccaaggagccucuggaaaaacagcauuauuuuaccguuaauuucagccacgagaaccagaaggcccuugaacugagaacagaggaugcuaaagacugcgaugaguggguggccgcuauugcccaugcgucuuaccggacccucgccacagaacacgaggcucugaugcaaaaguaucuucaucugcuccagaucguggaaaccgagaaaacagucgccaagcagcugcgccagcaaauugaggacggggaaaucgagauugaaagacugaaggcugagaucaccucccuccugaaagauaaugaacggauccagagcacgcagaccguggcccccaacgacgaggauucugacauuaagaaaaucaagaaaguucaguccuuucuucgcggauggcuguguagacggaaguggaaaacaauuauccaagauuacauucgcagcccucacgcggacucuaugagaaagcggaaucagguggucuucuccaugcucgaggccgaagcugaguaugugcagcaacugcacauccuuguuaacaauuuucugcgcccccucagaauggccgcuagcuccaagaaaccuccgauuacccaugacgaugugucuagcaucuuccugaacuccgaaacaaucauguuucugcaccagauuuucuaccagggccucaaggcccggaucagcucuuggcccacccugguccuugccgaccuguuugauauucuccugccuaugcuuaauaucuaccaggaguucgugagaaaccaucaauauucccugcagauucucgcucacugcaaacagaaucgcgacuuugauaagcugcugaaacacuacgaagcgaagcccgacugugaggagcggacgcucgaaacauuccugaccuauccuauguuccagauccccagauacauccuuacacugcaugagcuccuggcccacaccccgcaugaacacguggagcgcaacagccuggauuaugcuaagucuaaacuugaagaacucagccggauuaugcaugacgaggucuccgaaaccgagaauaucagaaagaaccuggccauugaacgcaugaucauugagggcugcgagauccugcucgauacaucucaaacguuuguucggcaggggagccugauccaggugccuauguccgaaaaaggaaagauuaccagaggccgccuugggagccugucucucaaaaaggagggagaacggcaguguuuccuguuuuccaagcaccugaucauuugcacaagaggcagcgggggaaaacuucaccucaccaagaacggcgugaucucucugauugacuguacacugcucgaggaacccgaguccaccgaggaagaggccaaaggcagcgggcaagauaucgaccaucuggacuucaagauuggagucgaaccuaaagauuccccucccuuuacggugauccuuguugcuucuagccgccaggagaaggccgcguggacauccgacaucucucagugcguggauaauauucgguguaacggccugaugaugaaugcuuucgaagagaacagcaaggucaccgugccccagaugaucaaauccgacgccagccucuacugcgaugacguugauauuagauuuucuaagaccaugaauagcugcaaagugcugcaaauccgguaugccagcgucgagcgccugcuugaaagacucacagaccugcgguuccugucuauugauuuucucaacaccuuccugcacuccuacagaguguuuacaacggcuaucgucgugcuugacaagcugaucaccauuuacaaaaagccgaucagcgccauucccgcucgcucucucgagcugcuguucgccagcgggcagaauaacaaacuucucuauggagaaccucccaaguccccucgggcgacaagaaaguuuagcucucccccgccucuguccaucaccaaaacaagcucccccucucgcagacggaagcugagccucaauauuccuaucaucaccggcgggaaagcccuggaucuugcugcccuguccuguaacucuaauggauacacgagcauguauuccgcuaugucucccuucagcaaggccacccucgacacauccaaacuguacguuuccucuuccuucaccaacaagauuccugaugagggcgacacaacccccgaaaagccggaggacccuagcgcgcugucuaaacaguccagcgaggugucuaugcgcgaagaguccgauaucgaccaaaaucagagcgaugacggcgauacggaaacaucccccaccaagagccccacaaccccuaaaucugucaagaacaaaaauagcuccgaguuuccgcuuuucucuuauaacaacggggugguuaugaccagcugcagagagcuggacaauaaccgguccgcccucucugcugccagcgcuuuugccauugccacagcuggagcgaaugaaggcacgcccaacaaggagaaguaccgcagaaugucccuggccucugcuggguucccucccgaucagcggaauggagacaaagaauuugugauccgcagagccgccaccaaccggguccucaaugugcugcgccauugggugagcaagcacucccaggauuucgagacaaacgacgaacuuaaauguaagguuauuggcuuucuggaggaggucaugcacgauccugaacuccugacccaagagagaaaagcugccgcgaauaucauccggacacugacccaggaagaccccggggauaaccagauuacgcuugaggaaaucacacagauggcugagggcgugaaggccgagccuuucgaaaaucauagcgcccuggagauugcugaacaacucacccugcucgaccaccugguguuuaagaaaauccccuaugaggaguucuuuggacagggcuggaugaaacuugagaagaacgagagaaccccguacauuaugaagacaaccaaacauuucaaugacaucucuaaccugauugccuccgaaaucauccgcaaugaggauauuaacgcgcgggucagcgcuaucgaaaaguggguggccguugccgacauuugcagaugucuccacaacuacaaugcugugcuggagaucacaucuuccaugaaccgcagcgccauuuuucggcugaaaaagacguggcuuaaggucuccaaacagaccaaggcucugaucgauaaacuccagaagcuggugucuagcgaggggagauucaaaaaucuccgcgaagcccugaagaacugcgacccucccuguguuccuuaucuuggaauguaccugacagaucuggcguucaucgaggaaggcacccccaauuauacagaggacgggcucgugaacuuuuccaagaugcggaugauuagccauaucauuagagaaauccgccaauuccagcagaccgccuacaaaauugagcaccaagcuaaggucacgcaguaucugcuugaucagucuuuugugauggacgaggaaucccuguacgagagcucucuccggaucgaaccgaaacugccuaccuga

SEQ ID NO: 74670 - RNA, 3714 nt, Artificial Sequence
  derived and/or modified sequence opt5 from RASGRF2__Homo_sapiens__NP_008840
augcaaaagagcgugagauacaacgagggccacgcccuguaucucgcuuuccuggcccggaaagaagggaccaagcgcggauuucuuuccaaaaagacagcggaggcuucuagauggcaugaaaaaugguucgcccuguaccagaauguccucuuuuauuucgagggcgaacagagcugccggcccgccgggauguaccugcuugagggauguuccugcgagcgcacgccugcuccgcccagagccggcgcugggcagggaggcguucgggacgcccuggauaagcaguauuacuuuaccgugcuguucggccacgaagggcaaaagccucuggagcugcgcugugaagaggagcaggacggaaaagaauggauggaggcgauccaucaggccucuuaugcugauauucucaucgaaagagaggugcugaugcagaaguacauucaccuuguccaaaucguggaaacagagaaaauugccgcuaaccagcugcggcaucagcucgaggaccaggauaccgaaaucgagcgccucaagagcgaaaucauugcccuuaauaaaacaaaggagagaaugcggcccuaccaauccaaccaggaagacgaggauccugacaucaagaaaauuaagaaaguucagucuuuuaugcgcggcuggcugugcagacggaaguggaaaaccaucgugcaagauuauauuuguagcccccacgcggaguccaugcgcaagagaaaucagaucgucuucacaaugguggaagccgagagcgaauacguucaccagcucuauauucuggugaacggguuucugcggccucucagaauggcugccucuuccaaaaagccgcccaucagccaugacgaugucucuuccaucuuccugaauagcgagaccauuauguuucuucacgaaaucuuccaucagggacugaaggcucgcauugccaacuggccuacgcucauccuggccgaccuuuuugauauucugcuccccaugcugaauaucuaccaagaguucgugcggaaccaccaguauucucuucaggugcucgcuaauugcaaacagaacagagacuucgacaagcugcuuaaacaauacgaggcgaauccugccugugaaggccgcaugcuggagaccuuucucacauaucccauguuccagaucccgcgguacauuaucacccugcacgaacuucuggcucauacaccucacgagcaugucgagagaaagucccucgaauuugccaaaagcaagcuggaggaacugucccgcguuaugcacgaugaggugucugacaccgaaaacauucggaagaaucucgccaucgagagaaugauuguggaggggugcgauauccugcuugacacgagccagacauucauccgccagggaucccugauucaaguccccagcguggaacggggcaaacucucuaagguuagacugggcucccugagccuuaaaaaggagggggaacgccaguguuuucucuucaccaaacauuuucugaucugcacacggucuagcggaggcaagcugcaccuccugaagaccgggggagugcuuucccugauugauuguacccucaucgaggaaccugacgcuucugaugacgauagcaaaggcuccgggcaggucuucggacaccuggacuuuaagauugugguugagccucccgaugccgcggcuuucacagugguccugcuugcccccagcagacaggagaaagccgcuuggaugucugacaucucccaaugcguggacaacauucggugcaacggccucaugacgaucgucuuugaagagaauagcaaggugaccguuccgcauaugaucaaaucugaugcccgccugcacaaggacgauacagacauuuguuucuccaagacccugaacagcugcaaagugccccagaucagauacgcuuccgucgaacggcuccuggagagacuuacagaucugcgcuuucucucuauugacuuccugaauaccuuccugcauacguaucggaucuuuacaaccgccgcggugguucuuggcaagcucagcgauauuuacaaaagaccuuucaccuccauccccgugcgcucucuggaacuguuuuucgccacaagccagaacaauagaggggagcaccucgucgacggaaaguccccucggcugugucgcaaauuuagcucucccccgccucuugcuguguccagaaccagcucucccgugcgggcccgcaagcugucccucacaagcccucugaacucuaaaaucggcgcucuggaucuuacgaccagcuccagccccacaaccacaacccaaucuccugccgcguccccgcccccucacacggggcagauuccccucgaccugagcagaggacuguccucucccgagcagagcccuggcaccguugaagagaaugucgauaacccgcggguggaccucugcaauaagcugaagcgcuccauccagaaagccgugcuugaaucugcucccgccgauagagcuggggucgagagcuccccugccgccgacacaaccgagcugucucccugucggagcccuuccacaccccgccaucucagauaucggcaaccuggcggacagaccgcugacaacgcgcacugcagcgugucucccgccuccgcuuucgccauugccacggcugccgcgggccaugggagcccgccuggauuuaauaacacagaaagaaccugugauaaggaguucaucauucgccggacagcuaccaauagaguucugaacgugcugcgccacugggucucuaaacaugcccaggacuuugaacuuaauaacgagcugaagaugaacgugcucaaucugcucgaagagguucugcgggaucccgaccuucugccucaggagagaaaagccgcugccaacauccuccgcgcgcugucccaagaugaccaggaugacauccaccugaagcuggaagauauuauccagaugaccgacugcaugaaggcugaguguuucgaaagccugucugccauggagcucgccgaacagauuacacugcucgaucacgugaucuuucgguccauucccuacgaggaguuccugggccaaggguggaugaaacuugacaagaaugaaagaacgccguauaucaugaaaaccagccagcauuuuaacgauauguccaaucuggucgcuagccagaucaugaacuacgccgacgugucuagccgcgcuaaugccauugagaaguggguugcgguggccgacaucugccggugucuccacaacuauaauggaguccuggaaauuacauccgcucugaacagaucugccaucuaccggcuuaaaaagaccugggcuaaggugagcaaacaaacaaaggcccugauggauaaacuccagaagaccguguccucugagggccgcuucaaaaaucugagagaaacgcucaagaacugcaauccucccgccgucccuuaccuggggauguaucuuacagaccuggcuuucauugaggagggcacccccaacuuuaccgaagagggacugguuaauuucagcaagaugcggaugaucucccauauuauccgcgaaaucagacaguuucagcaaacaucuuaccggauugaucaccagcccaaaguggcgcaguaucuccuggacaaggaucuuaucauugacgaggauacccuguacgagcucagccugaaaaucgaaccuagacucccggccuga

SEQ ID NO: 74671 - RNA, 2289 nt, Artificial Sequence
  derived and/or modified sequence opt5 from RASGRP1__Homo_sapiens__NP_001122074
augggcacccuggggaaggccagagaggcuccccggaaaccuagccacggaugccgcgccgcguccaaggcuagacucgaagccaaaccggccaacucucccuucccuagccaucccucccuggcucacaucacacaguuucggaugauggugucucuuggccaucuggccaagggggcuagccucgacgaucugauugacuccuguauccaaucuuucgaugccgacggaaaucuuugccgcagcaaccagcugcuccaggucaugcugacgaugcacagaauuguuaucuccagcgcggagcugcuccagaaagugauuacccuguacaaggaugcccuugcuaaaaauucuccuggccugugucucaagaucugcuauuuugugcgguacuggaucacagaguucugggucauguuuaagauggacgccucccugaccgauacaauggaggaguuccaagagcuugugaaagcuaagggggaggaacugcauugucgccucauugacaccacacagaucaacgccagagauuggagccggaaacugacccagcgcauuaagucuaauacguccaagaaaagaaagguuagccugcucuuugaccaccuggagcccgaagaacuuucugagcaccugaccuaucucgaguucaaauccuuucggcgcaucagcuucuccgauuaccagaacuaucuggucaauucuugcgugaaggaaaacccuacaauggaaagaagcauugcgcuuuguaauggaaucucccaaugggugcagcugaugguucucagccggccgacaccccagcugcgcgccgagguguuuauuaaauucauccaggucgcucaaaagcugcaucagcuccagaacuuuaauacccugauggccgugaucggcggccuuugccacucuuccauuagcagacugaaagaaaccucuagccaugugccucacgagaucaacaagguccucggggagaugacggaacugcuuuccucuagccggaauuacgacaacuauagacgcgcuuacggagaguguacagauuucaagauucccauccugggcguucaccucaaagaccugauuucccuguacgaagccaugccugacuaucucgaggaugggaaggugaaugugcauaaacugcuugcccuguacaaccacaucagcgaacucguccaacugcaggagguggcucccccgcuggaggcgaacaaggaccuuguucaucuccugacccugucucucgaucuguauuacacagaagacgagaucuaugaacuuuccuacgcccgggagccuagaaaucaccgcgcucccagcguguucaaaaacuaugaucaugaccaggauggauacauuucucaggaagaguuugagaagaucgccgccuccuucccuuuuagcuucugcgucauggacaaggaucgggaaggccugauuuccagagacgagaucaccgcuuacuuuaugcgcgccucuagcauuuauuccaaacucgggcugggauucccccacaauuuucaagaaaccacauaccugaagcccacguucugugauaacugcgcgggcuuucuuuggggcgugaucaaacagggguaucggugcaaggacuguggaaugaauugccacaaacaguguaaggaccucguuguguucgagugcaagaaaagagcuaagaacccugucgccccgaccgagaauaacacaucugugggccccgucagcaaucuguguucccugggggccaaagaucuccugcaugcuccugaagagggacccuuuaccuucccuaacggcgaagccguggagcacggggaagagagcaaggaccgcacaaucaugcuuaugggaguuucuucccagaaaauuagccugcggcucaagagagcuguggcccauaaggcgacccaaacggagucucagcccuggaucggcuccgaaggcccgagcgggccuuuuguccugucuagcccccgcaaaacagcccaggauacccuguacgugcuuccuucccccaccagcccuugccccucuccgguucucgugcggaagagagcuuucgucaaaugggagaauaaggacucccugauuaaaagcaaggaagaacugcggcaccuccgccugccuacauaucaggaacuugagcaagagaucaacacccugaaagccgauaaugacgcucucaagauucagcugaaguacgcccagaaaaagaucgaaucccugcagcuugagaaaucuaaccacgugcucgcgcaaauggaacagggagauuguagcuga

SEQ ID NO: 74672 - RNA, 1830 nt, Artificial Sequence
  derived and/or modified sequence opt5 from RASGRP2__Homo_sapiens__NP_001092141
auggccggcacccuggaccucgauaaggggugcacaguggaggaacugcuuagaggauguaucgaggcuuucgacgauagcggcaaaguccgggacccccagcugguucgcauguuucucaugaugcacccuugguacauuccguccucucaacuggccgcgaaacuucugcauaucuaucagcagagcagaaaggauaacuccaauucucuccaggugaagacgugccaccuggugcgguacuggauuagcgcuuuccccgccgaauuugaccugaacccugagcucgccgaacaaaucaaagagcugaaggcccuucuggaucaggaggggaaucgcagacauuccucucucauugacaucgauagcguccccaccuauaaguggaaacgccaggugacacagcgcaacccuguuggacaaaagaaaagaaagaugucccugcuuuucgaccaccuggaacccauggagcucgcugaacaucugaccuaccuggaguaucggagcuuuuguaaaauccucuuccaggauuaccacucuuuugugacacacggcugcaccgucgacaauccugugcuggagcgcuucauuucccuuuuuaacagcguuucucagugggugcagcugaugauccucuccaagccgacagcuccccaaagagcccuggucauuacccauuucgugcacguggcggaaaaacuucugcagcuccagaauuuuaacacgcugauggccgucguugggggacugagccauucuuccaucagccggcucaaggagacccacucccacgugucuccugaaacaauuaagcugugggagggccuuaccgaacuggugacagcuaccggcaauuaugggaacuaccgcagacggcucgccgcuugugucggauuccgcuuucccauccugggcgugcaucuuaaagaucugguugcccuccaacuggcgcugccugacuggcucgaccccgccagaacgcggcugaauggggcuaagaugaaacagcuuuucagcauucuggaggagcucgccauggugacaucccugagaccgccuguccaggcuaaccccgaucugcuuagccuccugaccgugucucuggaccaguaccaaacagaagaugagcucuaucagcugucccuucagcgcgaaccucggagcaagucuagccccaccucccccaccucuugcacaccuccgcccagaccucccguucuggaggaauggacgagcgccgccaaaccuaagcucgaccaggcucugguggucgagcacaucgagaagaugguggaauccgucuuccgcaauuuugauguggacggagauggccauaucagccaagaggaguuccagauuauccgggggaacuuucccuaccugucugcguucggagaccuugaucagaaucaggacggcuguauuuccagagaagaaaugguuagcuauuuucuccggucuuccagcgugcugggcgggcggaugggauucguccacaacuuucaagaguccaacucucugagaccgguggccugccgccauuguaaagcucucauccugggcauuuacaagcaggggcuuaaaugccgggccuguggaguuaauugccacaagcagugcaaagauagacugagcguggagugucgccggagagcccaguccgucucucucgaaggcagcgcuccuucccccagcccuaugcacucucaucaccaucgggccuucuccuuuagccugccccgcccugggagacggggaucuagacccccggagauccgcgaagaggaggugcaaaccguggaagacggcguuuucgacauccaccuguga

SEQ ID NO: 74673 - RNA, 2070 nt, Artificial Sequence
  derived and/or modified sequence opt5 from RASGRP3__Homo_sapiens__NP_056191
augggcagcuccgggcugggaaaggccgcuacccucgacgagcugcuuugcacauguaucgaaauguucgaugacaacggcgagcuggauaauucuuaccuccccagaauugugcugcuuaugcaccggugguaucugagcuccacggaacucgccgagaaacugcugugcauguaccgcaacgcgaccggggaaucuuguaaugaguuuagacucaagaucugcuauuucaugcgguacuggauucugaaauuuccugcugaguucaaccuugaccugggacucauccgcaugacagaagaguuuagagaagucgccagccagcugggcuaugagaagcauguuucccuuauugauaucucuagcaucccguccuacgacuggaugcggcgcgugacccaacggaaaaaggugagcaagaaagggaaggccugucuccuguucgaucaccuggagcccauugaacuggcugagcaucucacauuucuggaacacaaaucuuucagacgcaucuccuuuaccgacuaucagagcuacgucauucauggaugccuugagaauaacccuacacuggaaagaucuaucgcccucuucaauggcauuuccaagugggugcagcugaugguucuuagcaaacccaccccucagcaacgggcugaggugaucacgaaguuuauuaacgucgccaagaaacugcuccagcugaagaauuucaacacccugauggcggugguuggcgggcucucucacuccagcaucucccgccugaaagagacacacucucaucuuagcuccgaagugaccaagaauuggaacgagaugacagaacuggucagcucuaauggaaacuacuguaauuauagaaaagccuuugcugauugcgacggcuucaagauccccauucucggggugcaccugaaagaucuuaucgccgugcaugucauuuucccugacuggaccgaggaaaacaagguuaacaucgugaagaugcaccagcuguccgugacgcucagcgagcuggucucucugcagaaugcuagccaccaucucgagccgaacauggaucugauuaaucuucugacacucucccuggaccuguaccacaccgaagacgauaucuauaaacuuucucucgugcuggagccccggaacagcaaguccccuacaagccccaccaccccuaauaaacccguugugccgcuggaaugggcccucggagucaugccuaagcccgacccuacagugaucaacaaacauauucgcaagcugguugagucuguguuuagaaauuacgaucacgaccaugauggcuauaucucccaagaagacuucgagagcauugcggccaacuuucccuuccuugauucuuuuuguguccuggacaaggaucaggacgggcucaucuccaaagaugagaugauggcuuacuuccugcgggccaagagccagcugcacugcaaaaugggacccggcuuuauucacaauuuccaggaaaugacguaucuuaagccuaccuuuugugagcauugcgcuggcuuccucugggggaucaucaaacaaggauacaagugcaaggacuguggcgccaacugccacaaacaguguaaggaccugcuggugcucgccugcagacgcuuugcucgggcgccgucccugucuagcgggcauggaucccuucccggcucuccuagccugcccccugcccaggaugaagucuucgaguuucccggggugacagcuggacacagagaccucgauucccgcgccauuacccugguuacaggcagcucucggaaaaucuccgugagacugcaacgcgccaccacgagccaggcuacacagaccgagccggucuggucugaagccggcuggggagacuccgggagccacaccuucccuaagaugaaaucuaaguuccaugauaaggcggcuaaagacaagggcuuugccaaaugggagaaugaaaagccccgggugcacgccgggguugauguggucgacagaggaacagaguucgaacuugaucaggacgagggcgaggaaacccgccaagauggggaggacggcuga

SEQ ID NO: 74674 - RNA, 1980 nt, Artificial Sequence
  derived and/or modified sequence opt5 from RASGRP4__Homo_sapiens__NP_001139674
augaacagaaaggacagcaaacggaagucccaccaggagugcaccggcaaaaucgggggacgcggcagaccccggcaagugcgcagacauaagacauguccuucuccgcgggaaauuagcaaagucauggccuccaugaaucuggggcuccugucugagggaggcugcagcgaagacgagcuucuggaaaaguguauccaguccuucgacucugcugggagccucugccacgaggaucauaugcugaacaugguucuugccaugcacuccugggugcugcccagcgcggaccucgcugcccgccugcugacgucuuaccagaaggccaccggagauacacaggagcucagacggcugcaaauuugucaucuugugcgcuauuggcugaugagacacccugaagucaugcaccaggacccccagcucgaggaagugaucggccgguuuugggcuaccguugcccgcgagggcaauuccgcucagagacggcugggggauagcucugaccuuccuggacugggcaaaaagcgcaaagugucccuccuguucgaucaucuggagacaggggaacucgcccaacaccugaccuaccuugaguuuagauccuuccaggcgauuacaccccaggaccugcggucuuauguccuccagggauccgugagaggcugcccugcccuggaagggagcguuggacuuuccaacucugugagccgcuggguccaagugauggugcugucccggccgggcccccuccagagagcucagguccuggauaaguuuauccauguugcccaacgccugcaccagcuccagaauuucaacacccugauggcugugacgggcgggcuuugucacagcgccaucucucggcugaaagacucccaugcgcaccucagcccugauucuaccaaggcccugcuugagcugacagaacuccuggcuagccauaauaacuacgccagauaucgccggaccugggcuggaugcgccggcuuuagacugcccgugcucgggguccaccugaaggaccuugugucccugcaugaggcccagccugaccgccuccccgauggacggcugcaucugccgaaacuuaauaaccucuaccugagacugcaagagcucguugcucugcagggccagcacccucccuguucugcgaaugaagaccuucugcaccuccugacacugagccuugaucucuucuauaccgaggacgaaauuuacgagcuguccuacgcccgcgaaccucggugccccaagagccugcccccuucuccguuuaacgcuccccucguggucgagugggccccuggggugacgcccaaaccugauagaguuacacugggacggcacguggagcagcuugucgaauccguguucaagaauuaugaccccgagggccgcggcaccaucagccaagaagauuuugagagacugucugggaacuucccguuugccugucauggacuccacccucccccucggcagggcagaggguccuucagccgcgaggaacugacaggauaccugcuucgggcuuccgccauuugcucuaaacucggccuggcguuccugcacaccuuucaugaggucaccuucagaaagcccacauuuugcgacagcuguuccggguuccucuggggcgugacgaaacagggauaucgcugcagagaauguggccugugcugucacaagcauugccgggaucagguuaagguggaguguaaaaagcgcccuggggcuaaaggagacgccgggcccccgggcgccccuguccccucuacccccgcuccucacgccagcugcggauccgaagagaaucauagcuacacacuuucucuggagccggaaaccggcugucaacucagacacgcuuggacacagaccgagagcccccacccuagcugggaaacggauacagugcccugcccuguuauggaucccccuucuaccgccuccagcaagcuggacucuuga

SEQ ID NO: 74675 - RNA, 2892 nt, Artificial Sequence
  derived and/or modified sequence opt5 from RASIP1__Homo_sapiens__NP_060275
augcugagcggcgagagaaaggaagggggaucuccccgguucggcaaacuccaucugccuguggggcuuuggaucaacuccccgcgcaagcagcuggccaaacucggaagacgguggcccagcgcugccuccgucaagucuagcuccucugacaccggcagccgcuccagcgagccucugcccccucccccuccgcacguugaacuuagacgggugggggcggugaaagcugccggaggcgccucuggcucccgcgcuaagagaauuagccaacuguuucgggggucuggaacaggcacgaccggguccagcggagccggcgggcccggaacaccuggcggcgcucagcgcugggccucugagaagaaacuccccgaacuggcggccggggucgcuccugagcccccgcuggccaccagagcuacagccccucccggagugcucaagaucuucggcgcggggcuggccuccggagcuaauuacaaaagcguucuugccaccgcucgguccacagcccgcgagcugguggccgaagcucucgagagauauggccuggcggggucuccuggaggcggccccggggaaagcuccugcgucgaugccuuugcucuuugugacgcccugggacggcccgccgcugccggcguggggagcggagaguggcgcgcggagcaccucagaguucugggcgauucugaacggccucugcucgugcaggagcuguggagagcucgcccggggugggcccggagauucgaacuucgcggccgggaggaagccagacgccuggagcaggaggcuuuuggagccgcugacuccgaaggcaccggggcccccagcuggcggccucaaaagaacagaucucgcgcggccagcggaggcgcugcccucgcuucccccgggccuggaacgggcucuggggcccccgcgggcagcggaggcaaagagcgguccgaaaaucugagccuuagacgcucugucuccgagcugagccuccaggggcggagacggcgccagcaggaaagacggcaacaggcccugucuauggcuccgggagccgcugaugcccagauuggcaccgccgacccuggggauuucgaccagcugacacaaugccucauccaggcucccuccaacagaccuuacuuucugcuucugcagggauaucaagaugcgcaggacuucgugguguacgucaugacccgcgagcagcauguuuuuggccgcgggggcaauagcuccggaagaggcgggucucccgccccuuauguggauacauuccucaacgcucccgacauucugccgcgccacuguaccgugagagccggaccugagcaucccgccaugguccggcccagccgcggcgcuccugugacgcacaaugggugccuucugcucagagaagccgagcugcacccgggagaucugcucggccugggggaacauuuucuuuucauguacaaggacccccggacaggcggauccggcccugcgcggcccccuuggcugcccgcuagaccuggggccacacccccgggaccuggcugggccuuuucuugucggcucugcgggcgcggacugcaggagagaggcgaagcucuggccgcguaucuugacggccgggagcccguucuccgcuucagaccucgggaggaagaggcucugcugggggaaaucgugagagccgccgcugccggaagcggcgaucugcccccgcuggggccugcuacccuucuggcccucuguguccaacacuccgcgcgcgagcuggagcugggacaucuuccccggcuccugggcagacuggcccgccucaucaaggaagcugugugggagaaaauuaaggaaaucggggaccggcagccugagaaccaccccgaaggaguucccgaggugccucugaccccggaggccgucagcguggaacuuagaccccugaugcucuggauggcuaauaccacagagcugcugucuuucguccaggaaaaagugcuugagauggaaaaggaggccgaucaggaggacccucaacucugcaacgaucuggaacugugugacgaggccauggcucuccuggaugaaguuauuaugugcacguuucagcaguccguguacuaccuuaccaaaacacuguauagcacccuccccgcgcugcuggacucuaauccuuucacagccggcgcugagcuucccggcccuggggccgaacucggagccaugccgcccggccugcgcccuacccugggggucuuucaggcugcccucgagcugacgucccaaugugagcuucaccccgaucuggugagccagacauucggauaccucuuuuucuuuucuaacgcgagccugcucaauucccuuauggaacggggccaggggagaccuuucuaucaguggagccgcgcuguucaaauccggaccaaccuggaccucgugcuggauuggcuccagggagccggccugggcgacauugccaccgaguuuuucagaaaacuuucuauggcugucaaucugcucugcgugccccggacaucccugcugaaggccagcugguccucucuucgcaccgaccauccgacacugacgccugcgcagcuccaccaucugcucagccacuaccaacuggggcccggaagagggcccccugcugccugggaucccccuccggccgaacgggaggcuguggacaccggcgauaucuuugaguccuucucuagccaucccccucuuauucugccccucggauccucucgccugagacugacaggcccuguuaccgacgaugcccuucaccgggaacugagacgccuccggagacugcucugggaccuggagcagcaggaacuucccgcuaacuaucgccacgggccgccugucgccacaagccccuga

SEQ ID NO: 74676 - RNA, 612 nt, Artificial Sequence
  derived and/or modified sequence opt5 from RASL10A__Homo_sapiens__NP_006468
augggcgggagccugagaguggccguccucggagcucccggcguugggaagaccgccaucauucggcaguuccuguuuggagacuacccugagcgccacagaccgacagauggcccccggcuuuaucgcccugcggugcugcucgacggggcuguguacgaucuguccaucagagacggagaugucgccggccccggcucuagcccugggggacccgaagaguggccugacgccaaagauuggucccuucaagacacggaugcuuucgugcugguuuaugacauuugcucuccggauagcuuugacuacgugaaggcccuccggcagcgcaucgcugaaaccagacccgccggcgcgccugaggcccccauucuggucguggggaacaaacgggaucgccagagacugcgguucggaccucgcagagcucucgccgcucugguucggcgcggcuggagauguggguaucuugaaugcuccgccaaguacaauuggcaugugcugcggcucuuuagagagcugcuucgcugugcgcugguccgggccagacccgcucacccggcccuccgccugcagggagcucugcauccugcccggugcucucucauguga

SEQ ID NO: 74677 - RNA, 612 nt, Artificial Sequence
  derived and/or modified sequence opt5 from RASL10B__Homo_sapiens__NP_201572
auggugagcaccuacagagucgccguucugggcgcucgcggggugggaaaguccgccaucgugcggcaguuccucuauaacgaguuuucugaagucugcgugcccacaacggcgagacggcuguaccuuccugcuguugugaugaauggccacguccaugaccugcaaauucucgauuucccgcccaucagcgccuuuccugugaacacccugcaggagugggccgacacauguugccgcgggcuuagauccguucacgcuuauauucugguguacgauaucuguugcuucgacucuuuugaauaugucaaaaccauucggcagcagauccucgagacacgcgugaucggaaccagcgaaacacccauuaucauugugggcaauaagagagaucugcaacgggggcgcgucaucccuagauggaacguuucccaucuggugcggaaaaccuggaaguguggauacguggagugcucugccaaauauaauuggcacauucuccugcuuuucagcgagcugcucaaguccgucggcugugcucgcugcaagcaugugcacgccgcgcugagauuucagggcgcccuucggcgcaacagaugugcuaucauguga

SEQ ID NO: 74678 - RNA, 729 nt, Artificial Sequence
  derived and/or modified sequence opt5 from RASL11A__Homo_sapiens__NP_996563
augagaccccugagcauguccggccacuuccuccuggccccuaucccggagucuagcuccgacuaccuucugcccaaggauauuaaacucgcugugcugggggccggacgggucggcaagucugcgaugaucguucgcuuucuuaccaaaagauucauuggggacuaugaaccuaacacaggaaagcuguacagccggcucguguauguggagggcgaucagcugucccugcaaauccaggacacgcccgggggaguccagauucaggauucucucccucaagugguugacagccuguccaaaugcgugcagugggcugaaggcuuucuucuggucuacagcaucaccgauuaugacucuuaccucuccauccgcccccuguaucagcauauuagaaaggugcacccugauagcaaggccccgguuaucauugugggcaauaaaggggaccuucugcaugcccggcagguccaaacacaggauggaauccagcucgcuaacgagcugggcucucuguuccucgaaauuuccaccagcgagaauuacgaggacgugugugauguguuucagcaccugugcaaggaagucucuaaaaugcaugggcuuuccggagagcgcagacgggccagcaucauuccccgcccuagaucccccaacaugcaagaccugaagcggcgcuucaaacaggcucucucuccuaagguuaaggcccccagcgcgcugggcuga

SEQ ID NO: 74679 - RNA, 747 nt, Artificial Sequence
  derived and/or modified sequence opt5 from RASL11B__Homo_sapiens__NP_076429
augagacugauccagaacaugugcaccauugccgaguaccccgcuccuggcaaugccgcggcuagcgacuguugcgugggggccgccggacggcgccucgucaagaucgcuguugugggcgccuccggggugggaaaaacagcucuggucgugagauuccuuacgaagcgguuuauuggcgauuaugaacgcaacgccgggaaucuguacaccagacaaguucagaucgagggagaaacacucgcgcuucaggugcaggacaccccgggcauucaaguccacgagaacucucugagcuguuccgaacagcugaaucggugcauccgcugggccgaugcugugguuaucguguucucuauuacagacuauaaaagcuacgagcucaucucccagcugcaucagcacguccaacagcugcaucucggcaccagacugcccgugguggucguugccaacaaggcugaucuucugcacauuaaacagguggacccucagcucgggcugcaacuugccucuaugcugggauguagcuuuuaugagguguccgucagcgaaaauuacaacgauguguauucugcguuccauguucucugcaaggaggugucccacaagcagcagcccagcucuacaccugaaaaacggcgcaccucccugauccccagaccuaagagcccgaauaugcaagaccugaaacggcgcuuuaagcaggcccucucugcuaaagucagaacggugaccuccguuuga

SEQ ID NO: 74680 - RNA, 801 nt, Artificial Sequence
  derived and/or modified sequence opt5 from RASL12__Homo_sapiens__NP_057647
augagcuccguguucggcaagcccagagccgggucuggaccucagagcgcuccgcuggaggucaaccucgccauucugggccggcgcggggcgggaaaauccgcucuuaccguuaaguuucugacaaaaagauucauuucugaauacgaccccaaucucgaggauacguauagcuccgaagagaccguggaccaccaaccugugcaucugcgggucauggauacagccgaccuugauacaccccgcaacugcgaaagauaccugaauugggcccacgcuuuucucgugguuuauucuguggacagccggcaguccuucgauagcagcuccagcuaccuggagcugcucgcccugcaugcuaaggagacccagcgcucuaucccugcccuucugcucggcaacaaacuggacauggcgcaguauagacaagucaccaaggccgaagggguggcucuugccggacgguuuggcugucuguucuuugagguuuccgcuugccucgauuucgaacacgugcagcaugucuuucacgaggccgugcgcgaggcgagacgggaacuggagaagucuccccugacacgcccucucuucauuucugaagagagagcccugccgcaccaggcuccccuuaccgcccggcauggccuggcuuccuguacguuuaauacccucagcacaaucaaccugaaagaaaugccuaccguggcccaggccaaacuugucacaguuaaguccucucgcgcucaaagcaagagaaaagcgcccacccugacgcuccugaagggguucaagaucuuuuga

SEQ ID NO: 74681 - RNA, 570 nt, Artificial Sequence
  derived and/or modified sequence opt5 from RASSF1__Homo_sapiens__NP_001193886
augagccugaacaaggacggcuccuacaccggguucaucaaagugcagcucaagcuggucagacccguuucugugccuagcuccaaaaagccgcccucucuucaagaugcccggcgcggaccuggcagagggacaagcgugcggcgcagaacguccuuuuaucugcccaaagacgcugucaagcaccuccaugugcugucucggacccgcgccagagagguuauugaagcgcuucugcggaaguuccucguggucgaugacccucgcaaauuugcucuguucgagagagccgaacggcacggacagguguaccugcgcaagcuccuggaugacgagcagccccuuagacugcggcuccuggccggcccuagcgauaaagcucuuuccuuuguucugaaggaaaaugacagcggggaggugaacugggaugccuucucuaugccggagcuccauaauuuucugcgcauccugcagagagaagaggaggaacaccuccggcaaauucugcagaaauauuccuacugcagacagaagauccaggaggcccuucaugcuuguccccugggauga

SEQ ID NO: 74682 - RNA, 981 nt, Artificial Sequence
  derived and/or modified sequence opt5 from RASSF2__Homo_sapiens__NP_055552
auggacuacagccaccagaccucccuggugcccugcggccaagauaaguauaucucuaaaaacgagcuccugcuucaucugaagacauacaaucucuauuacgaagggcagaaccugcagcuuagacaccgggaggaagaggacgaguucauugucgaaggacugcucaauaucagcuggggccugcgcagaccuauucggcugcagaugcaagaugacaacgagcgcaucagaccgcccccuuccucuagcuccuggcauucuggguguaaucucggagcccagggcacgacccugaaaccccuuacaguuccuaaggugcagauuagcgaaguggaugcucccccugagggggaccagaugccguccagcaccgauucucggggacugaaaccccuccaagaagacacaccucagcugaugcgcaccagauccgaugucggcgugcggcgcagaggcaacguucggacacccagcgaccagcgcagaauccggcgccacagauuuucuaucaaugggcauuucuauaaccacaagaccuccguguuuacgccugccuacggaagcgucaccaaugugcggauuaacucuacaaugaccacaccccagguucuuaagcugcuccugaauaaauucaagaucgagaacuccgcggaggaauuugcucuguaugugguccacaccagcggcgagaaacaaaagcucaaagccacggauuacccgcugauugccagaauccuucaggggccuugcgaacagauuuccaagguguuccugauggagaaggaccaaguggaagaggucacauacgauguugcucaguauaucaaauuugagaugcccgugcucaagucuuucauucagaaacugcaggaagaggaagaccgcgaggugaagaaacuuaugcggaaguacaccguccugagacucaugauccgccaacggcuggaagagaucgccgagaccccugcuacaauuuga

SEQ ID NO: 74683 - RNA, 717 nt, Artificial Sequence
  derived and/or modified sequence opt5 from RASSF3__Homo_sapiens__NP_835463
augagcuccggcuacucuagccuggaggaagacgccgaggauuucuuuuucaccgcuagaacauccuuuuuccggcgcgcgccccaggggaagccuagaucuggacaacaggacguggaaaaagagaaggaaacgcacagcuaucucuccaaagaggagaucaaggaaaaaguccauaaguacaaccuggccguuaccgauaagcugaaaaugacacuuaauucuaacggcauuuauaccggguuuaucaaggugcagauggagcucugcaaaccgccccagacaagcccuaauuccggaaagcugagccccucuuccaacggcuguaugaauacccuucacauuagcucuacaaacaccgugggggaagucaucgaggcucugcucaaaaaguuccuggugacggaguccccugccaaguuugcccuguacaaacggugccaucgcgaagaccaaguuuaugcuuguaagcucagcgauagagagcacccccuguaccuucggcugguggccggaccucgcaccgacacacucucuuucguccugagagaacaugagauuggcgaaugggaggcuuuuucccuuccggagcugcagaauuuccuccggauccuggauaaagaagaggacgaacagcugcagaaccucaagcgcagauauaccgccuaccggcaaaaacuggaggaagcgcuucgcgagguguggaagcccgauuga

SEQ ID NO: 74684 - RNA, 966 nt, Artificial Sequence
  derived and/or modified sequence opt5 from RASSF4__Homo_sapiens__NP_114412
augaaggaggacugccugcccagcucccacgugccuaucucugauagcaaauccauucagaagucugaacuccugggccuucugaaaaccuacaacuguuaucaugaggggaagucuuuccaacucagacaccgggaagaggaaggaacacugaucauugagggccuucugaauaucgccugggggcuccgcagaccgauucggcugcagaugcaggacgaucgcgagcagguccaucugcccuccacgucuuggaugccuagacggcccagcugcccucucaaagaacccuccccucaaaacggaaauaucaccgcucagggcccgagcauccagcccguucacaaggccgagucuuccacagacagcucugggccucuggaagaggcggaggaagcuccccagcuuaugcgcaccaaguccgaugccagcuguaugucucaaagacggccuaaaugccgcgcccccggagaggcucagcggauucggcgccauagauuuuccaucaacggccacuucuacaaucacaagacaagcguguuuaccccggccuauggcuccgugacaaacguccgggugaauagcaccaugacgacccugcagguucucacacugcuucugaacaaauuccgcguggaagacgggccuagcgaguuugcucucuacauuguccaugaauccggagagagaaccaagcugaaagauugugaguauccccugaucagccggauucuccacggcccuugcgaaaagaucgccagaauuuuccugauggaggcggaccuugggguggaaguuccccaugagguggcccaguacaucaaguuugaaaugcccguccuggauucuuucguggagaaacucaaggaggaagaggaacgcgagaucauuaaacugacaaugaaguuucaagcucuuagacugaccaugcuccagagacuggaacagcugguggaggccaaauga

SEQ ID NO: 74685 - RNA, 1257 nt, Artificial Sequence
  derived and/or modified sequence opt5 from RASSF5__Homo_sapiens__NP_872604
auggccauggcuagccccgccaucggccagagaccuuacccgcugcuccuggaccccgagccuccccgguaucuucaaucccugucugggccugaacugcccccuccgcccccugaucgcagcuccagacucugcgugcccgcgccucuuucuaccgcucccggagcccgggagggccgcagcgccagacgggcugcccgcgggaaccuggaaccgccucccagagcuucccggccugcccgcccccucagacccggacugcagcagcggcugcgcagacggccuggcgcgccgcgccccagagacguccggucuauuuucgagcagccucaagaucccagaguuccugccgaacgcggggagggacacuguuuugcugagcucgugcugcccggcggcccgggguggugcgaccuuuguggacgggaagugcugagacaggcccuccgcugcacaaauuguaaguucacgugccauccugagugucggagccugauccagcuugauugcucccagcaagaaggccugagcagagaccgccccucuccugaguccacccucacagucaccuuuagccagaacguguguaaacccguugaggaaacacagcggccucccacccugcaggagauuaagcaaaagaucgauucuuacaauacaagagaaaagaacugccuggggaugaaacucuccgaggacggaaccuauacgggcuucauuaaggugcaccugaaacuucgccggccggucaccgugccugcugggaucagaccccagagcaucuacgaugccauuaaagaaguuaaucuggcggccacaaccgacaagcgcacaucuuuuuaucucccccuggaugcuaucaaacagcuucauauuuccagcaccacgacaguguccgaggucauccaaggacugcucaagaaauucauggugguggacaacccucagaaguuugcccuguucaagcggauucacaaagauggccagguccuguuucagaagcucucuaucgcugacagaccgcuguaccuucggcugcucgccggccccgacaccgagguucugagcuucgugcuuaaagaaaaugagacaggggaaguggagugggaugccuuuuccauuccugaacugcaaaacuuccucaccauccuggagaaggaggaacaggacaaaauccagcagguccaaaagaaauaugauaaguuucgccagaagcuggaggaagcucucagagagagccagggaaaacccggcuga

SEQ ID NO: 74686 - RNA, 912 nt, Artificial Sequence
  derived and/or modified sequence opt5 from RASSF6__Homo_sapiens__NP_001257320
augaccaugauggcccaccaguaccccagcuggaucuucauuaacgagaagacauuuaucacgagagaacaacucaauucccugcugaaaaccuauaacauuuucuacgagaaucagaagaaccuucauauccuguauggcgaaacagaggacgggaaacucauuguggaaggaaugcuggauaucuuuuggggcgucaagcggccuauccagcuuaaaauucaggacgagaagccguucucuagcuuuaccuccaugaagucuagcgauguuuucuccucuaaagggaugacacgcuggggagaguuugacgaucuguacagaaucagcgaacucgaccggacccaaauucccauguccgagaagcgcaauagccaggaagauuaucugucuuaccacuccaacacacugaaaccucaugcuaaggacgagcccgauagcccugugcucuauagaaccaugucugaggccgcgcuggugcggaaacgcaugaagccccuuaugauggacagaaaggaacggcagaaaaaucgcgcuuccaucaacggccacuucuacaaucaugagauugaaaacagcccucaggauuuugcccugcacaucauuuucgccacgggggagcaaagacggcucaagaaaaccgacaucccgcugcuucagcgccugcuccagggacccucugaaaagaaugcuagaaucuuucugauggauaaagacgccgaggagauuuccagcgacgucgcucaguacaucaacuuccacuuuucccugcucgaaucuauucugcaacggcuuaaugaggaagagaagcgcgaaauccagagaauugugacaaaauucaacaaggagaaggccaucauccugaaaugccuccagaauaagcugguuauuaaaaccgagacaaccguguga

SEQ ID NO: 74687 - RNA, 1014 nt, Artificial Sequence
  derived and/or modified sequence opt5 from RASSF7__Homo_sapiens__NP_001137465
augcugcugggccuggccgcuauggagcuuaaggugugggucgacgggauccagagaguugugugcggagugagcgaacaaaccacaugucaggaggucgugauugcccuggcgcaggcuaucggccagacggggcgguucguucucgugcaacgccugagagaaaaagagcggcagcuucugccccaggaaugcccugucggagcccaggccaccuguggccaauuugcuuccgaugugcaguucguucuccgcagaacagggccgucucuggccggacggcccagcuccgacucuugcccucccccugagcgcugucugauuagagcuagccuccccgugaagccucgggccgcgcugggcugcgagccgcgcaaaacccuuacacccgaaccugcccccucccugucuagaccuggccccgcugccccggucaccccuacacccggguguugcaccgaucuccggggacuggagcuucgcgugcagagaaacgcugaggaacugggccacgaggccuuuugggaacaggagcuccggcgcgaacaagcgagagagcgggaagggcaggccagacugcaggcucugagcgccgcuacggccgagcaugccgcucgccuccaagcgcuggacgcccaggcucgggcccuugaggccgaacugcagcucgcugccgaggcgccuggaccucccucccccauggcuagcgccaccgaaagacugcaccaggaucuugccgugcaagagcgccagucugcugaaguccagggcucccuggcccucguuagccgggcucuggaggccgcggagagagcccugcaggcucaagcccaggaacucgaggaacugaaucgcgagcuucggcaguguaaccugcagcaauucauccagcagacaggggcugcccucccgcccccucccagaccugaccgcggacccccgggcacccaggugggcgugguccucgggggaggcugggaagugcggacauggccuucucccaccccuuccuga

SEQ ID NO: 74688 - RNA, 1260 nt, Artificial Sequence
  derived and/or modified sequence opt5 from RASSF8__Homo_sapiens__NP_001158219
auggagcugaaggugugggucgacggcguucagagaaucgugugcggggugaccgaagucacaacgugucaagaggugguuauugcccucgcucaggccaucggacggaccggccgcuacacacugauugaaaaauggagagauaccgagcggcaccuugcgccccaugaaaacccuaucauuagccugaauaagugggggcaguaugcuuccgacgugcagcucauccugcgcagaacaggaccgucucuuagcgagcggcccaccuccgauucugucgcccgcaucccugagagaacacuguaccggcaaagccuucccccucuggccaaacugcgcccccagauugacaaguccaucaaaagacgggaaccuaagcgcaagucucucaccuucacgggcggggcuaaaggacugauggauauuuuuggcaagggcaaagagaccgaguucaagcagaaagugcuuaacaauugcaagacaaccgccgacgaacugaagaaacucaucagacugcagacagagaagcuccaaagcauugaaaaacagcuggaguccaacgaaaucgagauucgguuuugggaacagaaguauaauagcaaccucgaggaggaaaucguucgccuggagcagaaaaucaagagaaaugauguggaaauugaggaagaggaguucugggaaaacgagcugcaaaucgaacaggagaaugaaaaacagcucaaggaccaacugcaggagauucggcagaagaucaccgagugugaaaacaaacuuaaggauuaccuggcucagauuagaacgauggagucugggcucgaagccgagaaacugcaacgcgagguccaggaagcccaggugaaugaggaagaggugaagggaaaaaucggcaaggucaagggggaaaucgacauucagggacaacagucccuucggcuggagaacggcaucaaagcgguugagagaagccucgggcaggcuacaaagcgccugcaggauaaagaacaagagcuggaacagcucaccaaggagcugagacaggugaaucuucagcaauuuauucagcagacaggaaccaaagugaccguccugccggccgaacccaucgagauugaggcuucucacgccgacaucgaacgggaggcgccuuuccaauccggcagccucaagcgccccgggucuucccggcagcugccuagcaaccuuagaauccugcagaaucccauuuccucuggcuuuaacccggaaggaaucuauguguga

SEQ ID NO: 74689 - RNA, 555 nt, Artificial Sequence
  derived and/or modified sequence opt5 from RAX2__Homo_sapiens__NP_116142
auguuccugagccccggcgaggggccugccaccgaaggaggcgggcucggaccgggcgaggaagcucccaagaaaaagcacagacggaaccgcacaacguuuaccacauaccagcugcaucaacuugagagagccuucgaagcgucccacuauccugacguguacucucgggaggagcuggcugccaaaguccaucuccccgaaguucgcguccaggugugguuucagaauagacgggccaaguggcgcagacaggagcggcuggaaagcggguccggagcuguggccgcuccucgccuucccgaggccccugcgcugccguucgccagacccccugcuaugucucucccccuggagccuuggcugggccccggcccgccugccgugcccgggcucccucggcugcuuggacccggccccgggcugcaagcuagcuuuggaccucacgccuucgcgccgaccuuugccgauggcuucgcucucgaagaggccucccugcgccuucuggcuaaagaacaugcccaggcccucgacagagcuuggcccccugcguga

SEQ ID NO: 74690 - RNA, 1041 nt, Artificial Sequence
  derived and/or modified sequence opt5 from RAX__Homo_sapiens__NP_038463
augcaccuucccggcugcgccccugcuauggccgacgggagcuucucccucgcgggacaucugcuuagaucuccgggcgggagcaccucccggcugcacucuaucgaggcuauucucggauuuacaaaggaugacggcauccuggggacguuccccgccgaacgcggagccagaggcgcuaaagagcgggaucgcagacuuggcgcccggccugcuugucccaaggccccugaagaggggagcgaacccuccccuccgcccgcgccugcccccgcuccugaguacgaggcuccccgcccguauugcccuaaagaacccggagaggccagaccuucucccggccugcccguggggccugccaccggagaagcgaagcucagcgaggaggaacagccgaaaaagaagcaucggcgcaacagaacaaccuuuacaaccuaccaacugcacgagcuggaacgggccuucgagaaaucccauuaucccgacgucuacagccgcgaggaacucgcuggcaagguuaaucugccugaggugagagugcaggucugguuucagaaccggcgcgccaaauggagacggcaggaaaagcuggaggugucuuccaugaaacugcaagauagcccccuccugucuuucuccagaagcccucccucugcuacacuuuccccgcugggggccggaccuggcagcggcgggggacccgccggcggggcucucccucuggaauccuggcugggacccccucuccccggcgggggagcgaccgcccugcagucucuuccgggcuuuggcccucccgcucagagccugcccgccuccuauacgccuccgcccccucccccucccuuccucaauagcccuccccuggggccgggacuucagccucuggcucccccucccccgucuuacccuuguggccccggguuuggagacaaguucccucucgaugaggccgacccccgcaacuccagcauugccgcgcugcggcugaaggcuaaagaacacauccaagccauuggcaagcccuggcaggcccucuga

SEQ ID NO: 74691 - RNA, 4776 nt, Artificial Sequence
  derived and/or modified sequence opt5 from RB1CC1__Homo_sapiens__NP_001077086
augaagcuguacguguuccucgucaacaccggcacaacgcugaccuuugacacagagcuuaccguucagacaguggccgaucugaaacacgcuauccaaagcaaguauaaaauugccauccagcaucaggugcucgucgugaaugggggagaaugcauggcggcugacagacggguuuguaccuacuccgccggcacagauaccaaccccauuuuccuguuuaauaaggagaugauccuuugcgaccgcccuccggccauucccaaaacgaccuucucuacagaaaacgauauggagaucaagguggaagagagccugaugaugccugcugucuuucacaccguggccuccagaacacagcucgcucuggagauguaugaaguugccaagaaacuguguucuuucugcgaggggcucgugcaugacgaacaucugcaacaccagggaugggcggccaucauggcuaaucuugaggauuguagcaacuccuaccagaagcugcucuuuaaauucgagucuauuuauagcaauuaccugcaguccaucgaagacauuaaacuuaaacugacccaccucggcacggccgucagcgugauggcuaagaucccccugcuggagugccucacacggcacucuuaucgcgaaugucuggggagacuugauucccugccugagcaugaagacagcgagaaggccgagaugaaacggucuaccgaacucgugcugucccccgauaugccucgcacaaccaacgagagccuucugaccucuuuuccgaaguccgucgaacacguuagccccgacacagcggaugccgaguccggaaaagaaauuagagagucuugccaaagcacggugcaucagcaggacgagaccacaaucgacaccaaggauggcgaccucccuuucuuuaaugugucccugcuggauuggauuaacguccaggaccggcccaaugauguggaaagccucguucgcaaauguuucgacucuauguccagacuggauccucggaucauccgccccuuuauugcugagugcagacaaacaaucgccaaacuugacaaccagaauaugaaggcuauuaagggccuggaagaucggcucuacgcccuggaccagaugaucgccagcugugggcgccuugugaacgagcaaaaggaacuggcucagggauuccucgcgaaucagaaaagagccgagaaccugaaggaugcuucuguccugccggaccucugccugagccacgccaaccagcuuaugauuaugcugcaaaaucaccggaaacuccuggacaucaagcagaaaugcaccacggccaagcaggagcuggcuaacaaucuucaugugagacucaagugguguugcuucguuaugcugcacgccgaucaggacggcgaaaaacugcaagcgcuccugcgccuugugaucgagcugcucgaacgggucaagauuguggaggcucuguccacagucccucagauguacugucuggccgugguugagguggucagacgcaaaauguuuaucaagcauuaucgggaaugggccggggcucuugugaaagauggaaagagacucuacgaggccgaaaagucuaaacgcgagagcuucggcaagcuguuucggaaauccuuccugagaaaccgccucuuucgggggcuggacagcuggcccccuucuuucugcacccagaagcccagaaaauuugauugugaacuucccgacauuucccugaaggaucuccaguuccugcaauccuuuugcccuucugagguucagccguuccugcgcgugccccuucucugugacuuugagccucugcaccagcauguccuggcucuccacaaucuggugaaggccgcgcagucccuugaugaaaugagccaaaccaucacagaccugcucuccgagcagaaagccucugugagccagaccagcccccaaucugcuagcuccccucggauggaaagcacagccggaauuacgaccacaaccucucccagaacaccgccuccccugaccguucaggauccucugugccccgcugucuguccucuugaggaacucucccccgacagcaucgaugcccacacguucgacuuugagaccaucccgcauccuaacauugagcagacaauccaccaggugucucuggaccuggauucccucgcggaaagccccgagucugacuucaugagcgccgugaaugaguucgucauugaagaaaaccuguccagccccaauccuaucucugauccgcaaucccccgagaugaugguggagagccuuuauuccucuguuauuaacgcuaucgacagccggcgcaugcaggauaccaaugugugcggcaaggaagacuuuggcgaucauacaucccugaacguccagcucgagagaugucgggugguugcccaggacucucacuucagcauucaaaccaucaaagaagaucugugccacuuuagaacguucgugcagaaggagcagugcgacuuuuccaauucucugaaauguacagcugucgagauccgcaacauuaucgaaaaggugaaaugcagccuugagauuacccugaaggaaaagcaucagaaagagcuccugucccucaagaaugaauacgaggggaaacuggauggacuuaucaaggagacagaagagaacgaaaacaaaauuaagaagcugaaaggcgagcucguuugucuggaagaggugcugcaaaauaaggacaacgaguucgcccuugucaaacacgaaaaggaggccgugaucugccugcagaaugaaaaagaucagaagcuccuggagauggaaaacaucaugcauagccaaaauugugagauuaaggagcucaaacagucucgggaaaucgugcuggaggaccuuaagaaacugcacgucgaaaacgacgagaagcuccagcugcugagagcugagcuucagucccuggaacaaagccaucucaaagagcuggaagauacccuccagguucgccacauucaggaguuugaaaaggugaugaccgaccacagagugucucuggaggagcuuaagaaagaaaaucagcaaaucauuaaccagauccaggagucccaugcggaaaucauucaggagaaggaaaaacaacugcaggagcugaagcucaaagucagcgaucugucugacacacggugcaaacuugagguggaacuggcccucaaggaggcugaaacggaugagaucaagauucugcucgaagagucccgcgcccagcagaaggagacccugaaaagccuucuggaacaagagacagaaaaucugagaaccgagaucuccaagcucaaccagaaaauucaggacaauaacgagaauuaucaaguugggcuggccgaacuucggacacugaugaccaucgagaaggaucaguguaucagcgaacucauuucucgccacgaggaagagagcaacauccugaaagcugagcucaauaaggugacgucccugcauaaccaggccuucgaaauugagaagaaccuuaaagaacagaucauugagcugcaaucuaagcuggacagcgaacucuccgcgcuggagagacagaaagaugagaagaucacacagcaggaagagaaauacgaagcuauuauccaaaaucuugagaaggaccggcagaagcuggucucuagccaggaacaggaucgcgagcaacucauccagaaacugaacugcgagaaggacgaagccauucagaccgcccucaaagaguuuaagcuggaaagagaggugguugagaaagaacuucuggagaaggugaagcaccuggaaaaucaaaucgcuaaauccccugccauugacucuacccggggagauagcuccagccucgucgcggagcugcaggaaaaacuucaggaggagaaggcuaaguuccuggaacagcucgaggaacaagagaaacgcaagaacgaagagaugcagaaugugagaacaucucugaucgccgagcagcagaccaacuuuaauacaguucugacgcgggaaaagaugagaaaagagaacauuaucaaugaccucuccgauaaacuuaagagcaccaugcaacagcaggaacgcgacaaggaucugaucgagucucuguccgaagaccgggccagacuccuggaggagaaaaagaaacuugaagaggaagugagcaagcugcgcuccucuagcuucguccccuccccuuauguggcuacagcccccgagcucuacggcgcuugugccccugagcugcccggggaaagcgaucggucugcgguggagaccgccgacgaaggaagagucgauuccgcuauggagacaagcaugaugucuguucaggaaaacauucauaugcugagcgaggagaagcaacgcaucaugcuccuugaacggacccugcagcugaaagaggaagagaauaagagacucaaccagcgccugaugucccagucuaugagcuccgugucuagccggcacuccgaaaagauugccaucagagacuuucaagugggcgaucuuguccugauuauccucgacgagcggcacgauaauuacgugcuguucacgguuagcccgacccuguauuuccuccauucugagucccuuccugcucuggaccugaagcccgccagcggcgccucccgcagaccuugggugcucgggaaagucauggaaaaggaguacugccaggcuaagaaagcgcagaaccgguuuaaggugccccugggaacaaaauucuaucgcguuaaggccgugucuuggaauaaaaaggucuga

SEQ ID NO: 74692 - RNA, 2787 nt, Artificial Sequence
  derived and/or modified sequence opt5 from RB1__Homo_sapiens__NP_000312
augcccccuaagaccccgagaaaaacagccgcuacggccgcggcugccgccgcugagcccccugcucccccucccccuccgcccccugaagaggaccccgaacaggauagcggcccugaggaccugccccucgugcggcuggaauuugaggagaccgaagaaccggauuuuacagcucuuugccaaaagcugaaaaucccugaccacguccgcgaaagagccuggcucaccugggagaagguuuccucuguggauggggugcugggaggcuacauucagaaaaagaaggagcuuugggggaucuguauuuucaucgcggccgucgaccuggaugaaaugagcuuuacauucaccgagcuccagaaaaacauugaaaucuccgugcacaaguuuuucaaucugcugaaagagaucgacacaucuaccaagguugauaacgcuaugagccggcuccugaaaaaguaugacgugcuuuuugcccuguucuccaagcucgaacgcacgugcgagcugauuuaccuuacccagcccucuagcuccaucagcacagagauuaauucugcucugguccucaaaguguccuggaucaccuuucugcuggccaagggagaaguucuccaaauggaggaugaccuggugauuagcuuccagcuuaugcuguguguccucgauuauuuuaucaaacugucuccucccaugcuucugaaggaacccuacaaaacagcggugauuccuaucaacggcuccccgagaacccccagacgcgggcagaauagaagcgcccggaucgcuaagcagcucgagaacgacacgcgcauuaucgaagugcugugcaaagagcacgaguguaauauugacgaagucaagaacguuuauuucaagaauuuuaucccuuucaugaacucucugggacucgugacauccaauggccugcccgagguggaaaaccuuagcaaaagauacgaggaaauuuaucugaagaauaaagaucucgacgcccggcuguuccuugaucaugacaagacccugcaaacagauuccaucgacucuuuugagacccagcgcaccccuagaaaaagcaaccucgaugaggaagucaaugugauucccccgcacacaccuguucggacggugaugaacaccauccagcagcugaugaugauccugaacuccgcuagcgaccaacccucugagaaucucauuuccuacuucaacaauugcacagucaacccuaaggaaagcauccugaagcgcgugaaagauauuggcuacaucuuuaaggagaaauucgccaaggccguugggcagggauguguggagaucggcucucagagauauaaacuugggguccggcuguacuauagagugauggaaagcaugcucaaguccgaggaggagcgccugucuauucaaaauuuuagcaagcugcuuaacgacaauaucuuccauaugucccuccuggcuugcgcgcuggaagucgugauggccaccuacagccggucuacaucccagaaccucgauagcggaaccgaccugucuuuucccuggauucuuaauguucugaaccucaaagccuucgacuuuuauaaggugaucgaguccuucauuaaagccgagggcaaucugacgagagaaaugaucaagcaccuggagcgcugugaacaccggauuauggagagccuugccuggcucuccgauucuccucuguuugaccugaucaaacagagcaaggauagagaagggcccacagaccaucucgaguccgcuugcccgcugaaccuuccucugcagaauaaccacaccgccgcggauauguaccucucucccguccgcagccccaagaaaaagggauccaccacacgggugaauagcaccgcuaacgccgagacacaagccacgucugcuuuccagacccagaaaccucugaaguccacaagccugucucuuuucuauaaaaagguuuacagacucgccuaccugcgccugaacacccucugugaacggcugcuuuccgagcauccggaacuggagcacaucauuuggacacucuuccagcacacccugcaaaaugaauaugagcugaugagagaccgccaucuugaucagaucaugaugugcagcauguacggcauuugcaaagugaagaacaucgaccucaaguucaaaauuaucgucacggcuuauaaggaucugccccacgccgugcaggagaccuuuaaacgggugcugaucaaggaagaggaauacgacucuauuaucguuuucuauaauagcgucuuuaugcagagacucaaaacaaacauucugcaauacgcguccacccggccucccacacuuagcccuaucccccauauuccucgcucucccuauaaguucccguccagcccucugagaauccccggcgggaauaucuacauuuccccucucaagucucccuacaaaaucagcgagggacugccgaccccuacgaagaugacaccccggucccggauucuggugucuaucggcgagagcuuugggaccuccgaaaaauuccagaagauuaaccagaugguguguaauucugaucgcguccuuaaacggagcgccgagggauccaacccucccaagccccugaagaaacucagauuugacaucgaaggcagcgaugaggcugacgggucuaagcaucugccuggagaauccaaauuccagcaaaagcucgccgagaugacaagcacccgcaccagaaugcagaaacagaagaugaaugacucuauggauacauccaacaaggaggaaaaauga

SEQ ID NO: 74693 - RNA, 2145 nt, Artificial Sequence
  derived and/or modified sequence opt5 from RBAK__Homo_sapiens__NP_066986
augaacacccugcagggccccgugagcuucaaggacgucgccguugauuuuacacaagaggaauggcagcagcucgacccugaugagaaaaucacguacagagacgugaugcuggaaaauuauucccaccuugugucugucggguacgauaccacaaagccgaacgugauuaucaaacuggagcagggagaagaacccuggauuaugggcggggaguucccuugccaacauagccccgaggcuuggcggguugacgaucucaucgagcgcauucaggaaaaugaggacaagcacuccagacaggccgcguguaucaacucuaaaacccugacagaggaaaaggagaauaccuuuagccagaucuauauggaaacaucccuugugccuucuagcauuaucgcucauaacugcgucuccuguggaaagaaucuggagagcauuucucaacucaucuccagcgauggcucuuacgcccggaccaaacccgacgaaugcaacgagugugggaagacguaucacggagagaaaaugugcgaguucaaucagaacggcgauaccuacucccauaaugaggaaaacauucugcagaagaucagcauucuggagaaaccuuuugaauauaaugaguguauggaggcccucgacaacgaagcuguguucaucgcccacaagcgcgcuuacaucggcgagaagccguacgaauggaaugauucugggcccgacuuuauucagauguccaacuucaacgccuaucaaagaagccagauggagaugaaaccuuuugaaugcuccgaguguggaaagucuuucugcaaaaagagcaaauuuaucauucaccagcgggcgcauacaggcgagaagcccuacgaauguaauguuugcgggaaauccuucagccaaaagggaacccugacagugcaccgcagaucucaucuugaggaaaagccuuauaaaugcaacgaguguggcaagaccuuuugccagaaacugcaccucacgcagcaucugcggacacacuccggggagaagcccuacgaauguagcgagugcggaaaaaccuucugucagaagacacaccuuacccugcaucaacgcaaucacucuggcgaaagaccguauccuugcaacgaguguggcaagagcuucucccggaaaucugcccucagcgaccaucagcgcacccacacaggggaaaagcuguacaaaugcaaugaguguggaaaguccuauuacagaaaaagcacgcugaucacccaccagcggacacauaccggcgagaagcccuaccagugcucugaaugugggaaguuuuucucccgcgucagcuaucucacaauucacuacagaucucaucuggaggaaaaaccuuaugagugcaacgaaugcggaaagaccuuuaaucuuaacuccgcuuucauccggcacagaaaagugcacacggaggaaaagagccaugaauguuccgagugcggcaaauuuucucaacuguaccucacagaucaccauaccgcccaccuggaagagaagcccuaugaauguaaugagugcgggaagaccuuccuugugaacagcgcuuuugacggacaucagccccugccuaaaggcgagaaguccuacgaauguaaugucugcggcaaacucuucaacgagcugucuuauuacacagaacacuaccgcagccacuccgaggagaagccguauggguguagcgaaugcggaaaaaccuuuucucauaauuccagccuguuccggcaccagagaguucauacaggcgagaagcccuacgaauguuaugagugcgggaaauuuuucucucagaaguccuaccucacgauccaccaucgcauucacagcggagaaaagccuuaugaguguucuaaaugcggcaagguguuuagccggauguccaaccugaccgugcacuacagaagccauucuggggagaaacccuaugaaugcaaugaguguggcaaggucuucucccagaaaagcuaccuuacagugcacuaccgcacccauuccggagaaaagccuuaugagugcaacgaauguggcaagaaauuccaccaccggucugccuuuaacagccaucaaagaauccaccgccgggggaauaugaacguucuggauguggagaaucucuga

SEQ ID NO: 74694 - RNA, 1503 nt, Artificial Sequence
  derived and/or modified sequence opt5 from RBBP5__Homo_sapiens__NP_001180201
augaaccuggagcuccuggagagcuucggccagaauuaccccgaggaagccgacgggacccuugauugcaucuccauggcucugacauguacguuuaacagauggggaacccuccuggccgugggcugcaaugacgggcggauugucaucugggauuuccuuacacgcggaauugcgaagaucauuucugcucacauccauccuguuuguagccugugcugguccagagacggccacaaacucgugucugccagcaccgauaacaucgugucccaaugggacguccugucuggggauugugaccagcgguuucgcuucccgagccccauucugaaggugcaguaucauccuagagaucagaauaaaguucucgugugccccaugaaguccgccccugucaugcugacacuuagcgacucuaaacacgugguucugcccguggaugacgauuccgaccucaacgucguggcuagcuuugaccggcgcggagaguacaucuauaccggcaaugccaagggcaagauucuggugcuuaaaacagauucucaagaccuggucgcuuccuucagaguuaccacggggaccagcaacacaaccgccaucaagucuauugaauuugcgcggaaaggauccuguuuccucaucaauacagccgaucgcauuaucagaguguacgacggccgggagauccugaccugcgggcgcgauggagagccugaaccgaugcagaagcugcaggaccucgugaacagaacgcccuggaaaaaguguugcuuuagcggcgauggggaguauauugucgcuggauccgcccggcagcaugcucuguacaucugggaaaagucuauuggcaaucuugugaaaauccugcacggcacacgcggggagcuccugcuugacguugccuggcacccugugagacccauuaucgcgagcaucuccagcggagucgugucuauuugggcccaaaaccagguugagaauugguccgcuuucgccccugauuuuaaggaacuggacgagaacguggaauaugaggaacgggagagcgaguucgauaucgaagacgaggacaaaucugaacccgagcagaccggcgcugaugccgccgaagacgaggaggucgaugugacaagcgucgacccgauugcugcguuuuguuccucugaugaagaacucgaagacagcaaggcccugcuguaccucccuaucgcucccgagguggaagauccugaggagaaucccuacgggcccccuccggacgccguucagaccucccugauggaugaaggagccagcucugagaaaaagagacaauccagcgcugacggcucucagcccccuaaaaagaagcccaaaaccacaaacauugaacuucagggggugccuaacgaugagguccauccccugcucggagugaagggcgacggcaaauccaagaaaaagcaagccgggcgcccgaagggaagcaaagcgggcggggcuaucuccgagcugcuuuga

SEQ ID NO: 74695 - RNA, 5379 nt, Artificial Sequence
  derived and/or modified sequence opt5 from RBBP6__Homo_sapiens__NP_008841
augagcugcgugcacuacaaguucuccucuaaacugaacuaugacaccgucacauuugauggccuccauaucagccugugugaccuuaagaaacagauuauggggagagagaagcugaaagccgcugauugcgaccuccaaaucacgaaugcccagaccaaggaagaguacacagaugacaacgcgcugauucccaagaauuccucuguuaucgugcggcgcauuccuaucggaggcgugaaaagcaccuccaagacauaugucaucucuagaaccgaaccggcuauggccacaaccaaagccauugaugacagcuccgcuagcaucucucuugcccagcugacgaagaccgcuaaccucgccgaggcgaaugccuccgaagaggauaaaauuaaggcuaugaugagccagucugggcacgaguacgaccccaucaacuauaugaagaaaccucugggacccccucccccuuccuacacauguuuccggugcggcaagccggggcauuauauuaaaaauugucccaccaacggagauaagaauuuugaaagcggcccucgcaucaaaaagucuacaggcauucccagauccuucaugauggaggugaaagacccuaacaugaagggggccaugcugaccaauacgggaaaguacgcuauccccacaaucgaugccgaagcguacgccauuggcaaaaaggagaaaccgccuuuucuccccgaggaaccuagcuccucuagcgaggaagacgaccccauccccgaugagcugcuuugccugauuuguaaggacaucaugaccgaugcuguugugauuccuugcugugggaacuccuauugcgacgaauguauccggacagcccuccuggagagcgaugagcacaccugcccgaccugccaucaaaaugacgucucucccgaugcucuuaucgccaacaaauuccugcgccaggccgugaauaacuuuaagaacgaaacaggauacacgaagagacuccggaaacagcugccucccccucccccgccuauucccccuccccgcccucugauccagagaaaucuccaaccccugaugcgguccccgauuagccgccagcaggacccucuuaugauccccguuaccucuagcuccacacaccccgcuccuucuauuagcucccugaccagcaaccagucuucccucgcgccgcccgugagcggcaauccuucuuccgcccccgcuccuguccccgauaucacagccaccgugagcaucuccgugcacucugagaagagcgacgggccuuucagagauuccgacaacaaaauucugcccgccgcugcccuugcgucugaacauagcaagggaacguccagcaucgcuauuacagcccugauggaggaaaaaggcuaucaagucccgguucucggcaccccuucucugcuggggcagucccuccugcacggacagcuuauccccaccacaggcccugugcggauuaauaccgcccgccccgggggaggcagaccggggugggagcauagcaacaagcugggauaccucgugucuccuccccaacagauccggagaggcgagcgcuccuguuaucggagcauuaauagaggccgccaccacucugaacggagccagagaacacaggggccuucccugcccgcuacgcccgucuuugugccuguuccgcccccuccccuuuacccucccccuccgcauacccugccccucccucccggagugccucccccgcaauucagcccucaguuuccccccggccagccucccccugccggguauucugucccgcccccuggauuccccccugcucccgccaaccuguccacaccgugggugagcuccggcguucagaccgcgcacucuaauacaaucccuaccacgcaagcccccccucugagccgcgaggaauuuuaccgggagcagagacgccucaaggaagaggagaaaaagaaauccaagcuggacgaauucaccaacgauuucgcuaaagagcuuauggaauacaagaagauccagaaagagcggagacgcucuuuuagccgguccaagucucccuauagcggguccagcuacucuagauccagcuauacauacucuaaaucccggagcggcucuacccgcuccagaagcuauucccggagcuucucuagaagccauucccgcucuuacagccgguccccucccuauccgagacgcggaagaggcaagucucggaauuaccgcagcagaucccggucucacggguaccaucgcagcagaucccggagcccucccuaucgcagauaccacucucggucccgcagcccccaggccuuuagaggacaaucuccuaacaaacggaaugugccgcagggcgagacagaaagagaguauuucaaccgcuaccgggaaguccccccucccuaugacaugaaggcuuacuaugggagauccguggauuuucgcgacccuuucgagaaagaacgguacagagagugggagcgcaaguaccgggaaugguaugagaaguacuauaaaggauacgccgcgggcgcccagcccagaccuagcgcuaaucgcgaaaacuuuuccccggagcgguuccugccccucaacauuagaaauucuccuuuuacccgggggcgcagagaagauuaugucggcggacagagccaccggucccgcaacaucggcagcaauuaccccgagaagcugucugccagagacgggcauaaccaaaaagauaauacgaaguccaaagagaaggaaagcgagaacgcuccuggagacggcaaggggaauaaacacaagaaacaucggaagagacgcaaaggagaagagucugaaggcuuccugaaccccgagcuucucgagacaagccggaaguccagagaaccgaccgggguggaggaaaauaagacagauucucuguuuguucugccuagccgcgacgaugccacccccgugcgggacgagcccauggaugccgaguccauuaccuucaaaucugucagcgaaaaggacaaaagagagcgcgacaagccuaaagcuaagggcgauaagacaaaacggaagaacgacggauccgcggugagcaaaaaggaaaauaucguuaaacccgccaagggcccucaggagaaaguggauggggaaagagagcgcucuccgagauccgagcccccuauuaagaaggcuaaagaagagacgcccaagaccgacaacacaaaaagcuccucuagcucccagaaggaugaaaaaaucaccggaacaccucggaaggcccacucuaagagcgccaaagagcaccaagaaaccaagcccgucaaagaggagaaggugaaaaaggacuauuccaaggaugugaaaagcgaaaagcucacgacaaaagaggaaaaggcuaaaaagccgaaugagaagaacaaaccucuggacaauaagggcgaaaaacgcaagagaaaaaccgaggagaaggggguugauaaggacuuugaaucuuccagcaugaaaaucucuaagcuugaggucaccgaaauugugaaacccuccccuaagcggaaaauggagcccgauacagagaagauggaccgcaccccugaaaaagauaagaucagccugucugcccccgcgaagaaaauuaagcucaacagagagacaggaaaaaagaucggcagcacggaaaacauuuccaauaccaaagagccgucugaaaagcuggagagcacauccagcaaggugaaacaggagaaggucaaagggaaggugcggagaaaaguuaccggcacagaaggauccucuagcacccugguggacuacacguccaccucuagcacaggcggguccccuguccgcaagucugaggaaaagaccgacacaaaacggaccgugaucaagacaauggaggaauacaacaaugauaacaccgcucccgccgaggacguuaucauuaugauccaggugccccagagcaaaugggauaaggacgauuucgaguccgaagaggaagacgucaaaagcacgcaaccuauuucuuccgugggaaagccggccagcguuaucaagaaugugucuacaaaacccuccaacauugucaaguauccugagaaagaaagcgagcccucugagaagauccagaaauucaccaaggaugugucccaugaaaucauucagcacgaggugaaaagcuccaagaauagcgcuucuagcgaaaagggcaaaaccaaggacagagauuacuccguccuugagaaagagaacccugaaaagcgcaaaaauucuacacagcccgagaaggaaagcaaccucgaccggcugaaugagcaagggaacuuuaagucccugucucagagcuccaaagaagccagaaccucugauaagcaugacagcacgcgggcguccagcaauaaagacuucacaccuaaccgcgauaagaaaaccgacuaugauacaagagaguacucuuccagcaagcggcgcgacgagaagaaugaacucaccagacggaaagauucucccucccgcaacaaggacagcgcuuccggacagaaaaacaagccgagagaggaacgggaucugccuaaaaagggcacaggcgacucuaagaaaagcaauuccagccccucucgcgauagaaagccucacgaccauaaagccaccuaugauacgaagcggcccaacgaggaaaccaaauccguugacaagaauccgugcaaagauagagagaagcacgugcuugaggcccgcaacaauaaggaaagcucugggaacaaacugcucuacauccugaauccucccgagacacagguggaaaaggagcaaauuaccggacagaucgacaaaagcacagucaagcccaaaccucagcugucccacucuagccggcuuuccucugaccucaccagagaaacggaugaggcugccuuugagcccgacuauaacgaaagcgauuccgagagcaaugugucuguuaaggaagaggaguccagcggcaacauuuccaaggaccugaaagauaagaucguggaaaaagcuaaggagucucuggacacagccgcggucgugcaaguugggauuagccgcaaucagucccauucuagcccuuccgugagcccgucucggucccacagccccucuggaucccagaccagaagccauucuuccagcgccucuagcgcugaaucccaggauagcaaaaagaagaaaaagaaaaaggagaaaaagaagcacaaaaagcauaaaaagcacaaaaagcacaagaaacaugccggcacagaagucgagcucgagaagucccaaaaacacaagcauaaaaagaaaaagucuaagaaaaacaaggacaaagaaaaggagaaagaaaaggaugaccagaaggugaaaagcguuaccguguga

SEQ ID NO: 74696 - RNA, 1410 nt, Artificial Sequence
  derived and/or modified sequence opt5 from RBBP7__Homo_sapiens__NP_001185648
auggccgcugaggccggcguggucggggcgggagcuagccccgacggcgauuggagagaccaggccugcgggcugcuccugcacguucaucuuuccucucggcugggacgcgccgcuccugugagaaccggccggcaccuccgcacaguguucgaagauacggucgaggaaagagugaucaacgaggaauacaagauuuggaaaaagaauaccccguuucuguaugaccuuguuaugacacaugcccugcaauggcccagccucaccgugcaguggcugccugaggucacaaaacccgaggggaaggauuacgcucugcacuggcucgugcugggaacccauacauccgacgaacagaaccaccuuguuguggcccggguccacaucccuaaugaugacgcgcaguucgaugccucucauugugacagcgauaaaggcgaguuuggcggguucggauccgugaccggcaagauugaaugcgagaucaagauuaaccacgagggggaagugaaucgcgcuagauauaugccccaaaacccucauaucaucgccacgaaaaccccgucuagcgacguccugguuuuugauuacacaaagcaccccgcuaaaccugaccccuccggagaguguaauccugaccuccggcugcgcggccaccagaaggaaggguauggacuuagcuggaacucuaaucuguccggccaucuccugagcgccucugaugaccacaccgugugccugugggauauuaacgcgggccccaaagaggggaagaucguggacgccaaggcuauuuucacaggacauuccgccgucguggaagauguugcuuggcaccuccugcaugagagccuuuuuggcucuguggccgacgaucagaaacugaugaucugggacaccagauccaauacgacaagcaagccgucccaccucgucgaugcccacaccgcugaggugaacugucugucuuucaauccuuacagcgaauuuauucuugcgacaggguccgccgacaaaaccguugcucugugggaucuccggaaccugaagcugaaacuccauaccuucgagagccacaaggacgaaaucuuucaggugcauuggucuccccacaaugagacaauucuggccuccagcggaacggaccgcagacuuaacgucugggaucugucuaaaaucggcgaggaacaaagcgccgaggacgcugaagaugggccucccgagcuccuguucauccacggaggccauaccgccaagauuuccgacuuuucuuggaaccccaaugaaccuugggugaucugcagcgucuccgaggauaacauuaugcagaucuggcagauggcggaaaauauuuauaacgacgaggagagcgaugugacaaccucugaacuugagggccagggguccuga

SEQ ID NO: 74697 - RNA, 2604 nt, Artificial Sequence
  derived and/or modified sequence opt5 from RBBP8__Homo_sapiens__NP_976037
augaacaucagcggcuccucuugcgggagccccaauuccgccgacaccucuagcgauuucaaggaccuguggacaaaacucaaggagugucacgauagagaagugcagggacugcaagucaaaguuacgaagcugaaacaggagcggauucuggacgcucagcgccucgaagaguuuuucaccaagaaccagcaacugagagaacagcagaaggugcuucaugagacaaucaaagugcuggaggaucggcuccgcgccggccugugcgacagaugugcggucaccgaagaacacaugcggaagaaacagcaagaauuugagaauauucgccagcagaaccugaagcucaucacagagcugaugaaugaaagaaacacccuucaggaggaaaauaaaaagcuguccgagcaacuccagcagaagauugaaaacgaucaacagcaucaggcugccgagcuggagugcgaagaggacgugaucccugauucuccgaucacagccuucagcuuuuccgggguuaaucggcuucgcagaaaagaaaacccccacgugcgguacauugagcagacccauacgaagcuggaacacagcgucugugcuaaugagaugcgcaaagugucuaaguccagcacccacccucaacauaaccccaaugagaacgaaauccucguugccgacacauaugaucagucucaguccccuauggcuaaagcccacggaaccagcucuuacacacccgacaaguccagcuucaaucuggcgaccguggucgccgagacgcugggccucggggugcaggaagaguccgaaacacaaggaccuaugucuccgcugggcgaugagcuuuaucauugccuggagggcaaccacaaaaagcagcccuuugaagagagcaccagaaacacagaagacucccuccgguucagcgacucuaccuccaagaccccuccccaggaggagcugccuacacgcgugagcucucccgucuuuggggcuacgagcuccauuaaaucuggacuugaucugaauaccagccucuccccgagccugcugcagccuggcaagaaaaagcaccucaaaacacugcccuucucuaacaccuguaucuccagacuugaaaagacacggagcaagucugaggacuccgcccuguuuacccaucacagccucggguccgaaguuaauaaaauuaucauucaaucuagcaacaagcagauccugaucaauaaaaacauuuccgagucucuuggagaacagaauagaacggaguacggcaaggauagcaacacagacaaacaucuggagccucucaagucccuugggggacgcaccagcaagcggaaaaagaccgaagaggaaucugagcacgaaguguccugcccccaggcuagcuucgauaaagagaaugccuuucccuucccuauggacaaccaauucucuaugaauggcgauugugugauggacaagccgcuggaucucuccgacagauuuagcgcgauccagcgccaggagaaaucucaaggcagcgaaacauccaagaacaaguuccggcaggucacccuguaugaggcccuuaaaacaauucccaagggguuuagcagcuccagaaaagcuagcgauggaaauugcacgcugccuaaggacucccccggcgaaccuuguucucaggagugcaucauucuccagccccugaacaaaugcagcccggacaauaagccuucccugcaaaucaaagaagagaacgccguguucaagaucccccuucgcccucgggagucucucgaaaccgagaacguucuggaugacauuaagagcgcugggucccaugaacccaucaaaauucagacaagaucugaucacggaggcugugagcuggccagcgugcuccagcugaauccuugccgcaccgggaagaucaaaucccuucagaacaaucaagacgucagcuuugagaacauucaguggucuaucgaucccggagccgaccugucccaguacaagauggaugugacaguuaucgacaccaaagauggcagccagucuaagcucggcggggaaacgguggacauggauuguacccuggucuccgagacagugcugcuuaagaugaaaaagcaagaacagaaaggagagaagucuucuaaugaggagcggaaaaugaacgacucccucgaggauauguucgacagaaccacacacgaagaguaugaaagcugccuggcugacuccuuuagccaggcggccgaugaggaagaggagcugucuaccgcuacgaagaagcuccauacacacggcgacaaacaagauaaggucaaacagaaggccuucguggaaccguacuuuaaaggggacgagagcauuaugcagaucugucagcaaaagaaggaaaaacgcaauuggcugccugcccaggauaccgacuccgcuacauuccaucccacccaccagcggauuuuuggaaaacuuguuuuccugccccucagacugguguggaaggaggucauccugcggaagauucuuauccucgugcugguucagaaagaugugucucugaccacacaauacuuucuccagaaggcccgcagcagacggcacagacgcuga

SEQ ID NO: 74698 - RNA, 561 nt, Artificial Sequence
  derived and/or modified sequence opt5 from RBBP9__Homo_sapiens__NP_006597
auggccagccccuccaaggcugugaucgucccuggcaacgggggaggcgacguuaccacacacgggugguacggaugggugaaaaaggagcuggaaaagauuccgggcuuccagugccucgccaagaauaugcccgauccuaucacggcgagagagucuauuuggcugcccuuuauggaaaccgagcuucauugugacgagaaaacaaucauuaucgggcacagcuccggagcuaucgccgccaugcgguaugcugaaacccaucgcguguacgccauuguccuggugucugcuuauacaagcgaucucggcgacgagaacgaaagagccuccggcuacuucacccggccuuggcaaugggagaagaucaaggcgaauugccccuauauuguucaguuugggucuacagaugacccuuuccugccguggaaagaacagcaggagguggccgaucgccuugagaccaagcugcacaaauuuacggacuguggacauuuccaaaacaccgaauuucacgagcucaucacagucgugaaaagccugcugaaaguucccgcuuga

SEQ ID NO: 74699 - RNA, 1407 nt, Artificial Sequence
  derived and/or modified sequence opt5 from RBCK1__Homo_sapiens__NP_006453
augggcaccgccacacccgacgggagagaggaucaggaacggcugugggugagcgucgaggacgcucaaaugcacacgguuaccaucuggcucacagugcgcccugauaugaccguggccucccugaaggacauggucuuccuugauuacggauuuccgcccgugcugcagcaguggguuauuggccagagacucgcgcgggaccaagaaacacugcauucucacggggugcgccagaacggagauagcgcuuaucuuuaccugcucuccgccagaaauaccucucugaacccucaggagcugcagcgggaacgccaacucagaaugcuggaggaccuuggcuucaaagaucugacacuccagccccgggggccucuggagcccggaccuccgaagcccggcgucccucaggaacccggccgcgggcagccugacgccgugcccgagccgccucccguuggauggcaaugcccuggcuguaccuuuaucaauaaacccacgagacccgggugcgaaauguguugccgggcucgcccugaggccuaucaggugccggcuagcuaccagcccgaugaggaagagagagcccggcuugcgggagaagaggaagcccugcgccaauaucagcagagaaagcagcaacagcaggagggcaacuaccuccagcauguccaacuggaccagcggucccuggugcucaauaccgagccugcugaaugucccgugugcuauucuguccuggccccuggggaggcuguugugcuuagagaaugucugcacacauucugccgcgagugucuccagggaaccauucggaacagccaggaagccgagguguccugccccuuuaucgauaauacauacagcuguucuggcaaacugcuugagagagaaauuaaggcgcugcucaccccggaggacuaccaacgcuuccuggaccugggcaucuccaucgccgaaaaccggagcgcuuuuucuuaucauugcaagacgccugauugcaaagggugguguuucuuugaggacgaugucaaugaguucacaugccccguguguuuucacguuaacugccuccuguguaaggccauucacgaacagaugaauugcaaagaguaccaggaagaccuugcucugagagcccagaacgauguggccgcucgccaaaccacagagaugcucaaggucaugcugcagcagggagaagcgaugcgguguccucaaugccagaucgugguucagaaaaaggacggcugugauuggauuagaugcaccgugugucauaccgagaucugcugggucacaaaggggccccgcuggggaccuggcgggcccggagacacguccggcggcugccgguguagagugaaugggauuccgugccacccuagcugucagaacugccauuga

SEQ ID NO: 74700 - RNA, 1113 nt, Artificial Sequence
  derived and/or modified sequence opt5 from RBFOX1__Homo_sapiens__NP_001135805
augaacugcgagagagaacagcugcggggcaaucaagaggccgcugccgcgcccgacaccauggcucagccuuacgccagcgcccaguucgcuccgccccagaacgggaucccugccgaauauacagcuccccacccucaucccgccccugaguacacgggacaaaccacagugccggaacacacccucaaucuguaucccccugcgcagacacauuccgagcagucucccgccgauaccagcgcucagacagucuccggcaccgccacgcaaaccgacgaugcugccccuacagacgggcagccccagacccagccgucugagaacacagaaaauaagagccaaccuaaacgccuucacguuuccaacauucccuuuagauuccgggauccugaccugcgccagauguuuggacaguucggcaagauccucgauguggagauuaucuuuaaugaaagagggucuaaaggauucggcuuugugaccuucgagaacagcgcggacgccgaucgggcucgcgagaagcugcauggcacggucguggaagggagaaaaauugagguuaauaacgccacagcucgggugaugaccaauaagaagacagucaaccccuacaccaauggauggaaacuuaaccccgugguuggcgccguguauuccccugaauuuuacgccgucccgggguuccccuauccugcugcgaccgccgcugccgccuaccgcggagcucaccugagaggccgggggcgcacaguguacaauacguuuagagccgcggcucccccucccccgaucccugccuauggaggcguggucuaccaagacggcuucuauggggccgauaucuacggaggcuaugcugccuaccgguaugcucagcccaccccugccacagcggccgcuuacagcgacucuuacgggcgcguuuaugccgcugaucccuaccaccaugcccucgcgccugcccccaccuauggagugggcgcuaugaacgccuuugcuccgcugacagacgccaagaccagaucccacgccgacgauguggggcugguccucagcucucugcaggcuuccauuuaccggggaggcuauaacagauucgcgccuuacuga

SEQ ID NO: 74701 - RNA, 1143 nt, Artificial Sequence
  derived and/or modified sequence opt5 from RBFOX2__Homo_sapiens__NP_001026865
auggagaagaagaagauggugacccagggcaaccaagaacccacaacgaccccugacgccaugguccagccguucacaaccauccccuuuccucccccuccccagaaugggauuccuacagaguacggaguuccgcacacccaggauuaugcuggccaaacaggggaacauaaccugacccucuacggaagcacgcaggcccacggcgagcaguccucuaauagccccuccacccagaacgggucucugacaaccgaaggaggcgcgcaaacagacggccagcagagccagacccaauccucugagaauagcgaguccaaaagcacgccuaagagacuucaugugucuaacauccccuuccgguuucgcgauccugaccugagacagauguucgggcaguuuggaaaaauucucgauguggaaaucauuuucaaugagcggggcuccaagggguuuggauucgucacauuugaaaacagcgcugacgccgaucgcgccagagagaagcugcacggcaccgugguugaggggcggaaaaucgaagugaauaacgcuacagcccgcgucaugaccaauaagaaaauggugacccccuaugcuaacggauggaaacuuucuccgguugugggcgccgucuacggcccugagcuguaugcggccuccagcuuccaagcugacgugucucucgggaaugaugccgcugugccccuguccggaagaggcgggaucaacacauacauuccucugaucagccucccccugguccccggauuuccuuauccgacggccgcgaccacagccgcugccuuccggggcgcucaucuucgcgggagaggacggaccguuuacggcgccgugcgcgccgugcccccuacagcuauucccgcguacccuggcgucguguaucaggacggguuuuacggagccgaucuguauggcggguacgcugccuauagauacgcccagcccgcuaccgccacggcggcuacagccgccgcugccgcugccgcggccuauuccgacggauacggccggguuuacaccgcugauccguaucacgcccucgcuccugccgcgucuuacggggugggcgccgucgcuagccuguaucgcggaggcuacuccagauucgcccccuauuga

SEQ ID NO: 74702 - RNA, 939 nt, Artificial Sequence
  derived and/or modified sequence opt5 from RBFOX3__Homo_sapiens__NP_001076044
auggcccagcccuacccuccggcucaauaucccccucccccucagaacggcauccccgccgaguacgcgccuccgcccccucaccccacccaggacuauagcgggcagacaccugugcccacggaacauggaaugacccuguacacaccggcucaaacccacccugagcagcccggcuccgaagccucuacacagccuauugccgggacccagacagucccccaaaccgaugaggcugcccagacggacagccagccccuccauccuuccgauccgaccgaaaagcagcaacccaaaagacugcacguuucuaauaucccuuuccgguuucgcgaccccgaucuuagacagauguucggacaguuuggcaagauucuggacguggagaucauuuucaacgagcgggggagcaaaggauuuggcuucgugacauuugaaaccuccucugaugcugaccgcgccagagagaagcucaauggcacaaucgucgaagggcggaaaaucgaggugaacaaugcgaccgcccgcguuaugacgaacaagaagacaggaaauccuuauaccaacggcuggaaacugaaucccguggucggggcuguguacggaccggaguucuaugccguuacaggcuuuccuuaccccaccaccgggacagcuguggccuacagaggagcgcaucuucggggccgcggcagagccgucuauaacacguuccgggcugccccucccccucccccgauuccuaccuacggggcugugguguaucaagauggauuuuacggcgccgaaaucuaugggggauacgccgcuuaucgcuacgcgcagcccgccgcugccgccgcugccuacagcgacuccuauggcagagucuacgcggcugccgaucccuaucaccacacaauugggccugccgcuaccuacagcaucggaacaauguga

SEQ ID NO: 74703 - RNA, 3207 nt, Artificial Sequence
  derived and/or modified sequence opt5 from RBL1__Homo_sapiens__NP_002886
auguucgaggacaagccccacgccgaaggcgcugccguggucgcggcugccggggaggcccugcaggcucucugccaagaacugaaccuugaugagggaagcgccgcugaagcccuggacgauuuuaccgcgaucagaggcaauuacucccucgagggggagguuacacauuggcuggccuguucucuuuauguggcuugccggaaaagcauuaucccuacggugggaaagggcauuauggaagggaacugugucucccugacccgcauccucagaucugccaaacugagccugauucaguucuuuuccaagaugaaaaaguggauggacaugucuaaucucccgcaggaguuccgggaacgcaucgagagacuggagcggaacuuugaagugagcacaguuaucuucaagaaauacgagcccauuuuucuugauaucuuccagaauccuuaugaggaacccccuaagcugccccgcuccagaaaacaacggcgcauuccuugcagcgugaaggaccucuuuaacuucuguuggacccuguuugucuacacaaaaggaaauuucagaaugaucggcgaugaccuugugaacucuuaucaucugcuccugugcugucuggaucucauuuuugcuaaugccaucaugugcccgaaccggcaggaccugcuuaaucccuccuucaagggccugccuagcgauuuccacaccgcggacuuuacagccucugaggaacccccuuguauuaucgcuguucucugcgagcugcacgaugggcuucugguggaagccaagggaaucaaagagcauuacuucaagcccuauauuuccaaacucuuugaccgcaagauccugaaaggcgaaugucugcucgaccugagcucuuucaccgauaacuccaaggcugucaauaaagaguacgaagaguacgugcuuacggugggggacuuugaugagagaauuuuccugggagccgacgccgaagaggaaaucggcaccccgcggaaguuuacacgcgauaccccucucgggaagcugacagcucaggcgaacgucgaguauaaucuucagcaacacuucgagaaaaagagaucuuuugcccccuccaccccucugacgggacggagauaccuccgcgaaaaagaggcuguuauuacacccguggccucugccacccagagcgugucccggcugcagagcaucgucgcuggccugaagaacgcccccucugaccagcucaucaacauuuucgaauccugcgugagaaauccuguugagaacaucaugaaaauucugaagggcaucggggaaacauuuugccaacacuauacccagagcaccgaugagcagccgggaucucauauugacuucgcggugaaucgccuuaagcuggcugagauccucuacuauaaaauccuggaaacagucauggugcaagagacgcggagacugcacggcauggauaugagcguucuucucgaacaggacauuuuucaucgcucccugauggccuguugccuggagaucguccucuucgccuacucuagcccccggaccuucccuuggauuaucgaagugcugaaccuucagcccuuuuauuucuacaaggugauugaggucgugaucagauccgaggaagggcugagccgcgauaugguuaaacaccucaauucuauugaggaacagauccuggagucccuggcuuggagccacgacucugcccuuugggaagcucuccaaguguccgccaacaaggucccuacaugugaggaggugaucuuucccaauaacuucgaaaccggaaauggcgggaacguucagggacaucugccgcugaugccuaugagcccccucaugcacccucgggugaaagaggucagaacagacuccggcucucugcgccgggauaugcagccccuuagcccuauuuccgugcaugaaagauacucuagccccaccgcgggcuccgccaagcggcgccuguuuggggaggacccgccuaaggaaaugcucauggauaaaaucauuacggagggaacaaagcugaaaaucgcucccagcagcuccauuaccgccgagaaugugagcauccugcccggccagacccuucucacaauggcuaccgccccuguuacagggacgaccggacacaaggucacaaucccgcugcauggcguggcgaacgacgccggggaaauuacccugaucccccucucuaugaauacaaaccaagaguccaaagucaagagcccugugucucugaccgcucacagccuuauuggcgccucccccaagcagacgaaucugaccaaagcucaggaagugcacagcacaggaaucaacagaccuaagcggaccggcucucucgcccuguucuauagaaaaguuuaccaucuggccuccgugcgccuucgggaucucugccugaagcuggacgucagcaacgagcucagacgcaaaauuuggacauguuuugaguucacccuggugcacugccccgaucuuaugaaggacagacaucuggaucagcuccugcugugugcuuuuuauaucauggcgaaaguuacgaaggaggaacggacauuccaagaaaucaugaaguccuaccgcaaucagccucaggccaacucucacguguauagaagcguccuucugaaauccauuccccgggaggugguugcuuacaauaagaacaucaaugacgauuuugaaaugauugacugcgaucucgaggacgccaccaaaacaccggacuguucuagcgggccugugaaggaggaacgcggagaucugaucaaauucuauaacaccauuuacgucggcagagugaaguccuuugcccucaaguacgaccuggcuaaucaggaucacaugauggacgcgcccccucuuucucccuucccgcauaucaaacaacagccugggagcccccggcgcaucucccagcaacacagcauuuauaucucuccucauaagaacggauccggccugacccccagaagcgcccuccuguacaaauucaaugggucucccuccaagagccugaaagauauuaacaauaugauccggcagggcgagcagcgcacaaagaagagagugauugcuaucgacucugaugccgaauccccugccaaacgggucugccaggagaacgacgauguucuucugaagagacuccaagacguggugagcgaacgcgcuaaucacuga

SEQ ID NO: 74704 - RNA, 3198 nt, Artificial Sequence
  derived and/or modified sequence opt5 from RBL2__Homo_sapiens__XP_005256140
augcagagccugaccaagggcaacgaccuccacuggcuggccugcgcucuuuacguggccuguagaaaauccguccccacaguuucuaaggggacgguggagggaaauuaugugagccugacccggauccucaaaugcuccgaacaaucucugauugaguucuuuaacaagaugaaaaagugggaagauauggcgaaucuuccuccgcauuuccgcgagagaacagaacggcuggagcgcaacuuuaccgucagcgcugugaucuucaagaaauacgagcccauuuuucaggacaucuucaaguauccucaggaggaacagcccagacaacagcggggccgcaaacagagacggcagccuuguacaguuuccgaaauuuuucacuucugcugggugcucuuuaucuacgccaaggggaauuuccccaugaucucugaugaccuggucaacagcuaucaucugcuccugugugcccuugaucugguguacggaaaugcucuccaaugcuccaaccgcaaagagcugguuaauccuaacuuuaagggccuuagcgaggacuuccacgccaaggauucuaaaccguccagcgaucccccuuguauuaucgaaaagcugugcucucuccaugacgggcuggugcuggaggcuaaaggaauuaaggaacacuuuuggaaacccuauaucagaaagcucuacgagaaaaagcugcuuaagggcaaagaagagaaucugaccggcuuccucgagccugggaacuucggagaauccuuuaaggccauuaauaaagcguacgaggaauauguccugagcgugggcaaccuugacgagcggaucuuccugggggaagaugccgaggaggaaauuggaacacucucucgcugucugaaugcuggcuccgggaccgagacggccgaaagagugcagaugaagaacauccugcagcagcacuuugacaaaagcaaggcucuccggaucuccacaccccugacaggaguccgcuacauuaaggagaacucuccgugcguuaccccugugagcacagccacccauucccuuagcagacugcacacgaugcucacaggccugcggaaugcgcccucugaaaaacuugagcaaauccugagaaccuguucccgcgauccuacacaggccauugcuaaccggcucaaggagauguucgaaaucuauagccagcauuuucaacccgacgaggacuucucuaauugcgccaaagaaauugcuagcaagcacuuuagauucgccgagaugcuguacuauaaagugcuggaguccgucaucgaacaggagcagaagcgccucggcgauauggaccugucugggauccuugaacaggaugccuuucaccggagccugcucgcuugcugucuggaggugguuaccuucuccuacaagcccccuggaaacuuuccguucauuaccgaaaucuuugacgugccccuguaucauuucuacaaagucauugagguguucaucagagcggaggauggccuuugccgcgaaguugugaagcaccucaaucaaauugaggaacagauccuggaccaucuggccuggaaaccugagagcccccucugggaaaagauccgggauaacgagaauagagucccuacaugugaggaagugaugcccccgcagaaccuggagcgcgcugacgaaauuugcaucgccgggucuccucuuacgccccggagagucaccgaggugcgcgccgauacaggaggccuggggcgguccauuaccagcccuacaacccucuacgacagauauucuagcccucccgcuagcacgacacggcgcagacuguuuguugaaaaugauucccccucugacggaggcaccccgggccggaugccuccccagccccuggugaacgccgucccugugcaaaauguuagcggggagaccguguccgucacaccggugcccggacagacccuugugacaauggcgacggcuaccguuacagccaacaauggccagaccgucacaaucccugugcaggggauugccaacgagaauggaggcaucaccuucuuucccgugcaagucaacgugggaggccaggcucaggccguuacgggaucuauucagccucucagcgcucaagcccuggcgggcucccugagcucucaacaggugaccgggacaacccuccagguccccggacagguggccauccagcagaucuccccuggcgggcaacagcagaaacagggacaaagcguuacaucuuccagcaacagaccccgcaagaccucuagccugucccuuuucuuucggaagguguaccaccuggcugccgucagacuccgcgaccugugugcuaaacuggauauuagcgacgaacuuagaaagaaaaucuggacgugcuucgaguuuucuauuauccaguguccggaacucaugauggaucggcaucuggaccagcugcucaugugcgccauuuaugugauggcgaagguuacaaaagaggauaaguccuuccagaauaucaugcgcuguuacagaacccaaccucaggcccggagccagguguaucgcuccguccugaucaaaggcaagagaaagcggcgcaacucugggagcuccgacucuagaagccaccaaaauucccccacagagcuuaacaaagaucggaccucucgcgacagcuccccugugaugagauccucuuccacccugcccgugccgcagccuagcucugcucccccuacacccacgcggcucaccggcgccaauuccgauauggaagaggaagagagaggagaccugauucaguuuuacaacaauaucuauauuaagcagaucaaaacauucgcuaugaaguacagccaagccaacauggaugcucccccucugucuccguaccccuuuguccgcaccggcuccccucggcgcauucagcuuagccagaaucaccccguuuauaucuccccucauaaaaacgaaacaaugcucagccccagagagaagaucuucuacuauuuuucuaauagcccuuccaagcggcugagagagauuaacucuaugauccgcaccggggaaacgccgaccaaaaagcgggggauucugcucgaggacggcagcgaaucccccgccaaaagaaucugcccugagaaucacucugcgcugcuucgccggcugcaggauguggccaacgacagagggagccauuga

SEQ ID NO: 74705 - RNA, 2988 nt, Artificial Sequence
  derived and/or modified sequence opt5 from RBM10__Homo_sapiens__NP_001191397
augagcggcucccccucucugaccgccagagcugagaaggugagcgucgacgccgggcggggaggcggggaaucccuccaggaggcgucuccucgccuggcugaucacggaagcuccucuggcgggggaugggaaguuaaaagaagccaacggcuucgcagaggcccguccagcccccggcgcccuuaccaggacauggaguaugaaagacggggcgggcgcggagauagaacaggccgguacggggccacggaccgcucucaggaugacggaggcgagaacagaucccgggaucaugacuaucgcgauauggacuacagaagcuauccccgggaguacgggucucaggaaggaaagcacgauuaugacgauuccagcgaggaacaaucugccgaggacuccuacgaggcuagcccuggcuccgaaacccagagacgccggagacgccggcauagacacucucccacaggcccuccgggguucccccgcgacggagauuaccgggaccaggauuauagaaccgagcagggcgaagaggaagaggaggaagaggacgaagaggaagaggagaaagccagcaauaucgugaugcugcgcaugcucccucaagcugccacagaagaugacauucgggggcagcugcagucccauggagugcaggcgagagagguccgccuuaugcggaacaagagcucuggccaauccagaggguuugccuucguggaauuuagccaccuucaggaugcuacccgguggauggaggccaaucagcacucucucaacauccugggacaaaaaguuagcaugcauuacuccgaccccaagccuaagauuaaugaagauuggcugugcaacaaauguggcgugcagaauuucaagcgcagagagaaaugcuuuaaguguggcguccccaaaucugaggcugaacagaagcucccgcuggggacacggcuugaccagcaaacccugccucucggaggcagagagcugagccaggggcuucugccccucccucagcccuaucaggcccaaggagugcuggcgucccaggcccugagccagggcucugaacccuccagcgagaacgcuaaugauacgaucauucuccgcaaccugaauccucacucuaccauggacuccauccuuggggcccuggcuccguacgccguucucagcuccucuaacgugcgggucaucaaggacaaacagacacaacugaauagaggcuucgccuuuauucagcuuagcaccaucguggaggcugcgcagcugcuccagauucugcaagcccugcaucccccucucacaaucgauggaaagaccauuaacguggaguucgcuaaaggcuccaagcgcgacauggccucuaaugaagggagcagaaucuccgccgcuagcgucgccucuacggcgauugcugccgcccagugggcuaucucccaggccagccaaggaggcgaagggacaugggcuaccucugaggaacccccuguugauuauuccuacuaucagcaggacgagggauacggcaacagccaggggacagagucuagccuguacgcccacggcuaucuuaaaggaaccaagggccccgggaucaccggaacaaaaggcgauccgacgggggcgggaccugaagccucccuggagcccggcgcugacagcgugucuaugcaagccuuuucccgggcucagccuggggccgcgcccggcauuuaccagcagagcgccgaggcuuccucuagccaaggaaccgccgcuaacucccagucuuauacaaucaugagcccugccgugcucaaguccgaacugcagucucccacccacccgagcuccgcccuuccucccgcuacaagccccaccgcgcaggaaucuuacucccaauauccugucccggaugugagcacguaccaguaugacgagacaucuggcuacuacuaugauccccagaccgggcuguacuaugacccuaauucccaauacuauuacaacgcccagagccagcaguaucucuacugggauggagagcgcagaaccuacguucccgcucuggaacaaucugccgacggccauaaggagacaggggccccuuccaaagaaggaaaggagaaaaaggaaaaacacaagaccaagacagcucagcagauugccaaagauauggagcggugggcgcgcagccugaauaagcagaaagagaacuucaaaaauuccuuucaacccaucagcucucucagagacgacgaacggcgcgagagcgcuacggccgaugccggcuaugcuauucuggaaaagaagggggcccuugcggagagacagcauaccuccauggaccugccuaagcucgcuucugaugaccggcccagcccgccucgcggccugguggccgccuacuccggagagucugauagcgaagaggaacaggagagaggcgggcccgaacgggaggagaaacugacagacuggcagaagcuggcuugccuccuguguagacgccaauucccuuccaaagaagcccugauccggcaccagcagcucucuggacugcauaagcagaaccuugagauccacagacgcgcucaccugagcgaaaaugagcucgaagcccuggagaaaaacgauauggagcaaaugaaguaucgggacagagcggccgaacgccgggagaaguacggcauucccgaaccgccugagcccaaaagacgcaaguaugggggaaucuccaccgcuagcgucgauuuugaacagccuacacgggacggccugggcucugauaauauuggguccagaaugcuucaggccaugggauggaaagagggcagcgggcucggacggaagaaacaaggcaucgugacccccauugaggcucagacgcgcguuagagggucuggacugggcgcccggggcuccagcuacggggugaccuccacagaaucuuauaaggagacccugcauaaaacaauggucacccgcuucaacgaagcccaguga

SEQ ID NO: 74706 - RNA, 2799 nt, Artificial Sequence
  derived and/or modified sequence opt5 from RBM12__Homo_sapiens__NP_001185769
auggccguggucaucagacugcagggccuccccauuguugcugggaccauggacauccggcacuucuuuagcggacugacaauuccugauggcggggugcauaucgugggaggcgagcuuggggaagccuucauugucuuugcgacggacgaggaugcucgccugggaaugaugagaaccggcggcacaaucaagggguccaaagugacccuccugcuuucuagcaagacagaaaugcaaaacaugaucgagcugucccggcgcagauucgaaaccgccaaucucgacauuccgcccgccaacgcuucucggagcggaccucccccuuccucuggcaugagcucccgcguuaaucugcccacaaccgugagcaacuuuaauaacccuucuccguccgucgugacggccaccacaagcguucacgagucuaauaaaaacauccagaccuucuccacagcuagcguggggaccgcgcccccuaauaugggagccucuuuuggcucccccacguucagcuccacagucccuucuaccgccagccccaugaacacagugccgccucccccuauuccucccauccccgcuaugccgucccugcccccuaugcccagcauuccucccaucccggugccucccccuguccccacccucccucccguuccgccugugccucccauucccccggugcccucugucccucccaugaccccucugcccccuauguccgggaugcccccgcuuaauccucccccuguggcuccccugccggccggaaugaacggcagcggcgccccuaugaaucucaacaauaaccugaaccccauguuucuugggccucugaaucccguuaaccccauccagaugaacucucagagcuccgugaagccucucccgaucaaucccgaugaccuguacgucucugugcauggaaugccuuucagcgcgauggagaaugauguuagagacuuuuuccacggccugcggguggaugccguccaucuccugaaagaccacguggggcgcaacaauggaaacggccuugucaaguuucugagcccccaagauacauucgaagcucucaagagaaaucggaugcugaugauucagcgcuauguggagguuuccccugccacggaaagacaguggguggcugccgggggacacaucaccuucaaacagaacaugggccccucuggccaaacacauccuccgccccagacccuuccucgguccaagagccccucugggcagaaacgcuccagaagccgguccccucacgaggccggauuuugcgucuaccugaagggccuccccuucgaggcugaaaauaaacaugugauugacuuuuucaagaagcuggauaucguugaggacucuauuuauaucgcguacgggccgaacggaaaagccacaggcgaaggguuuguggaguucagaaaugaagcugacuauaaggccgcccugugucgccacaaacaguacaugggcaaccgguuuauccaaguccacccuauuaccaagaaaggaaugcucgagaagaucgauaugauuagaaaacgccugcagaauuucagcuaugaccagcgggagaugauccuuaaccccgaaggcgaugugaacuccgcuaaggugugcgcccauauuacgaauauccccuuuucuaucacaaagauggacguucugcaauuccucgaggggauuccugucgaugaaaacgcggugcacgugcuggucgacaauaacggacagggccuugggcaggcucuggugcaguuuaaaaaugaggaugacgccagaaagagcgaacgccuccaucggaaaaagcugaacggaagagaggccuucguucacguggucacccuggaggauaugcgcgaaaucgagaaaaaucccccugcucaaggcaagaaggggcucaaaaugccggugcccggcaacccugccguucccggaaugccuaaugcuggccugcccggggugggacuuccguccgccggccugccuggggcgggacuccccagcaccggccugccugggucugccauuacauccgcuggccugcccggagccggcaugccuagcgcugggauccccucugccggaggcgaggaacaugcguuucuuaccgucggguccaaggaagccaacaauggaccgccuuucaacuuccccggcaauuuugggggcagcaacgcuuucggacccccuauuccgcccccuggccucgggggaggcgccuuuggggacgcucggcccggaaugccuucugugggcaauagcggccugcccgggcugggacucgauguuccuggcuucgggggaggcccgaacaaccuguccgggcccagcggauuuggcggcgggccucagaauuucggaaacggccccgggucucuuggaggcccucccggguuuggauccggcccgccuggccuggggagcgcccccggacaccucggcgggcccccugccuucggacccggcccugggccgggacccggcccuggccccauccacauugggggaccucccggcuuugcuuccucuagcgggaaaccgggaccuacagugaucaagguccagaauaugcccuucacgguguccaucgacgagauucuggacuuuuucuacggcuaccaggugaucccugggucugucugucugaaauauaacgagaagggaaugcccaccggcgaagcgaugguugccuuugagagcagagaugaagcuacagccgccgugauugaccuuaaugaucgcccuaucggcucccggaaggugaaacucguccugggguga

SEQ ID NO: 74707 - RNA, 471 nt, Artificial Sequence
  derived and/or modified sequence opt5 from RBM14__Homo_sapiens__NP_001185765
augaagaucuucgugggcaacgucgacggggccgauaccacacccgaggaacuggcugcccucuuugcgccuuacggaacgguuaugagcugcgcugugaugaaacaguucgccuuugugcacaugagagagaaugccggcgcucugcgggccauugaagcccuucaugggcacgagcugcgcccgggcagagcucucgucguggaaaugucccggccccgcccucugaacaccuggaagaucuucguuggaaaugugucugcggccuguacaagccaagagcuuagaucccuguuugagcggcgcgggagagucauugaaugcgacgugguuaaagauuaugcuuucgugcauauggagaaggaagccgacgcuaaagccgcgaucgcccagcucaacggaaaggaggucaagggcaaacggauuaauguggagcugucuaccaagggcauggugcccacaggggucuga

SEQ ID NO: 74708 - RNA, 1020 nt, Artificial Sequence
  derived and/or modified sequence opt5 from RBM14-RBM4__Homo_sapiens__NP_001185774
augaagaucuucgugggcaacgucgacggggccgauaccacacccgaggaacuggcugcccucuuugcgccuuacggaacgguuaugagcugcgcugugaugaaacaguucgccuuugugcacaugagagagaaugccggcgcucugcgggccauugaagcccuucaugggcacgagcugcgcccgggcagagcucucgucguggaaaugucccggccccgcccucugaacaccuggaagaucuucguuggaaaugugucugcggccuguacaagccaagagcuuagaucccuguuugagcggcgcgggagagucauugaaugcgacgugguuaaaggaaagcggaugcaugugcagcucucuaccagccgccugagaacagcucccggcaugggcgaucaguccggguguuaucggugcggaaaagagggccacuggucuaaggaauguccuaucgaccgcagcgggagagucgccgaucugaccgagcaguacaacgagcaauauggagcugugcggacacccuacaccauguccuauggcgacagccucuacuauaauaacgccuacggggcgcuggaugccuacuauaagcgcugcagagcugcccggucuuacgaagcuguggccgccgcugcggccuccgucuauaauuacgcugagcagacgcuuagccagcugccucagguucaaaacaccgccauggccucucaucucacauccaccagccuggacccguaugauagacaccuucugcccacaucuggagcugccgcgaccgcugccgccgcugccgcugccgcggccgcugugacggccgcuuccacaagcuacuauggccgcgaccgguccccucucagacgcgccaccgcgcccgugccuacagucggcgaaggguacggauacggccacgagucugaacugagccaggccuccgcugccgcucggaauagccuguaugauauggccagauacgagcgcgagcaguaugccgaccgggcuagauacucugcguucuga

SEQ ID NO: 74709 - RNA, 2934 nt, Artificial Sequence
  derived and/or modified sequence opt5 from RBM15__Homo_sapiens__XP_011540270
augagaaccgccggccgggaccccgugccucgcagaagcccgcgguggcgcagagcugucccccugugcgagacauccgccgggcggcgcguuacgcagcucagaggagaugaccugcggcgcccugcgaccaugaagggcaaagaaagaucucccgugaaggcuaaacggagccgcgggggagaggauuccacaucuagaggcgaacggagcaagaaacuugggggauccggcggcucuaacgggagcuccagcggaaagaccgacucuggcgggggaucccgcagaagccugcaccucgauaagucuuccagccggggcgggucuagagaguacgacacaggaggcggcuccagcuccucucgccugcauagcuauuccagcccuucuaccaaaaauuccagcgggggaggcgaaucucggagcuccucuagagggggaggcggggagagccgcuccagcggagccgccucuuccgcucccggcggcggggauggagccgaguacaagacacuuaaaaucagcgaacugggcucucaacucuccgacgaggcuguggaagaugggcuguuccacgaguuuaagcgguucggagacgucagcgugaaaauuucccaucugucuggcagcggguccggcgaugagagaguugccuuugugaacuuccgccggccugaagacgcgagagccgcuaagcacgcccgcggacggcucguccuguaugauagaccgcuuaagaucgaggcuguguacguuucucgccggagaagccggagcccccuggacaaagacaccuauccucccuccgccucuguggucggcgcguccgucgggggacaucgccacccucccggcgggggaggcgggcagagaagccucucuccgggcggagccgcucugggcuaccgggauuauagacuucagcagcuggcccucgggcgccugccucccccucccccucccccgcugccccgggaccucgaaagagagcgcgauuacccuuuuuacgaaagagugcggcccgcuuauucccuggagccucgcgugggagccggcgccggggcugcgcccuucagagagguugacgaaauuagcccggaggaugaccaacgggccaaucgcacgcuuuuucugggaaaccucgauaucaccgugacagaaucugaccugagacgggcuuucgaucgcuuuggcgugauuaccgaggucgacaucaagagaccuagccgggggcagacauccaccuacggcuuccuuaaauuugaaaaucuggauaugagccaccgcgccaagcucgccaugucuggaaaaaucauuaucagaaaccccauuaagaucggcuaugggaaagcuacgccuacaacccggcugugggugggaggccuggggcccuggguuccucucgccgcgcuggcuagagaguucgaccgcuuuggaacaauucggaccaucgacuacagaaagggcgauuccugggccuauauucaguacgagagccuugacgccgcucaugccgcuuggacccacaugcgcggguucccccugggcggaccggaucggagacuccgcguggacuucgccgauacagaacaucgguaucagcaacaguaccugcagccucuuccccugacgcacuacgagcucgucaccgacgcguuuggccacagagcccccgauccucugcgcggggcucgggacagaacaccgccccugcucuaucgggaucgcgacagagaucuguacccugacuccgauugggugcccccucccccucccguucgggaacgcucuaccagaacagccgcuaccagcgugccggccuaugagccucuugacucccuggaccggagacgcgauggauggucucucgaccgggauagaggcgaccgcgaucugcccagcucccgggaccagccuagaaagcgccggcugcccgaagagucugggggaagacaucuugaucgcagcccggaguccgacagaccucggaaacgccacugugcgcccagcccugauagaucucccgaacucuccagcucucgggaccgcuacaauuccgauaacgacagaagcucucggcugcugcucgagagacccuccccuauccgcgaucggagaggcagccuggaaaagucccaaggcgacaaacgcgaccggaagaauagcgccucugcugagagagaucggaaacaucgcacgacagccccgaccgagggaaagagcccccuuaagaaagaagacagauccgaugggucugcuccuagcaccuccacagccucuagcaagcugaaaucccccucucagaagcaggacggcgggaccgccccugucgcuagcgcgucccccaaacucugccuggccuggcaaggaaugcugcuucucaagaacagcaauuucccuucuaacaugcaucugcugcagggcgaucuccagguggcuuccagccugcuugucgaggggucuacaggaggcaagguggcccagcugaaaaucacgcaacggcuccgccuggaccagccgaagcuggaugaaguuaccagacggauuaaaguggccggccccaauggguaugcuauccuucucgccgucccuggauccagcgacucccgcucuagcuccagcucugcggcuuccgauacagccaccagcacacagagaccccugcggaaccuggugucuuaccucaagcagaaacaagccgcuggcguuauuagccugccugucgggggaaauaaggacaaggagaacaccggcgugcuucacgccuuucccccgugugaguucucccagcaguuucuggauucuccugcgaaagcucucgccaagagcgaagaggacuaucuggugaugaucauugugcgcggguucggauuucagaucggcguuagauacgaaaacaaaaagcgggagaaucuggcccuuacgcuccuguga

SEQ ID NO: 74710 - RNA, 1206 nt, Artificial Sequence
  derived and/or modified sequence opt5 from RBM17__Homo_sapiens__NP_001139019
augagccuguacgacgaucucggcguggagaccuccgacucuaagacagaaggguggagcaaaaacuucaagcugcuucagucccaacugcaggucaaaaaggccgcucucacgcaggccaaaucucagagaaccaagcaaagcacaguucuggcgcccgugaucgaucuuaagcggggaggcuccucugacgaucgccagauuguggacaccccuccgcacgucgcugccgggcugaaagaucccgugccuagcggauuuuccgccggcgagguucucaucccccuggcugacgaauaugauccuauguuccccaaugacuacgagaagguggucaaaagacagcgggaagaacgccagagacaacgggagcuggaacgccagaaggagauugaagagagagagaaacggcgcaaggauagacaugaagccagcggguuugcucggcgcccugacccggauucugacgaggacgaagauuaugagagagaacggcgcaagagauccaugggaggcgccgcgaucgcucccccuacaagccucguggagaaagacaaggagcugccccgggauuucccuuacgaagaggacucuagaccccgcucccagagcucuaaagccgccauuccgccucccguuuaugaggagcaggaucggccuagaucccccaccggccccagcaacuccuuucuugcuaauaugggagggacaguggcccacaagaucaugcaaaaauacggcuuccgcgaagggcagggacugggcaagcaugagcaggggcucucuaccgcgcugagcgucgagaaaacguccaagcggggaggcaagaucauugugggcgacgccaccgaaaaagaugcuagcaagaaaucugacuccaacccucuuacagagauccugaagugcccgaccaaagugguccuccugagaaauaugguuggggccggagaaguggaugaggaccuggaaguggagacaaaggaggaaugugagaaguauggcaaagucgggaagugcgugauuuuugaaauccccggagcuccugaugacgaggccguucgcauuuuccucgaguuugaacggguggagagcgccaucaaagcugucguggaccugaacggcagauacuucgggggacgcguugugaaggcguguuuuuacaaucuugauaaauuccggguccuggaccucgccgaacaaguguga

SEQ ID NO: 74711 - RNA, 3684 nt, Artificial Sequence
  derived and/or modified sequence opt5 from RBM20__Homo_sapiens__NP_001127835
auggugcuggccgcugccaugagccaggacgcggaucccuccggcccugagcaaccggacagagucgcuugcucuguucccggggcccgggccagcccugcucccuccggaccucgcggcaugcagcagcccccuccgcccccucagcccccucccccgccucaagccgggcucccccagaucauucagaacgcugccaagcugcuugauaaaaauccuuucucugugagcaaccccaauccccugcucccuuccccggcgucucugcagcuugcccaacugcaggcucagcucacccugcacagacugaagcucgcccagacagcugugacgaacaauaccgccgcggccacaguccugaaccaagugcuuagcaaaguugcuaugucccagccccuguuuaaucagcuccggcauccuagcgugaucaccggaccccacggccaugccggggucccucaacacgcugccgccauucccucuacacgcuucccguccaacgcuaucgcguuuagcccucccucucagaccagaggaccuggccccuccaugaaucugccuaaccagcccccgagcgccauggugaugcauccuuucacaggcguuaugccccagacccccgggcaaccugcugugauucuuggaaucggcaagacggggccggcccccgccaccgcuggauuuuacgaauauggcaaagccucuuccgggcagacauacggaccugagaccgacggccagcccggcuuccugccuagcuccgcgucuacaagcggguccgucaccuaugaaggacacuacagccacacgggccaggaugggcaagcugccuuuucuaaggacuucuauggacccaauucccagggcagccauguggccucuggguuuccugcugagcaggccggaggccucaagagcgaagugggcccccugcugcaggggacaaacucccaaugggagucuccgcacggauucagcggccaguccaaaccugaucucaccgcugggcccauguggccucccccgcauaaucagccuuacgagcuguaugaccccgaagaaccuacaagcgaucggaccccucccucuuuuggaggccgccuuaacaauuccaagcagggguucaucggcgccggaagacgggcgaaagaagaccaagcccugcucagcguccgcccccugcaggcucacgagcuuaacgauuuucacggcguugccccgcugcaucucccccacauuuguucuaucugcgacaagaaaguguucgaucugaaggacugggagcugcaugugaaggggaaacuccacgcucagaagugucuggucuucuccgaaaacgccggaauuagaugcauccuuggcagcgcggaggggacccugugugccuccccuaauucuacagcuguguacaaccccgccggaaaugaagacuacgcuagcaaccucggcacguccuauguuccuauucccgcccggucuuuuacccaaagcuccccuacauucccgcuggccagcguggggaccacauuugcucagcgcaaaggcgcgggaagagucgugcauaucugcaaucuucccgagggcucuuguaccgaaaacgauguuauuaaucuggggcucccuuucggaaaggugacgaacuacauccugaugaaauccacaaaucaggccuuucuggagauggcuuauaccgaggccgcccaggcuaugguccaauacuaucaggaaaagagcgccgugaucaacggcgagaaacuccugauucggaugucuaagcgcuacaaggaacuucagcugaaaaagcccgggaaagcggucgcugccaucauucaggacauccacucccaaagagagcgggauauguucagagaagccgaccgcuauggaccugagcggcccagaagccgcucuccggugagccggucccucagcccuagaucucacacccccuccuuuacaagcugcuccucuagccauucucccccuggccccucccgcgcugauugggggaauggccgggacagcugggagcacuccccuuacgccagacgcgaagaggaacgggauccggcgcccuggagagacaacggagaugacaagcgcgaucggauggacccuugggcucaugacagaaaacaccacccccggcagcuggauaaggccgagcuggacgaacgcccugagggcgggagaccccaucgggagaaguacccgagaucuggaagcccuaaucuuccccacuccguuagcucuuauaaaucccgcgaagauggcuacuaucggaaggagccuaaagccaagagcgacaaauaccucaagcagcagcaagaugcucccgggagaucucgcagaaaggacgaagcccggcugcgcgaguccagacauccucaccccgaugacagcggaaaagaggauggccuggggccgaaggugacccgggcuccugaaggcgccaaagcgaagcagaacgagaaaaauaagacaaagcgcacggacagagaucaggaaggagccgacgaucggaaagagaacaccauggcugaaaacgaggccggcaaggaggaacaagaggggauggaagagucuccccaguccgucggacgccaggaaaaagaggcugaguucagcgaccccgaaaauacaagaaccaagaaagagcaggacugggaauccgagagcgaagccgagggcgagucuugguauccuacaaacauggaggagcucgugaccguugaugaagugggggaggaggaagacuuuauugucgagccggauauccccgaacuggaggaaaucgugccuauugaccaaaaggauaaaaucugucccgagacgugccuuugugugaccacaacccuggaccucgaucuggcccaggacuucccuaaggagggaguuaaggcugucggcaauggcgcggccgaaauuagccugaaaucuccccgggagcuuccuuccgcuagcacauccugcccgucugauauggacguggaaaugcccgggcucaaccuggaugccgagcgcaagccugccgaaagcgagaccggacugucccucgaggacucugauugcuacgaaaaagaggcuaagggcguggaaagcuccgacguccaucccgccccuacggugcagcagaugagcucucccaaaccggcggaggaaagagcucggcaaccuucccccuuuguugacgauuguaagacaagagggacccccgaggacggagccugcgagggcagcccucuggaagagaaggccucucccccuaucgaaacagaucuucagaaucaggcuugucaggaggugcugaccccggagaacucccgcuaugucgaaaugaaaagccucgaggugcggucccccgaauacaccgagguugaacugaagcaaccucugucucuucccagcugggagccugaggacguguucuccgaacucagcauuccccugggggucgaguuugugguuccgagaacaggauucuacugcaaacuguguggccucuucuauacgucugaagagaccgccaagaugucccacugccgcagcgcggugcacuaccggaaucugcagaaauaucuuucucagcuggcugaagagggccucaaggagacagaaggggccgauagcccuagacccgaggacuccggaaucgucccucgcuuugaacggaagaaacuguga

SEQ ID NO: 74712 - RNA, 2532 nt, Artificial Sequence
  derived and/or modified sequence opt5 from RBM25__Homo_sapiens__XP_011535346
augagcuuucccccucaccugaacagaccgcccaugggcaucccugcccugcccccugggauucccccuccgcaguuccccggauucccucccccugugcccccgggcaccccuaugauccccgucccuauguccauuauggcucccgcccccacaguucucgugccuacggugucuauggucgggaagcaucuuggagcgcggaaagaccacccgggccugaaggcuaaagagaaugaugaaaacugcgggcccaccacaaccguguuuguuggaaauaucagcgagaaggccuccgacaugcucauucgccaacugcuugccaaauguggccuggugcucucuuggaagagaguccagggcgcuagcgggaagcugcaggccuucggauuuugcgaauacaaagagccugaauccacacugcgggcucuccgccugcuucaugaucugcagaucggcgagaagaaacuccuggugaagguugacgccaaaaccaaggcgcaacuugaugaguggaaggccaaaaagaaagcuagcaacgggaaugccagacccgaaacagugaccaacgacgaugaggaagcucuggacgaggagacgaagcggcgcgaucagaugaucaaaggagccauugaaguccucaucagagaguauagcuccgaacugaaugcgccuagccaggagucugacucccacccccggaagaaaaagaaggaaaagaaggaggauauuuuccgcagauuuccgguggccccucugauccccuacccucucauuaccaaagaggacaucaacgcuauugaaauggaggaagauaagcgggaccugaucagccgcgagaucucuaaauucagagacacacauaagaaacuugaagaggagaaaggcaagaaagaaaaggagcggcaggaaauugagaaagaacgcagagagcgggagagagaacgcgagcgggaaagagagcgccgggagagagaacgcgagcgggaaagagagcgcgaacgggagaaggagaaggaaagagagcgcgaacgggagagagaucgggaccgcgauagaaccaaagaacgggacagagaucgcgaccgggagagagaucgcgacagagaucgggagcgcuccagcgacagaaauaaggaucggucucgcuccagagaaaaaucucgggaccgcgagagagaacgggagcgcgaaagagagcgggagagagaacgcgagcgggaaagagagcgcgagcgggaaagagagcgcgaacgggagagagaacgcgagcgggagaaggacaaaaagagagaucgggaagaggacgaagaggaugccuaugaacgcagaaagcuggagcggaaacuccgcgagaaggaagcugccuaccaagagagacugaaaaacugggaaauccgggagagaaagaaaacacgcgaauaugagaaggaggccgaacgggaggaagagagacgccgggagauggcuaaagaagcgaagagacuuaaggaguuucuggaagacuacgaugacgaucgcgacgaucccaaauauuaccggggguccgcccuccagaagagacugcgcgacagagagaaagaaauggaggcugaugagcgggaccgcaagagagaaaaagaggaacuggaggaaauucggcagcgccuccuggccgagggacacccugaucccgacgccgagcuucagagaauggaacaagaggcugaacggagacgccagccgcagaucaagcaagagccugaaucugaggaggaagaggaagagaagcaggagaaagaagagaagcgggaggaacccauggaagaggaggaggaacccgaacagaaaccuugucugaagccgacccucagacccauuagcuccgccccuagcgugucuuccgcgagcggcaaugcuacgcccaacacaccuggcgacgagucucccugcgggaucaucauuccucacgaaaauagccccgaucagcaacagccggaggagcaucgcccuaaaaucggacugucccuuaagcugggcgccucuaacagccccgggcagccuaauuccgucaagcggaaaaagcuccccguugacagcguguucaacaaauuugaagaugaggacucugaugacgugccgagaaagcggaaacuggucccucuggauuacggagaagacgauaagaacgccaccaagggcacagugaauaccgaggaaaaacgcaagcacauuaaaucccucaucgagaagauucccaccgcuaaaccugagcuguucgccuauccccuugacuggagcaucguugauucuauccugauggaaagacggauucgccccuggaucaacaagaaaauuaucgaguacauuggggaagaggaggcuacacucguggacuuugucuguuccaaggugauggcccauagcuccccucagucuauccuggaugacguugcgauggugcuggacgaagaggccgaagucuucauugugaagauguggagacuucucaucuaugagacggaagcuaaaaagaucggacuggucaaauga

SEQ ID NO: 74713 - RNA, 2952 nt, Artificial Sequence
  derived and/or modified sequence opt5 from RBM26__Homo_sapiens__NP_001273561
auggugagcaagaugaucauugagaacuucgaagcccugaaauccuggcucucuaagacccuggagcccaucugcgacgcugauccuagcgcccuugcgaaauacguccuggcucucguuaagaaagacaaguccgaaaaggagcugaaagcccuuuguauugaucagcuggacguguuucuccaaaaggaaacacagaucuucguggagaaacuguuugaugccgucaauacgaagucuuaucugccgcccccugagcagcccagcuccggcucucucaaaguggaguucuuuccucaccaggaaaaggacauuaagaaagaagagaucaccaaggaggaagagagagaaaagaaguucagccggcgccugaaccauagcccuccccaauccucuuccagauaccgggagaaucgcagcagagaugaacggaaaaaggacgaucgcucuagaaaacgggacuaugaucgcaacccgcccagacgggacuccuaccgcgauagauauaaucggcgcagagggcggagcagaucuuacucccgcagccgguccagaucuuggagcaaggagcgccuucgggagagagaccgcgaccgguccagaacacgcagccggucuagaacccgcucccgggaaagagaucugguuaagccuaaauaugaccucgaucggacagacccccuggagaacaauuacaccccugugagcucuguccccagcaucuccucuggacacuacccggugccuacacuuagcuccaccauuacgguuaucgcucccacccaucacggcaacaauacaaccgaaagcuggucugaguuucaugaagaucagguggaccacaacuccuauguccgcccucccaugcccaagaaaagaugccgggauuacgacgagaagggguucuguaugagaggagauaugugcccuuuugaccacggcagcgauccggugguggucgaggacguuaaucugcccgggaugcucccuuuccccgcccagccucccgugguggaaggaccgccucccccuggccugcccccucccccgccuauucugacacccccucccgucaaccuccgcccgcccgugccucccccuggcccccugccucccucucuuccgccuguuaccgggcccccucccccgcugccuccccuccagccuuccggaauggacgcuccucccaauagcgccacguccucugugcccacagucgugaccacaggcauccaucaccaaccgcccccugcgcccccuagccuguuuaccgccgauaccuaugacacagauggguacaaccccgaggcuccuuccauuacgaauaccucucggccgauguauagacaucgcguucacgcccagagacccaaccuuaucggacugacaagcggcgacauggaucucccuccccgggaaaaaccucccaacaaguccagcaugcgcauuguggucgacucugaguccagaaagcggaccaucgggagcggagaaccgggcgugccuacgaaaaagaccugguucgauaaacccaauuuuaaccgcacaaauucucccggcuuccagaagaaaguccaguucgggaacgagaauacaaagcuggagcugagaaaggugccucccgaacucaacaauaucuccaaacugaacgagcacuuuagccgguucggaacccuuguuaaucugcaaguggcuuacaacggcgacccugaaggggcccucauucaguuugcgaccuaugaggaggccaagaaagcuaucucuagcacagaagccguccugaauaaccgcuucauuaagguguacuggcauagagagggauccacccagcaacuucagacaacgagcccgaaaguuaugcagccccuggugcagcaaccuauccuccccgucgugaagcagucugugaaggaacggcugggcccuguucccuccagcaccauugagccggcugaagcccaguccgccucuagcgaucugccucagguccucuccacaucuaccgggcugacaaaaaccguguacaaucccgcugcgcuuaaggccgcucagaaaacgcugcucgugagcaccuccgccgucgacaacaaugaggcccaaaagaaaaagcaggaggcucugaaacugcagcaagaugugcgcaagagaaagcaggaaauccuugagaaacacaucgaaacacagaagaugcucauuucuaaacuggagaagaacaaaaccaugaaaagcgaagacaaggccgagaucaugaaaacacuggagguucucaccaagaacauuacgaaacugaaggaugaagugaaagcggcuuccccuggacggugucuucccaagagcaucaagacaaaaacccagaugcaaaaggagcugcucgacacagaacuggaccuguauaaaaagaugcaggccggcgaggaagucaccgagcuuagacgcaaauacaccgagcuccagcuggaagccgcuaagcggggcauucugucuuccgggagaggacgcggcauccauagccgggggagaggagccgugcacggccgcgggcggggcagaggacgcggcagagggguuccuggacaugcuguggucgaucaccggccccgggcccucgagaucucugcguuuacagaauccgaccgcgaggaucugcuuccgcacuucgcccaauauggcgagauugaagacugccagaucgaugacagcucucugcaugcugugauuacguuuaagaccagagccgaggcugaagccgcggccguucacggggcucgguucaaaggacaggaucucaagcuggccuggaauaaaccugugacaaacaucuccgcugucgagaccgaagagguggagcccgacgaagaggaauuucaggaggaaagccugguggaugacucccuucuccaagaugacgaugaggaggaagaggacaaugaaagccgcucuuggagacgguga

SEQ ID NO: 74714 - RNA, 3183 nt, Artificial Sequence
  derived and/or modified sequence opt5 from RBM27__Homo_sapiens__NP_061862
augcugaucgaggacguggaugcccucaagagcuggcuggcuaaacuucuggaacccauuugcgacgccgauccuuccgcgcucgcuaacuacgucguugcccuggugaagaaagacaagccggagaaagaacuuaaggccuucugugcugaucagcuggacguguuucuccaaaaggagaccucuggcuucgucgauaaacuguuugaaagccuguauacaaagaauuaccucccccugcuugagccugugaaacccgagccuaagccccugguucaggaaaaagaggaaaucaaggaggagguguuccaggaaccugccgaggaagagagagacgggcggaagaaaaaguauccgagcccccagaaaacgcgcucugaaagcuccgagagacggacccgcgagaagaaaagagaagauggaaaguggcgggacuacgaucgcuauuacgagagaaacgaacucuaucgggagaaauacgacuggcgcagaggccggucuaagagccgcuccaagagcagagggcugucucggucccgcagcagaucucggggaagauccaaagaucgcgacccuaaucggaacgucgaacacagagagcgcagcaaguuuaaaucugagcggaaugaccuugaauccagcuacgugcccguuuccgcuccucccccgaacucuagcgagcaauauuccagcggcgcccagucuauuccuuccacagugaccgucaucgcgcccgcccaucacagcgaaaauacaaccgagucuuggagcaacuacuauaauaaccauuccucuagcaauuccuucgggagaaaccugccucccaagcgccggugcagagauuacgacgaacgcggauuuugugugcucggcgaucugugccaguucgaccacggcaaugauccccugguggucgacgagguugcucucccuagcaugauuccguuucccccucccccucccgggcugccgccucccccucccccuggaaugcuuaugcccccgaugccuggccccgggcccggaccuggcccggggcccggaccuggccccggcccugggcccggaccuggccauucuaugcggcugcccgugccgcaggggcacggacaaccucccccuuccgugguccuccccaucccgagaccucccaucacacagagcucucugauuaacucccgcgaucagccuggcaccagcgccgugcccaaucuugcuuccguugggacgcggcugcccccuccgcucccccagaaccugcuguauaccgugucugagagacaaccuauguacagccgggaacacggagccgcggccuccgagcgccuccagcugggcacacccccuccccuucuggcugccagacucgucccuccgcggaaccugaugggcucuagcaucggguaucauaccuccgugagcucucccacaccucuuguucccgacaccuacgaaccugauggauacaaucccgaggcuccguccauuacgagcucuggcagaucccaguaucgccaauucuuuagccggacacagacccagagaccuaaccugaucgggcucacaucuggagacauggaugugaauccccgcgccgccaacauugucauccagaccgagcccccugugcccgucagcauuaauuccaacaucaccagagugguucuggaaccugacagccggaaacgcgcuaugucuggccuggaggggccgcucacaaagaagcccuggcugggcaaacaaggaaauaacaaucagaacaagccuggcuuccuuagaaagaaucaguacacgaacaccaagcuggaagugaaaaagaucccccaggagcucaauaacauuacaaagcugaaugaacacuuuuccaaauucgggaccaucgucaacauucaaguggcguucaagggagacccugaggccgcucugauccaguaucuuacaaacgaggaagcccggaaagccauuagcuccaccgaggcuguucucaauaaccgcuuuaucagagugcuguggcaucgggaaaauaacgagcagcccacgcugcagucuagcgcccaacuccugcuucagcagcagcaaacacugucccaccucucucagcagcaccaucaccuuccgcaacaucugcaccagcagcagguccugguggcgcaaagcgcuccuuccaccgugcauggcgggauccagaagaugaugucuaaaccccagaccagcggagccuacguucucaauaaggucccugugaagcaccgccugggccacgccgggggcaaccaguccgaugcuagccaucugcucaaucaaucuggaggcgccggggaagacugucagauuuucuccacacccggacacccuaaaaugaucuauuccucuuccaaccugaagacccccagcaaacuuugcucuggcuccaagagccaugaugugcaggagguccugaaaaagaaacaggaggcuaugaagcuccaacaggacaugagaaagaaacggcaggaagugcuggagaagcaaauugaaugucagaaaaugcugaucuccaaacuugagaaaaauaagaacaugaagccggaagaacgcgccaauauuaugaaaacacucaaggagcugggggagaaaaucagccagcugaaggaugagcucaaaacgucuagcgcgguuuccaccccuucuaaggugaagacaaaaaccgaagcccagaaggagcugcuugacacagagcuggaucuccacaaaagacugagcuccggagaagacaccacggagcugcggaagaaacuuucucaacuccaggucgaagcugccagacugggcauccugcccguggggcgcggcaagaccaugagcucccagggacggggcagagggcgcggacggggcgggagaggacgcggcucucucaaccacaugguuguggaucaucggcccaaggcucugacagucgggggcuuuauugaggaagagaaagaggaccuucugcagcacuucagcaccgccaaucaaggaccuaaguuuaaagauagacgccuccagaucuccuggcauaagccgaaagugcccagcauuucuacagaaaccgaggaagaggaaguuaaggaggaggaaacggagacauccgaccuguuccugccugaugacgacgaugaagacgaggaugaauacgagagccggucuuggagacgguga

SEQ ID NO: 74715 - RNA, 1857 nt, Artificial Sequence
  derived and/or modified sequence opt5 from RBM28__Homo_sapiens__NP_001159607
auggccggccugacccucuucguggggagacugcccccuagcgcucgguccgagcagcuugaagaacuguuuucucaagucggaccgguuaagcagugcuucguggugacagaaaaaggccgcacggucgccguggacugggcgguugcuaaggauaaauacaaggacacccagagcguguccgccaucggggaggaaaaaucucacgagagcaagcaucaggaguccgucaagaaaaagggaagagaagaggaagauauggaggaggaagagaacgacgaugacgaugacgaugacgaugaagaggacggcguguuugaugacgaagacgaggaggaagagaauauugaaucuaaaguuacaaagcccgugcaaauccagaaacgggccgucaagcgcccugcucccgccaagagcuccgaucacagcgaggaagacucugaucucgaggaguccgacagcauugaugacggggaagaacuggcucagucugauaccuccacagaggagcaggaagacaaagccgugcaagugagcaacaagaaaaagagaaaacuuccuucugaugucaaugagggaaagaccguuuucauccggaaccuguccuuugacagcgaggaagaggaacucggcgagcugcugcagcaguucggcgagcucaaauaugugcgcauugugcugcaucccgauacagaacacuccaaggggugugcguuugcccaguucaugacccaagaggcugcccagaagugccuucuggcugccucuccugaaaaugaggcgggaggccucaaacuggacgggagacagcuuaaggucgaccuggccgugacgcgggaugaagcugccaaacuccaaaccacaaagguuaaaaagccgaccggaacacgcaaccuguaccuggcuagagagggccucauccgggccgggaccaaggccgcugagggagugagcgcggccgacauggcuaaacgcgaaagauuugagcugcuuaagcaucagaaacugaaggaucagaauaucuucgucucccggacgcgccucugucugcacaaccuucccaaagccguggacgauaagcagcugagaaagcuccugcugagcgccacaucuggcgaaaaaggcguucggauuaaggagugcagagugaugcgcgaccucaaagggguccacggaaauaugaagggccaaucccugggguaugcuuuugccgaguuccaggagcaugagcacgcgcuuaaagcucugcggcucaucaacaauaacccugaaauuuuuggaccccugaagagaccuaucguggaguucagccuugaagaucgccggaagcugaaaaugaaggagcuccgcauucagagaucucugcagaaaaugcggagcaagcccgccaccggcgaaccgcaaaaagggcagccugagcccgccaaggaccagcagcaaaaagcugcccagcaucacacagaggaacaguccaaggucccucccgagcagaagagaaaagcuggaucuaccagcuggaccggcuuccaaacaaaggccgaaguggagcagguugagcugcccgauggcaaaaagcgccggaaagugcucgcgcugccuucccacagagggccgaagauccgccuucgggacaagggaaaagucaagcccgugcauccuaaaaagcccaaaccucagauuaaucaauggaagcaggaaaagcagcagcugagcucugagcaaguuucccggaaaaaggccaaaggcaacaagacggaaaccagauuuaaucagcucguggagcaguacaaacagaagcugcuggggcccagcaagggagcuccgcuugccaaacgcucuaagugguucgauuccuga

SEQ ID NO: 74716 - RNA, 816 nt, Artificial Sequence
  derived and/or modified sequence opt5 from RBM38__Homo_sapiens__NP_001278709
augcugcuccagcccgccccuugcgccccgagcgccggcuuccccagaccucuggcggcucccggggccaugcacggaucccaaaaggacaccacauuuacgaaaaucuucgugggcgggcuuccuuaccauaccacagaugccucucugcggaaguauuuugagggauucggcgacauugaagaggcugucguuaucaccgaucgccagacagggaaaagcagaggauacggcuuuggcauuaucuucgugcucgaagggcacauuucccaggcccugaacuuugacggacggucuuggaaucccggcgggaucuucgugggagagccucaggucaccauggcugaucgcgccgcggccgaaagagcuuguaaggacccgaaccccaucauugauggccggaaagccaaugugaaccuugcuuaucugggggccaagccucgcagccuccaaacaggauuugcgaucggcguucagcagcugcaucccacccugauucagagaacguacggccucaccccucacuauaucuacccuccggccauugugcaaccuuccgucgugauccccgcugccccuguucccucucugagcucccccuauauugaguacacacccgcuagcccggccuacgcccaguaucccccugcuaccuacgaccaguaucccuacgcggccucuccugcuacagccgccuccuucgugggguauagcuaccccgcugccgucccgcaggcgcuuucugcugccgccccugcuggaaccacguuugugcaauaucaggcuccccagcugcaaccugaucggaugcaguga

SEQ ID NO: 74717 - RNA, 1527 nt, Artificial Sequence
  derived and/or modified sequence opt5 from RBM39__Homo_sapiens__NP_001229528
auggccgacgauaucgacauugaggcuaugcuggaagcccccuacaagaaagaugagaacaagcucagcuccgcgaauggccacgaagagagaucuaaaaagcggaaaaagagcaagucccgcucuagaagccaugaacggaaacgcuccaagucuaaagagagaaagcggagccgcgacagagagcggaaaaaguccaagagccgcgaaagaaaacggucucgcuccaaggagagacggcgcagcagaucucgguccagagaucgccgguucagagggcgcuaucggagcccuuacagacgccggucuagauccaaaagcccguuucgcaaggacaaaucccccgugcgggaaccuaucgauaaccugacccccgaggagagagacgcucgcacagucuucugcaugcagcuugccgcccggauuagaccucgggaucuggaagaguuuuucucuacgguuggaaaggugcgcgacgugagaaugaucagcgauagaaauucccggcgcagcaaaggcauugcuuaugucgaauuuguggacguuucuuccgugccccucgccaucgggcugaccggacaacggguccuuggcgugccuaucauuguucaggcuagccaggccgagaagaacagagcggccgcuauggccaauaaccugcagaaggggucugcuggaccgaugcgccucuacgugggcagccugcacuucaauaucacagaagauaugcugagaggcauuuuugagcccuucgggcggaucgaguccauucaacucaugauggacucugaaaccggacgcagcaaaggcuauggguuuaucacauucuccgacagcgagugugccaagaaagcgcuggaacagcuuaacggauuugagcuggccggcagaccuaugaaggucgggcaugugaccgaacggacagaugcuucuuccgccagcucuuuccucgacuccgaugagcuggagcgcaccggaauugaccuuggcacgaccggcagacugcagcucauggcucggcuggccgaagggacaggacugcagauucccccugccgcucaacaggcgcuccagaugagcggcucccuggccuuuggggcuguggccgaguucucuuucgucaucgaucuucagacccgccugagccaacagacagaagccuccgcucucgccgcggcugccucuguucagccccuggccacccaaugcuuucagcuuagcaauauguucaacccgcagacggaggaagaggugggaugggacacagagaucaaagaugacgugaucgaagaguguaauaagcacggcggggucauucauaucuacguggauaagaacuccgcucagggaaauguuuaugugaaaugcccuagcauugccgcugccaucgcggccgucaacgcucugcacggcagaugguuugccggcaagaugaucaccgcugccuacgugccccucccuacauaccacaaucuguuccccgacucuaugaccgcgacccaacugcucguucccucccggcgcuga

SEQ ID NO: 74718 - RNA, 474 nt, Artificial Sequence
  derived and/or modified sequence opt5 from RBM3__Homo_sapiens__NP_006734
augagcuccgaggaaggcaagcuguucgucgggggacucaacuuuaauaccgacgagcaggcccuggaagaucacuucucuagcuuuggccccaucuccgaggugguuguggugaaagacagagaaacacaacggucucgcggguucggauuuauuacguucaccaacccugagcaugcuagcgucgccaugagagcgaugaauggcgagucccuugaugggcggcagauccgcguggaccacgcuggaaagucugccagaggcacacggggcgggggauuuggcgcccaugggcgcggaagaagcuacucccggggcgggggagaucagggcuauggcagcgggcgcuacuaugacucuagaccgggaggcuacggguauggauacggccggucccgcgauuauaacgggagaaaucagggaggcuacgaccgguacagcggcgggaacuaucgcgauaauuacgacaacuga

SEQ ID NO: 74719 - RNA, 1425 nt, Artificial Sequence
  derived and/or modified sequence opt5 from RBM45__Homo_sapiens__NP_694453
auggacgaggccggcagcuccgcuucugggggaggcuucagacccgggguggauagccuggacgaaccuccgaacucccggaucuuucucgucauuucuaaguacacccccgagagcguucugcgcgaaagauucuccccuuuuggagauauccaggacauuuggguggugcgggauaaacacacaaaggagucuaaaggcaucgccuucgucaaguuugcgcgcagcucccaggcuugcagagccauggaagagaugcaugggcaaugucuuggacccaaugacacgaaaccuauuaagguguucaucgcccagagccggucuuccggcagccaccgcgauguugaggacgaagaacugaccagaaucuuugugaugauucccaagucuuauacagaagaggaucuccgggagaaauucaaggucuacggcgacaucgaauauugcuccauuaucaaaaacaaggugaccggggagagcaaaggacugggcuacguucgcuaucuuaagccuucucaggcugcccaagcuauugaaaauugugauagauccuuucgggccauccuggcggagccgaagaacaaagccagcgaauccucugagcaggacuacuauagcaauaugcgccaggaggcucucgggcaugaacccagagugaacauguucccuuuugagcagcaauccgaguucagcucuuuugauaagaaugacucccggggacaggaggccauuagcaaacgccugucugucgugagcagagugcccuucacagaggaacagcuguucuccaucuuugacaucgucccuggccucgaguacugcgaaguucagcgggaucccuacucuaacuaugggcacggaguggugcaauacuucaaugucgcuagcgccauuuaugcgaaguacaaacugcauggcuuucaguauccgccuggcaacagaaucgggguguccuucauugacgauggaagcaaugccaccgaccuucugcgcaagauggcuacacagaugguugccgcucaacucgccucuaugguguggaacaaucccucccagcagcaguuuaugcaauucggcgggagcucuggaucccagcugccucagauccagaccgaugucgugcuucccagcuguaaaaagaaggcccccgcugagacgccuguuaaagaacggcuguuuauuguguucaacccgcacccccucccucuggacguccuggaggauaucuuuugcagauucggcaaucucaucgaaguguaccuggucuccgggaagaacgugggauaugcgaaauacgccgaccgcauuucugcuaacgaugccaucgccacccuucacggcaagauucugaauggcguucggcucaaagugaugcuggcugacagccccagagaggaguccaacaagcgccaacggacauacuga

SEQ ID NO: 74720 - RNA, 1602 nt, Artificial Sequence
  derived and/or modified sequence opt5 from RBM46__Homo_sapiens__NP_659416
augaacgaggaaaauaucgacggcaccaacgggugcagcaaggugagaacaggcauucagaaugaggccgcucugcucgcccugauggagaaaacgggcuacaacaugguccaagaaaaugggcagcggaaguucggaggacccccuccggggugggaaggacccccucccccucgcggcugugagguuuuugugggcaaaauccccagagauauguaugaggacgaacuugugccugucuucgagcgggcggggaagauuuacgaauuucgccugaugauggaguucuccggagagaacagaggcuaugcuuuugugauguacaccacaaaagaagaggcccagcucgccauccggauucugaauaacuaugaaauccgcccggggaaguucaucggaguuugcgugucucuugauaauuguagacuguuuauuggcgcuauccccaaggagaaaaagaaagaagagauucucgacgagaugaagaaagucaccgaaggggugguugaugugaucgucuacccuagcgccacagacaagaccaagaaccggggauucgcuuuuguggaguaugaaucccaccgcgccgcggccauggcuagacggaaacugauucccggcacauuccagcuguggggccauaccauccaaguggauugggccgacccugagaaggaagucgaugaggagacgaugcagcgcguuaaagugcucuacgugagaaaucugaugauuucuaccacagaagagaccaucaaggcugaauuuaacaaauucaagcccggggccgucgagcgggugaaaaagcugcgcgacuacgcguuuguucacuucuucaauagagaagaugccguggcugccaugagcgucaugaacggaaagugcaucgacggcgcuuccauugaggugacacuugccaaaccgguuaauaaggagaacaccuggcggcagcaucucaacgggcagaucucuccuaauagcgaaaaccugauuguguuugccaauaaagaggaaucccaccccaagacgcuuggaaaacugccuacacuccccgcuagacugaacggccaacauagccccucuccuccggaggucgagcgcuguaccuaucccuucuacccugggacaaagcugacccccaucuccauguauagccucaagucuaaucacuuuaacuccgcggugaugcaccuggauuacuauugcaauaaaaacaauugggccccucccgaauacuaucuuuacagcaccacaucucaggacggaaagguccugcucguguacaaaauuguuaucccggcuaucgccaacggcucccagagcuauuucaugccugacaagcuguguacgacccuugaggaugccaaagaacuggcugcccaguuuacacuccugcaucuggacuacaauuuccaccgguccucuauuaacagccucucccccgugagcgcgacccugucuuccggcacaccuagcguccuucccuauaccucuagaccuuacagcuaucccggguacccgcuguccccuacgaucucucucgcuaauggaagccaugugggccaacgccugugcauuuccaaccaggccagcuuuuucuga

SEQ ID NO: 74721 - RNA, 1782 nt, Artificial Sequence
  derived and/or modified sequence opt5 from RBM47__Homo_sapiens__NP_001092104
augaccgccgaggacagcacagcugccauguccucugauagcgcggcuggcuccucugccaaggugcccgaaggggucgccggagcuccuaacgaggccgcucugcucgcccugauggaaagaacgggcuacagcaugguucaggagaaugggcaacggaaauauggaggcccgcccccugggugggaaggaccccacccucagcgcggcugcgagguguucgugggcaagauccccagagacgucuacgaggaugaacuugugccuguuuuugaggcgguggggcggauuuaugaacugcgccucaugauggacuucgauggcaaaaacagaggauacgccuuugucauguauugucauaagcacgaggcuaaacgggccgugcgcgagcugaauaacuacgaaaucagaccggggcggcuucugggaguuugcuguuccguggacaauugccgccucuucauuggcgggauccccaagaugaagaaaagagaggaaauucuggaggaaaucgcuaaggucaccgagggagugcuggaugugaucgucuaugccucugcggccgacaaaaugaagaaccggggcuuugcuuucguugaguacgaaagccaucgcgccgcugccauggccagacggaaacucaugccuggccgcauucagcugugggggcaccagaucgcuguggauugggcggagcccgaaauugacguggaugaggacgucauggaaacagugaagauccuuuacguuagaaaucugaugauugagaccacagaggauaccaucaagaaauccuuuggacaauucaacccuggcuguguggaacgggucaagaaaauuagagacuaugccuuugugcauuucacaagccgcgaggacgcuguucacgccaugaauaaccucaaugggaccgaacuggagggaucuugccuugaagugacgcuggccaagcccgucgauaaagagcaguacucccgguaucagaaggcugccagaggcgggggagcggcugaggccgcccagcaaccgagcuacguguauucuugugacccuuacacccucgcuuauuacggcuaccccuauaacgcccugaucggcccuaaucgcgauuacuuugucaaagcuggguccauccggggaagaggccgcggggccgcgggaaaccgggcccccggccccagagggagcuaucugggcggauacucugcuggccgcgggauuuauucccgguaccacgaaggaaagggcaagcagcaggagaaaggguaugaacucgugccuaaucuggagaucccgacaguuaaccccguggccauuaagccuggaaccgucgcuauccccgccauuggcgcgcaguacagcauguucccugccgcucccgccccgaaaaugaucgaggacgggaagauccauacaguggaacacaugauuuccccuaucgcuguucaacccgauccugccucugccgcugcggccgcugccgccgcugccgcggcugccgccgcugugauucccaccgucagcacgccucccccguuucagggcagaccuaucacacccguguacaccguggcccccaacguucagcgcauuccuacagcgggaaucuauggcgcuuccuacgucccguucgccgcccccgcuaccgccaccaucgcuacacuucagaaaaaugccgcggccgcugccgcuauguaugggggauacgccggcuauauuccucaagccuuccccgcugcggccauccaggugccuauucccgacguguaccagacguauuga

SEQ ID NO: 74722 - RNA, 432 nt, Artificial Sequence
  derived and/or modified sequence opt5 from RBM4__Homo_sapiens__NP_001185772
auggugaagcuguucaucggcaaccuccccagagaggccaccgaacaggagauucggagccuguuugaacaguacgggaaaguccuugagugcgacaucauuaagaauuauggauucguucacaucgaagauaaaacagcugccgaggacgcgauucgcaaccugcaucacuacaagcuccauggcgugaauaucaacguggaggcuuccaaaaauaagucuaagacgagcaccaaacugcacgucgggaacaucuccccuacauguaccaauaaggaacuuagagccaaauuugaggaauauggaccggugauugagugcgauaucguuaaggacuacgccuucgugcauauggagcgggcugaagaugccgucgaggcuauucgcggccuggacaacacagaauuucaagggggaaugugugugggcuga

SEQ ID NO: 74723 - RNA, 2448 nt, Artificial Sequence
  derived and/or modified sequence opt5 from RBM5__Homo_sapiens__NP_005769
augggcagcgacaagagagugucccggaccgagcgcucugggagauacggaagcaucauugaucgggacgaucgcgacgaaagagagucccggucucgcagacgggauagcgacuauaaacgcuccucugaugacagacggggcgaucgcuacgacgauuauagagacuacgauagccccgaacgggagcgcgaaagacggaacuccgacagaagcgaggacggguaucacucugauggagacuacggcgagcaugauuaucgccacgacaucuccgaugaacgggagagcaagacaauuaugcugagagggcucccuaucacgauuaccgaaucugacauccgcgagaugauggaguccuucgaaggaccgcagcccgccgauguccggcugaugaaaagaaagacaggcguuagccgcggcuuugcuuucguggaguuuuaccaucuucaagacgccaccucuuggauggaagcgaaucagaaaaagcuggugauccaggggaagcacauugcuaugcauuacuccaacccucggcccaaauucgaggauuggcucugcaauaaguguugccugaacaauuuuagaaaacgccuuaaguguuuccggugcggagccgacaaauuugauagcgaacaggaggucccucccggcacaaccgaguccgugcaaucuguugacuauuacugugacacaaucauucugagaaacaucgccccucacaccguggucgauagcauuaugacggcucucuccccguaugccagccuggcugugaauaacauccgccugauuaaggacaagcagacccagcagaaucggggguucgccuuuguucaacucucuuccgcgauggaugccagccagcugcuucagauccugcagucucuccaucccccucugaaaaucgacggaaagacaauuggcguggauuucgcuaaaagcgccagaaaggaccuuguccuguccgaugggaaccgggugucugcuuuuagcguggccuccaccgcgaucgccgcugcccaauggagcucuacacagucccagagcggagaaggcggcucugucgacuacuccuaucuccaacccgggcaggauggauacgcucaguaugcccaguacagccaagacuaccagcaguucuaucagcaacaggccggcgggcuggaguccgaugcuucuagcgcguccggaaccgccguuacgacaaccucugcugccguggugagccaguccccucagcuguacaaucaaacaagcaaucccccgggcucuccuaccgaagaggcccagcccuccaccagcacaucuacgcaggcuccugccgcgucccccaccggggucgugcccggaacaaaauaugcuguuccugacaccagcacauaccaguaugaugaaucuagcggcuacuauuacgacccgaccacgggccucuacuaugaccccaacucccaauacuauuacaacagccugacacagcaguaucuuuacugggauggggagaaggagaccuaugugccugccgccgaaucuuccagccaccaacaguccggacugcccccugcuaaagagggcaaggaaaagaaagagaagcccaaaucuaagaccgcccagcagauugcuaaagacauggaacgcugggccaagagccucaauaagcaaaaagagaacuuuaagaacuccuuccagccggucaauucucugagagaggaagaacggagagaaagcgcggccgcugaugccggguucgcucuuuuugagaaaaagggagcccuggcggagcgccagcagcucaucccugaacuggugcggaacggcgacgaggaaaauccccugaaaagagggcucguugccgcuuacuccggcgauucugacaacgaggaggagcugguggagcgccuugaaagcgaggaagagaagcuggccgauuggaagaaaauggcuugccuccuguguagacggcaauucccuaauaaggacgcccuuguccgccaccagcagcuguccgaucuccauaaacagaacauggacauuuacagacggagccgccugucugaacaagagcuggaggcccucgaacugagagagcgggaaaugaaguaucgcgauagagcugcggagcggcgcgaaaaauacggaauccccgagccucccgagccgaagagaaagaaacaguuugacgccggcacagugaauuaugaacagccuaccaaggaugggaucgaccacuccaacauuggaaauaaaaugcuucaagcuaugggcuggcgggaggggagcggacugggcagaaagugccaggggaucacagcccccauugaagcccagguccgccucaaaggcgcuggacugggcgccaaggggucugcguacggacuguccggcgcugacagcuauaaagaugccgugcggaaggccauguucgcuagauuuacggagauggaguga

SEQ ID NO: 74724 - RNA, 3372 nt, Artificial Sequence
  derived and/or modified sequence opt5 from RBM6__Homo_sapiens__NP_005768
auguggggcgacagcagacccgccaaccggaccgggccuuuccgcggaucccaggaggaaagauuugcuccgggcuggaaucgggauuaucccccucccccucugaagucucacgcccaagagcgccauagcgggaacuuccccggaagagacucccucccuuuugauuuccagggccacucugggccgcccuuugcgaauguggaggagcauagcuucuccuacggagcucgggacggcccucacggcgauuaccgcgggggagaaggccccgggcaugacuuuagaggaggcgauuucucuagcuccgacuuucagagccgggauucuucccagcuggacuuccgcgggagagauauccacagcggagacuuucgggaucgcgagggcccucccauggacuauagaggcggggacggaacaucuauggauuaccggggccgcgaggccccgcacaugaacuauagagaccgggaugcccaugcugucgacuucagagggcgcgaugccccucccuccgacuuucggggaagaggcacguacgaucuugacuuccgcgggcgggauggaagccacgcugacuucagaggccgcgaucugucugaccucgacuuucgggccagagaacaaucccgcagcgauuuccggaauagagacguuuccgaucuggacuuucgcgauaaagacggcacccagguggauuuccgggggagaggaucuggcacaaccgaccuugauuuucgggaccgcgauacaccucauagcgacuucagagggcggcacagaucccgcaccgaucaggacuuucggggaagagagaugggcagcugcauggaguucaaggaccgcgaaaugccucccguggaucccaacauucuggacuauauccagccgucuacacaagauagagagcacuccgggaugaaugucaaccggcgcgaagagagcacccaugaccacacgauugaaagacccgcguuuggcauccagaaaggagaguucgaacauucugagacccgggagggcgaaacacaggggguggccuuugagcacgaaagcccugcugauuuccaaaauucccagucucccguucaggaccaggauaagagccaacucuccggacgcgaggaacagagcucugacgccggccuguuuaaagaggaagggggacuggauuuccucggcagacaggacaccgauuaccgguccauggaauaccgcgacguggaucauagacugccugggagccagauguucggcuauggacaaucuaaguccuuucccgagggcaagacagcucgggacgcccagcgcgaccuucaggaucaggacuacagaaccgggccgagcgaagagaaaccuucccggcugauuagacucucuggaguccccgaagaugcgacgaaggaggagauccugaacgccuuccgcacaccugacggcaugcccgugaaaaaucuucaacugaaggaauauaacaccggguacgauuauggauacguuuguguggaguuuagccuccuggaagacgcuaucggcugcauggaggccaaucaggggacacugaugauucaggauaaagaggucacccucgaauauguguccucucuggacuucugguacuguaagcggugcaaggcuaacaucggcggacacagaagcuccuguagcuuuugcaaaaauccucgcgaggugaccgaagccaagcaggagcuuauuacauacccccaaccgcagaaaacgucuaucccugcuccccuggaaaagcagcccaaccagccucuccggccggccgauaaagagcccgagccuagaaagcgcgaagagggccaagaaucccggcuggggcaccagaaaagagaggcggaacgcuaucuucccccuagccggagagagggacccaccuuccggcgcgacagagagcgggaaucuugguccggcgagacacgccaggauggggaaagcaagaccauuaugcugaagagaaucuaccggucuacaccucccgaggucauuguugaagugcucgagccguaugugagacugaccacggccaacguccgcaucaucaaaaaucggacaggaccuaugggccauaccuacggguuuauugaccuggacagccacgcugaggcccucagagugguuaagauccugcaaaaccuugaucccccuuucuccauugacggcaaaaugguggccgucaaucuggcuaccggaaagcgccggaacgauagcggcgaccauucugaucacaugcacuauuaccaggggaaaaaguauuuuagagaccgccggggaggcgggagaaauuccgauuggagcuccgacacaaaccgccagggacagcaaucuagcuccgauuguuacaucuacgacucugccaccggcuauuacuaugauccccucgcgggcacauacuaugacccgaauacgcagcaggaaguguacguuccucaggaucccgggcugccugaggaagaggagauuaaggagaaaaagcccaccagccaaggaaaauccucuagcaagaaagaaauguccaagagagacggcaaggagaaaaaggaccgcggggugacacgguuccaggaaaacgcuagcgaaggaaaagcccccgccgaggaugucuuuaagaaaccucuuccgcccaccgugaagaaggaggaaucuccucccccucccaaagucgugaauccucugaucggccuccugggggaguauggaggcgacuccgauuacgaagaggaagaggaggaggaacagacaccgcccccucagcccagaaccgcucaaccucagaagcgggaggaacagacgaaaaaggaaaacgaggaggacaaacugaccgauuggaauaagcucgccugccugcuuugucgcagacaauuccccaacaaagaaguucugaucaagcaucagcagcucagcgaccugcacaagcagaaucuggagauucaucggaaaaucaagcaaucugaacaggagcuugcuuaccucgagagacgcgaacgggagggcaaauuuaaggggagaggaaacgaucgccgggaaaaacugcaguccuucgacagcccggagagaaagcggauuaaguauucucgcgaaacagauuccgacagaaaacugguggauaaggaggacaucgauaccagcuccaaaggcgggugcguccagcaagccacaggauggcggaagggcaccgggcucggauacggccacccuggccuggcgagcucugaggaagccgaggggcgcaugagaggacccagcgugggcgcuuccgggcggacgucuaaacgccagagcaaugaaacauauagagacgccguucggcgcgugauguucgcuagauacaaggagcuugacuga

SEQ ID NO: 74725 - RNA, 801 nt, Artificial Sequence
  derived and/or modified sequence opt5 from RBM7__Homo_sapiens__NP_057174
augggcgccgcugccgcggaggcugacagaacccuguucguggggaaccucgaaacaaaggucacggaggaacugcuuuuugagcuguuccaccaggccggacccguuaucaaagugaagauuccuaaagauaaggacggcaaaccgaagcaauuugccuucgugaauuuuaagcaugaagucagcgugcccuacgcuaugaaccuccugaaugggaucaaacuuuauggacggccuauuaagauccaguuccgcuccggcucuagccacgcuccccaggauguuucccugucuuacccucagcaucacguggggaacagcucccccaccucuacaagcccuuccagauaugagcggaccauggacaauaugacaagcucugcccaaauuauccagcgcuccuuuagcucuccggagaacuuccagagacaggccgucaugaacuccgcgcuccggcaaaugagcuacggaggcaaauuuggcucuagcccccuggaucaguccggguucuccccuucugugcagagccauucccacagcuuuaaucagucuuccagcucucaauggcgccagggaacccccagcucccagagaaagguucggaugaacucuuauccuuaccuggccgaccgccacuauagcagagaacaacgguacacagaucauggcuccgaccaccauuaccgcgggaaaagagaugacuucuuuuaugaggaucggaaucacgacgauuggagccacgacuacgacaaucgcagagauucuucccgggacggaaaguggagaagcucucgccauuga

SEQ ID NO: 74726 - RNA, 1212 nt, Artificial Sequence
  derived and/or modified sequence opt5 from RBMS1__Homo_sapiens__NP_002888
augggcaagguguggaaacagcaaauguacccccaguaugccaccuacuauuacccucaguaucugcaggcuaagcaaagccucgucccggcccaccccauggcgccucccuccccuucuacaacgagcuccaacaauaacucuagcuccucuagcaauuccgggugggaccagcugagcaaaaccaaccuuuacaucagaggacugcccccucauacaaccgaucaggaccucguuaagcugugccagccguauggcaaaauugugucuacaaaggcuauccuugauaagaccacaaauaaauguaagggguacggauucguggacuuugauucccccgccgccgcucaaaaagccgucagcgcucugaaggccucuggcgugcaggcgcagauggccaaacagcaagagcaggacccuaccaaccucuacauuuccaaucugccccugagcauggaugaacaggagcucgaaaacaugcugaagccuuucgggcaaguuaucucuacgcggauucuucgcgacuccagcggaaccuccagaggcgugggcuuugcucggauggagucuacagaaaagugcgaggccgucaucgggcacuucaauggaaaauuuaucaagacacccccgggcgugagcgcuccuaccgagccccugcucuguaaauucgccgaugggggacagaagaaacgccagaacccuaauaaguauauucccaacggcagacccuggcaucgggaaggggaggcgggaaugacccugacguacgacccuacaaccgccgcuauccagaauggcuuuuauccgucccccuacagcauugccacaaaccgcaugaucacccaaaccucuauuacaccuuauaucgcuucccccguuagcgccuaccaggugcagucuccuagcuggaugcagccccaaccguauauucuucagcacccuggcgccguccugacgcccuccauggaacauaccaugucucuccagccugcuagcaugaucagcccccuggcgcagcaaaugucccaccugucucucggguccacaggaaccuacaugccugccacaagcgcuaugcagggcgccuaccugccccaguaugcccacaugcagaccacggcugugccgguggaggaggccucugggcaacagcaggucgcgguugaaacauccaaugaucauagcccuuacaccuuccaacccaacaaauga

SEQ ID NO: 74727 - RNA, 1224 nt, Artificial Sequence
  derived and/or modified sequence opt5 from RBMS2__Homo_sapiens__NP_002889
augcugcucagcgugaccuccagacccggcaucucuacauucggguacaaccggaauaacaagaaaccuuaugucagccuggcccagcaaauggcuccgcccuccccuucuaauagcacgcccaacuccucuagcggauccaauggcaacgaccagcuuagcaagaccaaucuguacauucgcgggcuccagccuggaacaaccgaucaggaccugguuaaacuuugccaacccuauggcaagaucgugucuacaaaagccauucuggauaagaccacaaacaaguguaaaggguacggauuuguggacuucgauuccccuagcgcggcucagaaggccgucaccgcccucaaggcuucuggcgugcaggcccagauggcuaaacaacaggagcaggacccgacgaaucuguauaucuccaaccugccccucagcauggaugaacaggagcuggaaggcaugcuuaaaccuuuugggcaaguuauuucuaccagaauccugcgggacacauccggaaccagccgcggcgugggguucgccagaauggaguccacagaaaagugcgaggcgaucauuacccacuuuaauggaaaguacaucaaaacgcccccuggcguccccgccccgucugauccucuccuguguaaguucgcugacgggggacccaaaaagcggcagaaccagggcaaauuugugcaaaauggccgcgccuggccuagaaacgcugauauggggguuauggcccuuacauaugaccccaccacagcgcugcagaauggauucuaccccgccccuuacaacauuaccccgaaccggaugcucgcucagagcgcccugucccccuaucugagcucuccuguguccagcuaccagcgcgucacccaaacaucuccccuccaggugccuaaucccagcuggaugcaucaccauuccuaucugaugcagccgucuggcagcgugcuuacgccugggauggaucaccccaucucccugcagccugcuagcaugaugggaccccucacccaacagcugggccaucuuucucuguccagcacagggaccuacaugccuacagccgccgcuaugcagggagcguauauuucucaguacacccccgucccguccagcuccguuucuguggaggaaagcuccggccaacagaaccagguggccgucgacgcuccuucugagcacggcguguauagcuuucaguucaauaaguga

SEQ ID NO: 74728 - RNA, 1260 nt, Artificial Sequence
  derived and/or modified sequence opt5 from RBMS3__Homo_sapiens__NP_001003792
augggcaagagacuggaccagccccaaauguacccucaguauaccuacuauuacccgcacuaucuccagacaaaaagcuacgcccccgcuccucaucccauggccccucccuccccuucuacgaacagcuccucuaauaacagcuccaauaacucuagcggggagcagcuguccaagaccaaucuuuauauccggggacugccgcccggcacaaccgaucaagaccucauuaaacugugccagccuuacgggaagaucgugagcacaaaagcgauucuugauaagaacaccaaucaguguaagggauacggcuucgucgacuuugauucucccgcugccgcccagaaagcuguugccucccugaaggcuaacggggugcaagcccagauggcgaaacagcaggaacaagacccuacaaaucucuauaucagcaaccugcccauuucuauggaugagcaggaacuggagaauaugcucaagccguucggacacgugaucuccacccgcauccugagagacgccaacggcgucagccggggcgugggguuugcucgcauggaaucuacggagaaaugcgagguugugauucagcauuucaauggaaaguaccuuaagaccccucccggcaucccugcccccuccgaaccccugcucuguaaauuugcugaugggggacaaaagaaaagacagaaccagagcaaguauacacagaauggccggccuuggccgcgcgagggggaagccggaauggcgcugaccuacgaccccacagccgcuauucaaaacggcuucuauuccucuccuuacagcaucgccaccaacagaaugauuccccagacguccaucacaccuuuuauugcugccagccccgucucuaccuaucagggcgccgugaucacaccgaccauggaucacccuauguccaugcagcccgcuaauaugauggggccucuuacccaacagaugaaccaucugagccucggaacaacgggcaccauccagucucaggaccggauuaugauccugcaccaacugcucugccaguacaugacagcggccgcucccaugcaggggaccuacauuccucaguauacacccguuccgccuaccgccgugagcaucgagggagucguggccgauacgucuccccaaacaguggcucccuccagccaggacaccuccggccagcaacagcagauugccgucgacaccagcaaugagcacgcgccugcuuacucuuaucagcaauccaaaccguga

SEQ ID NO: 74729 - RNA, 969 nt, Artificial Sequence
  derived and/or modified sequence opt5 from RBMX2__Homo_sapiens__NP_057108
augaacccccugaccaaggugaaacucaucaaugagcugaacgaaagagagguccagcuuggcguugccgacaaggugagcuggcacuccgaauacaaagauucugcuuggauuuuccucgggggacugccuuaugagcugacagaaggcgacaucauuugcguguuuagccaauacggggagaucgucaauauuaaccuugugcgggauaagaaaacgggaaaguccaagggcuucuguuuucugugcuaugaggaccagcgcucuaccauccucgccguugauaauuucaacgggaucaaaauuaagggaagaacaauccggguggaccaugucagcaauuaccgcgcgccgaaagauuccgaagagauugacgaugugaccagacagcugcaggaaaagggcuguggcgcucggacacccucuccuagccuguccgagagcucugaggacgaaaaacccaccaagaagcacaaaaaggauaaaaaggagaaaaagaaaaagaagaaagaaaaggagaaagccgaccgcgaaguucaagccgagcagccuuccucuucuucccccagacggaagacagugaaagagaaggaugacaccgggccuaagaaacauagcucuaagaacuccgaacgcgcucagaaaagcgagccgagagaaggacagaagcuccccaaaucccggacggccuauucuggcggggcugaggaccuggaacgcgagcuuaagaaggagaaaccuaagcacgaacauaaaagcuccagcagacgggaggcccgcgaagagaagaccagaauccgggauagaggacgcagcuccgacgcgcacagcucuugguacaauggccggagcgaagggagauccuaucgcucucggagcagaucccgcgauaaaagccaccggcauaagagagcccgccggucuagagagcgcgaguccagcaaccccucugaccgguggagacacuga

SEQ ID NO: 74730 - RNA, 591 nt, Artificial Sequence
  derived and/or modified sequence opt5 from RBMX__Homo_sapiens__NP_001158275
augguggaggccgaccggcccggcaagcuguucaucgggggacucaacaccgaaacaaaugagaaagcucuggaagccgucuuuggcaaguacgggcggauuguugaggugcuucugaugaaagaucgcgaaacgaacaagagcagaggauucgcguuugugaccuucgaguccccugcugacgccaaagaugccgcucgggacaugaauggcaagcuccuguaucacgucgaggaaaucgugauggagguucaucuugaagggaaccgcugcccgcugguggagauguuuauuuguccccaggagaugaugggaauccuccugaagacagccauucaagcugaaaucacccagguccuggugauccucgagauuaugcaccaucaccaugaaaucauucugacaguuaucauggugauuccuguccacgugaugaccauccaccaggaggauauugccaucgaaauggacaugguggucaucguuacaauucagaucauucaaguggaggugcccaccgagauccauaugagagucauggugggcgauuucgcgcacuacggcagagggguucuuauugacucucaguga

SEQ ID NO: 74731 - RNA, 1179 nt, Artificial Sequence
  derived and/or modified sequence opt5 from RBMXL2__Homo_sapiens__NP_055284
augguggaggccgacagacccggcaagcuguucaucgggggacucaaccuggaaaccgaugagaaagcucuugaagccgaguuuggcaaguacgggcggauugucgaaguucugcucaugaaagaccgcgagacaaauaagagcagaggauucgcguuugugacguucgaguccccugcugaugccaaagccgcugcccgggacaugaacggcaagucucuggaugggaaggcuaucaaaguggcccaggcgaccaagccggccuuugaaagcucccgcagaggacccccucccccucggucucgcggcagaccccgguuccuucgcggcacaagagggggaggcgggggaccucggcgcagcccguccagaggcgggcccgacgaugacggaggcuauaccgcugauuuugaccugcggccuucucgcgcccccaugccuaugaaaagaggcccgcccccucggagagucgggcccccucccaagcgcgcugcccccagcggaccugcgcgguccagcggcgggggaaugagaggccgcgcccucgcugugcgggggagagauggauacucuggcccgccccgccgggagccucugcccccuagacgcgaccccuaucugggcccgcgggaugaaggguacuccagcagagacggauauucuucccgcgacuaccgggagccuagaggcuucgcccccagcccuggggaguauacacaccgggauuacggacauucuuccguucgcgacgauugcccccucagaggcuacagcgaccgggauggguauggcggaagagaccgcgauuacggcgaccaccugucccgggggucucauagagaaccuuuugagagcuauggagaacuucgcggcgcugcccccgggagaggaaccccgccuuccuacggcgggggcggacgguaugaggaauaccgcggcuauagccccgaugccuacucugggggaagagacuccuacagcucuagcuauggccgguccgaucgcuacucuagagggcggcaccgcgugggaagacccgaccggggccugagccucuccauggagcgcggguguccuccgcaaagagacagcuauucucgguccggcugcagagucccccgcggaggcgggcggcugggaggcagacuugagcgcgggggaggccggagcagauacuga

SEQ ID NO: 74732 - RNA, 1491 nt, Artificial Sequence
  derived and/or modified sequence opt5 from RBMY1A1__Homo_sapiens__XP_011529738
augguggaggccgaccaccccggcaagcuguucaucgggggacucaacagagaaaccaaugagaaaaugcugaaggcugucuuuggcaaacaugggccuauuagcgaaguucuucugaucaaggaucggacauccaaaucucgcggauucgccuuuauuacguucgagaacccggcggacgcuaagaaugccgccaaggauaugaacggcaaaagccuccacgggaaggcuaucaaaguggaacaggccaagaaacccuccuuucaaucuggaggcagacggcgcccucccgcuagcuccagaaaucggucuccuagcggcucccugcgcagcgccagagggucucggggaggcacccgcggguggcuucccucccaugagggacaccuggacgauggcggguacacaccugaccucaagaugagcuauucuagaggacugauuccggugaagcggggccccuccagccgcucuggcgggccucccccuaaaaaguccgcgcccagcgccgucgcuagauccaacucuuggaugggaagccagggcccgaugucccagcggcgcgagaauuacggggugccucccagacgggccaccaucagcucuuggagaaacgaucgcauguccacacggcaugacggauaugcuaccaaugauggcaaccacccuagcugccaggaaacaagagacuacgccccucccucucgcggguaugcguaccgggauaauggacacagcaacagagacgagcauuccucucgcggcuaucggaaucacagaagcucccgcgaaacccgggauuacgccccuccgagcagaggccaugcuuaccgcgacuaugggcacucucggagagacgaguccuacagccggggauaucgcaacagacggucuuccagagagacgcgcgaauacgcuccucccagccggggccacggguauagagauuacggacauucccgcagacacgagucuuauagccggggcuaccgcaaucaucccuccucuagagaaacccgggacuacgccccgccccaccgcgauuaugccuacagagacuaugggcauagcuccugggaugagcacagcucucggggcuacuccuaucacgacggauacggcgaagcccuggggcgcgaucauagcgagcaccucucuggauccagcuauagagacgcucugcaacgguacggcacaucucauggggcgcccccugcccgcggacccagaaugagcuacggcggguccaccugucacgcuuauagcaacacacgggauagauacggccgcucuugggaguccuauagcuccugcggagacuuccacuacugugaucgggaacauguuugcagaaaagaccagcgcaacccucccucucuuggccgggugcugccugaccccagagaggccugugggagcuccucuuaugucgccagcaucguggauggaggcgaaucccgcucugagaagggggacagcucccgguacuga

SEQ ID NO: 74733 - RNA, 474 nt, Artificial Sequence
  derived and/or modified sequence opt5 from RBP1__Homo_sapiens__NP_001124464
auggaucccccugccggcuucgugagagcugggaacccggccgucgcggcuccccagagcccucugucccccgagggagcccacuuucgggccgcucaucacccucgcucuaccggcagcagaugccccgggucccuccaaccuucucggccgcugguugccaauuggcuucagagccugcccgaaaugccuguggacuucacaggauacuggaagaugcucgugaacgagaauuuugaagaguaucugcgcgcucuugacgucaacguggcccugagaaaaaucgcgaaucuccugaagcccgauaaagaaauuguucaggacggcgaucauaugaucauucggacgcuguccaccuuccgcaacuacaucauggacuuucagguggggaaggaguucgaggaagaucucacaggaauugacgauagaaaauguauggccggcguccaaucucgggaccugagcucccuuuga

SEQ ID NO: 74734 - RNA, 405 nt, Artificial Sequence
  derived and/or modified sequence opt5 from RBP2__Homo_sapiens__NP_004155
augaccagagaccagaacggcacaugggagauggaaagcaaugagaacuucgaaggguacaugaaggcccuggauaucgacuuugcuacgcggaaaauugccgugcgccucacccaaacaaaggucaucgaucaggacggagauaauuucaaaaccaagacaaccuccacauuuagaaacuaugacguugauuucaccgugggcguggaguuugacgaauacacgaaaucucuggauaaucggcacgucaaggcgcuugugaccugggagggggacguucuggugugcguccagaagggagagaaagaaaaccgcggcuggaagcaguggauugagggggauaaacucuaucuggaacuuacauguggagaccaagugugcagacagguuuucaagaaaaaguga

SEQ ID NO: 74735 - RNA, 3744 nt, Artificial Sequence
  derived and/or modified sequence opt5 from RBP3__Homo_sapiens__NP_002891
augaugagagagugggugcugcucaugagcguccugcuuugcggccuggccgggcccacccaccucuuccagccuucccugguucuugacauggcuaaggugcugcucgauaacuacuguuuuccggaaaaucugcugggaaugcaagaggccauccagcaggcgauuaaaucucaugaaauccucagcauuuccgacccccagacacuggcuucugugcuuacggccggcguccaaagcucccugaacgauccucggcucgugaucucuuaugagcccagcaccccugaacccccuccgcagguucccgcccugacaucccuuagcgaggaggaacugcucgcuuggcugcagcgcgggcugagacacgaggugcucgaaggaaaugucggcuaccugcggguggacucuguuccugggcaggaggugcuuuccaugaugggagaguuccuggucgcccauguguggggcaaccucaugggcaccagcgcucuggugcuugaucugcgccacugcacagggggacaagucucuggcauucccuauaucaucuccuaccuccauccugggaauaccauucugcacguugacacaaucuauaacagacccagcaauaccacgaccgaaauuuggacacugccucaggugcucggagagcgguacggcgccgauaaggacguggucgugcugaccucuucccagacacgcgggguugcggaagauaucgcccacauucuuaaacagaugagacgggcuaucguggucggagagcgcaccggcggcggggcccuggaccucagaaagcugcggauuggagaaagcgauuucuucuuuacggugccgguuucccgcucucuuggcccccuugggggaggcagccaaacaugggagggguccggagugcucccuugugucggcacccccgcugagcaggcccuggaaaaagcgcuggccauccucacacugagaagcgcccuucccggcgugguccauugccugcaggaggugcucaaggacuauuacacccugguugaucgggugccuacccugcuucaacaccucgcuucuauggacuucuccacagucgugagcgaagaggaccugguuacgaagcugaacgcugggcuccaggccgccucugaagauccgcgccugcuugugagagcuaucggacccaccgagacaccuagcuggcccgcgccugacgccgcugccgaggauucccccggcgucgccccggaacugccugaggacgaagcuauucggcaggcccucguggauucuguguuucagguuagcguccugcccgggaaugugggauaccugagauucgacuccuuugcggaugcuagcgugcuuggcguccucgccccuuaugugcugcgccaaguuugggagccccugcaggacaccgaacaucucaucauggaucugcggcacaacccugggggccccucuuccgccgugccgcuucugcucagcuacuuccagggaccugaggcuggccccguccaccuguuuacaaccuaugacagacgcacgaauauuacacaggagcauuucucucacauggaacugcccgggccucgguacuccacccaaagaggaguguaucuucucaccagccaucgcacagccaccgcugccgaggaauuugcguuccugaugcagucccugggcugggccacacucguuggggagaucacggcuggaaaccugcuucacacccggacagugccgcugcucgauacccccgagggcucucuggcccugacagucccugugcuuaccuucauugacaaucauggggaggcuuggcucggcggaggcguugugcccgacgccaucguccuggcggaagaagcccuggauaaagcucaggaggugcucgaauuucaccagagccugggggcccuuguggagggaacgggccaucugcucgaggcucacuacgccagaccugaagucguugggcaaaccuccgcccugcugcgcgcuaagcuggcgcagggagccuaucggacagcuguggaccuggagucucucgccagccagcugaccgccgaucuccaggaaguguccggcgaccacagacugcuugucuuccauagccccggggagcuggugguugaagaggcuccucccccgccucccgccgugccuucucccgaggaacucacauaccugaucgaggcgcuguuuaaaaccgaaguccuuccgggccaacugggauaccuccgcuucgaugcuauggccgagcuggaaacggugaaggccguuggcccucagcucgugcggcuggucuggcagcaacuuguggacacagcugcccugguuauugaucucagauauaaccccggguccuacagcaccgcgaucccucugcuguguucuuacuuuuucgaggcugagccccggcagcaccuuuauuccguguuugaccgcgccacaagcaaagucaccgaaguguggacccugccccagguggccggacagagauauggcucucacaaggaucucuacauucugaugagccauacauccgggagcgcugccgaggcuuucgcccacacgaugcaagaccuccagcgggcgaccgucaucggagaaccuacagccggcggggcucugucuguuggcauuuaucaggugggauccagcccgcuuuacgccuccaugcccacccagauggcuaugucugccacaaccggcaaggccugggaucuggcugggguggagccugacaucacgguccccaugagcgaggcgcuguccaucgcccaagauauuguggcucucagagccaaaguuccuacagugcugcagaccgccggaaaacuugucgcugacaauuacgccucugcggaacugggcgcuaagauggccaccaagcucagcgggcugcagucccgcuauucucgggugacaagcgagguugcccucgcugaaauccugggagccgaccuucagaugcuguccggcgauccccaucugaaagcggcucacauuccugagaacgccaaggacagaaucccgggcauugugcccaugcaaaucccuagccccgaagucuuugaggagcucauuaaauucucuuuucauaccaacgugcuggaagauaauaucggguaccuucgcuucgacauguuuggagauggcgagcugcucacacaggucuccagacugcucguggaacacaucuggaagaagauuaugcacacggacgccaugaucauugauaugcgguucaacaucgggggaccuaccagcucuauucccauccugugcuccuauuucuuugacgagggcccgccuguucuucuggauaaaaucuacagccgccccgacgauucuguguccgaacuguggacacaugcucaggucgugggggagagauauggaagcaagaaauccaugguuauucucaccagcucugugacagccggcaccgcugaggaauuuacguacaucaugaagcggcugggccgcgcccuugucauuggggaggugaccagcggaggcugucaacccccucagacauaucacguggacgauaccaaucuguaccucacaauccccaccgcgagauccguuggggccucugacggaagcuccugggaaggcgucggggugacaccucauguggucgugccggcugaggaagcccuggcucgggccaaagagaugcuccagcacaaccagcugcgcguuaagagaucucccggacuucaagaccaucuguga

SEQ ID NO: 74736 - RNA, 606 nt, Artificial Sequence
  derived and/or modified sequence opt5 from RBP4__Homo_sapiens__NP_006735
augaagugggugugggcccugcuccugcuugcugcccugggcagcgggagagcggagcgggacugccgcgucuccucuuucagaguuaaagaaaacuuugauaaggcucgguucagcggaaccugguacgccauggccaaaaaggaccccgagggccucuuucugcaggauaauaucguggcugaauuuuccguggacgagacagggcaaaugucugccacggcuaaaggacgcgucagacuucugaacaauugggaugugugugccgacaugguuggcaccuuuacagauaccgaagacccugcgaaguucaagaugaaauauuggggaguggccagcuuucuccagaaggggaacgaugaccacuggauugucgauacagacuacgauaccuaugcugugcaguacuccugccggcugcugaaucucgacggcacaugugccgacucuuauagcuucguuuucucccgcgauccgaacggccugcccccugaggcucagaaaaucgugagacaacggcaggaggaacuuugccuggcccgccaguacagacucauuguccauaauggguauugugacggacggagcgagcgcaaccugcuuuga

SEQ ID NO: 74737 - RNA, 1503 nt, Artificial Sequence
  derived and/or modified sequence opt5 from RBPJ__Homo_sapiens__NP_005340
auggaccacaccgagggcagccccgccgaggaaccuccggcucaugcccccuccccugggaaguucggagaaagacccccucccaaacggcugacacgcgaggcgaugagaaacuaccucaaggaacggggcgaucagacggugcugauccuucacgcuaaagucgcccaaaagucuuaugggaaugagaaacgcuuuuucugcccuccgcccuguguuuaccugaugggaagcggcuggaagaagaaaaaggagcagauggaaagagacgggugcuccgagcaggaaucucagccuugugccuuuauuggaaucggcaacagcgaucaagagaugcagcagcucaaucuggagggcaaaaacuauugcaccgcuaagacacuuuacauuuccgacucugauaaacggaagcauuucaugcugagcgugaagauguuuuauggaaauuccgacgauaucgggguguuccucagcaaacgcauuaaggucaucucuaaacccuccaagaaaaagcagagccugaaaaacgccgaccuguguaucgcuucuggcaccaagguggcccucuuuaauagacugcggucccaaacaguuagcacccgcuaccuucacguggaagggggaaacuuccaugcgucuucccagcaguggggcgccuuuuucauucaccuucucgaugacgaugagagcgaaggggaggaauuuacagucagagacggauauauccacuacggccagaccgugaagcugguuugcuccgugacgggcauggcucugccucggcugauuauccgcaaagucgauaagcaaaccgcccuccuggacgcugacgaucccgugucucagcugcauaaaugugccuucuaccucaaggacacagagagaauguaucugugccuuagccaggagcggauuauccaauuucaggcgaccccguguccuaaagaacccaauaaggagaugauuaacgauggggccuccuggacaaucaucagcaccgacaaggcugaauacacguucuaugagggaaugggcccugugcuggcccccgucacacccguuccugugguggaaucucuccagcugaaugggggaggcgaugucgcuaugcuugagcugaccgggcagaacuucacaccgaaucuccgcgugugguuuggagacguugaggccgaaaccauguacagaugcggcgaguccaugcugugugugguccccgauauuagcgccuuccgggaaggcuggagaugggugcgccaaccuguucaggugcccgucacccuggugcggaacgacgggaucauuuauucuacaagccucacguuuaccuacacaccugagcccggaccgagaccucacugcuccgcugcgggcgccauccugcgcgcuaauucuagccaggugcccccuaacgaauccaacaccaauagcgaggggucuuauacaaacgccuccaccaauagcacgucugucacauccagcaccgccaccguuguguccuga

SEQ ID NO: 74738 - RNA, 630 nt, Artificial Sequence
  derived and/or modified sequence opt5 from RBPMS2__Homo_sapiens__NP_919248
augagcaaccugaagcccgacggcgagcacgggggauccaccggcacagggucuggagccggcagcgggggagcucucgaagaggaagugagaacgcuguucgucuccggccuuccuguugauaucaaaccgcgggagcuguaccuccuguuucgccccuucaagggcuaugaagggucucuuauuaaacugaccgccagacagccugugggauuugugaucuucgacagccgggcgggcgcugaggccgccaagaaugcucucaacgggauucgcuuugaucccgagaauccucaaacacugagacuggaguucgccaaagcuaacaccaagauggccaaguccaaacucauggcgacacccaauccuucuaacguccauccggcccugggagcucacuuuaucgcccgggaccccuacgaucuuaugggcgcugcccugauuccugcgagccccgaagccugggcuccuuauccccucuacaccacagaacugaccccggccaucucccaugcugccuucacguauccuaccgccacagcugcggccgcugcccuucacgcccaggugcgcugguaccccagcucugacaccacacagcagggguggaaguauagacaauuuugcuga

SEQ ID NO: 74739 - RNA, 2355 nt, Artificial Sequence
  derived and/or modified sequence opt5 from RBSN__Homo_sapiens__NP_001289307
auggccagccuggacgaucccggcgaggugagagaaggguuccucugcccucugugucuuaaggaccugcaguccuuuuaccaacuccacucucauuaugaggaagaacacagcggagaagaucgggacgucaaaggccagaucaagucccugguucagaaagcuaagaaagccaaggaucgccuucugaagagagagggggacgaucgggcggagucuggaacccagggcuacgaaucuuucuccuaugggggaguggacccguacaugugggagccccaagaacucggcgcugugcgcucucaucugagcgauuuuaaaaagcacagagccgcccggauugaccauuaugucguggagguuaacaaacugaucauucgccucgagaagcugacagcuuucgauagaacgaauaccgaauccgccaaaauccgggcuauugaaaagagcguggucccuugggugaacgaccaggauguucccuuuugcccugacuguggcaauaaguucucuauccgcaacagacggcaccacugccgccuuuguggguccaucaugugcaaaaaguguauggaacugauuagccucccccuggccaauaaacuuacaucugcguccaaggagagccugucuacccauacauccccuagccaguccccgaacucugugcacggaagcagacggggcuccaucagcucuauguccagcgucucuagcgugcucgacgaaaaagaugacgaucgcauuagaugcuguacccauugcaaggacacacugcugaaacgggagcagcaaaucgaugagaaggaacacacccccgacauugugaagcucuacgagaaacugagacuuuguauggaaaaggucgaucagaaagccccugaguauauccgcauggcugccucccugaaugcuggggaaacgaccuacucucucgagcacgccagcgaccugcggguugaggugcagaagguguacgaacuuauugaugcgcuguccaaaaagauccucacacugggacugaaccaggaucccccuccccauccgagcaaucucagacugcaacgcaugauccgguauucugccacccuuuuuguccaggagaagcugcucggccugaugucccuuccuacaaaagaacaguucgaggaacugaagaaaaagagaaaagaggagauggaacgcaagcgggcuguggagagacaagccgcucucgaaagccagcgccggcuggaggagagacagucugggcuggccucccgcgccgcuaacggagaaguugcgagccuccggagaggccccgccccucugcggaaggcugagggcuggcuuccccuguccgggggacagggccaaucugaagacagcgacccccuccugcagcagauucacaauaucaccuccuuuauucgccaggccaaagccgcugggagaauggacgaggugcggacgcugcaagaaaaccuuagacagcuccaggaugaguacgaccagcaacagacagagaaggccaucgaacugucucgccggcaggcggaggaagaggaucugcagagagaacaacuccagaugcugcgcgagagagagcuugaacgggagcgcgaacaguucagagucgcuagccugcauacccggacacgcucccucgacuuuagagagauuggaccuuuccaacuggaaccgagccgggagccccgcacccaccuggccuaugcccuugaucucggcagcuccccugugcccagcucuaccgcuccuaaaacacccucccugagcucuacgcagccgaccagaguuuggagcgggccucccgccgugggacaggagcggcugccucaguccagcaugccccaacagcaugaaggcccuucucucaaucccuuugacgaggaagaucuguccagcccgauggaggaggcuacaaccggcccucccgccgcgggggucucccuugaccccucugcccgcauccugaaggaauacaacccuuucgaggaagaggaugaagaggaggaagcuguggccggaaauccguucauccagcccgacagcccugcucccaacccuuuuuccgaggaagaugagcacccccagcaaagacucucuagcccucugguccccggcaacccguucgaggagccuacaugcauuaaucccuuugagauggacuccgauucugggccugaagccgaggaacccaucgaggaggagcugcuucuccagcagauugacaacaucaaagcguauauuuucgacgccaagcagugcggacggcuggaugagguggaaguucugaccgagaaucucagagaacugaagcacacgcuugcuaaacaaaagggcgggacagacuga

SEQ ID NO: 74740 - RNA, 327 nt, Artificial Sequence
  derived and/or modified sequence opt5 from RBX1__Homo_sapiens__NP_055063
auggccgcugccauggacguggauacccccagcggcacaaacuccggggcgggaaagaaaagauucgaggucaagaaauggaaugcuguugcccugugggccugggacaucgugguggauaacugcgcuauuugucggaaucacaucauggaccucugcauugaaugucaggccaaccaggcuucugccacgagcgaggaaugcaccgucgcguggggcguguguaaucaugccuuucacuuccauugcaucucccgcuggcugaagacaagacaaguuuguccucuugauaaccgggagugggaauuucagaaauacgggcacuga

SEQ ID NO: 74741 - RNA, 3378 nt, Artificial Sequence
  derived and/or modified sequence opt5 from RC3H1__Homo_sapiens__NP_001287780
augcccgugcaggccccucaauggaccgacuuccugagcugcccgaucuguacacagacguuugaugagaccauuagaaagcccaucucccucggcugcgggcacacagucuguaaaaugugccugaacaaacuucaucggaaggcuuguccuuucgaccagaccacaauuaauaccgauaucgaacugcuccccguuaacucugcccugcuucagcuggugggagcgcaagugccugagcagcagcccauuacacucugcagcggcgucgaagacaccaagcacuacgaggaagcuaaaaaguguguggaggagcuggcccuguaucucaagccucuguccucugcccgcgggguuggacuuaauagcacgacccaguccgugcugucuagaccgaugcaacggaaacucgucacacuggugcauugccagcuuguugaagaggaaggccgcaucagagcuaugcgggccgcucgcagccugggggagagaaccgugacagagcucauccugcagcaccagaacccccaacagcuguccagcaaucucugggccgcgguccgggcccgcggaugucaguuucugggcccugcuaugcaagaagaggcccuuaagcuggugcuccuggcucuugaagauggcucugcccuguccagaaaagugcucguccuguucguugugcagcggcuggagccccgcuuuccucaggcgagcaagaccucuauugggcaugugguccagcuccuguacagagccuccugcuucaaagugacgaagcgggacgaagauagcucucuuaugcaacugaaggaggaguuucgcacauaugaagcucucagacgggagcacgacucccagaucguucagauugccauggaagcuggacugagaaucgcccccgaucaguggagcucccuucuguacggcgaccaaucucacaaaagccauaugcaguccauuaucgauaagcuccagaccccggccagcuucgcucagucugugcaagagcugacaauugcgcugcagcgcaccggggacccugccaaccucaaucggcugagaccccaccuugaacugcucgcuaacaucgauccuucccccgacgcucccccuccgaccugggagcagcuggagaauggacuggucgccgugcgcacaguugugcauggccuugucgacuauauccagaaccacagcaaaaagggggccgaucaacagcagcccccucaacacucuaaauacaagacguauaugugucgggacaugaaacagagaggaggcugcccccgcggcgccagcugcaccuuugcgcauucccaggaagaacucgaaaaguuccggaagaugaauaaaagacuggugccucgccggccccugucugcuagccucgggcagcugaacgaggucggacuuccguccgccgccauucugccugaugaaggcgcuguggaccuccccagcagaaagccucccgcccugccuaaugggaucguuucuacaggaaacaccgugacacaacugauuccccgcggcaccgauccguccuacgacagcucucuuaaaccugggaagaucgaucaccucuccagcuccgcucccggaucucccccugaccugcuggagagcgucccgaaauccauuucugcccuccccgugaauccucauagcauucccccucggggccccgcggaucugccucccaugccgguuacgaagccucuucagauggugcccagaggcucccagcuguacccugcccagcaaacagacgucuauuaccaggauccccgcggggcugccccgccuuuugagcccgcuccuuaucagcagggaauguacuauacacccccuccccaaugugugagccgguucgugagaccgcccccuucugcccccgaaccugcgcccccuuaccucgaccacuauccgcccuaccugcaggagcggguugucaacucccaguacggcacccaaccucagcaguaucccccuaucuaccccagccauuaugacgggagacgcguguacccggccccuucuuauacccgggaagagaucuuuagagagucccccauccccauugaaaucccucccgcugccgugccuagcuacgucccggagucucgcgaaagauaucagcaaauugagagcuacuaccccguggcuccucaccccacccagauccggccuuccuaucugcgcgaacccccguacagcagacuuccucccccuccccagccucaccccucucucgaugagcugcaucggcgcagaaaggagaucauggcccagcuggaggagcggaaaguuauuuccccgccucccuucgcccccagcccuacacucccgcccacguuccacccugaagaguuucuggacgaagaucuuaagguggcuggaaaauauaagggcaacgacuacucccaauauucucccuggagcugcgauaccaucggguccuacauuggcacaaaagacgcgaagccuaaggaugucguggccgcuggaucuguugagaugaugaauguggagagcaaaggcaugcgcgaccagagacuggaucuccagcggcgcgccgccgaaaccuccgacgaugaccugauccccuucggggauagaccuacagucucucgguuuggagcuauuagcagaaccuccaagacgaucuaucagggcgccgggccgaugcaagcgauggcuccccagggagccccuaccaaaagcauuaacaucucugacuacucccccuacggcacacaugggggcuggggagccagcccuuauucuccccaccagaauaucccgucccagggccacuucagcgagcgcgaacggauuucuauguccgagguggcuagccaugggaagccucugcccuccgccgaaagagagcaacuucgccucgagcugcagcagcugaaccaccaaaucagccagcagacccagcuccggggacuggaaagagaggcgaauacacuugcuggccaaucucagcccccucccccuccgcccccuaaauggcccgggaugauuagcuccgaacagcugucucucgagcugcaucagguugagcgcgaaaucggaaagcggaccagagagcugagcauggaaaaccaauguucccuugacaugaagucuaaacugaauacgagcaagcaggccgagaacggccagccugaaccccagaauaaagugccggccgaggaucucacacugaccuuuuccucugacgucccuaacgggagcgcucucacacaagagaauauuucccugcuuagcaacaagaccucuucccugaaucucagcgaagaucccgagggcggaggcgacaacaaugauucucagcgcuccggggugaccccuagcuccgcccccuga

SEQ ID NO: 74742 - RNA, 516 nt, Artificial Sequence
  derived and/or modified sequence opt5 from RCAN1__Homo_sapiens__NP_001272318
augguguacgccaaguucgagagccuguuuagaaccuaugacaaagauaucacauuccaguacuuuaaguccuucaaacggguccgcauuaacuuuucuaaucccuucagcgcugccgacgcgagacuccaacugcacaagacggaauuucuuggcaaagagaugaagcuguauuucgcucagacccuccauaucggguccucucaccuggccccuccgaaccccgauaagcaguuucuuauuagcccucccgccuccccucccguuggauggaaacagguggaagacgcuacaccugugaucaauuacgaucugcucuaugccauuucuaagcugggcccgggggagaaauacgaacugcaugcugccaccgacacaacccccagcgucgugguucacgugugcgaguccgaucaagagaaggaagaggaagaggagauggaacggaugcgcagaccuaaacccaagaucauccagacacggcgcccugaguauacccccauucaucucagcuga

SEQ ID NO: 74743 - RNA, 594 nt, Artificial Sequence
  derived and/or modified sequence opt5 from RCAN2__Homo_sapiens__NP_005813
augcccgcccccagcauggacugcgauguguccacccuggucgcuuguguuguggacguggaggucuucacaaaccaggaagugaaggagaaauuugaaggccucuucagaacguacgaugacugcguuaccuuucaacuguucaagucuuuucggcgcgugagaaucaauuucagcaacccgaaauccgccgcgcgggcucgcauugagcuucacgaaacacaguuuagagggaagaaacugaagcucuauuucgcccagguccagacccccgagacagauggagacaagcugcaucuugccccuccccaaccugcuaaacaguuucugaucucucccccuagcuccccgcccgugggcuggcagccuauuaaugaugccacccccguucucaacuacgaccugcuguaugcuguggccaagcucgggccuggagagaaauacgaacugcacgcgggcacagagucuacccccagcgucguggugcaugucugugauuccgacaucgaagaggaggaagauccgaagacgagcccuaaacccaagauuauccagacccggcgcccugggcuuccucccucuguuuccaauuga

SEQ ID NO: 74744 - RNA, 1596 nt, Artificial Sequence
  derived and/or modified sequence opt5 from RCBTB1__Homo_sapiens__XP_005266498
augguggacgucggcaaguggcccaucuucacccugcucagcccucaggagauugccuccaucagaaaagccugcguuuuugggacaucugcuagcgaagcgcuguacgugacggauaacgacgagguguucgucuuuggacuuaauuauuccaacugucugggcaccggggauaaucaaucuacacucgugccgaagaaacuggaaggacuuugcggcaagaaaauuaagagccuguccuacgggucuggaccccacguucuccugagcaccgaggacggcguggucuaugcuuggggccauaacggguacucccagcugggaaauggcacaaccaaccaggggaucgccccugugcagguuuguacaaaucuccugauuaagcaaguggucgaaguggccugcggaagccaccauucuauggcucuugccgcugauggcgagguguucgccuggggguauaacaauuguggacaggucggcuccggcagcaccgcgaaccagcccacgccucggaaaguuaccaauugccugcacaucaagcgcgugguggggaucgccuguggacagacaucuuccauggcuguccucgacaacggcgagguguacggguggggauauaauggcaacgggcaacugggacuuggcaauaacggcaaccagcugacccccguuagaguggccgcucuccauagcgucugcgugaaucagauuguuuguggguacgcccacacacuggcgcugaccgaugaaggacuccuguacgccuggggcgcuaacacguaugggcagcuuggaacaggcaauaaaaacaaucugcucucuccugcccacaucaugguggagaaggaacgggucguggagauugcugccugccauuccgcccacaccagcgcugcgaaaacacaagggggccaugucuacauguggggacagugucgcggccaguccgugauccugccgcaccuuacccacuuuucuugcaccgacgauguuuucgccugcuuugcuacacccgccgugagcuggagacugcucuccgucgagcaugaagacuuccugacgguggccgagagccugaagaaggaauuugauucuccugagaccgcugaccucaaauuccggauugaugggaaguauauccacguucauaaagccgugcugaagauucgcugugaacacuuuagauccauguuccaaagcuacuggaacgaggacaugaaagaggucaucgaaaucgaccaguuuucuuaucccguguaccgggcguuccuucaguaucuguacacagauaccguggaccucccucccgaggaugcuauuggacugcuugaccuggccacaagcuacugcgaaaaucgccucaagaaacugugucagcauaucauuaagagaggcaucaccguugagaacgccuucucccuguuuucugcugccguccgguaugaugcugaagaccucgaggaguucugcuuuaaguucuguauuaaucaccugacggaagugacacaaaccgccgcguuuuggcagauggaugggccgcuucugaaagaguucaucgccaaggcuagcaaaugcggagccuuuaagaacuga

SEQ ID NO: 74745 - RNA, 1671 nt, Artificial Sequence
  derived and/or modified sequence opt5 from RCBTB2__Homo_sapiens__NP_001273759
augagcgcccugcccagagaccucgagcuguccaacccucgggaaaaacuuaccaaaccggugcaggcuacacugucuagccucaagaugcuggaugucggcaaauggcccaucuucucccuuugcucugaggaagaacugcaacucauucgccaggccuguguuuuugggagcgcgggaaaugaagugcuguacacgaccgugaacgacgagaucuucguccugggcacaaauugcugugggugccucggacugggcgaugugcaguccaccauugagccuagacggcuugacucucugaacgggaagaaaaucgcuugucucagcuauggauccggcccccacauuguucuggccacaaccgaaggcgagguguuuacaugggggcauaaugccuacagccagcuuggaaacggcaccacgaaucacgggcuggucccuugccauaucucuaccaaccucuccaauaagcaagugaucgaaguugcuuguggaagcuaucacucucuggugcugacauccgauggcgaggucuucgccuggggguacaacaauagcggacaggugggcucuggcuccaccgugaaccagcccauuccucgcagagucacagggugccuccagaauaagguuguggugaccaucgcuuguggacaaaugugcuguauggccgucguggacacgggcgagguuuauguguggggguacaacggaaauggccagcuggggcuuggaaacagcggcaaccagccgacacccugccgggucgcggcccugcagggcauucgcgugcaaagaguugcuugcggguaugcccauacccucgugcugacagaugaaggacaggucuacgcuuggggcgccaauuccuacgggcagcuuggaaccggcaacaaaucuaaucaaagcuauccuacccccgugacagucgagaaggaccggaucauugaaaucgcggccugucacuccacgcacaccagcgcugccaaaacacaagggggccauguguacauguggggacagugccgcggccagucuguuauucugccucaccucacccauuuuuccuguacagaugacguguucgcuugcuuugccacccccgccgucacguggagacugcugagcguggagccggaugaccaccucacaguugcugaaucucugaagcgggaguucgauaacccugacaccgcggaccuuaaauuucugguggaugggaaguauaucuacgcccacaagguccuccugaaaauccgcugugagcauuucagaagcucccuugaagacaaugaggaugacauuguggaaaugucugaguuuagcuaucccguguaccgggcuuuccuggaauaucucuacaccgauuccaucagccugucuccugaggaggccguuggacugcucgaccuggccacauuuuaccgcgaaaacagacuuaagaaacugugccagcagaccauuaagcagggcaucugugaggaaaaugcuauugcccuccuguccgcggcugucaaauaugaugcccaggaccuggaggaguucugcuuccgguuuuguaucaaccaccuuacaguggugacgcaaaccagcggguucgccgagauggaucaugaccuccugaagaauuuuaucucuaaggcuuccagagucggagccuucaagaacuga

SEQ ID NO: 74746 - RNA, 759 nt, Artificial Sequence
  derived and/or modified sequence opt5 from RCHY1__Homo_sapiens__NP_001009922
auggccgcuaccgccagagaggacggcgcgagcgggcaggaacggggacaacgcggcugcgagcacuacgauagagggugucugcucaaggcucccugcugugacaaacuguauacaugccggcuuugucaugauaacaaugaagaccaccagcuggaucgcuucaaggugaaagagguccagugcaucaacugugaaaagauucagcaugcccaacagacgugcgaggaguguuccacccucuuuggagaauacuauugcgacaucugucaccuguucgauaaagacaagaagcaguaccauugcgagaauugcggcauuuguagaaucgggccuaaagaagacuuuuuccacugccuuaaguguaaccugugccucgccaugaaucugcagggacggcacaaauguauugagaacguuucucgccaaaauugcccgaucugucuggaggauauccauacaagcagagugguggcucacguccuccccugcggccaucugcuucaccggggcuaucgcuguccucugugcaugcacuccgcccucgauaugaccagauacuggcggcagcuggacgaugaaguggcucagacacccaugccuucugaguaucagaacaugaccguugacauucuuuguaaugacugcaacgggcgcagcacagugcaauuucauauccugggaaugaagugcaaaauuugugaauccuacaauaccgcccaggcgggcgggagacggaucucucucgaucagcaauga

SEQ ID NO: 74747 - RNA, 648 nt, Artificial Sequence
  derived and/or modified sequence opt5 from RCL1__Homo_sapiens__NP_001273629
augcccccuggcgggggaggcgagguggucuucagcugcccgguuagaaaggugcugaaacccauccagcucaccgacccugggaagauuaaacggauccgcggaauggccuacuccgugagagucucuccccaaauggcuaaccggauuguggauagcgcccgcuccauccugaauaaguuuauuccugacaucuauaucuacacagaucacaugaaaggcguuaacucuggaaagagccccggguucggccuuucccugguggcggaaacgaccucuggcacauuucucagcgcugagcuggccuccaauccucaggggcagggagccgcuguccuuccggaagaccugggcagaaacugugcccggcuccugcuggaggaaauuuaucgcgggggaugcguggauagcaccaaucagucucucgcucugcuucugaugacacucggccaacaggacguuuccaaggugcugcuugggccccugagcccuuacaccaucgaguuccucagacaucugaaauccuuuuuccagauuauguuuaagaucgagacaaaacccuguggagaggaacugaagggcggcgauaaaguccucaugaccugcguggggauuggauucucuaaccugagcaagacgcuuaaguga

SEQ ID NO: 74748 - RNA, 996 nt, Artificial Sequence
  derived and/or modified sequence opt5 from RCN1__Homo_sapiens__NP_002892
auggccagaggcgggcggggacgcagacugggccucgcucuggggcuucugcucgcccuggugcuugcgccccggguccugcgcgcuaagccuacaguuagaaaagagcggguggugcgcccggacagcgaacucggagagagacccccugaagauaaccaguccuuccaauacgaccacgaggccuuucugggcaaggaagauucuaaaacauucgaccagcugacgcccgaugagagcaaggagcggcucgggaaaaucgucgaccgcauugauaaugacggagauggcuuugugaccacagaagaacugaagaccuggaucaagagaguucagaaacgguauauuuucgacaacguggccaaggucuggaaagauuacgaccgcgauaaggacgacaaaaucuccugggaagaguauaagcaggcuacauacggcuauuaccuugggaauccugccgaguuucaugauucuagcgaccaccauaccuucaagaaaaugcugcccagagaugaacggcgcuuuaaggcugccgaccucaacggagaucugacagcgaccagagaggaguucacggccuuucuucacccugaggaguucgaacauaugaaagagauugugguucuggaaacccucgaggacaucgauaagaauggcgacggguuuguggaucaagacgaauauaucgcugauauguucucccacgaggaaaacggaccggagcccgacuggguccugucugagcgggaacaguuuaaugaguucagagaccugaacaaagauggcaagcucgacaaagaugaaauucgccacuggauccugccucaggacuacgaucaugcccaggcugaggcccggcaccuuguguacgaaagcgacaagaauaaggaugagaaacugacaaaggaggaaauucucgagaacuggaauauguucguggggucccaagcgaccaacuauggagaagaccugaccaaaaaucaugaugagcuuuga

SEQ ID NO: 74749 - RNA, 954 nt, Artificial Sequence
  derived and/or modified sequence opt5 from RCN2__Homo_sapiens__NP_002893
augagacugggcccccggaccgccgcucucgggcugcuucugcucugcgccgcggcugccggagccggcaaggcugaggaacugcacuacccucuuggggagcgcagaagcgacuaugaucgggaagcccugcucggagugcaggaggacgucgaugaauacguuaaacugggccaugaggagcaacagaagcgccugcaggcuaucauuaaaaagaucgaccucgauuccgacggguuccugacagaaucugagcuuagcuccuggauucagaugucuuuuaaacacuaugccaugcaagaagcgaagcagcaguucguggaguacgauaagaacagcgacgauacggugaccugggacgaguauaauauccagauguacgauagagucauugacuuugaugaaaacacagcccuggacgacgcugaggaagaguccuuccggaaacuccaucugaaggauaaaaagcgcuuugaaaaagccaaucaagacucuggaccgggccuuagccuggaggaguucaucgcuuuugaacaccccgaggaaguggauuauaugaccgaguucguuauccaggaagcccucgaggagcaugacaagaacggcgauggguuugugucccuggaagaguuccugggagacuacagaugggauccuacagcgaaugaagaccccgaguggauucucgucgaaaaggaucgguuugugaacgacuacgauaaagacaaugacggccgccuggauccucaggagcuucugcccuggguugugccuaacaaucaggggaucgcccaagaggaagcucuccaccugauugacgagauggaucuuaacggagacaagaaacugagcgaagaggagauccucgaaaauccggaucuguuccugaccucugaggccacagacuauggcagacagcuccacgaugacuacuuuuaucaugaugaacuguga

SEQ ID NO: 74750 - RNA, 1458 nt, Artificial Sequence
  derived and/or modified sequence opt5 from RCOR1__Homo_sapiens__NP_055971
augcccgccaugguggagaagggcccugaagucagcgggaaaagacggggacgcaacaaugcugccgcguccgcuucugccgccgcugccagcgcugccgcguccgccgcuugcgccucuccggcugccaccgcggccagcggcgcugccgcuuccucugccagcgccgcugcggccuccgcugccgccgcucccaacaaugggcagaacaagagccuggccgcggcugccccuaauggaaacucuuccagcaauucuugggaggaaggcuccagcgggucuuccagcgacgaggaacacggaggcggcgggaugagaguuggaccccaauaccaggccguggugccugauuucgaccccgcuaaacucgcccggcgcucccaggagagagauaaccugggcaugcuugucuggucuccuaaucagaaccugagcgaggcuaagcucgacgaauauaucgccauugcgaaagagaagcauggguacaauauggaacaagcccugggaaugcuguuuuggcacaagcauaacaucgagaaaucccuugcugaucucccgaauuucacacccuuuccugacgaguggacgguggaagauaagguucuguucgagcaggccuuuagcuuccacggcaaaaccuuucaucggauucagcagaugcugcccgacaagucuaucgcuucccucgugaaauucuauuacagcuggaagaagacacgcaccaaaacaucugucauggauagacacgcccggaagcaaaaacgcgaaagagaggaaagcgaggacgagcuggaagaggcgaacgggaauaacccuauugauaucgaaguggaccagaacaaggaguccaaaaaggaaguucccccgaccgagacagugccucaggucaaaaaggagaagcacucuacccaggccaaaaaucgggcuaagcgcaaacccccuaagggaauguuucuuagccaagaagauguggaggccguguccgcuaacgccacggccgcuaccacaguccugagacagcucgacauggaacugguuagcgugaaacggcagauccaaaauauuaagcagaccaacucugcgcuuaaggagaaacuggacggcggcaucgaacccuaucgccuccccgaggugauucagaaguguaaugccagauggacaaccgaggaacagcugcuggcuguccaagccauccggaaauacgggagagauuuccaggccauuuccgacgugaucggaaacaagagcguugugcaggucaaaaacuuuuucgugaauuaucgccggagauuuaauauugaugagguucuccaggaaugggaggcugagcauggcaaggaagagacgaacgggccuucuaaucaaaagccggugaaaucccccgacaacagcaucaagaugccugaagaggaagaugaggcccccguccuggacgugcgcuacgcguccgcuucuuga

SEQ ID NO: 74751 - RNA, 1251 nt, Artificial Sequence
  derived and/or modified sequence opt5 from RCSD1__Homo_sapiens__NP_443094
auggaggaaagacccgccgagaccaacgcuaauguggacaacagcgccuccccuucugucgcgcagcuggcuggccgguuccgcgaacaagccgccgcugccaaggagacaccggcuagcaaacccacgagacggaagccucccugcucccucccucuguuucccccuaaaguugaucuugggcagaauggagaagagaagucuccgcccaacgccagccacccucccaaauucaaggugaaguccucuccucugaucgagaaacuccaggcgaaucugaccuuugaccccgccgcucugcugccgggcgccagcccuaagucccccgggcucaaagcuauggugagcccuuuccauucuccucccuccacacccagcucuccgggaguccgcuccagacccagcgaagccgaggaagugccuguuucuuuugaucagcccccugagggcucccaccuucccuguuacaacaaggugcggacccgcgggagcauuaaaagacggccgccuucccgcagauuccggcgcucucaaagcgacugcggagagcugggcgauuuuagagcggucgaauccagccagcagaauggcgccaaggaggaagacggggaugaggugcuccccucuaaguccaaagcuccuggaagcccccugucuagcgaaggcgccgcuggggagggaguucggacacuuggcccugccgagaagcccccgcugcgcagauccccuucucggaccgaaaaacaggaggaagacagagccacagaggaagcuaagaacggggagaaagcgcgccggagcuccgaggaaguggauggacaacaucccgcccaggaggaaguccccgagagcccucagaccucuggcccggaagcugagaauagauguggcagcccccgcgaggaaaagccugccggggaggaagccgagauggagaaagcuacggaagugaagggagagcgggugcagaacgaagaggucggccccgaacacgacucccaagagaccaagaaacucgaggaaggggccgcgguuaaggagacaccucauucucccccuggaggcgugaaagggggagaugugcccaagcaggaaaaaggcaaggagaagcagcaagaaggcgcuguccuggagccggggugcuccccucagaccggacccgcccagcuugagacaagcuccgaagugcagucugagccugccguucccaaaccggaagacgauaccccugugcaagacacgaagauguga

SEQ ID NO: 74752 - RNA, 603 nt, Artificial Sequence
  derived and/or modified sequence opt5 from RCVRN__Homo_sapiens__NP_002894
augggcaacagcaaguccggggcccugucuaaagagauccucgaggaacugcagcuuaauaccaaguucagcgaagaggaacugugcuccugguaccaaucuuuucucaaagacugucccacaggaagaauuacgcagcagcaguuccaaagcaucuaugcuaaguuuuucccugauaccgacccgaaagccuacgcgcagcacguguuucgguccuucgauucuaaccuggacggcacacuugauuuuaaggaguaugucauugcucugcauaugaccacagccgggaagaccaaucagaaacucgagugggccuucagccuguacgacguugauggaaacggcacaaucuccaagaaugaagugcuggagauugugauggcuaucuuuaaaaugaucacccccgaagacgucaagcuccugccugaugacgagaacacgcccgagaaacgcgccgaaaagauuuggaaguauuucgggaaaaaugaugacgauaaacuuaccgagaaggaauuuaucgagggaacacuggcuaacaaggaaauucucagacugauccaguucgagccucaaaaagugaaggagaaaaugaagaaugccuga

SEQ ID NO: 74753 - RNA, 588 nt, Artificial Sequence
  derived and/or modified sequence opt5 from RD3__Homo_sapiens__NP_001158160
augagccugaucuccuggcucagauggaacgaagcccccucucggcugagcacccgcuccccugcugaaauggugcuugagacacugaugauggaacucacgggccagaugagagaggccgaacggcaacagcgcgagagaucuaaugcgguccggaagguuugcaccgggguggacuacagcuggcuggcuuccacaccgcgcucuaccuaugaucuuagccccauugagagacugcagcucgaagacgugugugucaaaauccacccuuccuacugcggacccgccauucugcgguuccgccagcugcucgccgagcaagaaccugaggugcaggagguuagccagcuguuuagaucugugcuucaggaaguccuggagcggaugaagcaagaagaggaagcucauaaacucacacgccaguggucccugagaccccggggcagccuugccaccuucaagacacgcgcuagaaucucuccuuuugccuccgauauucggaccaucagcgaggacguggagagagauacgccgcccccucugcgcucuugguccaugcccgaguuccgggcgccuaaagccgacuga

SEQ ID NO: 74754 - RNA, 1026 nt, Artificial Sequence
  derived and/or modified sequence opt5 from RDH10__Homo_sapiens__NP_742034
augaacaucguggucgaguucuuuguugugaccuucaaggugcugugggccuuuguccucgcugccgcgagauggcuggugcggcccaaagaaaagagcguugcuggccaggugugccuuauuacaggggccggauccggccuggggcgccucuucgcccuggaguuugcuagacggcgcgcccuucugguccucugggacaucaauacgcaaucuaacgaagagaccgcuggaauggugagacacauuuaccgggaucuggaagccgcggacgccgcugcccugcaggcuggcaauggggaggaggaaauccucccucauuguaaccugcagguuuucacauauaccugcgaugugggaaaacgcgagaaugucuaccuuacagccgaaagagugcggaaggaggugggcgaggucagcguucuggugaacaaugcgggcguggucuccgggcaccaucuccuggaauguccggacgagcuuauugaacgcaccaugauggugaacugccacgcccauuuuuggacaaccaaggcuuuccugcccacgaugcucgagaucaaucacggacacaucguuaccguggccucuagccugggccuguuuuccacagcuggggucgaagauuauugugccucuaaguucggagugguuggcuuucaugagagccucucccacgagcugaaggccgcugaaaaagacgggauuaagaccacacuugugugcccuuaccuggucgauaccggaauguucagaggcugucggauccgcaaagagauugaacccuuucucccuccccugaagccugacuauugcgugaaacaggcgaugaaggccauccuuacggaucaaccgaugauuuguacacccagacugauguacaucgucaccuucaugaaaagcauucucccuuucgaggcugugguuugcauguaucgguuucugggcgccgacaaauguauguaccccuucaucgcccagcgcaagcaggcuacaaacaauaacgaagccaaaaaugggaucuga

SEQ ID NO: 74755 - RNA, 957 nt, Artificial Sequence
  derived and/or modified sequence opt5 from RDH11__Homo_sapiens__NP_057110
augguggagcugauguucccccuccugcuucugcuccugccuuuucuucuguacauggccgcuccgcagaucagaaagaugcucagcuccggcgucugcaccucuacaguucaacugcccgggaaagugguggucgugacgggagccaacaccggcauugggaaggaaacagcgaaagagcuggcucagcggggagcccgcguuuaucucgccuguagagacguggaaaagggcgagcuggucgcuaaagaaauccagaccacaaccgggaaucagcaagugcuuguucggaagcuggaucucagcgacacaaaguccauucgcgccuucgcuaaaggauuucuggccgaggagaagcaccuucaugugcugaucaacaaugcgggcgucaugaugugcccuuacucuaaaaccgccgauggcuucgaaaugcacauuggggugaaccaucucggacacuuucugcugacgcaucuccugcuugagaagcugaaagaaagcgcucccuccagaaucgugaaugucucuagccucgcccaccaccugggccggauccauuuccacaaccuucagggggagaaguuuuauaaugcuggacuggccuacugucauuccaagcucgcgaacauucuguucacccaggagcuggcccgcagacucaaaggcagcgggguuacaaccuauucugugcacccuggaacagugcaguccgaacugguccggcacagcucuuuuaugcgcuggaugugguggcuuuucuccuuuuucaucaagacgccccaacagggcgcucagaccagccugcauugcgcccucacagagggccuggaaauucuuucugggaaucacuuuuccgacugucauguggcuuggguuagcgcccaggccagaaacgagaccaucgcucggcgccugugggauguguccugcgaccuccugggacugccuauugauuga

SEQ ID NO: 74756 - RNA, 951 nt, Artificial Sequence
  derived and/or modified sequence opt5 from RDH12__Homo_sapiens__NP_689656
augcuggugacccucggccugcuuacgagcuucuuuuccuuccuguacauggucgcccccucuaucagaaaguuuuucgcugggggaguuugccggacaaacgugcagcucccuggcaaaguggucgugauuaccggggccaauacaggaaucggcaaggagaccgcgcgcgaacuggcuagcagaggggcccggguuuauauugccugucgcgacgugcuuaaaggagaguccgcugccucugaaaucagagucgauacaaagaacagccaagugcugguucggaaacucgaccuguccgauaccaagucuauucgcgcuuuugccgagggcuuccuggcggaagagaagcagcuccacauccugaucaauaacgccggcgugaugaugugcccguacagcaaaacagcugacggguuugagacccaucuuggagucaaucaccugggccauuuccuccugacguaucuucugcucgaaagacugaagguguccgcccccgcucggguggucaacguuagcucuguggcccaccauauugggaaaaucccuuuucacgaucugcaguccgagaagcgcuacagcagaggauucgcguauugucacucuaaacucgccaaugugcuguuuacccgggaacuugcuaagcgccugcagggcacaggggucaccacauacgccgugcaucccggaguugugagauccgagcucguccggcacagcucucugcuuugccugcucuggcgccuguucuccccuuuugugaagaccgcuagagagggcgcccaaacgagccugcauugugcccucgcugaaggccuggagccccuuuccgggaaauauuucucugacugcaagcggacauggguuagcccuagagcgcgcaacaauaaaaccgccgaacggcuguggaacguguccugugagcuccugggaauuagaugggaauga

SEQ ID NO: 74757 - RNA, 1011 nt, Artificial Sequence
  derived and/or modified sequence opt5 from RDH14__Homo_sapiens__NP_065956
auggccguggcuaccgccgcggcuguccuggccgcccucggcggggcucuguggcuugccgcuagacgguucguuggaccccgcgugcagagacugcggcgcggcggggacccuggacucaugcacggcaagacagugcugaucacgggggccaacagcggacuuggcagagcgaccgccgcugagcugcuccggcugggcgcccgcgucauuauggggugcagagaucgggcucgcgccgaagaggcggccggacaacugagacgggaacuccgccaggcugccgaguguggcccggaacccgggguguccggaguuggcgagcugaucgugagagagcuugaccuggcuucucuccggagcguccgcgccuuuugccaggaaaugcugcaggaggaaccuagacuugaugugcugauuaauaacgccgggaucuuccaaugucccuacaugaaaacagaggacggauuugagaugcaguucggcguuaaucaucucggccacuuucugcugaccaaccuccugcuugggcugcucaaguccucugcuccuagccggauuguggucguguccucuaaacuguauaaguacggagauaucaauuucgacgaucuuaacagcgaacaguccuauaauaagagcuuuugcuacucuagauccaaacuggcgaacauccucuucacacgcgagcuggcccggagacuggaaggcaccaaugugacagucaacguucuccaucccgggauugugcgcaccaaucugggacggcacauccauauuccucuucuggugaagccgcucuuuaaccuggucagcugggcuuucuuuaaaacgcccguggagggcgcccagaccucuaucuaucuugccuccagcccugaaguugagggggugucuggaagauacuucggcgacuguaaggaggaggaacugcuccccaaagcuauggaugaauccgucgcccgcaagcugugggacauuagcgaggugaugguuggccugcucaaauga

SEQ ID NO: 74758 - RNA, 954 nt, Artificial Sequence
  derived and/or modified sequence opt5 from RDH16__Homo_sapiens__NP_003699
auguggcuguaccucgccguguucgucggccuguauuaccuucugcacugguauagagagcggcagguucucagccaucugcgcgacaaguacguguuuaucaccgggugcgauuccggauucggcaaacuucuggcuagacaacucgacgcccgggggcugcgcgugcuggcggcuugucucacagaaaagggagccgagcagcugagaggccagacgucugaucggcuugaaaccgucacacuggacgugaccaaaacagagagcguugccgcugccgcucagugggugaaggaaugcguccgcgauaaagggcucuggggacuggugaacaaugccggcauuucccuucccaccgcgccuaacgagcugcucacaaagcaagacuuuguuaccauccuggaugugaaucugcucggcgucauugacgugacgcugucucuucugccgcucgugagacgggcccgcgggagagucguuaacgugagcuccgugaugggacgggucucucuguucggcgggggauauuguaucagcaaguacggcguggaggcuuuuuccgauagccuucgcagagaacugucuuauuucgggguuaaaguggccaugauugagcccggauacuuuaagaccgcugucacauccaaagaacgguuccucaagagcuuucuggagaucugggacagaucuuccccugaggugaaagaagccuacggcgagaaguucguugcggauuauaagaaaagcgccgaacagauggagcagaagugcacccaggaccugucucucgugacaaauuguauggaacacgcucugaucgccugccauccccgcacccgguacuccgcuggcugggaugccaaacuucuguaucucccuaugagcuacaugcccacguuucuggucgacgccauuauguauuggguguccccuucuccggcuaaggcgcuuuga

SEQ ID NO: 74759 - RNA, 957 nt, Artificial Sequence
  derived and/or modified sequence opt5 from RDH5__Homo_sapiens__NP_002896
auguggcugccccuccugcuuggcgcccugcucugggcugugcuguggcuucugagagaccggcagagccucccugccuccaacgcguucgucuuuaucaccgggugcgauucuggauucggccgccugcuggcucuccaacuggaccagagaggguuucggguucuugccagcugucugacaccguccggagccgaggaucuccagcgcguggcuucuagcagacugcacacgacccuucuggacauuacagauccccaguccgugcaacaggccgcuaagugggucgaaaugcaugugaaagaggccggccucuucgggcugguuaauaacgcgggaguggccggcaucauuggcccuacccccuggcugacacgggacgauuuucagcgcguccucaaugugaacaccauggggccuaucggaguuacacuggcccuucugccccuccugcagcaagcuagaggccgggugauuaauaucaccucuguccuugggcgccuggcugccaacggaggcggguacugcgugagcaaguucggacucgaagcguuuuccgacagccugagacgggauguggcccacuucggcauccgcgucucuauuguugagccuggcuuuuucagaacgccggugaccaaucuggaaucccucgagaaaacacugcaggcuuguugggcccggcuucccccugcuacccaggcccauuaugggggagccuuucugacaaaguaccucaaaaugcagcaacgcaucaugaaccugauuugcgaccccgaucuuaccaaggugagcagaugucuggagcacgcucucacggcgcggcauccuagaacacgcuauucucccggcugggacgccaagcugcuguggcucccggcuuccuaccugccugccagccuugucgaugccgugcugaccuggguucuccccaaaccugcucaggccguguauuga

SEQ ID NO: 74760 - RNA, 996 nt, Artificial Sequence
  derived and/or modified sequence opt5 from RDH8__Homo_sapiens__NP_056540
augaacggccagagccaagugcugcccgggggaggccacgaguccagagaagggaucaauauggccgcugccccucggaccguccucauuucuggaugcagcuccggcaucgggcuggagcuugcgguucagcuggcucaugacccgaagaaacgcuaccaggugguggccacaaugagagaucucggaaagaaagaaacgcuggaggccgcugccggcgaagcucuuggccagacccugacagucgcccaacucgacguguguucugaugagagcguugcgcagugccuguccuguauucagggggagguggacguccuggugaacaaugccggaaugggccucguugggccccuggaaggacuuucucuggcugccaugcagaacguguucgauaccaacuuuuucggcgcuguccggcucgugaaggccgugcugccugggaugaaacgcagacggcaaggacacaucgucguuauuagcuccgugaugggccuucagggcgugaucuuuaaugacgucuaugcggccagcaaguucgcucuggagggguuuuucgaaucucucgccauccagcugcugcaguuuaauauuuucaucucccucguggagcccggaccuguugugacagaguuugaaggcaagcugcuugcucaagucagcauggccgaguuccccgggaccgauccugaaacacugcauuacuuucgcgaccucuaucugccggccucuagaaaacuuuucugcuccgugggacagaacccccaggauguugugcaagcuauugucaaugugaucagcucuacccggccuccccugcgcagacagacgaacauucgguacuccccucucaccacacugaagaccgucgacagcuccggcucucuguaugugcgcacaacccacagacuccuguuucgguguccccgccuucugaaucucgggcugcagugccuuagcuguggaugccugccgacgagaguucggccuagauga

SEQ ID NO: 74761 - RNA, 711 nt, Artificial Sequence
  derived and/or modified sequence opt5 from RDM1__Homo_sapiens__NP_001030008
auggccgagcuggugcccuucgcugucccuaucgaaagcgacaagacccuccugguuugggagcuuuccucuggcccgacagccgaagcgcugcaccauagccucuuuacggcuuucucccaguuugggcugcuuuacucugugagaguguuccccaacgccgccgucgcucacccuggauuuuaugccgugauuaaauucuacagcgcucgggccgcgcaucgcgcccaaaaggcuugcgauagaaaacagcuguuucagaagucccccguuaaagugcggcucggcacccgccacaaggccguccagcaucaagcucuggcccucaauucuagcaagugucaggagcuggcgaacuauuacuucggguuuaauggaugcuccaaaagaaucauuaagcugcaggaacuuagcgaccuggaggagcgggaaaacgaggauucuauggugccucuccccaaacagucccugaaguucuuuugugcccuugaaguugugcugccuagcugcgacugucgcucuccgggcaucgggcucgucgaggagcccauggauaaaguggaagagggaccucuguccuuccugaugaagagaaagacagcucaaaaacucgccauucagaaggcucugagcgacgccuuucagaaacuucugaucgugguccucggcaagaccguucugaucauucuugaagugcugcaguuccaauga

SEQ ID NO: 74762 - RNA, 1815 nt, Artificial Sequence
  derived and/or modified sequence opt5 from RDX__Homo_sapiens__NP_001247421
augcccaagccuaucaacgugagagucaccacaauggacgccgagcuggaguucgcuauucagccgaauacgaccggcaaacaacucuuugaucagguugugaagacaguggggcugcgggaggucugguucuuuggacuucaguacguggacagcaaaggcuauuccaccuggcugaagcucaacaaaaagguuacacagcaagaugugaagaaagaaaauccccugcaguucaaguuucgcgccaaauucuuuccugaggacgucucugaagaacuuauccaggagauuacccagagacuguucuuucuccaagugaaggaagcgauccugaacgaugagauuuacugucccccugaaacagcuguucugcucgccagcuaugccgugcaggcuaaauacggggacuauaauaaggagauccacaagcccggauaccuggccaacgaucggcuucugccucagcgcguccucgagcagcauaaacugaccaaggaacaaugggaggaaagaauccagaauuggcacgaggaacaucggggcaugcuucgcgaggacuccaugauggaguaucugaaaauugcucaggaucucgaaauguacggggugaacuacuucgagaucaagaauaaaaagggaacggaacuguggcugggcguggacgcccucggccugaacauuuaugagcacgaugacaaacuuaccccgaagaucggguuucccuggucugaaauuagaaauaucagcuucaacgauaagaaauuugucauuaagccuaucgacaaaaaggcgcccgacuucguuuucuacgccccucggcugcgcaucaauaaaagaauccucgcucugugcaugggaaaccaugagcuuuauaugcggcgcagaaagcccgauacaaucgaggugcaacagaugaaggcccaggcucgggaagagaaacaccagaagcaacuggaacgcgcccagcucgagaaugagaaaaagaaaagagaaauugcggagaaggaaaaggagcggaucgaaagagagaaagaggaacugauggagcgccugaagcagauugaggaacagaccaucaaagcccaaaaggaacucgaggagcagacacggaaagcucuggaacuugaccaggagagaaagcgcgccaaggaagaggcugaacggcuggagaaagagagacgcgccgccgaagaggcuaaguccgcgaucgccaaacaggcugccgaucaaaugaagaaccaggaacagcucgccgcugagcuggccgaauuuaccgcgaaaauugcccuucuggaggaggcuaagaaaaagaaggaagaggaagccacggaguggcagcacaaagccuucgcugcucaagaggaccucgaaaagacaaaagaggaacugaagaccgugaugucugccccgccucccccucccccucccccggucauucccccuacagagaacgaacaugaugagcacgacgagaauaacgcggaagccagcgcugagcuguccaaugaaggcgugaugaaccaucggagcgaggaagagagaguuaccgagacccagaaaaaugaacgcgugaagaagcagcuccaagcccugucuuccgagcuugcucaggcccgggaugaaacgaaaaagacacagaacgacguccugcacgcggagaaugugaaagccgggagagauaaguacaaaacccuccgccagauucggcaaggaaacacaaagcagagaaucgacgaauuugaggcuauguggggccccaagcuguaugcccuguuccagaugcggagcugccagucuuccauuaaacaaauguga

SEQ ID NO: 74763 - RNA, 1644 nt, Artificial Sequence
  derived and/or modified sequence opt5 from REC8__Homo_sapiens__NP_001041670
auguucuacuaucccaacgugcugcagagacacaccggcugcuuugccacaaucuggcucgcugccacgcgggggagccgccuggucaagagagaguaccuucggguuaauguggugaaaaccugugaagagauucugaacuauguccucgugcgcguucaaccuccgcagcccggacugccuagaccccgguucucccuuuaccugucugcgcagcuccagaucggcgugauucgcgucuauagccaacagugccaguaccugguggaagacauccagcauauucuggagagacuccaccgggcucaacugcagauccgcaucgauauggaaacagagcuuccuucccugcuccugcccaaucaucuugccaugauggagacccuggaagacgccccugauccguuuuucgggaugaugucuguugaccccagacucccuagccccuuugauauuccucagauccggcaccuccuggaggcugccauucccgaacgcguggaggagaucccgccugaaguccccacagagccuagagaacccgagcggauucccgugaccgugcucccuccggaagcuaucacaauucuggaggccgagcccauccgcaugcuugaaaucgagggagaaagagagcugccugaagucucccggagagagcucgaccugcuuauugcggaggaagaggaagccauccugcucgagauuccccgccugccucccccggcuccugccgaaguugagggcaucggggaggcucugggacccgaggaacuccggcugaccggcugggaaccuggcgcccuucugauggaggugacgcccccugaggaacucagacugcccgcgccgccuucucccgagcgccggcccccugugccgcccccucccagacgccggagacgccggagacuucuguucugggauaaggaaacccagauuagcccugagaaauuucaagaacagcuccagacacgcgcccauuguugggagugccccaugguccaaccucccgagcggaccaucagagggccggcugaacuguuccggacaccuacccuguccggauggcugcccccugagcugcuuggccuguggacgcacugugcccagcccccgccuaaggcucuccgcagagaacugcccgaggaagccgccgcugaggaggaacggagaaaaaucgaggugccuagcgaaauugagguuccccgcgaagcgcuggagcccucugugccucuuauggucucccucgagaucagccuggaagccgcugaggaagagaagucucggauuucccugaucccgcccgaggaaagaugggccuggccugagguggaagcccccgaggcuccugcccuccccguugugccugaacugccggagguccccauggagaugccucuugugcugcccccugaacucgagcugcugagccuugaagcgguccaccgcgcuguggcccucgagcugcaggccaacagagaacccgacuuuucuucccugguuagcccgcucuccccucggcgcauggcugccagaguguucuaucugcuucugguccucucugcucagcaaauucugcaugugaagcaggagaaacccuacgggcggcugcuuauccagcccggaccucgcuuucacuga

SEQ ID NO: 74764 - RNA, 2916 nt, Artificial Sequence
  derived and/or modified sequence opt5 from RECK__Homo_sapiens__NP_066934
auggccaccgugagagcuagccugcggggcgcccuccugcuucugcucgcggucgcugggguugccgagguggccggaggccuggcucccggguccgccggagcucuuugcuguaaccacucuaaggacaaucagaugugccgcgaugugugugaacaaaucuucagcuccaaaucugagagcagacugaagcaccuccugcagcgggccccugacuacugcccggaaacaauggucgagauuuggaacuguaugaacuccucucugcccggcguguuuaaaaagagcgauggguggguuggacucggcugcugugaacuggcgaucgcccuugagugccgccaggcuuguaaacaggccuccagcaagaaugacauuucuaaggugugcagaaaagaguaugaaaaugcucuguucuccuguaucagccggaacgagaugggcucugucugcugcuccuacgccgggcaccauacgaauugucgcgaauauugccaagcgauuuuuagaaccgauagcucuccuggacccucccagaucaaggccguggagaacuacugugcuagcaucuccccucagcucauucacugcguuaauaacuauacacagucuuaccccaugcggaauccuaccgacagccuguauuguugcgaucgcgccgaggaccaugcuugucaaaacgccugcaaaagaauccuuauguccaagaaaacagaaauggagauuguggauggccugaucgaaggguguaagacccagccgcucccccaggacccucuguggcagugcuuccuggagagcucucaauccguccaccccggagugacagugcacccucccccgagcaccggccucgauggggccaagcugcauuguugcucuaaagcuaauacgagcacaugccgggaacuuuguaccaagcuguacuccaugucuuggggaaacacccagagcuggcaggaguuugaccgcuucugcgaguacaauccugucgaaguuuccaugcucacaugucuggcggaugugagagagcccugccaacuuggcugucggaaccugaccuauugcacgaacuuuaauaaccgcccuacagaacucuucagaagcuguaaugcccagucugaccagggcgcuaugaacgacaugaaacugugggagaagggguccauuaaaaugcccuuuaucaauauucccgugcuggauaucaagaaaugccagccugaaauguggaaggccaucgccuguagccuccaaauuaagccgugccacucuaaaucccggggaagcaucauuuguaaguccgacugcgucgagauccugaaaaagugcggcgaucagaacaaauuccccgaggaccauaccgcugaaucuauuugugagcuucugagcccuacagaugaccucaagaauugcaucccccuggauaccuaccuuagaccuuccacccuggggaacaucguggaagagguuacacaccccuguaauccgaacccuugccccgccaaugaacucugugaggugaaccgcaagggaugcccuucuggcgaccccugucugccuuauuuuugcguccagggguguaaacugggagaggcgagcgauuucauugugcggcagggcacgcucauccaaguucccuccagcgcuggcgaaguggggugcuacaagauuuguucuugcggacaguccggccugcuugagaauugcauggaaaugcacuguaucgaccugcagaaaagcugcauugucgggggaaagagaaaaucucauggcaccuccuuuagcaucgauuguaacgugugcucuuguuucgccgggaaucucgucugcagcacacgccugugucuguccgagcacagcucugaggacgaccggagaaccuucacaggccuuccgugcaacugugccgaucaguuugugccuguuugcggacaaaacggccgcaccuaucccuccgcuuguaucgcccggugcguggggcuccaggaccaucaguucgaauuuggaagcugcauguccaaggaucccuguaauccuaacccgugccagaagaaucaaagauguauucccaaaccucaggucugccugacgacauucgacaaguuuggcuguucucaguacgagugcgugccccgccaacuggcuugugaucagguucaggacccugugugcgauaccgaccacauggaacauaacaaucucuguacccuguaucagcgggggaaaagccuuuccuacaagggacccugccaaccuuucuguagagccacagagcccgucugcggccacaacggggaaaccuacucuagcgugugcgcggccuauuccgaucgcguggcuguugacuacuauggcgauugucaggccgucggagugcugucugagcacagcuccguggcugagugcgccagcgucaaauguccgucucuccuggcggccggcugcaagccuaucauucccccuggggcuuguugcccccugugugccggaaugcuucgggugcucuuugacaaggaaaaacuggauacaaucgcuaagguuacgaauaaaaagccgauuaccgugcuggagauccuccagaaaauuagaaugcaugucuccgugccucagugcgacguuuucggcuacuuuagcaucgaaucugagaucgugauucugaucauucccgucgaccacuauccuaaggcccuucaaaucgaagccuguaacaaagaggcugagaagauugaaucccugaucaauagcgauucucccacacucgcgucccaugugccccugagcgcccugaucauuucccagguucaggugagcucuagcgucccuuccgcuggggugcgggcccgcccgucuugccacagccuucuccugccccugucccucggacuggcccuucaucugcucuggaccuacaacuga

SEQ ID NO: 74765 - RNA, 1308 nt, Artificial Sequence
  derived and/or modified sequence opt5 from RECQL5__Homo_sapiens__NP_001003715
augagcucccaccauaccacauuccccuuugacccugagagacgggugcgcucuacgcugaagaaagucuucggcuuugauagcuucaagaccccgcuccaggaauccgccacaauggcuguugugaaagggaacaaggacguguuugucugcaugcccaccggagccggcaaaucucuguguuaccaacuuccugcgcugcucgcuaaggggaucacaauugugguuagcccccugaucgcccuuauucaggaucagguggaccaccuucucacccugaaggucagaguguccucucugaauagcaaacucuccgcccaggagcggaaggaacugcuugcugaucuggagcgcgaaaaaccucaaacaaagauccucuauauuacccccgagauggccgcuucuagcuccuuccagccuacgcugaacagccuuguuucuagacaucugcucuccuaccugguggucgacgaggcccacugcgugagccaguggggacaugauuuucggccggacuaucugcgccucggcgcgcugagaucucggcuugggcacgcccccuguguggcucugaccgccacagcuaccccucagguccaagaagauguuuucgccgcgcuccaccugaaaaagcccguggccaucuuuaagacaccuugcuuccgcgcuaaucuguuuuacgacgugcaguucaaagagcugaucuccgaucccuauggaaaccucaaggacuuuugucugaaagcccugggccaggaagcugauaagggccucagcgggugcggaauugucuacuguagaacccgggaggccugcgagcagcuggccaucgaacuuuccugucgcggcgugaaugcuaaagcguaucaugccgggcugaaggcuucugagagaacgcucguucaaaacgacuggauggaagagaaagugccggucauuguggccacaaucagcuucggaaugggcguugacaaggccaaugugcgguucgucgcucacuggaacauugccaaguccauggcgggguacuaccaggaaagcggacgcgcuggcagagauggcaaaccuucuuggugccggcuguauuacuccagaaaugaccgcgaucaggugagcuuucuuauccggaaggaggucgccaaacugcaagagaagagagggaacaaagccucugacaaggcuaccauuauggccuucgaugcucucgugacauuuugugaggaacugggacgcuggggccgggggcauggaaagagccugagagccgcguggugcucccagguugugucucgccacgccgaacucuga

SEQ ID NO: 74766 - RNA, 1950 nt, Artificial Sequence
  derived and/or modified sequence opt5 from RECQL__Homo_sapiens__XP_006719196
auggccagcguguccgcucugaccgaggaacucgacucuaucacaagcgagcugcacgccgucgaaauucagauccaagagcuuacggaaagacagcaggagcugauucagaagaaaaagguucucaccaaaaagaucaaacaaugccuggaggauuccgacgcgggcgcuucuaacgaauacgauagcucccccgccgccuggaauaaggaggacuucccuuggucugggaaggugaaagauauucuucagaacguguuuaagcuggaaaaauuccggccgcuccagcuggagacaaucaaugucaccauggcuggaaaggagguguuucugguuaugcccacaggcgggggaaaaagccucuguuaucagcugccugcccuuugcuccgacggcuucacccuggugaucuguccccucauuagccugauggaagaucaacuuaugguccugaagcagcucgggaucucugcuacaaugcugaacgccuccagcucuaaggagcaugugaaauggguucacgcggaaauggugaauaagaacuccgagcugaaacucauuuacgucaccccugaaaagaucgccaaaagcaagauguuuaugucucgccuggagaaggcuuaugaggccagacgguucacgcgcauugcuguggacgaagugcauugcuguucccaguggggacacgauuuuagacccgacuacaaggcccuuggcauccugaagcggcaguucccuaaugcgagccucauuggccugaccgccacagcuaccaaccauguccuuacagaugcccagaaaauccugugcaucgagaaguguuuuaccuucacggcuuccuuuaaucgcccgaaccucuauuacgaaguuagacagaaacccucuaauacagaggacuucauugaagauaucgugaagcugauuaacgggcgguauaaaggacagagcggcaucauuuacugcuuuucccaaaaggacagcgagcaagugaccgucucucugcagaaucucgggauccacgccggagccuaccacgcuaaccuggagccugaagacaagacaaccgugcaucgcaaaugguccgcgaaugagauccagguuguggucgccaccguggcuuucggcauggggauugauaagcccgacguuagauucgugauccaccauagcaugucuaaaagcauggaaaacuauuaccaagaguccggacgggccggccgcgaugacaugaaggccgauuguauucuuuauuacggcuuuggggacaucuucagaauuucuagcauggucgugauggaaaacgucggacagcagaaacuguaugagaugguguccuacugccagaauaucagcaagugucggcgcguucucauggcucaacacuuugaugagguguggaacucugaagccugcaauaagaugugcgacaacuguugcaaagauuccgcguucgagagaaagaauaucacagaauauugucgggaccugauuaaaauccuuaagcaggcugaggagcugaacgaaaaacucacgccucugaagcugauugauagcuggaugggcaagggggccgccaaacucagagucgcuggagugguugcccccacccugccgcgcgaggaccuugaaaagaucauugcucacuuucugauccagcaguaccucaaagaggacuacucuuucacagccuaugcgaccauuuccuaccugaagaucggcccuaaagccaaucugcuuaacaaugaagcucaugccaucacaaugcaagugaccaagagcacgcagaacuccuuucgggcugagucuagccagacaugccacuccgagcagggggauaaaaagauggaagagaaaaauucuggaaacuuccagaaaaaggccgcgaauaugcuccaacagagcggcuccaaaaacaccggcgccaagaaaagaaagauugacgaugcuuga

SEQ ID NO: 74767 - RNA, 627 nt, Artificial Sequence
  derived and/or modified sequence opt5 from REEP1__Homo_sapiens__NP_001158202
augcagaaggugcugagcaacggccaaaccgaggaagucagauccgggucucggcucaucuucggaacacuguaccccgccuauuacagcuauaaagcuguuaaguccaaagacauuaaggaguacgugaaauggaugauguauuggaucauuuuugcccuuuucacgaccgcggaaacauuuaccgauaucuuccugugcugguuuccuuucuacuaugagcucaagauugcuuuuguggccuggcugcuuucuccguacacaaagggcagcucccugcucuaccgcaaauucguccaccccacccugucuagcaaggaaaaagagaucgacgauugucuggugcaggccaaggacagauccuaugaugcucucguucauuuugggaaacggggacugaauguggccgcuacagccgcggucauggccgcuagcaagggccagggggcccuuucugagcgccugagauccuucagcaugcaggaccucaccacgauccggggagauggcgcuccugcccccucuggcccucccccuccgggguccggacgcgcgagcggcaagcacgggcaacccaaaaugucuagauccgccagcgaauccgcuucuagcuccggaaccgccuga

SEQ ID NO: 74768 - RNA, 765 nt, Artificial Sequence
  derived and/or modified sequence opt5 from REEP2__Homo_sapiens__NP_001258732
auggugagcuggaucauuuccagacuggucguucucaucuucggcacccuguaccccgccuauucuagcuacaaggcugugaaaacaaagaacgugaaagaguaugucaaguggaugauguacuggauuguguuugccuucuuuacgaccgcggaaacacuuaccgacaucguucuguccugguucccuuuuuauuucgagcucaaaauugcuuuugugaucuggcugcuuucuccguacacaaaggggagcuccguccuguaucggaaguucgugcaccccacccucucuaauaaagaaaaggagaucgaugaauacauuacacaggcccgcgacaaaagcuacgagaccaugaugagaguuggaaagcggggccugaaccuggccgcuaaugccgcugugacggccgcggccaaagggcaaggaguccucuccgagaagcugcgcagcuuuucuaugcaggaucuuacccugaucagagacgaagaugcucucccucugcagcggcccgacggccgccuuagaccuucccccgggagccugcucgauacaauugaggaccugggagaugacccugcccugucucuccgguccagcaccaacccggcugauucucgcacagaagccuccgaggacgauaugggcgacaaggcgcccaaaagagccaagccuaucaaaaaggcucccaaagccgagccucuggcuagcaagacccuuaaaacgcggcccaagaagaaaacauccggcgggggagacucugccuga

SEQ ID NO: 74769 - RNA, 768 nt, Artificial Sequence
  derived and/or modified sequence opt5 from REEP3__Homo_sapiens__NP_001001330
auggugagcuggaugaucuccagagccgucguucugguguucggcaugcucuaccccgcuuauuacucuuauaaggccgugaaaaccaagaacgucaaagaguacgugcgguggaugauguauuggauuguuuuugcgcuguacacagugaucgaaacggucgcugaccagaccguggccugguucccucuuuauuacgagcugaagauugccuuuguuaucuggcuccugagcccguacacaaaaggggcuucccuuauuuaucgcaaguuccugcacccccuccugucuagcaaggaaagagagaucgaugacuacaucgugcaagccaaagaacggggauaugagaccauggucaauuuuggccgccaggggcugaaccucgcugccacagcggccgugaccgcugccgugaagucccagggagcuauuacagagagacugcggucuuucagcaugcaugaucuuaccacgauccagggcgacgaaccugucgggcaacgccccuaccagccucugcccgaggccaaaaagaaauccaagccugcgccgagcgaaucugccggauauggcauuccccucaaggauggcgacgagaaaaccgaugaggaagcugaggggccuuacuccgacaaugaaaugcugacacacaagggacuuagacggagccagucuaugaaauccguuaagaccacaaaaggccgcaaggaggugagauaugggagccugaaauacaaggugaagaaacggccccaggucuacuuuuga

SEQ ID NO: 74770 - RNA, 570 nt, Artificial Sequence
  derived and/or modified sequence opt5 from REEP5__Homo_sapiens__NP_005660
augagcgccgcuaugagagagcgguucgaccgcuuucugcacgaaaagaacugcaugaccgaucuccuggccaaacuugaggcgaagacaggcgugaauagauccuucaucgcucugggggucauuggacucguugcccuguaccuuguguuuggcuauggggccucucugcucuguaaccugaucggauucggcuaccccgcuuauauuagcaucaaagccauugaauccccuaauaaggaggacgauacgcaguggcugaccuacuggguggucuaugggguguuuucuaucgcugaguucuuuagcgacaucuuccucuccugguuuccguucuacuauaugcugaaaugcggauuucuucugugguguauggcccccucuccuagcaacggcgcggaacuccuguacaagcggauuauccgccccuucuuucuuaagcaugagucccaaauggauagcguugugaaagaccugaaggauaaagccaaggaaacagcugacgccauuaccaaagaggcuaagaaggccacagucaaucuccugggcgaagagaaaaagucuaccuga

SEQ ID NO: 74771 - RNA, 555 nt, Artificial Sequence
  derived and/or modified sequence opt5 from REEP6__Homo_sapiens__NP_612402
auggacggccugagacagcggguggagcacuuccucgaacaacgcaaccuggucaccgagguucuuggggcccuggaagcuaagacaggaguggagaaaagauaccucgccgcgggcgcugugacgcugcuuagccuguaucuccuguuuggguacggagccucccugcucugcaaucugaucggcuucgucuaucccgccuacgcuucuauuaaggccaucgaaagcccuuccaaagaugacgauaccguguggcuuacauauuggguuguguacgcucuguuugggcucgccgaguucuuuucugaccugcuucugagcugguucccguuuuauuacgucggaaagugugcguuccuccuguuuugcauggcuccccggccuuggaacggcgcccugaugcucuaccagcgcgugguuagaccccuguuccuucggcaucacggcgccguggaucgcauuaugaaugaccuguccgggagagcucucgaugccgcggccggaaucacccggaacgucaaaccuucucagacaccccagccuaaggacaaguga

SEQ ID NO: 74772 - RNA, 501 nt, Artificial Sequence
  derived and/or modified sequence opt5 from REG1A__Homo_sapiens__NP_002900
auggcccagaccagcuccuacuucaugcugaucucuugccucauguuucugagccaaucccagggccaggaggcucagacagaacuuccccaagccagaauuucuuguccugaggggacgaacgcguaucggagcuacugcuauuacuucaaugaagaccgcgagaccuggguggaugcugaccuguauugucagaacaugaacuccggaaaucucgucucuguucugacacaggccgaaggcgccuuuguggcuagccuuaucaaggaguccgggaccgaugacuucaauguguggauuggacugcacgauccgaaaaagaacagacgguggcauuggagcucuggcucccucgucagcuacaaaucuugggggaucggagcccccuccagcgugaauccuggcuauugcguuucucugacauccagcaccggcuuucagaaguggaaagacgugcccugugaggauaaguucuccuuugucugcaaguucaaaaacuga

SEQ ID NO: 74773 - RNA, 501 nt, Artificial Sequence
  derived and/or modified sequence opt5 from REG1B__Homo_sapiens__NP_006498
auggcccagaccaacagcuucuuuaugcugaucuccucucucauguuccugagccuuucccaaggccaggagucucagacagaacugcccaauccuagaauuagcugcccggaggggacgaacgcuuaccgguccuauuguuacuauuuuaaugaagaccccgagaccuggguggaugccgaccucuacugccagaacaugaacucuggaaaucuggucagcguucuuacacaagcggaaggcgcuuucguggccucccugaucaaggagagcucuaccgaugacuccaauguguggauugggcuccacgauccuaaaaagaaccgcagauggcauuggagcucuggaucccuggucagcuauaaaucuugggacacaggcucccccagcuccgccaaugcuggguacugugccucucugaccagcugcuccggauuuaagaaauggaaggaugagagcugugaaaagaaauucucuuuugugugcaaguucaaaaacuga

SEQ ID NO: 74774 - RNA, 528 nt, Artificial Sequence
  derived and/or modified sequence opt5 from REG3A__Homo_sapiens__NP_620355
augcugcccccuauggcccucccgagcguguccuggaugcugcuuucuugccugaugcuccugagccagguccaaggcgaggaaccccagagagagcuuccuuccgcucggauccgcugucccaaggggucuaaagccuacggaagccacugcuaugcgcuguuccucuccccuaagucuuggaccgacgcugaucuggccugucagaaaagacccagcggcaaccugguuuccgugcucagcggggccgaaggaucuuuuguguccagccuggucaagucuauuggcaauuccuacagcuauguguggaucgggcuucaugacccuacacagggaacggagccgaacggcgaaggcugggaguggucuuccagcgauguuaugaauuacuucgcuugggagcggaaccccuccaccauuucuagcccugggcacugcgccucccugagccgcucuacagcuuuucucagauggaaagacuauaauuguaacgugcggcugcccuacgucugcaaguucaccgauuga

SEQ ID NO: 74775 - RNA, 1647 nt, Artificial Sequence
  derived and/or modified sequence opt5 from RELA__Homo_sapiens__NP_001138610
auggacgagcuguucccccucaucuuuccugccgaaccggcucaggccagcggccccuacguggagauuaucgaacaaccuaagcagagagggaugcgguuccgcuauaaaugcgagggaagauccgcgggcucuauucccggggaacggagcaccgauacaacgaagacccacccuacaaucaaaauuaacggauacaccggccccgggacaguccgcaucucccugguuaccaaggacccuccgcauagaccccacccucaugagcuugugggaaaagauugucgggacggcuuuuaugaggcugaacugugccccgaucgcuguauccacucuuuccagaaucucggcauucagugcgugaagaagagagaccuggagcaagccaucagccagcggauucagacaaacaauaacccuuuucaggaggaacaacgcggggauuacgaccuuaaugccgucagacuguguuuccaggugaccguucgggaucccuccggacgcccgcucagacugccucccgugcugucucauccuaucuuugacaaccgggcucccaauacggccgagcucaaaauuugccgcgucaacagaaauagcggcuccugucugggaggagaugaaaucuuccuucugugcgacaaggugcagaaagaggauauugaaguuuauuuuaccggccccgggugggaggcucgggggagcuucucucaggccgacgugcacagacaagucgcgaucguguuucgcacaccuccguacgccgaccccucccuccaggcuccugugcgggucagcaugcagcugagacgccccucugaucgggaacuuuccgagccuauggaguuccaauaucugcccgacaccgaugacagacaccgcaucgaagagaagcggaaaagaacauacgaaaccuuuaagagcauuaugaagaaaucuccguucuccggcccuacggauccccgcccucccccucggagaaucgccguucccagccgcuccucugcuagcgugccgaagccugcgccccagcccuacccuuucacauccagccucucuaccauuaacuaugacgaguuuccgacaaugguguuccccuccggccagaucagccaggccucugcccuggcuccugcucccccucaaguccugccccaggccccugcccccgccccggcuccugcgauggugagcgcccucgcucaggcccccgccccuguucccgugcuggcuccggggccuccccaggccgucgcgccucccgcucccaaaccuacccaagccggagaaggcacccuuuccgaggcccugcuccagcugcaguuugaugacgaggaucuuggggcucugcucggaaauucuacagacccggccguguucacggaucuggcuagcguugacaacuccgaauuucagcaacugcucaaucagggcauucccguggccccucauaccacagagcccaugcugauggaauacccugaggcgaucacccggcuugucacaggggcccagagacccccugacccggcucccgccccucugggagcucccggccucccuaacggccugcuuagcggggaugaagacuucucuuccaucgccgauauggacuuuagcgcgcugcucucucagauuuccagcuga

SEQ ID NO: 74776 - RNA, 1740 nt, Artificial Sequence
  derived and/or modified sequence opt5 from RELB__Homo_sapiens__NP_006500
augcugagaagcggccccgccuccgggccuucugugccgaccggacgggcuaugcccagccgcagagucgcccggccucccgcggcuccugagcucggcgcccuggggucccccgaccuuucuagccugucccucgccguuucucgcagcacagaugaacuggagaucauugacgaauacaucaaggagaacggauucggccuugaugggggacagccuggcccgggcgaagggcugcccagacucgugucccggggagcugccagccugucuacggugacccugggcccugucgcucccccugccacacccccgccuugggggugcccccucggacgccugguguccccugcgcccggccccgggccucaaccgcaccuuguuauuaccgagcagcccaaacagagaggaaugcgguuucgcuaugagugugaaggcagaagcgccggcucuauccugggggaguccagcacagaggcuucuaagacccucccugccauugaacugcgggacugcggaggccuucgcgagguggaagucacagcuugucugguguggaaagauuggccccauagaguucacccucauucccucguggggaaggacugcaccgauggaaucugucggguccgccugagaccccacgugagcccgcggcauuccuucaauaaccugggcauccagugcgugcgcaaaaaggagauugaagccgcgaucgagagaaagauucaacucgggaucgacccuuacaaugccggaucucugaaaaaccaccaggaagucgauaugaauguugugcggauuuguuuucaggcuagcuauagagaccagcaaggccagaugcgccggauggaucccgugcuuuccgagccugucuacgacaagaaaagcacgaacaccucugagcugagaaucugccgcauuaauaaggaauccggccccuguacagggggagaggaacucuaucugcuuugcgauaaagugcagaaggaggacaucagcguuguguucucucgggccagcugggaaggcagagcugacuuuucccaggccgauguccaccgccaaaucgccauuguguucaagaccccucccuacgaggaccuggagaucguugaaccggugacagucaacguguuucuccagcggcugaccgauggggucuguucugagccucugcccuucacguaucuccccagagaccaugauagcuacggaguggacaaaaagcgcaaacggggcaugccugauguucugggggaacuuaauuccagcgacccgcacggcauugagucuaagagacggaaaaagaaacccgcuauccuggaucauuuucucccuaaccacggauccggccccuuccugccucccagcgcgcuucugccugaccccgacuuuuucucugggacagugucccucccgggacuggaaccucccggcgggccugaucugcucgacgauggauuugccuacgaccccaccgcuccgacacuguucaccaugcuugaucugcucccucccgccccuccccacgccagcgcugucgugugcuccggcggggccggcgcgguugugggagagacccccggcccugagccgcugacacuggacucuuaucaggcucccgggccuggagauggcgggacggccagccuugucggauccaauauguuccccaaccauuaccgcgaagccgcuuuuggcgggggccuccugucuccuggacccgaggccaccuga

SEQ ID NO: 74777 - RNA, 1764 nt, Artificial Sequence
  derived and/or modified sequence opt5 from REL__Homo_sapiens__NP_001278675
auggccagcggcgcuuacaaccccuauaucgaaauuaucgaacagccuagacaacgggggaugcgcuucagauacaagugcgagggacgguccgccggcucuauuccgggggaacacagcaccgacaauaaccgcacauaucccuccauccagauuaugaauuacuauggaaaaggcaaggugagaaucacgcuggucaccaaaaacgauccuuacaagccccauccucacgaccucguugggaaagauugucgggacggauauuacgaggcggaauuuggccaggagcgcagaccccuguucuuucagaaucuuggcauccggugcgugaagaagaaagaggugaaggaagcuauuaucacacgcauuaaagccgggaucaacccuuucaaugucccggagaagcaacugaacgauauugaagacugugaucucaaugugguuagacugugcuuucagguguuccuucccgacgagcauggaaaccugaccacagcccucccucccgucgugucuaauccuaucuacgauaaccgggcucccaauaccgccgagcugcgcauuuguagaguuaacaaaaauugcggcagcgugcgcgggggagacgaaaucuuucugcucugugauaagguccagaaggacgauaucgaggugcgguucgugcugaacgacugggaagcuaaaggcaucuuuucccaggccgacguccacagacaaguugcgaucguguucaagacaccgccuuauugcaaagccauuaccgagcccgugacggucaagaugcagcuucggagaccuucugaucaggaagugagcgaguccauggacuuucgcuaccugcccgaugagaaagacaccuaugggaacaaggcuaaaaagcagaagacaacccuccuguuccaaaaacuuugucaggaucauguuaauuuucccgaacggccuagaccgggacugcucggcagcaucggcgaggggcgcuacuucaagaaagaacccaaccuguucucucacgacgccgugguccgggagaugccuacaggaguguccagccaggcugaaucuuauuaccccuccccuggccccauuagcucugggcugucccaccaugccagcauggcgccgcucccuuccucuagcugguccagcguugcccaccccaccccuagaucuggaaauacgaacccccuguccagcuuuucuacacgcacccuuccuagcaauucccaaggcauucccccguuccugcggaucccuguggggaacgaucucaaugcuucuaacgccugcauuuauaauaacgcugacgauaucgucggaauggaggccagcuccaugcccagcgccgaccuguacggcauuucugaucccaauaugcuuuccaacuguagcgugaauaugaugacaaccucuuccgacagcaugggcgagaccgacaacccuagacugcucuccaugaaucuggaaaacccgucuugcaacagcguccuggauccccgcgaccuccggcagcugcaucagauguccucuagcuccaugagcgcuggggccaauucuaacacaacgguguuuguuucccagagcgaugcguucgagggaucugacuuuuccugcgcugauaauagcaugaucaacgaaucuggcccuagcaauuccaccaaccccaauagccacggguucgugcaagacucucaguacuccggaauuggcagcaugcagaacgagcagcuuuccgauucuuuuccuuaugaguucuuucaagucuga

SEQ ID NO: 74778 - RNA, 10383 nt, Artificial Sequence
  derived and/or modified sequence opt5 from RELN__Homo_sapiens__NP_005036
auggaaagaagcggaugggcccggcagaccuuccugcucgcucugcuucugggggccacacuccgcgcgagagcugccgccggauacuauccccgguuuuccccuuucuuuuuccugugcacgcaccacggcgaacuugagggggacggagaacagggcgaggugcugauuucucuccacauugcugggaacccgaccuacuauguccccggacaggaauaccacguuacaaucagcaccuccacauuuuucgauggccugcuggugaccggccucuauacaucuaccagcgugcaggccucccagucuauugggggaagcuccgcuuuuggcuucgggaucaugagcgaccaccaauuuggaaaucaguucauguguucuguuguggccucccacguuagccaucugccuacgaccaaccuuucuuuuauuuggaucgcgcccccugccggcacagggugcgugaauuucauggcuaccgccacacaccgcggacaggucaucuuuaaggaugcucuggcccagcaacucugugagcagggcgcgcccaccgacgugacgguucauccucaccuggccgagauucauuccgauagcaucauucuuagagacgauuucgacucuuaccaccagcugcagcucaacccgaauaucuggguggaaugcaacaauugugagacaggcgaacaaugcggggcuauuaugcacggaaacgccgucaccuucugugagcccuauggcccucgggagcugaucacaaccgggcugaauaccacaacggcuuccgugcuccaguuuagcauuggauccggcucuugccgcuucagcuacuccgaucccagcaucaucgugcuguacgccaagaacaauucugccgacuggauucagcuugaaaagaucagagcuccuuccaacgucagcaccauuauccauauucuguaucuccccgaggaugcgaagggggaaaauguucaauuucaguggaagcaggagaaccugcgggugggagaaguguacgaggccuguugggcucuugacaauauccugaucauuaacucugcccaccgccaggucgugcucgaggauagccuggacccgguugacacaggcaacuggcuguucuuuccuggcgccaccgugaaacauuccugccaaucugaugggaauagcaucuauuuccacggaaacgaaggcuccgaguuuaauuucgcuacaaccagagacgucgaucucagcacggaagacauucaggagcaguggucugaagaguuugagucccagcccacagggugggaugugcugggagccguuaucggcaccgaaugugggaccauugagagcggccuuucuaugguguuccugaaggacggagaacggaagcucugcacaccuuccauggauaccacaggcuacgggaaccugcgcuuuuauuucgucaugggaggcaucugcgaccccgggaauagccaugagaacgauaucauucuuuacgcgaaaaucgaaggaagaaaggagcacauuacgcuggacacccucuccuauucuagcuacaaagugcccucccuggucucugugguuaucaauccugagcugcaaacaccggcuaccaaguuuugucuccggcagaaaaaccaccagggccauaaucgcaacgugugggccgucgauuucuuccacgugcugcccguucuuccuagcacaaugucccauaugauucaguuuagcaucaaucuggggugcggcacccaccaacccggaaacucugugucccucgaguucagcacgaaucacggcagaucuuggucccugcugcauaccgagugucuuccugaaauuugcgccgggccccaccucccgcauagcacagucuacucuagcgagaacuauuccggauggaaucggaucaccaucccucugcccaacgcugcccugacaagaaacacccgcauucgguggagacagacgggcccuauccucgggaauaugugggcuauugacaacguguacaucggacccagcugucugaaguuuugcucuggccgcgggcaguguacacggcacggcugcaagugugacccuggauucuccggccccgccugcgagauggcgagccagaccuuuccgauguucauuuccgaaucuuuugggagcuccagacuuucuagcuaucauaauuucuacuccauccgcggagccgaggugucuuuuggcugugggguucuggcuagcggaaaagcccucgucuucaacaaggauggccggagacaacugaucacauccuuucuggacagcucucagucccgcuuccuucaguuuacccuccggcuggggagcaaaucugugcugucuaccugcagagcuccugaucaacccggcgaaggagugcuccugcacuauagcuacgacaauggcauuacauggaaacuucuggagcacuauagcuaccucuccuaccaugaaccccgcaucauuagcgucgagcugccuggggaugccaaacaguucggaauccaguuccggugguggcagccguaucacuccagccaaagagaggacgugugggcgauugaugaaaucaucaugacgucuguucuguuuaacagcauuucccuugacuucaccaaucucguggaggucacacagucucugggcuuuuaccuggggaacgugcagcccuauugcggacaugauuggacccucuguuucacaggcgacagcaagcuggccuccucuaugcgguacguugaaacccagagcaugcaaaucggcgcuuccuauaugauucaguuuucucuugugauggggugcggacagaaauacacgccucacauggauaaucaggucaagcuggaguauagcacaaaccauggccucaccuggcaccuggugcaagaagagugucugcccuccaugccuagcugccaggaguucaccucugccuccaucuaccacgcuagcgaauuuacacaguggcgcagaguuauugugcuucucccccaaaagaccuggucuuccgccacacgguucagauggagccaguccuacuauacggcccaggacgagugggcucuggauucuaucuacaucgggcagcaauguccuaauaugugcagcggacauggcuccugugaccacgggauuugccgcugugaccagggauaucagggcaccgaaugccaucccgaggcggcccugccgagcacaaucaugucugauuuugaaaaccagaauggcugggaguccgacuggcaagaggucauugggggagaaaucgugaaaccugagcagggcuguggggugauuagcucuggaagcucccucuacuucucuaaggcuggcaaacggcagcuggucagcugggaucuugacaccuccuggguugauuuugugcaguucuauauccaaauugggggagaaucugccagcugcaacaagcccgacuccagagaggagggcgugcugcuccaguacagcaauaacggcgggauccaguggcaucugcuggccgaaauguauuucucugauuuuuccaaaccucgcuucgucuaccuugagcugcccgcugccgcgaagacaccgugcaccagauuucggugguggcagccuguguucagcggagaagacuacgaucaaugggcuguugacgauaucauuauccucuccgagaagcagaaacagauuauccccgugauuaacccuacgcugccccaaaauuuuuaugaaaagcccgccuucgacuacccuaugaaccagaugucugucuggcucaugcuggccaaugagggcauggugaaaaacgagaccuuuugugcugccacaccgagcgcgaugaucuucgggaaguccgauggagaccgcuuugcuguuaccagagaccuuacacugaaacccggcuaugugcuccaguucaagcugaauaucgggugcgccaaccaguuuucuagcaccgccccuguccugcuucaauacucccacgaugcuggaaugagcugguuccuggugaaggaaggcuguuaucccgccucugcuggcaaagggugcgagggaaauucccgggaacucagcgagccuacaauguaccauaccggcgacuuugaagaguggacgcgcauuacaaucguuauucccagaucucuggccuccagcaagacccgguuccgcuggauccaggagucuagcucccagaaaaacgugccuccguucgggcucgauggagucuauauuucugaacccuguccuagcuacugcuccggccacggggacuguaucagcggagugugcuuuugugaucugggcuacaccgcggcccagggcacaugcguguccaauguccccaaccauaaugagauguucgacagauuugaagggaaacuuucuccucugugguauaaaaucaccggagcucaaguuggcacgggguguggaacacucaacgauggcaagagccuguacuucaaugggcccggaaagcgggaggcccgcaccgugccgcuggacacaagaaacauucggcuugugcaguuuuauauccagauuggcuccaaaaccucuggcaucacaugcauuaagccuagaacccgcaaugaagggcugaucguccaguacagcaacgauaacggcauucucuggcaucugcuccgggagcuggacuucauguccuuucuugagccccaaaucaucucuauugaucugccccaggacgcuaaaacgccugccaccgccuucagaugguggcagccccaacauggcaagcacagcgcucagugggcgcuggacgaugugcucaucgggaugaaugacuccagccagacaggauuucaggauaaauucgacggcucuauugaucugcaagccaacugguaucgcauccaagggggacagguugacauugauugccuuuccauggacaccgcucugaucuuuacagaaaauaucggcaagccucgguacgccgagaccugggauuuccacgugagcgccucuacguuucuccaguucgaaauguccaugggcuguagcaaaccguucucuaacucccauagcguccaacugcaguauucccucaauaacgggaaggacuggcaccuggugacagaggagugcguucccccuaccauuggaugucuucauuacacagaaagcucuaucuacaccagcgagagauuucagaauuggaagcgcauuaccguguaucugccccuguccacaaucucuccucggacgagauuccgcuggauucaggcuaacuacaccgucggcgccgauagcugggcgaucgacaaugugguccucgcuuccgggugccccuggauguguucuggacggggcaucugcgaugccgggagaugugugugcgaccggggcuuuggaggcccguauuguguuccuguggucccccugccuagcauucuuaaagacgauuucaacgggaaucugcaccccgaccucuggccugaaguguacggagccgagcgcggcaaccugaauggggaaacaaucaaguccggaaccucucucauuuuuaaaggcgaggggcugagaaugcuuaucagccgggaucuggacugcacaaacaccauguauguucaauucucccugcgcuuuauugcuaagagcacgcccgagagaucucacuccauccuccugcaguucagcauuucuggcggaaucacauggcaucuuauggaugaauuuuacuucccgcagaccaccaauauccuguuuauuaacgugccucuccccuauacagcccagaccaaugcgacacgguucagacuguggcaacccuacaacaacggcaaaaaggaggaaaucuggauugucgacgauuuuaucauugacgggaauaacgugaauaacccugugaugcuccuggauacguucgacuucggaccgcgcgaggauaauugguuuuucuaccccggcgggaacaucggacuuuauuguccuuacuccagcaagggcgcucccgaagaggacuccgccaugguuuuugucucuaaugaggugggggaacacagcaucaccacacgggaucugaacgugaaugagaacaccauuauccaguucgaaauuaaugucggcugcuccacagacuccucuuccgccgacccugugagacuggaguuuagccgcgauuucggagcuaccuggcaucuccugcuuccccugugcuaucacucuagcucccauguuucuagccucuguuccacggaacaccacccuucuagcaccuacuaugccggcacaaugcagggguggcggagagaggugguccauuuuggaaaacugcaccugugcggcuccgugcgcuuccggugguaccaaggguuuuauccggcuggaagccagcccguuaccugggccaucgacaacguguacauuggcccucagugugaggaaaugugcaauggccaggggucuuguaucaacggaacaaagugcaucugugaucccggcuacuccgggccuaccugcaaaauuagcacaaagaaucccgacuuccucaaagaugacuuugagggacaacuugaauccgauagauuccugcugaugucuggcgggaagccgagccgcaaguguggaauccucuccucuggcaacaaccuguuuuucaaugaggacggccuuagaaugcugaugacgcgggaucucgaccugagccaugcgcgcuucguccaguuuuucaugagacuggggugcggaaaaggcgugccugauccccggucccagcccguucuccuucaguauagccugaacgggggacugucuuggucccuccugcaagaguuucuuuucagcaauucuuccaacgugggccgcuacauugcccuggaaaucccucucaaggcuagaagcgggucuacccggcugagaugguggcagcccuccgagaauggacacuuuuauagcccuugggucauugaccagauccugauuggcggcaacaucucugggaauacagugcucgaagacgauuucaccacccuugacagccgcaaauggcugcugcacccgggaggcacaaagaugcccguguguggguccacgggagaugcccucgucuuuaucgagaaagcuagcacccgguacguuguguccacagacguggccgucaacgaagauucuuuccugcagauugacuuugccgcuagcugcuccgugaccgauucuugcuaugcgaucgagcuugaguacagcguugaccugggccucuccuggcauccucuggugagagauugucugcccacaaaugucgaaugcucucgcuaucaccuccaacggauucuugugagcgacaccuucaacaaguggacgagaaucacacugccucugcccccguacacccggucccaggccacccgcuuuagauggcaucagccugcucccuucgauaagcaacagacaugggccauugacaauguuuacaucggggauggauguaucgacaugugcagcggccacggccgguguauucaggggaacugcgugugugacgagcaguggggaggccucuauugcgaugacccugaaaccucucugcccacacaacuuaaagauaauuuuaaccgcgccccuuccagccagaauuggcugaccgucaacgggggaaagcucucuacgguguguggcgcugucgccuccgggauggcgcugcauuucagcggaggcugcucuagacugcucgugacaguugaccuuaaccugaccaaugcugaguucauccaguuuuacuucauguauggcugucugauuacacccaacaaucggaaccagggggugcuccuggaauacuccgugaauggaggcaucaccuggaaccuucugauggagaucuuuuaugaucaauacagcaaaccgggguucgucaauauccuccugccucccgacgccaaggagaucgccacgcgcuuuagaugguggcagccccggcacgauggacuggaccagaacgauugggcuauugacaauguucucaucucuggcuccgccgaucagcgcaccgugaugcuugacacauucagcagcgcgccugugccgcaacacgaaagaucccccgccgacgcugggccugucggacggauugccuuugauauguucauggaggacaaaaccucugugaacgaacauuggcuguuucacgaugacugcacaguugagagauucugugauagccccgacggcgugaugcugugcggcucccaugaugggcgcgaagucuaugcugugacccacgaccucacaccuaccgagggauggaucaugcaguuuaagauuucugucggcugcaaagugagcgagaagaucgcccagaaucaaauucauguucaguacuccacggauuucggggugucuuggaacuaccuggucccccagugucuuccugcugaccccaagugcagcggauccgugagccagccgucugucuuuuucccuacaaaaggcuggaagcggaucaccuauccccugccugaaucccucguggggaaucccgucagauuccgcuuuuaccaaaaauauagcgauaugcagugggccaucgacaacuucuaccugggaccgggcugucuggauaauugccggggccacggggacugucucagagagcagugcauuugugacccuggauauucuggccccaacugcuaccuuacccacacacugaagaccuuucugaaagaacgcuucgauuccgaggagaucaagcccgaccucuggaugagccuggaagggggauccacauguacggagugcggcauucuugcggaagauaccgcccuguauuuugggggcucuacagugcggcaggcugugacccaagaccucgaucugagaggagccaaguuccugcaguacuggggccgcaucgggagcgagaacaauaugacauccugucaucggccuauuugcagaaaagaaggaguucuccuugacuacucuaccgauggcgggaucacguggacccugcugcacgagauggacuaucagaaguacaucagcguccgccaugauuauauucuccugcccgaggacgcucuuacaaacaccacacggcugagaugguggcagccuuuugugaucuccaauggaauuguggucagcggcguugaacgcgcccaaugggcccucgauaacauccugauugggggcgcugagaucaauccgucucagcugguggacaccuucgaugacgaaggaacgucccacgaggaaaacuggagcuuuuaccccaaugcggugagaacagccggcuucugcgggaacccuucuuuucaccucuauuggcccaauaaaaagaaagacaagacccauaacgcucuuagcucccgggagcugaucauucagccuggauacaugaugcaguucaagaucgucgugggcugugaggccacaucuugcggggaucugcacagcguuaugcucgaauauaccaaagacgcccgcuccgauagcuggcaacuggugcagacccagugucuucccucuuccagcaauuccauuggaugcucuccuuuccaauuucaugaggcuacaaucuacaacagcgucaauuccucuagcuggaagagaauuacgauccagcugccggaccacguguccucuagcgccacccaguuccgguggauccagaaaggcgaagagacagaaaagcaauccugggcgauugaucauguuuacaucggggaggccugucccaaacucugcagcggccacggauauuguaccacaggcgcuauuugcaucugugacgagucuuuucagggggaugacugcuccguguucagccacgaucugccuucuuacauuaaggacaacuuugaauccgccagagucaccgaggcuaauugggaaacgauccagggaggcgugauugggagcggauguggccagcuggcccccuaugcgcauggggauucucucuacuucaacggcugccaaauccggcaggccgcuacaaagccucuggaccuuacccgcgccagcaaaaucauguuugugcugcagauuggauccaugagccagaccgacuccugcaacucugaucucagcggcccccacgcugucgacaaggccguucugcuucaauauuccgugaauaacgggaucacauggcaugugauugcucagcaccagccgaaagauuucacccaagcccagagagucucuuacaaugugccucuggaggcgcggaugaagggaguucuccugcgcugguggcagcccagacacaacggcacagggcaugaccagugggcccuggaucacguggaggucgugcucguuagcacgcggaaacaaaauuauaugaugaacuuuucccgccagcauggacugagacacuucuacaaucggcgcagacggucucuucgcagauaccccuga

SEQ ID NO: 74779 - RNA, 897 nt, Artificial Sequence
  derived and/or modified sequence opt5 from REM1__Homo_sapiens__NP_054731
augacccugaacacagagcaggaagccaagacgccccuccacagacgggcuagcaccccucugccgcuuucuccccgcggccaucaaccugggagacuguccacagugcccagcacccagucccagcacccucggcucggacagucugccagccugaaucccccuacacaaaaaccgucccccgcgccugacgauuggucuagcgaguccagcgacucugaaggcuccugggaggcucuuuaccgcgucguucugcucggggaucccggagugggcaagaccagccuggccucucuguucgccgggaaacaggaaagagaccuccaugagcagcugggagaggauguguaugaacggacacuuaccgucgacggcgaggauacgacccuggugguuguggacacaugggaagcugagaagcucgauaaauccuggagccaggagucuugccugcaaggcggguccgccuacgucaucguguauagcauugcugaccgcggauccuuugaaucugccagcgagcuuagaauccagcugcggcgcacccaccaggcggaucauguuccuauuauccucgugggcaacaaggccgaccuggcuagaugucgggaagucuccguggaggaagggcgcgccugcgcuguggucuucgauuguaaguuuauugagacaagcgccacccugcagcacaauguugcggaacucuucgagggaguggugagacaacugcggcuucgcagacgggacucugccgcuaaagagcccccggccccuagacgccccgcuucccuggcccagcgggccagacgcuuucucgcucggcugacggcgagaagcgcccgccggagagcucuuaaggcccgcucuaaaagcugccacaaccuggccguccucuga

SEQ ID NO: 74780 - RNA, 1284 nt, Artificial Sequence
  derived and/or modified sequence opt5 from RENBP__Homo_sapiens__NP_002901
augagcaagggccugcccgccagacaggacauggagaaagaacgggagacccuccaggcuuggaaggaacgcguggggcaagagcuggauagagucguugccuucuggauggaacacucccaugaccaggagcacggaggcuuuuucacaugccuugggcgggagggacgcguguacgaugaccugaaauauguguggcuccagggcagacaagucuggauguacugucggcuguaucgcacguuugaaagauuccggcaugcgcagcuucuggaugcugccaaggccgggggagaguuucuccugcgcuacgcuagaguggccccuccgggcaaaaagugcgcuuucguucugacccgggacggccgccccgugaagguccagagaacaaucuuuucugaauguuucuauaccauggccaugaacgagcucuggcgggcgacaggggaggugcgcuaccagaccgaagccguugagaugauggaucaaauugugcacuggguccaggaagacgcuagcggacugggcagaccucagcuucagggggcccccgcugccgagccuauggcggugcccaugaugcugcucaaucugguggaacaacuuggagaggccgaugaggaacuggcuggcaaauaugccgagcucggggacuggugcgcucggagaauccugcagcauguccagcgcgauggacaagccguucuggaaaacguguccgagggcggcaaggaacucccugggugucugggacggcagcagaauccgggccacacacuugaggccgggugguuucugcucagacacugcauucgcaaaggagaccccgagcugcgggcucaugugaucgauaaguuccuucugcucccuuuucacucuggcugggaccccgaccaugggggacuguucuacuuucaggaugcggacaacuucuguccuacccaacuggaaugggccaugaaacucugguggccccacagcgaggcuaugauugccuuccugaugggcuacuccgauucuggcgacccgguccuucugagacucuuuuaucagguggccgaauacacguuccgccaguuucgggauccugaguauggggaaugguucggauaccugagcagagagggcaagguugcucuuuccaucaaagggggacccuuuaagggcugcuuccacgugccucgcugucuggccaugugcgaggaaaugcucggggcgcugcugagccggcccgcucccgccccuucuccggcccccaccccugcuuguagaggcgccgaguga

SEQ ID NO: 74781 - RNA, 1221 nt, Artificial Sequence
  derived and/or modified sequence opt5 from REN__Homo_sapiens__NP_000528
auggacggcuggagacggaugccccgcugggggcugcuccugcuucuguggggaagcugcaccuucggccucccuacagauacgaccacauuuaagagaaucuuccugaaacggaugccguccauucgcgagucucuuaaggaaagagggguggacauggcccggcugggacccgaguggagccagccuaugaaacgccucacccugggcaacacaaccuccucugucauccugacaaauuacauggauacccaauauuacggggaaauuggaaucggcacgcccccucagaccuuuaagguuguguucgacacaggcagcuccaacguguggguccccucuagcaaauguuccagacucuauaccgcuugcguguaccacaagcuguuugaugccagcgacucuuccagcuauaagcauaaugggacagagcuuacccugcgguacucuacgggaacaguuuccggcuuccucagccaggauauuaucaccgucgggggaaucacagugacccagauguuuggcgaagugaccgagaugccugcgcugccguucaugcuugcugaguuugacgggguugugggaaugggcuucauugaacaagccaucggccgcgucacacccauuuuugauaacaucauuucucagggggugcugaaagaggacguguucuccuuuuauuacaauagagauagcgaaaacucccagucucucggaggccagaucguccucgggggaagcgacccucaacacuacgagggcaauuuccauuauauuaaccugaucaagacggggguuuggcagauccagaugaaaggaguguccgugggcagcucuacccugcugugugaggauggcugccuugcccuggucgacacaggggcuuccuacauuagcggaucuaccagcuccaucgaaaagcucauggaggcccugggcgcuaaaaagcggcuuuucgacuaugugguuaaguguaaugaagggcccacacugccugauauuucuuuucaccucggaggcaaagaguacacccugacgagcgccgacuauguguuccaggaauccuacagcucuaagaaacugugcacacucgcgauccaugccauggauauucccccgccuaccgggcccaccugggcucugggcgccacauuuauccgcaaguucuauaccgaguuugacagacggaacaaucgcaucggauucgcucuugccagauga

SEQ ID NO: 74782 - RNA, 2310 nt, Artificial Sequence
  derived and/or modified sequence opt5 from REPS1__Homo_sapiens__NP_001122089
auggagggccugacccucagcgacgccgaacagaaguacuauuccgaucuguucucuuacugcgacaucgagagcacaaagaagguggucguuaacgggagagugcuugaacuguuucgggcugcccaacuccccaaugaugugguccugcagauuauggagcuuuguggagcgacgcgccugggcuauuucgggagaucccaguuuuacaucgcucucaaacugguggccguugcccagucuggauucccucugcggguggaaagcauuaacaccgucaaggaccucccgcugccccgcuuuguggcuuccaaaaaugagcaagagucuagacacgccgcuagcuauuccagcgauucugaaaaccagggcuccuacagcgggguuaucccucccccucccggacggggccaggugaagaagggcucugucucccaugacacagugcagccucgcaccagcgccgaugcgcaagagccggccucucccguggucuccccucagcagagcccucccacaagcccccacaccuggagaaaacauucucggcacccgagcgggggaaauuccgaacgcccucuugcuggccccgggccuuucuggagccccuuuggagaggcccagucuggcuccagcgcuggggacgccguuuggucuggacauagcccucccccgccccaagagaacuggguguccuucgcggauacaccucccaccucuacgcugcucaccaugcacccugccagcgugcaggaccagacaaccgucagaacaguggcuuccgccaccacggcuauugaaauccggcgccaauccucuuccuaugaugaccccuggaagaucacagaugagcagagacaguacuacguuaaucaguuuaaaaccauucaaccggaccugaacggcuucaucccuggcagcgccgccaaggaauuuuucacaaaaucuaaacuucccauucuggagcucucccacaucugggaacugagcgacuuugauaaggacggggcucugacccucgaugaguucugcgcggccuuccaucugguggucgcucggaaaaauggauaugaccuuccugagaagcugcccgaaucccucaugccuaaacugauugaucuugaggacucugccgaugugggcgaccagcccggggaaguuggauacagcggcuccccggccgaggcuccucccucuaagagccccuccaugccuagccugaaccagaccuggccggaacucaaucagucuuccgaggauacagccaucgugcaccccgucccuauucgcaugacgcccagcaaaauccauaugcaagagauggaacugaagagaaccgggucugaccacacaaacccuaccagcccccugcucgugaaaccuagcgaucugcuugaggaaaauaagaucaacucuagcgucaaguuugcguccggaaauacaguggcugacggcuauuccucuuccgacagcuucaccuccgaucccgagcagauuggcucuaacguuacgcggcagagaagccacuccgggacaucuccggacaacaccgccccucccccucccccgccucgcccccagccuagccauucccggucuagcucccuggauaugaauagaaccuuuacagugaccacaggacaacagcaggccggcgucguggcucacccucccgccguucccccgcgcccccagccuagccaagcucccgggccugccgugcaucggcccgucgacgcggauggacucaucacgcacaccucuacauccccucagcagauuccggaacaacccaacuucgccgacuuuagccaguucgagguguuugcugccucuaaugugaacgaugagcaggacgaugaagcugagaaacauccugaaguucugcccgccgagaaggcguccgacccugccagcucucuuagagucgcuaaaaccgauuccaagacagaggagaaaaccgccgcuagcgcccccgccaauguguccaagggcacgaccccgcuggcuccuccucccaagcccgugcgccggagacucaaaagcgaagacgaacugcgccccgaggucgaugaacacacacagaagaccggggugcuggcggccguucucgcuucucaaccuagcaucccgcgguccgugggcaaagacaagaaagccauucaggccucuaucagacgcaacaaggagacaaauaccguccuggcucggcuuaacagcgagcugcagcagcaacucaaggacgugcuggaagagagaaucucccuggaaguucagcuugagcagcuccggcccuucucucaccuguga

SEQ ID NO: 74783 - RNA, 1980 nt, Artificial Sequence
  derived and/or modified sequence opt5 from REPS2__Homo_sapiens__NP_001074444
auggaggccgcugccgcggcugccgccgcugccgcugccgcggccgcugccggcgggggaugcggcagcgggcccccuccgcugcuccuguccgaaggagagcagcaauguuacucugaacuuuucgcuagaugcgccggcgcggccgggggaggccccggcagcgggccucccgaggcugcccggguggcuccuggaaccgccacagccgcugcgggccccgucgccgaccuguuucgcgcuucccagcucccugccgaaacgcugcaccagaucaccgagcuuuguggggccaagagaguuggauauuucggcccgacacaguuuuacauugcucugaaacucaucgccgcggcucaaucugggcugcccgugcggauugagagcaucaagugcgaacugccucucccccgcuucaugauguccaaaaacgauggagagauuagauuuggcaauccugccgaacugcauggcaccaaggugcagauccccuaucuuacaaccgagaaaaacucuuucaagcggauggacgaugaggacaagcaggaaacacagagcccgaccauguccccucuggccucucccccuagcuccccuccccacuaccaacgcgucccccucagccauggguauucuaaacugagauccagcgcugagcagaugcacccggcccccuacgaagcucggcagccucuugugcagcccgagggaucuuccagcggcgggccuggaacgaagccccugcgccaucaagccucccucaucagaucuuuuagcguugaacgggagcugcaggauaauuccagcuauccggacgagccuuggcgcauuaccgaggaacagagagaauacuacgugaaccaauuccggucucugcagcccgauccuuccagcuuuaucucuggcagcgucgcgaaaaauuucuuuacaaaguccaaacucucuauucccgagcugagcuauaucugggaacuuuccgacgccgauugugacggggcucugacccucccugaguucugcgccgcuuuucaccugauuguggcccgcaagaacggauacccccuuccggagggccugccucccacacuccagcccgaauaucugcaggcggccuucccuaagccgaaaugggauugucaacuguucgacagcuacucugagucccuccccgcuaaucagcagccuagagaucugaaccggauggaaaagaccagcguuaaagacauggccgaccuucccgugccuaaucaggaugucacgucugacgauaagcaagcucugaaauccacaaucaacgaggcccuccccaaggacgugagcgaagauccugccacccccaaagacuccaauucucugaaggcuagaccgcgcagccgguccuauucuagcacauccauugaggaggcgaugaagagaggcgaagauccucccaccccucccccgcgcccucagaaaacccacagccgggccucuucccuugaccugaacaagguguuucagcccagcgucccugcuacaaaaucugggcuccugcccccucccccggcccugcccccuagacccugcccuucccagagcgagcaaguuucugaagccgagcuccugccccagcuuagccgcgcuccuucccaggccgcggagagcucuccggcuaagaaagaugugcuguacucccagcccccuagcaagcccauccggagaaaguuccgcccugaaaaucaagccacggagaaccaggaacccuccaccgccgcuucuggaccggccagcgcggcuacaaugaaaccucaucccaccgugcagaagcaauccucuaaacagaagaaagccauccagacagccauucggaagaauaaggaggcuaacgccguccucgcuagacugaacagcgaacugcagcaacagcuuaaagaggugcaccaggagcgcaucgcccucgaaaaucagcuggagcaacugcggcccguuaccgugcucuga

SEQ ID NO: 74784 - RNA, 543 nt, Artificial Sequence
  derived and/or modified sequence opt5 from RERG__Homo_sapiens__NP_001177655
auggccaagagcgcugaggugaaacuggccaucuucggcagagcgggggucggaaaguccgaaucuaccuaccggcaccaggcuacaauugacgaugagguugugagcauggaaauccucgacacggccggccaagaggauaccauucagcgcgaagggcauaugagauggggagagggcuuugugcuggucuaugacaucacagaucggggguccuucgaggaagugcuuccccugaaaaacauucucgacgagaucaagaaaccuaagaauguuacccugauccuugugggaaacaaggccgaucuggaccacucucgccaggucagcacagaagagggcgagaaacucgcuaccgaacuggccugcgcuuuuuacgaguguuccgccugcacaggcgaagggaauauuaccgagaucuucuaugaacuguguagagaggugcggcgcagacggaugguucagggaaagacgcgcagacggucuagcaccacacaugugaaacaagcgauuaacaagaugcucaccaaaaucuccagcuga

SEQ ID NO: 74785 - RNA, 618 nt, Artificial Sequence
  derived and/or modified sequence opt5 from RERGL__Homo_sapiens__NP_079006
augagcaacuuccugcaccucaaguacaaugagaaauccgugucugucaccaaggcccugacaguuagauuucuuacgaaacgguucaucggcgaauaugcuagcaacuuugaguccauuuacaagaaacaucugugccucgaacgcaagcagcugaaucuugagaucuaugaccccuguucucaaacccagaaggccaaauucagccugacauccgaacuccacugggcggauggguuugugauuguguacgacaucucugauagaagcuccuucgcuuuugccaaggcccugauuuaucggauccgcgagccucagaccagccauugcaaaagagcugucgagucugccguguuccugguuggaaacaagcgggaccucugucacgugcgcgaagucggcugggaggaagggcagaaacuggcucuugagaauagaugccaauuuugugagcuguccgccgcggaacagagccucgagguggaaaugauguucauccggauuaucaaggauauucugaucaacuuuaaacuuaaggagaagcgcagaccgucuggauccaaaagcauggccaagcugauuaauaacguuuucggcaaacggcgcaagucuguguga

SEQ ID NO: 74786 - RNA, 3294 nt, Artificial Sequence
  derived and/or modified sequence opt5 from REST__Homo_sapiens__NP_001180437
auggccacccaggugaugggccaaagcuccgggggaggcgggcuguucacaucuagcggaaacaucggcauggcucuccccaaugacauguacgaucugcacgaccuuuccaaggccgagcuggcggcuccucagcucauuaugcuggccaacgucgcccuuacgggggaaguuaauggaucuugcugugauuaucuggugggcgaggaaagacagauggcugagcucaugccggugggcgacaacaauuuuagcgauuccgaagagggggagggacuggaagagucugccgacaucaaaggcgaaccccaugggcuggagaacauggagcuccggagccuggaacuuuccgucguggagccucagcccguuuucgaagcuagcggagccccugauauuuacucuuccaauaaggaccugcccccugagaccccgggcgcggaagauaaaggaaagagcucuaaaacaaagcccuuucgcugcaagccuugucaauaugaggccgaguccgaggaacaguucgugcaccauaucagaguccacagcgcuaaaaaguuuuucguggaagagucugccgaaaaacaggcuaaggcccgggaguccgggagcuccaccgcggaggaaggcgacuuuucuaaaggccccauucgcugcgauagauguggguacaacacaaaucgguaugaccauuacaccgcccaccucaagcaccauacacgcgcuggagauaacgagagaguuuauaagugcaucaucuguaccuacacgaccgugagcgaauaccacuggcggaaacaucugcgcaaucacuucccuagaaaggucuauacaugcggcaaauguaacuacuuuuccgaccggaagaauaacuaugugcagcacgugcgcacccauacaggggagagacccuacaaaugcgaacuuuguccguauuccucuucccaaaagacccaccugacgcggcauaugcgcacacacagcggagagaaaccuuucaagugcgaccagugcucuuacgucgccagcaaucagcaugagguuaccagacacgcuagacaggugcacaacggccccaagccucucaacuguccccauugcgauuauaaaacagccgacagauccaauuuuaagaaacacguggaacugcaugucaacccccgccaauucaauuguccugugugcgauuacgccgcuucuaagaaauguaaccugcaguaccacuuuaagagcaagcacccgaccugccccaauaaaaccauggacguuuccaaggugaaacucaagaaaacaaagaagcgggaggcggaucugccugacaacauuacgaaugagaaaaccgaaaucgagcagacaaagauuaaaggggaugucgccggaaagaaaaacgaaaagagcgugaaggcugagaaaagagacguuucuaaggagaaaaagcccuccaauaacgugagcgucauccaagugaccacacgcacccggaaaucugucacggaagugaaggaaauggauguucauacaggcuccaauagcgagaaauucuccaagaccaagaaaucuaagagaaaacuugagguggacagccacucccugcauggcccugucaacgaugaagagucuagcaccaagaaaaagaagaaaguggaauccaagagcaaaaauaacucucaggagguucccaagggggacuccaaaguggaagagaauaagaagcagaacacauguaugaaaaagagcaccaaaaagaaaacacucaagaacaagucuuccaaaaagagcucuaaaccgccucagaaggagcccgucgaaaaaggaagcgcccaaauggacccuccccagaugggcccugcccccacggaggcugugcagaaggggccggugcagguugaaccucccccucccauggagcacgcccaaauggaaggagcgcagauucgcccggcucccgaugagccuguccagauggagguggugcaggaaggccccgcccaaaaagagcugcuuccucccgucgaaccugcccagauggugggggcucagaucguucuggcccauauggagcugcccccgccuauggagaccgcucagacagaaguggcccaaaugggccccgcgccuauggagcccgcccagauggaagucgcucagguggaguccgccccgaugcaaguugugcagaaggaaccuguccagauggagcucagcccucccauggaggugguucagaaggaacccgugcaaauugagcugucucccccuauggaagucgugcagaaagagccggugaagaucgaacucagcccucccaucgaggucguucagaaagagcccgugcagauggaacugagcccucccaugggagugguccaaaaggagccugcucagcgggaaccgcccccucccagagagccuccccuucacauggaaccgauuuccaaaaagccuccccugcgcaaggacaaaaaggagaaaucuaauaugcagagcgagcgggccagaaaggaacaggugcucaucgagguuggccuggugcccgucaaagauuccuggcuucugaaggaaucugugagcaccgaggaccucuccccucccucuccuccgcugcccaaggagaaccugcgcgaagaggcgagcggggaucaaaaacuccugaauacaggagaaggcaacaaggaggccccucuucagaaaguuggggcugaagaggccgacgagucccugcccggacucgcugccaauauuaacgaaagcacccacaucucuuccagcggccagaaucugaacacgccugagggggaaacccugaauggcaagcaucaaacagauucuauugugugcgagaugaaaauggacaccgaucagaacacacgggaaaaucuuaccggaaucaacuccacggucgaggagcccgugagcccgaugcucccucccucugccguugaagagagagaagcuguguccaagacagcgcuggccagcccucccgcuaccauggccgccaaugagucccaggaaaucgacgaggaugagggcauucacagccaugaagggucugaccugagcgauaacauguccgagggaucugacgacagcggccuccacggggcucggccugucccccaggaauccucucgcaagaaugccaaagaggcgcuggcugugaaggccgccaaaggagauuucguguguaucuuuugcgaccggagcuuccggaagggcaaagauuauuccaagcaucuuaacagacaccuggucaacguuuacuaucucgaggaagcugcccaagggcaggaguga

SEQ ID NO: 74787 - RNA, 3219 nt, Artificial Sequence
  derived and/or modified sequence opt5 from RET__Homo_sapiens__NP_065681
auggccaaggcuaccagcggcgccgcggggcugagacuccugcuucugcuccugcuuccccugcucggaaaaguggcucugggccuguacuucucccgggacgccuauugggagaagcucuacgucgaucaggccgcugggacaccucugcuuuauguucacgcccugcgcgacgcuccggaagaggugcccucuuuuagacucggacaacaucuguacggcacguaucggacccgccuucacgaaaacaauuggaucugcauucaggaggauacagggcugcucuaccugaacagaagccuggaccauuccucuugggaaaaacucagcgugcggaaucgcggauucccucugcuuaccgucuaucugaagguguuucucucccccacaucucugagagagggcgagugucaguggccuggcugcgcccggguuuacuucagcuuuuucaacaccuccuuucccgcguguagcucucuuaaaccucgcgaacugugcuucccggagacaagacccuccuuucggauccgcgaaaauagaccucccgggaccuuccaccaguuucggcuccugccugugcaauuccugugucccaacauuagcgucgccuaccgccuccuggagggagagggccuuccguuuagaugcgcuccugauucucuggaaguguccacgcggugggcccucgacagagagcagcgcgaaaaguaugagcugguugcuguguguaccguccaugccggggcgcgggaagagguggugaugguccccuucccuguuacaguguacgaugaggacgauagcgcccccaccuuccccgcuggaguggacacagccucugcugucguggaauuuaagagaaaagaggauaccguuguggccacgcuucgcgucuucgacgccgaugugguuccugcuuccggcgaacuggugcggagauauacaagcacccuccugccgggggacacaugggcgcagcagaccuuucgcgucgagcacuggcccaaugaaaccuccgugcaagccaacggaucuuucguccgggcuacagugcacgacuacagacugguucucaaucgcaaccugagcaucuccgagaaucggacgaugcagcuugccgugcuggucaacgauagcgacuuucagggcccuggcgccggggugcuccugcugcauuucaauguuucugugcuucccgucucccuccaucugccuagcaccuauucucugagcguguccagacgcgcucggagauuugcccagauuggaaaggugugcguugagaacugucaagcguucucuggcaucaauguccaguacaaacuccacagcuccggggcuaacugcagcacacugggaguggugaccucugccgaagauacauccggcauccuuuuugucaacgacaccaaggcccugcggcgccccaaaugugcugagcuccacuauauggugguugccacggaucagcaaacaagcagacaggcucaggcccagcugcuggugaccgucgaagggucuuacguggcggaggaagccggaugcccgcuuuccugcgcuguuagcaagcggagacucgagugugaggaaugcggcggccugggguccccuaccggacgcugugaguggcggcaaggcgacgggaagggaauuacaagaaauuucucuaccugcagccccuccacaaaaacguguccugauggccacugcgacguggucgaaacccaggauaucaacauuuguccccaggacugccugcgcgggucuaucgugggcggacaugagccuggcgagcccagagggauuaaggccggauacggcacauguaauugcuuuccggaagaggaaaaauguuucugcgagccugaagauauccaggacccccucugcgacgagcugugucggaccguuauugcugccgcggugcuuuuuagcuucaucgucuccgugcugcucagcgccuucugcauccacuguuaucauaaguuugcucacaaacccccuauuucuuccgccgagaugacauuccgcagaccggcucaagccuuucccgugagcuacucuuccagcggggcccggcgcccuucucuggauagcauggaaaaccaggucuccguugacgcuuucaagauccuggaggaucccaaaugggaauuuccuagaaagaaucuugugcucggaaagacccugggcgagggggaguucggcaaaguggucaaggcgacggccuuucaucugaaaggacgggcuggcuauaccacaguggccguuaagaugcucaaagaaaacgccagccccucugagcugcgcgaccuucuguccgaguucaaugugcucaagcaggucaaccacccucacgugauuaagcuguacggggcuugcagccaggauggaccccugcuucucaucguugaauaugccaaauacggcucccugagaggguuucugcgggaaucucgcaaggugggaccgggcuaucucgggagcggcggauccagaaauucuagcucccuggaccauccugaugagcgggcgcuuaccaugggcgaccugauuucuuucgcuuggcaaaucagccaggggaugcaguaccucgccgaaaugaaacugguccacagagaucuggccgcucgcaacauccuuguggccgagggacggaagaugaaaauuuccgacuuuggccugagcagagauguuuacgaggaagacucuuaugugaagcgcucccaggggcggauccccgucaaguggauggcgauugagagccucuucgaucauaucuacacaacccaaucugacgugugguccuuuggagugcugcucugggaaauugucacgcugggcgggaauccuuaucccggcaucccgccugagagacuuuucaaccugcucaaaacaggacaccgcauggagcggcccgacaauuguagcgaagagauguacagacugaugcugcagugcuggaagcaggaaccugauaaacgccccguuuucgcugacaucucuaaggaucuugagaaaaugauggugaagcggagagacuaucuggaucucgccgccuccacccccagcgacucccugauuuacgaugacggccucagcgaagaggagacaccucugguggauuguaacaaugcuccgcuuccccgggcccugccuucuaccuggaucgaaaacaagcucuaugggcgcauuagccacgcuuuuaccagauucuga

SEQ ID NO: 74788 - RNA, 327 nt, Artificial Sequence
  derived and/or modified sequence opt5 from RETN__Homo_sapiens__NP_001180303
augaaggcccugugccuccugcuucugcccgugcucggccugcuugucagcuccaaaacccuguguucuauggaggaagcuaucaacgagcggauucaggaaguugccgggagccucaucuucagagcgauuuccucuaucggacuggagugccaaagcgugacaucccgcggcgaccuggcuacguguccuagaggguuugccgugaccggaugcacauguggcucugccugcgggagcugggauguccgggcugaaaccacaugucacugccagugugccggaauggacuggaccggcgcucgcugcuguagagugcagccguga

SEQ ID NO: 74789 - RNA, 336 nt, Artificial Sequence
  derived and/or modified sequence opt5 from RETNLB__Homo_sapiens__NP_115968
augggccccagcuccugccugcuccugauccuuauuccucugcuccagcugaucaacccggggucuacccaauguagccuugacuccgugauggauaagaaaauuaaggacguccucaauucucuggaguacagccccuccccuaucucuaaaaagcugagcugcgccuccguuaaaagccagggaagacccucuuccuguccugcuggcauggccgugacagggugcgcguguggauauggcugcgggagcugggaugugcagcuggaaacgaccugucacugccaguguucugucguggacuggacaaccgcucggugcugucaucucacauga

SEQ ID NO: 74790 - RNA, 1833 nt, Artificial Sequence
  derived and/or modified sequence opt5 from RETSAT__Homo_sapiens__NP_060220
auguggcugccccucgugcugcuucuggccguccuccugcuugcuguucugugcaagguguaccucggccuguucagcggguccucuccuaacccguuuagcgaggacgugaaaagacccccugcgccccuggucaccgauaaggaagcccggaaaaaggugcucaaacaggcuuucuccgccaaucaaguuccugagaagcuggacguggucgugaucggaucuggcuuugggggacuugccgcugccgcuauucuggccaaggcgggcaaacgcguucucgugcuggaacagcacacaaaggccgggggauguugccauacguucggcaaaaacggccuugaguuugauaccgggauccacuauauuggaagaauggaagagggcagcaucgggcgguucauucuggaccagaucacagagggacagcucgauugggcuccccuguccucuccuuuugacaucaugguccuggaaggcccgaaugggcgcaaggaguaccccauguauagcggagaaaaagccuacauucaaggccucaaggagaaguucccucaggaggaagcuaucauugauaaauauaucaagcuggugaaaguggucuccagcggcgcgccccaugccauucuucugaaguuucucccucugcccguugugcagcuucuggacagaugugggcuccugacccgguucucuccguuucugcaggccuccacacaaagccucgcugaggugcugcagcagcuuggagccucuuccgaacugcaggcuguccucagcuacaucuucccuaccuauggcgugacacccaaccacucugccuuuuccaugcaugcccugcuuguuaaucacuacaugaaagggggauucuacccucgcggcgggagcuccgagauugcuuuccacaccauccccgugauccaaagagcgggaggcgccguccugacgaaggcuaccgugcagucuguucuccuggauagcgccggcaaagccugcgggguguccgucaagaagggacaugaacuggugaacauuuauugucccaucgucgugagcaaugcuggccucuuuaacacauacgagcaucugcuuccugggaaugcccggugccugccgggaguuaaacagcaacucggcaccgugcgccccgggcugggcaugacaucugucuucauuugucugagaggaaccaaggaggaccuucaccucccuuccacgaacuauuacguguauuacgauacagacauggaucaggcgauggaacgguauguuagcaugccccgcgaggaagcugccgagcacaucccucugcuguuuuucgccuuucccucugcuaaagacccgaccugggaagacagauucccuggccggagcacaaugauuaugcucauccccaccgccuacgagugguuugaggaauggcaggcugagcugaaggggaaacgcggauccgauuacgaaaccuucaaaaauucuuuuguggaggccagcauguccgucgugcuuaagcuguucccucagcucgaaggcaagguggagagcguuacagcggggucuccccugacgaaccaauuuuaucuggccgcuccuagaggagccugcuacggcgcugaccacgaucuugggcggcuccaucccugugucauggccucccugagagcgcagagcccgaucccuaaucuguaucucaccggccaggacauuuucacaugcggacuggugggcgcccuucagggggcucugcucuguucuuccgccauccugaagcgcaaccuguacagcgaucuuaaaaaucucgacucccggauuagagcucaaaagaaaaagaacuga

SEQ ID NO: 74791 - RNA, 3753 nt, Artificial Sequence
  derived and/or modified sequence opt5 from REV1__Homo_sapiens__NP_001032961
augagacggggcggguggcgcaagagagccgagaacgacggaugggaaaccuggggcggguacauggcugccaaagugcagaagcuggaggaacaauuccggagcgaugcggcuaugcagaaagacggaacauccucuacgaucuuuagcggcgucgccauuuauguuaauggguacaccgaucccuccgccgaggaacuccgcaagcugaugaugcuucacggaggccaguaucauguguacuauucuagaagcaaaacaacccacaucauugcuacaaaccugccuaaugccaagaucaaggagcucaaaggcgagaaggugauucggccggaauggaucgucgaguccaucaaagcugggcgccugcuuucuuacauucccuaucagcuguacaccaagcaaagcuccgugcagaaaggacucagcuucaacccuguuugcagacccgaagacccucugcccggcccuucuaauaucgccaagcagcugaacaaucgggugaaccauauugucaagaaaaucgagacagagaaugaagugaagguuaacgggaugaacuccuggaaugaggaagaugagaauaacgacuuuagcuucguggaucucgaacagaccucuccgggacgcaaacaaaauggcauuccccacccuagaggguccacggcgaucuuuaacggacauacccccagcucuaacggcgcccugaagacacaggacugucuugucccuauggucaauuccguggcuagccggcugucccccgccuucucucaggaggaggauaaagcugaaaagagcuccaccgacuuucgcgauugcacacuccagcaacugcagcagagcaccagaaacacggacgcccuucggaauccgcaccgcacaaacucuuucucccugagcccucuccacucuaauaccaaaauuaacggcgcgcaucacagcacagugcaagggcccuccucuaccaagagcaccuccagcguuucuacauuuuccaaggccgcuccuagcgugcccucuaaacccuccgauuguaauuucaucagcaacuuuuacucccauucuagacugcaccacaucagcauguggaagugcgagcugacggaguucgugaauacccuccagcggcaguccaacggaauuuuuccuggcagagagaaacugaagaaaaugaagacagggcgcucugcccuugucgugaccgacacaggagacaugagcguucuuaauuccccgcggcaucagagcuguaucaugcacguggauauggacugcuucuucgucucugugggcauuagaaaccgccccgaucucaaggggaaaccuguugcugugaccuccaaucggggaacgggcagagcuccccugcgcccuggcgccaacccccaacuugaauggcaguauuaccagaauaagauccugaaagggaaggccgacauuccggauagcucucucugggagaacccugacuccgcgcaggccaacggaaucgauagcguccugucucgggcugagaucgccagcuguuccuaugaagccagacaacugggcauuaaaaaugggauguuuuucggacaugcuaagcagcucugccccaaccugcaggccgugccuuacgacuuucacgcguauaaggaggucgcucagacacuuuacgaaacccuggccagcuauacccauaauaucgaggccgugucuugugaugaagcucucguugacauuacagagauccuggccgagaccaaacuuacacccgaugaguucgcuaacgccgugcgcauggaaauuaaggaccaaacgaaaugcgcggccuccgucggcaucgggagcaauauccugcucgcucggauggccaccagaaaggcuaaaccugacggccaguaccaccugaagcccgaagagguggaugacuuuauucgcggacagcugguuacaaaccucccgggcguggggcacuccauggagucuaagcuggccagccuuggaaucaaaaccuguggcgaucugcaguacaugacaauggcgaagcuccaaaaagaguucgggccuaagaccggacagaugcuguaucgguuuugcagaggccuggacgaucggcccguccgcacggaaaaagaaagaaaguccgugucugccgagauuaauuacgggauccgguucacccagcccaaagaagcugaggccuuucuucucagccuguccgaggaaauucaaagacgccuggaggcuacaggcaugaagggaaagcggcucacccugaaaaucauggugagaaagccuggcgccccgguugaaacagccaaauucgggggacauggcauuugcgacaacaucgcucgcaccgucacgcuugaucaggcgacagacaaugccaagaucauugggaaagcuaugcugaacauguuucacaccaugaagcucaauaucucugauaugagaggagugggcauucaugugaaccagcugguccccacaaaucugaacccuagcaccugucccucccggccuagcgugcagucuucccacuuccccagcgggucuuauuccguucgcgacguguuucaaguccagaaggccaaaaagagcaccgaggaggaacacaaagagguguucagagccgcuguugaucuugaaaucucuuccgccagccggacaugcacguuccucccucccuuuccggcgcaucugccuaccucccccgacacaaauaaggcugagagcucuggcaaauggaacggacugcacaccccugugagcguccagucccgccucaaccugucuauugaagugcccagcccgucccagcuugaucaaucuguucuggaggcccucccucccgaccugagagaacagguggagcaggucugugccgugcagcaagcugagagccauggcgacaagaagaaagaaccugugaaugggugcaacacaggaauccugccccagcccgucggcaccguucuucuccagaucccugagccgcaagaauccaauucugaugccgggauuaaccugaucgcgcugcccgcuuucagccagguggacccugagguguuugccgcccuccccgcugagcugcagcgggaacuuaaggccgcuuacgaucagcgccaaagacagggagaaaauuccacgcaccagcagagcgccucugcguccgucccuaaaaacccccugcuccaucugaaggccgcugugaaagaaaagaagcggaauaaaaagaaaaagacaauuggcagcccuaaacgcauccaaucuccgcugaacaauaagcugcucaacucccccgccaaaacccugccuggggcuuguggcagcccccagaagcugauugacggauuccucaagcacgagggcccucccgccgaaaaaccgcuggaggagcuuuccgccucuaccagcgggguuccuggacuguccagccuccagucugaucccgcuggcugcgugagacccccugcgcccaaucuggccggggcugucgaauuuaacgacgugaagacacugcuucgggaguggaucaccacaaucuccgauccuauggaagaggacauucugcagguugugaaauauuguacggaucucaucgaagagaaggaccuggagaaacucgaucuggucauuaaguacaugaagagacuuaugcaacagagcguggaaucuguuuggaauauggccuucgacuuuauccuggauaacgugcaggucgugcuccagcaaaccuauggaagcacacugaaagugaccuga

SEQ ID NO: 74792 - RNA, 9159 nt, Artificial Sequence
  derived and/or modified sequence opt5 from REV3L__Homo_sapiens__NP_001273361
auggccuucagcaucgacagagcucugaacguggcccucggcaaucccuccucuaccgcgcagcacgucuuuaagguuagccugguguccgggaugccuuucuacggguaucacgaaaaggaacggcacuuuaugaagauuuaccuuuauaacccgaccauggugaagcgcaucugcgagcugcuccaaucuggcgcuauuaugaauaaguucuaccagccccaugaagcccacaucccuuaucugcuucagcuguuuauugauuacaaccucuaugggaugaaucugaucaaccuggccgcugucaaguucagaaaggcccggcgcaagagcaauacgcuccaugcuaccggauccuguaaaaaccaccugucuggcaauagccuugccgacacacuguuuagaugggagcaggaugaaauccccuccagccucauucuggaggggguggagccucaaucuaccugcgaacuugagguugacgcgguggccgcugauauccugaaccggcucgacauugaagcccagaucggaggcaaucccggccugcaggcuauuugggaggaugagaagcagcgcagacggaaccgcaaugaaacaucccaaaugagccagccugagucucaggaccacagauucgucccggccaccgaauccgagaaaaaguuucagaaacggcugcaagaaauccucaagcagaacgauuucagcgugacacugucuggguccguugacuacagcgauggaucccaggaguuuucugcggagcuuacccugcauagcgaagugcucucccccgagaugcugcaauguacgccugccaauauggucgaagugcacaaggacaaagagagcucuaagggccauacccgccacaaaguggaagaggcucuuauuaacgaggaagccauccugaaccucauggaaaauagccagacauuccagccccugacccagagacugagcgaaucuccugucuuuauggauagcucccccgacgaggcucucguucaucugcuugccgggcuggaaucugacggauaccggggcgagcgcaacagaaugccgagcccuugccgguccuucgggaauaacaaguauccccaaaauagcgaugacgaggaaaacgagccucagaucgaaaaagaggagauggaacucucucuggugaugucccagagaugggauagcaauauugaggaacauugugccaagaaacgcucucuuugccggaacacacacagauccagcaccgaggacgaugacuccucuagcggagaagagauggagugguccgauaauucucugcuccuggcuagccuguccaucccccagcucgacggcacggcggaugaaaacagcgacaauccccugaacaaugagaacucucgcacacauuccagcgugauugccaccucuaaacuuuccgucaagccuagcaucuuccacaaagaugcugccacacuggaaccgucuagcuccgccaagauuaccuuucaauguaaacauaccagcgcucucucuucccacgugcugaauaaggaggaccugaucgaagaccuuagccagacaaacaaaaacacggagaagggccucgauaauuccguuaccucuuucacaaacgagagcaccuacuccaugaaguaucccgggucucugagcuccacagugcacucugaaaauagccauaaagagaacuccaagaaagaaauccugccugucagcucuugcgaguccagcauuuuugacuacgaagaggauauccccucugugacccggcagguuccuuccagaaaguauacgaauauucgcaaaaucgagaaggacagccccuucauucacaugcaucggcacccgaacgaaaauacacucggaaagaacucuuuuaauuucuccgaucugaaccacagcaaaaauaagguguccagcgagggcaacgaaaaaggaaauucuaccgcccuuagcucccuguuuccuucuagcuucaccgagaacugugagcuccuguccugcucuggagaaaauagaacaaugguccauagccugaacuccaccgcggacgagucuggccuuaacaagcucaaaauccgcuacgaagaguuucaggaacacaagacagagaagcccagccugucccaacaggcugcccauuauauguucuuuccuagcgugguccugucuaauugucucacgcggccccagaaacuguccccugugaccuacaaacuucagcccgggaacaaaccgagcagacugaagcucaauaaacgcaagcuggccggacaccaagagacaucuaccaaauccagcgaaacaggcuccaccaaggauaacuucauccagaauaacccuugcaauucuaaccccgagaaggacaaugcucuggccagcgaucuuacgaaaaccacacggggcgcuuuugaaaacaagacccccacagacggguucauugauugccauuucggagacggcacccucgagacggaacaguccuuugggcuguacggaaauaaauauacacugagagccaagcggaaaguuaacuacgagaccgaggauagcgaaucuuccuucgugacacacaauagcaagaucucucucccucacccgauggagauuggcgaaagccuggacgggacccuuaagucccgcaaaagacggaagaugucuaaaaagcugcccccugucaucauuaaauauaucauuaucaacagauuucgcggccggaagaauaugcucgugaagcugggaaaaaucgacagcaaggagaaacaaguuauucugaccgaagagaagauggagcuuuacaaaaagcucgcgccccugaaggauuucuggccuaaagugcccgacuccccugccacaaaguaucccaucuacccgcugacgccuaaaaagucucauagacgcaaaagcaagcacaaauccgcuaagaagaaaaccggcaagcagcagagaacaaacaacgaaaauauuaaacggacccucagcuuucgcaagaaaagaucucaugccauccuguccccucccagccccuccuauaacgcugagacagaagauugugaccuuaauuacucugaugucaugagcaagcugggguuccucuccgagcggucuaccagcccgauuaacuccagcccuccccgcugcuggucuccuacggaccccagagccgaggaaaucauggcggccgcugagaaggaagccaugcuguuuaaaggacccaauguguacaagaaaacagugaacucccggaucggcaagaccagccgcgcuagagcccagauuaaaaagucuaaggccaaacuggcuaauccuuccaucguuaccaagaaacggaacaagcgcaaucaaacaaacaaacuugucgaugacgggaagaagaaaccgagagcgaagcagaaaaccaaugagaagggaacaagccggaaacacacgacccugaaggaugaaaagauuaaaucucagagcggcgccgaggugaaguucgugcucaaacaucagaacgucuccgaguuugcuucuagcuccgggggcagccaacuccuguucaagcagaaagacaugccccugaugggauccgccguggaucacccucuuucugccagccugcccacaggcaucaaugcucagcagaagcucuccggguguuuuucuagcuuccuggaauccaaaaagucuguugaccugcaaaccuuuccuagcuccagagaugaccuucaccccagcguggucugcaacucuauuggaccuggcguguccaagaucaauguucagcgcccgcauaaccagagcgccauguucacacugaaagagucuacccucauccaaaagaauauuuucgaccuguccaaccaccucagccagguggcgcagaacacgcagaucucuuccgggaugagcuccaaaauugaagauaaugcuaacaauauccaacggaacuaucugagcucuauuggaaaacuuagcgaguacagaaauucccuggaaucuaaacucgaccaggccuauacccccaacuuucugcauuguaaggauagccagcagcaaaucgucugcaucgccgagcaguccaagcacucugagacauguagcccuggcaauaccgcuuccgaagagucucagaugcccaacaauugcuucgugacaagccugcgcuccccuauuaaacagaucgccugggaacaaaagcagcggggguuuauucuugacaugagcaacuucaaacccgagagaguuaagccgcgcucucuguccgaagcgaucagccagaccaaagcucucucucaguguaagaaucggaacguguccacaccuagcgccuuuggcgagggacaauccggccuggccguccucaaggagcugcuucagaaaagacagcaaaaggcucagaaugccaacaccacgcaggauccccugucuaauaaacaccagcccaacaagaacauuagcgggucccuggaacauaauaaagcuaacaagcgcacacggagcgugaccucuccuagaaagccccggaccccucgcuccacaaaacaaaaggagaaaaucccgaagcuccugaaaguggacagccuuaaucugcagaacucuagccagcucgauaauuccgucucugacgauagccccauuuucuuuuccgacccuggauucgaaucuugcuacagccuggaggauucccucagccccgagcacaacuauaauuuugacaucaacaccaucggccagacgggguucuguucuuuuuacuccggaagccaauucguuccugccgaccagaaucugccccagaaguuccuuuccgaugcggugcaggaccuguuuccgggccaagccauugagaagaacgaguuccugucucaugauaaucagaagugcgacgaagauaagcaccauacaaccgacagcgcuuccuggaucagaucugggacacucagcccugagauuuuugaaaaauccaccaucgauagcaacgagaaucggcgccacaaccaguggaaaaauucuuuccacccccugacaaccagauccaacagcauuauggacucuuuuugcgugcaacaggccgaggauugucuuuccgaaaagagccggcugaacagaucuuccgucagcaaggagguguuccucucucugccucagcccaauaacagcgacuggauccagggccauacgcgcaaagagaugggacaaucccucgauagcgcuaauaccuccuuuacagccauccugucuagcccugacggcgagcuuguugauguggccugcgaagaccuggagcuguaugucucccggaacaaugacaugcucacccccacaccggauucuagcccuagauccaccucuagccccucccagagcaagaacgggucuuucacgccccgcacagcuaauauucugaagccucuuauguccccgcccagccgggaggaaaucauggcgacccugcucgaccacgaucugucugagacaauuuaccaggaaccuuuuuguuccaaccccagcgacgugccugagaaacccagagaaaucggaggccgccuccugaugguugagacccggcuugccaaugaucuggcugaguucgaaggggacuuuucucuggagggacucagacuguggaagaccgccuucuccgccaugacacagaacccucgcccgggcagcccccuuagaucuggccaagggguggucaauaaaggauccagcaacagcccuaagaugguggaagauaaaaagauuguuaucaugcccugcaagugugcuccuucccggcagcuggugcaggucuggcuccaggccaaagaggaguacgaacgcucuaagaaacugcccaagacgaaaccgaccggcguggugaaaagcgcggagaauuuuuccucuagcgucaacccugacgauaagcccguugugcccccuaaaauggacgugucccccugcauccugccuacaaccgcucauacaaaggaagaugucgacaauucucaaauugcccuccaggccccgaccacgggguguagccagacagcuuccgagagccagaugcuucccccuguggccucugcguccgaucccgaaaaagacgaggacgaugacgauaacuauuacaucagcuauucuuccccugacagccccguuauuccgccuuggcaacagcccaucuccccugauucuaaggcucugaacggagacgauagacccagcuccccuguggaggaacugcccucucucgccuucgagaauuuccugaaaccgauuaaggacggcauccagaaaagcccuugcuccgaaccccaagagccccuugucauuagcccuaucaacacccgggcccgcaccgggaagugugaaucucugugcuuucacuccacaccgaucauucagagaaagcuccuggagcggcugcccgaggcuccuggacucagcccccuuucuaccgaaccuaaaacacagaagcugagcaauaaaaagggcuccaacacggauacccugagacgcgugcuccugacacaggccaaaaaucaauucgcugccguuaacacaccccagaaggagacaucucagaucgacggcccuagccuuaauaacaccuacggguuuaagguguccauucagaaucugcaagaagcgaaagcccuccacgagauccagaaccugacgcugauuagcgucgaacuccaugcucggaccagacgcgaucuugagcccgacccggaguucgacccuaucugugcccuguuuuauugcaucucuuccgauacaccccugccugacaccgaaaagacagagcucaccggagugauugucaucgauaaagacaagacaguguucagccaggauauucgguaccagacgccccugcuuaucagauccggcauuaccgggcuggaaguuacauaugcugccgacgagaaagcccucuuucacgagaucgcuaauaucauuaagcgguacgauccggacauccugcugggauacgaaauucaaaugcauucuuggggcuaucuccuucagcgcgcggccgcucugagcaucgaucugugcagaaugauuucccgggugccugacgauaagaucgagaaccgcuucgccgccgaaagagacgaguacgggucuuauaccaugagcgaaauuaauaucgucggacggaucacccucaaccuguggcgcauuaugagaaaugagguggcucuuacaaacuacacguuugagaacguuuccuuccacgugcugcaucagcgguuuccccucuucaccuuucgcguccugucugauugguucgacaauaaaacagaccuguauagauggaagaugguggaucacuacgugagccggguuagaggcaaccuccaaaugcuugaacagcuggaccugaucggcaaaaccuccgagauggcccgccucuucgggauucaguuucugcacguccuuacacggggaagccaguauagaguggaaucuaugaugcugcgcaucgcgaagcccaugaauuacauuccugugacccccuccguccaacagcggagccagaugagagcuccucagugugugccgcucaucauggagcccgaaucucgcuucuacuccaacagcguucuggugcuggauuuucaaucucucuauccuagcaucgucauugccuacaauuauugcuucuccacgugucuuggccauguggagaaccuggggaaauacgacgaguuuaaguucggaugcacaagccugcggguucccccugaucuccuguaucaggugagacacgacaucaccgucucccccaauggcguggccuuuguuaagccuucugugcgcaaagggguccuuccgcggaugcuggaagagauucucaagaccagauucauggugaaacagagcaugaaggcuuacaaacaggaucgcgcccugucccggaugcuggacgcgagacaacucggacuuaagcugaucgccaacgugacauuuggcuauaccucugcuaauuucagcggccgcaugcccuguauugaagucggggauuccaucguucauaaggccagagagacacuggaacgggcuaucaaacucgugaacgacaccaagaaauggggagcccgcguggucuacggcgauacggacucuauguuugugcugcuuaagggggcuacaaaagagcagagcuucaagauuggacaggagaucgccgaagcgguuaccgccacaaauccuaaacccgugaagcugaaguuugagaaagucuaccucccuugcgugcugcaaaccaagaaaagauauguuggcuacauguaugaaacgcuggaccagaaggaucccguguucgacgcuaaagggauugagaccguccggagagauuccuguccggccgugagcaagauccucgagcggucucuuaagcugcuguucgaaacacgcgacauuucccucaucaaacaguacguccagagacaaugcaugaagcugcuugagggaaaagcuagcauucaggauuuuaucuucgccaaggaauaucggggcucuuuuuccuacaaaccuggcgccugugugcccgcucuggagcucacccgcaagaugcugacauaugacagacggagcgaaccccagguuggggagcgcgugccuuacgugaucauuuacggaacccccggcgucccucugauccagcucguuagacggccgguggaggugcuucaagaucccacacugcgccugaacgcgaccuauuacauuacgaagcagauccucccuccccuggccagaauuuucucucuuaucgggaucgacgucuuuuccugguaucacgaacugccucggauucacaaagcuacauccucuucccgcagcgagcccgaaggaagaaagggcaccaucucccaguacuucaccacacuccauugcccggugugugaugaccugacccagcacgggauuugcagcaaaugccggucucaaccucagcauguugccgugauccugaaucaggagauucgcgaacucgagagacagcaagagcagcuggucaagaucuguaaaaacugcacaggauguuuugaucggcacauccccugcgugagccuuaauuguccuguccuguucaagcucuccagagugaaccgcgaacugucuaaggcccccuaucuucggcagcugcucgaccaauuuuga

SEQ ID NO: 74793 - RNA, 3666 nt, Artificial Sequence
  derived and/or modified sequence opt5 from REXO1__Homo_sapiens__NP_065746
augcugagaagcaccggcuucuuucgggccaucgacugccccuacugguccggggcuccuggaggcccgugucgcagacccuauugccacuuccggcaucgcggggccagaggaucuggcgcgccuggggauggaggcgaggcucccccugccgccggccucggguacgaccccuauaacccugaacugccgaagcccccugcucagcgggagaauggaacacuuggccugggggaggagccccgcccugaugugcucgaacuggagcuugucaaccaagccauugaggcuguuagaagcgaaguggagcuggaacagcggcgcuacagagagcuccuggagacgacccgggaacaccgcuccgccgaggcgcccgcccuggcuccgagaggaccuaaugccucucccacagugggcccugacgaagaugcuuuuccccucgccuucgacuauagccccgggucccauggacugcuuucuccugaugcgggcuaccagccgacaccccuggccgcuccugccgagcccggcagcaaauauucccucgcuagccuggaccgggggcagggacgcggcgggggaggcgggggagcccuugaauacgucccuaaggccgugucucaacccagacggcacuccagaccgguuccuagcggcaaauacguggucgauaacucucggcccccuaccgaccuggaguaugauccccucuccaauuacagcgcucgccaucugucuagagcguccagccgcgacgagcgggccgcuaagagaccucgcggcucccgggggucugaacccuauaccccggccccuaaaaagcugugugaucccuuuggaagcugcgacgccagauucuccgacagcgaggaugaagcugccacagugcccggcaacgagccuaccacggcgucuaccccgaaggcucgcgccgaccccgaaaucaaagccacagggcagccucccuccaaggagggacucgaggcugaaggcgggggccugcgggagaccaaagaaacagccguucagugugaugugggagaccuucagccucccccugcuaagcccgccagcccggcgcaaguccagucuagccaggauggcgggugcccuaaagagggaaagcccaagaaaaagaaaaccggcgccccucccgcuccguccuguaaggacggggcccagggaaaagauaagacgaaagacaagggcagagggcgcccuguggaaaagccccgggcugauaaaaagggcccucaagccucuagccccagacggaaagcggagcgccccgagggaacaaagaaaaagccuuccagcgccaccccgguggcuacaucuggcaaggggagacccgaccggccugccagacgccccuccccuaccagcggagauucucggcccgcugccggcagagggccuccgcgcccccugcagcucccugacagaaaauccaccaaggcccccagcggaaaacuggucgaacggaaggcucgcucccuugacgagggcgcgucucaggaugccccuaaacugaagaagagagcucucagccacgccgaccuguuuggggaugaauccgaggacgaggccgcuggccccggaguuccgucuguguggccuagcgcccugcccucccucagcucugauuccgacagcgauucugacuccagccugggcuuccccgaagcgcaagggccucccaaacggcuuaaggcuucuccuccgcccagcccugcccccuccagcagcuccagcuccucuagcuccacaucuagcgccggagcugauguggacuacuccgcccuggagaaagaagucgauuuugacucugauccuauggaggaaugccuccgcauuuucaaugagagcacguccgugaagaccgaggacagaggccggcuggcgcgccagcccccgaaagaagaaaagagcgaagagaaggggcuuucuggacugacaacccucuuuccuggccagaaaagacggaucucccaccugagcaagcaggggcaagaaguugagcccccucgcagaggccccgcugugccucccgcccggccgccuacagcccaggaggucuguuaucugagagcucagcaggcccaacgcgcuucugccucccuccugcaggcgcccgcccggcuugcugaaaaaucucccucugugcauauuuccgccccuggagagaagagacgcaucgcucacaucccgaacccccggcuggccgccgcuccuaccggcgcgaaaagaacgcucgccgcuagcgggucccagagcucuaauggacccgaaccuggcgggcagcaacugaagacacgcacccugagcggaauggccuccaaaaccacaaccacaauuauccccaagcggauugcccauucuccuagccuucagucccucaagaaaccgaucauucccaaggaguucggcggcaaaguuccuacggugaucagacagcgcuaccugaaccuguuuauugaagagugccucaaguucuguaccucuaaucaggaggcuaucgaaaaagcccugaacgaggaaaaggucgcguaugaccggagccccuccaagaauaucuaccuuaacguggcugucaauacacugaaaaagcucagagggcuggccccuucugccgugcccggacugagcaaaaccuccggccggcgcguugugagccacgaggucgugcuugggggaagacucgcugccaagacaucuuucucccugagccggccgucuuccccucgcguugaggaucugaaaggcgcggcucucuacagcagacugcgggaauaucuucugacccaagaccagcucaaggagaacggguaccccuuuccccacccugaaagacccggaggcgccauuaucuucacggccgaggaaaagcgcccuaaagauuccucuugccggaccugcuguagaugcggcacagaguaucuggugagcuccagcgggcgcuguauucgggacgaggaaugcuacuaucauuggggaagacugcgccggaacagagucgcuggcgggugggagacccaguacauguguugcucugccgcugccggauccgugggcugucaaguggcgaagcagcacguucaggaugggcgcaaagaaagacuugagggauuugucaagacauucgaaaaagagcucagcggcgacacccauccgggcaucuaugcccuggauugcgagaugucuuacacgacauacgggcuggaacucacccgggugacaguggucgacaccgaugugcacguuguguaugacaccuuugucaagcccgauaaugagauuguggacuacaacacacgcuucagcggaguuacggaagcugaucuggccgacaccuccgugacacuuagagacguccaggcugugcugcucucuauguuuagcgccgauaccauccugaucggccauucccuggagucugaccuucucgcccugaagguuauucacagcacaguggucgauaccuccgugcuguucccucaccggcucgggcugcccuauaaacgcagccuuagaaaucugauggcugacuaccuccggcaaaucauucaggauaacguggacggacauucuuccagcgaagaugcgggcgccuguaugcaccuggucaucuggaagguuagagaggacgcuaaaacgaagcgcuga

SEQ ID NO: 74794 - RNA, 714 nt, Artificial Sequence
  derived and/or modified sequence opt5 from REXO2__Homo_sapiens__NP_056338
augcugggcgggagccucggauccagacugcuucggggcgucgggggaucucacggccgcuucggggccagaggagugcgggagggcggcgcugccauggcggcuggggaaagcauggcccagcgcaugguuuggguggaccuggagaugaccggacucgauaucgaaaaggaccaaauuaucgagauggccugccugauuacagauuccgaccuuaacauccuggcugaaggccccaaucucauuaucaaacagccugaugagcugcuggacucuaugagcgauugguguaaggagcaucacgggaaauccggacucacgaaggccgugaaagaaucuaccaucacacugcagcaggcugaguacgaauuucuuagcuucgucagacaacagaccccgcccggccugugcccucucgccgggaacuccgugcaugaggacaagaaguuucuggauaaauauaugccccaguucaugaagcaccuucauuaccggauuaucgacguuagcacagugaaagagcugugucgcagaugguauccugaagaguacgaauuugcgcccaagaaagccgcuucucaccgggcccucgaugacauuuccgagagcaucaaggaacugcaguucuaucgcaauaacauuuuuaagaaaaagaucgaugagaaaaagagaaaaauuaucgagaauggagaaaacgagaagaccgucucuuga

SEQ ID NO: 74795 - RNA, 753 nt, Artificial Sequence
  derived and/or modified sequence opt5 from REXO4__Homo_sapiens__NP_001266278
augggcaaggccaaagugcccgcuagcaagagagccccuuccucuccggucgcgaaacccgggccuguuaagacccugacacggaaaaagaacaagaaaaagaaacgcuucuggaaaagcaaggcuagagagguguccaagaagcccgccucuggaccuggcgccgugguccggcccccuaaagcuccggaagacuuuagccagaauuggaaggcccuccaagaggugccccgcuggaccgggggaagacaguaccuggcuccucggcccguugaacaguccacgauccgcaaagagccuagaaagggccagauggugauucuuuuccaaaacgaagggacaucuagcauccgguccggaaaacugcgcagacagccccagccgcacccuccccgggaggagcucgaagucgugcagaaggagguugccgaaaugcugaaaggccgcauucuugugggccaugcgcugcacaaugaucucaagguccuguuucuggaccauccuaagaaaaagaucagagauacccaaaaauauaagcccuucaaaagccaggugaagucugggcggcccucccuccgccugcuuagcgagaagauucugggacuccaggugcagcaagccgagcacugcucuauccaggacgcucaggccgcuaugagacuguacgucaugguuaaaaaggaaugggaguccauggcccgggauagacgcccucuucugacagcgccggaccauuguagcgaugacgccuga

SEQ ID NO: 74796 - RNA, 3447 nt, Artificial Sequence
  derived and/or modified sequence opt5 from RFC1__Homo_sapiens__NP_001191676
auggacaucagaaaguucuuuggcgugauucccagcgggaaaaagcuggucuccgagaccguuaaaaagaacgagaaaacaaagucugaugaagaaacgcucaaggccaaaaagggaaucaaagagauuaaggugaauagcucccggaaagaagacgauuucaagcagaagcaaccuucuaaaaagaaacgcaucauuuacgacagcgauuccgagucugaggaaacccuucaggugaagaacgcuaaaaagccgcccgagaaacugccugucagcuccaagcccggcaagaucagcagacaggacccugugacauauaucucugaaaccgaugaggaggacgauuuuaugugcaaaaaggccgcguccaaaagcaaggaaaaugggcggucuacaaacucccaccugggaaccagcaauaugaaaaagaacgaggaaaauacaaagaccaaaaacaagccccucucuccuauuaaacugacgccgaccuccguucuugacuacuucggcacagggagcgugcagcgcuccaauaagaaaauggucgcuucuaagagaaaggagcugagccaaaacaccgaugaauccggacucaaugacgaggccaucgccaaacagcugcagcuggaugaggacgcugaacucgagcggcagcugcaugaagacgaggaauuugcccgcacacuugcuaugcuggaugaggagcccaagaccaaaaaggccagaaaagacacggaagcgggcgagacauucagcucugugcaagccaaccucuccaaggcugaaaagcacaaauauccucauaagguuaaaaccgcccaggugagcgaugagcggaagucuuacagcccccgcaaacaguccaaguaugaaucuagcaaagagucccagcaacacagcaagucuuccgcugacaagauuggcgaggucagcucuccuaaagccuccagcaagcuggcgaucaugaaaagaaaggaagaguccucuuacaaagaaauugagcccguggccagcaagcggaaggagaaugcuaucaaacuuaagggggaaacaaaaaccccgaagaaaaccaaguccucuccugccaagaaagagagcgugucccccgaagauagcgagaagaaacgcacaaacuaucaggcuuacagaucuuaccugaaucgggaaggaccuaaggcccucggcuccaaagagauucccaagggggccgagaacugucuggaaggacugaucuuugucaucacgggcguucucgagagcauugaacgcgacgaggcuaagucucugaucgaaagauaugggggaaaagugaccggcaacguguccaagaaaacaaauuaccuugucaugggccgggauagcgggcagucuaagagcgacaaagcggccgcucugggaaccaagauuaucgaugaggacggccuccugaaccuuauuagaacaaugcccgggaaaaaguccaaguaugagaucgccguggaaaccgagaugaaaaaggaaagcaaacuggagcgcacgccucaaaagaauguucagggaaaacggaagaucucuccguccaagaaagaaagcgaguccaagaaaucuagacccacaagcaagcgcgauucccucgccaaaaccauuaagaaggagaccgacguguucuggaaaucucuggacuuuaaggaacaggucgcugaggaaacaagcggcgauuccaaagcccggaaccuggcggacgauucuagcgagaauaagguggagaaccuccuguggguugacaaauacaagccuaccucccuuaagacaaucauugggcagcaaggagaucagagcugcgcuaauaaacugcucagauggcugcgcaacuggcagaagucuuccagcgaagacaaaaagcaugccgccaaauucggcaaguuuucuggcaaggaugacggguccagcuucaaagcugcccuucugucuggacccccuggcguggggaagacgaccacagcuucccucgucugucaggagcugggauauagcuacguggaacugaaugccuccgauacccggagcaaaucuagccucaaggcgaucgucgccgagucccugaacaauacaucuauuaaaggcuuuuauagcaacggggcugccuccucugugagcaccaagcacgcucuuaucauggacgaaguugauggcauggccggaaaugaggacagaggcgggauccaagagcugauuggacucaucaaacacacgaagauucccaucauuugcauguguaacgaucgcaaucauccgaagauccggucccuggugcacuacugcuucgaccugagauuccagcgcccucgggucgaacagauuaaaggcgcgaugaugucuaucgccuuuaaggaggggcuuaaaauucccccucccgcuaugaacgaaaucauccucggagccaaccaggacauuagacaagugcugcauaaucugagcauguggugugcucgguccaaggcccucaccuacgaucaggccaaagcugacagccaccgcgcgaagaaggauaucaaaaugggcccuuucgacguugccagaaagguguuugcugccggggaggaaacagcccacaugucucuggucgauaaauccgaccuuuucuuucaugauuauagcauugcuccccuguucgugcaggagaacuacauccacgugaagccgguugccgcgggcggagacaugaaaaagcaucucaugcugcugucucgggcugccgauuccaucugcgacggcgaucuugucgacagccagauuagauccaagcaaaauuggucucuccugccugcccaggcuaucuaugccagcgugcugcccggggagcucaugcgcggauacaugacccaguuucccacauucccuuccuggcugggcaaacacagcucuaccgggaagcaugaucggauugugcaagaccuugcgcugcacaugucccucagaacguauagcucuaaacgcacagucaacauggacuaccugagccugcuuagagaugcucucgugcagccgcugaccucccagggaguugacggcgugcaggaugucguggcccugauggacacauauuaccucaugaaggaagauuuugagaauaucauggaaauuucuagcuggggcgggaaacccuccccuuucucuaagcuggaccccaagguuaaagccgcuuuuacccgggccuacaacaaggaggcucaccuuaccccuuauagccugcaagccaucaaagcgucccgccauagcacaucucccucccucgauagcgaauacaaugaggagcugaacgaagacgauucccagucugacgagaaggaucaggacgccaucgaaacggacgcuaugauuaaaaagaaaaccaagagcuccaagccuucuaaacccgagaaggauaaagagccgagaaagggaaaaggcaagagcuccaagaaauga

SEQ ID NO: 74797 - RNA, 963 nt, Artificial Sequence
  derived and/or modified sequence opt5 from RFC2__Homo_sapiens__NP_002905
auggagguggaagccgucugcggcggggcuggagagguugaagcccaggacagcgaucccgcgccugcuuucuccaaggccccgggcucugccgggcacuacgagcugcccuggguggaaaaauauagaccugugaagcucaacgagaucgucggaaaugaggacaccgugagccggcuggaaguuuuugcucgcgagggcaacgugcccaauauuaucauugccgggccucccggaacaggcaaaacgaccuccauccuuugucuggcuagagcccuccugggcccugcgcuuaaggaugccaugcuggaacucaacgcuucuaaugacagcaugacagauggggcccaacaggcucugcggcgcaccauggagauuuacuccaaaacaaccagauucgcccuggcgugcaacgccucugacaagaucaucgagccgauucagagccggugugcuguccuccgcuauacaaagcugaccgaugcccagauccuuacgagacugaugaaugugauugaaaaagagcggguucccuacaccgacgauggacucgaagcuaucauuuuuacagcccaaggcgacaugcgccaggcccugaacaaucuucaguccaccuucagcggguuuggauucaucaacucugagaauguguuuaaggucugcgaugaaccucauccccugcucgugaaagagaugauucagcacugugugaacgcuaauaucgacgaggcguauaagauccuggcccaucuguggcaccucggcuacuccccugaagauauuaucgggaacauuuucagagucugcaaaacauuucaaauggcugaguaucugaaacuugaguucaucaaggaaauuggauacacccauaugaagaucgccgaaggcguuaauagccugcuccagauggccggccugcuugcucggcugugucagaagacgauggcccccguggcgucuuga

SEQ ID NO: 74798 - RNA, 1071 nt, Artificial Sequence
  derived and/or modified sequence opt5 from RFC3__Homo_sapiens__NP_002906
augagccuguggguggacaaguacagacccugcucccucggccggcuggauuaucacaaagagcaggccgcucaacuucgcaaccugguccaguguggggacuucccucaucuccugguuuacggaccgucuggcgccgggaagaaaaccagaaucaugugcauucuucgggaacuguauggagugggcguggagaagcuccgcaucgaacaccagacaauuacgacccccagcaaaaagaagaucgagauuuccacaaucgcgucuaauuaccaucuggaagucaacccuagcgaugcuggaaauuccgacagagugguuauccaggagaugcugaaaaccguggcccaaucucagcagcucgagacaaacagccagcgggauuuuaaggucgugcugcuuaccgaaguugacaaacugacaaaggaugcccaacacgcucuccgcagaaccauggagaaauauauguccacgugucggcugauucuuugcuguaauagcaccucuaaggugauucccccuauccgcuccagaugccuggccguccgggugcccgcuccuagcaucgaagacauuugucaugugcucucuacagucugcaagaaagaggggcugaaccugccgucccagcucgcccaccgccuggcggaaaagagcuguagaaaucuucggaaagcccugcucaugugcgaggcuugucgcguucagcaguaccccuucaccgccgaucaagagaucccugaaacagacugggagguguaucugagagaaaccgcuaacgccauugugucucagcagacgccccaacggcuucuggaggucagaggccgccucuacgagcugcugacacacugcaucccucccgaaaucauuaugaagggccuccuguccgagcuucugcauaauugcgaugggcagcucaaaggagaaguggcgcagauggccgcuuacuaugagcaccggcugcagcuuggcagcaaggccaucuaccaucuggaggcuuuuguugccaaauucauggcccucuauaagaaguuuauggaagacgggcuggagggaaugauguucuga

SEQ ID NO: 74799 - RNA, 1092 nt, Artificial Sequence
  derived and/or modified sequence opt5 from RFC4__Homo_sapiens__NP_853551
augcaggccuuccugaagggcaccagcaucuccacaaaacccccucucacgaaggacagagggguggcugccucugcgggaagcuccggcgagaacaaaaaggcuaaaccgguccccuggguugaaaaguaccggccuaagugcguggaugagguggccuuucaagaagaggucguggccguucugaaaaagucucuugaaggggcugaccugcccaaucuccuguucuauggaccucccggcaccgggaaaacaagcaccauucuugccgcugcccgcgagcuguuuggaccugagcuguucagacugcgggugcuggaacucaacgcguccgaugagcgcggcauccaggucgugagagaaaagguuaaaaauuuugcccagcugacagugucuggcagccgguccgacgggaagccgugucccccuuucaagauugucauccuugaugaggcugacagcaugaccucugccgcucaggccgcgcugcgcagaacaauggagaaagaauccaagaccacgcgguuuugccucauuuguaacuacgugagccgcaucaucgagccccugaccucuagaugcuccaaauuccgguuuaagccucuuagcgauaaaauucaacagcagcgccugcucgacaucgccaagaaagaaaaugugaagauuucugaugagggaaucgcuuaucuggucaagguuuccgaaggcgaccugagaaaagccauuacauuccuccagagcgcuacccggcugacagggggaaaggagaucaccgagaaagugauuacggauaucgccggcgugauccccgccgaaaagauugacggggucuuugcugcgugucaauccggaucuuucgauaaacuugaggccgugguuaaggaccugaucgacgaaggccacgcugccacacagcucgugaaccagcugcaugaugucgugguugagaauaaccuuagcgacaagcagaaauccauuaucaccgaaaagcuggccgagguggauaaaugccucgcugacggcgccgaugagcaccuccaacugauuagccucugugcgacagucaugcagcagcugucucaaaauugcuga

SEQ ID NO: 74800 - RNA, 768 nt, Artificial Sequence
  derived and/or modified sequence opt5 from RFC5__Homo_sapiens__NP_001123584
auggugcuggagcucaacgccagcgacgauagaggcaucgacauuauccgggggcccauucuguccuucgcuucuacccgcacaaucuuuaagaaaggauucaaacuugucauucuggaugaagccgacgcgaugacgcaggaugcucaaaaugcccucagacggguuaucgagaaauuuaccgaaaacacacgcuucugccugaucuguaauuaccuuagcaagauuaucccugcccugcaguccagaugcacccgguuucgcuucggcccgcucacacccgagcugauggugccuagacuggaacacguggucgaggaggaaaaaguggacauuucugaggaugggaugaaggcucucguuacccugagcuccggagacaugcggcgcgcccuuaacauccugcagucuacaaauauggcuuuuggcaaggugaccgaagagacggucuauaccuguacagggcauccccucaaaagcgauauugccaacauccuggacuggaugcuuaaucaggauuucaccacagcguacagaaacauuaccgagcugaagacgcucaaaggacuggcccugcacgacauccucacagaaauccaucuguuugugcaccggguugauuucccuuccagcgugcgcauucaucuucugaccaagauggcugacaucgaguauagacucucugucggcacaaaugaaaagauucaacuguccagccuuaucgccgcuuuucaggugacccgggaccugauuguggccgaggcguga

SEQ ID NO: 74801 - RNA, 1092 nt, Artificial Sequence
  derived and/or modified sequence opt5 from RFFL__Homo_sapiens__NP_001017368
augugggcuaccugcuguaacugguucugccuggacggccagcccgaggaagugccuccgccccaaggggccagaaugcaggccuacagcaauccuggauauuccucuuuucccagcccuacaggccucgagcccuccuguaagucuugcggggcgcacuucgcuaacacggcccggaaacagaccugucuggauugcaagaaaaauuuuuguaugacaugcagcucccaggucggaaacggcccucgccuuugucugcucugccaaagauuccgggccaccgcuuuucagcgcgaggaacugaugaagaugaaaguuaaggaccuuagagauuaccugucucuccaugacaucagcacagaaaugugucgggagaaggaggaacuggugcugcucgugcuggggcagcagccggucauuucccaagaggaucgcaccagagccagcacacuuucucccgacuucccugaacagcaggcuuuucugacccagccccacuccagcauggugccucccacgucuccgaaucucccuuccagcucugcccaagcgaccuccguucccccugcccaggugcaggagaaccaacaggcuaauggacaugucagccaggaucaggaggaacccguguaucuggaguccguugcccgggugcccgcugaagacgagacacaaucuaucgauagcgaagacuccuucgucccuggccgcagagccagccuuucugaucugaccgaccucgaggauauugagggccugacagugcggcagcugaaagaaauccucgcgcgcaacuuugugaauuacaaggggugcugcgagaaaugggaacugauggagagagucacccggcuuuauaaggaccagaaaggacugcagcaccucguuuccggcgccgaagaccaaaacgggggagcugugccgagcggccuggaggagaaucuuuguaagauuugcauggauucucccaucgacugugugcugcucgaaugcgggcauauggucacguguacaaagugcggaaaacgcaugaacgaguguccuaucugcagacaguacgugauucgggccguucacguguucagaagcuga

SEQ ID NO: 74802 - RNA, 468 nt, Artificial Sequence
  derived and/or modified sequence opt5 from RFK__Homo_sapiens__NP_060809
augagacaucugcccuacuucugccggggccaggugguccgcggguuuggaagaggcagcaagcaacucgggaucccuaccgccaacuucccggagcagguuguggacaaucugcccgcugauauuuccacaggaaucuauuacggcugggccucuguggggagcggagacguccacaaaauggugguuuccauuggcuggaacccuuauuacaagaauacgaaaaagucuauggaaacccacaucaugcauacauuuaaagaggauuucuauggcgaaauucuuaacguggcgaucgucggguaccugcggcccgagaagaauuuugacagccucgaaucccugaucucugcuauucagggagauaucgaggaggccaagaaacgccuugaacugccugagcaccucaagauuaaagaagacaacuucuuucaggugagcaaguccaaaaucaugaauggccauuga

SEQ ID NO: 74803 - RNA, 954 nt, Artificial Sequence
  derived and/or modified sequence opt5 from RFPL1__Homo_sapiens__NP_066306
augaagagacugagccucgugaccacaaaccggcugucuccccacggcaauuuccuuccucugugcacguuuccgcucgccgucgacauggcugcccuguuccaggaggcguccagcugucccguuugcuccgauuaccuugaaaaaccuaugucucuggagugugggugcgcuguguguuuuaagugcaucaacagccuccaaaaagaaccccauggagaggaccugcuguguugcuguugcuccauggugucucagaagaauaaaauucgcccuagcuggcagcucgaaagacuggccucccacaucaaggagcuugagcccaagcugaaaaagauucuccagaugaacccucggaugcgcaaauuccaagucgauaugacccuggacgccgauacagcuaauaacuuucuucugaucagcgacgaucucagaucugugcgguccggcuguauuacccagaaucgccaggaccuggccgaaagauucgauguuagcaucugcauccuggggucuccgcgguuuacaugcggacgccauuauugggagguggacgucggcaccuccacagaaugggaucucgggguguguagagagagcguucaccggaagggacgcauucaucugaccacggagagaggcuucuggaccgugucucuucgggacggcucccgccugagcgcuuccacagucccccucaccuuucuguucguggauagaaaacuucagcggguggggaucuuucuggacaugggaaugcaaaacgucucuuucuuugacgccgaaggcgggagccacguuuacacauucagauccgugagcgcggaggaaccucuccaccuguucuuugcucccccuucucccccgaauggagauaaguccgugcugagcauuugcccugucaucaaccccggcaccacggacgccccugugcaucccggggaggccaaguga

SEQ ID NO: 74804 - RNA, 1626 nt, Artificial Sequence
  derived and/or modified sequence opt5 from RFT1__Homo_sapiens__NP_443091
augggcagccaggaggugcuggggcacgccgcuagacucgccuccucuggacugcuucugcaaguccucuuccggcugaucaccuuuguucuuaacgcguucauucugcgcuuucucagcaaggaaaucgugggcguggucaaugugagacugacacugcucuacuccacgacccuguuccuugcucgggaggccuuucgcagagccugccugucugggggaacacagcgggacuggagccagacccucaaccugcuuuggcugacaguuccccucggcguguucuggucccuguuucugggguggauuuggcuccagcugcuugaagucccugauccgaaugugguuccccauuaugcuaccggagugguccuguucggccucucugccgugguggagcugcuuggcgaaccuuuuuggguccuggcucaagcccacauguucguuaaacucaaggugaucgcggagagccuguccgugauucugaaaagcguccucacagccuuucuggugcuuuggcugccccauugggggcucuacaucuucucucuggcucagcuguuuuauaccacgguucuugugcucuguuacgucaucuauuucaccaagcugcugggauccccugagagcacaaaacuccagacccugcccgugucucgcauuacagaccuucugccuaacaucaccagaaauggcgccuucauuaacuggaaggaagcuaagcucacgugguccuuuuucaaacagagcuuucugaagcaaauccugacagagggggaacgguacguuaugaccuuccuuaaugugcucaacuuuggagaucagggcgucuaugacauugugaauaaccuggggucucuggucgcccgccucaucuuccagccgauugaggaguccuuuuacaucuucuuugcgaaagugcuggaaagaggaaaggaugccacacuucagaaacaagaggacguugcuguggccgcugccguccuggaaagccuccugaagcuggcccuucucgcuggccugaccaucaccguguucggcuuugcguacucccagcuggcccucgauauuuaugggggaacaaugcugucuagcggcuccgggcccguucuucugcggagcuacugccucuaugugcugcugcuugcuaucaauggagucacggaguguuucaccuuugccgccaugucuaaggaagagguggaccgcuacaacuucgugaugcucgcucuguccagcucuuuccugguucucagcuaucugcuuacaagauggugcggcuccgucggguuuauucuggccaauuguuucaacaugggaauccggauuacccagucucucugcuuuauccaccgcuacuauagacggagcccucauagaccccuggcgggccugcaccuuuccccugugcuccugggcacauucgcucugagcgggggagugaccgccgucucugagguguuucucuguugcgaacaaggcuggcccgcccgccuggcucacaucgccguuggggcuuucugucuuggagccacgcugggcacagcguuucucaccgagaccaaacugauucauuuccugcggacacagcuuggggugccgagacgcaccgauaagaugacauga

SEQ ID NO: 74805 - RNA, 1737 nt, Artificial Sequence
  derived and/or modified sequence opt5 from RFTN1__Homo_sapiens__NP_055965
augggcugcgggcugaacaagcucgagaaaagagacgaaaagcggcccggaaauaucuacagcacccugaaacgcccucagguggagacaaagauugaugucuccuaugaauacagauuccuugaguuuacgacccugucugccgcugaacucccgggcagcuccgccguucggcuggcgucucuucgcgaccugcccgcucaacuccuggagcuguaucagcagggguucagccucgccgcccugcacccuuuugugcagcccacacaugagagagagaaaaccccucuugagcacaucuuccgggcuauucugaucaagaagacagaucgcucccaaaagaccgaccuccauaacgaaggauacauucuggagcuugauuguugcucuagccuggaccaccccacagaucagaagcucaucccugaguuuaucaaaaagauucaggaagccgcuucccagggccugaaauucgugggggucaucccgcaauaucauagcucuguuaauuccgccggaagcucugcgcccguguccaccgccaacagcacggaggacgcuagagaugccaagaaugcucggggcgaccacgccucucuggaaaacgagaagccuggcaccggggauguguguuccgcgcccgccggacgcaaucagagcccugaacccuccucuggcccgagaggggaggucccucucgcuaaacagcccagcuccccuagcggagagggcgacgggggagaacugucuccccagggcguguccaagacacuugauggccccgagagcaacccucuggaaguucacgaggaaccgcucucugggaaaauggagauuuuuacccuguucaauaagcccaaaagccaucaaaagugccggcaguacuauccugugacaaucccccuucacgucuccaaaaacggacagaccgugucuggccuggacgccaauuggcucgagcauaugagcgaccacuuucgcaaagggggaaugcuggugaacgcugucuucuaccugggcauuguuaaugauucccuccacgggcugacggacggaguguuuaucuucgaagccgugagcacagaggauucuaagaccauucaaggcuacgacgccaucgucguggaacaguggacaguucuugagggcguggaaguccagaccgauuaugugccucugcucaacucccuggcugcguacggguggcagcuuaccuguguucugcccacaccgguggucaaaacgaccagcgagggaucuguguccacaaagcaaaucgucuuucuccagagaccuugccugccccagaaaauuaagaaaaaggagagcaaguuccaguggcgguucucccgcgaagagaugcauaauagacaaaugcggaaaucuaagggcaaacugagcgccagagacaagcagcaggcugaagagaacgagaaaaaccucgaagaucaguccucuaaggccggggacaugggaaauugugugagcggccaacagcaggaagggggcguuuccgaagagaugaagggaccugugcaggaagauaaaggcgagcaacugagccccgggggacuucugugcggcgucgggguggagggagaagccguucagaacggcccugcuucucacucccgcgcccucguggggaucuguaccggccauagcaaucccggagaggacgcgcgggauggcgacgcugaagaggucagagaacuggggacaguggaggagaacuga

SEQ ID NO: 74806 - RNA, 1506 nt, Artificial Sequence
  derived and/or modified sequence opt5 from RFTN2__Homo_sapiens__NP_653230
augggcugcgggcugagaaagcucgaggaccccgaugacagcuccccuggaaaaaucuucucuacccugaagcggccccagguggaaacaaaaacggaguuugccuacgaauauguccuucuggauuucacccuccaagcuagcuccaacccggagguuauuaagaucaauucuauucuggacaucgugacaaaaguggaaaacuacuaucuuaagggcuacauugucggggccauccacccugugauccagcccguuggacagcgcaagcaucugccugcgagcuaucucuacagagugguccugcugcggcucaaacugucccccaagaauagcgcugccccuagcggccagcgcagaccgcggcuugugauugaggaguguccccugaccuccgaagcccaaacaaacgaugcugccaaagagcucaucgaaaagauuaauguugcugccaaacgcgggaugaaguuugugggauucaucagccagcacuauucuccuuccaaguuuugcaacggcaccaaucaugacggcgauauugagagcaugcugcacgucagacaugggucugacgagaacugucgguccuggaaugaaggaacacuuagcggccagucuuccgagagcgggaucgaagaggaacugcaccacgaguccggacaguaccaaauggagcagaacggcucucccaccagcuccaaaagccgcaagggggaagcgucugauaauaaacucuacacgguguucaacgccuuugacgaugacuccaccagcugggcuuaucaggagggcauucugucuaugaaggugacaagaaaaggaagcgucaucuccacccuggaugccgacuggcucgaacugacaaccuucuacuauaagcagggccuuucucugaucgacagcuuuguuuucugggagacguccaaaggggaacaucucccuaagagccuggagggauuuuucauuuacgaggaagagggcucuggggugcccggauccagccggaagggcaaugaugcuaucguggucgaacaauggacagugauugaggggugcgaaaucaaaaccgacuauggaccgcuucugcacacacucgccgaguuuggcuggcugcugaccucuguucucccuacccccgugcugcgccaugauuccgagggcaaccuugcgacaaagcagauugucuuccugcagagaccugugauguggaauagcgccgcucaaacgcccgacaaaaaggccucccggcacaucaaaggggaagauaagaacaaggcuaccucucgcagcaucggacucgacacaaccuccucucagcccgccgagagcagacaucugccugaagagugucggcuuuccccgagcagagagugcuggacaaaagaaggccgccuggcccagcacaacucuuucuccggguuuucuucuuccgauaauguucuccgggagcuggacgauggacaguucgaccaagaagauggcgugacccaggucacguguauguga

SEQ ID NO: 74807 - RNA, 2124 nt, Artificial Sequence
  derived and/or modified sequence opt5 from RFWD2__Homo_sapiens__NP_001001740
augagcggcuccagacaggccgggucuggaagcgcuggcaccucccccgggucuagcgccgcguccucugugacaagcgcuuccagcucucuguccagcucuccuuccccgcccagcgucgccguuucugccgcugcccucguguccggaggcguggcucaagccgcggggagcggaggccugggcgggccuguccggcccgugcuuguugccccugcuguguccggaucuggcgggggagccgucagcacgggccugucccgccacagcugcgcugccagacccucugcgggggugggaggcuccagcucuagccucggcuccgggucucggaagcgcccucugcuugccccgcuguguaacggacucaucaauagcuacgaggacaaauccaacgauuucguuugccccauuuguuuugacaugaucgaagaggcuuauaugaccaagugcggccauagcuucuguuacaaaugcauucaccagucucuggaagauaauaacagauguccuaagugcaauuauguggucgacaacaucgaucaucuguaccccaauuuucucgugaacgagcugauucuuaaacagaagcagcgguucgaagagaagcgcuuuaaacuggaccacuccaaugggcauagauggcaaaucuuccaggauuggcucggaacagaccaggauaaccuggaccuugccaaugugaaccugaugcucgagcugcugguccagaagaaaaagcaacucgaagcugagagccacgccgcccagcugcagauccuuauggaauuucugaaaguugcucggcgcaauaagagagaggagaugucuggccucuauuccccugugagcgaagauuccaccgugccccaguucgaggcgccgucuccuagccacuccucuauuaucgacagcacagaauacucccaacccccuggguuuagcggaucuucccagaccaagaaacagcccugguauaacagcacacuggccucucggcgcaagagacuuaccgcucauuucgaggaucuggaacaauguuacuuuuccacgcggaugagccgcauuucugacgacagcagaaccgccucccagcucgaugaguuccaggagugccugagcaaauuuacacgguacaauucugucagaccccuggccacccucuccuaugcuagcgaccuguacaacggcuccucuaucgugagcuccauugaguucgaucgcgacugugauuauuucgccaucgcgggcguuacaaagaaaauuaagguguacgaauaugacaccgucauccaggaugcuguggacauccacuacccugaaaacgagaugacgugcaauucuaaaauuagcugcaucuccuggucuagcuaucauaagaaccuucuggccuccagcgauuacgaagggacaguuauucucugggacggauuuaccggccaacggucuaagguguaccaggagcacgagaaaagauguugguccgucgauuucaaucugauggacccgaaacuucuggccagcgggucugacgaugcuaaggugaagcucugguccacaaaccuggacaauagcgucgccucuaucgaagcuaaagccaacgugugcuguguuaaguuuucccccagcucccgcuaucaccuggcguucggaugcgccgaucauugugugcacuacuaugaccuccggaauaccaagcagccuauuauggucuuuaaaggccauagaaaggcugugagcuacgccaaauucguuucuggggaggaaaucgugagcgcuuccaccgauucucagcugaaacuuuggaacgucggcaagcccuauugccugcgcagcuuuaagggacacaucaaugagaagaacuucgugggccucgccuccaauggggacuacauugcguguggaucugaaaacaauagccuguaucuguacuacaaaggccuuuccaagacacuccugacguuuaaauucgauaccgugaagucuguucuggacaaagaucggaaggaggacgauacaaacgaguuugucagcgccgugugcuggagagcucucccugacggggaauccaaugugcugaucgccgcuaacagccaaggaaccauuaagguccuugagcugguguga

SEQ ID NO: 74808 - RNA, 2325 nt, Artificial Sequence
  derived and/or modified sequence opt5 from RFWD3__Homo_sapiens__NP_060594
auggcccacgaggcuauggaauacgacgugcagguccaacugaaccaugccgagcagcagcccgcgccugcuggcauggccagcucccaagggggaccggcccuccugcaacccguuccugcugauguggugucuagccagggcguccccuccauccuucagccugcccccgcugaagugauuucuagccaggccaccccuccgcugcuccaacccgcgccucagcuguccguugaccuuacagagguggaaguccugggggaggauacgguggagaauaucaaccccagaaccucugaacagcaccggcagggaagcgacggcaaucauacaauuccugccuccagccuccacucuaugaccaacuucaucuccgggcugcaacgccugcauggaaugcucgaguuucugagacccagcagcuccaaucacagcguuggcccgaugcggacacgcagacgggugucugcuucccgcagagcccgggcuggcgggagccagcgcaccgauuccgccagacuucgggcgccucuggacgccuauuuccaggucucucgcacacaacccgaucucccugcuaccacguacgacagcgaaaccagaaaccccguguccgaggagcuucaggugucuucuuccagcgauucugacagcgauuccucugccgaauauggaggcgucguugaccaggcugaggaaagcggggccgugauucuugaggaacagcuggccggaguguccgcugagcaagaggucacaugcaucgauggcgggaagacccuccccaaacagccuagcccgcagaagucugaaccccugcugccuuccgcgagcauggacgaggaagagggagacacauguaccaucugccucgaacaguggacgaaugccggcgaucaccggcugucugcccuucgcuguggccaucuguuuggguacagaugcauuuccacauggcucaaaggacaagugcggaaguguccccagugcaacaaaaaggcuagacacagcgacaucguugugcuguaugcccgcacccuucgggcucuggauacauccgagcaggagagaaugaagucuagccuccugaaagaacagaugcugcgcaagcaagccgagcucgaauccgcgcagugucggcugcagcuucagguccugaccgacaaaugcaccagacuccaacgccgggugcaggaucugcagaagcugacaucucaucaaagccagaaucugcagcagccuagaggcucccaggcuuggguucucagcuguucucccuccagccaggggcagcacaaacacaaguaccauuuccagaagacguuuaccgugucucaagccggaaacugccgcauuauggccuauugugacgcucuguccugccuggucaucagccagccgucuccucaggccagcuuccuccccggcuuuggggugaaaaugcuguccacagcuaauaugaaaagcucucaguacauuccuaugcacggaaaacaaauccggggccuugccuucuccagcuaccugagaggccuccugcuguccgcgucucuugauaacaccauuaagcucacaagccuggagaccaauacggucgugcagacauauaacgccgggcgccccguuugguccugcuguuggugccuggacgaagcuaauuacaucuaugccggacucgcuaacggcucuauccugguguacgauguccggaacaccagcucccaugugcaggagcuuguugcccaaaaagcgagauguccucuggugucucucagcuauaugccccgggccgcuuccgccgcuuuuccguacgggggaguccuggccggcacccuggaggacgccagcuucugggaacagaagauggauuuuucucacuggccucaugugcuuccccucgagcccgggggcugcauugacuuccagacagaaaauuccagccgccacugucuggugaccuauagaccugacaaaaaccacacaacgauccggucuguucugauggagauguccuacagacucgaugacaccggaaauccgauuugcagcugucagcccguccauacauuuuucggcgggccuaccugcaagcugcuuacaaagaacgcuaucuuccaaucucccgagaaugauggaaacauucugguguguaccggcgacgaagcggccaauuccgcucuccugugggaugccgccagcgggucccugcuucaggaccuccagacggaucagccugugcuggacaucugccccuuugaggucaaccgcaauagcuaccuggcuacccucacagaaaagauggugcacaucuauaagugggaguga

SEQ ID NO: 74809 - RNA, 2940 nt, Artificial Sequence
  derived and/or modified sequence opt5 from RFX1__Homo_sapiens__NP_002909
auggccacccaggcuuacacagagcugcaagccgcgcccccuccgagccagcccccucaggcucccccucaggcccaaccccagccuccgcccccucccccucccgccgcuccgcagccuccccagccucccacggccgcugccacaccccaaccucaguaugugaccgaacuccaguccccgcagccccaagcgcagccucccggcgggcagaagcaauacgucaccgagcugccugccguucccgcuccgucucagccuacaggagcccccaccccuagccccgcuccucagcaguauaucguggugacagucuccgaaggcgccaugagagcgucugagaccgugagcgaagccucccccgggucuacggcuagccaaaccggaguuccgacacaggugguccaacaggugcagggcacccagcagcggcuucugguucagacauccgugcaagccaaaccugggcacgucagcccccuccagcugaccaacauucaggugccccagcaagcccuuccuacgcagcgccuggugguccagucugccgccccgggauccaagggcggccaaguuagccucacagugcaugggacccaacaggugcacucucccccugagcagucccccguccaggcuaauucuagcuccagcaaaacagcgggagccccuaccggcaccgugccccagcagcugcagguucauggggugcaacaguccgucccugugacacaggagagaucuguugugcaggcuacgccccaagccccgaagccuggacccguccagccucugaccgugcagggccuccaacccguccacguggcccaggaaguucagcagcugcaacaggugccggucccucauguguacagcucccagguucaguauguggagggaggagacgcuagcuacacagccucugcgauccgguccagcaccuauucuuaccccgaaacaccucuuuacacccaaacggcuagcacauccuauuacgaggccgccggcaccgcuacccaggucucuacacccgccaccagccaggcuguggccuccagcggcucuaugcccauguauguguccgggagccagguugucgcgucuuccacaagcacgggagccggcgcuuccaacucuagcgggggaggcggguccggaggcggcgggggaggcgggggaggcgggggcggaggcgggucuggaagcaccggcgggggaggcuccggggccggcacauacgugauucaaggaggcuauaugcuggggagcgcuucucaguccuacagccacaccacacgcgccucuccugcgaccgugcaguggcuccuggauaauuaugagacggccgaaggagucucccuuccgagaagcacccuguacugccacuaccuccugcauugucaggagcaaaaacuggaacccgugaacgcugccucuuucggcaagcucauccggagcguuuuuauggggcugcgcacaagacggcuuggaacccgcggcaauuccaaguaucacuacuaugggcugagaauuaaagcuagcucuccucuccugcggcuuauggaggaccagcagcauauggccaugcgcggccaacccuucucccagaagcagagacugaaaccuauccagaagauggaaggaaugacaaacggcguggccgucgggcaacagcccagcaccggacucuccgauaucucugcucaggugcagcaauaccagcaguuucuggacgcgagccggucccugccugauuucacggagcucgaccugcagggcaaaguucuuccggagggggugggacccggcgauauuaaggccuuucaaguccuguaucgcgaacacugcgaggcuaucguggacguuauggugaaucuccaguucacacuggucgaaacccuuuggaagacauuuuggagauacaaccugucucagccuagcgaggcucccccucucgccgugcacgaugaagcugagaaacggcugcccaaggccauucuggugcuccuguccaaauucgagccgguccuucaauggaccaagcauugugacaauguucuguaucaggggcucguggaaauccugauuccugaugugcugagacccauccccucugcgcuuacccaggcuauucgcaacuuugccaaaagccucgaguccuggcugacacacgccauggucaauaucccugaagagaugcugcgggugaagguugcugccgcgggcgcuuucgcccagacgcucagacgcuacaccagccugaaccaucuugcccaagcugcccgggcugugcugcagaauacagcccagaucaaccagaugcucucugaccugaauagagucgauuuugcgaacgugcaagaacaggccuccuggguuugccgcugugaggaccgggugguccagagacuggagcaggacuucaaagugacccuucaacagcagaacagccucgaacagugggcugccuggcuggauggaguugugucucaaguccugaagcccuaccagggcuccgcuggguuuccuaaggccgccaaacucuuccugcuuaaguggagcuucuauucuuccauggugauucgcgaccugacacuccggagcgcugcguccuuugggagcuuccaccugaucagacugcuuuacgaugaguauauguacuaucucauugaacaucgcguggcccaggcuaaaggcgagaccccgaucgccgucaugggggaguuugccaaucuggcuacgucucugaacccccucgacccugauaaggacgaagaggaagaggaagaggaggaaagcgaggaugaacugccccaagacauuucccuugccgcgggaggcgagucuccugcucugggccccgaaacacucgagccgccugccaaacuggcccggaccgaugcuagagggcuguucguucaggcccuucccagcuccuga

SEQ ID NO: 74810 - RNA, 2172 nt, Artificial Sequence
  derived and/or modified sequence opt5 from RFX2__Homo_sapiens__NP_000626
augcagaacagcgagggcggggccgacucccccgcuucuguggcccugagaccuagcgcggcugccccgcccgucccugccagcccccaacggguucucgugcaggcugccucuagcaauccuaagggagcucagaugcagcccaucucccugccucgcgugcaacaggucccgcaacaggugcagcccguucagcacguguacccugcccagguccaguauguggaaggcggggaugcgguuuacaccaacggagccauuagaacagcuuauacguacaaucccgagccucaaauguaugcccccucuagcaccgcuuccuacuucgaagccccgggcggggcccaggugacagucgcggcuagcucuccucccgccgugccuucccauagcauggugggaaucaccauggacgucggcggcucucccauuguuuccagcgcuggggccuaucuuauccacggaggcauggauucuacacggcauucccuggcccacaccagccgcuccucucccgcuacacucgagauggcgauugaaaaccugcagaaaagcgaggggaucaccucccauaagagcggacuucuuaauucucaccuccaauggcugcuggacaacuacgagacggccgaaggcgugucccucccuagaagcucucuguacaaucacuaucuucggcauugccaggagcacaaacuggauccggugaacgcugccagcuuugggaagcucauccgcuccgucuucaugggacugagaacccggcgccuuggcacaagaggcaauucuaaauaccauuauuacgggauucggcugaagcccgacagcccucucaaccgccugcaggaagauacccaguauauggccaugagacaacagcccaugcaccagaagccucgguaccgccccgcucagaaaacagacucccugggagauagcggcucucacuccgggcuccauagcaccccggagcaaacgauggccgugcagucucagcaccaucagcaauauaucgacguuucccacguguuuccugaguuccccgcgccugaucugggauccuuucuucugcaggacggcgucacacuccaugaugugaaggcucugcagcuuguuuacagacggcacugugaagccaccguggacgucgugaugaaucugcaguuccacuacauugagaaacucuggcuguccuuuuggaacucuaaggccagcuccucugacgggcccacaagccugccugcuuccgaugaagaccccgagggagccguccucccgaaagauaagcugaucagccuuugccaaugugacccuauucugagauggaugcgcucuugcgaucauauccucuaucaggcucugguggaaauucuuauccccgacguucugcggcccgugccuuccacccucacccaggccaucagaaauuucgccaagagccuggagggcuggcugacaaacgcgaugucugauuuuccgcaacaggucauucagacgaaagugggcguuguguccgcuuucgcccagacccuccgccgguacacaagccugaaucaccuugcucaagccgcgagagccguccugcagaacaccucucagaucaaccagaugcucagcgaccugaaucgcguggauuuugcuaacgugcaagagcaggccuccuggguuugucagugcgaagagagcgucgugcagcggcuggaacaagacuucaagcugacacuccagcagcaaucuucccuggaucagugggcuagcuggcuggacuccguggucacccaggugcucaaacagcaugccgggucucccagcuuuccuaaggccgcuagacaauuccugcuuaaaugguccuucuauucuagcaugguuauucgcgaccugacgcuccgguccgcggccucuuuuggcagcuuccaccugaucagacugcuuuacgaugaguauauguuuuaccucguggaacaccgcgucgcugaggccacaggagagacccccauugccgugaugggggaguucaaugaccuggcuucccugagccucacccugcuugauaaggacgauaugggagacgaacagcggggcucugaagccgggccugaugcgagaucccugggcgagccccucguuaaacgggaacgcagcgacccuaaccauucucugcagggaaucuga

SEQ ID NO: 74811 - RNA, 1242 nt, Artificial Sequence
  derived and/or modified sequence opt5 from RFX3__Homo_sapiens__NP_001269046
augcagacaagcgagacaggcuccgacacggggucuaccgugacacugcaaaccagcgucgccucccaggcugccguucccacacagguggugcagcaagucccugugcagcagcagguucaacaggugcagaccguccagcaagugcagcacguuuacccggcucaggugcaauaugucgaaggaucugauacaguguacaccaacggcgcgaucagaacgaccacauaucccuacaccgagacacagauguauagccagaauaccgggggaaacuacuucgacacgcagggcuccucugcccaagugacaaccgucguuagcucccauagcaugguggggacaggaggcauucagaugggcgugaccgggggacagcucaucucuuccagcggcgggaccuaucugauuggaaauucuauggaaaacuccggccacagcgucacacauacgacccgggccucuccugcuacaaucgagauggccauugaaacccuucagaaguccgaugggcugagcacacaccgcuccucucuccugaauagccaucuucaauggcugcucgacaacuacgagaccgcugagggagugucccugcccagaagcacgcuguacaaucacuaucuccggcacugccaggaacauaaacuggauccuguuaacgccgcgucuuuuggcaaacuuauccgcuccaucuucaugggccugagaacacggcgccucgggaccagaggaaauagcaaguaccacuauuacggcauucgggugaagcccgacucuccucugaaccgccuucaggaggauaugcaguauauggccaugagacaacagccgaugcagcagaaacaacgguacaagcccaugcagaaggucgacgggguggcugauggauuuaccggcagcgggcagcaaacaggaaccuccguugaacagacagugaucgcccagucucagcaucaccaacaguuccuggacgcuagccgcgcccucccugaguuuggcgaggucgaaauuuccagccugcccgauggcacgaccuucgaggacaucaaaucucugcagucccucuauagagaacacugugaggcgauucuggauguggucgugaaucuucaguuuagccugaucgaaaagcucuggcaaacauucuggcgguacucuccuuccacccccacagacgggaccacgauuaccgagagccgcuccgagucuaccagcuuuccgauccauuuccacggauga

SEQ ID NO: 74812 - RNA, 2235 nt, Artificial Sequence
  derived and/or modified sequence opt5 from RFX4__Homo_sapiens__NP_001193620
augaucaagagacgggcccaccccggcgcugggggagaccgcaccagaccucggcgcagacggagcacagaguccuggauugaacgcugccugaacgagucugaaaauaaaagauacagcucccauacgucucucggcaacgugagcaaugaugagaacgaagagaaggagaauaaccgggccuccaaaccgcacucuacccccgcgacacugcaguggcuugaagagaauuaugaaaucgcugagggggucuguauuccucgcagcgcccuguacaugcauuaucucgacuucugcgagaagaacgauacccaacccguuaaugccgcuuccuuuggaaaaaucauuagacagcaguucccucagcugacaacccggcgccuuggcacaagagggcaaagcaaguaccacuauuacggaaucgccgugaaggaaucuucccaguauuacgacgugauguacagcaaaaagggcgcugccugggucucugagaccggcaaaaaggaaguguccaaacagacgguugcguauagcccccggucuaagcuggggacccuccugccugaguuuccgaacgugaaggaucugaaucuccccgccucccugccugaagagaaagucagcacauucaucaugauguaccgcacccauugucagcggauucuugacacagugauccgggcuaacuuugaugagguucaauccuuccugcuccacuuuuggcagggaaugcccccucacaugcugcccgugcuuggcucuagcaccgucgugaauauugugggggucugcgacuccauccuguauaaggccauuagcggaguucucaugccgacggugcugcaggcucugccugauucucucacacaggugaucagaaaauucgccaagcaacuggacgaauggcuuaaagucgcgcugcaugaucuccccgagaaccugcgcaauauuaaguuugaacuuucccggagauucagccagauccugcgccggcagaccucucucaaccaccugugucaagccagcagaacagugauccauuccgcugacauuaccuuucagaugcuggaggauuggcgcaacguugaccucaauucuaucaccaaacagacacuguacacgauggaagacagccgggaugagcacagaaaacuuauuacccagcuguaucaagaguucgaccaccuccuggaggaacaguccccuaucgaaagcuacauugaguggcuugauacaaugguggaccgcugcgucgugaagguugccgcuaagcggcagggcucucugaagaaaguggcccagcaauuucuccugaugugguccuguuucgggaccagagucauccgcgauaugacacugcauagcgcccccucuuucggauccuuucaccucauccaucugauguucgacgauuaugugcuuuaccugcucgaaagccugcacugccaggagcgggcuaacgagcugaugagagcgaugaagggcgaaggcuccaccgccgagguccgggaagagauuauccuuacggaggcugccgcccccacaccuucuccggugcccagcuuuuccccugcuaaaucugccaccagcguugaagugcccccucccuccagcccggucucuaauccuucccccgaguacaccgggcucagcacaaccggagcgaugcagucuuauacauggucccugacguacaccgugacaaccgcugccggcagcccugccgaaaacucucagcaacugcccuguaugcgcaauacacauguuccuagcuccagcgugacccaccggauucccgucuauccgcacagagaggaacauggguacacgggaucuuauaacuacggcuccuaugggaaucagcacccucaucccaugcagagccaguaccccgcucucccucacgacaccgccaucuccggaccgcugcacuacgcucccuaucauagaucuagcgcccaauacccuuucaacucccccacaucucgcauggagccuugccuuaugagcuccacccccagacugcacccuacacccgugaccccgagauggccugaggugcccucugcgaauacguguuauacaagcccuuccguucauagcgcccgcuacggcaacucuuccgauauguauacaccccucaccaccagacggaauagcgaauacgagcacaugcagcauuuuccgggcuucgcuuauauuaacggggaagccucuaccggaugggcuaaguga

SEQ ID NO: 74813 - RNA, 1851 nt, Artificial Sequence
  derived and/or modified sequence opt5 from RFX5__Homo_sapiens__NP_001020774
auggccgaggacgaacccgaugcuaagagcccuaaaaccggcgggagagccccgcccggaggcgcggaggcuggggaaccuacaacgcugcuccagcggcugcgcggaaccaucuccaaggccgugcaaaacaaagucgagggcauucuucaggacguucagaaguucucugauaaugacaaacuguaccucuaucugcagcuucccagcgggccuacaaccggagauaaguccucugaacccagcacacuguccaacgaggaguacauguaugccuacagauggauccggaaucaccucgaggaacauaccgacacaugccugccuaagcaaucuguguaugaugcuuaccgcaaauauugugaaagccuggccugcuguagaccgcucuccaccgcuaacuuuggcaagauuauccgggagauuuuccccgacaucaaagcccgcagacugggcgggcggggacagagcaaguacugcuacucuggcauccgcagaaaaacgcuuguguccaugccuccccugccugggcucgaucugaagggaagcgagucucccgaaaugggcccggaggucaccccugcgccccgggacgaacuuguggaggccgcuugugcccugacaugcgauugggcugaacgcauucucaagagauccuuuagcucuaucguugagguggcccgguuccugcugcagcagcaccucauuuccgcgcgcagcgcccaugcucacguccugaaagccauggggcuugcugaggaagacgagcaugccccuagagaacgguccucuaagcccaaaaauggacuggagaaccccgaaggcggcgcccacaagaaaccugagagacucgcucaaccgcccaaggaucuggaggcgcgcaccggggccggaccucuugcucggggcgaacgcaaaaagagcgugguugaguccagcgcccccggggccaauaaccuccaggugaaugcucuggucgccagacugccucugcuccugccccgggcgccgagaucucuuaucccucccauuccuguguccccucccauccuggcuccccgccucagcucuggagcccugaagguggccacacuuccgcugagcucccgggcuggcgccccucccgcugccguccccauuaucaacaugauccucccuaccguuccggcgcugcccgggccuggacccggcccuggcagagcucccccugggggacugacgcagccccgcggcacagaaaaucgggagguggggauuggaggcgaccaggggccgcacgacaaaggcgugaagagaaccgccgaagucccugugucugaggccagcggacaagcucccccugccaaagcggccaagcaggauaucgaggacacagcuuccgaugccaaacgcaagcggggcagaccccggaagaaaagcgggggaucuggcgaacgcaacuccaccccgcucaagagcgcugccgccauggagucugcucaguccagcagacugccuugggaaaccuggggguccggaggcgaggggaacucugcgggcggagccgagcggcccggcccuaugggggaagcugagaaaggagccguucuugcccaaggccagggggacggaacagugagcaagggcgggagaggccccggaucccagcauacgaaagaagcugaggauaagauuccccuggucccuucuaaggugagcguuaucaaaggcucccgcagccagaaggaagccuuuccgcucgcgaaaggggagguggacaccgcuccccaaggaaauaaggaucugaaagagcacguccugcagucuucccuuagccaggaacauaaggacccuaaggccacacccccuuga

SEQ ID NO: 74814 - RNA, 2787 nt, Artificial Sequence
  derived and/or modified sequence opt5 from RFX6__Homo_sapiens__NP_775831
auggccaaggugcccgagcuggaagacaccuuccuccaggcucaaccugccccgcagcugagccccggcauccaggaggauugcuguguccagcuucuggggaaaggacuccugguuuacccugaagagacaguguaucuugcggcugaaggccaacccgggggagagcagggcgggggagagaagggcgaagacccugagcugcccggcgccgugaaauccgaaaugcaccucaacaaugggaacuuuucuagcgaggaggaagaugccgacaaucaugauuccaagacgaaagcugccgaccaguaccugucucagaagaagaccauuacacaaaucgucaaagauaagaaaaagcagacccagcugacacuccaguggcuggaggaaaacuauauugugugcgagggaguuugucuuccuagaugcauccuguacgcucacuaucucgacuucugucggaaagaaaagcuggagccggccugcgcggccaccuuuggcaagacaauucgccaaaaauucccccuucugaccacgagacggcucgggacccgcggacauagcaaguaccacuauuacggcaucgggaucaaagaguccucugcuuacuaucauagcguguacuccggaaagggccugacaagauuuagcggcucuaaacugaagaaugaagggggauucacccggaaauauucccucagcucuaagacaggcacccugcuuccugaguuucccuccgcccagcaccuggucuaccagggguguauuagcaaggauaaaguggacacgcucaucaugauguauaagacacacugccaauguauucuggauaacgcuaucaauggaaacuucgaagagauucagcauuuucuucugcacuucuggcagggcaugccugaccaucuccugccccugcucgaaaauccgguuaucauugauaucuuuugcgugugugacucuauccuguacaaaguccuuaccgacgugcugauuccugccacaaugcaggagaugcccgagucccuccuggcggauauccgcaacuucgccaagaauugggaacaauggguggucagcucccuugagaaccugccugaagcucucaccgacaaaaagauucccaucguuagacgguuugugucuagccugaagcgccagaccuccuuccugcaccucgcccagauugcuagacccgcccuguucgaucagcacguggucaauagcauggugucugacaucgagcggguugaucuuaacuccaucgggagccaagcccugcucacaauuucuggaagcacggacaccgaauccggcaucuauacagagcaugauucuauuaccguguuucaggagcugaaagaccugcuuaagaaaaaugcuacagucgaagcguucaucgaguggcucgauaccgugguugaacagcgcgugauuaagacgagcaaacagaacggcagaucccugaagaagcgggcccaagacuuucugcucaaauggagcuucuuuggggcucgcgucaugcacaaccugacacuuaauaacgccucuuccuucggcagcuuucaucugaucagaaugcuccuggaugaguacauccugcuugccauggagacccaguucaauaacgacaaggaacaggagcuccagaaucugcuggacaaauacaugaagaacucugaugcuuccaaagccgcguuuaccgcuagcccuuccucuugcuuccucgccaaucggaacaagggaagcaugguguccucugacgccgucaagaaugaaagccacguggagacaaccuaucugccgcuucccuccagccaaccugggggacugggccccgcucuccaucaguuuccugccgggaacacagauaauaugccccugacgggccagauggaacugucucaaauugcuggacaccuuaugaccccgccuaucucccccgccauggcgagcagaggcucuguuauuaaccaggggccuauggccggacggcccccuuccgugggccccguccucagcgcuccgucucacugcagcacauacccugagcccaucuaucccacccugccucaggccaaucaugacuucuacuccacaagcucuaacuaucagaccguguuucgcgcucaaccgcacuccacgagcgggcuguacccccaucacaccgagcacggaagauguauggccuggacagaacagcagcucucccgcgauuucuucucuggcagcugcgcgggguccccuuauaauucucggcccccuagcuccuacggccccucucugcaggcccaagacagccauaacaugcaguuucuuaacaccggauccuucaauuuucugagcaacacaggcgcugccucuugucagggggcuacccucccucccaauuccccgaacggauacuauggcagcaauauuaacuacccugagucucacagacugggguccaugguuaaucagcaugugagcgucaucucuuccauucgcagccugcccccuuauuccgauauccacgacccccuuaacauccucgaugacagcggacggaaacaaacgucuagcuucuacacagauaccuccucuccgguggccugcagaacaccugugcuggccagcucccugcagacccccauuccuucuagcuccucucaguguauguauggcaccagcaaucaauaccccgcucaggaaacacucgacucccaugggacgagcucucgcgagaugguuuccagccugcccccuaucaacaccgucuuuaugggcacagcggccggaggcaccuga

SEQ ID NO: 74815 - RNA, 1422 nt, Artificial Sequence
  derived and/or modified sequence opt5 from RFX8__Homo_sapiens__NP_001139136
auguacgagaucuauguggaaaccugcggccagaacacagagaaucaagucaaccccgccacguucgggaagugugaagaccacagcccuaugaaaaccgauccgguuggaagcccccugucugaguuuagacggugcccuuuccucgaacaggagcuggcuaagaaauacagcuguaauaugauggccuuucuugcggacgaguauugcaacuacugucgcgauauucugagaaauguggaagaccuccugacauccuucuggaagucucuucagcaggauaccgugaugcugaugagccuccccgacgucugccaacuguuuaaauguuaugaugugcagcuguacaagggcaucgaggacguucuccugcaugauuuccuugaagacguguccauucaguaucugaagucuguccagcucuuuagcaaaaaguucaaacuguggcuucugaacgcucucgagggggugccugcccugcugcaaaucuccaagcucaaagagguuacacuguuugugaagcggcuucgcagaaagaccuaccugagcaauauggccaaaacaaugcggaugguccucaagucuaaacgcagaguguccgugcugaaguccgaucuucaggcuauuaucaaccagggaacccuggccacgucuaaaaaggcucucgccuccgaccggagcggcgcggaugaacuggagaauaaccccgaaaugaaaugccugcgcaaucucaucucucugcuugggaccuccacagaccugagagucuuccucagcugucuguccucucaccuucaggccuuuguuuuccaaaccagccgguccaaggaggaauuuacaaagcuggcugccagcuuccagcuccgcuggaaccugcugcucaccgcugugucuaaagccaugacgcugugccauagagacuccuucggaagcuggcaccuuuuucaucugcuccugcuggaguacaugauucacauccuucagucuugucucgaggaagaggaagaggaagaggauaugggcacagugaaggagaugcugccugacgauccgacccugggccaacccgaccaggcgcuguuccacagccucaauuccucucuuagccaggccugcgcuuccccuagcauggaaccccugggggucaugccuacacauaugggacagggccgguaucccguggggguuucuaacauggugcuccgcauucugggauuucuggucgauaccgccaugggcaauaaacuuauccaagugcuccuggaggacgaaaccacagaguccgcuguuaagcugagccucccgauggggcaggaagcccugauuacgcuuaaagauggacagcaguucgugauccaaauuucugacgucccucaguccagcgaggauaucuacuuuagagagaacaacgccaauguguga

SEQ ID NO: 74816 - RNA, 717 nt, Artificial Sequence
  derived and/or modified sequence opt5 from RFXANK__Homo_sapiens__NP_001265656
auggagcugacccagcccgccgaagaccucauccagacacagcagacgccugcuagcgagcugggcgauccggaagaccccggggaggaagccgcggauggauccgacaccgugguccuuucucuguucccuugcacacccgagccuguuaaccccgagccugaugcuagcguguccucuccgcaggccggcagcucccucaagcacucuaccacacugaccaauagacaacgggggaacgaagugagcgcccuucccgcuacacuggacugugauaaucucgucaacaaaccugacgagcgcggauuuacgccccugauuugggccuccgcuuucggcgaaaucgagaccgugagauuucugcucgaguggggagccgauccucauauucuggcgaaggaacgggagagcgcccuuucucuggcuuccaccgggggcuacacagacaucguuggccuccugcuugaacgcgauguggacauuaauaucuaugauuggaacgggggaacaccccugcucuacgccgucagaggcaaucacgugaaaugcguugaggcucugcuggcccgcggggcggaccucaccaccgaagccgacagcggauauacgccgauggaucuggcuguggcccuuggcuaccggaagguccaacaggugaucgagaaccauauucugaaacucuuccagucuaaucuggugccugcugaccccgaguga

SEQ ID NO: 74817 - RNA, 819 nt, Artificial Sequence
  derived and/or modified sequence opt5 from RFXAP__Homo_sapiens__NP_000529
auggaggcccagggcguggcugaaggggccggacccggcgcggcuagcggggucccucacccggccgcccuggcucccgccgcugccccuacccucgcgcccgccuccguugcugccgcugccucucaauucacacugcuugugaugcagccuugcgcgggacaggacgaggccgcugcccccggcgggagcgugggagcuggcaagccugucagauaccugugugaaggcgccggggauggagaggaagaggccggcgaggacgaagcugaucuccuggacacguccgauccgcccgggggaggcgagucugcggccagccuugaagaccuggaggaugaggaaacccauuccgggggagagggcucuagcggcggggcucggcgcagaggauccggcgggggaagcaugucuaaaacaugcaccuaugaaggcuguuccgagacaaccagccagguggccaagcaacggaaaccuuggaugugcaagaaacaccgcaacaagauguacaaggacaaauauaagaaaaagaaaucugaucaggcccucaauugugggggaacagcuuccaccggcagcgccggcaacguuaagcuggaagagucugcggacaauauccuguccauugugaagcagagaacggggagcuuuggagaucggcccgcucgcccuacccuccuggagcagguccuuaaccagaaaagacugucccuccugcggucucccgaagugguucaauuccuucagaagcagcaacagcugcucaaucagcaagugcuggagcagcgccagcagcaauuuccgggcacaagcauguga

SEQ ID NO: 74818 - RNA, 414 nt, Artificial Sequence
  derived and/or modified sequence opt5 from RGCC__Homo_sapiens__NP_054778
augaagcccccugccgcucagggcagcccggccgcggcugccgccgcugcccccgcucuggacuccgccgcggccgaggaucucucugacgcucugugcgaguucgaugccgugcuugcugacuuugccagcccuuuccacgagagacauuuucacuacgaagaacaucuggaacggaugaaacgcagauccucugcgagcgucuccgauucuagcggguucuccgacagcgagucugccgauucccucuaucggaacagcuuuucuuucuccgacgagaagcugaauagccccaccgauucuaccccugcccuucuguccgcuacgguuacaccccaaaaagcuaagcucggagacacaaaagaacuggaggccuuuaucgccgaucuggacaagacccucgcuagcauguga

SEQ ID NO: 74819 - RNA, 2301 nt, Artificial Sequence
  derived and/or modified sequence opt5 from RGL1__Homo_sapiens__NP_001284598
auggaggugaagcccgucggcgaaccuacccaggagguuagcaaauucaagcuguccacaaaaguggaaucuacggggcacuggcucguggaggaccaugucagaaucugggaagugcugaagaccgaggagguugaaggagaucaacuuccgcccggccacacagugagccaguacgagaccugcaaaauucggacaaucaaggccgggacccuggaaaagcucgucgagaaccugcuuacagcuuuuggagacaaugauuucaccuauauuuccaucuuucugucuacguaccgcggcuucgccagcaccaaagaggugcucgaacugcugcucgacagauaugggaaccugacauccccuaauugugaggaagauggaucucagagcuccagcgagucuaagaugguuauucggaacgcgaucgcuuccauccuucgcgccuggcuggaccagugcgccgaagauuuuagagagcccccucauuuccccugucuccaaaaacugcuugacuaccugacccggaugaugccuggcagcgauccggagcgcagagcucagaaucuccuggaacaguuucagaagcaagagguggaaacagacaacggccugcccaauaccauuucuuucucccucgaggaagaggaggaacuggaagggggagagagcgccgaguuuacgugcuucucugaagaucuugucgcugagcagcugacauauauggacgcccagcucuuuaaaaagguggugccucaccauugucugggcugcaucuggucccggcgcgauaagaaagagaacaagcaccuugcgcccaccauuagagccacaaucagccaguucaauacccugaccaaaugugucguuuccacaauucucgggggaaaggaacugaaaacgcaacagcgggcuaagaucauugagaaauggaucaacaucgcccacgaaugccgccugcucaagaauuuuucuagccugagagcuauuguguccgcccuucagagcaacucuaucuaccggcugaagaaaaccugggcggccgugccucgcgacagaaugcucauguucgaggagcuguccgacauuuucagcgaucauaauaaccaccuuacaucucgggaacugcucaugaaggagggcaccagcaaauuugcuaaucuggacuccucugucaaggaaaaccagaaaagaacacaacgccggcugcagcuccagaaggauaugggggugaugcaaggaaccguucccuaucugggcacguuccuuacagaccugaccaugcucgauaccgcccugcaggacuacaucgagggcgggcugauuaacuuugaaaagagacgccgggaguucgaggugaucgcucagaucaaacuucuccagagcgccuguaauuccuacugcaugacaccggaucaaaaguuuauucagugguuccagagacagcaacugcugaccgaagaggaaagcuaugcccucucuugugagaucgaagcugcggccgacgcuuccacaacgagcccuaaaccccgcaagucuauggucaaacggcugucccuucuguuucucggaagcgauaugauuaccuccccuacacccaccaaggagcagcccaagucuacagccagcggcuccucuggggagagcauggacuccgugagcguuucuuccugcgaaagcaaccauucugaggccgaagagggauccaucaccccuauggauacgccggacgaaccccagaaaaagcugagcgagucuagcuccagcuguucuuccauucacagcauggacaccaauuccucuggcaugagcucccugaucaacccucuuucuucucccccuuccugcaauaacaaucccaaaauccacaagagaucugugagcgucacauccauuaccagcacagugcucccgccugucuacaaccagcaaaaugaggauaccugcaucauucgcaucucuguggaagacaacaaugggaacauguauaaauccauuaugcugacgagccaggauaagacacccgcuguuauccagcgggccaugcugaagcauaaucucgacucugauccugcggaggaauacgagcuggugcaagucauuuccgaggacaaagaacuugugauccccgauagcgcuaacguuuucuaugccaugaauagccaggugaacuuugacuucauccugagaaagaaaaacuccauggaggaacaggucaagcuccgcagccggaccucccugacacugccuagaaccgccaaacggggauguuggagcaaucgccacucuaagauuacccuuuga

SEQ ID NO: 74820 - RNA, 2334 nt, Artificial Sequence
  derived and/or modified sequence opt5 from RGL2__Homo_sapiens__NP_004752
augcugcccagaccucuccggcugcuucuggacaccagcccgcccggcggggugguccucuccucuuuccgcagcagagauccugaggaaggaggcgggcccggaggccugguuguugggggaggccaggaggaagaggaagaggaggaagaggaagccccuguguccgucugggacgaggaggaagauggcgcuguguuuacaguuacgucucggcaauaccgcccccuugacccucuggugccgaugcccccucccagaagcucccggcgccucagagccgggacccuggaggcgcugguccggcaccuccuggauacacgcaccucuggaacagacgugagcuucauguccgcuuuucuugccacccauagagccuucacaagcaccccugcucugcucggccugauggccgaucggcuugaagcucuggagucucaccccacggacgaacucgagcgcaccacagagguugccaucuccgugcugagcaccuggcuggcgucucauccggaagauuuuggguccgaggccaagggacagcucgacagacuggaauccuuccuucugcagacaggcuaugcugccgggaaaggagucggcggcgggucugcugaucucauucggaaccugcgcuccagaguggacccucaggcccccgaucuuccuaagccccuggcgcuccccggagacccuccggccgaccccaccgaugugcuggucuuucuggcugaccaccucgccgagcaacugacgcuucuggaugcugaacucuuccugaaucuuaucccuagccagugccugggcgggcucuggggacaucgggacagacccggccacucccaccuguguccuucuguucgcgccacagugacccaguuuaacaaaguggccggggcugucgugagcuccguucugggagcgacaagcaccggcgagggccccggggaggugaccauucggccgcucagaccuccccagcgcgcccggcugcuugaaaaguggaucagagucgcugaggaaugccgccugcuccggaauuucucuuccguguacgccguugugagcgcccugcaaucuagcccuauucauagacugcgcgcugccuggggagaggcgacacgggauucccuuagagucuuuucuagccucugucagaucuucuccgaagaggacaacuauagccagucucgcgagcugcuggugcaggaagucaaacuccaaagcccccuggagccucacagcaagaaggcuccccggucuggcuccagagggggaggcgugguuccguaccuugggacguuucugaaagaucucgugaugcuggacgccgccagcaaggaugaacuggagaauggcuauaucaacuucgacaaacggcgcaaggaguucgcuguccuuuccgaacucagacggcugcagaaugagugcagaggauacaaccugcagccugaucaugacauucaacgcuggcuccagggccugcggccccuuaccgaagcccagucucacagagugagcugugagguugaacccccuggguccucugacccgcccgcuccucgcgugcugagacccacacucgucaucagccaguggaccgaggugcugggauccgugggcguuccuacaccccuggucagcugcgaucggccuucuaccgggggagacgaggcccccacgacaccggcgccucuucucacccgccuggcccaacacaugaaauggcccuccgugagcucucuggauuccgcucucgaaagcucuccuagccugcauucccccgccgacccgagccaccuuucuccucccgcuuccagcccuagacccucccggggccaucgcagaucugccagcugugggucuccccugucuggcggagcggaggaagccagcggcgggaccggauauggcggggagggauccggcccuggggcuucugauugccggauuauccgcgugcagauggaacucggcgaggacggaagcgucuacaaguccauucuggugacaagccaggauaaggccccgucuguuaucuccagagugcugaaaaagaauaaccgggacagcgcugucgccucugaguacgaacuugugcagcuccugcccggcgagcgcgaacugaccauuccugccuccgcuaauguguuuuaugcgauggauggggccagccacgacuuccuccugagacaacggagacgcuccuccacagcuacgcccggagugaccagcggcccuuccgccagcgggacacccccuucugagggaggcgggggcagcuuuccgcggaucaaagccaccggaagaaagaucgcucgcgcccuuuucuga

SEQ ID NO: 74821 - RNA, 1422 nt, Artificial Sequence
  derived and/or modified sequence opt5 from RGL4__Homo_sapiens__NP_705843
augagaaagcugcucaccaaccugcccgccgcugccgugcuuagcgcgcaggucuacuccgcuguucugcaaggccucugggaggaaaaugugugcgggacaccuggacggacgcgcguguguaccgcccugcuuuauggccaggucugcccguuccaggacucuacagaugggcugagaaccaucacaagcauucucuuuaacuggcccccugagaauaccuccguguacuaucagcccccucaacggucuagcuuccgcaucaaacuggccuuuagaaaccuguccuggcccggacucggccuggaagaccaccaggagauuguucuugggcagcuggugcucccugaaccgaaugaggcuaagcccgaugacccugcuccccggccuggacagcaugcccugacaaugcccgcccuugagccggcgccuccccugcucgccgaucugggcccugcucuggaacccgagucucccgccgcucucggcccuccgggguaccugcacagcgcccccggaccugcgcccgccccuggcgaagggcccccgccuggaaccguccuugagccccaauccgcuccugagagcucuugucccugccgcggcuccgugaaaaaccagccuagcgaggaacugcccgacaugacgaccuucccgccuagacuccuggccgaacagcuuacacugauggaugcugagcucuuuaagaaaguugugcugcaugaaugucuggggugcaucuggggacagggccaccucaagggcaaugagcauauggcccccaccguccgggccacaauugcucacuucaaccgccugaccaauuguaucacgacaucuugccuuggggaccacuccaugagagcgcgggaucgcgccagagugguggagcauuggaucaaggucgcucgggaaugucugagccucaacaauuuuucuuccguucacgugauugugagcgcccugugcuccaaccccaucggacaacuucauaaaaccugggccggcgucucuagcaaguccaugaaagagcugaaggaacucuguaaaaaggacacagcugugaagcgcgaucugcugauuaaagccgggagcuucaagguugcgacccaggagagaaauccucagcgggugcaaaugagacuccgccggcagaaaaagggagucgugccguuucugggcgacuuccuuaccgaacugcagagacucgauucugcuauccccgacgaccuggaugggaacacaaauaaacgcuccaaggagguucgggugcugcaggagaugcaacuucuccaggucgccgccaugaacuauagacugcgcccucuggaaaaauuugugacguacuucacccggauggagcagcucagcgacaaggaaucuuauaagcugagcugccagcuugagcccgaaaacccuuga

SEQ ID NO: 74822 - RNA, 1377 nt, Artificial Sequence
  derived and/or modified sequence opt5 from RGMA__Homo_sapiens__NP_001159755
augggcgggcugggacccagacgggccggcaccagccgcgagagacucguggucacagggcgggcuggauggaugggcauggggcgcggagccggcagauccgcgcugggcuucuggccuacgcuugcuuuucugcucugcucuuucccggccgccaccagccccuguaagauccugaaaugcaacuccgaauuuuggucugcuacaagcgggucccacgccccugcuucugacgauacccccgaguucugugccgcgcuucggagcuacgcccugugcacacgcagaaccgcucggacaugucgcggagaccucgccuaucauuccgcuguucacggcauugaagaucugaugagccagcauaauugcucuaaggacgggccuaccucccaacccagacugcggacgcucccuccggccggagauagccaggagcgcucugacucccccgaaaucugucacuacgagaaaucuuuucauaagcacucugcgaccccuaacuauacacacugcggccuguucggggauccccaucuuagaaccuuuacagaccgguuccagaccuguaaagugcagggagccuggccucugauugauaauaacuaccucaaugugcaagucacgaacacacccgugcugccgggcuccgcugccaccgcuacaagcaaacuuaccaucauuuuuaagaauuuccaggagugcguugaccagaagguguaucaggccgaaauggaugagcugccugccgcuuuugucgacggcuccaagaacgggggagauaaacacggcgcgaauagccucaagaucaccgaaaaagugagcgggcaacauguugagauccaggccaaguacauuggaacaacgaucgugguccgccaggugggcagauaucugaccuucgcugugcggaugcccgaggaagucguuaacgccguggaggacugggacucccaggggcuguaccucugucugagaggaugcccucuuaaucaacagauugauuuucaggccuuccacacaaacgcugaaggcaccggcgcccgccggcuggcggcugccagccccgcccccacagcuccugagaccuucccguacgaaacggccguggcuaagugcaaagagaagcuccccgucgaggaccuguauuaccaagccuguguguuugaucuucugacaaccggggacguuaauuucacccucgcggccuauuacgcucuggaagaugugaaaaugcugcacucuaacaaggacaaacuccaucuguaugagagaacacgcgaucuuccuggacgggccgcugccggccugccccucgcgccuagaccccugcuuggggcccuggucccgcuccuggcucugcucccuguguuuugcuga

SEQ ID NO: 74823 - RNA, 1437 nt, Artificial Sequence
  derived and/or modified sequence opt5 from RGMB__Homo_sapiens__NP_001012779
augaucagaaagaaacggaagcgcagcgcucccccuggcccgugcagaucccacgggccccggccugcuaccgcccccgcgccucccccuucuccggagcccacacgcccugcuuggacgggaaugggccugagagccgcccccagcuccgcugccgcugccgcggccgaaguggagcagcggcgcucuccugggcucugucccccgccucuggaacuucugcuccugcuucuguucagccucggacugcugcaugcuggcgacugccaacagcccgcccagugucggauucagaaaugcaccacagauuuugucucccucaccucucaccugaacagcgcuguugacggguucgauuccgaguuuuguaaggcccuuagagcguacgccggaugcacacaacgcaccagcaaagccuguagaggcaaucugguguaucauucugccgugcucggcaucuccgaccugaugagccagcggaacugcucuaaggaugggccuacauccagcaccaaucccgaagucacgcacgaccccuguaacuaccauucucacgcuggagcccgcgagcacagacggggcgaucagaauccuccguccuaucuuuucugcgggcuguuuggagacccccaucuccgcaccuucaaggauaacuuucagacauguaaaguggagggcgccuggccucugauugacaauaacuaccugagcguucaagugaccaauguccccgugguuccuggguccucugcuacagcgaccaacaagaucacgauuaucuucaaagcccaccaugaaugcacagaucagaagguguaucaggcugucaccgacgaucuccccgccgccuuuguggacggaacaaccagcggcggcgacuccgaugcuaaaagccugagaaucguggagcgggaaucugggcacuacgucgagaugcacgccagauauauuggaaccacaguuuucgugcgccaggugggccgguaccuuacgcuggcgaucagaaugccggaggaccucgcuauguccuacgaagagagccaagaucugcagcuuugcgucaauggguguccucugucugaacgcauugacgauggacagggccaagugagcgccauccucgggcauucccugccccggaccucucugguucaggccuggccuggauauacacucgagaccgcuaacacacagugccacgaaaagaugcccgugaaggacauuuacuuucagagcugugucuucgaucugcuuaccacgggcgacgccaauuuuacagcugccgcgcauuccgcccuggaggauguggaggcucuccacccuagaaaagaacgcuggcauaucuuccccagcucuggcaacgggaccccgcggggaggcuccgaccugagcguuucucuugggcugaccugccucauucugaucguguuccuguga

SEQ ID NO: 74824 - RNA, 900 nt, Artificial Sequence
  derived and/or modified sequence opt5 from RGN__Homo_sapiens__NP_004674
augagcuccaucaagauugagugcgugcugcccgaaaacuguagaugcggcgagucuccugucugggaagagguuagcaauucccuccuguucguggacaucccggccaaaaaggugugucggugggauucuuuuaccaaacagguccaacgcgugacaauggacgcucccguuagcuccguggcccuuagacagucugggggauacgucgcgacgauuggcaccaaguucugcgcucugaacuggaaagaacagagcgccgugguucucgccacaguggauaaugacaagaagaacaaucgguuuaacgaugggaaagucgacccugcuggacgcuauuucgccggcaccauggcugaggagacagcccccgcggugcuggaaagacaccagggggcccuuuacucccuguuuccugaucaucacgugaagaaauauuucgaccaagucgauaucagcaauggacucgacuggucucuggaucauaagaucuuuuacuauauugacucccugagcuacucuguugaugcuuucgacuaugaccuccagaccggccagaucuccaaccggcgcagcguguacaaacuggagaaggaggaacagauucccgauggcauguguaucgacgccgaggggaaacuuuggguggcuugcuacaauggaggcagagucauucggcuggauccugugacagggaagcgccuccaaaccguuaagcugccgguggacaaaacgaccucuuguugcuuuggaggcaagaacuauuccgaaauguacgucacaugugccagagaugggauggaccccgagggacuucugcggcagccugaagcgggcggcaucuucaaaauuaccgggcucggagugaagggcaucgcccccuauagcuacgcuggguga

SEQ ID NO: 74825 - RNA, 5271 nt, Artificial Sequence
  derived and/or modified sequence opt5 from RGPD2__Homo_sapiens__NP_001071638
augagacgguccaaggccuacggagagcgcuaucuggcuuccgugcaggggucugcccccagcccuggcaaaaagcucagaggcuucuacuuugcgaaacuguauuacgaagcuaaggaguaugaccuugccaaaaaguacgucugcaccuaucuguccguucaagaacgggauccgcgcgcccacagauuccucgggcugcuuuacgagcuggaagagaacacagagaaggcuguggaauguuaccggcgcucucucgagcugaaucccccucagaaagaccuggugcucaagaucgccgaacugcuuugcaaaaacgaugucacggacgggagagcuaaguauuggguggagcgggccgcgaaacuguuucccggcagcccugccauuuacaagcucaaggagcaucugcuugauugugaaggggaggacggauggaauaaacuguucgauuggauccaguccgaacucuauguucgccccgacgaugugcacaugaacauuagacuggucgagcuguaccggucuaauaagcgccucaaagacgcuguggccagaugccacgaagcugagcggaacaucgcccugcgcagcucccuugaguggaauagcuguguugugcagacccugaaggaauaucucgagucucugcaaugccuugaauccgauaaaagcgacuggagagcgacaaacaccgaucugcuccuggccuacgcuaaucugaugcuccugacacuuucuacccgggacguccaggaguccagagaacugcucgagagcuuugacucugcccugcaguccgcuaagagcucccuuggcggcaacgaugagcugucugccacauuccucgaaaugaaagggcacuuuuauaugcacgccggaagccugcugcucaagaugggccagcacgggaauaacgugcaauggcaggcucuguccgagcuugcggcccuguguuacgugauugcuuuccaggucccucgcccgaagaucaaacucaucaagggagaagccggccagaaucugcuggagaugauggccugcgaccggcuuagccaaucugggcacaugcuccugaaccuguccagaggaaaacaggauuuucucaaggaaguuguggagaccuucgcuaauaaaagcggccagucugugcuguacaacgcccuuuuuagcucccaaucuagcaaggacacguccuuccugggcagcgaugacauugggaacaucgauguccaggagcccgaacucgaggaccuggcgcgcuaugaugugggagcuauucaggcccauaauggcucucugcagcaccuuaccuggcucgggcugcaauggaacucccugccugcccuccccggaauccggaaguggcugaaacagcuuuuucaucaucugccucaggaaacaagcagacucgagaccaaugcucccgagucuauuuguauccuggaccuggaaguuuuccuucucggcguggucuacacaucccaucugcagcugaaggagaaaugcaacagccaucacuccucuuaucaaccgcucugucugccucuucccgugugcaagcgccugugcaccgaacggcagaaaagcuggugggaugccguuuguacgcucauucauagaaaggcugugccuggaaauuccgccgagcugcgccuggucgugcagcacgaaaucaacacacuucgggcgcaggagaagcauggacuccaacccgcccugcugguccacugggcuaaaugccuccagaagaugggcagaggccucaauucuagcuacgaccagcaggaguauaucgggcgcuccgugcacuacuggaaaaagguucuuccccugcucaaaauuaucaagaagaacagcauuccugaaccgaucgacccccuguucaaacauuuucacucuguggauauucaagccuccgagaucgucgaauaugaggaagacgcucauaucaccuucgccauucuggaugcggugcacggaaauaucgaggacgccguuacagcuuuugagagcauuaagucuguggucuccuacuggaaccuugcccugaucuuccaccggaaagcugaagauauugagaaugacgccguguuuccugaggaacaggaagaguguaagaacuaccucagaaaaacccgggauuaucugaucaagaucauugacgauagcgacucuaaucucagcgugguuaaaaagcugcccgucccucuugaguccgugaaggaaaugcugaaaagcgugaugcaggagcucgaagauuacucugagggcgggccccuguauaagaacggaucccugcgcaaugccgacagcgagaucaaacauuccaccccgucuccuacaaaguacagccuuucccccucuaaaagcuauaaguacuccccuaagacgcccccuagaugggcugaagaucaaaacucucugcggaaaaugauuugccaggaggucaaggcgaucaccaaacucaacagcuccaagagcgccucuagacaccgcuggcccacagaaaauuauggcccggacuccgugccugacggguaccagggcagccagaccuuccauggagcuccccugacaguugccaccacgggccccucuguguacuauucccaaagcccugccuacaacucucaguaucuccugcggccggcugccaaugucacacccaccaaaggguccagcaacaccgaguuuaaguccacaaaggaaggauucagcauugcggugucugcugauggcuuuaaauucgggaucagcgagccuggaaaucaggagaagaaauccgaaaagccccuugagaacgacaccggcuuucaggcccaagauauuucugggcagaaaaauggcagaggaguuaucuucggccagacaagcuccacguuuaccuucgccgacguggcuaagucuacaagcggggaaggauuccaguuuggcaagaaagauccuaacuucaagggguuuuccggagccggcgagaaacuguucucuagccaaugugggaagauggcgaauaaagcuaacaccuccggcgacuuugaaaaggaugacgaugccugcaaaacagaggacagcgaugacauccacuucgagcccgucgugcagaugccugaaaagguugagcucgugaccggagaagagggcgaaaagguccuguacucucagggggugaaacuguuucgcuucgaugccgagauuucccaauggaaggagagaggacuuggcaaucugaaaauccucaagaacgaagugaaugggaaaccccggaugcugaugcgcagagaccagguccucaagguuugugcuaaccauuggauuacgaccacaaugaaucugaagccgcuuagcggaucugaccgggccuggauguggcuggcuuccgauuuuagcgacggcgaugccaaacuggagcgccucgcggcccaguucaagaccccugaacuggcugaggaguuuaaacagaaguucgaagagugccaaagacuucugcucgacaucccccugcagacaccucacaaacucguggauaccgggcgggccgcuaagcugauucagcgcgccgaagagaugaaguccggccuuaaagacuuuaagacguuccugacaaacgaucagaccaaagugacagaagaggagaacaagggaucuggcaccggggccgcuggagcgagcgacaccacaaucaaacccaauccggaaaacacgggcccuacccuggagugggauaauuaugaccucagagaagaugcccuggacgacaacgucuccagcagcuccgugcacgauagcccccuugcuucuagcccuguucggaagaauaucuuccgcuuugacgaguccacaaccggguucaacuuuucuuucaagagcgcccugucccucucuaaaagccccgccaagcugaaucaauccggaacaagcgugggcaccgaugaagagucugacgucacgcaggaggaagagagagauggccaguacuuugaacccgugguuccucucccggaccugguggaggucuccagcggggaagagaacgaacaggugguuuucucccauauggcugaacuuuaucgguacgauaaagacgugggacaauggaaggagagaggcauuggggauaucaaaauucugcagaauuacgacaacaagcagguccgcaucgugaugcggagagaucaggugcugaagcucugugccaaucaccgcauuacacccgacaugucucugcaaaacaugaaaggaaccgaacgggucuggguuuggaccgcgugcgauuuugcugacggcgagagaaagguggagcaucuugccgugcgcuucaaacugcaggacgucgccgauagcuuuaagaaaaucuucgacgaagcuaagacagcccaggagaaagauucccucaucaccccucacgugucucggagcuccacacccagagaaagcccuugugggaagauugcgguugcugugcuggaggaaacgacccgcgagcggacagacgucauccaaggagaugacguggccgaugccgcuucugagguugaaguguccagcaccucugagacaaccacgaaggccgucgugucucccccuaaauuugucuucggcagcgaaucugugaagagaauuuucagcuccgagaaaucuaauccguuugcuuucggcaacagcuccgccaccgggagccucuuuggauucuccuuuaaugcgccccugaagucuaacgacagcgaaacauccucuguugcccagagcggcuccgagucuaaaguggagccuaagaagugcgaacuuagcaaaaacuccgauaucgagcagagcucugacuccaaggucaaaaaucugagcgcuucuuuccccauggaagaguccagcauuaacuauaccuuuaagacaccugaaaaagagcccccgcuguggcaugccgaguucaccaaggaggagcuggugcagaagcugucuuccacaaccaaaagcgcugaucaacuuaaugggcugcuccgggaaacggaggccacauccgccguucugauggagcagaucaagcugcucaaaagcgaaauccgcagacuugagcggaaccaggaagagucugcugcgaauguggaacaccugaagaacguccugcuccaguuuauuuuccugaaaccuggaagcgagcgcgagucccuucugcccgugaucaauaccaugcuccaacugucucccgaagagaagggcaagcuggccgcuguggcccaggggcuccaggaaaccagcauuccuaaaaagaaauga

SEQ ID NO: 74826 - RNA, 876 nt, Artificial Sequence
  derived and/or modified sequence opt5 from RGR__Homo_sapiens__NP_001012738
auggccgagaccagcgcucugcccacaggcuucggggaacucgaggugcuggccgucggaaugguucuucugguggaagcgcucuccggccugucucuuaacacgcugaccaucuuuagcuucugcaagacaccugagcucagaaccccgugucaucugcuggugcucucccuggcucuugccgacucugggauuagccugaaugcccucgucgcugccacauccucucugcuucggcgcuggcccuacggaagcgauggcugccaggcucacggguuucaaggauucgugaccgcccuggcguccaucuguagcucugccgcuauugccuggggcagauaucaccauuacugcacacggucccagcucgcuuggaacagcgccguuucucuggugcuguuugucuggcucuccagcgcguucugggccgcucugccucuucugggcugggggcacuaugacuacgaaccccucggaaccuguugcacgcuggauuauucuaaaggcgaccgcaauuuuaccuccuuccuuuuuacaaugagcuucuuuaacuucgccaugccucuguuuaucaccauuacauccuacucucucauggagcagaagcuggggaaaagcggacaucuucaggugaauaccacgcuccccgcuagaacacugcuucugggcugggggccuuaugccauccucuaccuguacgccguuaucgcugaugugaccuccauuagcccgaagcugcaaaugguccccgcgcugaucgccaaaauggugccuacaauuaacgcuaucaauuaugcccucggaaacgagauggugugucggggcauuuggcagugccugucuccccagaagcgcgaaaaggacagaaccaaauga

SEQ ID NO: 74827 - RNA, 546 nt, Artificial Sequence
  derived and/or modified sequence opt5 from RGS10__Homo_sapiens__NP_001005339
auguucaacagagccgugagccggcugucccgcaagagacccccuucugacauccacgauagcgacggcuccucuagcuccucucaucagagccucaaauccaccgcuaagugggccgcgagccuggagaaucuucuggaagauccggagggggucaaacgguuucgcgaguuccucaagaaagaauuuucugaagagaacguucuguucuggcuugcuugcgaggacuuuaagaagaugcaagauaaaacacagaugcaggaaaaggccaaagagauuuacaugacguuccuguccagcaaggccucuucccaggugaauguggaaggacaaagcagacucaacgagaaaauccuggaggaaccccacccucugauguuucagaagcuccaggaccagauuuucaaucugaugaaguaugauucuuacucccgguuucuuaaaagcgaccuguuccucaagcauaaacgcaccgaggaagaggaagaggaucugcccgacgcucaaacagccgcuaagagagccucccggaucuauaacaccuga

SEQ ID NO: 74828 - RNA, 1341 nt, Artificial Sequence
  derived and/or modified sequence opt5 from RGS11__Homo_sapiens__NP_003825
auggagagaguggucguuagcaugcaggaccccgaucaaggcgugaagaugcggucccagcgccugcucgugaccgucaucccucacgccgugacagggucugacguugugcaguggcuggcucagaaauucugcgucagcgaagaggaagcccuucaucugggagcggugcucguucaacacggcuacauuuauccgcugagagauccccggucccuuaugcugcgcccugacgagacgcccuacagauuucagaccccuuauuucuggacaucuacccuccggcccgcugccgaacuggauuacgccaucuaucuggcuaagaaaaacauucgcaagagagggacacucguggacuacgagaaagauuguuaugaccggcugcauaagaagaucaaucacgccugggaucuuguccugaugcaggcucgcgagcagcucagagccgcgaaacaacggagcaagggagaccgccuggugauugccugccaggaacagaccuacuggcuugugaacagaccuccgcccggcgcuccugauguccuggagcaggggcccggacggggcuccugugccgcuucucgcguucucaugacaaaaagcgccgacuuucauaagagagaaaucgaguacuuccggaaagcgcugggcagaacccgcgugaaguccagcgugugccuggaggccuaucucucuuuuugugggcaacggggaccucacgauccccuggucuccggcugccuuccgagcaauccuuggaucucugacaacgacgcuuacugggugaugaaugcccccacgguugcugccccuaccaagcugagaguggaacgcuggggguucuccuuucgggagcuccuggaagaucccgucggcagagcccacuucauggacuuucuuggaaaagaguucagcggggaaaaccugucuuuuugggaggcuugugaggaacuccgcuauggagcgcaggcccaggugcccacacugguugaugcuguguacgagcaauuccuggccccuggcgccgcucauugggucaauauugacucccggaccauggaacagacacucgagggccugagacagccgcaccgcuaugugcuugaugacgcccagcugcauaucuacaugcucaugaagaaagauagcuauccccgguuucugaaguccgacauguacaaagcgcuucuggcugaagccgggauuccucucgagaugaagagacgcgucuuccccuucaccuggcggccuagacacucuagccccuccccggcccugcugccuacgcccguggagccuacagcugccugcggacccggcgggggagauggcguugcuuga

SEQ ID NO: 74829 - RNA, 2400 nt, Artificial Sequence
  derived and/or modified sequence opt5 from RGS12__Homo_sapiens__NP_937870
augaaccugggcaaggagcucagcaaugaaacccacguguccaacgaccagcaaucugccacagucagcgauggggagcugacgggagcugaccuuaaagauugcguuuccaauaacucucugagcuccaaugccucucuccccagcgugcaguccuguagacggcugcgcgaaagacggguggcgagcugggcugucucuuucgagcgccuucugcaggacccugugggcguuagauacuuuuccgauuuccuccggaaggaauuuagcgaggagaacauccuguucuggcaggccugcgaauauuuuaaucaugugccggcccacgacaaaaaggagcugucuuaccgcgcuagagaaauuuucuccaaauuucucuguagcaaggccaccacacccgucaacaucgauucucaagcucagcuggccgacgaugugcuucgggcgccucaucccgacauguucaaggagcagcagcugcaaauuuuuaaucucaugaaauucgauuccuauacccgcuuucuuaagagcccucuguaccaggagugcauccuggccgaaguugaggggagagcucuccccgacucccaacaggugccuucuagcccggccuccaaacacagccugggaucugaucauuccagcgucucuacacccaagaaacugagcggcaaguccaagucugggcggagccucaacgaggaacugggagacgaagacuccgagaaaaagcgcaaaggcgcuuucuuuagcuggucuagaacccgguccacaggccgcagccagaagaaaagagagcacggggaucacgccgacgaugcgcuucaugccaauggaggccugugucggagagaaucucagggguccgugagcuccgcuggaucucucgaccugagcgaggccugccgcacccuugcuccugaaaaggauaaagccacgaagcacuguugcauucaucugcccgacggcaccuccuguguggucgccguuaaggcuggguucucuaucaaagauauccucagcggacugugcgagcggcacggcauuaacggcgcggccgcugaccuguuccucgugggaggagauaagccucuggugcuucaccaggacuccagcauccuggaaucuagagaucuccgccuggagaaacggacacuuuuuagacuggaccucguccccauuaaucgcuccgugggccugaaggccaaaccgaccaagccuguuacagaggugcugcggcccgucguggccagauaugggcucgaccugagcggacuucugguucgccucucuggcgaaaaggagccucuggaucugggggcucccaucuccagccuugacggacaacgggugguccucgaagagaaagaucccucuagaggcaaggccagcgcggacaaacagaagggcgugccugucaaacagaacaccgcuguuaauuccagcucucgcaaccauuccgccacgggggaggaacggacacugggaaagagcaacuccauuaagaucaaaggcgagaaugggaagaacgccagagauccgcggcugucuaaacgcgaagagagcauugcuaagaucgggaaaaagaaguaccagaaaaucaaucucgacgaagccgaggaguucuuugaacugauuuccaaggcucaaucuaacagagccgaugaccagcggggccuucugagaaaagaggaucucgugcugcccgaguuccugcgccuuccucccgggagcaccgaacucacacugccuacccccgcggccguggcuaagggcuuuuccaaacggucugccaccggaaauggcagagaaagcgcuucccagccgggggagcagugggagccuguccaagaaagcucugacucccccagcacaucuccuggauccgccagcucucccccuggacccccggggacgaccccucccggacagaagucccccagcggcccuuucuguacaccgcagucccccgugagccuggcgcaggaggggaccgcccaaaucuggaaacgccagucucaggaaguugaggcuggcggcauucagacaguggaagaugagcacgucgccgagcucacccugaugggcgaaggggacaucagcuccccuaacucuacgcuucugcccccucccagcacaccucaagaggugcccggaccguccagaccuggcucugggacccauggaagccgggaucuccccgugaaucgcauuaucgacguugaccuggucaccggcuccgcuccugggagagauggcggaaucgccggcgcccaggcugggcccggacggucucaggcgagcggcgggccgccuacauccgaccugcccggacuuggcccugugcccggggaacccgccaagccuaagaccagcgcucaccaugccacauuuguguga

SEQ ID NO: 74830 - RNA, 480 nt, Artificial Sequence
  derived and/or modified sequence opt5 from RGS13__Homo_sapiens__NP_002918
augagcagacggaacugcuggaucuguaagaugugccgcgacgaguccaaaagacccccuucuaaucugacccucgaagaggugcugcagugggcccagagcuucgaaaaccuuauggcuacaaaguacggcccggucguuuaugccgcguaccugaaaauggagcacuccgaugaaaauauucaauuuuggauggcuugugagacguauaagaaaaucgccucucgguggagccgcauuuccagagccaagaagcucuacaaaaucuauauucagccccagucuccucgggagaucaacaucgacagcuccacccgcgaaacaauuaucagaaauauucaagagcccaccgaaacaugcuucgaggaggcucagaagaucguguacaugcauauggaacgggauagcuauccucgcuuucugaaaucugagauguaccagaaacuucugaagaccaugcaguccaacaauagcuucuga

SEQ ID NO: 74831 - RNA, 1701 nt, Artificial Sequence
  derived and/or modified sequence opt5 from RGS14__Homo_sapiens__NP_006471
augcccggcaagccuaaacaccugggggugccgaacggaagaaugguccucgccguuagcgacggcgagcuguccucuaccacagggccccagggacaaggcgaagggcggggaagcucccuuucuauccauagccugccuuccggccccucuagcccuuuccccacggaggaacagccuguggcuuccugggcccucagcuuugagcgccugcuucaggauccgcugggccucgcguacuucaccgaauuucugaagaaagaguucucugcugagaaugugacauuuuggaaggccugcgaaagauuccagcaaauucccgccuccgacacccagcagcuggcucaggaggcccggaacaucuaucaagaauuucucagcucucaggcucuguccccugucaauauugaucgccaggccuggcuuggggaggaggugcuggcggaacccagaccugacauguuccgggcccagcaacuccagaucuuuaaccugaugaaauucgauagcuacgcucgcuuuguuaagucuccccuuuauagagagugucugcucgccgaagcugagggacggccgcugcgcgaaccuggcuccagcagacuggggucccccgacgccacacggaagaaaccuaagcucaaacccggaaagucucugccccuuggcguggaggagcuggggcagcucccuccggucgaaggacccggcggccgcccucugagaaagagcuuccggcgcgagcuugggggaaccgcgaaugccgcucugagacgggaaucccaaggcagccucaacucuuccgccagccuggaucugggguuucucgcuuucgugucuagcaaauccgagucucacagaaagagccugggauccacagaaggcgagagcgagucucgccccgggaaauacugcuguguuuaucuuccugacggaaccgccucccuggcccucgcucggcccggccugacgauuagagauaugcuugcgggcaucugcgaaaagcgcgggcugagccucccggacaucaaaguguaccuggucggaaaugagcaggcccuggugcucgaucaggacuguaccgugcuggcugaucaggaaguccggcuugagaacagaauuacauucgaacuggagcucaccgcccuggagcgcguugugcggaucucugccaagccuacaaaaagacugcaagaagcccuucagcccauucucgagaagcauggccuguccccucuggaagugguccuccaccgccccggggagaaacagccucuggaccuuggaaagcuggugagcuccguugcugcgcagcggcucgugcuggacacccugcccggcgucaagaucucuaaagcuagagauaagagcccgugccgcucccaaggguguccuccccggacgcaggacaaagccacacaucccccuccggccucucccagcucccuugugaagguuccuagcucugcuaccggcaaaagacagacaugcgauauugagggacucguggaacugcugaaucggguccaguccagcggcgcccacgaccaacgcgggcuccugagaaaggaggaucuugugcugcccgaauuucuccagcugccugcucagggacccucuuccgaggaaaccccuccccagaccaagagcgccgcgcaaccgaucggcgggucucugaacagcacaacggacuccgcccuuuga

SEQ ID NO: 74832 - RNA, 609 nt, Artificial Sequence
  derived and/or modified sequence opt5 from RGS16__Homo_sapiens__NP_002919
augugcagaacccuggccgcuuuccccacaacgugucucgagcgggccaaggaauuuaaaacccgccugggcaucuuccuucacaagagcgagcuggggugcgacacaggauccaccggcaaauuugaaugggggucuaagcauagcaaagagaacagaaauuucuccgaagaugugcucggauggcgggagucuuuugaccugcuucugagcuccaagaacggcgucgcggcuuuccacgccuuucucaagacagaguucucugaagagaaucuggaauuuuggcuggccugugaggaguucaaaaagauucgcagcgcuaccaaacucgccuccagagcucaucagaucuuugaagaguucauuugcagcgaagccccuaaggagguuaacaucgaucacgaaacacaugagcugacccggaugaaucuucaaacggcgaccgccacauguuuugacgcugcccaggggaaaacccgcacacugauggagaaggauucuuacccgagauuccucaagucccccgcuuaucgggaccuggccgcgcaggccagcgcugccucugcuacccuuuccagcugcucucuggaugaaccuucccacacguga

SEQ ID NO: 74833 - RNA, 666 nt, Artificial Sequence
  derived and/or modified sequence opt5 from RGS17__Homo_sapiens__XP_011534055
augagcucccagcugggccccgagguggccgaaaugagaaagcggcaacagucucagaacgagggcaccccugcugucagccaggccccgggaaaucaacgccccaacaauacaugcuguuucugcugguguugcuguugcuccuguucuugccucacgguuagaaacgaggaacggggcgaaaaugcggggcgcccuacccacacaaccaaaauggagagcauccaggugcuggaggaaugucagaaccccacagcugaggaagugcuuuccuggucucagaauuuugacaagaugaugaaagccccugccggaagaaaccuguuccgggaguuucuccgcaccgaguacagcgaagagaaucugcuuuucuggcuggcuugcgaagaucucaagaaagagcaaaacaagaaggucauugaagagaaagccagaaugaucuaugaggacuacauuuccauccugagccccaaggaagugucucuggauucccggguucgcgaggugauuaauagaaaccuccuggacccuaauccgcauauguaugaagaugcucagcuucagaucuacacacugaugcaccgggacagcuuuccccgcuuccucaacucucagaucuauaaauccuuugucgagagcaccgccgggucuuccagcgaauccuga

SEQ ID NO: 74834 - RNA, 708 nt, Artificial Sequence
  derived and/or modified sequence opt5 from RGS18__Homo_sapiens__NP_570138
auggagaccacccuucucuucuuuagccagaucaacaugugcgaauccaaggagaaaacguucuuuaagcugauucacggcucugggaaagaagagaccagcaaggaagccaaaaucagagcuaaggagaagcggaaucgccuuucccugcucgugcaaaaacccgaguuccaugaagacacaagaucuagccgguccggacaccuggccaaggagacccgcgucucuccugaagaggcgguuaaauggggcgagagcuuugauaagcugcugucccauagagacgggcucgaagccuucacacgguuucugaaaaccgaguucagcgaagagaacauugaauuuuggaucgcuugugaggauuucaagaagucuaaaggaccgcagcagauucaccugaaggccaaagcuaucuacgagaaguuuauccagacagacgcccccaaagaagugaaucucgauuuccauaccaaggaggugauuacgaacuccaucacccaaccuacacugcacagcuuugacgcugcccagucucgcgucuaucagcuuauggaacaggauuccuacaccagauuccugaaaagcgacauuuaucucgaucugauggagggccggccccaacgcccuacaaaucuuagacggcgcucuagauccuucacaugcaacgaauuucaggacgugcagagcgauguugcgaucuggcuguga

SEQ ID NO: 74835 - RNA, 654 nt, Artificial Sequence
  derived and/or modified sequence opt5 from RGS19__Homo_sapiens__XP_011526788
augcccaccccucacgaggccgaaaagcagaucacaggcccggaggaagcugacagacccccuagcauguccucucaugauacggccagccccgcggcuccuucccggaaccccugcugucugugcugguguugcuguugcucuuguagcuggaaucaagagcgcagacgggccuggcaggccucccgcgaaucuaaacuccagccucugccgagcugcgaggugugugcuacccccuccccugaggaaguccagagcugggcccaaucuuucgacaaacuuaugcacucccccgcugggagaagcguuuuucgggccuuccugcgcacagaguacucugaagagaacaugcucuuuuggcuggcgugcgaggaacuuaaggccgaggcuaaucagcaugugguggaugaaaaggccagacugauuuaugaggacuacgucuccauccucagcccuaaagaagugucucuggauucccggguucgcgagggaauuaacaagaagaugcaggagcccagcgcucacaccuucgacgaugcccagcugcaaaucuauacacucaugcauagagacuccuacccgcgguuucugucuagcccuaccuaucgcgcgcuucugcuccagggccccucccagucuagcuccgaagccuga

SEQ ID NO: 74836 - RNA, 630 nt, Artificial Sequence
  derived and/or modified sequence opt5 from RGS1__Homo_sapiens__NP_002913
augagagccgcugccaucagcacccccaagcuggacaaaaugccuggaauguucuuuuccgcgaacccgaaggagcucaaagggacaacgcacucucugcuugaugacaagaugcagaaacggcgccccaagaccuucggaauggauaugaaggcuuaccugagaagcaugauuccucaucucgaauccggcaugaaaucuagcaaguccaaagacgugcugucugccgccgaggucaugcaauggagccagucccuugaaaagcugcucgcuaaucagacagggcagaacguuuuuggcagcuuccugaaaucugaguuuuccgaagagaauaucgaguucuggcuggccugcgaagauuauaagaagaccgagagcgaccuccugcccuguaaagcugaagagauuuacaaggccuuugugcacucugaugcggccaaacaaaucaacauugacuuccggacacgcgaguccaccgcuaagaaaaucaaggccccuacaccuaccugcuuugaugaagcucagaaagugaucuauacgcuuauggagaaggacagcuaccccagauuccugaagucugauauuuaucucaaucugcuuaacgaccugcaggccaauucccucaaauga

SEQ ID NO: 74837 - RNA, 726 nt, Artificial Sequence
  derived and/or modified sequence opt5 from RGS20__Homo_sapiens__NP_003693
augagaaccgccgacggcggggagcccgcuggagccagcuccccugcgggccggguggaugggggacugcagaugggcucugaacgcauggagaugagaaagcggcaaaugccggcugcccaggacacacccggggccgcuccuggacagcccggcgccggcagccgcggguccaacgcuugcuguuucugcugguguugcuguugcucuuguagcugccucacggucagaaaucaggaagaucaacggccuaccaucgccucccacgagcugcgcgcggaccuucccacaugggaagagucuccugccccgacccuggaggaaguuaacgcuugggcccagagcuuugauaaacucauggugacacccgcuggaagaaaugccuuccgggaguuucugcgcaccgaauuuuccgaggagaacaugcuuuucuggauggcgugugaagaacugaagaaagaagccaauaagaacauuaucgaggaaaaagcuagaauuaucuacgaggacuauauuagcauccucucuccuaaggaggugucccuggauagccggguccgcgaagugaucaauagaaacaugguugagcccucucagcauauuuucgacgaugcccagcugcaaaucuacacacucaugcaccgggacuccuauccucgcuuuaugaauagcgcuguguacaaggaucugcuucagucucuguccgagaaaagcauugaggccuga

SEQ ID NO: 74838 - RNA, 459 nt, Artificial Sequence
  derived and/or modified sequence opt5 from RGS21__Homo_sapiens__NP_001034241
augcccgugaagugcuguuucuacagaagcccuaccgccgagacaaugacgugguccgaaaacauggacacccugcucgcuaaucaggccggccuggaugcguuucggaucuuccuuaaaucugaguuuagcgaagagaacgucgaguucuggcuggcuugcgaagacuuuaagaaaacaaagaaugccgauaaaauugccuccaaggcuaagaugaucuauucugaguucauugaagccgacgcuccgaaagagaucaacauugauuuugggacccgcgaccucaucagcaagaauaucgccgaacccacacugaaauguuucgaugaggcgcagaaacuuauuuacugccugauggccaaggacuccuuuccuagauuccucaagucugagaucuauaagaaacugguuaacagccaacaggugcccaaucacaagaaauggcugccuuuucucuga

SEQ ID NO: 74839 - RNA, 3759 nt, Artificial Sequence
  derived and/or modified sequence opt5 from RGS22__Homo_sapiens__NP_001273621
augcccgagaagagacugaccgccgaaccuccgacaaucacggaggaagaguucgaagacagccucgcuaccgaugacuuucugguggauuacuucaacgaguuucuuucccugcccacauucucugaggccauucgguuuaaugcggacuauggcgucuucgaaguugcuaacgaugccccucaguuucucgagaaacaacugaagaaaauccuucagaaucagcagccccgcaacccuauuuacgacguggugagaaaggggaaaaaugaagucaagcccgugcaaaugaacgccccugaugaggacgagaccaucaauguuaacuauaauauuaugugccugagccgggaagagggaaucaaguggaucaaaaaggaacgccucccggcuuuccuggaguccgauuguuacuuugaauauagacuggccaaacucgugucucagguccgguggagcaaguccggcaugaacuucacaguggggucuaauuuuagccccuggauuguuaaaaagccucccucccugccucccccggcuaccgaggaggacaaccuugccagcuacacacagaccaaggauugguucgcgcuggccaaacagucucaacagacgguguccaccuuuagccucccuugcuguguccccuauaauaagcugaaaucuccugcuaucuccagcgugucugaaaacuucauuuucgacgauggagugcacccccgcacaaagaaagaccccuccaagaccaauaaacuuaucagcgaguuugaagaggaagagggcgaggaagaggaagucuccguuucucugcaggacacaccuagccaggcccuccugagaguguaccuggagaagaagcaagauguggacgaaucccucaccaugcauuucagcacgugcgaggaguuucugucuuccuacauuuauuucauccuucgcggggcuauucagcagaucgucggaaaaccggugggcgaaacacccgauuacaucaacuuuaacaauauuaccaagguuagcuucgacgauuguuuugagucuauccacggcaaaaacuuccugagcgaacucgugcaaacaaccaaggagcgguccgaggaaauugagcagaccucucugagcuccaaaaaugaaagcgccgggccugagucuagagcggacuggugcaucucccaucggacauaugauauuggaaaccgcaaggaauuugagagauucaagaaauuuaucaagggcacgcuuggggagcgguacugguggcuguggauggacaucgaacgccucaaaguccugaaggaucccggaagacaccagcggcaucuggagaaaaugaagaaguguuaucucgugagcaauggcgacuacuaucugucugccgaaauucuuuccaaauucaagcugcucgaugggagccaguggaacgaggaacaccugagaaauauccaauccgagguucuuaaaccucugcuccuguacugggcuccccgcuuuugcgugacccacucugccagcacaaaguacgcuuccgccgagcugaaauucuggcaucuccggcaggccaagccgagaaaggacauugacccuuucccccagauggcuacccugcuuccucugcgccccaaaucuuguaucccucagauucccgaaauccaaaaggaggaauuuagccucucccagccgccuaaaagccccaacaagucucccgaggucaaaacagcgacccagaagccuuggaaacgggaacugcuguauccgggauccagcaaggaugacgugaucgagaagggcucuaaauacauguccgagagcucuaaggucauucaccuuacgagcuucacagauaucuccgaaugccucaaaccccagcuggacagacgcuaugccuacaccgaggaaccucgggugaagaccguuagcgaugugggcgcucuugggggaucugacauggagaaucuccugcaaucccuuuaugucgagaacagagccggcuuuuucuuuacaaaauucugugaacauagcgggaauaagcuguggaagaacuccguguacuuuugguucgaucuccaggccuaucaccagcuguuuuaccaggagacccugcaacccuucaaaguuugcaagcaggcucaguaccuuuuugccacauauguggcgccuucugcuacgcucgacauuggacugcaacaggaaaagaagaaagagaucuacaugaagauucagcccccuuucgaagaucuguuugacaccgccgaggaguauauccuccugcuucugcucgaacccuggacaaagauggucaaaagcgaucagauugccuacaagaaaguggagcugguggaagagacccgccaacuggacuccacauauuuccggaaacuucaggcucuccacaaagaaaccuucucuaagaaggccgaggauacgaccugcgagaucggcacagggauccugagccuguccaauguuucuaaaagaaccgaauacugggacaacgucccggcugaguauaagcauuuuaaauucagcgaccuccugaauaacaaacuugaauuugagcacuuccgccaguuucuggaaacacauuccagcucuauggaucucauguguuggaccgacauugagcaguuccggagaaucacguaccgggaucgcaaccaaagaaaagccaaguccauuuacaucaaaaauaaguaucugaacaagaaauacuuuuucggaccuaauagccccgcgucucuguaucagcagaaccaggugaugcaccuuuccggcggcugggggaagauucuccaugagcaacuggacgccccugugcuggucgaaauccagaaacacgugcagaaucggcucgagaacguuuggcugccccuuuuucuggcuagcgaacaauucgccgcuagacagaagaucaaagugcagaugaaggauauugccgaggagcuccugcugcagaaggcggaaaagaagaucggagucuggaaaccgguggagucuaaguggauuuccagcuccugcaaaaucauugccuuucgcaaggcccuucugaauccuguuacaagccggcaauuccagagauucguggcucucaagggcgaccugcucgaaaacgggcugcuguuuuggcaggagguccagaaauacaaggaucugugucacucucauugcgacgaaagcgugauccagaaaaagaucaccacaauuaucaauuguuucauuaacuccucuauucccccugcucuccaaaucgauauccccguugagcaggcccagaaaaucauugagcaccgcaaggaacugggacccuauguguuuagagaggcccaaaugaccaucuucggcguccuguuuaaguucuggccucaguuuugcgaguuccggaaaaaucuuaccgacgaaaacauuaugagcgugcuggaacgcagacaggaguacaauaagcagaaaaagaaacucgcugugcuggaggaugaaaaguccgggaaggacggcaucaaacaauaugcgaacacaucugucccggccauuaagacggcucuccugagcgauuccuuucuuggacugcagcccuacggccggcagccuaccugguguuacucuaaauauaucgaggcccucgaacaagagcgcauucugcugaagauccaggaggaacuugagaaaaagcuguucgccgggcuccagccccugacaaauuuuaaagcuagcuccagcaccaugucucucaagaagaacauguccgcccauagcucucagaaauga

SEQ ID NO: 74840 - RNA, 636 nt, Artificial Sequence
  derived and/or modified sequence opt5 from RGS2__Homo_sapiens__NP_002914
augcagagcgccauguuccuggcugugcaacacgacugcagacccauggauaaguccgccggcucugggcauaaaagcgaggaaaagcgggagaaaaugaagcgcacccuccugaaagacuggaagacaagacuuuccuacuuucugcagaacucuagcacgccuggaaagccgaaaaccggcaagaaauccaagcagcaggcguucaucaaacccucuccugaagaggcucaacucuggagcgaagccuuugaugagcugcuugccuccaaguaugggcuggcugccuuccgggcuuuucucaagagcgaguucugugaagagaauauugaauuuuggcuggccugcgaggacuucaaaaagacaaaaucuccccagaagcuguccagcaaagcgcgcaagaucuacaccgauuuuauugagaaagaagccccuaaggagaucaacauugacuuccagacaaagacccucaucgcucagaauauccaagaagccacaucuggauguuuuaccacggcucagaaaagagucuauucccugauggagaacaauagcuacccccgguuccuugaaucugaguuuuaucaggaucugugcaagaaaccucagauuaccacagagccgcacgccaccuga

SEQ ID NO: 74841 - RNA, 1776 nt, Artificial Sequence
  derived and/or modified sequence opt5 from RGS3__Homo_sapiens__NP_001263190
augaacagauucaauggccugugcaagguguguagcgagcggcgcuacagacagaucaccauuccccgggggaaagacggauuuggcuucacaaucugcugugauuccccuguccgcguucaagccguggacucugggggaccggcugaaagagccggccuccagcagcuggauacggugcuucagcugaacgagcggcccgucgaacacuggaagugcguggagcucgcgcaugaaauucgcagcuguccuuccgagaucauucugcuuguuuggagaauggugccccaagucaaaccugggcccgacggaggcgugcugcggcgcgcuucuugcaagagcacccacgaucuccaguccccuccgaauaaaagagagaagaacuguacacauggcguucaggcccggcccgaacagcgccacucuugccaucuggugugugacagcuccgaugggcugcuccugggaggcugggagagauauaccgaagucgccaagcgcgggggacaacacacacuuccugcucugagccgggccaccgcucccacagacccuaauuacaucauccucgcgccccugaacccgggcucucagcuucugagaccuguguaucaggaggauaccauucccgaggaauccgggagcccuucuaaaggaaaguccuacacgggccucggcaaaaagagccggcugaugaaaaccgugcagacaaugaaggggcacggaaauuaucaaaacugccccgucguuagaccccaugccacccacucuuccuacggcacauaugugacccuggccccuaaggugcucgucuuuccgguguucguucagccccuggaccuuuguaauccugcucgcacgcugcuccugagcgaggaacuucugcucuacgaggggcggaacaaagccgcugaagugacacuguuugccuacuccgaucugcuccuguucaccaaggaggacgagcccggaagaugcgauguccuucgcaauccucuguaucuccagucugugaaacugcaagaaggcagcuccgaggaccuuaaguuuugcguucuguaccucgcggaaaaagccgagugucuguucacacuggaagcucauagccaggagcagaagaaacgggugugcuggugucucucugagaacaucgccaagcagcaacagcuggcugccagcccgcccgacagcaagaugucuggggccgauaccgucggagacgaugacgaagcuagcagaaaacgcaaguccaaaaaucuugcgaaggauaugaaaaacaagcugggcauuuuucggagacgcaaugagucuccuggcgcucccccugccgggaaggccgacaaaaugaugaaguccuucaaacccaccuccgaagaggcccucaaguggggagaaagccuggagaaacugcuugugcacaaguauggccucgcugucuuucaggccuuccugcggacagaguuuucugaagagaaccuggaguucuggcucgcgugcgaagauuucaagaaagugaagucccagagcaaaauggcuucuaaggccaaaaagaucuuugccgaguacauugcuauccaagccuguaaggaaguuaaccuggacuccuauacgagagagcacaccaaagauaaucuucagagcgugacacgcgggugcuucgaccuggcucagaagcggauuuuuggacucauggaaaaagauuccuacccuagauuccugcggucugaccuguaucuugaccucaucaaccagaagaaaaugagcccgccccuguga

SEQ ID NO: 74842 - RNA, 909 nt, Artificial Sequence
  derived and/or modified sequence opt5 from RGS4__Homo_sapiens__NP_001095915
auguacaacaugaugcugcucauccagaagagaaaaggcauugggagccaacugcuucgggccggagaggcugaaggcgaccgcggggccggaaccgcggagagauccucugauuggcuggacggccggagcugggcuaucaaggaaacacccacggggcucgccggacgcagauccgaggauucugacaauauuuucaccggcgaagaggccaaauaugcucagagccggucccacucuagcuccugccgcaucagcuuucugcuugccaacucuaagcugcucaauaaaauguguaagggccuggcugggcugccugccuccugccucagaagcgcgaaggauaugaaacaucggcugggauuccuucugcagaagucugacuccugugagcacaacagcucucauaauaaaaaggauaaaguggucauuugccagcgcguuucccaagaagaggugaagaagugggccgaaagccucgagaaccugaucucccacgaguguggccuugcugccuuuaaggcuuuccugaaaucugaauacagcgaggaaaauaucgacuuuuggauuuccugcgaggaauauaaaaagaucaaaagcccgucuaagcucucccccaaagccaagaagauuuacaacgaguucaucagcgugcaggcgacaaaagaggucaaucuggauucuuguaccagagaagagacaagccggaacaugcuggaaccuaccauuacaugcuuugacgaggcccagaagaaaaucuucaaucucauggaaaaggauuccuaucgcagauuucugaaaucucgguucuaccuugaccuggugaaccccagcuccuguggggcugagaagcagaagggagccaaaagcucugcugauugcgccucccucguuccucaaugugccuga

SEQ ID NO: 74843 - RNA, 222 nt, Artificial Sequence
  derived and/or modified sequence opt5 from RGS5__Homo_sapiens__NP_001241677
auggccgagaaggcuaaacagaucuacgaagaguucauucaaaccgaagcccccaaggaggugaacaucgaccacuuuacaaaagauauuacgaugaagaaucuggucgaaccuagccucuccucuuucgacauggcgcagaaaagaauccaugcucugauggagaaggauagccuuccgcgguuuguucgcuccgaguucuaucaggaacugauuaaguga

SEQ ID NO: 74844 - RNA, 1458 nt, Artificial Sequence
  derived and/or modified sequence opt5 from RGS6__Homo_sapiens__NP_001191346
auggcccagggcagcggggaccaaagagcugugggagucgccgaucccgaggaauccucuccuaacaugaucguuuacugcaagauugaggacaucauuaccaaaaugcaggaugacaagacaggcggggugccgauccggacggugaaauccuuccugagcaagauucccucugucgugaccggaacagauaucguucaguggcucaugaaaaaucugagcaucgaagacccuguggaggcgauucaccuuggcucccugaucgcugcccagggguauauuuuucccaucucugaucauguccucaccaugaaggacgauggaacauucuaccgcuuucaagccccuuauuucuggcccagcaacuguugggaaccugagaauaccgacuacgcuauuuaucugugcaagagaacaaugcagaacaaagcccggcuugagcuggcugauuacgaagccgagaaucucgcgcgccugcagagagccuuugcucggaagugggaguucaucuuuaugcaggccgaagcucaagugaaaauugaccgcaagaaagauaagaccgagagaaagauccuggacucccaggaacgggccuucugggacguucaccgcccggugcccggcugugucaacacgaccgagauggauaucagaaaaugccggcgccucaagaauccucagaaagugaagaaaagcguguauggcgucacagaagagucucaggcgcaaucccccguucaugugcugagccagccuauuagaaagaccacaaaagaagacauccggaagcagauuaccuuucuuaacgcccaaaucgaucgccacugucugaagaugucuaaaguggcugagucccucauugccuacacggagcaguacgucgaauaugacccccugaucacaccggcugagccuagcaaucccuggaucucugaugacguggcccuuugggauauugaaauguccaaggagccuagccagcagagaguuaaacgguggggguucuccuuugacgaaauccugaaggaucaagugggaagagaccaguuccuccgcuuucuggagucugaguucagcuccgaaaaccugcgguucuggcucgccguccaggaucugaaaaagcagccccuucaagacguggcuaagagaguugaggaaauuuggcaggaguuucuggcgcccggcgccccuagcgcuaucaaucucgacucucauuccuacgaaauuaccagccagaacgugaaagaugggggacgcuauacauucgaggacgcccaggagcacaucuacaagcugaugaaaucugauagcuaugcccgguuucuuagauccaaugcuuaccaagaccugcuccuggccaagaaaaagccggaaucugagcagggccgccggaccagccuggaaaaguucaccagauccguccucuauagcaacacaccccuggcgaaacgcccuuga

SEQ ID NO: 74845 - RNA, 774 nt, Artificial Sequence
  derived and/or modified sequence opt5 from RGS7BP__Homo_sapiens__NP_001025046
augagcuccgcccccaacggcagaaagaaacggccuucucgcagcaccagauccucuaucuuccagauuagcaagccgccccugcaauccggggacugggagcggcgcggaucuggcagcgaauccgcucacaaaacacagagagcccucgaugacugcaagaugcuggugcaggaguuuaauacgcaggucgcgcuuuaccgggaacugguuaucagcauuggggaugugucuguguccuguccuagccuccgcgcugagaugcauaaaaccagaacaaagggaugcgaaauggcccggcaagcccaccagaagcuggcugccaucucuggccccgaggacggggagauucauccugaaaucugucgccuuuauauccagcugcagugcugucucgagauguacaccacagaaaugcugaaauccauuugccugcucggaagccugcaauuccacagaaagggcaaagagcccggcgggggaaccaagucucuugauuguaaaaucgaggaauccgcugagaccccugcccuggaagacagcuccucuagcccggucgauucccagcagcauagcuggcaagugucuacagacauugagaacacggaacgggauaugcgcgagaugaagaaucuccuguccaaacuuagagagaccaugccccugccucucaagaaccaggacgauagcucucugcugaaucucacacccuauccucugguucggcgcagaaagcggagauuuuucggccuuugcugucugaucagcuccuga

SEQ ID NO: 74846 - RNA, 1275 nt, Artificial Sequence
  derived and/or modified sequence opt5 from RGS7__Homo_sapiens__NP_001269702
auggcccagggcaacaauuacgggcaaaccagcaacggaguggcugacgagucccccaauaugcuggucuauagaaagauggaagauguuaucgcccggaugcaggacgagaaaaacggcauuccuauccgcacagugaagucuuuccucagcaaaauuccguccguguuuucugggagcgauaucguccaguggcugauuaagaaucuuacgaucgaagaccccgcgguguaccugugcaaaagaaccaugcagaacaaggcucggcucgagcuggccgauuaugaagccgagucccuugcucgccugcaaagagccuucgcucggaagugggaguuuaucuucaugcaggccgaagcgcaggccaaaguugacaagaaacgcgauaagauugagagaaaaauccucgacucucaggaacgggcuuuuugggaugugcaccgcccuguccccggaugugugaauacaaccgagguugacauuaaaaagagcuccagaaugcggaacccucauaagacacgcaagagcguguacggccugcaaaaugauaucagaucucacucccccacccauacaccuaccccggagacgaaacccccuaccgaagacgagcugcagcagcagauuaaguauuggcaaauccagcucgaucggcaccgccugaaaaugagcaaggucgccgacucucuucuguccuacacagaacaguaucucgaguacgaccccuuccugcuuccucccgauccgagcaacccuuggcugucugacgauaccacauuuugggaacucgaggcuuccaaagagcccagccaacagagagugaagcgguggggguucggaauggacgaagcccugaaggauccugugggcagagagcaguuucugaaauuccucgaauccgaguuuucuagcgaaaaucugcgcuucuggcuugcggucgaggaccugaagaaacggcccauuaaggagguucccuccagagugcaggaaaucuggcaagaguuucucgccccuggcgcuccgagcgccaucaaccuggauucuaaauccuacgacaagaccacgcagaaugugaaggaacccgggcgcuauacauucgaggaugcucaggaacauauuuacaaacuuaugaaaagcgacucuuauccucgguucaucagaagcuccgccuaccaggagcugcuccaagccaagaagaaaggacgcaacauucccaucuuuccuugccacaagaauuguacccccacacugcgggcuucuaccaaccugcucuga

SEQ ID NO: 74847 - RNA, 543 nt, Artificial Sequence
  derived and/or modified sequence opt5 from RGS8__Homo_sapiens__XP_005245612
auggccgcucugcucaugcccagacggaacaagggcaugcgcaccagacuggggugccuuagccacaaauccgacucuuguagcgauuucacagccauccugccugacaagccgaaucgggcgcucaaacgccuguccacggaggaagcuaccagaugggccgauucuuuugacgugcuucugagccauaaguacggagucgccgcuuuccgggccuuucucaaaacagaguucuccgaagagaaccuggaauuuuggcuggcuugcgaggaguucaagaagacccgcucuacagccaaacucguuagcaaggcgcacagaauuuuugaagaguucguggaugugcaggcccccagagaagucaauaucgacuuucaaacccgcgaggcuacacggaaaaaccugcaggagccuucccuuaccuguuucgaucaggcccagggcaaggugcauagccugauggaaaaagacucuuauccccgguuucuccgcuccaagauguaccuggaucuucugagccaaucucagagacggcucuccuga

SEQ ID NO: 74848 - RNA, 708 nt, Artificial Sequence
  derived and/or modified sequence opt5 from RGS9BP__Homo_sapiens__NP_997274
auggccagagaggaaugcaaggcucugcucgacggccugaacaaaaccacagccuguuaccaccaucuugugcugacggucgggggaagcgcggauucccagaaucuccggcaagagcugcagaagacccgccagaaagcucaggaacuugccguuucuacaugcgccagacugaccgcugugcuccgggaccgcggccuggccgcugaugagagagccgaguucgaacggcuguggguggcguuuagcgggugucucgaccugcuugaggccgauaugcgcagagcucuggaacucggagccgcuuucccccugcacgccccucggcgcccgcuugucagaacaggcguggcgggggccuccucuggaguugcugcccgggcucugagcacccgcucccucagacuggaggccgaaggcgacuuugauguggccgaccugcgggagcucgagcgcgaaguccugcaagugggcgagaugaucgauaacauggaaaugaagguuaaugugcccagauggacaguccaggcucggcaggcggccggggcugagcuucugucuaccgugagcgccggaccuuccagcguggucucucuccaggaaagaggcgggggaugcgacccccgcaaagcccuggcugccauucuuuucggcgcgguucugcucgcugccguggcccuggcugugugugucgccaagcuguccuga

SEQ ID NO: 74849 - RNA, 2016 nt, Artificial Sequence
  derived and/or modified sequence opt5 from RGS9__Homo_sapiens__NP_001075424
augaccaucagacaccagggccaacaguaccggccccgcauggccuuccugcagaagauugaggcucucgugaaagacaugcagaacccugaaacaggggucagaaugcaaaaucagcggguucuggugacgagcgugccgcaugccaugaccggauccgauguccuucaguggaucgugcagcgccuguggauuucuagccucgaggcgcaaaaccugggcaauuuuaucguuagauauggguacauuuauccccuucaggacccuaagaaccugauccucaaacccgauggaucccuguaccgguuccagacaccuuauuuuuggcccacccagcaauggccugcugaagacacagauuacgccaucuaucuggccaagcgcaauauuaaaaagaagggcauccucgaggaauacgagaaagagaacuacaauuuccugaaccagaagaugaauuauaaaugggacuuugugauuaugcaggcuaaggaacaauacagagccgggaaagagcggaacaaggcugaucgcuaugcccuugacugccaggaaaaggcguacuggcugguccacagauguccgcccggaauggauaaugugcucgacuauggccuggaucggguuaccaacccuaaugaggugaaaaagcagacagucguggccgugaaaaaggagaucauguacuaucagcaagcucuuaugcgcucuaccgucaaaagcuccguuucucugggcgggauugugaaguacagcgaacaguucuccagcaacgacgccaucaugucuggaugccuccccuccaauccuuggauuacggaugacacccaguuuugggaccugaacgcuaaacugguggagauccccacaaagaugagagucgaacggugggccuucaacuuuagcgagcucauccgcgauccgaagggcagacagucuuuccaauacuuucugaaaaaggaguucuccggggaaaaucuuggauuuugggaggcgugugaagaccugaaauauggcgaucagagcaaggugaaagagaaggccgaagagauuuacaagcuguuccuggcuccuggggcccggagauggaucaacauugacggaaaaaccauggauaucacaguuaagggccuuaaacauccccaccgcuaugugcuggacgcugcccagacccauauuuacaugcucaugaagaaagauucuuaugcccgguaccugaaguccccuaucuauaaggacaugcuggcuaaagcgaucgaaccccaggagacgacaaagaaaagcuccacccuccccuucaugagacgccaccuccggucuagcccuuccccggucauucuuagacaacuggaggaagaggccaaggcucgcgaagccgccaauacaguggauaucacccagcccggccagcacauggcuccuagcccccaucucaccguuuacacagggacgugcaugccucccucuccguccagcccuuuuucuagcuccugucggucucccagaaaaccuuucgccagccccucccgcuuuauucggagaccuagcaccacaaucugccccucuccgauucgcguggcgcuggaguccagcucuggacuugaacagaagggcgaguguuccgggagcauggcuccucggggacccuccgucaccgagucuagcgaagccucccuggacacaucuuggcccagaagccggccucgcgccccgcccaaggcuagaauggcccucuccuucagccgguuucugagacgcggcugccuggcuucuccuguguucgcccggcucucccccaaauguccugcggucagccacgggagagugcaaccccugggagauguuggccagcagcuuccucgccugaagucuaaaagaguggccaacuuuuuccaaaucaagauggacguccccaccggcuccgggacgugccucauggacagcgaggaugcuggaacaggcgaaucuggggaccgggccaccgagaaagaggugaucuguccgugggaaagccuguga

SEQ ID NO: 74850 - RNA, 3231 nt, Artificial Sequence
  derived and/or modified sequence opt5 from RGSL1__Homo_sapiens__NP_001131141
augagcuccgccgagaucauuggcucuaccaaccugaucauucuccuggaagacgagguguucgcugacuuuuucaauacauuucuuagccugcccgucuucgggcagacgccuuuuuacaccguugaaaacucccaauggucucucuggccggagauccccugcaaucugauugccaaguauaaaggacuucugacauggcucgaaaaguguagacugccuuucuuuugcaaaaccaaccuguguuuccacuacauccucugccaggaguuuaucagcuucauuaagucccccgagggcggggaggaacugguggauuuuuggauccuugcggaaaauauucugucuaucgaugagauggaccucgaggugcgggauuauuaccugagccuucugcucaugcugcgcgcuacacaucugcaggaaggauccagagucgugacccucuguaacaugaauauuaaaagccugcuuaaccugucuaucuggcacccuaaucaguccacaacccggcgcgagauucucagccauaugcaaaagguugcccuguucaaacuucagucuuauuggcugcccaacuuuuacacgcacaccaagaugacaauggccaaggaagaggcuugccauggccucaugcaggaauaugagaccagacuguacuccguguguuacacacacaucgggggacugccucucaauaugagcaucaaaaagugccaccauuuccagaaacgguauucuucccgcaaggccaagagaaaaauguggcaacuggucgacccggauagcuggucccuugagauggaccugaagcccgaugcuauuggcaugccucuccaggaaaccuguccccaggagaaagugguuauccagaugccuucucugaagauggccagcuccaaagaaacgcggauuagcucucuugagaaggacaugcacuacgcgaaaaucuccagcauggaaaacaaggccaagucucaucugcacauggaggcucccuucgagacaaaagugagcacccaccuccgcacagucauuccgaucgugaaucauuccucuaagaugaccauccaaaaagccauuaagcagagcuuuucccugggcuauauccaccuggcucucugcgccgaugcgugugccgggaacccuuucagagaccaucugaaaaagcugaaucuuaagguggaaauucagcuccuggaucuguggcaagaccuucagcacuuucucagcguccugcugaacaacaaaaagaauggaaacgcuaucuuccggcaucuccugggcgaccgcauuugcgagcuuuaccugaaugaacagaucgggcccugccucccucugaaaucucagaccauccaaggacugaaggagcuucuccccuccggcgauguuauucccuggaucccuaaagcccagaaggaaauuuguaagaugcugagcccgugguaugacgaguuucuggaugaggaagacuacugguuccuccuguuuacaacgcagaacagauucaucucuucccggcagcacaaacgcgaguuuauugggaaggaagagaauauccuucuguauaaacggauucaacagagccucgagcugucccaggcucuggccgauaugaaggaaauggacuacagacaguggagaaaaaucgccaccgaggaucuuaagcaaggaggcucucuccagguggaacugacaagccccguguuccugaccgacaucacaaagauguccuuugaggaacucugcuacaaaaacccuaagauggcuauucagaaaaucucugaugacuauaagauuuacugugagaaagcgcccaagaucgauuucaaaauggagauuaucaaggaaaccaagacggucagccgcuccaaucggaaaaugagccugcuuaagagaacacuggugcgcaaaccuucuaugcggcccagaaaccucaccgagguucugcugaauacccagcaccuugaauuuuuccgcgaguuccucaaggaacggaaagccaagaucccgcugcaauuucugacagcugugcagaagauuuccaucgagaccaacgagaaaauuugcaagagccucaucgaaaaugucauuaaaacauucuuucagggccaacugucuccugaggaaaugcuucagugugacgcccccaucaucaaggagauugccuccaugagacaugugacgaccagcacacugcucacccugcaggggcacguuaugaaaucuaucgaagagaagugguucaaggacuaucaggaucuguuuccuccccaucaccaagagguggaaguccagagcgaggugcagauuuccagccgcaaaccuucuaagaucgucuccacauaccuucaggaaagccagaaaaagggauggaugcggaugauuuccuucaucagaucuuuuugcaaauaucgccgguucaugcugaaccccagcaagagacaggaguuugaggacuaccuccaccaggaaaugcaaaauuccaaggagaacuucaccacggcucauaauaccucuggccggagcgccccgccuuccacaaacgugcgcucugcggaucaagaaaacggggagaucacccugguuaaaagacggauuuuuggacacagaaucauuacagugaauuucgcuaucaacgaccucuacuuuuucagcgaaauggagaaguucaaugaucuggucuccagcgcccauaugcuucaggugaaccgcgccuauaaugagaacgacguuauucugaugcggucuaaaaugaauaucauucagaagcucuuucugaacuccgauaucccucccaaacugagagugaauguccccgaguuccaaaaggacgcuauccuugccgcuauuaccgaaggcuaccuggaucgcagcguguuucacggggccaucaugucuguguucccgguugucauguauuuuuggaaaagauucuguuuuuggaaggcgacgcgguccuaccuccaguaucgcggaaagaaauucaaggacagaaaaucucccccuaagagcacagauaaauaccccuuuuccagcggcggcgacaacgccauucugcgguucacccuccugcgcgggaucgaauggcuucagccucagagagaggcuauuuccagcgugcaaaauucuagcuccucuaagcugacacagccccggcucguggucagcgccaugcagcugcauccugugcagggacaaaagcuguccuauaucaaaaaggaaaaauga

SEQ ID NO: 74851 - RNA, 1230 nt, Artificial Sequence
  derived and/or modified sequence opt5 from RHAG__Homo_sapiens__NP_000315
augagauucaccuuuccccugauggccaucgugcucgagauugcuaugaucguccuguucggccuuuuuguugaauacgagacagaccagacggugcuggaacaacucaacauuaccaagccuacagauauggggaucuucuuugagcuguauccgcuuuuccaggacgugcacgucaugauuuuugugggauucggcuuucugaugaccuuccucaaaaaguacggguuuagcuccguuggaaucaaucugcugguggccgcgcucggccugcagugggggacaaucguccagggcauucuucaaucucagggacagaaauucaacaucggcauuaagaauaugaucaacgcugauuuuagcgccgccaccgugcugauuuccuucggggcuguucucggaaaaacaucucccacccagaugcugaucaugacgauucuugaaaucguguucuuugcccauaaugaguaucuggucagcgagaucuucaaggcuuccgacauuggcgccucuaugaccauccacgcguuuggggccuacuucggacucgcuguggccggcauucuguaucggagcgggcugcgcaagggacaugaaaacgaggaauccgcuuacuauagcgaucucuuugccaugaucggcacacuguuccuuuggauguuuuggccuucuuucaauuccgcgauugccgagcccggcgacaaacaaugcagagcuaucgugaacaccuacuuuagccuggccgcuuguguccucacagccuucgccuuuucuucccugguugagcaccgggggaaacuuaauauggugcauauccagaacgcuacccuggcgggaggcguggccgucgggacgugcgcugauauggccauucacccuuucggaagcaugaucauuggcucuaucgccgggaugguguccguucucggauacaaguuucugacaccccuguucaccacaaagcuccgcauucacgacaccuguggcgugcauaaucugcacggccuuccuggggucgugggaggccuggcugggaucguugccguggcgaugggagcuagcaacaccuccauggccaugcaggccgcugcccucggcucuagcaucgggacagcugucgugggcggacugaugacgggccuuauucugaaacucccgcugugggggcagcccuccgaucaaaauugcuaugacgauagcgucuacuggaaggugccuaagaccagauga

SEQ ID NO: 74852 - RNA, 1095 nt, Artificial Sequence
  derived and/or modified sequence opt5 from RHBDD2__Homo_sapiens__NP_001035546
auggccgcuagcggccccgggugcagauccuggugucugugcccugaggugccgucugccaccuucuuuacagcgcuccugagccuucuggucuccggaccccggcuguuccugcuucagcaaccucuggcucccucuggccucacgcucaagagcgaagcccugcgcaacuggcagguuuacagacucgugaccuauaucuuuguguacgagaauccuauuucccugcuuuguggggccaucauuaucuggcgguucgcuggaaacuuugaacgcacagucggcaccgugagacacugcuucuuuacaguuauuuucgccaucuuuucugcuaucauuuuccugagcuuugaggccguguccagccucucuaaacugggggaagucgaggacgcgcggggauucacccccguggccuuugcuaugcuuggcguuacaaccgugcgcuccagaaugcggcgcgcccuggucuucggcaugguggugccuagcguccucguuccguggcugcugcucggggcuucuuggcugaucccccagacguccuuccuuagcaauguguguggacugucuauuggccucgccuaugggcugaccuacugcuauuccaucgaucuuagcgagagaguggcgcugaagcucgaccagacauuuccuuucucccugaugcggcgcauuucugucuuuaaauacgugagcggauccagcgccgaaagacgggcugcccaaucucgcaagcugaaccccguuccuggcuccuaucccacccagagcugucauccgcaccucucuccuagccaucccgugucccagacacagcacgcuucugggcaaaaacuggccagcuggccuuccugcacccccggacauaugcccacgcuuccuccguaccagcccgccagcggccuguguuacguccagaaucacuucggcccuaaccccacaucuuccagcguguauccugcuucugcggggaccucccucggaauccagcccccgacaccuguuaauagccccggcaccguguacuccggggcccugggaaccccuggcgcugccgggucuaaggagagcuccagaguccccaugccuuga

SEQ ID NO: 74853 - RNA, 1161 nt, Artificial Sequence
  derived and/or modified sequence opt5 from RHBDD3__Homo_sapiens__NP_036397
augcacgccagaggcccccaugggcagcugagcccugcucucccgcuggccuccucugugcuuaugcugcucaugagcacccuguggcuugucggagcgggccccgggcugguucucgcuccugagcugcugcucgaccccuggcaagugcaccggcugcuuacacaugcccugggacacacggcccucccuggccugcuucugucccuccugcugcuccccaccgugggguggcagcaggaaugccaucugggaacacuucgcuuccugcacgcuucugcccuccuggcucuugccagcggccugcucgcgguccugcuggccggccucgggcuguccucugcugccggaagcuguggcuacaugccugugcaccuugcuaugcuggccggggagggacauagaccgcggcgccccagaggcgcgcucccucccuggcuguccccuuggcuucugcucgcccugacaccccugcucagcucugaaccgccuuuucugcagcuucugugcgggcuccuggcuggacuggccuaugcugccggcgccuuccgguggcuugagcccuccgaacgcagacuccaaguucugcaggagggcgugcugugucggacccucgcugggugcuggccucugcgccuucuggcgacccccggaagccucgccgagcugcccgucacacacccugcuggcgugagaccgcccaucccugggcccccuuacguugccucucccgaucuguggucccauugggaagacagcgcccuuccgccucccucucuccggccugugcagcccaccugggagggauccagcgaagcuggccuggauugggccggggcguccuuuucuccuggaacgcccaugugggcugcccuggacgagcagaugcuccaagagggcauucaggccagccugcuugauggcccggcucaggaaccucaguccgcccccuggcugagcaagucuuccgucagcucucuccgccugcaacagcuggagagaaugggguuccccaccgaacaggcugugguggcccuugcggccacaggacgggucgagggcgcuguuagccuccuggucgggggacaagugggcaccgaaacacuggugacccacgggaaaggcggaccugcccacuccgagggcccggggcccccuuga

SEQ ID NO: 74854 - RNA, 2568 nt, Artificial Sequence
  derived and/or modified sequence opt5 from RHBDF1__Homo_sapiens__NP_071895
augagcgaggccagacgggacuccaccucuagccugcagcgcaagaaacccccuuggcucaagcuggauaucccguccgcugugccccuuacagccgaagaaccuucuuuccugcaaccccucagacggcaggcguuucugcgcagcgucuccaugccugcugaaacggcccacauuucuagcccccaucacgagcuuagacggccuguucugcagcgccagaccuccaucacacaaaccauuagacggggcacagccgacugguucggggugagcaaagauucugacuccacccagaaguggcagcgcaaaagcaucagacauugcucucagcgguacggaaagcucaagccgcaagugcugcgcgaacuggaucuccccucccaggacaacgucagccugacaucuaccgagacgccucccccucuuuaugugggccccugucagcuggggaugcagaaaauuaucgauccgcucgcuagaggacgggccuuucgcguugcugacgauaccgccgagggccuguccgcgccucacacacccgugaccccuggggccgcuagccuuugcuccuucucuagcuccagaagcggauuucaucggcugcccagacgccggaagagagaaucugucgccaaaauguccuuccgcgcugccgcggcccucaugaagggccggagcgugagagacggcacauuucgccgggcucaaagacgcucuuucacccccgccagcuuucuggaggaagauacgacagacuucccugaugagcuggacaccuccuuuuucgcucgggaggggauccuccacgaggagcugucuacauacccggacgaaguuuuugagagccccuccgaagccgcccuuaaagauugggagaaggcuccugagcaggcggaccugaccggaggcgcccucgauagaagcgaacuggagcgcucucaccuuaugcugccccucgaacggggguggagaaagcagaaagagggagcugccgccccucaacccaaggugcggcugcgccaggaagucguguccaccgcuggcccgagacgggggcagagaauugccgugccuguccgcaaacuguucgcgcgggagaagagacccuauggacucggcaugguuggccgccugacaaauagaacguaccggaaacgcaucgacagcuucgugaagagacagauugaggauauggacgaucaucggccuuucuucaccuauuggcuuacauuugugcacucucuggucaccauccucgcuguguguauuuacgggaucgcccccguuggauucucccaacaugaaacaguggacagcguccugcgcaacagaggcguguaugagaauguuaaauacgugcagcaggaaaacuuuuggauugggccuuccucugaggcccuuauccaccugggagcuaaguucagccccugcaugcggcaggauccgcaaguccacuccuuuauccgcucugccagagaacgggagaagcauagcgcuuguugcgugcgcaaugacagauccggcuguguccagaccagcgaggaagaguguucuuccacgcucgccguguggguuaaauggccuauucaccccagcgcgcccgaacuggccgggcauaagcggcaguucggaucugugugccaccaggauccuagagucugcgacgagccguccagcgaggacccccaugaauggccugaggauaucacaaaauggcccauuuguaccaagaacucugcuggcaaucacaccaaccacccucauauggacugcgugaucacaggccgccccugcuguauugggaccaaaggacggugcgaaaucacaagcagagaguacugugauuuuaugcgcggcuauuuccacgaagaggccacgcugugcucccaaguucauuguauggacgaugugugcgggcuccugccuuuucuuaaucccgaggucccggaccaguucuaccggcuguggcucagccuguuucugcacgcuggaauccuucacugucucgugucuauuugcuuccagaugaccgugcugagagaucuggaaaagcucgccggcuggcaucgcaucgcgauuaucuaucugcuuuccgggguuacaggcaaccuggccagcgcuauuuuccucccuuaccgggccgaggucggacccgcuggcucccaguuugggauccuggccugucuguucguggaacuuuuucaaucuuggcagauccucgccagaccuuggcgcgcuuucuuuaagcugcuggcggugguccucuuccuguuuaccuucggacuucugcccuggauugacaauuuugcccacaucagcggcuucauuuccgggcucuuucugucuuucgcuuuucugccguauaucagcuucggaaaauucgaucuuuaccggaagagaugccagauuaucauuuuucaagugguuuuccucggccugcuggccgggcucgugguccuguuuuauguguacccuguucggugugaguggugcgaauuucuuacaugcauccccuuuaccgacaaauucugugagaaguacgagcuggaugcccagcuccauuga

SEQ ID NO: 74855 - RNA, 2484 nt, Artificial Sequence
  derived and/or modified sequence opt5 from RHBDF2__Homo_sapiens__NP_001005498
auggccagcgcugacaagaacggcggguccgugucuagcgucuccucuagcagacugcagucccggaaacccccuaaucucucuaucaccauuccgcccccugagaaggaaacacaagcccccggagagcaggauagcaugcugccugaacgcaaaaaccccgcguaccuuaaguccguuagccugcaggagccuagaucucgguggcaggaauccagcgagaaacgcccgggcuucagacggcaggcuucucucucccaaagcauccgcaagggggccgcccagugguuuggagugucuggcgacugggaggggcagagacaacaguggcagcggcgcucccugcaccauugcagcaugagauauggacggcuuaaggcuuccugucagcgcgaucuggaacuccccucucaagaggccccuagcuuccagggcacggaaucccccaaaccuugcaagaugcccaaaauuguggacccgcuggcuagaggccgggccuuucgccacccugaggagauggauagaccccaugcgccucacccuccccugacccccgggguccucagccugacaucuuucaccuccgugcggagcggauacucucaucuuccgagacgcaagcggaugagcguugcccacaugucccugcaggcugccgcugcccuccugaaaggcagaucugugcuugacgcgacagggcaacgcugucgggucgugaagcgcagcuuugccuuccccuccuuucuggaagaggauguuguggacggagcugauaccuucgacagcuccuuuuucuccaaggaagagaugagcucuaugccugaugacgucuuugaaucucccccucucagcgccuccuauuucagaggcaucccccacucugcuagcccgguguccccugauggggugcagauuccccugaaagaguacggacgggccccuguccccggcccuagacgcggcaagcggaucgccucuaaaguuaagcauuuugcuuucgaccgcaaaaagagacacuaugggcugggaguggugggcaauuggcucaaccggagcuacagacgguccaucagcucuacaguccagcgccagcuggaguccuucgacagccauagacccuauuuuaccuacuggcuuacguucgugcacguuauuaucacccugcucgugauuugcacauacgggaucgcgccggucggauuugcccaacacgugaccacacagcugguucuucggaauaaaggcguguaugaaucugucaaguacauucagcaggagaacuucuggguggggccuuccagcaucgaucugauucaucucggagcuaaguuuucucccuguaucagaaaagacggccaaaucgaacagcugguccugcgcgagcgggaucucgaaagagacagcggcugcugugugcagaaugaucacuccgggugcauucagacccaacgcaaggacuguagcgagacgcuggccacauucguuaaauggcaggaugacaccggacccccuauggauaagucugaccuuggccagaaaagaacauccggggccgugugccaucaggauccgcggaccugugaggaacccgcuagcuccggagcccacaucuggccugacgacauuaccaaguggcccaucugcacagagcaagcgcgcucuaaccauacgggcuuucugcacauggauugcgaaauuaaggggagaccuuguugcaucggcaccaaaggaagcugugagaucacaacccgggaauauugcgaguucaugcacggcuacuuucaugaggaagcuacacucuguucccagguccacugccuggacaaggugugugggcuucugcccuuccucaauccugagguucccgaucaguuuuaucgccuguggcugucucucuuccugcaugccggagugguccacugccuugugagcgugguuuuucaaaugaccauucugagagaccucgaaaaacuggccggcuggcaccggaucgcuauuaucuucauucuguccgggaucacgggaaaccuugccucugcuaucuuccucccguaccgcgccgaggucggcccugcggggagccaguuuggccugcuggccugucucuucguggagcuguuucaguccuggccccuucuggaaagaccuuggaaggcuuuccucaaucugagcgccauugugcuguuucuuuucaucugcggacuccugcccuggauugauaacaucgcucauauuuuuggcuuccugucugggcuccugcuugccuuugcguuccugccguauaucacauuuggaaccuccgacaaauaccggaagcgcgcccucauucuggucagccugcuugcuuucgccggccucuuugcugcccuggugcuguggcucuacaucuauccuaucaauuggcccuggauugagcaccugaccuguuucccuuucacaucuagauuuugcgaaaaguacgagcuugaucagguucugcauuga

SEQ ID NO: 74856 - RNA, 1122 nt, Artificial Sequence
  derived and/or modified sequence opt5 from RHBDL1__Homo_sapiens__NP_001265649
auggacagaagcucccugcuccagcugauccaagagcagcagcuugaucccgaaaacaccggcuucauuggggccgacacauuuacgggacuggugcacucucaugagcucccucuggauccggcuaaacuugacaugcuggucgcccucgcgcagagcaaugaacaaggccagguuugcuaccaggagcugguggaucugaucuccucuaagcggagcuccucuuucaagcgcgcuauugccaacgggcagagagcccucccccgggacggaccucuggaugaacccggccuugggguguauaaacgcuuugucagauacguggcuuaugagauccugccuugugagguugaccggcgcugguacuucuauagacaccggagcugucccccuccgguguuuauggccuccgucacccucgcucaaauuaucguguuccugugcuacggagcccgccuuaauaaguggguucugcagacauaucaucccgaauacaugaaaagcccucucguguaccaccccggccauagagcgcgggccuggcgcuuucugaccuauauguucaugcacgucggccuggagcagcucggguuuaacgcucugcuucagcugaugaucggagugccucucgaaauggugcacggccugcuuagaauuucucugcucuaccuggccgggguccuggcuggaucccucacaguuagcaucaccgauaugcgggcccccguggugggcgggucuggaggcgucuaugcgcugugcuccgcccaucuugcuaaugugguuaugaacugggccggcaugcgcuguccguacaagcugcucagaauggugcuggcucuugucugcaugagcucugagguggggcgggccguuuggcugagauucuccccuccccucccugccagcggaccccaacccuccuuuauggcucaccuggcgggcgccguggucggggugucuaugggacugacaauucuccgcagcuaugaggaacggcugagagaccaguguggcuggugggucgugcuucuggcuuacgggaccuuccuccuguuugccguuuucuggaauguguucgccuaugaucugcuuggagcucauaucccuccgcccccuuga

SEQ ID NO: 74857 - RNA, 1152 nt, Artificial Sequence
  derived and/or modified sequence opt5 from RHBDL2__Homo_sapiens__NP_001291675
augcagcugggcaagagacacaaacucaccacaaagagcgugugccaugggaaaggagucguuauccgggugcuggcccuucccggcccuuccugggugcgcagacggcgcgaggggaaggcucuggaaucuagcagaugugcccggcaaccgcgcgaggaaagacagcccgaggaccucggaccucccgcggucccuugggauuccugccccucuggcgaagaagggggaccucggacgauggcugccgugcacgaccuggagauggaaagcaugaaccuuaauaugggccgcgagaugaaagaggagcuggaggaagaggaaaagaugagagaggauggcgggggaaaggaccgggccaaauccaagaaaguucaucgcauugugucuaaguggaugcucccggagaaaagcagaggcaccuaccuggaacgggcuaacuguuuucccccucccgucuucaucauuuccaucagccuggccgagcucgcuguguucauuuauuacgccguuuggaagccucagaagcaguggaucacacuggauaccgggauccuugaaucucccuuuauuuauuccccggagaaacgcgaagaggcguggagauucaucagcuacaugcuggugcacgccggaguccaacauauucucggcaaucugugcaugcagcuugugcuggggaucccucucgaaauggugcacaagggacugcgggucggccugguuuaucucgcuggcgugauugccgggucucuggcuuccagcaucuuugacccccuuagauaccuggugggagccucuggcggggucuaugcgcucaugggaggcuacuucaugaacgugcugguuaauuuucaggagaugauuccugccuucgggaucuuucgccuucugaucauuauccucauuaucgugcuggauaugggauucgcucuguaccggagauuuuucguccccgaggacggcucccccgugagcuuugccgcucacauugccggcggguucgccggaauguccaucggcuauacaguuuucucuuguuuugauaaagcucuccugaaggacccucgcuucuggaucgcgauugccgcuuaccuugccugcgugcuguuugccgucuucuuuaacaucuuccucagcccggcuaauuga

SEQ ID NO: 74858 - RNA, 1125 nt, Artificial Sequence
  derived and/or modified sequence opt5 from RHCE__Homo_sapiens__XP_011540191
augcccggcaccgugcuggucgggcaggaccucacaguuauggccgcucugggacuuggcuuccugacgagcaacuuuagacggcacuccuggucuagcguggccuucaaucucuuuaugcuggcgcuuggggugcaaugggcuauccugcucgauggauuccugucccaguuuccuccgggcaaggucgugauuacccuguucucuauccgccucgccacaaugagcgccauguccguucugauuucugcuggggccgugcuuggaaaagucaaccuggcucagcucgugguuauggugcuggucgaggugaccgcccuuggcacacugagaauggugaucagcaauauuuuuaacaccgacuaccauaugaaucuccggcacuucuaugucuuugcggccuacuucggccugacaguugcuuggugccugcccaagccucuccccaaagggaccgaagauaacgaccagcgcgccacgaucccuucccugagcgcuaugcuuggagcccuguuucucuggauguucuggcccucugucaauuccgcgcugcuuagaagcccuauccaacggaagaacgccauguuuaauaccuauuacgcucuggccgugucuguggugacagcuauuuccggcagcucucucgcccauccgcagcgcaaaaucuccaugaccuauguucacagcgccgugcuggcugggggagucgcggugggcacauccugucaucugauucccucuccuuggcucgccaugguucuggggcuuguggcuggacugaucagcauuggcggcgccaagugccuccccgucuguugcaacagagugcuggggauccaccacauuuccgucaugcauagcaucuucucucuucugggacuccugggcgagaucaccuacauugugcugcucguucugcacacgguguggaaugggaacggaaugaucggcuuccagguccuucuguccauuggggaacucagccuggccaucgugauugcucugacaucuggacuucucaccggccugcugcucaaucugaagaucuggaaagccccucauguugcgaaguauuuugaugaccagguguucuggaaauuuccccaccuugcugucggcuucuga

SEQ ID NO: 74859 - RNA, 1440 nt, Artificial Sequence
  derived and/or modified sequence opt5 from RHCG__Homo_sapiens__XP_011519965
auggccuggaacaccaaucugagauggcggcucccccugacaugccuucugcuccaggugaucauggucauucuguucggcguuuuugugcgcuacgacuucgaggcugaugcccacugguggagcgaaagaacgcauaagaaccuuuccgacauggagaaugaauuuuauuaccgguauccuucuuuccaagaugugcacgucaugguguuuguuggguucggauuucugaugaccuuccuccagcgcuacggcuuuagcgcggugggguucaacuuucugcuggcugccuucggaauccagugggcccuccugaugcagggcugguuucauuuccuucaagacagauauauugucguggggguugagaaucugaucaacgcugauuucuguguggccuccgucugcguggcuuuuggagccgugcucggcaaagucucuccgauucagcugcuuaucaugacauucuuucagguuacccuguucgcggugaaugaauuuauccuccugaaccugcucaaggugaaagacgccggcgggagcaugacaauucacaccuucggagcuuacuuuggccugacagucacccggauccuuuaucgcagaaaucuggagcaguccaaggagcggcaaaacucuguguaccagagcgaucucuucgccaugauugggacgcuguuucuuuggauguacuggcccuccuucaauagcgcuaucucuuaucauggagacucccagcaccgcgccgcgauuaacaccuacuguagccuggccgcuugcguucucacaucuguggccaucuccagcgcucugcacaaaaagggcaagcuggauaugguccauauucagaaugccacccucgccgggggaguggcuguuggcacagcggccgaaaugaugcugaugccuuauggcgcucuuaucaucggguuuguguguggaauuaucucuacccugggcuucgucuaccucacgcccuuucuggaguccagacuucacauucaagacacaugcgggaucaacaaucugcauggcauuccuggaaucaucgggggaauugugggcgccgucaccgccgcuagcgccucccucgaaguguauggcaaagaggggcugguucacucuuucgauuuccagggauuuaacggcgacuggacagcgcggacccaggggaaguuccaaaucuacggacugcucgugacccuggcuauggcccuuaugggcgggauuaucgucggccugauucuccgccugcccuuuuggggacagccuagcgaugagaacuguuucgaagacgccguguauugggagaugccggaaggcaauuccacaguuuacauccccgaggacccuacguuuaaacccagcgggccuucugugcccuccgucccgauggugagcccucugcccauggcuucuagcgugccucuuguucccuga

SEQ ID NO: 74860 - RNA, 555 nt, Artificial Sequence
  derived and/or modified sequence opt5 from RHEB__Homo_sapiens__NP_005605
augccccagagcaaguccagaaaaaucgccauucugggcuaccggucugugggaaagagcucccucaccauccaauucgucgaggggcaguuuguugacucuuaugauccuacaauugaaaacacguucaccaaacugaucacagugaauggccaggaguaccaccuucagcugguggacaccgcugggcaagaugaauauagcauuuuuccgcagacauacuccaucgacaucaacggauauauucucgucuacucugugaccagcaucaaguccuucgagguuauuaaagugauccauggcaagcugcuugauauggucgggaaggugcagauucccaucaugcugguuggaaauaaaaaggaccuccacauggaacgcgugauuagcuaugaggagggcaaagcccuggcggaaucuuggaacgcugccuuucuggaguccagcgccaaggaaaaucagacagcugucgauguguucagacggaucauccucgaggccgagaaaauggacggcgcugccucucaagggaaguccagcugcucugugauguga

SEQ ID NO: 74861 - RNA, 552 nt, Artificial Sequence
  derived and/or modified sequence opt5 from RHEBL1__Homo_sapiens__NP_653194
augccccuggugagauaccggaaggucguuauccucggcuaucgcugcguggggaaaaccagccuggcccaccaguucguggagggagaauuuuccgagggcuacgacccuacagucgaaaacacguauucuaagauugugacccuugggaaagaugaguuccaucugcaccucguugacacagcuggacaagaugaauacagcauccugccguauuccuuuauuaucggcgugcauggguacguccuuguguauucuguuaccagccugcacuccuuccaggugauugagucucucuaccagaagcugcaugagggacacggcaaaacaagaguccccguggugcuggucggcaauaaggccgaccucagcccugaacgggagguucaggcgguggaagggaagaaacuggcugaguccuggggagccaccuuuauggagagcucugcccgcgaaaaccaacuuacacagggcaucuucaccaaggugauccaggagauugcuagagucgaaaauuccuacgggcaggagcggcgcugucaccugauguga

SEQ ID NO: 74862 - RNA, 717 nt, Artificial Sequence
  derived and/or modified sequence opt5 from RHNO1__Homo_sapiens__NP_001239428
augcccccuagaaagaaacggcgccagccgagccaaaaggcuccccuccuguuccaccagcagccucuggagggccccaaacauuccugcgccucuacccagcuuccuaucacacacacgagacaagugcccagcaagccuauugaccauuccaccaucacaucuugggucagcccggauuuugacaccgccgcggggucccuguuccccgcuuaccagaaacaccagaaccgggcccgccauucuagcagaaagccuacaaccuccaaguuuccccaccucacauucgaaagcccucagucuuccagcucugagacccugggcauuccccuuauccgggaauguccguccgagagcgaaaaagauguuucucgcagaccucuggugcccgugcucuccccucaaagcugcggaaauauguccguccaggcccugcagucucugcccuauguguuuauucccccugacauccagacgccggagagcuccagcguuaaggaggaacucaucccccaagaucagaaagagaacucucugcuuuccuguacccugcacacagggaccccuaauagccccgaaccuggacccgugcucgucaaggacacaccggaggauaaauacggcauuaaggugaccuggcggcgcagacagcaucugcuugcuuaucugcgggagcgcgggaagcucucuagaagccaauuccugguuaaauccuga

SEQ ID NO: 74863 - RNA, 591 nt, Artificial Sequence
  derived and/or modified sequence opt5 from RHOB__Homo_sapiens__NP_004031
auggccgcuaucagaaagaaacugguggucguuggcgacggggccugcggaaagaccugucuccugauuguguucagcaaagaugaguuucccgaaguguacgucccuacaguguucgagaacuauguugcggacaucgaaguggauggcaagcaggucgagcuugcucugugggacacggccgggcaagaagauuacgaccggcuccgcccgcuguccuaucccgauaccgacgugauucuuaugugcuuuucuguugauagcccugacucccuggagaauauccccgagaaaugggugccugaagucaagcacuucugucccaacgugccuauuauccucguggccaauaagaaagaucugagaucugacgagcauguccggacagaacuggcucgcaugaagcaggagccgguuagaaccgaugacggacgggccauggcugugcgcauccaggccuacgacuaucucgagugcagcgcgaaaacaaaggaaggcgugagagaggucuuugaaaccgccacacgggcugcccugcagaaacgcuacgggucccaaaacggauguauuaauugcuguaaggugcuuuga

SEQ ID NO: 74864 - RNA, 2091 nt, Artificial Sequence
  derived and/or modified sequence opt5 from RHOBTB1__Homo_sapiens__XP_011538726
auggacgccgauauggacuacgagagacccaacguggaaaccaucaagugcgucguugugggcgauaaugcuguggggaaaacacggcugauuugugcccgcgcgugcaacacgacccucacacaguaucaacugcuugcuacccacgucccuacagugugggccaucgaccaguacagaguuugucaggaggugcuggaacggagccgcgaugucguggacgagguuuccgugucucucagacugugggauaccuucggagaccaucacaaggaucggcgcuuugccuauggcagaagcgacgucguggugcuuugcuucuccauugcuaauccgaacucucugaaucaugucaaaagcaugugguaccccgaaaucaagcacuuuuguccucggacacccguuauucucguggggugccagcuggaucugcgcuaugccgaccucgaggcugugaacagagcccggcgcccucuggcgagacccaucaaacggggagauauccuuccuccggagaagggccgcgaagucgccaaggagcuggggcuccccuacuaugaaaccuccguguucgaccaauuuggaauuaaagacguuuucgauaaugcuaucagagccgcucugauuucucggagacaucuucaguuuuggaagucucaccugaaaaaggugcagaaaccucuccugcaggcccccuuccugccucccaaggcgccgccucccgucaucaagauuccugagugucccuccaugggcacgaacgaggccgcuugccuccuggacaauccccuuugugccgaugugcuguuuauccuccaagaccaggaacacauuuucgcucaucgcaucuaccuggccaccagcagcuccaaauuuuacgaucuuuuccugauggagugcgaagagagcccuaacggcucugaaggggccugugagaaggagaaacagucccgggacuuucagggaagaauccucagcguugauccggaagaggaacgcgaggaagggcccccucggauuccccaagcugaccaguggaagucuuccaauaaaagccugguggaggcgcugggccucgaggccgaaggagcugucccugagacacagacccugacaggcugguccaagggguucaucggaaugcacagagaaaugcaagugaaccccauuucuaaacgcaugggcccgaugaccgucgugcggauggaugccagcguucagccuggccccuucagaacgcuucugcaguuucucuauacagggcagcuggacgagaaggaaaaggaucuugugggacuggcccaaaucgcugagguccucgagauguucgaccugcgcaugaugguggaaaauauuaugaacaaagaggccuuuaugaaucaggaaaucaccaaggcguuccauguucggaaagcuaacagaaucaaggagugccuguccaaaggcacauuuagcgacgugaccuucaagcucgaugacggggccauuucugcccacaagccucugcuuaucugcuccugugaguggauggcugccauguuuggaggcagcuucgucgaaucugcuaacagcgagguguaccugcccaauauuaacaaaaucuccaugcaggccgugcucgauuaucuguacaccaagcagcugucuccuaaucuugaccucgauccccuggaacugauugcgcucgccaaccgcuuuugccugccgcaccuuguugcucuggccgagcaacaugcuguccaggaacucacaaaagccgcgacgagcggggugggaaucgacggcgaggugcuguccuaucuggagcuugcccaguuccacaaugcucaucagcucgccgcuuggugucugcaccauaucugcaccaacuacaauagcgucuguucuaaguuucggaaagaaauuaaguccaagagcgccgauaaccaagaguauuucgaaagacaccgguggccucccgugugguaccugaaagaggaagaccacuaccagcgcguuaagagagagcgggagaaagaagauaucgcccucaauaagcauagaucucgccggaaauggugcuuuuggaacuccagccccgcuguggcguga

SEQ ID NO: 74865 - RNA, 2250 nt, Artificial Sequence
  derived and/or modified sequence opt5 from RHOBTB2__Homo_sapiens__NP_001153508
augcaggccuggagaaagggccccgacgggccucagaaaaccagcuccgauucuaugagccggcugauggacuccgauauggacuacgagcgcccgaacguggaaacaaucaagugcgucguugugggagauaaugcugugggcaaaacgagacucauuugugcccgggcgugcaacgcuacccugacacaauaucagcuucuggccacccacguccccacagugugggccaucgaccaguaccgcguuugucaagaggugcucgaaagaucucgggaugucguggacgauguuagcgugucccugcgccuuugggacaccuucggggaucaucacaaggacagacgguuugcuuauggacgcucugaugucguggugcugugcuucagcauugccaauccuaacucccuccaucacgucaaaacaaugugguaccccgagaucaagcauuuuuguccuagagcucccguuauucuggugggcugccagcuggaccuccgguaugccgaccuggaagcggugaaucgcgccagacggccucuugcucgcccgaucaagcccaacgagauccugccucccgagaaagggagagaagucgccaaggagcucgggauuccuuacuaugaaaccagcgugguugcucaguucggcaucaaagauguguuugacaaugccauucgggcggcccugaucucuagacgccaccuucaguucuggaagucccaucugcggaacguccaaagaccccuccugcaggcuccguuucugccucccaaaccucccccucccauuaucgugguuccggaucccccuucuagcuccgaggagugucccgcccaccuccuggaagacccucuuugcgcugaugugauucugguccuccaggagcgcgugcggaucuucgcccacaagaucuaccugagcacgucuuccagcaaguuuuacgaccuuuuccugauggaucucuccgaaggcgagcugggaggacccucugaaccgggcgggacccauccugaggaccaccagggacacagcgaucaacaucaccaucaccaucaccaccaucacggcagagacuuucugcuccgcgccgcuuccuucgaugucugugagagcguggacgaagccgggggaucuggccccgcgggccugcgggcuuccacaagcgacgggauucuuagaggaaauggcaccggguaucugccuggacgcggccggguucucucuagcugguccagagccuuugugucuauccaggaggaaauggccgaggauccccugacauacaaaagccgccuuauggucgugguuaagauggacuccagcauucagccugggcccuuccgggcugugcugaaauaucucuacaccggagaacuggaugagaacgagagagaccugaugcauaucgcccacauugcggaacuccuggaggucuucgaucuucggaugaugguggcuaauauccugaacaaugaagccuuuaugaaccaagagaucacgaaggccuuccacgugcgcagaacaaaucggguuaaagaaugccucgcuaagggcaccuuuucugacgucacauucauucuggaugacggcaccaucuccgcccauaaaccgcugcuuauuagcucuugugauuggauggcugccauguuugggggaccuuucguggaguccagcaccagagagguggucuuucccuauacauccaagucuugcaugcgcgcggugcucgaauaccuguauacgggcauguucaccagcucccccgaccuggaugacaugaagcucaucauucuggccaaccggcuuugccugccucaccucguugcucugacagagcaguacaccgugacagggcugauggaagccacccagaugauggucgauaucgacggagacgugcuuguuuuucucgagcuggcucaguuccauugugccuaccaacuggcggauuggugccuccaccauaucuguacgaacuauaauaacgugugcagaaaauuuccgcgcgacaugaaggccaugucucccgagaaucaggaauacuucgagaaacacagauggccucccgucugguaucugaaggaagaggaucacuaccagcgggcucgcaaagaaagagagaaggaggacuaucuucaucugaagcggcagccuaaacgcagauggcucuuuuggaacagccccuccagcccuucuuccagcgccgcuucuuccagcucucccagcuccagcucugccgugguuuga

SEQ ID NO: 74866 - RNA, 1836 nt, Artificial Sequence
  derived and/or modified sequence opt5 from RHOBTB3__Homo_sapiens__NP_055714
augagcauccacauuguggcccugggcaacgagggggacaccuuccaucaggauaauagacccuccggacucauccggacauaccugggccgcucuccucuugucagcggggacgaauccucucugcuccugaacgcugccagcacgguugcgagaccgguguuuaccgaguaucaggcuuccgccuucggaaaugugaaacuugucgugcacgauugccccguuugggacauuuuugauucugacugguacacaagccggaaccugaucggcggggccgauauuaucgugaucaaauauaaugucaacgacaaguucuccuuucaugaagugaaagauaauuacauuccuguuaucaagcgcgcucucaacagcgugcccgucauuaucgccgcugugggaaccagacaaaaugaggaacugccuuguacaugcccccuguguaccucugaccggggcuccugcgugagcacaaccgagggcauucagcucgccaaagagcugggggcgacguaucuugaacugcacucucucgaugacuucuacaucggaaaguauuuuggcgggguccuggaguacuucaugauucaggcccuuaaccaaaagaccuccgaaaagaugaagaaacgcaagaugagcaauucuuuucauggaaucagaccuccgcagcuggagcagcccgagaaaaugccuguucucaaggcugaagccucccacuacaacagcgaucugaauaaccuccuguucuguugccaguguguggacguggucuuuuauaaucccaaccugaagaaagugguugaggcucacaagaucgugcuuugcgccgucucccauguguucaugcugcucuuuaacguuaaaucuccuacagacauucaagauagcuccaucauucggaccacacaggaccuguucgcgaucaaucgcgauaccgccuuccccggcgcuagccacgaaucuuccgggaacccgccucuuagagugauugucaaggacgcccuguuuuguagcugccucucugauauccugcgguucaucuacagcggagcuuuucagugggaggaacuggaggaggacauucgcaaaaagcucaaagauuccggcgacgugucuaaugucaucgaaaaggugaaguguauucugaaaacgcccggcaagaucaacugccuuagaaauugcaaaacauaucaggcccggaagccucugugguucuacaacaccagccucaaauuuuuccugaauaagcccaugcuugccgauguuguguuugagauucaagggacaaccguccccgcucaucgcgcgauccugguggccagaugugaaguuauggcugccauguucaacggaaauuauauggaggccaaguccgugcucaucccugucuacggcgugagcaaagaaaccuuucugucuuuccuggaguaucucuacacagacuccugcuguccggcugggauuuuucaggccaugugccugcuuaucugugcggagauguaccaggugagccggcugcaacacauuugcgaacucuucaucauuacgcagcugcagucuaugcccuccagagagcuggcuagcaugaaccuugauaucguugaccuccugaagaaagccaaguuucaccauuccgacugucugucuaccuggcuccugcacuucauugccacaaauuaucuuaucuucagccagaaaccugaauuucaagaucuguccgucgaggaacgcucuuucguggagaagcaucgguggcccagcaacauguaccucaagcagcuggcugaguauagaaaauacauccacucccgcaagugccggugucuggugauguga

SEQ ID NO: 74867 - RNA, 633 nt, Artificial Sequence
  derived and/or modified sequence opt5 from RHOD__Homo_sapiens__NP_055393
augaccgccgcucaggccgcgggcgaggaagcucccccuggggugagaagcgucaagguugugcuggugggagacggcgggugcggaaaaacaucccuccugauggucuucgccgauggcgccuuuccggagucuuacacgcccaccguguucgaacgguauaugguuaaccuucaagugaaggggaaaccuguccaucugcacaucugggacacagcuggacaggaugacuacgaucgccucagaccccuguuuuauccugacgccagcgugcuucugcucuguuucgauguuaccucccccaauucuuuugacaacauuuucaaucggugguacccugaggugaaccacuuuugcaagaaagucccgaucauuguggugggcuguaagacagaucugcgcaaggacaaaagccuggucaauaagcucagacggaacggccuggaacccguuaccuaucaucgcgggcaggagauggcuagauccgugggagccguggcguaccuugagugcucugcccggcugcacgauaauguccaugcuguguuccaggaagccgcugagguugcccucagcucccgcggcagaaacuuuuggcggcgcaucacacaaggguucuguguggucaccuga

SEQ ID NO: 74868 - RNA, 636 nt, Artificial Sequence
  derived and/or modified sequence opt5 from RHOF__Homo_sapiens__NP_061907
auggacgcccccggcgcucuggcccagaccgcggcuccugggccgggaagaaaggagcucaaaaucgugauugucggcgaugggggaugcggcaagacaagccugcuuaugguuuacucccaagggucuuuccccgaacacuaugccccuagcguguuugagaaauacacggccuccgugaccgucggaucuaaggaagugacacugaaccucuaugacaccgcuggccaggaggauuacgaccggcugcgcccccuuagcuaucagaauacacaucugguucucaucuguuacgaugugaugaacccuaccuccuaugacaauguccugauuaaaugguuccccgaagugacacacuuuugcagaggcaucccuaugguucugauuggguguaagaccgaucuccggaaggacaaagagcagcugcgcaaacuuagagccgcucaacuggagccgaucacguacaugcagggacucucugccugcgaacagauccgggcggcccuguaccuugaguguagcgcuaaguuccgcgaaaacguggaggaugucuuuagagaggccgcuaagguggcccuguccgcgcucaaaaaggcccagcggcaaaagaaacgcagacugugccugcuccuguga

SEQ ID NO: 74869 - RNA, 576 nt, Artificial Sequence
  derived and/or modified sequence opt5 from RHOG__Homo_sapiens__XP_005252973
augcagagcaucaagugcguggucguuggcgacggggccgugggaaaaaccugucugcucauuugcuacacaacgaacgcuuuccccaaggaguauaucccuaccguguuugauaauuacuccgcccaaucugcggucgacggcagaacagugaaccugaaucuuugggauaccgcugggcaggaagaguaugaccggcugcgcacacucagcuacccgcagaccaacguuuucgugauuuguuuuuccaucgccucucccccuagcuaugaaaaugucagacacaaauggcaucccgaggugugccaccauuguccugauguucccauucugcuugugggaacaaagaaagaccugcgggcccagccugauacccuccgcagacugaaggaacaaggccaggcuccgaucacgccccagcaggggcaagcccuggcuaagcagauccacgccguccgguaccucgagugcuccgcgcugcagcaggacggagugaaagagguguucgccgaagcuguccgcgccguucuuaacccuacccccauuaagagaggccggucuuguauccugcucuga

SEQ ID NO: 74870 - RNA, 576 nt, Artificial Sequence
  derived and/or modified sequence opt5 from RHOH__Homo_sapiens__NP_001265298
augcugagcuccaucaagugcgugcucgucggcgacucugccguugggaaaaccagccugcuugugagauucacauccgagacguuucccgaggcuuacaagccuaccguguaugaaaacacaggagucgauguguucauggacggcauucagaucucucuggggcucugggauaccgccggaaaugacgcguuucggagcauucgcccgcuguccuaccaacaggcugauguugugcuuauguguuauucugucgccaaccacaauagcuuccugaaccucaaaaauaaguggaucggcgaaauuagauccaaccugcccugcacaccugugcugguuguggccacccagacagaccagcgggagauggggccccaucgcgcuagcugugucaaugccauggaaggcaaaaagcucgcucaagaugugagagccaagggauaccuggagugcucugcgcuuuccaaccggggcgugcagcaggucuuugagugugccguucgcaccgcugugaaucaggccagacggcgcaacagacggcgccuguucagcaucaaugaaugcaaaaucuuuuga

SEQ ID NO: 74871 - RNA, 1047 nt, Artificial Sequence
  derived and/or modified sequence opt5 from RHO__Homo_sapiens__NP_000530
augaacggcaccgaggggcccaauuucuacgugccuuuuagcaacgccacaggagucguuagauccccguucgaauauccccaguacuaucuggcugagccuuggcaauuuucuaugcucgccgcguacauguuccugcuuaucgugcugggcuuucccauuaauuuccucacgcuguaugugaccguccagcacaagaaacuucggacaccucugaacuacauccuccugaaucuggcuguggccgaccucuuuaugguucuugggggauucaccagcacacuguauaccucccugcauggcuacuuuguguucgggcccacaggaugcaaccucgaaggcuuuuucgccacccugggcggggagauugcucuuuggucucuggucgugcucgccaucgaacgcuacguuguggucuguaagccuaugagcaauuuuagauucggagagaaccacgcuauuaugggcguggccuucacgugggugauggcgcuggccugcgcugccccgccccuggcuggguggucccgguauaucccugagggacuccaguguucuugcggcaucgauuacuauacccugaaacccgaagucaauaacgagagcuuuguuauuuacauguucguggugcauuuuacaaucccuaugauuaucauuuucuuuuguuaugggcagcuugucuucaccgugaaggaagccgcggcccaacagcaggaguccgcuacaacccagaaagccgagaaggaaguuacgcgcauggugaucauuauggucaucgcuuuucugaucugcugggugcccuacgccagcguugccuucuauauuuuuacacaccaaggaucuaauuucggcccgaucuuuaugaccauuccugcuuucuuugcgaaguccgccgcuaucuacaaccccgugauuuacaucaugaugaauaaacaguucagaaacuguaugcucacaaccaucugcuguggcaagaauccucugggggacgaugaggccagcgccaccgucucuaaaacagaaacgucccagguggcucccgccuga

SEQ ID NO: 74872 - RNA, 645 nt, Artificial Sequence
  derived and/or modified sequence opt5 from RHOJ__Homo_sapiens__NP_065714
augaacugcaaggagggcaccgacagcuccugugggugcagaggaaaugaugagaaaaagaugcugaaauguguggucguuggcgacggggccgugggaaagacaugccuccugaugucuuacgcuaacgaugccuuccccgaagaauaugugccuacggucuuugaccacuacgcggugaccguuacagugggcgggaaacagcaucuucugggacucuaugauaccgcuggccaagaggacuacaaucagcugcggccgcuuagcuaucccaacacagaugucuuccugaucuguuuuuccgugguuaauccugccucuuaccacaacgugcaggaagaguggguccccgagcucaaggacugcaugccucaugugcccuaugugcugauuggcacccagaucgaucugcgcgacgauccuaagacacucgccagacugcuuuacaugaaagaaaagccgcugaccuacgagcacggggucaaacucgcuaaggccauuggagcucaauguuaucuggaaugcagcgcccuuacgcagaaaggccugaaggcgguuuucgacgaggccauccucaccauuuuucaucccaagaaaaagaaaaagcgguguuccgaggggcacucuugcuguagcaucaucuga

SEQ ID NO: 74873 - RNA, 618 nt, Artificial Sequence
  derived and/or modified sequence opt5 from RHOQ__Homo_sapiens__NP_036381
auggcccacggccccggggcucugaugcucaagugcguggucguuggagacggcgccguggggaaaaccugucugcuuaugagcuacgcgaacgaugcuuucccugaggaauaugugccgacagucuuugaccauuacgccguguccguuacggugggaggcaagcaguaucugcucgggcuguacgauaccgccggacaagaggacuaugauagacuucggccccugucuuacccuaugacagacgucuuccucaucugcuuuagcgugguuaaucccgcuuccuuccagaacgugaaagaagagugggucccugaacugaaggaguaugcccccaaugugccuuuucugcucauuggcacccagaucgaucugcgcgacgauccgaaaacacuugcuagacugaacgacaugaaggagaagcccauuuguguggaacagggccaaaaacucgccaaggagaucggggcgugcuguuacgucgaaugcucugcccugacccagaaaggacuuaagacaguuuucgaugaggcuauuaucgccauccugaccccuaaaaagcacacggugaagaaacggauuggcagccgcuguaucaauugcugucucauuaccuga

SEQ ID NO: 74874 - RNA, 1980 nt, Artificial Sequence
  derived and/or modified sequence opt5 from RHOT1__Homo_sapiens__NP_001028738
augaagaaagacgugagaauccugcucgucggcgagccccggguugggaagaccagccugauuaugucccuugugucugaagaguucccugaagaggugccgccccgcgccgaagagaucacaauuccugcugaugucacgcccgagagagugccuacccacaucguugacuacagcgaagccgagcaguccgaugaacaacugcaucaggagauuucucaggcgaacgugaucugcaucgucuaugcugugaauaacaaacacagcauugacaagguuacaucccgguggaucccccucauuaaugagcgcaccgauaaagacucuagacugccucuuauccuggugggaaacaagagcgaucucgucgaauacuccagcauggagacaauucugccgaucaugaaucaguauaccgaaauugagacauguguggaaugcucugccaagaaccugaaaaauaucuccgagcucuuuuacuaugcccaaaaggcugugcugcaucccaccggcccucuuuacugucccgaggaaaaagagaugaagccugccugcaucaaagcucugacgcggauuuucaagaucagcgaccaggauaacgacgggacccucaaugaugccgaacugaacuuuuuccagcgcauuuguuuuaauacaccccuugcgccgcaggcccuggaggacgucaagaacguugugagaaaacacaucucugauggaguggcugacuccggccucacccugaagggguuccuguuucuccauacacuguucauucaacggggacgccacgaaaccacguggacaguccuuagacgguuuggcuaugacgaugaccuggaucucaccccugaguaccuguucccccuucugaaaaucccucccgacugcacaaccgagcucaaucaccaugccuaccuguuucugcagagcaccuucgauaagcacgaccucgaucgcgacugugcucugucucccgaugaacuuaaagaccuguuuaagguguucccuuauaucccguggggccccgauguuaacaauacagugugcacgaacgagagaggguggauuaccuaccagggauuccucucccaguggacacugaccacauaucuugacguccaacggugucuggaauaccucggcuaucugggguacagcauccugaccgagcaggaaucccaggccucugcggugacgguuacacgcgacaaaaagauugaucuccaaaagaaacagacccagagaaacguguuucggugcaaugucaucggagugaagaacuguggcaaaagcgggguccugcaggcccuucugggaagaaaucucaugcgccaaaagaaaauucgggaggaccauaaguccuauuacgcuaucaacaccguguacguuuauggccaggagaaguaccugcugcuucacgauaucagcgaaucugaguuccucacagaagccgagauuaucugcgacguggucugccugguguaugauguuuccaauccuaaauccuuugaguacugugcuagaauuuucaagcagcacuuuauggacucucgcauccccugccugauuguggccgccaaaagcgaucuccaugaagucaagcaggaguauuccaucucuccuaccgacuucugucggaaacacaagaugcccccgccucaggcuuuuacaugcaacacggcggaugcccccagcaaggacauuuucgugaaacugaccacaauggcuauguacccucaugccagacuucgcuguaugugcaccuguaaucggugcacauuuuguaucugccaaaacuuccugaauagcgaucuccugcagagcgugaagaacaaaaucuuuaccgccguucugaauagacacgucacgcaggcugaccuuaagucuuccaccuucuggcuccgcgccagcuuuggcgcgacaguguucgcugugcugggguucgccauguauaaagcccugcucaagcaacgguga

SEQ ID NO: 74875 - RNA, 777 nt, Artificial Sequence
  derived and/or modified sequence opt5 from RHOU__Homo_sapiens__NP_067028
augcccccucagcaaggcgacccggccuuccccgauagaugcgaggcuccucccgugccuccccggcgcgaaagagggggacggggcgggcgcggaccuggcgagcccgggggaagaggccgggccggcggggcggaaggacgcggcgucaaguguguucuggugggggacggagcugugggcaaaaccagccucgucguguccuacacaacgaacggguauccgaccgaguacaucccuacagccuuugauaauuucucugccguugugagcgucgacggaagacccgugcggcugcagcuuugcgauaccgcuggccaggacgaauuugauaagcugcgcccucucuguuauacaaacaccgacauuuuccugcuuugcuuuuccguugugucucccagcuccuuccagaaugucucugagaaaugggugccggagaucagaugucacugcccuaaggcccccauuauccuggugggcacacaaagcgaucuccgggaagacgucaaaguucugauugagcuggauaaguguaaggaaaaaccugugcccgaggaggcugccaagcucugcgcggaagagaucaaagccgcuuccuacaucgaauguagcgcccugacccagaagaaccuuaaagagguguuugacgcugccauugucgcggggauccaguauucugauacgcagcaacagcccaagaaguccaaaagccgcaccccugacaagaugaaaaaucugucuaaguccugguggaaaaaguacugcuguuucguguga

SEQ ID NO: 74876 - RNA, 711 nt, Artificial Sequence
  derived and/or modified sequence opt5 from RHOV__Homo_sapiens__NP_598378
augcccccuagagagcugagcgaagccgagccgcccccucuccgggcucccaccccucccccucgcagacgguccgccccgcccgaacugggcaucaagugcgugcuugucggggacggagcgguuggcaaaucuagccugauuguguccuacacauguaacggguauccugcucgcuacagacccacggcccucgauaccuucucugugcagguccugguggacggagccccuguucggaucgagcuuugggauacagcuggccaagaagacuuugaucgccugagaagccucugcuaucccgacaccgauguguuccuggccuguuuuuccgucgugcagccgucuagcuuccagaauauuacagagaaguggcugccugagauccggacccacaacccccaggcuccuguucuccugguggggacacaagccgaccuucgcgaugacgucaaugugcugauucagcucgaucagggaggcagagaaggccccgugccccagccucaagcgcaggggcuggccgagaaaauccgggcuugcuguuaccuugaaugcuccgcccugacccagaagaaccucaaagaggucuuugacagcgcuauccugucugccauugagcauaaggcgcgccuggaaaagaaacucaaugccaagggaguuagaacgcugucccggugucgcuggaaaaaguucuuuugcuucguguga

SEQ ID NO: 74877 - RNA, 555 nt, Artificial Sequence
  derived and/or modified sequence opt5 from RHOXF1__Homo_sapiens__NP_644811
auggccagaagccuggugcacgacaccgucuucuacugccucuccguuuaucaggugaagaucucucccacaccucaacugggcgcugccagcuccgcggaggggcaugugggacagggcgcuccggggcuuaugggaaacaugaaucccgaaggcggggucaaccacgagaauggaaugaaccgggauggcggcaugauuccugaagggggaggcgggaaucaggagccccgccagcaaccucagcccccuccggaggaacccgcccaggccgcuauggagggaccucagcccgaaaacaugcaaccuagaacgcggcgcaccaaauuuacacugcuccagguggaggaacuggagucuguuuucagacauacccaguaccccgacgugccgacacggcgcgagcuugccgaaaaucugggcgucaccgaggauaaggugagaguuugguuuaaaaacaagcgggcucgcuguagacggcaccagcgcgaacucaugcuggccaaugagcugagagcggacccugaugacugcguguauaucgucguggauuga

SEQ ID NO: 74878 - RNA, 867 nt, Artificial Sequence
  derived and/or modified sequence opt5 from RHOXF2__Homo_sapiens__NP_115887
auggaacccccugaccagugcagccaauacaugaccucccuccucucuccggccguggaugacgaaaaggagcugcaggauaugaacgcuaugguccuuagccugacagaagagguuaaagaagaggaggaagacgcccagcccgagccugaacagggcacggcggcuggggagaagcucaaauccgccggagcccaaggcggggaggaaaaggauggaggcggggaggaaaaagacggaggcggcgcuggggugcccggacaccugugggagggcgaucuugaagggaccucuggaagcgacggcaauguggaggauuccgaccagucugagaaggaaccugggcagcaguauagcagaccccaaggagccgucggcggccuggagccugggaacgcucagcagccgaaugugcaugccuucacaccccuccagcugcaagaacuggagcggaucuuucagcgcgaacaguucccuuccgaguuucucagacggcgccuggcgagaagcaugaacguuaccgagcuugccgugcaaauuugguucgaaaaucggcgcgcuaaguggagacggcaccagcgcgcccugauggcuagaaacaugcuccccuuuauggccgucggacagccugugaugguuacagcggccgaggcuaucaccgcuccccuguucauuucuggcaugcgggaugacuacuuuugggaucauucccacucuagcucccuuuguuucccgaugccucccuuuccuccucccagccugccccucccgcugaugcugcugcccccuaugcccccugccgggcaggccgaguucggacccuuuccguucgugaucgucccuucuuuuacauuccccaauguguga

SEQ ID NO: 74879 - RNA, 2013 nt, Artificial Sequence
  derived and/or modified sequence opt5 from RHPN1__Homo_sapiens__NP_443156
augauccuggaggaaagacccgacggcgccggggcuggagaggaaagcccucggcuccagggcugcgauucccugacccaaauucagugugggcagcuucagucucgcagagcccaaauccaccagcagauugacaaggagcugcagaugcggacaggagcggaaaaccucuaccgcgcuacgagcaauaacagagugcgggagaccgucgcccuggagcuuuccuauguuaauucuaaccugcaacuccugaaagaggagcuggaggaacucagcggcgggguggauccgggacgccauggcuccgaggccgugacaguccccaugaucccucugggccuuaaggaaaccaaagagcuggacuggucuacaccccucaaggaacugauuagcgugcacuucggggaggauggagcuuccuacgaagccgagaucagagagcuugaagcucugcggcaggccaugcgcaccccuagcagaaaugagucuggccucgaacugcugacagcguauuacaaccagcucugcuuucuggacgcccgguuccuuacccccgcucgcucccuggggcucuuuuuccauugguaugauagccugacgggaguuccugcccagcaaagagcucuugccuuugagaaaggcucugugcuguucaauaucggggcgcuccacacccagauuggagcccggcaggaccgcuccuguacagaaggcgcuagacgggccauggaggcuuuucaaagagccgccggcgcuuucagccugcugcgcgagaacuuuucucaugcgccgucccccgauaugagcgccgcuucccucugcgcccuggaacagcuuaugauggcccaggcucaggagugugucuucgaagggcugucuccucccgccagcauggcgccucaagacugccucgcucagcugcggcuugcccaggaggccgcucagguggccgcugaauacagacugguucaccgcaccauggcccaacccccggugcacgauuaugucccuguguccuggacagcgcucgugcaugucaaggccgaguacuuucggagccuggcucacuaccauguugccauggcucugugugacggaucucccgccaccgagggcgaacucccuacgcacgaacagguguuccugcagccucccacauccagcaagcccagagggccggugcuuccccaggaacuggaggagcgccggcaacucggaaaagcgcaccugaagagagccauccugggccaggaagaggcccuucgccuccaugcucugugccggguccugagagaaguggaucuccugcgcgcuguuauuucucagacccuucagcggagccuggccaaauaugccgagcucgacagagaagacgauuuuugugaggcugcggaggccccugacauccaacccaagacacaccagaaaccugaagcucggaugccccgccugucccaggggaagggaccggauauuuuccauagacugggcccucuuucuguguucagcgccaagaaucgguggagacucgucggccccgugcaccugacccgcggggagggaggcuuugggcugacccuccggggagacuccccuguucugaucgccgcugugauucccggcagccaagccgcggcugccgggcuuaaagaaggcgauuacaucgucucugugaacggacagccuugcagaugguggcgccaugccgaggucgugacagaacugaaggcugccggcgaggcgggggcuucccuccagguugugagccugcugcccucuuccagacuuccgagccucggagaccggcgcccuguccugcugggccccagagggcuccugcggucccagcgcgagcacggauguaaaacgcccgccucuaccugggccagcccuagaccgcuucugaauuggucccggaaggcucaacagggcaaaacagggggcugcccccagccuugcgcccccgugaagccugcucccccuucuagccucaaacaccccggauggccguga

SEQ ID NO: 74880 - RNA, 2061 nt, Artificial Sequence
  derived and/or modified sequence opt5 from RHPN2__Homo_sapiens__NP_149094
augaccgacgcccugcuccccgcugccccucagccgcuggagaaggaaaacgauggcuacuucagaaaagggugcaauccccuugcgcaaacaggacggagcaagcugcagaaccagcgcgcugcccucaaucagcaaauccugaaagccgugagaaugcggacgggcgcugagaaccuucugaaggucgccaccaauuccaaaguucgcgaacaggugagacucgagcugucuuuugugaacagcgaccugcagaugcucaaggaagaacuggaggggcuuaauauuuccgucggaguguaucagaacacagaagaggcuuucaccaucccucugauuccccucggccugaaggaaacaaaagauguugacuuugccgugguccuuaaggauuucauccuggagcacuacucugaggacggguaucucuacgaagaugagauugcggaccugauggaucugcggcaagccugucgcaccccuagcagagacgaagcuggaguggagcuccugaugacauauuuuauccagcuuggcuucguugaaucccgguuuuucccucccacccgccagaugggccugcucuuuacgugguacgauucucugaccggggugccggucagccagcaaaaucuucugcucgagaaagccuccgugcuguucaacacaggagcucuguauacccagaucggcacaagaugcgaccggcagacccaagccgggcucgagagcgcgauugaugccuuucagcgcgcugccggagugcugaauuaccuuaaggacacguucacacauacccccucuuacgacauguccccugcuaugcugagcguccucguuaaaaugaugcuggcccaggcccaggaaucuguguuugagaagaucucccuucccggcauuagaaacgaguucuucaugcuggugaaggucgcucaagaggcggccaaagugggggaaguuuaucagcagcuccacgcugccaugagccaggccccugugaaggagaauauccccuacucuugggcuucccuggccugugucaaagcgcaucacuaugcugcccuggcccauuacuuuacagcuauucuccugaucgaucaccaagugaagccgggaaccgaccuugaucaccaggagaaaugccugagccagcucuaugaccauaugccugaaggccugacaccccuggccacccuuaagaacgaucagcaacggcgccagcucggcaaaucccaccugagacgggcuauggcccaucacgaggaaucuguuagagaggcgagccuguguaagaagcuccgcuccauugaagugcugcagaaaguccuuugcgccgcucaggagcggagcagacugacguacgcccaacaccaggaggaagacgaucuccugaaucugaucgacgcuccuucuguggucgccaagaccgagcaggaaguggauaucauucuuccccaauucuccaaacucacaguuaccgacuuuuuccagaagcuggggccccugagcguguuuucugcgaacaaacgcuggacaccuccgcggagcaucagauucaccgccgaggagggagaucucggcuuuacgcugcgcgggaacgcucccguccaggugcauuuccuugacccuuauuguuccgccucuguugcuggagcccgggaaggcgacuacauugugagcauccagcuggucgauugcaaguggcucacacuguccgaggugaugaagcugcuuaagagcuuuggggaagacgagauugaaaugaaagugguuucucuccuggauuccaccagcucuaugcacaauaaauccgccaccuacagcgucggaaugcaaaagacauauuccaugaucugucuggcuaucgacgaugacgauaaaaccgacaagacaaagaaaauuucuaagaaacucagcuuccuguccuggggcacgaacaagaauagacagaaaucugcgagcacccuuugccugcccuccgugggcgccgcucgcccucaggugaagaagaaacuccccagcccguuuucucugcugaacuccgauagcucuugguacuga

SEQ ID NO: 74881 - RNA, 1149 nt, Artificial Sequence
  derived and/or modified sequence opt5 from RIBC2__Homo_sapiens__NP_056468
augggcagccagaccauggccguggcucugcccagagaccuccggcaagaugccaaccuggcgaagcgcagacacgcugagcuuugccggcagaaacgcgucuucaaugccagaaaccggaucauugggggagacacagaagccugggauguucaggugcacgaccagaagaucaaagaggcuacggaaaaggcccgccacgagaccuuugcugccgaaaugagacaaaaugauaaaauuauguguauccuggagaaccggaagaagcgcgaccggaaaaaucucugcagagcgauuaacgauuuccagcaguccuuucagaagccugagacacgcagagaguucgaccugucugauccgcuugcccugaaaaaggaccuccccgcucggcaaagcgauaaugacgugcgcaacaccaucuccggcaugcagaaauuuaugggggaagaucugaauuuccaugaaagaaagaaguuucaggaggagcagaaccgggaauggucucugcaacagcagagagaguggaaaaaugcccgcgcugaacaaaagugugccgaggcgcucuacacagaaacccggcugcaguucgacgagacagccaaacaccuucagaagcuggagagcaccacgagaaaagcugucugcgccuccgugaaggacuuuaacaaaucucaggcuaucgaaagcguugagcgcaagaagcaagagaaaaagcaggaacaggaagauaaucucgccgagauuaccaaccugcuucggggagaccugcucuccgagaauccucagcaagccgcuagcucuuucggcccccauagaguggucccugaucgcuggaaagggaugacacaggaacagcuggagcagauccggcuggugcaaaagcagcagauucaggaaaaacucagacugcaagaggaaaagcgccagcgggaccuugauugggacagacgccggauccagggagcgagagccacccugcucuuugagcggcaacaguggcgcagacagcgggaucugagacgcgcucuugacuccagcaaccugucucucgccaaggagcagcaucugcagaaaaaguauaugaacgaaguuuacacaaaucaacccaccggcgauuauuucacgcaguuuaacacaggcucccgguga

SEQ ID NO: 74882 - RNA, 3498 nt, Artificial Sequence
  derived and/or modified sequence opt5 from RIC1__Homo_sapiens__NP_001129392
auguacuuccugagcggcuggcccaagagacuccugugcccucuuggguccccggccgaggcucccuuucacgugcagucugacccucaacgggccuucuuugcgguccuggcugccgcccgccucagcaucugguauuccagacccucuguucugauugugaccuacaaagaaccugcuaagagcuccacacaguucggaucuuauaaacaggccgaguggcggcccgauagcacgaugaucgcuguguccaccgccaacggcuacauucuuuucuuccauaucacaagcacccgcggggacaaguaucuguacgaaccugucuauccgaaaggaucuccccagaugaagggcacaccucacuuuaaggaggaacaaugugcgcccgcccucaaucuggagaugagaaaaauucuggaucuccaggcuccuaucaugucccugcagagcgugcuugaggaccugcucguugccaccucugaugggcugcuucaucugauccacugggaaggaaugacaaacggccggaaggcuauuaaucucugcaccgugcccuucuccgucgaccugcagagcucucgcgugggcuccuuucugggguucacggauguucauaucagagacauggaguacugugccacccucgauggauuugcgguggucuucaacgacggcaaagugggguuuauuacaccggugagcucccgguucaccgccgaacaacugcacggagucuggccucaggauguuguggacggcacaugcguggcugucaauaacaaguaccgccuuauggccuucgggugugugucuggaagcguucagguguauaccaucgauaauuccacgggcgcuaugcugcucagccacaaacuggagcuuacagccaagcaguaccccgacauuuggaacaagaccggcgccgucaaacugaugagauggucuccugacaauuccgugguuaucgugacaugggaguaugggggacucagccuguggucugucuuuggcgcucaacugauuugcacccucgggggagauuucgcguaccggagcgacggcaccaagaaagauccccugaagaucaacuccaugucuuggggagccgaaggguaucaucuuugggugaucagcggcuuuggcucccagaauacagagauugaaagcgaccugcgcucugucgugaaacagcccuccauccuccuguuccaauuuauuaagagcguucuuacggugaacccuuguaugucuaaucaggagcagguccugcuccagggggaagauagacuguaccugaacugcggagaggcuucccaaacccagaauccgcggagcuccucuacacacagcgagcauaaacccucccgcgaaaagucuccuuucgccgacggcgggcucgagagccagggacuguccacccuucugggccacagacacuggcaugugguucagaucagcucuacauaucucgaauccaacuggcccauucgguuuagcgccaucgauaagcuggggcaaaacaucgcuguggucggcaaauucggauuugcccacuacucucugcuuaccaagaaauggaagcucuuuggcaauauuacgcaggagcagaacaugaucgugacagggggacuggcgugguggaaugacuuuauggugcuggcuuguuacaacauuaaugauagacaggaggaacuccgcguuuaucugcggaccuccaaccuugacaaugccuucgcccaugucaccaaagcucaagccgagacacugcuccugagcguguuucaggauauggugaucgucuucagagcugacugcucuauuugucuguacagcaucgaacgcaaguccgacggcccuaacaccacagccgggauccaggugcuucaggagguuagcaugucucgguauauuccccacccguuccucguggucuccgugacgcugaccagcguuuccacagaaaauggaaucacccugaagaugccucaacaggcgagaggcgccgagucuauuaugcucaaccuggcugggcagcuuaucaugaugcaacgcgaucggagcggcccccagauuagagaaaaagacuccaauccuaacaaucagcgcaagcugcuccccuuuugcccucccgugguccuggcccagucuguggagaacguuuggacaaccugccgggcuaauaaacaaaagagacaucugcuugaggcccucuggcugagcuguggaggcgcggggaugaaaguguggcugccgcuguucccucgcgaucaccggaagccccacuccuuucugucucagagaaucaugcuucccuuccauauuaacaucuacccucuggccguccucuuugaagacgcucuggugcugggagccgugaacgauacgcuucucuaugacagccuguacacccggaauaacgcucgcgagcagcuggaaguccucuucccguuuugcguuguggagagaacaucccagaucuaucugcaccauauucuucggcaacugcucgugagaaaucugggcgagcaggcccugcuucuggcccagagcugugcuacccuccccuacuucccucacguccuggaacucaugcugcacgaggugcuugaagaggaagcgacaucucgcgagcccaucccugauccccugcucccuaccguugccaaguuuauuacggaguucccccuguuucugcagacagugguccauugcgcucggaaaaccgaauacgcccuuuggaacuaucuguucgccgcuguggggaauccgaaggaccucuuugaggaaugucugauggcccaagaucucgacacagcggcuuccuaccugaucauucuucagaacauggagguuccugccgugagcagacagcacgccacccuccucuucaauaccgcucuggaacaaggaaaaugggaucugugccgccauaugaucagauuccuuaaggccaucggcucuggggaguccgagacacccccuagcacgcccaccgcgcaggaaccgucuuccagcggcggauuugaguucuuucggaaccgcuccauuagccugucucagagcgcugaaaaugucccugccuccaaauucucucuccagaagacacugagcaugcccuccggcccuucugggaagagauggagcaaagacuccgauugugccgagaacauguauaucgacaugaugcucuggcggcacgcucgcagacugcuugaagacgugcggcugaaggaucugggaugcuuugccgcucaacucggcuucgagcugauuucuuggcuuuguaaagagcgcaccagagccgcgcggguugacaauuuugugaucgcccugaagcgccuccauaaagauuuccuguggccccuccccauuaucccugcuagcuccaucagcucuccguuuaagaacgggaaauacagaacaggaaaugucgacuucaugucccuggugcagggcgaacuuuauuuuacccccugcauuuacacguucuguuauuga

SEQ ID NO: 74883 - RNA, 564 nt, Artificial Sequence
  derived and/or modified sequence opt5 from RIC3__Homo_sapiens__NP_001128581
auggccuacagcaccgugcagagagucgcucuggccuccggccucguucuggcgcuuucucugcuccugcccaaggcuuuccuuagccgggggaaacgccaagagccuccgcccacaccugaaggauaucccgaggaaacguacccuaucuaugaccuguccgauugcauuaagagacggcaggagaccauccucguggacuaccccgauccuaaagaacugucugccgaggagauugccgaacgcaugggcaugaucgaggaagaggagagcgaccaccuggggugggaaucccucccgacagaucccagagcucaggaggacaacucugugaccagcugugauccuaagcccgaaacaugcuccuguugcuuucaugaggacgaagauccugccguccuggcugagaaugccggauucagcgcggacucuuaucccgagcaggaagagaccacaaaagaagaguggucccaagauuuuaaggacgaaggccuugggauuagcaccgauaaggccuacacgggaucuaugcugcggaaacgcaacccgcagggccucgaguga

SEQ ID NO: 74884 - RNA, 5199 nt, Artificial Sequence
  derived and/or modified sequence opt5 from RICTOR__Homo_sapiens__NP_001272368
auggccgcuaucggccgggggcggagccugaagaaccuccgcgugagaggacggaaugacuccggcgaggaaaacgucccccuggaucuuacccgcgagccuucugacaaucugagagaaauccuccagaacguugcccggcugcaaggggugagcaauaugcgcaaacuuggacaccugaacaauuucaccaagcuccugugcgauaucggccacuccgaggaaaagcugggguuucacuacgaggacauuaucauuugucucagacuggcgcuucugaacgaggcuaaggaagugcgggccgccggacuccgcgcucugagauaucuuauccaggauucuagcauccugcagaagguccucaagcugaagguggacuaccugauugcccggugcaucgauauucagcaauccaaugagguugaacgcacgcaggcucucagacuggugcggaaaaugaucaccgucaacgccucucuuuucccgagcuccgugacaaauagccugauugcgguuggcaacgacggccuccaggagcgcgauagaauggugcgggccuguaucgcuauuaucugcgagcuggcccuucagaaucccgaagucguggcucugagagggggacucaacaccauccugaagaaugugauugacugucaacugucucgcaucaacgaggcccucauuacaaccauccugcaucuucugaaccacccuaaaacacggcaguaugucagagcggauguugaacucgagcgcauucuggcccccuacaccgacuuucauuaucggcacuccccugauacggcugaaggccagcuuaaggaggacagagaggcccgcuuccuggcuagcaaaauggggaucaucgccaccuuucggucuugggccggaauuaucaaucucugcaagcccggcaacuccgggauucagagccugaucggagugcuguguauuccuaauauggaaaucagacgcggccuccuggaggugcuuuacgacaucuuccggcugccgcuccccgucgugacagaagaguuuauugaagcucugcugucuguugauccuggcagauuccaagacuccuggcgccuuagcgauggguuuguggcggccgaggcuaagaccauccucccccaccgggccagaucccggccugaccugauggauaacuaucuggcccucauucugucugcuuucauccgcaauggacuucuggagggccucgucgaagugauuacaaacagcgacgaucauaucuccguuagagccaccauucugcugggggagcuucuccacauggcgaauacgauccugccccauagccacucucaccaucugcacugccucccgacacugaugaacauggcugccuccuuugacaucccuaaagaaaagcggcuuagagccagcgcugcccugaauugucucaaacgcuuccaugagaugaagaaacggggacccaagccuuacucucugcaccuggaucauauuauccagaaagcuauugccacccaccagaagagagaccaauaccuucgcgugcagaaggauaucuuuauucucaaagacacagaagaggcgcugcugaucaaccucagagacagccagguccugcagcacaaggagaaucuugaauggaacuggaaucugaucggcaccauucucaaauggcccaacgugaaucugcggaacuauaaggaugagcaacugcaucgcuucgucagacggcuucucuacuucuauaaacccuccucuaagcuguacgccaaccuggaccucgauuuugcuaaggccaaacagcugaccgugguugggugccaguucacagaauuucuucuggagagcgaggaagacggacagggcuaucucgaggaucuggugaaggacaucguccaauggcugaaugcuuccagcggcaugaaaccugaacgcucucuucagaacaaugggcugcucacgacccugucccagcacuacuuccucuuuauuggaacacugagcugucauccgcacggcgugaagaugcuugagaaaugcucuguuuuccagugccugcucaaccuguguucccugaagaaucaagaucaccuucugaagcucaccgugagcucccuggacuauucuagagaugggcucgcccgggucauccugagcaaaauucuuacagcggccaccgacgcuugccgccuguacgccacgaagcaucucagagugcugcugcgggcuaacguggaauuuuucaauaacuggggaaucgagcuucugguuacacagcuccacgauaaaaauaagaccaucuccucugaggcccuggacauucucgaugaagccugugaggacaaagcuaaccugcaugcgcuuauccagaugaagcccgcccugagccaccugggcgacaaggggcuccugcuucugcuccgcuuucuguccauuccuaaaggcuucagcuaccucaaugaaagaggauaugucgcuaagcagcuggagaaauggcaucgggaauacaacucuaaguauguggaucuuaucgaggagcaacugaaugaagcccugaccacauacagaaaacccguggacggcgauaacuauguccgccgguccaaucagagacuccagcgcccucacguguaccugcccauucaccuuuaugggcaacugguucaucacaagaccggaugccaucuccuggaggugcagaacaucaucacagaacucugucggaacgucagaacgccggaccuggauaaaugggaggaaauuaagaaacuuaaagccagccugugggcucugggcaauaucgggucuuccaacuggggacucaaucugcuucaggaggagaacgugauuccugacauccugaagcucgccaaacagugcgaaguucugagcauucgcggcaccuguguguacguccucgggcugaucgcgaagacaaaacaaggcugcgauauucuuaagugucacaauugggacgcugugcggcauucuagaaagcaccuguggcccguugugccugaugacgucgagcagcugugcaacgaacucagcuccauccccagcacccugucucuuaauuccgagagcacauccucucgccacaacagcgaguccgaaucugugccuagcuccauguuuauccuggaggaugaccgguucggaucuagcuccaccagcacguuuuuccucgauauuaaugaagacaccgagcccacauucuacgacagaucuggcccgaucaaagauaagaacuccuuuccuuucuuugccagcucuaaacuggugaagaaucggauucugaacucccucacccuucccaauaaaaagcaucgcuccucuagcgaccccaaagggggaaaacugagcuccgaaagcaagacaucuaacagacggauccgcacccugacggagccuagcgucgauuucaaucacuccgacgauuuuacaccgauuucuaccguucagaaaacacuccagcuggagaccagcuucaugggcaacaagcauaucgaagacaccggguccacacccucuaucggagagaacgaucuuaaauuuacgaagaauuucggcaccgaaaaccacagagagaauacaagccgggaaagacuggugguggaguccucuaccagcucccacaugaagauucgcagccaaucuuuuaacacagacaccacgacauccgggaucagcucuauguccagcuccccuucucgggagaccgucggcguggaugccaccacaauggacaccgauuguggaagcauguccacaguugugagcacgaaaaccauuaagacaucucauuaucucacaccccaguccaaucaccugagccugucuaaaagcaacuccgucucucucgugccucccggcagcucccauacacuuccuagacgcgcucagucucugaaggcccccagcaucgcgaccauuaaaucccuggcugacugcaauuucagcuacacgucuucccgggacgccuuuggguaugccacccucaagagacugcagcaacagcgcaugcacccgagccuuucccauucugaagcucuggccagcccugcuaaagauguucucuucacagacaccaucacaaugaaggccaacuccuuugagucucggcugacccccagcagaaucgauuucaagaaaaagcacgugggaggcauucgcucccugagaccuacaaucaccaauaaccucuuccgguuuaugaaagcgcuuagcuacgccucucuggacaaggaagaucugcucucccccauuaaucagaacacgcugcaacgcuccucuagcgucagaagcauggugucuagcgcuacauaugggggauccgacgauuacaucggccuugcccugccgguugacauuaaugauaucuuccaggugaaagacauuccuuauuuucagaccaagaacauucccccucacgaugacagaggggcucgcgccuucgcccaugaugcuggcggacuccccucuggcaccgggggacuggucaagaauagcuuucaucugcucagacagcaaaugucccuuacagagaucaugaacagcauucauuccgacgcgucucuguuccuggaaagcaccgaggacacgggccuccaggagcacacagaugacaauugccuguacugugugugcaucgaaauucuuggguuucagcccuccaaccagcugucugccaucuguagccacuccgauuuccaagacauuccuuacucugauuggugcgagcagaccauccauaacccgcucgaagugguccccagcaaauuuuccggaaucagcggcuguucugacggcguuucccaggaggggagcgcuucuuccacaaagagcaccgagcugcugcucggagugaaaacaauuccugaugacacccccaugugccggauccuucugagaaaggaagugcugcgccucgucauuaaucugucuuccagcguguccacgaaaugucacgagaccggccuucugacaaucaaggaaaaguauccucagaccuucgaugacauuugccucuacagcgagguuucucaucugcugagccacuguacauuucggcuccccugcagacgcuucauccaagaacuuuuccaggaugugcaguuucugcagaugcaugaggaggccgaagccguccuggcuaccccuccgaaacaacccaucguggacacguccgccgagucuuga

SEQ ID NO: 74885 - RNA, 7341 nt, Artificial Sequence
  derived and/or modified sequence opt5 from RIF1__Homo_sapiens__NP_001171134
augaccgccagaggccagagcccccuggcuccucuucuggaaacccuugaagacccguccgccucucacgggggacaaacggaugcguaccugacccucacaagccggaugaccggcgaggaagggaaggaggugaucacagaaauugagaaaaagcugccccgccuuuauaaaguccugaagacccacaucuccucucagaacagcgagcucuccucugcugcccugcaggcccugggauucugccucuacaauccuaaaauuacaagcgaacuguccgaggcuaacgcccuugaacugcucagcaagcugaaugacaccaucaagaacucugauaaaaauguuagaacgcgggcucuuugggugauuuccaagcagaccuuucccagcgagguggucggcaaaauggugucuuccaucaucgacagccuggagauucucuucaacaagggggaaacacacucugccguuguggauuuugaggcgcugaaugucaucgugcgccugauugaacaagccccuauccagaugggagaggaagcuguuagaugggccaaacucgugauuccccuggucgugcauuccgcucagaaggugcaccuucggggcgccaccgcgcuggagaugggcaugccucuccugcuucagaagcaacaggagaucgccagcauuacagaacagcugaugaccacgaaacucaucuccgagcugcagaagcuguucaugucuaaaaacgaaacauauguccucaagcuguggccgcuuuuuguuaaacugcucgggcgcacccugcauagaagcggauccuucaucaauagccuucugcaacucgaggaacugggcuuucggucuggggcucccaugauuaagaaaaucgccuucauugcuuggaagucccugaucgacaacuuugcccucaauccugauauucuguguagcgccaagcgccuuaaacugcucaugcagccccugucuagcauccacgugagaacagagacccuggcucuuaccaagcucgagguguggugguaccugcugaugcggcucggaccucaucugcccgcgaacuucgaacaggucugcgugccgcuuauccaauccacaauuucuaucgacagcaaugccuccccucagggcaacagcugucauguugcuacgucucccgggcugaauccuaugacccccgugcacaaaggagccuccagccccuauggcgccccuggcacaccgcgcaugaaccucucuuccaaccucgggggaauggcuaccauucccagcauccagcugcuuggccucgagaugcugcugcauuuucuccuggggccugaagcccuuuccuucgcgaagcagaauaaacugguccucucucuggagccccuggaacacccucuuauuagcucccccagcuuuuucagcaagcacgcuaacacacucaucaccgccgugcaugauuccuucguugccgugggaaaggacgcuccggaugucguggucagcgccaucuggaaagagcugauuucucuggugaaguccguuacggagagcggcaauaaaaaggaaaaaccugggucugaggugcucacacugcuucugaagucccucgaaagcaucgucaagucugagguguuucccguuagcaaaacccuggugcugauggagauuaccaucaagggacuuccucaaaaaguccucggcucccccgcuuaccagguggccaacauggacauucugaauggcacacccgcgcuguuccucauccagcugauuuuuaacaauuuccuugaaugcggggugagcgaugagagauuuuuccugucucucgaaucccugguuggauguguccugagcggccccaccuccccgcuugccuuuucugacagcgugcugaacgugaucaaucagaacgcuaagcaacucgagaauaaagaacaccuguggaagaugugguccgucaucgugacaccucucacggagcugauuaaccagaccaaugagguuaaccagggggacgcccuugaacauaauuucucugcuaucuauggagcccugacacuccccgugaaccacauuuuuagcgagcagcgguuccccgucgcgaccaugaagacacugcugcgcaccugguccgaacuuuacagagccuuugcucggugcgccgcucugguggccacggccgaggaaaaccucuguugcgaggagcugucuagcaaaaucauguccagccucgaagaugagggcuucucuaaucugcuuuuuguugacagaauuaucuacaucauuaccgugauggucgauuguaucgacuucuccccuuauaacauuaaguaccaaccgaaagugaaguccccucagcgcccuucugauugguccaaaaagaaaaaugaaccccuggggaagcucacaagccuguucaagcugaucguuaaagugauuuauucuuuucauacccuuuccuucaaggaggcucacagcgacacacuguuuaccaucggcaacuccaucacgggaauuaucagcucuguccucggccacauuagccugccuuccaugauccggaaaauuuucgcgacacucaccagaccccuggcccucuuuuacgaaaauucuaagcuggaugaggugccuaaaguguauagcugccugaacaauaagcucgagaagcugcuuggggaaaucaucgcuugucugcaguucuccuacacaggaaccuaugacucugagcuccuggaacagcucagcccccugcuuugcauuaucuuucugcauaaaaacaagcaaauucgcaaacaguccgcccaguucuggaaugccaccuuugcuaaggucaugaugcugguuuacccggaggagcucaaaccugugcugacacaagccaagcagaaguuccuucugcuccugcccggccucgaaacgguggagaugauggaagagucuagcgggccuuacuccgauggaaccgaaaacagccagcugaaugucaaaaucucuggcauggagcggaaguccaacgggaaaagagacagcuuucuugcgcagacaaagaauaaaaaggagaacaugaagcccgcugccaaacugaagcuggaaucuuccagccucaaagugaagggcgagauucugcuugaagaggaaaaauccaccgauuucguuuuuaucccgccugagggaaaggacgccaaagagcgcauucugacagaccaccaaaaggaagugcucaagaccaaacggugcgauauccccgcuauguauaauaaccuggacgucucucaggauacgcuguucacacaguacagccaggaggaaccuauggagauccccacccugaccagaaagcccaaagaagacuccaagaugaugauuacagaggagcaaauggauagcgacaucgugauuccucaggauguuaccgaagacuguggcauggccgagcaucuugaaaaaucuucccugagcaacaaugagugcgggucucuggauaagacaagcccggagauguccaacucuaauaacgacgaacgcaagaaagcgcucaucagcucccggaagacgucuaccgagugugcuagcuccacagaaaauagcuucguggucucuuccagcuccgugucuaacaccacaguugccggaacacccccuuaucccacgagcagacgccagaccuuuauuacacuggagaaauucgauggcuccgaaaaucggccuuuuucucccagcccucuuaacaauaucuccagcaccgugacagucaagaacaaucaggagaccaugaucaaaacagacuuccugccgaaggccaagcaaagagaggggaccuuuucuaaauccgauagcgaaaagauugugaacggaacgaaacggucuucccgcagagcuggcaaggccgagcagacagggaauaaacggagcaagccccucaugagaucugaaccugagaagaacaccgaagagagcguggagggcaucgucguucuggaaaauaaucccccuggacugcucaaccagaccgagugcguguccgacaaucaagugcaccuuucugaaagcacaauggagcacgacaacaccaaacugaaggcugccacggucgaaaaugcggugcugcucgagacaaacaccguugaggagaagaacguggagauuaaccuggaauccaaggagaauacacccccggucgugaucagcgccgaucagaugguuaacgaggacucccaggugcagauuaccccuaaucagaaaacacuucgccggucuagcagacgcagauccgaagucguggagucuaccacggaaagccaagauaaggagaacucccaucagaagaaagaacggcgcaaggaggaggaaaaaccccugcagaagucuccccuccacaucaaagacgauguccugccuaagcaaaaacugaucgcugagcagacccuccaggaaaaucuuauugagaagggcagcaaccugcaugaaaagacacugggggagaccuccgccaaugcugagacagaacagaacaaaaagaaagccgaccccgagaauaucaagagcgaaggagauggcacccaagacauuguggauaaaucuuccgagaagcucguuagagggcggacgcgcuaccagacaagacgggccagccagggacugcuuucuuccaucgaaaacagcgagucugacuccagcgaggcuaaggaagagggcucccgcaaaaagagaagcgggaaauggaagaauaaaucuaacgaaagcguggauauucaggaccaagaggagaaggucgugaagcaggaauguaucaaagcggagaaccagucccacgauuauaaggccaccucugaagaggacguuagcauuaaauccccuaucugcgaaaagcaagacgagucuaauacagugaucugucaggauagcaccgucaccuccgaccugcuccaggugccggaugaccugcccaacgugugcgaggagaaaaaugagacaucuaaguacgcugaauauagcuucacgucccugccuguucccgagagcaaccuccggacccgcaaugccauuaagagacuucauaaacgggauucuuuugacaacuguucccugggcgaaagcucuaagaucggaauuuccgauaucagcucccugucugagaaaacauuccagacccucgagugccaacacaagagaagccgccgggucagacgcuccaaaggcugugacugcugcggggaaaagagccagccucaggagaaaucucugauuggacuuaagaauacagaaaacaaugauguggagaucuccgaaaccaagaaagccgacgugcaggcucccgucagcccgucugagacgagccaagccaacccuuacuccgagggccaguuucuggaugaacaccauucugugaauuuccaccucgggcugaaggaggacaacgacacaaucaaugauagccugauuguuuccgaaaccaaaucuaaggagaacaccaugcaggagagccuccccuccggaaucgugaauuuucgggaagagauuugugacauggauagcucugaagcgaugucccuugagagccaggaauccccuaacgagaacuucaaaacagucggccccugccugggcgacucuaagaaugugagccaagagucccuggaaaccaaggaggaaaaaccugaggaaacacccaagauggagcucucucuggagaacguuacgguggaagggaaugcuuguaaagucaccgagagcaaccuugaaaaggccaaaacaauggagcugaaugugggaaacgaagccuccuuccauggccaggagagaaccaagacagggaucagcgaggaagcugccauugaggaaaauaagcgcaacgaugacucugaggcggauaccgcuaaacucaaugccaaggagguugccacggaagaguuuaacuccgacaucagccugucugauaauaccacaccggugaaacugaacgcucagaccgaaaucuccgagcaaacagccgcuggagaacucgacggcgggaaugaugucagcgaccuucacucuuccgaggagaccaacacaaagaugaaaaauaacgaagagaugaugauuggagaagccauggcggagacgggccaugauggcgaaaccgagaacgaggggaucacaaccaagaccagcaagccugacgaagccgagacaaauaugcugacggcugaaauggacaacuucgugugcgauaccguggagaugucuacagaagagggaauuaucgacgccaauaaaaccgagacaaacaccgaauacagcaaguccgaggaaaaacuggauaauaaccagauggucauggagagcgacauucuccaggaggaucaccacacgucccagaagguugaggaacccucucaaugucuggcuagcggcacagccaucuccgaacuuauuaucgaggacaauaacgccucuccccagaaacugcgggaacucgauccuagccugguguccgcuaaugacucuccgagcgggaugcagaccagaugcguguggagcccccuggcgagcccuucuaccuccauccucaagcgcggacuuaaacggagccaggaggaugagauuucuucccccgucaacaaggugagacggguuagcuuugccgacccuaucuaucaagcuggccuggccgaugacauugaucgcagauguucuaucgugcggucccauagcucuaauuccagccccauugggaagucugucaaaacauccccuaccacacagucuaagaucagcgaaauggccaaagaguccaucccgugccccaccgaaucuguguacccuccccugguuaacuguguggcuccugucgacauuauccucccccagauuacgagcaauaugugggcccgcggacugggccagcuuaucagagcgaagaacauuaaaacaaucggcgaccuguccacccucacagcuucugagaucaagacccugccgauucggagcccuaagguguccaaugucaaaaaggcccugagaaucuaucacgaacaacaggugaaaacgcgcgggcucgaggagauucccguuuucgauaucagcgaaaagaccgugaacggaauugagaacaaaucucuuucccccgacgaagaacggcuggugagcgauaucauugacccugucgcccuggaaaucccccucucuaagaaucugcuugcucagaucuccgcccuggcgcuccagcuggauagcgaggaccugcauaacuacuccggcucucaacucuuugagaugcacgaaaaacuuagcugcauggccaauuccguuauuaaaaaccugcagucuagauggcgcagcccuucccacgagaauagcaucuga

SEQ ID NO: 74886 - RNA, 1206 nt, Artificial Sequence
  derived and/or modified sequence opt5 from RILP__Homo_sapiens__NP_113618
auggagcccagacgggccgcuccuggcgugccgggguggggaagccgcgaagccgcgggcuccgcuucugccgccgagcuggucuaccaccucgcuggggcccugggaaccgaacuucaggaccuggcuagacgguucggccccgaggccgcggccgggcucguuccucugguggugcgcgcucuugaacugcucgagcaagccgcugucggacccgccccugauagccuccagguguccgcgcagcccgccgagcaggaacugagacggcugcgcgaggaaaacgagagacugcggcgcgagcuuagagcuggcccucaagaagaacgggcccugcuccgccagcugaaggaaguuacagacagacagcgggaugagcuucgcgcucauaauagagaccugcggcagagaggccaagaaacggaggcccuccaggagcagcugcagcgccugcuccuggugaacgccgaacuucggcacaaacuggcugcgaugcaaacccagcucagagccgcucaggaucgcgagcgggaaagacaacagccgggggaggccgccacaccccaggcuaaggaacgcgcccggggacaggcgggcagaccugggcaucaacacggacaggagcccgagugggcuaccgccggcgccggggcuccuggaaaucccgaagacccggccgaggcugcccagcagcugggccgcccuucugaagcgggccaaugccgguuuagcagagaggaguucgagcagauccuucaggagcgcaacgaacugaaagccaaggucuuucuccugaaagaggaacuggcuuauuuccagcgggagcuccugacagaucauagagugcccgggcuucugcucgaggccaugaagguugcugugcggaagcaacgcaaaaagauuaaagccaagaugcugggaaccccugaagaggcggaauccucugaggacgaagccggccccuggauccuucugagcgaugacaaaggggaucaucccccuccgcccgaguccaagauucagagcuuuuucggacucugguacagaggcaaggcugagucuuccgaagacgagacaagcucuccugcccccuccaaacucgggggagaagaggaagcucagccucagagccccgccccggauccucccuguucugcccugcacgagcaccugugccugggcgcuuccgcggccccugaggcuuga

SEQ ID NO: 74887 - RNA, 1212 nt, Artificial Sequence
  derived and/or modified sequence opt5 from RILPL1__Homo_sapiens__NP_847884
auggaggaagagagaggcagcgcccuggcugccgaauccgcgcucgagaagaacguggcugaacugaccgucauggacguuuacgauaucgccucucuuguggggcacgaguucgagcgggugauugaccagcauggaugcgaagccaucgcucgccugaugcccaaagucgugagaguucucgagauucuggaagugcuugucagccggcaccauguggccccugagcuggaugagcuccgccuggaacuggacagacuccggcuggagcgcauggauagaaucgaaaaggagcggaaacaccaaaaggaacuugagcugguugaggacguguggcgcggcgaagcucaggaucuccugucccagauugcccagcuucaagaggaaaauaaacagcugaugacaaaccucucucauaaggacgucaauuuuagcgaggaagaguuccagaagcacgaggggauguccgaaagagagcgccaggugaugaaaaagcugaaagaaguggucgauaagcaacgggacgagaucagagcgaaagaucgggaacugggacucaagaacgaggacguugaggcccugcagcagcagcaaacgcgccuuaugaagaucaaucacgaucugagacaucgggugaccguggucgaagcucagggcaaagcccucauugagcagaagguggaacuggaggcugaccuucaaacaaaagagcaggaaauggggucucugagagccgagcucggaaagcugcgcgaacggcugcagggcgagcacagccagaacggcgaagaggagccggaaaccgagcccguuggggaagaguccaucagcgacgcggaaaaaguggccauggaucucaaggacccuaauagaccccgcuuuacacugcaagagcuucgggauguccugcaugagagaaacgaacucaaaucuaagguguuccugcuucaggaggaacuggcuuauuacaaguccgaggaaauggaggaggaaaaucgcauuccucagcccccuccgaucgcccacccccggaccagcccucagcccgagucuggaauuaaaagacucuuuuccuucuuuagccgcgacaagaaacggcuggcuaacacacaaagaaauguucacauccaggaaucuuucggccagugggccaacacccaucgcgaugacggguauacggagcagggacaagaggcccugcagcaccucuga

SEQ ID NO: 74888 - RNA, 3159 nt, Artificial Sequence
  derived and/or modified sequence opt5 from RIMBP2__Homo_sapiens__NP_056162
augagagaggccgcugaacggcgccagcaacugcagcucgagcacgaccaggcccuggcggugcuuagcgcuaagcagcaagaaaucgaucugcuccagaaauccaaggucagagagcuggaagagaaaugccggacccagucugagcaguucaaccuucugagccgcgaccucgaaaaguuuagacaacaugccggcaaaauugaucugcucgggggauccgccguugcuccccuggacaucucuacagccccuagcaagccguucccccaguuuaugaauggccuggcuacgucccuugggaagggacaggagucugccauuggcgggagcuccgcgaucggagaauacauucggccucugccccagccuggcgaucgccccgagccucucagcgccaaaccgaccuuccugucuagauccggcagcgcucggugucgcucugaguccgacauggaaaacgagagaaauagcaacacaucuaagcaacgguauuccgggaaagugcaccuuugcguggcccgcuacagcuauaaucccuuugauggaccuaacgaaaaucccgaggcugaacugccucucaccgccggcaaguaccuguaugucuacggggacauggaugaggacggauucuaugagggcgaacugcucgaugggcagagaggacuggugcccuccaacuuuguugacuucgugcaggauaaugagucucggcuugcgagcacacugggcaacgaacaagaccagaauuuuaucaaccauuccggcaucgggcucgagggagaacacauucuggaccuucauagcccgacccacaucgaugccggcauuacagacaauucugcugggacccuggaugucaacaucgacgauauuggagaggacaucgugccuuacccccgcaaaauuacgcucaucaagcagcuggccaaguccguuaucgugggcugggagccucccgcugugcccccuggguggggaaccgucagcucuuacaaugugcuggucgauaaagaaacaagaaugaaccucacccugggcagccggacaaaggcccuuauugagaaacugaacauggccgcuuguaccuauagaaucuccguucagugcgugacgucucgcggcagcuccgacgaacuccaauguacacugcuuguggggaaggaugucgugguugcgccgagccaucugcggguggacaauauuacccagaucucugcccagcucuccuggcugcccacaaacagcaauuacucucacgucauuuuccugaacgaggaagaguuugauaucgugaaagcugccagauauaaguaccaguucuuuaaucuccgcccuaacauggccuauaaaguuaaggugcuggcuaagccccaccaaaugccuuggcagcuuccccuggagcagcgggagaaaaaggaggccuucgucgaguucuccacccucccggcgggaccucccgcuccuccccaggacgugaccguccaagccggcgugacgccugccacaaucagaguuagcuggcggcccccggugcugaccccuacagggcuguccaauggagcuaacgucaccggcuacgggguguaugccaaaggccagcggguugcugaagugauuuuucccacagccgacucuaccgcggucgagcuugugagacuccgcagccuggaagccaagggagugacgguucggacacuguccgcucagggcgagucugucgauagcgccguggcugccgugcccccugaacuccuggucccgcccaccccucaucccagaccugcgccccaguccaaaccucuugccagcucuggggugcccgagaccaaggacgaacaccugggaccgcacgcucgcauggaugaggccugggagcaaucccgggcuccuggccccguucaugggcacaugcucgaaccucccgugggaccgggcagacggagcccuucucccucccgcauccugccucagccccaggggacacccgucagcaccacaguggccaaggccauggcuagagaggcggcccaacggguugcugaaucuagcagacuggagaaacgcuccguguuccuugaacggagcucugccggccaguacgccgcuuccgacgaggaggaugccuacgacagcccugauuuuaagagacgcggagcguccgucgacgauuuccucaaaggcucugaacuggggaagcagccgcauugcugucacggagacgaguaucauacggaaagcuccagaggcucugaucugagcgacauuauggaggaagaugaggaggaacucuacuccgagaugcagcuggaagacgggggacggcgcagacccucuggcaccagccacaaugcucuuaaaauccuggggaacccugccuccgccggccggguggaccacaugggacgcagauuuccccggggcagcgcugggccucaacgcucuagacccguuacagugccuuccauugaugacuauggacgggaucgccucagcccggacuucuacgaggagucugaaaccgaucccggcgccgaggaacugccugcgagaaucuuugucgcucuguucgacuaugauccccuuacaauguccccuaaucccgacgccgccgaggaagaacucccguuuaaggaggggcagaucauuaagguguacggagauaaagacgcugauggcuucuaucgcggggaaaccugcgccagacugggccugaucccuuguaacauggugagcgagauucaggcugacgaugaagagaugauggaccagcuccugcgccaaggauuucuuccccugaauacgcccgucgaaaagaucgagcggucuagacgcuccggccggagacauagcguuuccacccgccggaugguggcccucuacgacuacgauccuagagagagcucucccaacguggacgucgaagcggagcugacauucugcaccggggauauuaucacaguguuuggagaaauugacgaggauggcuucuauuacggggaacugaauggacagaaaggccuuguuccuagcaacuuccucgaggaggugccggacgaugucgaaguguaucuguccgacgcccccucucacuacagccaggauaccccuaugcgcuccaaggcuaaacggaagaagucuguucauuuuacgcccuga

SEQ ID NO: 74889 - RNA, 4920 nt, Artificial Sequence
  derived and/or modified sequence opt5 from RIMBP3C__Homo_sapiens__NP_001122105
auggccaaggacagccccuccccucugggcgcuucuccgaaaaagcccgggugcagcuccccugccgcggcugugcucgagaaccagagacgggaacuggagaaacuucgcgccgaacuggaggccgaaagagcuggauggcgggccgagcgcagacgguucgcugcccgcgagagacaacuccgggaagaggcggaacgcgagagacggcagcuggccgaucgccuuagaucuaagugggaggcucagcggagccgcgaacugagacagcuccaagaggaaaugcagcgggagagagaagccgagauccgccagcugcugcgguggaaagaggcugaacagagacaacuccagcagcugcuucaccgcgagcgggacggcgucguuagacaggcccgcgaacugcaacggcagcucgcggaggaacuggugaauagagggcauuguucccgccccggagccucugaggugagcgcugcccagugccgguguagacuucaagagguccuggcucagcuccgcuggcagaccgauggcgaacaggccgcccggauuagauaccugcaagcugcgcuggagguggaacggcagcucuuucugaaguauauccuugcccacuuccgcgggcauccugcucuguccggaagccccgacccucaggccguucacucucucgaggaaccgcugccccagacauccagcggcucuugccaugccccuaagcccgcuugucaacuuggcucccuggauagccucucugccgaggugggggucagaucccggagccugggacugguguccucugcgugcagcuccagcccugacggccuccugucuacgcacgcuuccagccuugauuguuuugcccccgccugcucuagaagccuggacuccacccgcucucucccgaaagcuagcaaguccgaggaacggccuagcucucccgauacauccaccccugggagcagacgccugucucccccucccuccccgcuucccccucccccucccccgagcgcccacagaaaacuguccaacccucggggaggcgaggggucugaaagccagcccugugagguucucacaccuucucccccuggacugggccaucacgagcugauuaagcucaauuggcugcuugcuaaagcccugugggugcucgcgcgcagaugcuacacccugcaggaagagaacaagcagcugcggcgcgccggcugucccuaucaagcugacgaaaaggucaaaagacuuaaggugaaacgggccgagcucacagggcuggcucgcagacuggccgaucgggcgcgcgaacuccaggagaccaaucugagagccguguccgcuccgaucccuggagagagcugcgccggccuugaacugugccaggucuucgcucggcagagagcccgcgaccucuccgagcaagccagcgcuccccuggcgaaggauaaacagauugaggaacugcggcaggaaugucaucuucuccaagccagaguugcuucugggcccugcuccgaccugcacacgggacgcggcgggccuuguacccaguggcugaacgugcgggaccucgauagacugcagcgcgagagccagcgggaggugcuuagacugcaacgccagcucaugcugcagcagggaaauggcggcgccuggccggaagccgggggacaaucugcuacaugcgaggaaguccggagacagaugcuggcccuugagcgggaacucgaccagcgcagacgggagugucaggagcugggcacccaagcggcucccgcccgcagacgcggggaagaggccgaaacacagcugcaggcugcccuccugaagaacgcguggcuugcugaggagaauggaagacugcaagccaaaaccgauugggugcgcaagguugaagccgagaacuccgaagugcggggccaccucgggagagcuugccaggagcgcgacgccagcggccugaucgcugaacagcugcuucagcaagccgcgcggggacaggauagacagcagcaacuccagcgcgacccucagaaggcccugugugaucugcaucccucuuggaaagagauccaggcucuccaaugccggccuggccaucccccugagcagcccugggaaacgagccagaugccggagucccaggucaaggggagcagacgcccuaaauuucacgccagacccgaagacuacgcugugucucaaccuaaucgggauauucaggagaagcgcgaagccucccuggaggagagccccguugcccuuggagaauccgcuucugugccgcaggucagcgagacagugccugcgucccaaccccugucuaaaaagaccagcucccagucuaacagcuccagcgaaggcucuaugugggccacagucccuuccagccccacccucgacagagauaccgcuucugagguggacgaccuggaacccgauuccguuagccuggcccuugagaugggcggaucugccgcuccugccgcgccgaagcugaaaaucuucauggcucaguauaauuacaaccccuuugagggcccuaaugaccaccccgaaggggagcucccucugacagccggcgauuauauuuacaucuucggagacauggaugaagacggcuuuuacgagggggagcucgaugacggacggcgcggccuggugcccuccaacuucgucgaacagauuccugauagcuauaucccggggugucuucccgccaaguccccugaccugggacccagccaacucccugcuggccaggaugaggcccuggaagaggacucucugcuuagcgggaaagcgcagggcaugguggauagaggacugugccagaugguucgggugggcuccaagacggaagucgcuaccgagauucucgacacaaaaaccgaggccugucaacuggggcuccugcagucuaugggaaagcagggccuuagcagaccccugcucgggacaaagggagugcugcgcauggccccgaugcagcugcaucuucaaaacgugaccgcuacguccgccaauaucacauggguuuacucuagccaccggcacccucaugucguguaucuggacgauagagaacacgcucucacccccgccggcguguccugcuacaccuuucaggggcugugccccggcacacauuaucgcguccggguggagguuagacucccuugggaccugcuucagguguacuggggaaccaugucuagcacagucacguucgauacccugcuggcggggcccccuuauccgccccucgacgugcugguugaacggcacgccuccccuggggugcuugucgugagcuggcugcccguuacaaucgauucugcuggauccagcaacggcgugcaagucaccggguacgccguguacgcugacggacucaaagugugugaggucgccgaugccacagcuggcucuaccguucuggaauuuucccagcuccaggugccucugacguggcagaaggugagcguccgcaccaugucccuuugcggcgagucucuggacagcgugcccgcgcaaauuccggaggauuucuucaugugucacagauggccugaaacacccccuuuuuccuauaccugcggggaccccagcacauaccggguuaccuucccuguguguccccagaaacugucucucgccccgccuuccgcuaaggccagcccccauaaucccggaucuugcggcgagccucaggccaaauuucuggaggcuuucuuugaagaaccgccccgcagacagagcccugucuccaaccuugggucugagggagagugucccagcuccggcgccgggucucaagcgcaggaacuggcugaggccugggaaggaugccggaaggaucuccuguuccaaaagagcccucagaaucaccggcccccuuccgugagcgaccagccgggcgagaaagagaacuguuaucagcauaugggcacgucuaagucccccgccccuggguuuauccaccucagaacagaaugcggaccccggaaagagccuugucaggaaaaggcugcccuggagcgcguucuuagacagaaacaagaugcgcagggcuucacacccccgcagcugggggccagccaacaguacgcuuccgacuuucauaaugugcugaaggaggaacaggaggcccucugccuggaccuucggggaaccgaaagacgcgaggaacggagagagccugaaccccacucucgccagggccaagcucugggggucaaacggggaugccagcuccacgagcccagcuccgcccuguguccugcucccucugccaaggugauuaagaugccuagaggcggcccgcagcagcucgggaccggagcgaacacccccgcccgcguuuucguggcucugagcgauuauaauccucuugucauguccgccaaccugaaagcugccgaggaggaacugguguuucaaaagcggcagcuccugagaguguggggcagccaggacacacaugauuucuaccuuucugaaugcaaucgccaggucgggaacauccccggacggcugguugccgagauggaagugggcacggagcaaaccgacagacgcuggcgguccccugcucaggggcaccuccccagcguggcgcaucuggaggauuuucagggacugauuaucccgcaagggucuucccucguccuucagggcaauagcaaaagacugccucuguggacacccaagaucaugauugccgcucucgacuaugauccuggcgacggacagaugggcgggcagggaaaaggccgccuggcccuuagagccggggaugugguuaugguguacggacccauggacgaucaaggcuucuacuauggcgaacucgggggacaccggggccuggucccugcucaucugcuggaccacaugucucuccacgggcauuga

SEQ ID NO: 74890 - RNA, 3039 nt, Artificial Sequence
  derived and/or modified sequence opt5 from RIMS1__Homo_sapiens__NP_001161879
augugcgcccccggcauccacgugagcuccgaggggugggaagaggucagaucuguugacagcgaagagggaaccauugaagcucggcgcgccguggcgggcgaucuggacuacuauuggcucgauccugcuacauggcauuccagagagacgucuccgaucagcucccaccccgugaccuggcagccuucuaaggagggggaccggcugauuggacgcgucauccuuaacaaaagaacaaccaugcccaaggauagcggcgcccugcucgggcugaaagugguuggaggcaagaugacagaccuuggccggcugggggccuucauuaccaaagugaagaagggaucccucgcugaugucgugggccaucugcgcgccggggacgaaguucuggaguggaauggaaaaccucuccccggcgcuacaaacgaagagguguacaauaucauccuggagagcaagucugaaccucaagucgagauuaucguguccagaccgauuggggauaucccccggauuccugaaagcucucaucccccucuugaguccagcagcuccagcuucgaaucccagaaaauggagcgccccucuaucagcgugauuuccccgaccagcccuggagcccugaaggacgcgccccagguccucccuggccagcugucuguuaaacuuugguaugauaaggugggccaccaacugaucgugaacguccuccaggccacggaccugcccgcuagaguggaugggcggccccgcaauccuuacguuaagauguauuuccugccggacagauccgacaaaagcaagcggcgcaccaaaacagugaagaaaauccucgagcccaaguggaaccagaccuuugucuacucucacgugcacagacgggauuucagagaacgcaugcuggagauuacaguuugggaccagccucgggugcaagaagaggaaagcgaguuucuuggagagauccugauugaacucgagaccgcccugcuugaugacgaaccccauugguauaaacugcagacgcacgaugaguccucucucccucugccccagccgagcccuuucaugcccagacgccauauccacggcgaauccagcucuaagaagcugcagcggucccaaagaauuagcgacucugauaucuccgacuacgaggucgaugacgggaucggaguggucccucccggcuaccgcagcuccgcucgggagucuaaaagcacaacccucacagugccugaacagcagagaaccacccaccaucgcucccggucuguuagcccccacagagggaaugaucaaggaaagccgcgcucccggcugccuaacgugccccuucagagaagccuggacgagauucaucccacacggcgcucuagauccccuacgcggcaccaugacgccagcagaucuccggucgaucaccgcacccgggacguggauucccaguaucucagcgaacaggacucugagcugcuuaugcugcccagagcgaaacgcggcagaagcgccgagugucuccacacaaccuccgaacugcaaccuuuucuggaucgggcucgcagcgccucuacaaauugccucagacccgacaccucccugcauagcccugagcgggaacgccacuccagaaagucugagcggagcuccauccagaaacagacgcgcaagggcacagcuucugaugccgaaagaaugcaucggcagcgcagccccacccaauccccucccgccgacaccucuuucagcuccagacgggggagacagcuuccgcagguuccugugcgcagcggaucuauugagcaggcuucccuggucguggaggaacggacaagacaaaugaagaugaaagugcaccgcuuuaagcagaccacaggcagcgggucuucccaggagcucgaucgggaacaguacagcaaauauaacauccacaaggaccaauacagaucuugugauaauguuuccgcgaaaagcuccgacagcgaugucucugacgugagcgccauuucccgcacgucuagcgcuucccggcugucuagcaccuccuucaugucugagcagagcgaaagaccccgcggacggaucuccagcuuuacaccuaagaugcagggcagacggauggggaccucuggccgcuccaucaugaagucuacaucuguguccggagagauguauacccuggagcauaacgacggcagccaauccgauacggccgucgggaccgugggagccggcgggaaaaagagacggucuagccuuuccgcuaaaguuguggccauugucagccgcagaucucgguccacaagccagcucucucagaccgaaagcggacacaagaaacugaaguccacaauccagagaucuaccgagacgggcauggcggcugaaaugcgcaagauggugcggcaacccagcagagaguccacagacgggucuauuaauagcuacuccagcgaaggcaaccugaucuucccgggaguucgccucggcgccgauucucaguuuuccgacuuccuggaugggcuuggaccugcccagcuggugggccggcagacccucgcuacacccgccaugggggacauucaaaucggaauggaggauaaaaagggccagcuggaggucgaagugauuagagcucgcagccugacccagaaaccuggguccaagucuacccccgcccccuauguuaaaguguaccuucucgagaauggcgcgugcaucgccaagaaaaagacacggaucgcuagaaagacgcuggacccucuguaccagcaaagccucgucuucgaugaauccccgcagggaaaagugcuucaggugauugucuggggcgacuaugggcgcauggaucauaaguguuuuaugggaguugcccaaauccugcuggaggagcucgaccugucuagcauggugauuggcugguacaaacuguuucccccuuccagccuuguggaucccacccucacaccucugaccagacgggcuucucaguccagccuggaaucuuccacagggcccccuugcauccgcagcuga

SEQ ID NO: 74891 - RNA, 4050 nt, Artificial Sequence
  derived and/or modified sequence opt5 from RIMS2__Homo_sapiens__NP_001093587
augagcgcccccgugggcccuagagggcggcuggcuccgauccccgccgcgucccagccuccccuccaaccugagaugcccgaccugucucaccuuaccgaagaggaacgcaagauuauccuggcugucauggauagacagaaaaaggaggaagagaaagagcagagcguucucaagaaacugcaucagcaauucgaaauguacaaggaacaggugaagaaaaugggagaagagucccagcagcaacaggagcagaagggcgacgccccuacaugcgggauuugucacaaaacgaaguuugccgauggaugcggccauaacuguucuuauugccagaccaaauucugugcucggugcgggggacgcgugagccuuagauccaauaaggucauguggguguguaaccugugccggaagcaacaggaaauccucacaaaaucuggcgccugguuuuacaauagcggcuccaacaccccgcagcaacccgaccagaagguucugcgcgggcugagaaaugaggaagcuccucaggagaaaaagcccaaacuccacgaacagacacaauuccagggaccuagcggcgaucugucugugcccgccgucgagaagucccggagccaugggcuuacccgccagcacucuauuaaaaacggauccggcgugaagcaccauaucgcgagcgacaucgccucugauagaaagcgguccccgagcguuucccgcgaccagaauagacgguaugaucaacgcgaggaaagagaggaauacucucaguaugcuacaagcgacaccgccaugccucggucccccagcgauuacgcugacagacgcucucagcacgagccucaguuuuaugaagauuccgaccaucugagcuaccgggacucuaacagacgcagccaccggcacuccaaagaguacauuguggaugacgaggaugucgaaucuagagacgaguaugaacgccaacggagagaggaagaguaccagagccgcuaucgguccgaucccaaucucgccagauaccccgugaagccucagccguaugaggaacagaugcgcauccaugcggaggugagccgggccagacacgaacggcgccauucugacgucucccuggcuaacgccgaucuugaggacagcagaauuucuaugcugcggauggauagacccucccgccaacggagcaucuccgagagacgcgcugccauggaaaaucagagaucuuacagcauggagcggacgcgcgaagcccaggggccuuccucuuaugcucaaagaaccacaaaccacagcccucccacaccccggcgcuccccgcucccuauugacagacccgaucugcggcgcaccgacagccugagaaaacagcaucaccucgacccuucuuccgcgguucggaagaccaaacgcgagaagauggaaacgaugcugagaaaugauagccuuucuuccgaccagagcgagucugugcggcccccucccccgaagccucacaaaagcaagaaaggaggcaagaugagacagaucucccuguccucuuccgaggaagaacucgccagcacacccgaauacaccuccugugaugacguggagauugaaucugagagcgucuccgagaaaggcgauauggacuacaacuggcuggaucauacaucuuggcacagcuccgaggcuucucccaugagccuucauccugugaccuggcaaccguccaaggacggggaucgccugaucggacggauccuccugaauaagagacugaaagacggcagcguuccccgcgauucuggggccaugcucggacugaagguggucggcgggaaaaugaccgaguccggacggcuuugcgccuucauuacaaaggugaaaaagggcagccuggcugacacgguuggccaccucagaccuggggaugaagugcuggaguggaacggacgccuucugcagggcgccaccuuugaagaggucuauaacaucauucucgagucuaagcccgaaccucagguggagcuggucgugucccggcccaucggggacauuccuagaauccccgacagcacacacgcgcagcuggaaucuuccagcuccagcuucgagucucagaaaauggaucgcccgagcaucuccguuaccucuccuaugagccccggaaugcuccgggacgugccucaauuucuguccggccagcuuucuagccagucccugucuagacggacaacccccuucgucccgcgcgugcaaauuaagcucugguuugauaaaguugggcaucagcugaucgugacgauucugggcgcuaaggaccuuccuagcagagaggauggacggccccgcaauccuuacgucaaaaucuauuuccuccccgacagauccgauaagaacaaacggagaacaaagaccgugaagaaaacccuggaacccaaguggaaucagacauuuauuuacagcccugugcaccgccgggaguucagagaacgcaugcuggagaucacccucugggaccaagcccggguuagagaagaggagucugaguuccugggcgagauccuuauugaacuggagacagcccuccuggaugacgaaccgcauugguauaaacugcagacgcacgaugucuccagccuuccccucccucaucccucuccuuacaugccccgccggcagcugcacggggaguccccuaccagacgccugcagagaagcaagcggaucuccgacucugaggugagcgauuaugacugugacgauggaauuggcguggucuccgacuaccgccacgaugggagagaccuccaaagcucuacacuguccgugccggaacagguuaugagcucuaaccauugcagccccuccggaucuccucaccggguggaugucaucggccgcaccagaagcuggucccccucugugccucccccgcagagccggaauguugagcaggggcuuagaggcacacgcaccaugacgggacauuacaacaccauuucccggauggacagacaccgcgugauggaugaccauuauagcccugaucgggacagagauugcgaagcugccgaccggcaacccuaccaccgcucuagauccacagagcagcggccccugcucgaacgcaccacaaccagaagccgguccacggagcgcccugacacaaaucugaugagaucuaugcccagccugaugaccggccgguccgcuccuccgucucccgcccuuagccgcucccacccuagaacagggagcguccagaccucucccuccagcaccccuguggcgggacggagaggccgccagcucccccaacugccgccuaaagggacacuggaucggaaggccggaggcaagaaacucagaucuacgguucagcgcuccaccgagacagggcuggcuguggaaaugcggaacuggaugaccagacaggccagccgcgagucuacagacggcagcaugaacuccuauucuagcgaaggaaaucuuaucuuucccggcguccggcuggcuuccgauagccaguucuccgacuuucucgaugggcugggaccugcccaacuggugggcagacagacccuugcgacgcccgccaugggggacauucaggugggaaugauggauaagaaaggccaacucgaggucgagaucauccgcgcucgggggcugguugugaagccuggcucuaaaacacugcccgccccguacgugaaggucuaucuccuggacaauggaguguguauugcuaagaaaaagaccaaaguugccagaaagacccuugaaccucuguaccagcagcuccugagcuucgaggaaagcccccagggcaaagugcugcaaaucauugucuggggagauuaugggcgcauggaccauaagucuuuuaugggcguggcccagauccuucuggaugagcucgaacugagcaacaugguuauugggugguucaagcucuuucccccuuccucucugguggacccgacacuugcuccccugacccggagagcgagccaguccagccucgagucuuccacaggaccuagcuacucucgcuccuga

SEQ ID NO: 74892 - RNA, 813 nt, Artificial Sequence
  derived and/or modified sequence opt5 from RIMS4__Homo_sapiens__NP_001192246
auggagagaagccagucccggcugucucucagcgccuccuucgaagcucuggccaucuacuuucccugcaugaacucuuucgacgaugaggacgcggaaggcgauagccgcagacuuaagggggcuauucaacgguccaccgagacaggacuggccguggaaaugccuucucgcacgcucagacaggccagccacgaguccaucgaggacagcaugaacucuuauggcuccgaagggaaucugaauuacggaggcgucugucuugcuagcgaugcccaguuuucugacuuccugggguccaugggaccggcucaguuuguuggccggcaaacccucgccacaacccccaugggcgauguggagauugggcugcaggaacgcaacggacagcuggagguggacaucauucaggcgagaggccucacagccaaaccugggagcaagacccugcccgcugccuauaucaaagccuaccuucuggagaauggaaucugcauugcuaagaaaaagacaaaggucgcgcggaaaucucucgauccucuguauaaccaagugcuucuguuccccgaauccccucagggcaagguucuccaggugaucgucugggggaauuacggacgcauggagagaaaacaguuuaugggcguggcccggguucugcuggaggaacucgaccugaccacgcuugcugugggcugguauaagcuguucccgaccagcuccauggucgaucccgccacagggccucuccugcgccaggcuucucaacuuagccuggaauccaccgugggacccuguggcgagagaagcuga

SEQ ID NO: 74893 - RNA, 2352 nt, Artificial Sequence
  derived and/or modified sequence opt5 from RIN1__Homo_sapiens__NP_004283
auggagagccccggcgaauccggggccggaucuccuggcgcuccgagccccuccucuuucaccacagggcaccuggccagagagaagccugcgcaggacccccucuacgaugugccuaacgcuagcggaggccaagccgggggaccccagcggccuggccgcgucguuucccugagagaacggcuucugcucacgcgcccgguguggcugcagcuucaggccaaugcugccgcugcccugcauaugcucagaaccgagcccccuggcacauuucuggugcggaaaucuaacacccgccaaugccaggcgcuguguaugagacuccccgaagccagcgggccuuccuucgucagcucucacuauauccuggagucccccggaggcgugagccuugaggggucugaacugauguuuccggaccucguucagcugauuugcgcuuacugucauacacgggauauccuucugcucccucugcagcugccccgcgccauucaccaugcugccacccacaaggagcucgaagcgaucucccaccugggaauugaguucugguccucuucccuuaauaucaaagcccaaagaggcccugcugggggacccgugcugccccagcucaaggcccggagcccucaggagcuggaccagggcacaggcgcugcccuuugcuuuuucaacccgcuguuucccggggaucucggaccuaccaaacgcgaaaaguucaagagauccuuuaaaguccgggugucuacggagaccagcagcccccugagcccucccgccguuccgccucccccugugcccguccugccuggcgcugugcccucucaaacagaacgccucccgccuugucagcugcuuagacgggaguccagcgugggguauagaguccccgcgggaucuggccccagccugccuccgaugcccucccuccaggaaguugacugcgggucuccuagcuccagcgaggaggaaggagugcccggcucucgcggcuccccugccaccagcccccaucuggggcggagacgcccucuucugcggucuauguccgcugccuucuguagccuccuggcccccgagagacaagugggacgcgcugccgcggcucugaugcaggaucggcacacagccgccggccagcucguccaggaccugcuuacccaagugagagcugggccggaaccucaggagcugcagggaauccgccaggcccucucccgggcuagagccaugcugucugcggaacugggccccgagaaacuucucagcccuaaacgccuggagcauguucuggaaaagucccuccacugcucugugcugaaaccccuucggccgauucuggccgcuagacuccggcgcagacuggccgcugaugggagccugggccggcuugccgagggacucagacuggcgcgcgcccaaggcccuggggcuuuuggaucccaccugagccuccccucuccugucgaacuggaacaggugcggcagaaacuucugcagcuccugagaacguacucccccagcgcccaaguuaagcgccugcuucaggcuuguaagcuccuguauauggcccugagaacacaggaaggcgagggggccggagcugacgaguuccucccccugcuuucucuggugcucgcgcauugcgaucugccugaacugcuucucgaggccgaauacauguccgagcugcuggagccgagccuccugaccggcgaagggggcuauuaccuuacaucucugagcgcuucccucgcccugcugagcggacuuggccaggcccacacccugccccucucuccuguccaagagcugcggcgcucccucagccugugggaacagagacggcuucccgcuacccauuguuuucagcaucugcuccgcguggccuaccaagacccuuccucugggugcacaagcaagacgcuggcggugcccccugaggcuuccaucgccacccugaaucagcuuugcgccacaaaauucagagucacccagccgaacacauucggacuguuucucuauaaggaacagggcuaccaccggcugcccccuggggcucucgcccaccgccugcccaccacgggauaucuuguuuacagacgggcggaguggccugagacacaaggcgcugugaccgaagaggaagggucuggccagagcgaggcccgcuccagaggagaggagcagggcugucagggggauggagacgccggcgucaaggcuucuccccgggacauuagagagcaaagcgaaaccacagccgaagggggacagggccaggcucaggaggggccggcccaaccuggcgagcccgaagcggagggaucccgcgccgcugaggaauga

SEQ ID NO: 74894 - RNA, 2835 nt, Artificial Sequence
  derived and/or modified sequence opt5 from RIN2__Homo_sapiens__NP_001229510
augcuggacagcuucucccaggagucuacccuccccuuuagagaagcccggaagcgcacgagcuuccaaccugugcaggucuggagaaacuuuacagcuucccagaccacagagucuccggccugcagcggcgcgucccugggggaaaugaccgcuuggacaaugggagcccggggccuugauaaacgcgggucuuucuuuaagcugaucgacaccauugccagcgagaucggagaacucaaacaggagaugguuagaacagaugugaaucuggagaacggccuugaacccgcugagacccacuccauggugcggcauaaggacgggggauacagcgaagaggaggaugucaaaacgugugcccgcgacucuggcuaugauucccugagcaauagacucucuauucuggaccggcugcuccacacccauccuaucuggcugcaacuuucccugagcgaagaggaagcugccgaggugcuccaggcgcagcccccuggcauuuuccugguucacaagucuacaaagaugcagaaaaaggugcuuucccugcgccuccccugcgaauuuggggccccucugaaagaguucgcuaucaaggagagcaccuacacauuuucccuggaaggaucuggcaucagcuucgccgaucucuuuagacugauugcuuucuauuguaucucccgggacguccuuccguuuacccugaaacuccccuacgccauuagcacggcgaagucugaggcccaacuggaggaacuugcucagauggggcugaacuucugguccagcccugccgauucuaagcccccuaaucucccgccgccucaucgcccccugagcuccgacggagugugcccugcuucucugagacagcucugucugaucaacggcguucacagcauuaaaacacggacccccuccgaacuugagugcagccagacaaauggggcccuguguuucaucaacccccucuuucugaaggugcacucucaagaucuuuccggaggccugaaacgcccuagcaccagaaccccgaaugccaacggcacagagcggacgagaucucccccuccccgcccucccccgccugcuauuaauucccuccauaccagcccccggcuggcgagaacagaaacccagacauccaugccugagaccgucaaccacaauaagcaugggaacguggcccugcccggaacgaaaccuacacccaucccgccuccccgccucaagaaacaggcuucuuuccuggaagccgagggcggggccaagacccuuagcggaggccggcccggggcuggaccugaacuggagcucggcaccgccggcucccccgggggagcgcccccugaggcugcccccggcgacugcacaagagccccucccccuucuagcgaaucccggcccccgugucacgggggacgccaaagacugagcgacaugucuaucuccaccucuagcuccgauagccuggaguuugaccgcucuaugccucuuuucggcuaugaagcugauacaaauagcucccucgaggacuacgagggggaaagcgaucaggagacgauggcucccccuauuaagucuaaaaagaaacgguccagcuccuuugugcugcccaagcuggucaaaucucagcuccagaagguuagcggcguguucuccucuuuuaugaccccggaaaagagaauggugcgccggaucgccgagcugagcagagacaaaugcacauauuucggaugucuuguccaagauuacguguccuuucugcaggaaaacaaggagugccacguuucuagcaccgacaugcuccagacaauucggcaguucaugacccaagugaaaaacuaccugucccagagcucugagcuggauccucccaucgaaucccuuauuccugaggaccagaucgaugucgugcucgaaaaggccaugcauaaaugcauccugaagccccugaagggccacguugaggcgaugcucaaagacuuucauauggccgacgggagcuggaagcagcugaaagaaaaucuucaacuggugcgccagagaaacccccaggagcucggagucuucgcuccuacgccggauuuuguggacgucgagaagauuaaagugaaguucaugaccaugcagaagauguauucucccgagaaaaagguuaugcugcugcuucggguguguaaacucaucuacacagucauggaaaauaacuccggcagaauguauggggccgaugacuuccugccugugcugaccuacguuauugcucaaugcgauaugcucgaacuggacacagagaucgaauauaugauggagcuucuggaucccagccuccugcacggagagggcggguacuaucugaccucugccuacggcgcgcuuucccucauuaagaauuuucaggaggaacaggccgcucgccugcugagcuccgaaacgcgggacacacucagacaauggcauaaacgcagaaccacaaaccggaccaucccuagcguggaugacuuccagaauuaccugcgcgucgccuuucaggaggugaacucuggauguaccggcaagacacuucuggugagacccuauaucacgaccgaggauguuugccagauuugugcugaaaaauucaaggucggggacccugaggaauacagccucuuucuguucguggaugagacauggcaacagcuggccgaagacaccuauccgcagaagaucaaagccgagcuucacucccggccccagccucacauuuuucauuucguguacaagcgcaucaaaaaugaccccuauggaauuaucuuucaaaacggcgaggaagaucugacaaccucuuga

SEQ ID NO: 74895 - RNA, 2958 nt, Artificial Sequence
  derived and/or modified sequence opt5 from RIN3__Homo_sapiens__NP_079108
augaucagacacgccggcgcucccgcccgcggggacccuaccggaccggugcccgucguuggcaagggggaggaagaggaagaggaagauggaaugcggcugugccucccugcgaaccccaaaaauugucugccucauagacggggcauuagcauccuugagaagcugauuaaaacaugccccguguggcuccagcugucccuugggcaagcugagguggcccgcauccugcacagagucguggccggaauguuccucguucggcgcgacucuagcuccaagcagcuggugcuguguguccauuuuccuucucucaacgaaagcuccgcugaggugcuggaauacacgauuaaagaggagaagucuauccuuuaucuggaaggcagcgcccucguuuucgaggauaucuuuagacugauugcuuucuacugcgugucccgggaccuucugccguuuacccuccgccugccccaggccauccuggaagcgagcucuuucacagaucucgagaccauugccaaucugggccuuggguuuugggacuccagccugaacccuccccaggaaagaggaaagccugcugagcccccgcgggaucgcgccccuggcuucccccucgucucuucccugagaccuacagcucacgacgccaauugugcgugcgagaucgaacuuagcguggggaacgaucggcugugguuugugaaucccauuuucaucgaggacuguucuuccgcccuccccaccgaucaaccuccgcugggaaacugccccgcucgcccucugcccccuacaagcgacgccaccucccccacgucuagaugggcuccgcggagaccucccccucccccucccguccucccgcugcagccuuguagccccgcccagcccccuguucuuccggcccuggcucccgcgccugccugcccccucccuaccuccccucccgugcccgcuccgcaugugacaccucacgcccccggcccucccgaucacccgaaucagccucccaugaugaccugugaacgccugccuugccccacagccgggcuuggaccccugcgggaggaagcuaugaaaccuggcgccgcgagcucuccgcuccaacagguccccgcuccuccccugccugccaagaaaaaccugcccaccgccccuccgagacgccggguguccgagagaguuagccucgaggaccagucucccggcauggcugccgaaggggaccagcugagccuuccuccccaaggaacguccgauggcccugaggacacaccccgcgaaucuaccgagcaggggcaggauacagaagugaaggcuagcgacccgcauuccaugccugagcugccccggaccgccaaacaacccccugugcccccuccgagaaagaagcgcauuagccggcagcucgcgucuacccugcccgccccucuggagaaugcugaacuuugcacacaggccauggcucucgagacgcccaccccuggacccccgagagaaggccaguccccugccagccaagcggggacacagcaucccccugcccaggcuaccgcccacucucaguccagccccgaguuuaaaggaucccuggcuucucugagcgauucccucggcgucucuguuauggccacagaccaagauagcuauuccaccagcucuacggaggaagaacuggaacaguucuccagcccuucugugaagaaaaagcccuccaugauccuuggcaaagcccgccaccggcugagcuuugcuucuuucagcuccauguuccacgcguuucucagcaacaauagaaagcuguacaaaaaggucguggagcuggcccaggacaaggggucuuauuucggaucccuuguccaggauuacaaaguguauagccucgaaaugauggcucggcaaacauccucuaccgagaugcugcaggagauccgcaccaugaugacacagcucaagagcuaccugcugcaguccaccgaacuuaaagcccugguugacccggcccuccauucugaggaggagcuggaagcuauuguggagagcgcccuguacaaguguguccuuaaaccucucaaggaggcgaucaacuccugccugcaccaaauucauucuaaggauggcagccugcagcagcucaaagaaaaucaacuggugauccuugcuacaacgaccacagaccuggggguuaccacauccgugcccgagguccccaugauggaaaagauucuccagaaauuuaccagcaugcacaaggccuauucuccugagaaaaagaucuccauccugcugaagacguguaaacuuauuuacgacagcauggcccucggaaacccgggcaagcccuauggggcugaugacuuccugccugugcugauguacgugcucgccagaucuaaccugaccgaaaugcuucugaauguugaguauaugauggagcucauggaucccgcgcugcagcugggcgaaggauccuacuaucuuacaaccacauacggcgcucuggagcauaucaaaagcuacgacaagauuaccgucacgcggcagcucucuguggaagugcaagauuccauccacagaugggagcgccggagaacacugaacaaagcccgcgccagcagauccagcguccaggacuuuauuugcgugucuuaucucgagccugaacagcaggcucggacccuggccagccgcgcugauacacaagcccaggcgcuuugugcccagugcgcugagaaguucgccguugaaagaccccaggcucaccggcuguuugugcucgucgacgggcgcuguuuccaacuggccgaugacgcccugccucauugcaucaagggauaccuucugagauccgagccgaaacgggauuuucacuucguguaucgcccccucgacggcgggggaggcgggggcggaggcucuccucccugucugguugugagagaaccuaauuuucucuga

SEQ ID NO: 74896 - RNA, 1221 nt, Artificial Sequence
  derived and/or modified sequence opt5 from RING1__Homo_sapiens__NP_002922
augaccacacccgccaacgcucagaaugccagcaagacgugggagcugucccucuacgaacugcacagaaccccucaagaggcgaucauggacggcacagaaauugcugugucuccgcggagccuucauuccgagcugaugugccccaucugucucgauaugcugaaaaacaccaugacaaccaaggaaugccuucaccgcuucuguucugacugcauugucacagcccugagaagcgggaauaaagaguguccuaccugccggaagaaacucguuuccaagcgcucucugagacccgauccuaacuuugacgcccugaucagcaagauuuaucccucccgggaggaauacgaggcucaucaggaucgcgugcucaucagacugagccggcuucacaaucagcaggcccugucuuccagcaucgaagagggacuccgcaugcaagcuaugcauagagcccagcgggugcgcagaccuauuccgggcucugaccagacgaccacaauguccgggggagagggcgaacccggggagggagaaggcgauggcgaggacgucagcucugauuccgcgccugacagcgcccccgggccugcucccaaacggccgcgcggaggcggggccggaggcuccucuguggggaccggaggcggcgggacaggaggcguugggggaggcgcugggagcgaagauuccggagacagaggcggcacccuugggggaggcacgcuggggccucccagcccucccggagcccccucuccuccggagcccggcggggagaucgaacugguguuccggccucacccccuccuggucgagaagggcgaauauugucagacaagauacgugaaaaccacaggaaacgcgaccguugaucaccuguccaaguaucucgcccugcgcauugcucuugagcggagacaacagcaggaagccggcgagccugggggacccggcgggggagcuagcgacaccggcgggccggacggcugcggaggcgaagggggaggcgccgggggaggcgaugggccugaggagcccgcccugccuucucucgaaggcgugagcgagaaacaguacacaaucuauauugcucccggaggcggggcguuuacgacccugaauggaucccuuacacuggaacucgucaacgagaaguucuggaaggugucucgcccucuggagcuguguuacgcccccaccaaagacccgaaguga

SEQ ID NO: 74897 - RNA, 2379 nt, Artificial Sequence
  derived and/or modified sequence opt5 from RINT1__Homo_sapiens__NP_068749
augcugcccgccggcgagaucggggcuagcccugccgcgccgugcuguuccgaaucuggagacgagagaaagaaccucgaagagaaaagcgauauuaaugugaccguccugaucggcuccaagcagguuucugaagggacagacaacggagaucuucccagcuacguguccgcuuucauugagaaagaggugggcaaugaccugaagucucucaaaaagcuggauaaacuuaucgaacaacggacggucagcaagaugcagcuggaggaacaggugcucaccauuuccagcgagaucccuaagcgcaucagaucugcccugaaaaacgccgaggaauccaagcaguuucugaaucaauuccucgagcaggaaacacaccuguuuagcgcuauuaacucucaucuucugaccgcccagcccuggauggacgaucucgggacaaugaucucccagauugaggaaaucgagcggcaccuggcuuaucuuaaauggauuagccaaaucgaggaacugucugacaauauucagcaguaccucaugaccaacaauguuccugaggccgcguccacacuggugagcauggccgaacuggauaucaagcuccaggaguccucuugcacccaucugcuuggauucaugcgcgcuacggucaaguuuuggcacaaaauccugaaggacaaacucaccagcgauuucgaagagauucuggcccaacuucauuggcccuuuaucgcuccuccgcagucccagacagugggccugagcagacccgccucugcgccugagauuuauuccuaccucgaaacccuguucugucaacugcucaagcugcagacaagcgacgagcuucugaccgaacccaaacagcucccugagaaguauucucugcccgccagcccguccguuauccuuccuauucaggugaugcugacgccccuccaaaaacgguuucgcuaccacuucagaggcaaccggcagacaaauguccugucuaagccugaaugguaucuggcucaggugcucauguggaucgggaaccacaccgaguuucuggaugagaagauccagcccauucuugacaaagugggaagccuggucaaugcccgccucgaguucuccagaggccugaugaugcugguucuugaaaagcucgcuacagacauccccugccugcuguacgaugacaaccucuuuugucaucugguggaugaagugcuucuguucgagcgggagcuccacagcguccauggguacccuggaaccuucgccucuugcaugcacauucuguccgaagagaccuguuuucaacgcuggcugacaguggaaagaaaauucgcccuucagaagauggacagcaugcucucuuccgaggcugcguggguuagccaguauaaagauaucacggacguggaugaaaugaaggucccggacugcgccgagaccuuuaugacacugcugcucgugauuaccgaucgguacaagaaucugcccacagcuucccgcaaacuucaguuccuggagcuccaaaaggaccugguugaugacuuuagaauccggcugacccaggugaugaaagaagagacgagagccucucuuggcuuccgcuauugugccauccucaacgcugucaacuacauuagcacagugcuggccgacugggcggauaaugucuuuuuccugcagcuccagcaagcugcccuggaaguguuugccgagaacaauacccuuuccaagcugcagcucgggcagcuggcuucuauggaaagcuccguuuucgacgauaugaucaaccugcuugagcggcucaaacacgacaugcugaccagacaaguggaucaugucuuucgcgaggugaaggacgccgcuaagcuguauaaaaaggaacgguggcucagccugccuucucaguccgagcaggccguuaugagccuuucuuccagcgcgugcccccugcuccugacacugagagaucaccuucugcagcucgaacaacagcuguguuucucucucuuuaaaauuuucuggcagaugcugguggagaaacuugacgucuacaucuaucaggaaauuauccuggccaaucauuucaacgagggaggcgcugcccaacuccaguuugauaugacccgcaaucuguucccucuguuuagccacuacugcaagcggcccgagaacuacuucaagcauauuaaggaggcuugcaucgugcuuaaucugaacgugggcuccgcccuccugcucaaagacguucugcagagcgcgucugggcagcuuccggccacagcugcccugaaugaagucggaaucuauaagcucgcucaacaggauguggaaauucugcugaaccuuagaacgaauuggccuaacaccggcaaauga

SEQ ID NO: 74898 - RNA, 1707 nt, Artificial Sequence
  derived and/or modified sequence opt5 from RIOK1__Homo_sapiens__NP_113668
auggacuacagacggcugcucaugagccgcgugguccccggccaguucgaugacgccgauuccucugacagcgagaacagagaucugaagaccguuaaagaaaaggacgauauccuuuuugaggaccugcaagauaaugugaacgaaaauggggagggagaaauugaggacgaggaagaggaaggcuaugaugacgaugacgacgauugggacugggaugagggggugggaaaacucgcuaagggcuacgucuggaacgggggauccaauccucaggccaaccggcagacaucugacagcuccucugcgaaaaugagcacgccggcugauaaggugcugcgcaaguucgagaauaaaaucaaccuugacaagcugaauguuaccgauuccgugauuaacaaagucacagaaaagagcagacagaaagaggccgacauguaucggaucaaggauaaggccgaccgcgcuaccguggaacaaguucucgaucccagaacacggaugauucuguuuaaaaugcugacccgcggcaucaucacagagauuaauggcugcaucucuaccgggaaggaagccaacguguaccacgcuuccacggccaauggagagagcagagcgauuaaaaucuauaagaccucuauucucgucuucaaagaccgggacaaguacguguccggcgaguuucgcuucagacauggguauuguaaaggaaacccucggaagauggugaagacaugggccgaaaaagagaugcgcaaucugaucagacuuaacaccgcugaaauucccugcccugagcccaucaugcugcggagccacguccucguuaugucuuuuaucggcaaggaugacaugccugccccgcugcuuaaaaacgugcagcuguccgaaagcaaggcuagagagcucuaccuccaggugauucaguacaugcgccggauguaucaagaugccagacugguccaugcggaccuguccgaguucaauaugcuguaccacgggggaggcguguauaucauugauguuucucagagcguggaacaugaccacccccacgcccuugaguuucugcgcaaagauugugcuaacgucaaugacuucuuuaugcggcauuccguggccguuaugacagugagagaacucuucgaguuugucaccgauccuagcaucacgcacgaaaacauggacgcuuaccugucuaaggccauggagauugccucccagcgcacaaaggaggaacggagcucucaggaucauguggacgaggaagucuucaaaagagcuuauaucccccgcacccuuaaugaggugaagaacuacgagcgggauauggacaucauuaugaaacugaaggaagaggacauggcgaugaaugcccaacaggauaacauccucuaucagacaguuaccggccugaaaaaggaccugagcggggugcaaaaggucccugcucuccuggaaaaucagguggaggaaagaaccugcuccgauucugaggacauuggaagcuccgaguguagcgauacagacucugaggaacagggcgaucacgcccgccccaaaaagcacacgaccgacccggauaucgacaaaaaggaacggaaaaagaugguuaaggaggcccagagagaaaaacggaagaacaaaauuccuaagcaugugaaaaagcgcaaagagaagacagcuaagaccaaaaaggggaaauga

SEQ ID NO: 74899 - RNA, 1425 nt, Artificial Sequence
  derived and/or modified sequence opt5 from RIOK2__Homo_sapiens__NP_001153221
augggcaaggugaacgucgccaaacugagauacaugagccgggacgauuuccgcguucucaccgcuguggagauggggaugaagaaucacgaaaucgugcccggaucccugauugccucuaucgcgagccuuaaacauggcgggugcaacaagguccugagagagcucgugaaacacaagcugauugcuugggaacggacaaagacgguucagggauaucgccuuaccaaugccggcuacgacuaucuggcccucaaaacacuguccucuagacaaguggucgagagcguggggaaccagaugggaguuggcaaggaauccgauaucuacauuguggcuaaugaggagggccagcaguuugcccugaaacuccaucggcuggggcgcaccucuuucagaaaccuuaagaauaaacgggacuaucacaagcaucgccacaacgucagcuggcuguaccucuccagacugagcgcuaugaaggaauuugccuauaugaaagcgcuuuacgagcggaaguucccugugccgaaacccaucgauuacaaucgccacgccguggucauggaacugaucaacggauauccucucugucaaauucaucacguugaggaccccgcuucuguguacgaugaggccauggaacugaucgugaagcuggcuaaucauggccucauucacggggacuuuaacgaguucaaucugauccuugaugaauccgaccacauuacaaugaucgauuuuccucagauggucagcaccucucaucccaacgccgagugguauuucgacagagaugugaaaugcauuaaggacuuuuucaugaaacgguuuuccuacgaaagcgagcuguucccuacauuuaaggacauccgcagagaggauacccucgacguugaagugucugcguccggauauacgaaggagaugcaggccgaugacgaacugcuucacccgcugggccccgaugacaaaaauaucgagaccaaggaagggagcgaguucuccuucucugauggagaggucgcugaaaaagccgagguguacggcagcgaaaacgaguccgaacggaacugucucgaggagagcgaaggcugcuauuguagaucuuccggggacccugagcagauuaaggaagauagccugucugaggagagcgcugacgcccgcuccuuugaaaugacagaguucaaucaagcccuggaagagaucaaaggacagguuguggaaaacaauucugucaccgaguuuagcgaggaaaagaaccggacagagaauuacaacagacaggauggccagcgcgugcaagggggaguccccgcuggcuccgacgaauacgaggacgaaugcccucaucucauugcgcugagcucucuuaaucgggaguucagacccuuucgcuaucggcugcucuccaucgccuucuga

SEQ ID NO: 74900 - RNA, 1560 nt, Artificial Sequence
  derived and/or modified sequence opt5 from RIOK3__Homo_sapiens__NP_003822
auggaccuggugggcgucgccagccccgagccugggaccgcugccgcguggggaccguccaagugccccugggcuaucccucaaaacacaauuucuuguagccucgccgauguuauguccgaacaacuggccaaagagcuucagcuggaagaggaagcugccguguuccccgagguggcugucgccgagggcccuuuuaucacgggggaaaauauugacaccucuagcgaucucaugcuggcgcagaugcuucagauggaguacgacagagaauaugaugcccaacugcggcgcgaggagaagaaauucaacggagacuccaaggugucuaucagcuuugaaaauuacagaaaaguucaccccuaugaggauuccgacagcucugaagaugagguggacuggcaggauacacgggacgauccuuaccgcccggcuaagcccgucccuacccccaagaaaggcuucauugggaagggaaaagacaucacaaccaagcaugacgaagugguuugcggccggaaaaacacagccagaauggagaauuuugcuccugaguuccaggugggcgaugggaucggaauggaccucaagcuguccaaccacgucuuuaaugcccugaagcagcaugcguauagcgaggagcgcagaucugcccggcuccacgagaaaaaggaacauuccaccgcugaaaaagccguggaucccaagacgcgccugcuuauguacaaaauggugaacagcggcaugcuggagaccauuacaggguguaucucuaccggaaaggaguccgucguuuuccacgcuuauggcgggagcauggaagacgagaaagaagauuccaaggugauuccgacagagugcgccaucaagguguuuaaaaccacgcucaaugaguucaagaacagagacaaauacauuaaggaugacuuucgguucaaagaucgcuuuucuaagcugaauccuagaaagaucauucggaugugggccgaaaaagagaugcacaaccuugcucgcaugcaaagagcgggaauccccuguccuacagucgugcugcucaagaaacauauccugguuaugagcuucauuggccacgaccaggugcccgcccccaagcugaaagaagucaagcucaauuccgaggaaaugaaggaggcuuacuaucagacccugcaucuuaugcggcagcuguaccacgagugcacacucgugcacgccgaucugagcgaauauaacaugcuuuggcaugccggcaaaguuuggcugaucgacgugucucaauccgucgagccuacccacccgcaugggcucgaguuccuguuuagagacugucgcaaugugagccaguucuuucagaagggaggcgucaaagaagcucugucugaacgggaacucuucaacgccgugagcgggcugaacauuaccgcggauaaugaggcugacuuucuugccgaaaucgaggcccuggaaaagaugaacgaggaucacguucagaaaaauggaagaaaggcugccuccuuccucaaggacgauggcgaucccccucugcuuuacgacgaauga

SEQ ID NO: 74901 - RNA, 2016 nt, Artificial Sequence
  derived and/or modified sequence opt5 from RIPK1__Homo_sapiens__NP_003795
augcagcccgacaugagccugaacgugaucaagaugaaauccucugauuuccucgagagcgccgaacuggacuccggcggguuuggaaaggucucucuuugcuuccacagaacccaaggccugaugauuaugaaaacaguuuacaaggggccuaauuguaucgagcauaacgaagcucuccuggaggaagccaaaaugaugaaucggcuucgccacagcagaguggugaagcugcucggagucauuaucgaggagggcaaguauucccuggugauggaauacauggagaaagggaaccugaugcauguucucaaggcggaaaugucuacgccgcugagcgugaaaggacggauuauccuugagaucauugagggcaugugcuaucugcacggcaagggggucauccauaaagaucucaagcccgaaaauauucugguggacaacgauuuucacaucaagauugcugaccuuggacuggccuccuucaaaauguggagcaagcucaauaacgaggaacacaaugagcugcgcgaaguugauggcaccgccaaaaagaacgggggaacacuguacuauauggcuccugagcaucucaaugacgugaacgccaaacccaccgagaagucugaugucuacuccuuugcuguggugcugugggccaucuucgcgaauaaagaaccuuaugagaacgccauuugugaacagcagcuuaucaugugcaucaagagcggcaauagacccgacgucgaugacauuacagaguacuguccucgggaaaucauuucucugaugaagcucugcugggaggcuaacccggaggcccgccccaccuuuccugggaucgaagagaaauucagacccuuuuaccugucccagcuugaagagagcguugaagaggaugugaagucucugaaaaaggaguauuccaacgaaaaugcuguggucaaacggaugcaaagccuccagcuggacuguguggccguuccuuccucucgcagcaacuccgcgacagagcagcccggaagccugcacucuucccagggccucggcauggggccgguggaagagagcugguucgccccuucucuggagcauccccaagaagagaaugaaccuagccuucaguccaagcugcaggacgaggcuaacuaccaccucuauggaucuagaauggaucggcagaccaagcaacagccccgccagaaugucgccuacaacagagaagaggagcggcgcagacgggugagccacgaccccuuugcucaacagagaccuuaugaaaauuuccagaacacggagggcaaagggaccgccuacuccagcgccgcuucucauggaaaugcgguucaccagccguccggccugacaagccaaccccaggugcuuuaucagaacaaugggcuguacucuucccauggauuuggcacccgcccucucgaucccggcacagccgggccucgggucugguacagacccauuccgagccacaugccuucccugcauaacauccccgugccugaaaccaauuaucugggaaacacgcccacaaugccuuucucuagccugcccccgaccgacgaguccaucaaguacacaauuuauaauucuaccggcauccagauuggggcuuacaacuauauggaaaucggaggcaccagcuccagccuccuugauucuacaaacacgaauuucaaagaggagccugccgccaaguaccaagcuauuuuugacaacaccacaucccugaccgauaaacaccucgaccccauccgcgaaaaucuggggaagcacuggaagaacugcgcccggaaacugggcuucacacagagccagaucgaugagauugaccaugauuaugaaagagacggacuuaaggagaaagucuaccagaugcuccaaaagugggugaugcgcgaaggcaucaaaggggcgaccguuggaaagcuggcucaggcccugcaccaguguucucggauugaccuccuguccagccuuaucuacgugucucagaauuga

SEQ ID NO: 74902 - RNA, 1623 nt, Artificial Sequence
  derived and/or modified sequence opt5 from RIPK2__Homo_sapiens__NP_003812
augaacggcgaggccaucugcagcgcucugcccaccauuccuuaccacaagcucgccgaccugagauaucuuuccagaggggcgucuggaacagugagcuccgcucgccaugccgauuggagaguccagguugccgugaaacaucugcacauccacacgccgcuccuggacucugaacggaaggaugugcuucgcgaggcugaaauucugcauaaagccagauucagcuacauccuccccauucugggcaucuguaaugagccugaauuucuggggaucgucaccgaguauaugcccaacggaucccucaaugagcugcuucaccggaagacagaauacccugacguggcuuggccccugcgcuuccggauucuccacgagaucgcccugggcguuaacuaucuucauaauaugaccccuccgcugcuccaccaugaucugaaaacacaaaacauucugcucgacaaugaauuucacgugaagaucgcggauuucgggcugucuaaguggcggaugaugagccuuucccagagcagaucuuccaaaagcgcccccgagggaggcaccauuaucuacaugccucccgagaacuaugaaccuggccagaagucucgcgcuuccauuaaacacgacaucuacagcuacgccgucaucacaugggaggugcugucucggaagcagcccuuugaagauguuaccaauccgcuccaaauuauguauuccgugagccaggggcaucgcccugucaucaacgaggaaucccugcccuacgacauuccucacagagcucggaugaucucucuuauugagagcggaugggcccagaaucccgaugagcgccccuccuuccugaaaugccucaucgaacuggagccugugcugagaacguuugaagagaucaccuuccucgaagcggugauucagcugaagaagacaaaacuucaaagcgucucuuccgccauccaucugugugacaagaaaaagauggagcucagccugaacauuccgguuaaucacggcccccaggaggaaucuugcgggagcucccagcuucaugagaacucuggaagcccugaaaccucccggagccugcccgcuccucaggauaaugacuuucucucuagaaaagcccaagacuguuauuucaugaagcugcaccacugccccggcaaccauuccugggauagcacaaucucugggucccagcgcgcugccuuuugugaccacaaaaccacgccgugcagcuccgccauuaucaacccucugucuacagcuggaaauagcgagcggcuccagcccggcaucgcgcaacaguggauucaguccaagagagaagauaucgugaaccagaugaccgaggccugucugaaucaaucucuugacgcucugcucagccgcgaucugauuaugaaggaggacuacgaacugguguccacaaaaccuacccggaccagcaaggucagacagcuucucgauacaacggacauccagggcgaggaguucgccaaagugauuguucagaagcugaaagauaacaagcaaauggggcugcagcccuauccugaaauccucguggucucucgcucccccagccugaaucuucugcagaacaagucuauguga

SEQ ID NO: 74903 - RNA, 1557 nt, Artificial Sequence
  derived and/or modified sequence opt5 from RIPK3__Homo_sapiens__NP_006862
augagcugcgugaagcuguggcccuccggcgccccugcuccgcucgucucuaucgaggaacuggagaaccaggaacuuguugggaaaggaggcuucgggaccguguuuagagcccaacaccggaaguggggauacgacguggcggucaaaauugugaauagcaaggcuaucucccgcgagguuaaagccauggccucucuggauaacgaguucgugcucagacuggagggcgucauugagaaggugaauugggaccaggaucccaagccugcucuuguuacaaaauuuauggaaaacgggagccuguccggacuccugcagucucaguguccccggccuuggccccugcucugccgccugcuuaaggaggugguccugggcauguucuaucuccaugaccaaaauccugugcugcuucacagagaucugaaaccgagcaacgugcuccuggaccccgaacugcaugucaagcucgccgauuuuggccuguccacguuccaagggggaagccagucuggcaccggguccggagagccuggcgggacacuuggauaccuggcucccgagcucuuuguuaaugugaaccggaaagccagcaccgcgucugacguguauuccuucggcauccugaugugggccguccuugcuggccgcgaaguggagcugccuacagaacccagccucguuuacgaggccguguguaauagacagaaccggccgucucuggcugaacugccucaggccgggcccgagaccccuggacucgagggccugaaggaacuuaugcagcugugcugguccagcgagcccaaggaucgccccuccuuucaggaaugucucccuaaaacagacgaggucuuccagaugguggaaaauaacaugaaugcggccguuucuaccgugaaggauuuucugagccaacuuagauccagcaaccggcgcuucucuauuccggaguccgggcagggaggcacggagauggacggguuuagacggaccaucgaaaaucagcacagccgcaacgaugucauggugucugaguggcugaacaaacucaaucuggaggaacccccuagcuccguccccaagaaaugcccuucucugacaaagagaagccgggcucaagaagaacaggugccccaggccuggaccgcuggaacauccagcgacucuauggcccagccgccucaaacccccgagacguccacauucagaaaccagaugccuagccccaccucuacaggcaccccuucccccggcccgcgcgggaaucagggagccgaacggcagggcaugaacuggagcuguagaaccccugagcccaaucccguuacagggcgcccucucgugaacaucuauaauugcuccggaguccaagugggcgacaacaauuaccugacgaugcagcagaccacagcgcuuccgaccugggggcuggcucccucuggcaaaggacggggccuccagcauccucccccuguugggagccaagaaggacccaaggauccugaggccugguccagaccccagggcugguauaaccacucugggaaguga

SEQ ID NO: 74904 - RNA, 2355 nt, Artificial Sequence
  derived and/or modified sequence opt5 from RIPK4__Homo_sapiens__NP_065690
auggagggcgacgggggaacccccugggcccuggcucuccugagaacauucgaugccggcgaauuuacggggugggagaaggugggaagcggcggguucggacaggucuacaaaguucggcacgugcauuggaagaccuggcuugcgaucaaaugcuccccuucucugcacguggacgaucgcgaaagaauggagcuccuggaagaggcuaagaaaauggagauggccaaguuucgguauauucuuccggucuacggcaucugucgcgaacccgugggccugguuauggaguauauggaaacagggagccucgagaagcugcuggccuccgagccucuccccugggaccugagauuccggauuauccaugaaaccgcugugggaaugaacuuucuucacugcauggccccuccccugcuccaucuggaucuuaaaccugcuaauauucugcucgacgcccacuaccacgucaagaucucugauuucggccuggcgaaauguaacgggcugagccauucccacgaccucucuauggauggacuguuuggcacaaucgccuaucuuccgcccgagcgcauuagagaaaagagccggcuguucgacaccaaacaugauguguacuccuuugcuaucguuauuuggggagugcucacacagaagaagccuuucgccgacgagaaaaauauccugcacauuauggucaagguggugaaagggcaccgccccgaacuuccucccgucugcagagcucggccgcgcgccuguagccaucugaucagacucaugcagcggugcuggcagggcgauccucgcguuagacccaccuuucaggagauuacgucugagaccgaagaccugugugagaagccugacgaugaagugaaagagacagcgcacgaccuggaugugaaguccccucccgaaccccggagcgaggucgugccggccagacucaaacgcgcuucugcccccaccuucgacaacgauuauucccugagcgagcuucugucucaacucgacuccggcguuagccaggcuguggaagggccugaggaacugucccggucuagcuccgagagcaagcugcccucuuccggaagcggcaagagacugucuggggucagcuccguggauucugccuuuagcucccgcggaagccucucucuguccuucgaacgggagccuagcacaucugaccugggcaccacggauguucagaaaaagaaacucguggacgccaucgucuccggggauacaagcaagcugaugaaaauccuucagccccaagacguggaccuggcucucgauuccggagcgucucugcugcaucuugccgucgaggcuggccaggaagagugcgccaaguggcuccugcugaauaacgccaauccgaaccucagcaauagacgcggcuccaccccucugcacauggcuguggaacggagaguucgcgggguggucgagcuucugcucgcccggaagauuucugugaacgcgaaagacgaggaucaguggacagcucugcauuucgccgcccagaauggagacgaaagcuccaccagacugcuucucgagaagaacgcuagcguuaaugaaguggauuuugagggccgcacccccaugcacgucgccugucaacacgggcaggaaaacaucgugcggauucugcugagacggggaguggacguuucucuccagggcaaagaugcuuggcugccucuucauuacgccgcguggcaagggcaccuucccaucgucaagcuccuggccaaacagccuggcguguccgugaaugcucagacacuggacggacgcacgccccuucaucucgccgcucagagaggccacuaccgggucgcccgcauucugaucgaucugugcagcgacgugaacguuuguucucuccuggcgcaaaccccgcuucacguggccgcugagacagggcauaccuccacagccagacugcuccugcaccggggagcuggcaaggaggccaugaccagcgauggguauacggcccugcaucuugcugcgagaaacggacaccucgccacagucaagcugcugguggaagagaaagcugacguucucgcccgcggcccucugaaucagaccgcccuucaucuggcugccgcgcacgggcacucugaaguggucgaggaacucgugagcgcugauguuaucgaccuguucgacgagcagggccuguccgcccuucaucuggccgcucagggaagacacgcccaaaccguggagacacuccugcggcauggcgcgcacauuaaccuccagagccugaaguuucaagggggacauggccccgcugccacccuucugcgcagaucuaaaacauga

SEQ ID NO: 74905 - RNA, 387 nt, Artificial Sequence
  derived and/or modified sequence opt5 from RIPPLY2__Homo_sapiens__NP_001009994
auggagaacgccggcggggcugaaggaaccgagagcggcgccgcggcuugcgccgccacagacgggcccacgcggcgggcuggagccgauuccggcuacgcuggguucuggcgcccuuggguggacgccggaggcaagaaagaagaggaaaccccgaaucacgcggccgaggcuaugcccgauggcccugggaugacagccgcuucuggaaagcuguaucaguuuagacaucccgucagacucuucuggccuaaaagcaaguguuacgacuaucuguaccaagaggccgaagcgcuucugaaaaacuuucccauccaggccaccauuuccuucuaugaggauucugacagcgaagaugagaucgaggaccucacaugcgaaaauuga

SEQ ID NO: 74906 - RNA, 552 nt, Artificial Sequence
  derived and/or modified sequence opt5 from RIT1__Homo_sapiens__NP_001243749
augaccaugcaguucaucagccacagauuucccgaggaccaugauccuacaauugaagacgccuacaagauccggauucgcaucgaugacgagccggcuaaccuggauauucucgacacggccggccaagcggaauuuaccgcuaugagagaucaguauaugcgggccggggagggauuuaucaucugcuacuccauuacagaccgcagaucuuuccacgaagugcgggaguuuaaacagcugaucuaucgcgucagacggaccgaugacacacccguugugcuugugggcaauaagagcgaucugaaacagcuccgccaagucaccaaggaggaagggcuggcccuugcuagagaguucuccuguccuuucuucgaaacaucugccgcuuaccgguauuacauugacgauguguuucaugcccugguucgcgagaucagacggaaagagaaggaagcggugcucgccauggagaagaaaagcaagcccaaaaacuccgucuggaagcgccugaaaucuccuuucagaaagaagaaagacagcgugaccuga

SEQ ID NO: 74907 - RNA, 462 nt, Artificial Sequence
  derived and/or modified sequence opt5 from RIT2__Homo_sapiens__NP_001259006
auggagguggaaaacgaggccagcugcucccccggcucugcuagcgggggauccagagaauacaaggucguuaugcugggcgccgggggagugggcaaaucugcgaugaccaugcaguucaucagccaccaauuuccugacuaucaugauccgacaauugaggacgcuuacaagacccaggugcggaucgauaaugaacccgccuaucucgacauucuggauacggccgggcaggcugaguucacagccaugcgcgagcaguacaugagaggaggcgaaggcuuuaucauuuguuauuccgucaccgaccggcaaucuuuccaggaggcugccaaauuuaaggaacuuaucuuccaggugcgccacacauacgagaucccucugguucucguggggaacaaaauugaucuggagcaguuuagacaacccacccuuaaggaguucggacgggaagaauuuuga

SEQ ID NO: 74908 - RNA, 882 nt, Artificial Sequence
  derived and/or modified sequence opt5 from RITA1__Homo_sapiens__NP_001273144
augcugagagagccccggaagcagggccucgccgggcgcgcucaucugcuuagcccuggaaccacaggcuccaugaaaacgccgguggaacuggccgucucugggaugcaaacccucggacugcagcacagaugccggggcggguaccgcguuaaggcgagaacaagcuauguggacgagacccuuuucggaucccccgcuggcacacggccuacacccccugauuuugaucccccuuggguggaaaaagccaaccgcaccagaggcgucgggaaggaggccucuaaagcucugggagccaagggcagcugugaaaccacgccgucccgggggucuacccccacacucaccccucgcaagaaaaauaaguacagacccaucagccacacaccuuccuauugcgacgagagccuguucggaucucgguccgagggcgcuagcuuuggggcgccccgcauggccaaaggagacgccgcuaagcugagagcccuccuguggaccccgccucccacgccucggggcucucauagcccccgccccagagaagcuccucuucgggccauucacccggcgggccccuccaaaacagagccugggcccgccgcugauucucagaagcuguccaugggaggccuccauagcuccagaccucugaagcgcgggcuuucucacagccugacccaccucaacgugcccuccacaggacauccggccaccagcgcuccucacaccaauggcccccaggaccugcggccuucuacauccgggguuacguucagaagcccccuggugaccucucgcgcccggagcgucuccaucucugugccuagcacacccagacgcggaggcgccacccaaaaaccgaagccucccuggaaauga

SEQ ID NO: 74909 - RNA, 954 nt, Artificial Sequence
  derived and/or modified sequence opt5 from RLBP1__Homo_sapiens__XP_011520172
augagcgagggcguggggaccuucagaaugguccccgaagaggaacaggagcugcgggcccaacucgaacagcugacaacgaaggaccacggaccuguuuuuggcccgugcucccagcuuccccgccauacccugcagaaagcuaaggaugagcucaacgagagagaagagacacgggaagaggccgugcgcgagcugcaagaaauggugcaggcgcaggcugccucuggggaggaacuugccgucgcuguggccgagagaguucaggaaaaagacagcggauucuuucugcgguucauccgcgcuagaaaguuuaaugugggccgggccuacgagcuccugcgcggguaugucaacuucagacugcaauacccugagcucuuugauucccugucucccgaagcggugcgguguaccauugaggccggauauccuggcguucuuagcucccgcgacaaauacggcagaguggucaugcuguucaauaucgaaaacuggcagucucaggagauuacauuugaugaaauccuccaggcuuauugcuucauucuggagaaacuucuggagaaugaagagacccaaaucaacggguuuuguaucauugaaaauuucaagggauuuacaaugcagcaggccgcuagccuccggaccuccgaccugcgcaagaugguggauaugcugcaagacagcuuccccgccagauucaaggcgauccacuuuauucaucagccuugguacuucacgaccacauauaacguggucaaaccguuucucaagucuaaacugcuugagcggguuuucgugcacggcgaugaccuguccggguuuuaccaggaaaucgaugagaauauucuccccagcgacuucggaggcacccugccuaaguacgaugggaaggccguggcugagcagcuuuuuggaccccaagcccaggcugaaaacacagccuucuga

SEQ ID NO: 74910 - RNA, 4578 nt, Artificial Sequence
  derived and/or modified sequence opt5 from RLF__Homo_sapiens__XP_011540196
augaaggccagcgugugcaaaaccaucgcuugucugcuccccgaggaccuggaagucagacgggccugccagcuuacagaguuccugauugaaccuucccucgauggcuuuaacaugcuggaggaacuuuaccugcaaccggaccagaaguucgaugaggagaaugcgcccguuccuaacucucuccgcugugaacugcugcucgcucugaaagcccacuggcccuuugacccugaguucugggauuggaagacgcuuaaaagacauugccaccagcugcucgggcaggaagccagcgacuccgaugacgaucugucuggauaugagaugagcaucaaugacaccgaugugcuugaguccuuucugucugacuacgaugaaggcaaggaggacaagcaauaucggcgcagagaccucacagaucagcauaaagaaaagcgggacaaaaagcccauugggagcuccgagcgcuaccagagauggcugcaguauaaauucuuuugucugcucugcaagcgggaauguaucgaggcucgcauucugcaccauagcaagaugcacauggaggauggaaucuauaccugcccuguguguaucaaaaaguucaaaagaaaggaaauguuugucccgcacgugauggagcauguuaaaaugcccccuucucggcgcgacagauccaagaaaaagcugcugcucaagggcagccaaaaagggauuugccccaagucuccuuccgccauccccgaacagaaccacagccugaaugaucaggcuaaaggagagucucaugaauacgugacauucuccaagcuggaggacugucaccuucaggaucgggaccucuacccgugcccuggcaccgauugcagccgcgucuuuaaacaauucaaguaccuguccgugcaccugaaggccgagcaucagaacaaugacgaaaacgcgaaacacuaucucgauaugaagaauagacgggagaaauguacauacugcagacgccauuuuaugucugccuuccaucugcgggaacacgagcagguucacuguggcccccaaccuuauaugugcgugagcauugacuguuacgcuagauucggguccgucaacgaacuucugaaucacaagcagaaacaugacgaucuccgcuauaagugcgagcugaacggauguaauaucguguuuagcgaccuuggccagcuguaccaccaugaggcccagcacuuccgggaugcuucuuauaccugcaacuuucucggguguaagaaauucuacuacuccaagauugaauaucaaaaucaccugagcaugcauaacguggagaacucuaauggagacaucaaaaagagcgucaaacuggaagaguccgccacgggcgagaagcaggauugcauuaaccagccccaccuccugaaucagaccgacaagucucaucuucccgaagaucuguuuugugcggagagcgccaacucccaaaucgacacagaaaccgcugagaaucucaaagaaaacagcgauucuaauuccagcgaccagcugucucacuccagcuccgccucuaugaacgaggagcugaucgauacacuugaccauagcgaaaccaugcaggauguucuccuguccaaugagaagguguucgggccuucuagccugaaagaaaagugcuccagcauggcugugugcuuugacggaacgaaauucacauguggcuuugacggcugcgggucuaccuacaagaacgccagaggaaugcagaaacaccuccgcaagguccacccguaucauuucaagcccaaaaagauuaaaacaaaggaucuguuuccuucccuuggcaaugagcacaaccaaaccaccgaaaaacuggacgccgagcccaagccuuguagcgauacaaauucugacucccccgaugaggggcucgaccauaacauccacauuaagugcaaacgggaacaucagggauacagcucugagagcuccaucugugcuagcaagagaccgugcacggaagauaccaugcuggagcugcuucuccgccugaaacaccugucucucaaaaauuccauuacacacggcagcuucuccgggucucugcagggauauccuagcuccggcgcgaagucucuucagagcguguccucuaucagcgaccugaacuuucaaaaccaggaugaaaauaugcccucccaguaccucgcccaacuggcugccaagccuuucuucugugagcugcagggcugcaaguaugaguuuguuacccgggaagcccuucucaugcauuaccugaaaaagcacaacuacagcaaagagaaggugcugcagcucacaauguuccagcauagauauucucccuuucaaugucacaucugccagcgcuccuucacccggaaaacgcaccugagaauccauuacaagaauaagcaccagauugggagcgaccgggcuacacauaaacuucuggauaacgaaaagugugaccacgagggaccuugcucugucgaucgccucaaaggcgacugcuccgccgagcuugggggagaccccagcucuaauuccgaaaagccgcauugucacccuaaaaaggaugagugcagcuccgaaaccgaccuggagagcucuugugaagagaccgagagcaaaacauccgauauuucuagccccaucggcucccacagagaggaacaggaagggcgggagggcagaggaucucgccggaccguggcgaagggcaaccuuugcuauauucucaauaaguaccauaaacccuuucacuguauccauaagacaugcaacagcuccuucacgaaucugaaagggcugaucagacacuaucgcaccguucaccaauacaacaaggaacagcucugucuggagaaagacaaggcuagaacaaagcgggagcuugugaaaugcaagaaaauuuuugccuguaaguauaaagaaugcaauaagcgcuuccuguguucuaaggcccucgcuaaacauugcagcgauucccacaaccuggaccauaucgaggaaccuaagguccugagcgaggccggaucugcugccagauuuuccugcaaucagccgcagugucccgcgguguucuacaccuuuaacaaacuuaagcaccaucugauggaacaacacaauauugagggcgagauccacagcgauuacgaaauucauugcgaccucaacggguguggacagaucuucacacaccggucuaacuauucccagcaugucuacuaucgccacaaagauuacuaugacgaucuguuuagaagccaaaagguggccaaugagcggcuccugcgcuccgaaaagguuugccagaccgcugacacgcagggccacgagcaucagaccacaagacggucuuucaacgccaaaagcaagaaaugugggcuuauuaaggagaaaaaggcuccuaucuccuucaagacccgcgccgaagcgcugcacaugugcguggagcauagcgaacacacacaauaccccuguaugguccagggcugccucucugugguuaaacuggaguccagcaucgugagacauuauaagcggacccaccagaugucuagcgccuaccuggaacagcaaauggagaaucuugucgugugugugaaauacggaacgaagauuaaagaggaaccucccuccgaggcugacccuugcaucaagaaagaagagaacagaucuugugaaagcgagcgcacagagcacucccauucucccggcgauagcuccgccccgauucagaauaccgacugcugccacagcucugaacgggaugggggacagaagggcuguaucgaguccagcuccguuuuugacgcugauacacugcucuauagagggacccugaagugcaaccauucuagcaaaaccacaucccucgaacaguguaauauuguccaaccucccccucccugcaagaucgagaacucuaucccgaauccuaacggaacggaaagcggcaccuacuucacauccuuucagcugccccuuccucgcauuaaagagagcgagacccggcagcacucuuccgggcaggaaaauacagugaagaaccccacccaugugcccaaagagaauuucagaaagcacagccaaccucgcucuuuugaccugaagacguauaaaccgaugggcuucgaauccagcuuucucaaguucauccaggagucugaggaaaaagaggaugacuuugaugacugggaacccagcgagcaccugacacuguccaacucuagccaguccagcaaugaucuuaccggaaacgucguggccaacaauaugguuaacgacuccgaaccugagguggauauuccccauucuagcuccgacucuaccauccacgagaaucugacagccauuccuccccucaucgucgcugaaaccacaacggugccuagccuggagaaccuccggguugugcuggacaaggcgcuuaccgauuguggcgaacuggcccugaaacaacuccauuaccugagaccggucgugguucuugagcgcuccaaguucucuacacccauccuggaccucuuuccuaccaagaaaacagaugaacugugcguggggagcuccuga

SEQ ID NO: 74911 - RNA, 1875 nt, Artificial Sequence
  derived and/or modified sequence opt5 from RLIM__Homo_sapiens__NP_899196
auggagaacagcgacuccaaugauaagggcucuggggaccagagcgccgcucaaagacggucccagauggaucgccuggacagagaagaggccuucuaccaguuugugaacaaucucucugaagaggauuaucggcugaugcgcgacaacaaucuucugggaacccccggcgaaagcacagaggaggaacuccugagacggcuucagcaaaucaaagaggggccuccgccccagaacuccgaugaaaaucgcggaggcgacucuagcgaugacgucuccaacggggauagcauuaucgacuggcugaauagcguuagacagacgggaaacaccacacgguccggccagcgcggcaaucaaagcuggagagcggugucucggaccaacccuaauuccggggauuuccgcuuuagccucgagauuaacgugaauagaaacaacggaucucagaauagcgagaacgaaaaugagcccagcgcucggcgcuccucuggcgaaaacgucgagaauaacagccagagacagguggaaaauccucgguccgagagcacaucugccagacccucccgcagcgagcggaacucuaccgaagcccugacagagguuccuccgaccagagggcaacgccgggcuagaagccgcucccccgaccaccggagaacgcgcgcccgggcugaaagaucucgcagcccucugcaucccauguccgagaucccucggagaagccaccauucuauuuccagccagaccuucgaacacccccucgugaaugagacagagggaucuucccggacccgccaucacgucacacugagacagcaaaucagcggcccggaacuucugucccgggggcucuuugccgcgucuggaaccagaaacgccagccagggcgcuggcuccucugacacggccgcuagcggggaguccacaggaagcggccagcgcccucccaccaucgugcuggaucuucagguucggagagugcgcccuggggaauacagacaacgggacucuauugccucccgcacaagaagccggucucagacccccaauaacaccgucacauaugaguccgaacgcggaggcuucagacggacguuuagccgcucugagagagcgggggugcggaccuacgugagcacaauccgcauucccaucagacggauucugaauaccggacucuccgagacaaccagcgucgccauccagacgaugcugagacagauuaugacaggcuucggcgaacugucuuauuuuauguacuccgauagcgacuccgagccuaccgggucuguuagcaaccgcaauauggaacgggcugaguccagaucuggacgcggcgggagcggaggcggguccucuagcggcuccucuucuuccuccucuuccucuagcuccagcuccagcucuagcuccucuagcuccucuccgagcuccucuagcggaggcgaguccagcgaaaccucuuccgaucucuucgaggggagcaacgaaggaucuuccagcuccggcucuagcggggcccggagagagggacgccaccgggcucccgugacauuugacgaauccggcagccugccuuuccuuucucuggcccaauuuuuccuccugaacgaggaugacgaugaccagcccagagggcuuaccaaggagcagaucgauaaucuggccaugcgcuccuucggcgaaaacgacgcucucaaaacaugcagcguguguaucacggaguauaccgaaggaaauaagcugcggaaacugccuugcucucaugaguaccacguccauuguauugacagauggcucagcgaaaacuccacaugccccaucugucggcgcgcggugcuggccucuggcaauagagagagcguuguguga

SEQ ID NO: 74912 - RNA, 558 nt, Artificial Sequence
  derived and/or modified sequence opt5 from RLN1__Homo_sapiens__NP_008842
augcccagacuguuccucuuucaccuucuugaguucugccugcuccugaaccaguuuagccgggccguggcugccaaguggaaagacgaugucaucaagcuguguggccgcgaacugguuagagcgcaaauugcuaucugcgggauguccaccuggucuaaacggagccucucccaggaggacgccccucagacaccgcgccccguggccgaaauugugccuucuuucaucaauaaggauacggagaccauuaucaucaugcuggaauuuauugcuaaccugcccccugagcucaaagccgcucugagcgagagacagcccucccuuccugaacugcaacaguacgucccggcccucaaggacucuaaucugagcuucgaggaauuuaagaaacuuauccggaaccgccaguccgaggcggccgauagcaaucccucugagcugaaguaucucggacuggacacacauucccagaaaaagagacggccuuacguggcucuguucgaaaaauguugccucauuggcuguaccaagcgcagccuggccaaguauugcuga

SEQ ID NO: 74913 - RNA, 354 nt, Artificial Sequence
  derived and/or modified sequence opt5 from RLN2__Homo_sapiens__NP_005050
augcccagacuguucuuuuuccaccuccugggcgugugccuucugcucaaccaguuuagccgggccgucgcugacuccuggauggaggaaguuaucaagcugugugggcgcgagcuugugagagcccaaauugcgaucugcggaaugucuaccuggagcaaacggucccugucucaggaagaugcuccucagacaccgcgccccguggccggcgacuucauucagacggucagccucgggaucuccccugauggaggcaaggcccugagaaccgggucuuguuuuacacgggaguuccugggagcucucagcaaacugugccaucccuccagcaccaagauucaaaaaccuuga

SEQ ID NO: 74914 - RNA, 429 nt, Artificial Sequence
  derived and/or modified sequence opt5 from RLN3__Homo_sapiens__NP_543140
auggccagauacaugcugcuccugcuucuggcuguguggguccucaccggcgagcuguggcccggggccgaagcgcgggcugccccuuauggaguucgccuuugcggcagagaguucauccgggccgugauuuuuacaugugggggaagccgcuggagacgguccgacauccuggcucacgaagccaugggcgauacguucccggacgcugaugccgacgaggauucucucgcgggggaacuggacgaggccaugggaagcuccgaguggcuggcucucaccaagucuccccaggccuuuuaccgcggcagaccuagcuggcaaggcacacccggggugcugcggggaucccgcgauguccuugcuggccugucuagcuccugcuguaaaugggggugcagcaagucugaaauuuccagccucuguuga

SEQ ID NO: 74915 - RNA, 855 nt, Artificial Sequence
  derived and/or modified sequence opt5 from RMDN1__Homo_sapiens__NP_001273648
auggcccuggcugccagacucuggcggcugcuucccuuccgcagaggcgcggcuccugggagccggcugccggccggaaccuccggcucucgcgggcacugcggacccuguagauuucggggcuucgaggugauggggaacccuggaacauuuaagcgcggccuccugcuuagcgcccuguccuaccucggcuucgaaacguaucaggucaucucucaagcugccguugugcaugcuaccgccaaaguggaggaaauucuggagcaggcggacuaccuguaugaaagcggggagacagagaagcucuaccagcugcuuacccaguauaaagaauccgaggaugccgaacugcucuggagacuggcucgggccucucgcgacgucgcucaacuuagcagaacauccgaggaggaaaagaaacugcucguguacgaggcccuggaauaugcgaagcgggcccuggagaagaaugaaagcucuuuugcuucccacaaaaaggccaucgagcucaaccccaaagaugcuaccagcauucaucugaugggaaucuggugcuacacauucgccgagaugccuugguaccagcgcagaauugccaagaugcuuuuugcuacgcccccuucuuccaccuaugaaaaagcgcugggcuacuuccaccgggccgagcagguugacccgaauuuuuauagcaagaaccuccugcuucuggggaagaccuaccucaaacugcauaauaagaaacuggcugccuucuggcucaugaaggccaaagauuaucccgcucacacagaagaggacaagcagauccaaaccgaagccgcgcagcugcuuacaucuuuuuccgagaaaaacuga

SEQ ID NO: 74916 - RNA, 1233 nt, Artificial Sequence
  derived and/or modified sequence opt5 from RMDN2__Homo_sapiens__NP_001164263
augcccuacagcaccaacaaggagcugauccucggcauuaugguggggacagccggaaucucccugcuucugcucugguaucacaaagucagaaagccuggcauugcuaugaaacugccggaguuccuuucucuggggaauacguuuaacagcaucacccuccaggacgagauucaugaugaccaaggaacaaccguuaucuuccaggaacggcagcugcagauccuggagaagcucaaugaacugcuuacaaacauggaggagcugaaagaagagauucgcuuucucaaggaagccauccccaagcuggaggaguacauucaagaugaacuuggcgggaaaaucaccgugcacaagauuuccccucagcauagagcgcggaaacgcagacugcccacaauccagucuagcgcuaccuccaauucuagcgaggaagccgaguccgaaggaggcuauauuacggccaacaccgacacagaggagcagagcuucccugugcccaaggcuuuuaauacccgggucgaagaacucaaccuggaugugcugcuccaaaaaguugaccaucugcgcaugucugaauccggcaagagcgagucuuucgaacuucugagagaucacaaggagaaauuucgggacgagaucgaguucauguggcgcuuugccagagcuuacggggauauguaugagcucuccacaaauacccaggaaaagaaacacuacgccaacaucggaaagacgcugagcgagcgggcgauuaaucgcgccccuaugaacggccacugccaucuuugguaugcugugcuguguggguacgucucugaguucgaaggacuccagaauaaaaucaacuacggccaccuguuuaaggagcaucuggacauugccaucaaacuccugccggaagaacccuuccuuuauuaccugaaggggagauauugcuacacaguguccaagcucagcuggauugagaaaaagauggcugccacccuguuuggaaaaaucccuuccucuacaguucaggaagcgcuucacaauuuccugaaggccgaggaacucugucccggcuauagcaacccuaacuacauguaucuggcuaaaugcuacaccgaucuggaggaaaaucaaaacgcccucaaguucuguaaucuggcccuucugcuccccaccgugacaaaggaggacaaagaagcucagaaggagaugcagaaaaucaugacgucccugaagcgguga

SEQ ID NO: 74917 - RNA, 1413 nt, Artificial Sequence
  derived and/or modified sequence opt5 from RMDN3__Homo_sapiens__NP_001291731
augagcagacugggcgcccucgggggagcucgggccggccuggggcuucugcucggaaccgcggcuggccugggguuccuuugccugcucuacucccagcgcuggaagagaacacaacggcacggacgcucucagagccugcccaacucccuggacuauacgcagaccucugauccuggcagacaugugaugcuccugcgggccgucccgggcggggccggagacgcuagcguucuucccucccugccucgcgagggccaggaaaaagugcucgauagacuggacuuugugcuuacaucucuggucgcccuccggcgcgagguggaagaacugagaagcucccugcgggggcucgcuggagaaaucguuggcgaggugcgcugucacauggaggaaaaucaaagagucgcccggcgcagacgguuccccuuugugagagagcgcagcgauucuaccggguccagcucuguuuacuucacagcguccagcggagccaccuuuacagacgcugaaucugagggcggcuauaccacggccaacgcugaguccgauaaugaacgggacagcgauaaggaguccgaagacggggaggaugaagugucuugcgagaccgucaaaaugggaagaaaggacagccuggaucuugaggaagaggccgcguccggcgccagcucugcucuggaagccgggggauccagcggccucgaggacgugcugccucuucugcagcaggcugacgaacuccaucgcggggaugagcagggaaaacgggagggcuuccaacugcugcucaacaauaagcugguguacggcucuagacaggacuuucuuuggcgccuggcccgggccuauagcgauaugugugaacucacagaggaagucuccgagaagaaaucuuacgcucuggacgggaaggaagaggcggaggccgcucuugaaaaaggagaugagagcgccgacugccaccugugguaugccguucucuguggccagcuggcugaacaugaguccauucagagacgcauccaaagcggguucucuuuuaaggagcacguggauaaagccauugcgcugcagcccgaaaacccuauggcucacuuccuccugggacgguggugcuaccaggugucccaucuuagcuggcuggagaagaagaccgccacagcccuccuggaaucuccgcuguccgcuaccgucgaggacgcccuucagagcuuucucaaagcugaggagcugcaacccggcuucuccaaggccgggagaguguacaucucuaaauguuaucgcgagcugggcaagaauagcgaagcgcggugguggaugaaacucgcccuggagcuuccugauguuacgaaggaagaccuggcuauucagaaagaucucgaggaacuggaggugauccugagagacuga

SEQ ID NO: 74918 - RNA, 1878 nt, Artificial Sequence
  derived and/or modified sequence opt5 from RMI1__Homo_sapiens__XP_011517336
augaacgugaccagcaucgcccugagagcugagacauggcuccuggccgcguggcacgucaagguucccccuauguggcuugaggcuugcauuaauuggauccaggaagaaaacaauaacgugaaucugucccaagcccagaugaacaaacagguguucgagcaguggcuccugacggaccuucgggaucuggaacauccgcuccugcccgacggcauucuggagaucccuaagggggagcucaauggauuuuacgcccugcaaauuaacucucuugucgaugugagccagcccgcuuauucccagauccagaaacugcgcggcaagaauaccacaaacgaccucguuaccgccgaagcucaagugacaccuaaacccugggaggccaagccuucuagaaugcugaugcuucagcugaccgaugggaucguccagauucagggaauggaauaccaaccgauccccauucuccacagcgaccugccucccggcacaaagauccugauuuaugggaauaucuccuuccggcucggagugcugcuucugaaaccugagaacguuaaggugcucggcggcgaggucgaugcgcugcuugaagaguacgcccaggaaaaagugcuggcucgccucauuggggagcccgaccugguggucucuguuaucccgaauaacagcaaugaaaacaucccuagagugaccgaugugcuggaccccgcccucggaccuuccgaugaggagcugcuugcuagccuggacgaaaacgaugagcucacggccaauaacgacaccucuuccgaacgguguuuuacaaccggcuccucuuccaauacaauucccacccgccagagcucuuucgagcccgaauuugucaucuccccuagaccgaaggaggagcccagcaaccuguccauucaugugauggacggggaacuugaugacuucucucuggaggaagcgcuccugcuggaggaaacgguucaaaaagagcagauggagacaaaggaacuccagccucugaccuuuaaucggaacgccgaucgcagcaucgagagauucucccacaaucccaacacaaccaauaacuuuagccuuaccugcaagaauggaaacaauaacuggucugagaaaaauguguccgaacagaugacaaacgaggacaagagcuucggcuguccuucuguccgggaucaaaaccgcagcauuuuuagcgugcauugcaauguuccccuggcucacgacuucacgaacaaagaaaagaaucucgagaccgauaacaaaaucaagcagacaucuagcuccgacagccacucucugaauaacaaaauccugaauagagaaguggucaacuaugugcagaagcgcaauucccagauuagcaacgagaaugauuguaaccuucaaucuugcucccuccggagcuccgaaaauucuaucaaccugagcauugccauggaccuguacuccccgccuuuugucuaucucucugugcugauggcuagcaagcccaaagagguuaccacagugaaggucaaagccuucaucgugacccuuacggggaaucuguccagcucuggaggcauuugguccaucacagccaagguuagcgauggcaccgcuuaccucgacguggacuucgucgaugagauccugaccucucugauuggguuuuccgugccugaaaugaaacagagcaagaaggacccccuucaguaccagaaauuccucgagggacugcaaaagugucagagagaucugaucgaccucugcugucugaugacaauuucuuuuaacccuagccuuuccaaagcgauggugcuggcccuccaggauguuaacauggaacaucuggagaaucugaagaaacggcuuaacaaguga

SEQ ID NO: 74919 - RNA, 444 nt, Artificial Sequence
  derived and/or modified sequence opt5 from RMI2__Homo_sapiens__NP_689521
auggccgcugccgcggacagcuucuccggcgggcccgcuggagugagacugccucggucuccgccccucaagguccuggccgagcagcuucgcagagaugccgaaggcgggccuggagcuuggcggcugagccgcgccgcugccggcagagggccccucgaccuggcggccguuuggaugcaaggacggguggugauggcugaucgcggcgaggccagacuucgggacccuuccggcgauuuuucuguccgcgggcuggaaagagugccccggggacgcccuugccucguuccgggcaaauacgugauggucaugggggugguucaggcuuguagccccgagccuugccugcaggccgugaagaugaccgaccuguccgauaaccccauccacgaaucuaugugggagcucgaggucgaagaccugcauagaaauauuccuuga

SEQ ID NO: 74920 - RNA, 840 nt, Artificial Sequence
  derived and/or modified sequence opt5 from RMND1__Homo_sapiens__NP_001258866
augcacugcaccgccuucgcuacagccgacgaguaccaucugggcaaccucagccaggaucuggcgucccacggguauguggaagucacgucucuucccagagacgcugccaauauccugguuaugggaguggagaacagcgccaaggaaggcgauccugggaccaucuuuuucuuucgggagggagcugccguguucuggaaugucaaagacaagacaaugaaacaugugaugaagguucucgaaaaacacgagauucaaccguacgagauugcucuggugcauugggaaaacgaggaacuuaauuauaucaagauugagggccaguccaagcugcaccgcggggagaucaaacucaacucugaacuggaucuggacgaugccauccucgagaaguuugcguucagcaaugcccugugucuuuccgucaaacuggcuauuugggaagccucucucgacaaguuuaucgagagcauucaguccauccccgaagcucugaaagccggaaagaaggugaaacuuagccacgaggagguuaugcagaagauuggcgaacuguucgcgcucagacaucggaucaaccugucuuccgauuuucugauuaccccugacuucuacugggaucgcgagaaucucgaaggccuguaugacaaaacaugccaauuucuuagcaucgggagacgggugaaggucaugaacgagaaacugcagcacuguauggaacucaccgaucugaugcgcaaucaucuuaacgagaagagagcccugcggcucgaguggaugaucgugauucugaucacaauugaagugauguucgagcugggacgcgucuuuuucuga

SEQ ID NO: 74921 - RNA, 600 nt, Artificial Sequence
  derived and/or modified sequence opt5 from RNASE11__Homo_sapiens__NP_660293
auggaaaccuucccccugcuccugcuuagccugggccucgugcuggccgaggcuuccgaaucuacaaugaagaucauuaaagaagaguuuacggacgaagagaugcaguacgauauggccaagagcgggcaagagaaacagaccaucgaaauucuuaugaacccuauccugcucgucaagaauacaucccugucuaugagcaaagacgauauguccucuacccugcucacauucagaagccugcacuauaacgacccgaagggaaauuccagcggcaacgauaaggagugcuguaaugacaugaccguuuggcggaaagugucugaagcgaacggguccugcaaguggagcaauaacuuuauuagaucuuccacagaggugaugcgccggguccaucgcgcucccagcuguaaauucgugcagaauccuggaaucucuugcugugagucccuugaacuggagaacaccguuugccaguuuacgaccggcaagcaauuccccagaugucaguaccacagcgugacaucccucgagaaaauccugaccguccuuacagggcauucucugaugagcuggcucgugugcggauccaagcuguga

SEQ ID NO: 74922 - RNA, 444 nt, Artificial Sequence
  derived and/or modified sequence opt5 from RNASE12__Homo_sapiens__NP_001019993
augaucauuauggugaucauuuuccugguccuccuguuuugggagaacgaaguuaaugacgaggccgugaugagcacccuugaacaucugcacguggauuacccccagaacgacgucccugugccggcuagauauugcaaucacaugaucauucaacggguuauccgcgagcccgaucauacauguaagaaagaacacguguucauccaugagagaccucggaagauuaacggcaucugcauuucccccaaaaaggucgccugucagaaucucucugcgaucuuuugcuuccagagcgagacgaaauuuaagaugaccgugugucagcugauugaagggacacgcuacccugcuugcagauaucacuacucccccaccgagggauucguucuugugacaugugacgaucugcggccugacucuuuucucggcuaugucaaguga

SEQ ID NO: 74923 - RNA, 471 nt, Artificial Sequence
  derived and/or modified sequence opt5 from RNASE13__Homo_sapiens__NP_001012264
auggcccccgcugugaccagacuccuguuccugcagcuuguccugggcccuacacucguuauggacaucaagaugcaaauugggagccggaacuuuuacacgcuguccaucgauuauccgcgcgugaauuaccccaaaggauucagaggcuauugcaacgggcuuaugucuuacaugcggggaaagaugcagaauagcgacuguccuaaaauucacuaugugauccaugcccccuggaaggcgauucagaaauuuugcaaguacuccgauucuuucugugagaacuauaaugaauacugcacccugacacaggacagccucccuaucaccgucuguucccugucucaccaacagcccccuacaagcugcuacuauaacuccacccugacaaaucagaagcucuaccugcuuuguagccgcaaauaugaggcugauccgaucggcauugccgggcuguacucuggaaucuga

SEQ ID NO: 74924 - RNA, 471 nt, Artificial Sequence
  derived and/or modified sequence opt5 from RNASE1__Homo_sapiens__NP_937875
auggcccuggaaaagagccucgugagacugcuucugcucguccugauccuucugguucucggcugggugcagcccucccuggggaaagagucucgggcuaagaaauuccaacgccagcacauggacagcgauuccucuccuagcuccucuagcaccuacugcaaccagaugaugagacggcgcaauaugacacagggaagauguaagccggugaacacguuuguccaugagccccugguggacguucaaaaugugugcuuccaggaaaaagucaccuguaagaacggccaggggaauugcuauaaguccaacagcucuaugcacauuacagauugucggcucaccaauggaucccgcuacccuaacugcgccuauagaacaagccccaaagagcggcauaucauuguggcgugugaaggcucuccuuacguucccgugcacuuugacgcuuccgucgaggauagcaccuga

SEQ ID NO: 74925 - RNA, 486 nt, Artificial Sequence
  derived and/or modified sequence opt5 from RNASE2__Homo_sapiens__NP_002925
auggugcccaagcuguucacaagccagaucugccuccugcuucugcucggccugcuugccgucgaggggucccugcacguuaaaccuccgcaauuuacaugggcucagugguucgaaacgcagcauauuaacaugaccucucagcaauguacaaaugccaugcaagugaucaacaauuaccagagacggugcaagaaccagaauaccuuucuccugacaaccuucgcgaacguggucaauguguguggaaaccccaauaugacaugcccuagcaacaaaacccgcaagaauugucaccauuccggcucucagguuccccugauucacugcaaccucacgaccccuagcccccagaauaucuccaacuguagauaugcucagaccccugccaauauguuuuacauuguggccugcgacaaccgggaucagcgcagagacccgccccaauauccugucgugcccguucaucuggaucggaucaucuga

SEQ ID NO: 74926 - RNA, 483 nt, Artificial Sequence
  derived and/or modified sequence opt5 from RNASE3__Homo_sapiens__NP_002926
auggugcccaagcuguucaccagccagaucugccuccugcuucugcucggccugaugggggucgagggaucccuucacgccagaccuccgcaauuuacacgggcucagugguucgccauucagcauaucucucugaaucccccucgcuguacgauugcgaugagagcuaucaacaacuaccgguggcgcugcaaaaaucagaacaccuuucucagaacaaccuucgccaauguugugaacguguguggcaaucaaagcauucggugcccccacaaccgcacacugaauaacugucauagaucccgguuucgcgucccucugcuccacugcgaccugaucaaucccggggcccagaacaucucuaauuguaccuaugcugauagaccuggacggcgcuucuacgugguugccugcgacaacagagauccgcgggacagcccccgcuauccugugguccccgugcaucuugauacaaccauuuga

SEQ ID NO: 74927 - RNA, 444 nt, Artificial Sequence
  derived and/or modified sequence opt5 from RNASE4__Homo_sapiens__NP_002928
auggcccugcagagaacccacagccuccugcuucugcuccugcuuacacugcucggccuggggcuggugcaacccuccuacggacaggacggcauguaucagcgguuccuccgccagcauguccacccugaggaaaccgggggaucugauagauacugcaaccugaugaugcaacggcgcaagaugacgcuuuaucauuguaaaagauuuaauacauucauccacgaggacauuuggaacauccggagcauuugcuccaccacaaauauccaguguaagaacggcaaaaugaauugccaugaagggguugugaaggugaccgauugucgcgacacaggaucuagcagagcuccgaacugccgguaccgcgccauugcguccaccagacgggucgugaucgcuugugagggcaauccccagguuccugugcacuuugauggcuga

SEQ ID NO: 74928 - RNA, 453 nt, Artificial Sequence
  derived and/or modified sequence opt5 from RNASE6__Homo_sapiens__NP_005606
auggugcugugcuucccccuccugcuucugcuccugguccuuuggggcccuguuuguccgcugcacgccuggcccaagagacucaccaaagcucauugguuugagauccagcacauucaaccuagcccccugcagugcaaccgggccauguccgggaucaauaacuacacacagcauuguaagcaccagaauacguuccugcaugacucuuuucaaaacguggcggcugugugcgaucuccugagcauugucuguaaaaaucgcagacacaacugccaccaguccucuaagccugugaauaugaccgacugucggcuuacaagcggaaaauauccccagugccgcuacuccgccgccgcucaguauaaguucuuuaucguugccugugauccuccgcaaaagucugaucccccuuacaaacuggugcccguccaucucgacagcauucuguga

SEQ ID NO: 74929 - RNA, 471 nt, Artificial Sequence
  derived and/or modified sequence opt5 from RNASE7__Homo_sapiens__NP_115961
auggcccccgcuagagccggcuucugcccucugcuccugcuucugcuccuggggcuuuggguggcggagaucccggucagcgcuaagcccaaaggaaugaccuccucucagugguuuaagauucaacacaugcagccuagcccccaggccuguaacuccgccaugaaaaauaucaacaagcauacaaaacggugcaaggaccugaauacguuccuccacgaaccuuuuucuagcguugcugccaccugucagacacccaagauugcuugcaaaaacggcgauaagaauugucaucaaucccacggggccgugucucugaccaugugcaaacugacaagcggaaaguacccuaacugucgcuauaaagagaagagacagaauaaguccuacguggucgcgugcaaaccgccccagaagaaagacagccagcaauuccaucucgugccuguucaccuggaucgggugcuuuga

SEQ ID NO: 74930 - RNA, 465 nt, Artificial Sequence
  derived and/or modified sequence opt5 from RNASE8__Homo_sapiens__NP_612204
auggcccccgcuagagccggcugcuguccucugcuccugcuucugcucgggcuguggguggcggagguccuuguucgggcuaagccgaaagacaugaccagcucccagugguucaagacacaacacgugcagcccucuccucaggccugcaacagcgccauguccaucauuaauaaauacacggaacgcuguaaggaucugaacaccuuucuccaugagcccuucucuagcguggcuaucacaugccagaccccuaauauugccuguaaaaacuccugcaagaauugucaccaaucucauggacccaugagccugacaaugggcgaacugaccuccgggaaguauccuaacugcagauacaaagagaagcaccucaauacaccguauaucgucgcuugugaucccccucagcagggagaccccggcuacccucuggugcccguucaucuugacaaaguggucuga

SEQ ID NO: 74931 - RNA, 618 nt, Artificial Sequence
  derived and/or modified sequence opt5 from RNASE9__Homo_sapiens__NP_001103826
augaugagaacccugaucacaacgcacccccucccucugcuucugcucccgcagcaacugcuucagcuggugcaguuccaggaggucgacaccgauuuugacuuccccgaagaggauaagaaagaagaguuugaagagugccucgagaaguucuuuagcacaggcccugcccggcccccuaccaaagaaaagguuaaacgcagagugcugauugagcccgggaugccucugaaccauaucgaauacuguaaucacgagauuaugggaaagaacguguauuacaagcaucggugggucgcugagcacuauuuccuccugaugcaauacgacgaacuucagaaaaucugcuauaaucgcuuugugccguguaagaacggcauuagaaaaugcaaucgguccaaggggcugguugagggaguguacuguaaccucacagaagccuucgagauccccgcgugcaaauaugaaucucuguaccgcaagggcuacguccuuaucaccuguagcuggcagaaugagaugcagaagcggauuccucauacaaucaacgaucugguggagcccccugaacacagauccuuucucucugaggacgggguuuucgugauuagccccuga

SEQ ID NO: 74932 - RNA, 861 nt, Artificial Sequence
  derived and/or modified sequence opt5 from RNASEH1__Homo_sapiens__NP_002927
augagcuggcuccuguuccuggcccacagaguggcucuugccgcgcugcccugccggcgcggcuccagaggguuuggaauguucuacgcuguccggcgcggcagaaagaccgggguuuuucucacauggaacgagugucgggcccagguggaccgcuucccugccgcuagauuuaaaaaguucgccacggaagaugaggcuugggccuuugugcggaaaucugcgagcccggaagucuccgagggacaugaaaaucaacacggccaggagucugaggccaaggcuagcaaacgccugagagaaccccuugacggggauggacaugaguccgccgaaccuuaugcuaagcacaugaagcccucuguggagccugcgcccccuguuagccgggacaccuucuccuacaugggcgauuuuguggucguguauacagacggcugcuguagcucuaacgggcgcagacggccgcgcgccggaaucggcguuuacugggggcccggacauccucugaaugugggcauuagacuccccgggcggcagaccaaccagagagccgagauccacgcugccugcaaagcuauugaacaagccaagacacagaauaucaacaaacugguccuguauaccgauuccauguucacaauuaauggaaucaccaacugggugcagggcuggaagaaaaauggcuggaagacgagcgccgggaaggaggugaucaacaaagaagacuuugucgcucucgagcgccugacccagggaauggauauucaauggaugcacguuccuggccauucuggguucaucggaaaugaagaggcggaccggcuugccagagagggcgcuaagcaguccgaagauuga

SEQ ID NO: 74933 - RNA, 900 nt, Artificial Sequence
  derived and/or modified sequence opt5 from RNASEH2A__Homo_sapiens__NP_006388
auggaccugagcgagcucgaaagagauaacaccggccggugccgccuguccucucccgugccugccgucuguagaaaggagccgugcguucuugggguggacgaagcuggacggggccccgugcuggggccuauggucuacgccaucuguuauugcccccucccucgccuggcggaucuugaggcucugaaaguggccgacagcaagacacuccuggaauccgagagagagcggcuguucgccaaaauggaagauacggacuuuguuggaugggcucucgaugugcugucucccaaucuuauuagcaccuccaugcugggccgcgucaaguacaaccucaauucucugagccacgacacagccaccgggcuuauccaguaugcucuggaucaaggagugaacguuacacagguguucgucgacaccgugggcaugccugagacauaccaggccagacuccagcaauccuuuccgggcauugaagugaccgucaaagcgaaggccgaugcucuguaucccguugugagcgccgcuucuaucugugccaagguggcgcgggaccaggccgucaaaaaguggcaguucguggagaaacugcaggaucucgacacggacuacggguccggauauccuaaugaucccaagaccaaggcuuggcugaaagagcauguugaaccuguguuuggcuucccccaauuuguccgcuucagcuggagaacagcccagaccauucuugagaaggaagcugaggacgugaucugggaagauucugccuccgagaaccaggaggggcugcggaaaaucacaagcuacuuucucaaugaaggaucucaggcccgcccgagauccagccaccgguacuuccuggagcgcggccuugaauccgcuaccucucuguga

SEQ ID NO: 74934 - RNA, 774 nt, Artificial Sequence
  derived and/or modified sequence opt5 from RNASEH2B__Homo_sapiens__NP_001135751
auggccgcuggcguggacugcggggauggagucggcgccagacagcacguuuuccuggugagcgaguaccucaaggacgcguccaaaaagaugaaaaacgggcugauguuugugaaacuugucaaucccuguucuggagaaggcgcuaucuaucuguucaacaugugccuccaacagcuguuugaggugaagguuuucaaggaaaagcaucacagcugguuuauuaaucaguccgugcagucugggggacuucugcauuucgccaccccugucgauccgcucuuucugcugcuccacuaccugaucaaagccgacaaggagggcaaauuccaaccccuugaucaggugguuguggacaacgucuuuccuaauuguauucugcuccugaaacuucccggccuggaaaagcuccugcaucacgugacagaggagaaggggaacccugaaaucgauaauaagaaauauuacaaguauagcaaagagaagacgcugaaauggcucgaaaagaaagugaaccagaccgucgcugcccugaagacaaauaacguuaauguguccucucgggugcagagcaccgcuuucuuuuccggagaccaagccagcacagauaaggaggaggacuacauucgcuaugcgcacggccuuaucucugauuacauccccaaagaacuguccgacgaucucagcaaguaccugaaacuuccugagccgucugccucccugcccaacccucccagcaagauggcugcccagagacagaaacgggggaaguga

SEQ ID NO: 74935 - RNA, 495 nt, Artificial Sequence
  derived and/or modified sequence opt5 from RNASEH2C__Homo_sapiens__NP_115569
auggagagcggcgacgaagccgcuaucgagcggcaccgggugcaucugcgcuccgccacccucagagaugcgguccccgcuacacugcaccuucugccuugcgaaguugccguggacgggccggcccccgugggacgguucuuuacgccugcuauucgccagggccccgaggggcucgaagucucuuucagaggacggugucugcgcggcgaggagguggccguuccucccgggcuugugggauacgucauggugaccgaagagaagaaaguuagcaugggcaagccugauccgcugagagacuccggcacagaugaccaagaagaggagccccucgaacgggauuuugaccgcuucaucggggcuaccgccaacuuuucuagauucacacuguggggacuggagaccauuccuggccccgaugcgaaagugagaggggcccucacauggccuagccuggcugccgcuauccaugcccagguccccgaagacuga

SEQ ID NO: 74936 - RNA, 414 nt, Artificial Sequence
  derived and/or modified sequence opt5 from RNASEK__Homo_sapiens__NP_001004333
augggcuggcugagacccgggccucggccgcucugucccccugcccgcgcuagcugggccuucucccacagauuucccucuccucuggcgccccggcgcagcccuaccccguucuuuauggcuucccuucugugcugcggacccaagcucgccgccuguggcaucgugcugucugcuuggggagucauuaugcuuaucaugcuggggauuuucuuuaacguucauagcgccgugcucaucgaggacgugccuuucacagaaaaagauuuugagaauggcccccagaacauuuacaaucuguaugaacaagucuccuacaacugcuucaucgcugccgggcuguaucuccugcuuggaggcuuuucuuucugucaggugagacugaauaagcggaaagaguacaugguucgcuga

SEQ ID NO: 74937 - RNA, 2226 nt, Artificial Sequence
  derived and/or modified sequence opt5 from RNASEL__Homo_sapiens__NP_066956
auggagagcagagaccacaacaauccccaggaaggcccuaccuccucuagcgggcggcgcgccgcuguggaggauaaccaucugcucaucaaggccguccaaaaugaagacguugaucuggugcagcagcuucuggagggaggcgcgaacgugaauuuccaggaagaggaagggggauggacaccgcuccacaacgcuguccaaauguccagagaagacauuguggagcugcuucugcggcauggcgccgaucccguucuccgcaaaaagaauggggccacgccuuuuauccuggcugccauugcuggaucugugaaacugcucaagcuguuccuuagcaaaggcgccgacgucaacgaaugcgauuuuuacggcuucaccgcguuuauggaggccgcuguguaugggaagguuaaggcccugaaauuccucuacaagagaggagcuaaugugaaccugcggcgcaaaacaaaggaggaccaggaaagacuucggaaaggcggggccaccgcgcugauggaugccgcugagaagggacacgucgaagugcucaagauccugcuggacgagaugggcgccgaugugaaugcuugugacaacauggggcgcaaugcccucauucaugcccugcuuuccucugaugacagcgacgucgaagcuaucacacaucugcuccuggaucacggagcggacguuaacgugagaggcgagcggggcaaaacaccccuuauccuggccguggagaagaaacaccucgggcugguccagcgccugcucgaacaggagcacauugaaaucaaugauaccgacuccgauggaaagaccgcucugcuucuggccguggagcucaaacugaagaaaauugccgaacuucugugcaagagaggcgcuagcacggacuguggggaucucguuaugaccgcccggcgcaacuaugaccauucucuggugaagguccugcucucccacggagcgaaagaggauuuucacccucccgcugaggacuggaagccucaaagcucucauuggggcgccgcccugaaagaucuucacagaaucuaccggccgaugauugggaagcugaaauucuuuaucgacgaaaaguauaagauugcugacacauccgagggaggcaucuaccucggcuucuaugaaaaacaggagguggccguuaagaccuuuugcgaagggagccccagagcucagcgcgaggugucuugucugcaguccagccgggagaacucccaucuggucacauucuacggaucugaaagccacagaggccaucuuuuugugugcgucacccucugugagcaaacgcuggaagccugccuggaugugcaccgcggggaggacguugagaaugaagaggaugaguucgcgcggaacgugcucuccagcaucuucaaagccguccaggagcugcaccuuucuuguggauacacacaucaggaccugcaaccucagaauauucucaucgauuccaagaaagcugcccaccuggcugacuuugauaagagcauuaagugggccggcgacccccaggaagugaaaagagaucuggaggaccuugggcgccucguucuguauguggucaagaaaggcucuaucagcuucgaggaucugaaggcgcaguccaacgaagagguggugcaacucucuccugacgaagagaccaaagaucugauucaucggcuuuuucaccccggagaacacguuagagacugccugagcgaccuccugggccauccguucuuuuggacaugggagucccgcuaccggacccugagaaaugucgggaacgagagcgauaucaagacccgcaagucugaauccgagauccuucggcuccugcagccuggacccagcgaacacucuaaauccuucgacaaguggacaacgaaaauuaaugagugugugaugaagaaaaugaacaaguuuuaugagaaaagaggcaauuucuaccagaacaccgugggggaucugcucaaguuuauccggaaucugggagaacauauugacgaggaaaagcacaaaaagaugaaacuuaagaucggcgauccuagccuguauuuccagaaaacauuucccgaccucgucauuuacguguauaccaagcugcaaaacacagaguaccgcaagcauuucccccagacccacuccccuaauaaaccgcagugcgauggggccggcggagcuucuggccuggccagccccgggugcuga

SEQ ID NO: 74938 - RNA, 771 nt, Artificial Sequence
  derived and/or modified sequence opt5 from RNASET2__Homo_sapiens__NP_003721
augagacccgccgcucugcggggcgcccuccuggggugccuuugucuggcgcuccugugccuuggaggcgcugacaagcgccugagagauaaccacgaguggaaaaagcucaucaugguucagcauuggccugaaaccgucugugagaaaauucaaaaugacugccgggauccgcccgacuacuggacaauccacgggcuguggccugauaagagcgaaggauguaaccgcuccuggcccuucaaucuggaggaaauuaaagaccuccugccugagaugagagccuauuggcccgauguuauccauucuuuuccuaaccggagccgcuucuggaagcacgagugggaaaagcauggcacgugcgccgcucagguggacgcccuuaauucccagaaaaaguacuuugggagaucucuggagcucuaucgggaacuggaucuuaacagcgugcugcucaaacugggaauuaagccguccaucaauuacuaucaggucgcugacuucaaagaugcccuggcgcgcguguacggcguuauccccaagauucaaugucucccucccucucaggacgaggaggugcagaccaucggccagauugaacugugccuuacaaagcaagaucagcagcugcagaacuguaccgagccuggggaacaacccagcccgaaacaggaggucuggcucgccaauggagcugccgaauccagaggccugcgggugugcgaggacgggccuguguuuuaucccccucccaagaaaacaaagcacuga

SEQ ID NO: 74939 - RNA, 699 nt, Artificial Sequence
  derived and/or modified sequence opt5 from RND1__Homo_sapiens__NP_055285
augaaggagagacgggcuccccagccuguggucgcccgcugcaaacugguucucgugggcgacgugcaaugugggaagaccgccaugcugcagguccuugcgaaagauugcuacccggaaacauaugugcccacgguuuucgagaacuacaccgcuugucuggaaacagaggaacagagaguggagcucagccugugggacaccuccggaucuccuuauuacgauaauguccggccccuuugcuauagcgacuccgaugccgugcugcucuguuuugacaucucucgcccugagacaguugauagcgcccugaagaaauggagaaccgaaauucuggacuacugccccuccacacgggugcuccugaucggcuguaagaccgaucuucgcacggaccugucuacccucauggagcugagccaccagaagcaagcuccuauuuccuaugaacaggggugcgccaucgcuaaacagcuuggagccgagauuuaccuggagggcagcgcguucacaucugaaaaguccauccacagcaucuuuagaaccgccucuaugcucugucugaacaaaccgagcccccugccucagaagucccccguccggucucucuccaaacgccugcuucaucugccuagcagauccgagcucauuucuagcacauucaagaaggaaaaagcuaaguccugcagcaucauguga

SEQ ID NO: 74940 - RNA, 735 nt, Artificial Sequence
  derived and/or modified sequence opt5 from RND3__Homo_sapiens__NP_005159
augaaggagagacgggccagccagaaacuguccucuaagagcaucauggaccccaaccaaaaugugaaaugcaagauugucguugugggcgauucccagugugggaaaaccgcucuccugcacguguucgccaaggacugcuuuccugaaaacuacgucccgacaguguucgagaauuauacggcgucuuuugaaaucgauacccagcgcauugagcuuagccugugggacacauccggaucucccuacuaugauaacguuagaccucucagcuaccccgacuccgaugcugugcugaucuguuucgacauuagccggccugaaacccuugauucuguccugaagaaauggaagggcgagauccaggaguuuugccccaauacaaaaaugcuccuggugggguguaaguccgaccugcgcaccgauguuagcacacucguggaacugucuaaccauagacaaaccccugucuccuaugaccagggagccaauauggccaaacagaucggcgcugccacguacauugagugcagcgcccuucagucugaaaacuccgugcgggauaucuuccacguggcuacccuggcgugugucaauaagacaaacaagaauguuaaacgcaacaagagccaaagagccaccaaacggauuucccauaugccgucucgccccgagcucagcgcuguggccacagaccugagaaaggacaaagcuaaguccugcaccgugauguga

SEQ ID NO: 74941 - RNA, 756 nt, Artificial Sequence
  derived and/or modified sequence opt5 from RNF103-CHMP3__Homo_sapiens__NP_001185883
auggagggcgaacuguacagcgcccucaaggaggaagaggcuuccgaaucugugagcuccaccaacuucucuggggagaugcacuuuuaugagcuggucgaagacacaaaagauggaaucuggcuuguucaggugaaugaguggagccugaagauuagaaaagaaaugcggguggucgaccgccaaaucagagauauucagcgggaggaggaaaaggugaaacgcuccguuaaggacgccgcgaagaaaggccagaaggaugugugcaucguccucgcuaaagagaugauuagaucucggaaggccgugagcaaacuguacgccuccaaggcucauaugaacagcguucuuauggggaugaagaaucagcuggccgugcuccgcgucgcuggaucucugcaaaaauccacggaagugaugaaggccaugcagagccuggugaaaauccccgagauccaggcgaccaugagagaacucucuaaggagaugaugaaagccggcauuaucgaggaaaugcuggaggacacauucgaauccauggaugaccaggaggaaauggaggaggaagcugagauggaaauugaucggauccuuuuugagauuaccgccggggcucugggaaaggccccuagcaaagucacagacgcgcucccggaacccgagccucccggcgccauggcugccucugaggaugaagaggaagaggaggaagcucuggaggccaugcaaucccgccuugccacccugagaagcuga

SEQ ID NO: 74942 - RNA, 2046 nt, Artificial Sequence
  derived and/or modified sequence opt5 from RNF103__Homo_sapiens__NP_001185880
augagcagacugcggccccgcccuccgcucauccacggcugcgggggauucuuugaggccauugugugguacgaaaccggcaucuucgcuacacagcuggucgaccccguugcccuuuccuuuaagaaacugaagacgauucucgaguguagagggcugggauauucuggccuuccugagaaaaaggaugugcgggaacugguggaaaaauccggggaccucauggagggagagcuguacuccgcgcugaaggaagaggaggcuucugaaagcgucuccucuaccaacuucagcggcgagaugcauuuuuaugaacucguggaggauacaaaggacggcaucuggcugguucaagugauugccaaugaucgcagcccccuugucgggaaaauccacugggaaaagauggugaaaaagguuagcagauucggaauccggaccggcacauuuaacuguucuuccgacccucgcuacugcagacggcgcgggugggugagaagcacccugauuaugucugucccccagacauccaccagcaaaggaaaggugaugcucaaggaguauucuggccggaaaaucgaaguggagcauauuuucaaguggaucacggcccacgcugccucccgcauuaaaaccaucuacaaugcugagcaucugaaggaagaguggaacaaaagcgaucaguauuggcuuaagauuuaccuguuugccaaucucgaccagccuccggcguucuuuuccgcccugucuaucaaauucacagggagagucgaauuuaucuucguuaacguggagaauugggauaacaagagcuacaugaccgacauuggaaucuauaauaugcccuccuacauucugcggacaccugaaggcaucuaucgcuacggcaaccacaccggggaguucauuagccuccaagcuauggauucuuuucugagaucccuucagcccgaggugaaugaccuguucguccucagccuggugcuuguuaaccugauggccuggauggaucucuuuaucacgcagggagcuacaaucaagcgguucgugguccugauuucuacccugggcacauauaauagccuccugaucauuuccuggcuuccugugcugggguuucuccagcugcccuaccuugacucuuucuaugaauacagccugaaacuccugagauacuccaacaccaccacacuggccagcuggguucgcgcggacuggauguuuuauucuucccacccggcccucuuccugagcacguaccuuggacauggccugcucaucgauuauuuugagaagaaacggagacgcaauaacaacaaugacgaagugaacgcuaauaaccuggaguggcugucuucccuuugggauugguacaccagcuaucucuuccacccuauugccuccuuucaaaauuuccccgucgaaucugacugggaugaggacccugaucuguuucuggagcggcucgcuuuccccgaccuguggcuucauccccugaucccuacagauuacaucaagaaccucccgauguggagauucaaaugccugggggugcagagcgaagaggaaauguccgagggaucucaggacaccgagaaugauagcgaauccgagaacacagacacccugagcucugaaaaggaggucuuugaagacaagcaguccgugcuucacaauagccccggcacggccucucacugugaugccgaggcuugcuccugugcgaacaaauauugccaaacaagcccuugugagcgcaagggccggucuuacgggagcuacaauaccaacgaagacauggagcccgauuggcucaccuggccugccgacaugcugcauugcacagaauguguugugugccuggagaauuucgaaaacggaugccuccugaugggccuucccugugggcacgucuuucaucagaauugcauugugauguggcuggcuggaggcagacacuguugcccgguuugucgcuggccuuccuauaaaaagaaacagcccuacgcccaacaucagccucucagcaacgaugugcccucuuga

SEQ ID NO: 74943 - RNA, 3081 nt, Artificial Sequence
  derived and/or modified sequence opt5 from RNF111__Homo_sapiens__XP_006720638
augcacguguucagccugaucgacggcuccucugggcucgccguccugagacuuagccugaaguuucccaugucccaguggaccccugaguacaacgaacucuauacacugaaaguugauaugaagucugagauuccgagcgacgcucccaaaacgcaagaaucccuuaagggaauccugcuccauccugagcccauuggcgccgcgaaaucuuucccugcugggguggaaaugaucaauagcaaggugggaaacgaguuuucccaccugugcgaugacagccagaagcaggagaaagaaaugaauggcaaccagcaagagcaggaaaagucucuggucgugcggaaaaagcgcaaaucccagcaggccgggcccagcuacguucaaaauugugugaaggagaaccagggcauucucggacugagacagcaucuuggcaccccuucugaugaggacaaugauuccagcuucucugacugccuguccagcccguccucuagccuccacuuuggggauuccgacacagucaccagcgaugaagacaaggaggugucuguucggcauucccagacaauccugaacgccaaaagccgcucucacagcgcuagaucccacaaguggccccggaccgaaacagagucugugagcggacuucugaugaaacgcccuugucuccauggcuccagccugagacggcugcccugccgcaagagauucgucaaaaauaacucuucccaacggacccagaagcagaaagaacgcauccucaugcaaagaaagaagcgggaggugcuggcccgcagaaaauaugcccuucugccuucuagcuccagcuccucugagaaugaucucagcuccgaaucuagcuccucuagcuccacggagggggaagaggaccuguuugugagcgccucugaaaaccaccagaauaaccccgcggucccguccggaagcauugacgaggauguuguggugaucgaggccucuagcaccccucaggucacagcuaaugaagagauuaacgugaccuccacagacagcgaaguugagaucgugaccgucggcgaaucuuaccgguccagaagcacgcuugggcauucccgcucucacuggagccagggauccucuagccacgccucccggccccaagagccuagaaaccgcucucggauuagcacagugauccagccccugagacagaaugcugccgagguuguggaucucaccgucgacgaagaugagcccacaguggucccuaccaccuccgcgcgcauggaaagccaggccacaucugcuuccauuaacaauagcaacccgucuacguccgagcaagccagcgacaccgcuucugccgugacauccagccagcccuccaccguuagcgagacaucugccacccugacgagcaauuccacaaccggcaccucuaucggcgaugacagccggagaacaaccuccucugcugugacagaaacggggccucccgcgaugccucgccugcccagcuguugcccgcagcauuccccuuguggaggcucuagccagaaccaccaugcccucgggcacccccauaccuccugcuuccaacagcacggacaccauuuucagcaccaucaccaccaucaccauacaccucaccccgcugucccugugagccccucuuucuccgauccggccuguccuguugagcggccuccccaggugcaagcccccugcggcgcuaauucuagcuccgggaccagcuaucaugaacagcaggcccugccggucgaccuuuccaacucuggaaucagaagccacggcuccggcagcuuucacggggcgucugcuuucgaucccuguugcccuguguccagcucucgcgccgccauuuuuggacaucaagcugccgcugccgcgcccagccagccucuguccucuaucgacggcuacgggagcuccaugguggcccagccccagccucaacccccgccucagcccucucucagcuccugccggcacuauaugccucccccguacgcuagccugacaagaccucuucaucaccaggccucugcuuguccccauucccacggaaauccuccuccccagacccaacccccgccccagguugacuacgucauuccucaccccgugcaugccuuccacagccagaucuccucucaugcgacgagccacccuguggcucccccuccgcccacccaccuggcuuccacagccgcuccuauuccccagcaucucccucccacccaccaaccgaucucucaucacaucccugccacagccccucccgcucagcggcugcauccccacgaggucaugcagcgcauggaagugcaaagacggagaaugaugcagcaccccaccggccuguucguguuuugcguuagccgccgggcgcaugagagaccuccgccccacccucaucgcaugcaccccaacuaugggcacggccaucacauucaugucccucagacgauguccagccaccccagacaggccccggagcggucugcuugggaacucggaaucgaggccggcgugacagccgcuaccuacacaccuggggcccugcauccccaccuugcgcacuaucaugcuccuccccgccugcaccaucuccaacugggagcccugccucuuaugguucccgauauggccggcuacccgcacauuagauauaucuccagcgggcucgacggaaccucuuuccggggcccuuuucgcgggaauuucgaggaacugauucaccuggaagagagacucggcaacgugaaucggggagcuucccagggcaccaucgagcgcuguacauacccccauaaguauaaaaaggucacgaccgauugguuuagccagagaaaacugcacugcaagcaggacggggaagagggaacagaagaggauaccgaagagaaguguacaaucugccuuucuauucuggaggaaggcgaggacgugcggcgccuccccuguaugcaucuguuccaccaaguuugcguggaucaguggcugaucaccaacaaaaaguguccuauuugcagagucgacaucgaagcccagcuuccgagcgaguccuga

SEQ ID NO: 74944 - RNA, 1896 nt, Artificial Sequence
  derived and/or modified sequence opt5 from RNF112__Homo_sapiens__NP_009079
augcccagaccugcccugagcgugaccuccuucugccaccggcucggcaagcgcgagagaaaacagucuuuuauggggaacagcggaaauuccuggucucauacaccguuccccaagcuggaacuuggccuggggccucaacccauggcuccucgggagcuccccacguguagcaucugccuggaacgccuuagagacccuauuucccuggauuguggacacgacuuuugcauccgguguuucucuacccaucgccucccgggcugcgagcccccuuguugccccgaauguagaaaaauuugcaagcagaaacgggggcugcgcagccugggagagaagaugaagcuccugccucagagaccccuuccgccugcccugcaggagacaugucccguccgggcggaaccucuccugcuuguucgcaucaacgcuuccggcggccugauucucagaaugggggccaucaaucggugccugaaacacccccuggcccgcgauacccccgugugccuccuggcugugcuuggagagcaacauagcggcaagucuuuucugcucaaccaucugcuucaggggcugccuggacucgaauccggcgaagggggaagaccgcggggcggcgaggccagccugcagggguguagauggggagcuaauggccuggcccgcgggaucuggauguggucucaccccuuccuccugggaaaagaaggcaagaaagucgcgguguuucuuguugacacaggggaugccauguccccugagcugagccgggaaaccagaauuaagcucugcgcucugacaaccaugcuuucuuccuaccagauccugagcacgucccaagagcucaaggacaccgaucuggacuaucuggaaauguucgugcacgucgccgaggugaugggaaaacacuacggcaugguucccauucagcaucucgaucugcuugugcgcgacucuagccacccuaacaaggcuggccaggggcacgucggaaauaucuuucagcggcuguccggcagauaucccaaagugcaagagcuccugcaggggaagcgcgcccgguguugccugcuuccggcgccuggaagacgccggaugaaccagggccaugccagccccggggauacagacgaugacuucagacaccuccugggcgcuuacgugucugacguccuguccgccgcuccucaacaugccaaaagccgcugucagggauauuggaaugaaggccgggccguugcuagaggggaucggcgccuccugaccggacagcagcuugcgcaagagauuaagaaccugucuggcuggauggggagaacaggacccggcuuuaccagcccugacgaaauggccgcucagcuccacgaucugcggaaaguggaggccgccaagagagaguucgaggaguacgugcgccagcaggacgucgcuacgaagcggaucuuuuccgcccugagagugcuucccgauacaaugcgcaaucuccugucuacccaaaaagacgcgauucuggcuagacaugggguugcccuccugugcaagggccgggaucagacacuugaagcccuggaggcugaacuccaggccaccgcuaaagccuucauggacagcuauaccaugcgcuucuguggacaccuggcggccgugggcggggcugucggagccggccugauggggcuugcuggaggcgugguuggggccggcauggcggccgcugcccucgcugccgaggccggaaugguggcugcgggcgccgcugucggggccacaggagccgcuguggucggcgggggagugggcgccgggcuggcggcuacgguuggcugcauggaaaaggaggaggaugaaagacugcucgagggagaccgggaaccgcugcuucaggaggaguga

SEQ ID NO: 74945 - RNA, 687 nt, Artificial Sequence
  derived and/or modified sequence opt5 from RNF114__Homo_sapiens__NP_061153
auggccgcucagcaaagagacugcggcggggccgcgcagcuggcuggacccgccgccgaggcugauccucucggccgguucaccuguccggugugccuggaagucuacgagaagcccguucaggugccuugugggcacguguuuugcagcgccugucuucaggaaugccugaaacccaagaaaccugucuguggagugugccgcuccgcucucgcccccggcguuagagcgguggagcuggaacggcaaaucgagucuacagagacgagcugucaugggugccgcaagaacuucuuucuuuccaaaauuagaucucacgucgccaccuguagcaaguaucagaauuacaucauggaaggagugaaggcuacaauuaaagacgccucccugcagccucggaacguuccgaaucgcuauaccuuccccugcccuuacugccccgagaagaacuuugaucaggaaggccucguggagcauuguaaacuguuccacucuacagacaccaagagcgucgugugcccuaucugugcuuccaugcccuggggcgauccgaauuauagaagcgccaacuuucgggagcauauucaacgcagacaccgguucucuuacgacacauuuguggauuaugacgucgaugaagaggacaugaugaaucagguucugcagcgcuccaucaucgaucaguga

SEQ ID NO: 74946 - RNA, 3945 nt, Artificial Sequence
  derived and/or modified sequence opt5 from RNF123__Homo_sapiens__NP_071347
auggccagcaagggcgcugggauguccuucucuagaaaaagcuaccggcugaccuccgacgccgagaagucucgcgugacaggaaucguccaggaaaaacuccugaacgauuaucuuaauagaauuuuuagcuccucugagcacgcgcccccugcugccacgagccggaagccgcugaacuuccaaaaucuccccgaacaucuggaccagcuucugcagguugauaacgaggaagaggagucccagggccaaguggaagggcgccucggaccuagcaccgugguccuggaccacacaggcggguuugagggacugcuccugguggaugacgaucuucugggcguuaucggccauucuaauuucgggaccauuagauccacaaccugcguguacaaaggaaaguggcucuaugaaguccugaucagcucucagggccuuaugcagauugggugguguacaaucuccugccgguuuaaccaggaggagggagugggcgacacccacaauagcuacgccuaugaugggaaccgcguuagaaaguggaaugugacgaccacaaacuacggaaaggcuugggccgcuggcgacaucgucucuugucugauugaucucgacgauggcacccuguccuucugccugaauggggugagccucggaacagccuuugaaaaccugucccggggccuugggauggcguauuuccccgccaucucucugagcuuuaaagaguccguggcuuucaauuuuggaagccgcccucucagauaccccgucgccggcuaccggccucugcaagacccgcccucugcugaccuuguucgcgcccagagacugcucggguguuuccgggcggugcuguccguggaacuggauccugucgagggacgccuccuggacaaagaaagcucuaaguggagacuucggggccagcccaccgugcugcucacgcuggcccauauuuuucaccacuucgcuccucuucugagaaaaguuuaucucguggaggccguccugaugagcuuccugcucggcaucguggagaaggggacacccacccaggcucaauccguugugcaucagguccuggaucuucuguggcucuuuauggaagacuacgaggugcaggauugccugaagcaacugaugaugucucuucuccgccuguaucgguucagcccgauugucccugaccugggacuccagauccacuaccugagacuuacaauugccauccugcgccaugaaaaaucccggaaguuucuccugagcaacgugcuguucgauguucuuagaucuguggucuuuuucuauaucaaaagcccccuccgcguggaggaagccggccugcaggagcugauuccuaccaccugguggccccacuguuccucucgggaggggaaggaauccacagagaugaaagaagagacggcugaagagagacuccgccggagagcguacgagcgcggaugccagcggcugagaaagcggaucgaaguuguggaggaacuucaaguccagauucugaaacuccugcuggacaauaaggaugacaacggcggggaggccagccgcuauaucuuucuuaccaaguucagaaaauuucuccaggagaacgcuuccggccggggaaauaugcccaugcuguguccuccggaauacauggugugcuuccugcacagacucauuucugcccugcgcuacuauugggaugaguacaaggccagcaacccccaugcuuccuuuucugaagaggccuauaucccuccccagguguucuacaauggcaaaguugacuauuuugaccuucaacggcuugggggacuccugagccaccugagaaagacacuuaaagaugaccucgcguccaaggcuaacaucgucauugauccucuggaacugcagagcaccgccauggacgaucucgacgaggaugaggaacccgccccggcuauggcccagcgcccuaugcaggcucuggccgugggcgggccccuuccucugcccagaccuggauggcucucuucccccacacugggccgggcgaaucgcuuccugagcaccgccgcugugucucuuaugacgccgagacggccucuguccacaagcgagaaggucaaagugcgcacccucucuguugaacaaagaacccgggaggacaucgaagggagccauuggaacgagggccugcuccugggacgcccucccgaggaacccgagcagccgcuuacagaaaauucccugcucgaggugcuggauggcgccgucaugauguacaaccugagcgugcaccagcagcuugggaagaugguuggagugucugacgaugucaaugaauaugcuauggcccugagagacaccgaggauaaacuccggcgcugucccaagagacggaaagacauucuggcggagcucacaaagucccaaaagguguucagcgaaaaacuggaccaucuuuccagacgccuggccuggguucacgcuacgguguacucucaggagaagaugcucgauaucuacuggcugcugcgggucugccuuagaaccauugaacacggcgaccgcacagggagccuguuugccuucaugccugaguuuuaucucuccguggcuaucaacucuuacagcgcccugaaaaauuauuucggacccgugcauuccauggaggaacucccuggcuacgaggaaacccugacacggcuugccgcuauccuggcgaagcacuuugccgaugcuagaauugucgggaccgacauccgcgauucucugaugcaggcccucgccagcuauguuugcuacccccauucccugcgggcuguggagcgcauuccugaggaacaaagaaucgccauggugcggaaccuucuggcgcccuaugagcagagaccgugggcucagacgaauuggauucucguccggcuguggcgcggcuguggauucggcuacagauacacccggcucccucaucugcuuaaaacaaagcuggaagacgccaaccugcccagccuccagaagccuugccccucuacccugcuucaacagcacauggccgaucugcuccagcaggggccggacguggcuccuuccuuucugaauagcguucucaaccaacugaacugggccuucucugaguuuaucggaaugauucaggaaauccagcaggcggcugagcgccuugaaagaaauuucguggauucccggcaacugaaagucugugccacaugcuuugaccugagcgugucucuccugagaguucuugagaugaccaucacgcuggugcccgagauuuuccucgauuggacacgcccuaccuccgaaaugcugcuccggagacuggcccagcuucugaaccagguccugaaucgcgugacagcugagcggaaccucuuugacagaguugugacccugcgccuucccggccuggaaagcgucgaucacuaucccauccucguggccgugaccgggauucugguccaacugcucguucggggaccugcuuccgagagagaacaggccacaagcgugcuucuggcggacccguguuuccagcugcgcucuaucugcuaccuccugggccagcccgagccucccgccccugggacggcucugcccgccccugacagaaagcgguucagccugcaauccuaugcugauuacauuucugccgacgagcucgcccagguggaacagaugcuggcucaccugaccagcgcguccgcccaggcugccgccgcuucucucccgacaagcgaggaagaucuuugucccaucugcuaugcccauccuaucuccgcggucuuucaacccuguggccacaaaucuugcaaggcuuguauuaaucagcaucugaugaacaauaaagacugcuucuuuugcaagaccacaaucgugagcguugaggauugggagaaaggagccaacaccuccacgacaagcucugccgcuuga

SEQ ID NO: 74947 - RNA, 699 nt, Artificial Sequence
  derived and/or modified sequence opt5 from RNF125__Homo_sapiens__NP_060301
augggcagcgugcuguccaccgacucuggaaagagcgcccccgcuuccgccacagcgagagcucucgagcggcgcagagauccugaacugccggucacgucuuucgacugcgccguuugucuugaggugcugcaccagcccgugcggacccgcugcgggcaugucuuuuguagaagcugcaucgccacaucccucaaaaacaauaaguggaccuguccuuacugccgggcuuaucugcccucugaaggcgugccugccacagauguugcuaaacgcaugaaaagcgaguacaagaacugugccgaaugcgacacccuugugugucuguccgagaugagagcgcacauucggacaugccaaaaguauaucgauaaguacgggccccuccaggagcuggaagagaccgccgcucgcugugucugcccuuucugccagagagaacuguaugaggacagccuccuggaucauuguauuacgcaccaucggucugagcgcagaccgguguuuugcccccuuugucggcugaucccugacgaaaaucccuccagcuucucuggaucccucauucgccaccuucagguuagccacacccuguuuuacgaugacuucaucgauuuuaacaucauugaggaagcccugaucagacgggugcucgacagaucucugcuggaguaugucaaucauuccaacacaaccuga

SEQ ID NO: 74948 - RNA, 1209 nt, Artificial Sequence
  derived and/or modified sequence opt5 from RNF128__Homo_sapiens__NP_078815
augaaccaggagaauagaagcuccuucuuuuggcugcucgugaucuucaccuuucugcuuaagauuacagccucuuucagcauguccgcuuacgucacgguuaccuauuacaacgaaacaucuaauuauaccgccaucgagacaugcgaauguggcguguacgggcuggcgagccccguggcuaacgccaugggagucgugggcauuccuaaaaauaacaauuaucaagccugcgaccacaacaccgaguuuuccaauacaaagaaaccguggaucgcucucauugaacgggggaacuguaccuucucugagaagauccagacggccggacgcagaaaugcugaugccguugugaucuacaacgcgcccgagaccggcaaucagacaauucagauggccaacuuuggggcugucgacaucguggccauuaugaucggaaaucugaaaggcaccaagauucuucaaagcauccagcggggcauucagguuacaauggugaucgaagucgggaagaaacauggaccuugggugaaccacuauuccaucuucuuugugagcgucucuuucuuuauuaucaccgcugccacgguuggcuacuucaucuuuuacuccgcgcgcagacugcggaacgcccgcgcucagagcagaaagcaacggcagcucaaagccgaugcuaagaaagccauugggcgccugcagcugagaacacucaagcagggagacaaggagauuggccccgauggggacucuugcgccguguguaucgaacuguauaaaccuaaugaucuugugcggauccugaccugcaaccauauuuuccacaagacaugugucgaccccuggcuccuggagcauagaaccugcccuauguguaaaugcgauauccuuaaggcucugggaauugagguggacguugaagauggcuccgugagccuccaagucccggugucuaaugagaucuccaacagcgcguccucucacgaagaggacaaucgcagcgaaaccgccuccagcggcuacgcuucuguucaggggacagaugagcccccucuggaggaacacgugcaguccacgaacgagagccugcaacucgucaaucaugaagccaacucuguggccgucgacgugauuccccacguugacaauccuaccuucgaggaagaugagacacccaaccaggagaccgcugugcgggaaaucaaaagcuga

SEQ ID NO: 74949 - RNA, 1260 nt, Artificial Sequence
  derived and/or modified sequence opt5 from RNF130__Homo_sapiens__NP_060904
augagcugcgccggcagagcugggcccgcccggcuggcggcucucgcccugcuuaccuguucccuguggccugcccgcgcugacaacgccucucaggaguacuauacagcucucaucaaugugacgguccaagaaccgggaagaggcgcgccccugaccuuccggauugaucgcgggagauacggacuugacagcccuaaggccgagguucggggccaggugcuggcuccccucccucugcacgggguggccgaucaucugggaugcgacccccagacacgcuuuuucgucccuccgaacaucaaacaguggauugcccuccugcaaagaggcaauuguaccuuuaaggagaaaaucucccgggcugccuuccacaacgcgguggccguugugauuuauaauaacaagucuaaagaagaacccgucacaaugacccauccuggcacaggggauaucaucgcugugaugauuaccgagcuucgcggaaaggacauccugagcuaccucgagaagaauauuuccguucagaugacgaucgccgugggcaccagaaugcccccuaaaaacuuuucucgggggagccuggucuucguguccauuagcuuuaucgugcuuaugauuaucucuuccgcuuggcugaucuucuauuuuauucagaagauccgcuacacaaaugccagagaucggaaccagcgcagacucggagacgccgcuaaaaaggcgauuagcaaacugaccacacggaccgucaagaagggcgauaaagaaacggaccccgauuucgaccacugcgccguuuguaucgagucuuauaagcaaaaugauguggugcgcauucugccgugcaaacaugucuuucacaaguccuguguggacccuuggcucagcgaacacugcacaugucccaugugcaaacugaacauccuuaaggcucuggggaucguuccuaaucuccccuguaccgacaacguggccuucgauauggagagacugacacggacccaggccgucaauagacgcucugcucuuggagaccuggccggcgauaacucccucggccuggagccccugcggaccagcgggauuuccccucucccgcaggacggagaacugacacccagaacgggcgagaucaacauugcggugaccaaagaaugguuuaucauugcuucuuucgggcuucugagcgcccucacacugugcuacaugaucauccgcgccaccgcuucccuuaaugccaacgagguugaaugguucuga

SEQ ID NO: 74950 - RNA, 861 nt, Artificial Sequence
  derived and/or modified sequence opt5 from RNF135__Homo_sapiens__NP_001171921
auggccggccuggggcucggaagcgcugugcccgucuggcuggccgaggacgaucuuggcugcaucauuugucaggggcugcucgacuggccugcgacccugccgugcggacacuccuucuguagacauugccuugaagcucuguggggcgcccgggaugcccgcagaugggcuugucccacaugccggcaaggggccgcucagcagccucaccuccgcaagaacacgcugcugcaggaccucgccgauaaauacagacgggcggcccgcgagauccaagcuggaucugaccccgcccauuguccuugccccggcagcuccucucugagcuccgcugccgcgagaccucggcgcagaccggaacuucagcggguugccguggagaagucuauuaccgaaguggcucaggagcugacagagcucgucgaacaccugguggauaucguucgcagccuucagaaucaaagaccccuguccgagagcggcccugacaacgaacucucuauucuggggaaagccuuuuccagcggaguggaucugucuauggcuucccccaagcucgucaccagcgacacagccgccggcaaaauccgggauauccugcaugaccuugaggagauucaggaaaagcugcaggagucugugaccuggaaggaagcuccugaggcgcagaugcaagggucccuccugccccgccuugaauguagcggaacaaucaccgccgcuuccauuucucaggcccaggagaauagcuggaaaccgagacugccuccccacgcccacugccucacgcgggcuacccugcauuccggcgagcugcucgggcugcuuagcggaccuucuauccaaccccugacauga

SEQ ID NO: 74951 - RNA, 738 nt, Artificial Sequence
  derived and/or modified sequence opt5 from RNF138__Homo_sapiens__NP_057355
auggccgaggaccugagcgcugccaccuccuacacagaagaugacuucuauugccccgugugucaggagguccucaagacgccuguuagaaccacagcgugccaacacguguuuugucggaaaugcuuccugaccgcuaugcgcgaaucuggcgcccauuguccgcuuugcagagggaacgugacacggcgcgagagagccugucccgaacgggcucuggaucucgagaauaucaugcgcaaguuuagcggauccugcagauguugcgccaaacagauuaaguucuaccggaugcgccaccauuauaaaucuuguaagaaguaccaggacgaguauggcgucagcuccaucauuccuaacuuucagaucucucaagauagcguggggaauagcaacagaagcgaaaccucuacauccgacaauaccgagacguaccaggaaaacaccuccucuuccggacaccccacauucaaaugcccucugugccaggagagcaauuuuacccggcagcgccuucuggaucauuguaacucuaaucaccucuuccaaauuguucccgugacaugcccuaucugugucucccugccguggggcgaccccagccagaucaccagaaacuuugugucccaccugaaucagcggcaucaguucgauuauggggaguuuguuaaccuccaacuggacgaagagacgcaguaccagacagcuguggaagagucuuuccaagucaauauuuga

SEQ ID NO: 74952 - RNA, 1995 nt, Artificial Sequence
  derived and/or modified sequence opt5 from RNF139__Homo_sapiens__NP_009149
auggccgcugugggacccccucagcaacaggucagaauggcccaccagcagguuugggcggcucuggagguggcccuccgggugccgugccuguacaucauugacgccaucuucaacagcuaucccgauuccucucaaagccgcuuuuguauuguccuucagaucuuccugagacucuuugggguguucgcuuccucuauuguucugauccuuagccagcggucccuguuuaaguucuacaccuauucuagcgccuuucuccuggcugccacauccgugcuggucaauuacuaugcgagccuccauaucgacuucuacggagccuauaacacgucugcuuuuggcauugaacugcuuccucgcaaagggcccucccuguggauggcccucaucgugcugcagcuuaccuucggaauuggcuacguuacacugcuccaaauccacagcauuuacucucagcugaucauucuggaucuccuggugccugucaucgggcuuaucaccgagcugccccuccauauuagagaaacacugcuuuuuaccuccagccugauccucacacugaauaccguguucgugcuggcugucaagcucaaaugguuuuauuacucuacgcgguauguuuaccugcuugugcgccacauguauagaauuuacggacugcagcuccugauggaggacaccuggaagcggauccgcuucccugauauucuuagaguguucuggcugacacgggucaccgcccaggcgacagugcucauguauauccugcgcauggccaacgaaaccgacuccuuuuucaucagcugggaugacuuuugggaucugauuugcaaucucaucauuuccggcugugacucuacgcugacaguucuuggcaugagcgcugugaucuccagcgucgcccauuaccuggggcucggcauucuggcuuucaucggcucuaccgaggaggaugacagacggcugggguuuguggccccgguucuuuucuuuauccucgcccugcaaacaggacuguccggccuccgccccgaagagagacugauucggcuuagcagaaacaugugccugcuccugaccgcugugcugcacuucauccacgggaugaccgauccuguccuuaugucucucagcgcgucccaugugucuagcuuucgccggcacuuccccguccuguuuguguccgccugucuguucauucucccuguucugcuuagcuacgugcuguggcaucacuaugcucucaauacauggcuguuugccgucacggccuucugcguggaacugugucuuaaaguuaucgugucucucaccgucuacacacuguucaugauugacggauauuacaacgugcugugggagaagcucgacgauuauguguacuauguuagauccaccggcagcaucauugaguuuaucuucggcgucgugauguuugggaauggagcuuacacaaugauguucgaaucuggcuccaagauccgcgccuuuaugaugugccugcacgcguacuucaacauuuaucuucaggcuaaaaauggguggaagaccuuuaugaaccggagaacggccgugaaaaagaucaauagccugcccgagauuaaaggaucccgccuccaggaaaucaacgacgucugugccauuugcuaccaugaguucacaaccucugcucggaucaccccguguaaucacuauuuucaugcccugugccugagaaaguggcuuuacauccaagauacaugcccuaugugucaccagaagguguauauugaagacgauaucaaagacaacagcaacguuuccaauaacaauggcuucauucccccuaacgagacccccgaggaagcugugcgcgaggccgcggccgaaucugaucgggagcucaaugaagacgauagcacagacugcgaugacgacguccagagagagcgcaacggggugauccagcauacgggagcugccgcugaggaauuuaaugaugacaccgauuga

SEQ ID NO: 74953 - RNA, 879 nt, Artificial Sequence
  derived and/or modified sequence opt5 from RNF144A__Homo_sapiens__XP_005246259
augaccacaacgagauaccggcccaccugggaccuggcccucgauccucuggugagcugcaagcucugucugggcgaguauccggucgaacagaugacaaccaucgcucaaugccaguguauuuucugcacacucugucugaaacaguacguugagcuucugaucaaggaagggcucgagaccgccauuuccugccccgacgcggcuuguccuaaacagggacaucugcaagaaaacgagaucgagugcaugguggccgccgaaauuaugcagcgcuauaagaaacugcaguuugagagagaagugcuuuucgaucccugucggacauggugcccugcuucuaccugucaggccgucugccaacugcaggacgugggccuucagacgccccagccuguucaaugcaaggcuugucgcauggaguuuugcagcaccuguaaggccuccuggcacccggggcagggaugccccgagacaaugccuaucaccuuccugcccggcgaaacaucugcggccuuuaaaauggaggaagaugacgcuccuaucaagagaugucccaaaugcaagguguacauugagcgggaugaagggugugcccagaugaugugcaaaaauuguaagcacgcuuucugcugguauugucucgagagccuggacgaugacuuucuucugauccauuacgauaagggaccgugccgcaacaaacucggccacuccagagccucugucauuuggcaucggacccaagugguuggcaucuucgcgggguuuggacugcugcuccugguggccagcccuuuccuucugcucgcuacgcccuuuguccugugcuguaagugcaaauguuccaagggcgacgaugacccucuucccacauga

SEQ ID NO: 74954 - RNA, 912 nt, Artificial Sequence
  derived and/or modified sequence opt5 from RNF144B__Homo_sapiens__XP_005249041
augggcagcgccgggagacugcacuaccucgcuaugaccgccgagaaccccacaccuggagaccuggcgccggcuccccuuaucacgugcaagcugugucucugcgaacagucccuggauaaaaugaccacacuucaagagugucagugcauuuucuguaccgccugccugaagcaguauaugcagcucgccauccgggaaggcugugggucuccuauuacaugccccgacauggugugucugaaucauggaacccugcaagaggcugaaaucgccugccucgucccuguugaucaguuucagcuguaccagcgccuuaaauucgagagagaggugcaccuggaccccuaucggacaugguguccuguggcugauugccaaaccgucugcccgguggccagcuccgaccccggccagccuguucucguggaaugucccucuugccaucugaaguuuuguagcugcuguaaagaugcguggcacgccgaggucuccugccgcgacucucagccuauugugcuucccacggaacauagagcucuguucgggaccgaugccgaggcuccgaucaagcaguguccuguuugccggguguacaucgagcgcaacgaaggaugugcccaaaugaugugcaagaauuguaaacacacauuuugcugguauugccuccagaaccuggacaaugauauuuuccugagacacuacgacaagggccccugucggaacaaacucggccauagccgcgcguccgucauguggaauagaacccaggugguggggauccuggucggacuuggcauuaucgcccugguuacaagcccucuccugcuucuggcuucucccugcauuaucuguugcguguguaaguccugccgggggaaaaagaagaaacacgaucccagcaccacguga

SEQ ID NO: 74955 - RNA, 1080 nt, Artificial Sequence
  derived and/or modified sequence opt5 from RNF146__Homo_sapiens__NP_001229778
augauggccggcugcggggagaucgaccacagcauuaacaugcugcccaccaauagaaaggcuaacgaauccuguucuaauacagccccuagccucacggugccggagugcgcgaucugucugcagaccugcguccaucccguuucccuuccuuguaaacacguguucugcuaccugugugugaagggagcuucuuggcucggcaaacggugcgcccugugucgccaagaaauucccgaggauuuucuugacaagccuacacugcucagccccgaggaacugaaagccgcuuccagagggaacggagaguaugccugguacuaugaaggccggaaugggugguggcaguacgaugagcgcaccucuagagaacuggaggacgcuuucagcaagggaaagaaaaacacagagaugcucaucgccggcuuucuguaugucgcggaucuugaaaauauggugcaguaccggcgcaacgagcauggcagacggcgcaagauuaaaagagacaucaucgauauuccuaagaaagggguugccggacugcggcucgacugcgaugcuaauaccgugaaccuggcccgcgaauccagcgcugacggcgccgauucugucuccgcgcagagcggggccucugugcaaccgcuuguuuccagcgugagaccccugacaucugucgacggacagcucaccuccccugcuacgcccagcccugaugccuccaccucucuggaggacagcuucgcucaucugcagcucuccggcgacaauacagccgaacggagccaccgcggggagggagaggaagaucacgagucucccuccagcggcagagugccggccccugacaccucuaucgaagagacagaaagcgaugcuuccucugacagcgaggauguguccgcggucguugcccagcacagccugacccaacagcggcuucuggugucuaacgcuaaucagacggugcccgacagauccgaucgcagcggcacagaccggucugucgccgggggaggcaccguguccguuagcgugagaucccgccggccugaugggcaguguacagucaccgagguguga

SEQ ID NO: 74956 - RNA, 1203 nt, Artificial Sequence
  derived and/or modified sequence opt5 from RNF149__Homo_sapiens__NP_775918
auggccuggagacggcgcgaggcuagcgugggcgccagagggguccuggcgcucgcucugcuugcccuggcccucugcguucccggagcucggggccgcgcccuggaaugguucuccgcuguggugaacaucgaguacgucgacccucagaccaaucuuacaguguggucuguuagcgaauccgggagauuuggagauucuagcccgaaggagggcgcccacgggcuggugggaguccccugggcgccuggcggcgaccucgaagggugugcccccgauacgcgguucuuugugccugagcccggaggccgcggggcugccccuuggguugcucugguggccagaggaggcugcaccuucaaagacaagguccugguggcggcccggcgcaacgcuuccgccgugguccucuauaaugaggaaagauacgggaacauuacacugccgaugucucaugcuggaaccggcaauaucguugugauuaugaucagcuaucccaaaggccgggagauucuugaacuggugcaaaaggggaucccugucacaaugaccaucggagugggcacacgccacguucaggaguuuauuuccgggcagagcguggucuucguggccaucgccuuuauuaccaugaugaucauuucucucgcuuggcugaucuucuacuauauucagagauuucuuuacacgggaucccaaaucggcagccagucucaucggaaagagaccaagaagguuaucgggcagcugcuccugcacacagugaaacauggagaaaagggcauugaugucgacgcggagaacugugccgugugcaucgaaaauuucaaagucaaggauauuauccgcauucugcccuguaaacacaucuuucacagaaucugcauugacccuuggcuccuggaucaucggaccugucccaugugcaaacuugacgugaucaaggcucugggcuauuggggagagccgggggauguucaggaaaugccugcccccgaguccccucccggcagagaccccgccgcuaaccucagccuggcccuuccugaugacgacgggucugaugacuccagcccgcccuccgcgucuccugcugagagcgaaccccaaugugauccuuccuucaagggagacgccggcgagaauacagcccugcucgaagcugggcgcagcgauucucggcacggcggacccauuuccuga

SEQ ID NO: 74957 - RNA, 1047 nt, Artificial Sequence
  derived and/or modified sequence opt5 from RNF14__Homo_sapiens__XP_005268598
augcaguuccugaaggaggaaacccucgccuaccugaacaucgugagccccuuugagcuuaaaauuggcucccaaaagaaaguccagagacggacagcucaggccucuccuaauacggaacuggacuucgggggagcggcuggcagcgauguugaccaggaggaaaucguggaugagcgcgccgugcaagacgucgagucccucucuaaccugauucaggaaauccuugauuuugaccaggcccagcaaauuaagugcuucaauagcaaacuguuucucuguuccaucugcuucugugagaagcuggggucugaaugcauguauuuucuggaguguagacacguguacugcaaggcuugucucaaagauuauuucgagauccagauucgggacggacagguucagugccugaacuguccggaacccaagugcccuagcguggccacccccggccaagucaaagagcuuguggaagcugagcuguuugcccgcuacgauagacuccugcuucaguccagccuggaccucauggcggauguuguguauuguccucggcccugcugccagcugccugucaugcaagaaccgggguguacaaugggaaucuguucuuccugcaauuucgccuuuugcacccugugucgccucacauaccauggcgugagccccugcaaggugaccgcugagaaacugauggaccuuagaaacgaguaucugcaggccgaugaagcuaauaagcggcuccuggaccagcgcuacggcaagagagucauucagaaagcccuugaggaaauggagucuaaggaauggcuggagaaaaacuccaagagcuguccuugcugugggacacccaucgagaaacucgacggaugcaauaagaugaccuguacgggcugcaugcaauacuucugcuggauuuguauggggucucugucccgggcgaacccuuauaaacacuuuaaugaucccggaagcccgugcuucaaccgccuguucuacgccguugacguggaugacgauaucugggaagacgagguggaagauuga

SEQ ID NO: 74958 - RNA, 1317 nt, Artificial Sequence
  derived and/or modified sequence opt5 from RNF150__Homo_sapiens__NP_065775
auggccaugagccugauccaggcuugcuguucccucgcccugucuaccuggcuucugagcuucugcuuugugcaccuccugugucuugacuucacagucgcggagaaggaagagugguacacggcuuuuguuaacauuaccuaugccgaacccgccccugauccgggcgcuggggccgcuggaggcgggggagccgagcugcauacagagaaaaccgaaugcggcagauacggggagcacucccccaagcaagacgcgcggggagaaguggugauggccucuagcgcucaugaucgccucgccugugacccuaauacaaaauucgcugcccccaccagaggcaagaacuggaucgcgcugauuccuaaaggcaauugcacauaucgggauaagauccgcaacgccuuucugcagaaugcuuccgccgucgugauuuucaacguugggucuaauaccaacgagacgaucaccaugccccacgcuggaguggaagacaucgucgccauuaugaucccugagccgaagggcaaagagauugugagccuccuggaaagaaauaucacaguuaccauguacauuacaaucgggacccggaaccuucagaaguaugugucccgcacgagcgucguguuugugucuauuuccuucaucguccugaugaucauuagccucgccuggcugguguuuuacuauauccagagauuccgguacgcuaaugcgcgcgauagaaaccaacggcgccuuggagacgccgcuaaaaaggccauuucuaaacugcagaucagaacaauuaagaagggcgauaaagagaccgaauccgacuuugauaauugugccguuugcaucgagggguacaagcccaacgacgugguccggauccucccuugucgccaucuguuccacaaaagcugcguggaucccuggcugcucgaccacagaacauguccuaugugcaagaugaauauucugaaagcucuuggaaucccgcccaacgccgacugcauggaugaccugccuaccgauuuugaaggcucucucggcgggcccccuaccaaccagauuacaggagcguccgacacgaccguuaaugagagcuccgugacacuggaucccgcuguccggaccgugggcgcccuucagguugugcaagacacagaucccaucccucaggagggggacgucauuuucaccacgaacucugaacaggagccggccgugagcuccgauagcgacaucucucugaucauggcuauggaagucggacucuccgauguggagcugagcacagaccaggacugugaagagguuaagucuuga

SEQ ID NO: 74959 - RNA, 612 nt, Artificial Sequence
  derived and/or modified sequence opt5 from RNF152__Homo_sapiens__NP_775828
auggagacccugagccaggacucccuccuggaaugccaaaucuguuucaacuacuauucucccagacggcgcccuaaacuucuggauugcaagcacacauguugcagcgugugucuccagcagaugagaacgucccagaaggacguccggugcccguggugucgcggcguuaccaaacugcccccuggguuuucugugagccaacuucccgaugacccugaggugcuggccgucauugcuaucccccauacauccgaacacaccccuguguucauuaagcucccgucuaauggaugcuacaugcugccccugccuaucagcaaagagagagcccuccugcccggcgauauggggugucggcuucugccuggaucccagcaaaagagcguuacaguggucaccauucccgcggaacagcagccgcuccagggcggggcuccucaggaggccguggaggaggaacaggaccgcagaggaguugugaagucuuccacauggagcggcgucugcaccgugauccugguggccuguguccuuguuuuucugcucggcaucgugcugcauaacaugucuugcauuuccaaacgguucacggugaucagcugcggguga

SEQ ID NO: 74960 - RNA, 2040 nt, Artificial Sequence
  derived and/or modified sequence opt5 from RNF157__Homo_sapiens__NP_443148
augggcgcccugaccagcagacagcacgcugggguggaggaagucgacauccccuccaacucuguuuaccgguauccuccgaaguccggauccuacuucgccucucauuuuauuaugggcggggagaaauucgauagcacacaccccgaaggauaucucuuuggcgagaauagcgaccugaacuuccuugggaaucgcccugugguguuucccuacgcggcuccucccccucaagaaccggucaagacgcugagaucucucgugaacauccggaaagauacccugcgccuuguuaagugcgccgaggaggugaaaagccccggagaagaggccuccaaggcuaagguccauuauaauguggaguucacauuugacaccgaugccagaguugcuauuacaaucuacuaucaggccaccgaggaguuccagaacggcauugcgagcuacaucccuaaagacaauucucugcaguccgaaacagugcaauacaagcggggcgucugucagcaguuuugccuccccagccacaccguggauccuucugagugggccgaagaggaacugggguucgaccuggaucgcgagguguauccccucgucguucaugcugugguggacgagggagaugaauacuuuggccacugucacguccugcuugggacguucgagaaacauaccgacggaacauuuugcgugaagccgcugaaacagaagcaaguuguggauggcgucuccuaucuccugcaggaaaucuacgggauugagaacaaguauaauacccaggacagcaaaguggccgaagacgagguuucugauaacuccgcugaguguguggucugccuuagcgacgugagagauacacugauccucccuugucggcaccugugccuguguaauaccugcgccgacacgcuccgcuaccaggcgaacaauugucccauuugcagacugccuuuccgggcccuucugcaaauccgcgcuaugagaaagaaacucggaccccugucccccacaucuuucaacccuauuaucagcucccagaccagcgauucugaagaacauccguccagcgaaaauauucccccuggcuaugaggucgugucucuucuggaagcccucaacggcccccugacaccuagccccgcuguuccgccucugcacgugcucggggacggacaccuguccggcaugcuucccucuuacgggagcgauggacaucugccucccguccggaccaucuccccucucgaccgccugagcgauucuuccagccagggccuuaagcugaaaaagucucucuccaaaagcaccucccaaaacucuagcgugcugcacgaggaggaagacgagcauuccugcucugaaagcgagacacagcugucccagagacccagcguucagcaccucggggaggaauguggagugacgccggagucugaaaaucugacccuuuccagcucuggcgccaucgaucaauccagcugcacaggcaccccucugucuagcacaauuuccagccccgaggggcccgccucuuccagccucgcucaguccgucaugucuauggcgagcucccagaucucuaccgacacggugagcuccaugucuggaagcuacauugccccuggcacagaagaggagggggaagcucuguccagcccgcagcccgccucucgggccccuuccgaggaaggagagggccugcccgcugaaagcccugacucuaacuuugccgggcuucccgcgggcgagcaagaugcugagggaaaugacgugaucgaagaggaagauggcuccccuacccaggaggggcagagaaccugugccuuccucggaauggaaugcgacaacaauaacgauuuugacauugccagcguuaaggcucuggauaauaagcuguguucugaggucugccuccccggcgccuggcaggcugacgauaacgccgugucccgcaaugcgcaacggagacgccugagcuccagcucucuugaggacagcgaaacacggccgugugugugggggccucuggccgucuga

SEQ ID NO: 74961 - RNA, 1053 nt, Artificial Sequence
  derived and/or modified sequence opt5 from RNF167__Homo_sapiens__NP_056343
augcaccccgccgcuuucccucugccgguggucguugccgcggugcucuggggcgcugcccccaccagagggcugauccgggccacaagcgaccauaacgcuuccauggauuuugccgaccuuccugcucuguucggagccacgcucucucaggagggccugcaaggguuucuuguggaagcgcaccccgauaaugccugcagcccuauugcucccccuccgcccgccccugucaacggauccguguucaucgcucugcuccgcagauuugacuguaauuucgaucugaagguucugaacgcccagaaagcgggcuacggggccgcugugguccauaaugugaacucuaaugagcuccugaacaugguuuggaauagcgaagagauucagcagcaaaucuggauucccuccguguuuaucggagaacggucuagcgaguaucuucgcgcccuguucgucuacgagaagggcgcuagagugcuccuggugccugacaacaccuuuccccuuggcuauuaccugaucccguucacagggauugucggacuccugguucuggccaugggcgccgugaugaucgcucggugcauucagcaccgcaaaagacuccagcggaaucgccugaccaaggaacagcuuaaacaaaucccuacacaugauuaucagaagggggaccaguacgaugugugugcgauuugccuggacgaguaugaagauggagacaagcucagaguccugcccugugcccacgcuuaccacucccggugcguggauccuuggcuuacccagacacgcaaaaccugucccaucugcaagcaacccguucauagaggcccuggggacgaggaccaggaggaagagacgcagggacaagaagagggcgaugaaggcgagccgcgggaccaccccgccagcgagcgcaccccucugcucgggucuucccccacacugccuaccagcuuuggaucucuggcccccgcuccgcucguguucccuggccccuccacagauccuccccugagcccucccucuuccccggucauucuuguguga

SEQ ID NO: 74962 - RNA, 1716 nt, Artificial Sequence
  derived and/or modified sequence opt5 from RNF168__Homo_sapiens__NP_689830
auggcccugcccaaggacgcuaucccuagccucuccgagugccaguguggcauuugcauggaaauccugguggagccggucacccuucccuguaaccacacacugugcaaaccuuguuuccaaucuacgguugaaaaggccagccucugcugucccuuuugcagacggcgcguguccucuuggaccagauaccauacacggcgcaauagccuggugaacgucgagcuuuggaccauuauccagaaacacuauccuagagaauguaagcugcgggcguccgggcaggagucugaggaaguggcugaugacuaccagcccguucgccuccugagcaaaccuggagagcugagacgggaauaugaggaggaaauuuccaagguggccgccgagcgcagagcuagcgaagaggaagagaauaaggccucugaggaauacauccaacggcuccuggcugaggaagaggaagaggagaaacgccaggccgaaaagagacggcgcgcgauggaggaacagcuuaaauccgaugaggaacuggccagaaagcucagcaucgacauuaacaauuucugcgagggcucuaucuccgcuagcccgcugaacucucggaaauccgaucccgucacaccuaagagcgagaagaaauccaagaauaaacagagaaacaccggggacauucaaaaguaucuuacacccaaaucucaguuuggaagcgccucccauagcgaagcugugcaggagguucgcaaggauucuguguccaaagacaucgauagcucugacagaaagagcccuaccggccaggauacggaaauugaggacaugcccacccuguccccgcaaaucucucucggggucggagagcagggcgccgauagcuccauugaaagcccuaugcccuggcugugugcgugcggcgccgagugguaccacgaagggaaugugaagacacggccuucuaaccauggaaaagagcugugcgugcucucccacgaacgccccaagacccggguccccuauagcaaagagacagcuguuaugccuuguggcagaaccgagucugggugcgccccgacguccggagugacacagaccaauggcaacaauacaggggaaaccgagaacgaagagagcugucugcuuaucuccaaggaaaucucuaaacgcaagaaucaagagagcuccuucgaggcugugaaggaccccugcuuuucugccaaacggagaaaggucagcccugaauccagccccgaccaggaggaaaccgagauuaacuucacacagaaacugaucgaucucgaacaucugcuuuuugagcgccacaagcaggaggaacaagaccggcugcucgcccugcagcugcagaaagagguggauaaggaacagaugguuccuaacagacaaaagggaucucccgacgaguaccaccuccgcgcuacguccagcccgccugauaaagugcugaauggccagcggaagaaccccaaagacggcaauuucaagagacagacccauacaaaacacccuacccccgagcgggggucucgcgauaagaacagacaggucucccuuaagaugcaacugaaacagagcgugaaucggagaaagaugccuaacucuacacgcgaccacuguaaaguuagcaaguccgcgcauagccuccagcccucuauuucccagaaaagcguguuucaaauguuccagcggugcaccaaguga

SEQ ID NO: 74963 - RNA, 777 nt, Artificial Sequence
  derived and/or modified sequence opt5 from RNF170__Homo_sapiens__NP_001153695
auggccaaguaccagggcgaggugcaaagccugaaacucgacgaugacuccgucaucgaagggguuucugaucaggugcugguggcugucgugguuagcuucgcccuuauugcgacccugguguaugcucucuuuagaaacguccaccagaauauccaucccgagaaccaggaacuggugcggguucuucgcgagcaacugcagacagaacaggacgccccugccgcuacgagacagcaauucuacaccgauauguauugcccgauuugucuccaccaggccuccuuucccguggagacaaauugcggacaucuguucuguggcgcuugcaucauugccuacuggcgguaugggucuuggcugggagcgaucagcuguccuaucugccgccagaccgucacacuccugcuuaccguguuuggcgaggacgaucagucccaagacgugcugagacuccaccaggauauuaacgacuacaaucggcgcuucucugggcagcccagaagcaucauggaacggauuauggaucugccuacacuucugcgccaugccuuuagagagauguucuccgucggaggccucuuuuggauguuccggauccgcauuauccugugucugaugggcgccuuuuucuaucucauuagcccccuggacuuuguuccugaagcucuuuucgggauccugggauuccucgaugacuuuuucgugaucuuucugcuucugauuuacaucucuauuauguacagagaggugaucacccaacggcucacgcgcuga

SEQ ID NO: 74964 - RNA, 1779 nt, Artificial Sequence
  derived and/or modified sequence opt5 from RNF180__Homo_sapiens__NP_001107033
augaagagaagcaaagagcugaucaccaagaaccacucccaggaagagacaucuauucuccggugcuggaaaugucgcaagugcaucgccagcuccggcuguuucauggaauaccuggagaaucaaguuauuaaagacaaggaugacucugucgaugcucagaacaucugccauguuuggcacaugaauguggaagcccuucccgaguggauuagcugucugauccagaaggcgcaguggacgguggggaaacucaacugcccuuuuuguggagcuagacugggcggguucaauuuugucuccaccccgaagugcucuuguggacaacuugccgccgugcaucugagcaaaucccggacagacuaucagcccacccaggcuggccgccucaugagaccuagcguuaaguaccugucucacccccgggugcaguccgggugcgauaaagaggcccugcucacaggaggcggcagcgaaaaccgcaaucauagacugcuuaacauggcucggaauaacaaugacccugggcgccugaccgaggcccucugucuggaagucagacccacauauuucgagaugaagaacgagaaacuucugucuaaggcguccgaaccuaaguaccaacucuuugugccgcagcugguuaccggacggugcgccacgcgcgcuuuccacagaaaaagccacucucuggaucucaauaucuccgagaagcugacccuucugcccacacucuaugaaauucauagcaaaaccacagccuacucccggcugaacgagacccagccuaucgaccuuucuggccugccccuccagagcuccaagaauagcuauucuuuucaaaacccuuccagcuucgaucccucuaugcugcugcagcgcuuuagcguggcuccgcacgaaacgcagacacaaagagggggagaguuccagugcggccucgaggccgcguccgucuacucugaccauaccaacacaaauaaccugaccuuucuuauggaucugccuagcgccgggcgguccaugcccgaagcuagcgaccaggaggaacaccucucuccucuggauuuccuucacuccgccaauuuuagccugggaucuauuaaccagagacucaauaaacgcgagcgguccaagcugaagaaccugagacgcaaacaacggagacgcgaacgguggcuccagaagcagggcaaauacagcggcguggggcugcuugaccauaugacccugaauaacgagauguccacagacgaggauaaugaauaugcugaggaaaaggacucuuacaucugugccgugugccucgaugucuauuucaaccccuacauguguuaucccugccaccauauuuucugugagccuugccugagaacgcuggccaaagacaauccgagcuccacccccuguccucuuugccgcacaaucauuucucggguguuuuuccagaccgaacucaacaaugcuacaaagaccuuuuucacgaaggaguaccugaaaaucaagcagagcuuucaaaaauccaacagcgcgaaguggccccugccuucuuguagaaaagccuuccaccucuuuggaggcuuccgccggcaugcugcccccguuacaagacggcaguuuccgcacggggcccaccgcauggauuaucugcauuucgaggacgauuccagaggauggugguuugacauggauauggugaucauuuacaucuacagcgucaauugggugauuggcuucaucguguuuugcuuccuuuguuauuucuuuuucccuuuuuga

SEQ ID NO: 74965 - RNA, 744 nt, Artificial Sequence
  derived and/or modified sequence opt5 from RNF182__Homo_sapiens__NP_001158506
auggccagccagcccccugaggacaccgcugaaucccaagccucugaugagcuggaaugcaagaucuguuacaacagauauaaucucaaacagcggaagccgaaagugcuggagugcugucaccgcgucugcgcgaagugucuuuacaaaauuaucgacuucggcgauagcccccaggggguuauugugugcccuuuuuguagauucgaaacaugccugcccgacgaugagguguccucucucccugacgauaacaauauccuggucaaccuuacguguggaggcaaggggaagaaaugccugcccgagaauccuaccgaacuccugcugacaccgaagcggcucgcuagccuggugucccccucucauaccagcuccaacugucuuguuauuacaaucauggaggugcagcgcgaaagcucuccuucccugagcucuacccccgucguggaguuuuauagaccugccuccuucgacagcguuacaaccgugucucacaauuggacggucuggaacugcaccucccuccuguuucaaacaagcauccgggugcuuguguggcugcucggacugcuguacuucuccucucucccccugggcauuuaucuucuggucagcaaaaagguuacccucggggugguguuugucucccuggugccgagcucucuuguuauccugaugguguacggauucugccagugugucugccaugaguuucucgauuguauggccccucccuccuga

SEQ ID NO: 74966 - RNA, 2517 nt, Artificial Sequence
  derived and/or modified sequence opt5 from RNF19A__Homo_sapiens__XP_005250910
augcaggagcaagaaaucggcuucauuagcaaguacaacgaggggcugugcgugaauaccgaccccgucuccauccucacaucuauucuggauaugagccuucacagacagaugggauccgaccgggaucugcagucuagcgccuccucuguuagccucccuuccgugaaaaaggcuccgaaaaagcgcagaaucagcauuggcucucuguuucggcgcaaaaaggacaacaagagaaaaucccgggaacuuaaugggggaguggauggcaucgccagcaucgagucuauucauuccgaaauguguacggacaagaacagcaucuucucuaccaauacauccagcgauaacgggcugaccuccauuucuaaacagaucggagacuuuauugagugcccccucugucugcugcgccacagcaaggauagauucccugacaucaugacaugccaucaccgguccugugucgauugccuccgccaauaucugagaauugagaucagcgaaucucgggugaauaucuccugucccgagugcaccgaacgcuuuaacccucaugacauuagacuuauccugagcgaugacguucucauggagaaauacgaggaguucaugcugcggcgcuggcuuguggcggaccccgauuguagauggugcccugcuccggacuguggcuaugccgucauugccuuuggcugcgcuucuugccccaagcugacaugugggcgggaaggaugcggcaccgaguucuguuaccacugcaagcagaucuggcacccuaaucagacgugugaugccgcuagacaggaacgcgcccaaagccuccggcugagaaccauucgcuccucuagcaucuccuauagccaggaaucuggggcggccgcugacgauaucaaacccugcccucggugugccgcuuacauuaucaagaugaacgacggauccugcaaucauaugacaugugccgugugcggcugugaguuuugcuggcugugcaugaaagagauuagcgaucuccacuaucugucucccuccggguguaccuucuggggaaagaaaccguggagcagaaagaaaaagauccuuuggcagcugggcacacucguuggcgcgccuguggggauugcccugaucgcuggaaucgccauucccgcuaugaucauuggcaucccugucuacguggggcgcaagauucauaaccgguacgaaggaaaagacguguccaagcacaaaagaaaucuugccaucgccggcggggucacccugucuguuauugugagccccguggucgcugcggugacgguuggaaucggcgugcccaucaugcucgccuaugucuacggcgugguuccuauuucccugugccgcucugggggauguggcgugagcgcugggaacggaaagggcguccggaucgaguuugaugacgaaaaugauauuaacgucgggggcacaaacaccgccguggacacaaccuccguggccgaggcuagacacaauccgagcaucggagaaggcucuguugggggacugaccggcucccucagcgccucugggucccauauggaccgcauuggagcgauccgggauaaccugagcgagacagcuucuacgauggcccuugccggcgcuagcaucaccgggucccugagcggcucugccauggugaauugcuucaacagacucgagguccaggcugacgugcaaaaagaacgguauucccugagcggagaguccggcacaguuucucuugggaccgugagcgauaaugccuccacaaaggcgauggccggaucuauucugaacagcuacaucccccucgacaaggaaggcaauuccauggagguccagguggauauugaaucuaaaccuagcaaguuucgccacaacuccgggagcagcuccguggacgauggaagcgcuaccagaucucaugccggcggguccagcucuggccugcccgagggaaaauccagcgcuacgaagugguccaaagaggccacagcgggcaagaagucuaaaucugggaagcugcggaaaaagggaaauaugaaaaucaacgaaaccagagaggacauggaugcccagcuccuggaacaacagagcaccaauuccucugaguucgaggcuccuagccuuuccgacucuaugcccagcguugccgauucccacucuagccauuucuccgaauuuagcuguucugaccuggaguccaugaagacaagcugcucucacggcuccagcgauuaucacacccgcuucgcuacagucaacauucucccggaaguggagaaugaccggcuggaaaacuccccucaucaguguucuaucagcguggucacgcagaccgccuccugcagcgaggugucucaacugaaucacaucgccgaggaacaugggaacaacggaauuaagcccaauguugaccuuuacuuuggcgaugcucucaaagagacaaacaauaaccacucccaccagaccauggaacugaagguggcgauccagacagagauuuga

SEQ ID NO: 74967 - RNA, 2049 nt, Artificial Sequence
  derived and/or modified sequence opt5 from RNF207__Homo_sapiens__XP_011539741
augcccgaggaagccagcccugcuggccacccggaggacaccagacgggggaucccccgcgugggagucagacggggccgcagagggcauggacggggccgcccuagagccgaaugggagcccuccccuggggcgggacugaacuuccagggccggcuccugcuuggccgcgcuacagccagaugccugcgggcccgccccggggcugcccucagagcucuggauggaggccgggaagcccgcagaacggggucuagccaacaguccggaccugcggacguuggcucuuaccuucgggcccccgggggaccggagcugccuggcugucccgagcacccucccgcuggcgugccggccgugccuagagcuguccgcgcccccgugagcuccgggcucuuuccucggcugcugugcagacuccccgcguggccccgcgaucggagaccuccgcaucugcccgccguuccugacguggaaaccacauauuucuguaauaccugcggacagccccuuugugcucgcugccgggaugagacacacagagcccgcauguuugcucggcaugacauugucgcccugggccagagaucucgcgaugugccucaaaaguguacccuccacgccgaacccuaccugcuuuucagcacagacaaaaagcugcuccugugcauccgguguuuuagagauaugcagaaagagucccgggcucacugcguugaccuggagagcgcguaugugcaggggugugaacgccucgagcaggccguccuggcugugaaggcccuucaaaccgccacgagagaagcuauugcccugcuccaggcgaugguggaggaaguccggcauucugcugccgaggaggaagaugccauccacgcucuguucggauccaugcaggacagacuugccgagcgcaaagcucugcuccugcaggccguucaaagccaguacgaagagaaggauaaggcguuuaaagaacagcugucucaucucgccacccugcuuccgacacugcaagugcaccucgugauuugcuccagcuuccugucucuugcuaacaaggccgaguuucuggaccucggcuaugagcugauggaacggcugcaggggaucgucaccagaccucaccaucuccgccccauccaguccagcaaaauugcuuccgaccacagagccgaguucgcgcggugccuggaaccucuucugcuccugggaccccgcagaguggccgcugccgcuucuggcgccaauacacuggccggcgggcuuggaccuaaggcucucaccggcccccauuguccgagcccuguugggaaaauguccggaagccccgugcagaagcccacgcugcaccggucuaucuccacaaagguccugcucgcggagggcgaaaacaccccuuuugccgagcauugccgccacuacgaggauagcuauagacaucugcaagcugaaaugcagucucuuaaagaccaggugcaggagcugcaccgggaucucacaaagcaccauagccugauuaaagccgaaaucaugggggacguucugcacaagucccuucaacucgaugugcagauugccucugagcacgcuagccuggagggcaugcgcgucguguuccaggaaaucugggaggaagccuaccagagagucgcgaaugagcaagaaauuuacgaggcucagcugcaugaccuccugcagcuucggcaggagaacgccuaucugaccaccaucacaaaacaaaucacgccguacgugcgcuccauugccaagguuaaagaaagacucgagccccgguuucaggcuccuguggaugaacagagcgagucucugcaaaauacccacgacgauuccagaaacaaugccgcgagcgcucgcaacaaucccggaucugucccugaaaagcgggagaagacauccgagcccaaaggcaacagcugggccccuaaugggcuguccgaggaaccccuucucaagaacauggaccaucacagaucuaaacagaagaauggaggcgaugugccgaccuggcgcgaacauccuacauga

SEQ ID NO: 74968 - RNA, 2928 nt, Artificial Sequence
  derived and/or modified sequence opt5 from RNF20__Homo_sapiens__NP_062538
augagcggcaucgggaacaagagagccgcuggagagcccggcaccuccaugccuccggaaaagaaggccgcgguggaggacucugggacaacggucgaaaccauuaaacugggaggcguuagcuccacagaggaacucgauauccggacccugcagacaaagaaucgcaaacuugcugagaugcuggaccaaagacaggccauugaggaugaacuccgggagcacaucgaaaagcuggagcgcagacaggccaccgacgaugcuucucuucugauugugaaccgguacuggagccaguucgacgagaauauccgcaucauucucaagagauaugaucuggaacaagggcugggagaccuccugacagagcggaaagcccuugugguccccgaaccugagcccgauuccgacucuaaccaggaacgcaaggaugacagagagcggggcgagggccaggaaccugcuuuuagcuuccuggccacccucgcguccucuagcuccgaggaaauggagagccagcugcaagaacgcguggagucuuccagacgggccguuagccagaucgugacggucuacgauaaacuucaggagaagguggaacugcucucucgcaaacuuaauuccggggacaaccugauuguugaggaagcugugcaggagcucaauagcuuucuggcccaagaaaacaugagacuucaggagcugaccgaccuccugcaggagaagcaucggacaaugucccaagaguucucuaaacuucagagcaaagucgaaaccgcugaauccagagugagcgugcuggagucuaugaucgaugaccuccagugggauauugacaagauccgcaaacgggagcagagacugaaucgccaccuggccgaaguccucgagcggguuaacuccaagggauauaaaguguacggcgcggggagcucucuguauggaggcacaauuaccaucaaugccagaaaguuugaagagaugaacgcugaacuugaggagaauaaagaacuggcccaaaaccgccucugcgagcuggaaaaacuucggcaggauuucgaggaagugacgacacagaaugagaagcugaaggucgagcucagaagcgcuguggaacagguugugaaggagacccccgaauaccgcuguaugcaaucccaguuuucuguccuguauaacgagagccugcagcucaaagcccaucuggacgaagcccggacacuucugcacgggaccagaggaacccaucagcaccaaguggagcucaucgagcgcgaugaaguuucccugcacaagaaacugcggacagaggugauucagcuugaagacacgcucgcucaggucagaaaggaguacgagaugcugcggaucgaguucgaacagacccuggcggccaacgaacaagcuggcccuauuaaucgcgagaugagacaucucaucagcucucugcagaaccacaaucaucagcuuaagggcgaagugcugcgguacaaaagaaagcuccgcgaggcccaauccgaucugaacaaaacacggcugagaagcgggucugcccuucuccagucccagagcuccaccgaggacccgaaggaugaacccgcugagcugaaaccugacucugaagaccugagcucccagucuagcgccuccaaggcgagccaagaggaugcuaaugaaauuaagucuaaacgcgacgaggaggaaagagagcgggaacgcagagagaaggaacgggagcgcgagagagaacgggagaaagaaaaggagcgcgagagagaaaaacagaagcucaaggaguccgaaaaagagcgggauagcgccaaggacaaagaaaagggaaaacacgaugacggccgcaagaaagaggccgagaucaucaagcagcugaagauugaacuuaaaaaggcucaggagucucaaaaagaaaugaagcugcuccuggauauguauagauccgcccccaaagagcagcgggacaagguccagcugauggcugccgaaaagaaaagcaaggcggagcuugaggaucucagacagcgccugaaagaccuggaagauaaggagaaaaaggaaaacaagaaaauggccgacgaggaugcucuccggaagaucagagccguggaggaacaaauugaguaccugcagaaaaagcuggcuauggccaaacaggaagaggaagcgcugcucucugagauggacguuacagggcaagccuuugaggacaugcaggaacagaauauccgccugaugcagcaacugcgggagaaggaugacgcuaacuucaaacuuaugagcgaaagaauuaaguccaaucagauccacaagcuccugaaagaggaaaaggaggagcuggccgaucaggugcucacccugaaaacgcaggucgacgcucaacuucaggugguucgcaagcuggaagagaaagaacaucuccugcagagcaacaucggaacaggcgagaaggaacuggggcuucggacccaggcccuggagaugaauaagagaaaagccauggaggcugcgcaacucgccgaugaccugaaggcucagcucgaacuggcccagaaaaagcugcacgauuuucaggacgagauuguggaaaacucugucaccaaagagaaggauauguucaauuuuaagcgcgcccaagaagacaucucccggcuuagacggaaacucgagacaaccaagaaaccugauaacgugcccaagugcgacgagauucugauggaagagaucaaagauuauaaggcucgccugacauguccgugcuguaauaugagaaagaaagacgccgugcuuacgaagugcuuccauguuuucuguuuugaaugcgucaaaacccgguacgacacacgccagagaaaguguccuaaaugcaacgcggcuuucggagccaacgauuuucaccggauuuauaucggcuga

SEQ ID NO: 74969 - RNA, 15624 nt, Artificial Sequence
  derived and/or modified sequence opt5 from RNF213__Homo_sapiens__NP_001243000
auggagugccccagcugucagcacguguccaaggaagagaccccuaaguucugcucucaauguggagaaagacugccgcccgcugcuccuauugccgacagcgagaacaauaacuccaccauggcgucugcuagcgaaggggagauggagugcggacaggaacucaaggaggaaggagggcccugucuguuuccuggauccgauucuuggcaggagaaucccgaggaaccuugcagcaaagccuccuggacgguccaggagagcaagaaaaagaagcggaaaaagaaaaagaaaggaaacaagucugccuccagcgaacuugcuucucugccgcucucccccgccagcccuugucaccugacccuucugucuaaucccuggccucaagacacagcucucccccacucccaggcccagcagagcgggccgaccggacaaccuucccagcccccuggaacagcgaccacaccccuggagggcgaugggcugucugcccccaccgaaguuggagacagcccucuccaggcucaggcccugggcgaggcugggguggccacgggauccgaggcgcaaagcucuccgcaguuccaggaucacaccgaaggcgaggaccaagaugccuccauucccagcgggggacgcggccuuucucaggaaggcacagggccucccaccagcgcuggagagggccacuccagaacagaagacgccgcucaggagcugcuccugccugagucuaaagggggaagcuccgaacccggcaccgagcuucagacgacagaacaacaggccggggccagcgcuucuauggcgguggaugccgucgcugagccggccaacgccgugaaaggagcuggcaaggaaaugaaagagaagacccagcggaugaaacagccucccgccacaaccccucccuuuaagacccauugccaagaggcggaaacaaaaacgaaggacgagauggcugccgccgaagagaagguuggcaaaaaugagcagggggaaccugaggaucugaagaaacccgaaggaaagaaccgcuccgcugccgcugugaaaaaugagaaggaacagaagaaccaggaggccgacguccaagaggugaaagcgagcacccucucuccgggcgggggaguuacaguguucuuucacgccaucauuucccugcacuucccuuuuaaucccgaucugcauaaggucuucaucagaggcggggaagaguuuggcgaaagcaaaugggacuccaacauuugugagcuccacuacacccgggaccugggacaugaucgcgugcuuguggaaggcaucgucugcaucucuaagaaacaccuggacaaguauauucccuacaaguauguuaucuacaauggggagagcuucgaguaugaauuuauuuacaaacaccagcagaagaaaggagaguaugugaacagaugucucuucaucaaguccucucugcuuggcagcggggauuggcaucaguacuacgacauuguguauaugaaaccucacggacggcugcaaaaggucaugaaucauaucacagauggcccgcgcaaggaccucgugaaagggaagcagauugcugccgcucugaugcuggauuccaccuuuagcauccuccagacgugggacacaaucaaccugaacucuuucuucacccaauuugaacaguucugcuuuguucuucagcagcccaugauuuacgagggccaagcccagcuguggaccgaucuccaguauagagaaaaagaggugaagcgguaccuguggcagcaccuuaaaaagcaugucgugccucugcccgacggaaaauccacagauuuccucccuguugacugccccgugcgcagcaagcugaagaccggccugaucguccucuuuguggucgagaaaauugaacugcuucuggaggggucucucgacuggcugugucaucugcuuacauccgaugcgagcucuccugacgaguuccacagagaucucagccauauccugggcauuccgcaauccuggcggcuguaucucgugaaucugugccagcgcuguauggacacgagaaccuacacauggcuuggcgcccugccgguucuccacugcuguauggagcuggcuccucggcauaaggaugccuggagacagcccgaggacaccugggcugcccuggaagggcuuagcuuuucuccuuuccgcgagcagaugcucgauacauccagccugcugcaauuuaugcgggaaaaacagcaccuccuguccaucgacgagccccuuuucagaucuugguuuagccugcucccgcugucccaccuggugauguauauggaaaacuucaucgagcaucuuggacgcuuuccugcccacauucucgauugccugucuggcaucuacuaccggcugcccgggcucgagcagguccugaauacccaagacgugcaggauguucagaacgugcagaauauucuugaaaugcugcucagacugcuggacacguaucgcgauaagaucccugaggaagcucuuagccccuccuaccucaccgucugucugaaacugcaugaggcgauuugcucuagcacaaagcuccugaaguucuaugaacuucccgcccuguccgcugagaucgugugucggaugaucagacuccugagccugguggacucugccggccaacgcgacgagaccggaaacaauuccguucagacagucuuccagggcacccuugccgcuacgaaacgguggcugagagaaguguuuacaaagaacaugcucaccagcucuggggccuccuucacauacgugaaagagauugaagucuggcgccggcugguggagauccaguuuccugcggaacacggauggaaggagagccuccugggcgauauggaguggagacuuaccaaagaagaaccgcugucucaaauuaccgcuuauugcaauuccuguugggacacaaaggggcucgaagauagcguugccaagacguucgagaaaugcaucauugaggccguguccagcgcuugccagucucagaccagcauccugcagggauuuuccuacucugaccugcggaaguucggcauuguccuuagcgccgugaucacaaaauccuggccccgcaccgcggauaacuuugacgauauccugaagcaucuccugacacucgcugacguuaaacacguguucagacugugugggaccgaugaaaagauucuugccaaugucacggaggacgccaagcggcugaucgcuguggccgauucuguucucacaaaaguggucggcgaccugcugagcggaaccauucuugugggccaacuggaacucaucauuaagcacaaaaaccaguuucuggauaucuggcagcucagagagaagucccugucuccucaggacgaacaaugcgcuguggaggaggcccuugacuggcgccgggaagaacugcugcuccugaaaaaggagaagcgcugugucgauagccuucugaagaugugcgggaauguuaagcaucucauccagguggacuucggagugcuggcgguccgccacucccaggaucucagcucuaaaagacugaacgacaccgugacaguucggcuuuccaccagcucuaauucccaacgcgccacacauuaucaccugagcucccaggugcaggagauggcuggcaagauugaucugcucagagacucucauaucuuucagcuguucuggcgggaagccgcugagccccuuagcgagccuaaagaagaucaagaggccgccgaacugcucuccgagcccgaagaggagagcgaacgccacauucuggagcucgaagaggucuacgacuaccuguaucagccuucuuacagaaaguuuaucaaacuucaccaggaucugaaguccggggaggugacgcuggcugaaauugacguuaucuucaaggauuucgugaacaaauauaccgaccucgacagcgagcugaagaucauguguacagucgaucaucaggaccaacgggauuggauuaaagaccgcguggaacagaucaaggaguaccaccaucuucaccaggcgguucacgccgcuaaagugauucugcaggucaaggaaucucucggacugaacggcgauuuuagcgugcucaauacccugcuuaacuucacagacaauuuugaugacuucagacgggagacccuggaucaaaucaaccaggagcugauucaggccaagaaacuccugcaagacaucuccgaagcccgcugcaagggccuucaggcucugucucucagaaaagaguuuaucuguugggugcgggaagcccucgggggaauuaaugagcugaaggucuucguugaucucgcgagcaucuccgcuggcgaaaacgacauugauguggacagaguggccugcuuucaugacgccguccagggguaugcuucucuucuguucaaacuggauccgagcguggacuuuuccgccuucaugaagcaccucaagaaacuguggaaggcgcuugauaaagaccaguaccugccccgcaagcucugugauagcgcucggaaucuggaguggcugaaaacgguuaacgagucucauggauccguggaaagaagcucccucacccuugccacagccaucaaucaacgcggcauuuaugucauccaggcuccuaaagggggacagaagauuucucccgacaccgugcugcaccugauccucccugagagccccggcucccaugaagagucucgggaauacagccuggaggagguuaaagaacuucugaacaagcucaugcugauguccggcaaaaaggauagaaauaacacagagguggaacgcuuuagcgaggucuucugcucugugcagcggcugucccaagccuucaucgaccuccacagcgcugggaauaugcuuuuuagaaccuggauugccauggcguacuguucuccgaaacagggagucucccugcagauggauuucggccuggaccucgugacagagcugaaggaagggggagauguuaccgagcuucuggccgcucucugccgccagauggaacacuuucuggacagcuggaaacgguucgugacgcaaaagagaauggagcauuuuuaucugaacuucuacacagccgaacagcucgucuaucuuucuaccgagcugcggaagcagccucccagcgaugcugcccugaccaugcucuccuuuaucaaaucuaauugcacacugcgcgacgugcuuagagccagcguuggcuguggguccgaggcugcgcgguaccgcaugagacgggugauggaagaacugccccucaugcugcugagcgaguucucccucgucgacaaacuuagaauuaucauggagcagucuaugcgcugccugccugccuuucugcccgauugucucgaccuggaaacccuuggacacugccuggcucaucucgccggcaugggcgggagcccuguggagcggugucugccgagaggacugcaagugggccagcccaaccucguugucugcgggcacuccgaggugcuuccugccgcucuggccguguauaugcagacgcccucucaaccucugcccacauacgaugaaguccuccuguguaccccggcgacaaccuucgaggaaguggcccuucugcuccgccggugccugacacugggaagccucggccacaaaguuuauucccuucuguuugccgaccagcugucuuacgagguggccagacaggcugaagaacuguuccauaaccuguguacccagcaacaccgcgaggauuaccagcuugucauggugugcgacggggauugggaacauuguuaucugccuagcgccuuuucccagcacaagguuuucgugacgccccaggcgccucucgaggccauucaggcuuaccuggccggacauuaucggguccccaaacagacccugagcgcugccgcuguguucaaugacagacucugcguuggcaucguggccucugaacgcgcgggcgucgggaagucccuuuacgugaagagacugcacgauaaaaugaagaugcagcugaacgugaaaaaugucccucucaagacaauccggcugauugacccccagguugaugagagccgcgugcuuggagcccugcucccguuucuggacgcucaauaucagaaagugccuguccuguuccaccucgacgugaccucuuccguucagacaggcaucuggguguuucuuuucaagcugcugauucuccaauaccugauggauaucaacgggaagauguggcuuagaaaucccugccaucuguauauugucgagauccucgaacggcgcaccagcgugcccucuagauccagcuccgcccugcggacgagaguuccucaguuuagcuuccuggacaucuuuccgaaagugacauguagacccccuaaggaggucauugauauggaacucucugcucugcggagcgacaccgagcccggaauggaucuuugggaguucugcuccgagacauuucagagaccuuaccaguaccugcgccgguucaaccaaaaucaggaccucgauaccuuucaguaucaggagggcucuguggaagggacccccgaggaaugucugcaacacuuccuuuuucauugcggagucaucaacccuagcugguccgagcugagaaauuucgcccgguuccucaacuaccagcugcgcgacugugaagccucucuguuuugcaauccgagcuucauuggcgauacacucagaggcuuuaaaaaguucgugguuacguuuaugaucuucauggcucgggacuuugcgacccccucccugcacacaucugaucagagcccugggaaacacauggugaccauggacggagugcgcgaggaggaucuugcccccuucucccugagaaagcggugggaaagcgagccucaucccuaugucuuuuucaacgacgaccacacaaccaugacguuuauuggcuuccaucuccagccgaauaucaacgggucuguugaugcuauuucccaccugacaggaaaggugaucaaacgcgacgugaugaccagagaucuuuaccaaggccugcuccugcagcgggucccuuuuaauguggacuucgauaagcugccccgccauaaaaagcucgaaagacugugucuuacccuggggaucccccaggccacagacccugauaaaaccuaugagcucacaacggacaacaugcugaagauucuugccaucgaaaugcgguucagaugcggcauucccguuaucauuaugggcgagaccggcugugggaaaacacgccugaucaaguuucucagcgaucugcggagaggaggcaccaacgcugacacaaucaagcuggugaaaguccacgggggaaccacggccgauaugauuuacucucgcgugcgggaggcggaaaaugucgccuucgcuaacaaggaccaacaccagcucgacaccauccuguuuuucgaugaggccaauacaaccgaagcuauuuccugcaucaaagaggugcuuugugaccauaugguugauggccagccucuggccgaggacagcgggcuccacauuaucgcggccugcaacccguauagaaagcauuccgaagagaugaucugccgccuggaaucugcuggacuuggcuaccgggugagcauggaggaaacagccgauagacugggcuccauuccccuccgccagcuggucuaccgggugcacgcucugccucccagccucaucccucugguuugggacuuugggcaacuuucugauguggccgagaaacuguauauucagcagaucguccagagacucguggaguccauuagccuggacgaaaauggaacccgcgugaucacagagguucuuugugcuucucaaggcuucaugcggaagacggaagaugagugcagcuuugucucccugagagacguggaacgcugugugaaggucuucagaugguuucaugagcacucugccaugcuccuggcgcagcugaacgccuuccucagcaaauccucuguuagcaagaaucacaccgagcgggaucccgugcuguggucccuuaugcuggcuauuggggugugcuaccaugccagccucgagaagaaggacucuuaucgcaaagcuaucgccagauuuuucccgaagccuuacgaugacucccggcugcuucuggacgagaucacaagagcccaggaucucuuucuggacggagucccccugcggaagaccauugcgaaaaaccucgcucugaaggaaaauguguucaugaugguuguguguaucgagcuuaaaauuccucuguuccucgucggcaagcccgggagcuccaaaucucuggccaagaccaucguggcugaugccaugcagggcccugccgcuuauagcgaccuuuuucgcucccugaagcaaguucaccucgugucuuuccagugcagcccccauuccacaccgcagggaauuaucagcacguuuagacagugugcccgguuccaacagggcaaagaucugcagcaauacgucucuguggugguccuggacgaaguugggcuugcggaggauuccccuaagaugccccugaaaacccuccacccccugcucgaggacggaugcaucgaagaugacccugccccgcacaagaaagugggcuuuguggggauuagcaacugggcucuggaucccgccaagaugaaucgcggaaucuucgucucuagaggcuccccuaacgagacagaacuuauugagagcgcuaaagggaucuguucuuccgacauucuggugcaggaucggguucagggcuauuuugccagcuucgcgaaggccuacgagaccgugugcaagcgccaggacaaagaauuuuucggacugagagacuacuauucucucaucaagauggucuuugcugccgcuaaagccagcaaucggaagcccuccccucaagauaucgcucaggccgugcugcgcaacuucagcggcaaagacgauauucaggcgcuugacaucuuucuggccaaucuccccgaggcuaaguguuccgaagagguuucuccuaugcagcugauuaagcaaaacaucuucgggcccagccagaaagugccgggaggcgaacaggaggaugccgaguccagauaccuccugguccugacaaagaauuauguggcccuucaaauucugcaacagaccuucuuugaaggggaccagcaaccugagaucauuuucggaucuggcuuucccaaagaucaggaauacacgcagcucugccggaacaucaaccgcguuaagaucugcauggagacagggaaaauggugcugcuucugaaucuccagaaccuguaugaaagccucuacgacgcucugaaucaauauuacguccaucugggcggacagaaguacguggaucuuggccuggggacccacagagucaagugucgggugcauccuaacuuccgccucauuguuaucgaggagaaagacguggucuauaagcacuuucccauuccgcugaucaauagacuugaaaaacauuaccuggauauuaacaccgugcucgagaaguggcagaaauccaucguggaagaacugugcgccuggguugaaaaguucaucaaugugaaggcgcaccacuuucagaaacggcauaaguauucuccuagcgacgucuucauuggauaccacuccgacgcuugugccagcgugguucugcaagugaucgagagacagggcccccgcgcccucacagaggaacugcaucagaaagucucugaggaagcuaaguccauucuucugaacugcgccacccccgaugcugugguccggcucagcgccuauucucucgggggauuugcggccgaguggcuuucccaggaguacuuccacagacaacgccacaauagcuuugcugacuuccugcaggcccaucuccacacagcugaucuggaacggcaugccaucuuuaccgagauuacgacauucucuagacugcucaccucccacgacugugaaauccuggagagcgaagugacaggccgcgcgccuaaacccacccuucuguggcuccagcaguucgauacggaguauucuuuucugaaggagguucggaacugccuuaccaauacagccaaguguaaaauccugauuuuccaaaccgacuuugaagauggcaucagauccgcucagcucauugccagcgcuaaguacagcgugaucaacgagauuaauaaaauccgcgaaaacgaggaccggauuuucgucuacuuuaucacaaagcuguccagaguggggcgcggaaccgccuauguuggcuuccaugggggacuguggcagucugugcacaucgaugaccuccggagaagcacacugauggucuccgaugugacccggcuucaacacgugacgauuucucagcuguuugcuccuggcgaccucccggaacuggggcuugagcauagagccgaggauggacacgaagaggcgauggaaacagaggccagcaccuccggcgaaguugcugaggucgccgaggaagccauggagaccgaaucuagcgagaaagugggcaaggagacauccgaacucgggggaagcgacgugucuauccucgacaccacacgccugcugcgguccugcguccagagcgcugugggcaugcucagagaucagaaugagucuuguacgcgcaacaugagacggguugugcugcuucuggggcuccugaacgaagacgaugccugccaugcguccuuccuucgcgucagcaaaaugagacuguccguguuucucaagaagcaagaggaaucucaguuccacccccuggaguggcuggcucgggaggccuguaaucaggacgcccuccaggaagcuggaaccuuucgccauacacuguggaaaagaguucaaggcgccgugaccccucuucuggcuagcaugauuuccuucaucgaucgggacgggaaccucgagcugcuuacacgccccgauaccccucccugggccagagaccuguggauguucaucuuuucugauacgaugcuccugaauaucccucuggucaugaacaaugaacggcacaagggagagauggcguacaucgugguucagaaccacaugaaucucagcgaaaacgccuccaauaacgugccguucagcuggaaaauuaaggacuaucuggaggagcuuuggguccaggcucaguacaucaccgaugccgaaggccugcccaaaaaguuuguggacauuuuccaacagacaccucucggccgcuuucuggcucagcugcauggggagccccaacaggaacuccuucagugcuaucugaaggauuucauccugcucaccaugagagugucuacagaggaagaacugaaauuucuucagauggcccugugguccuguacccggaagcucaaagcggccagcgaggcuccugaagaggaagucucucugcccuggguucaccuggccuaccaacgcuucagaagccggcuucagaauuuuucccgcauucugacgaucuauccccaggugcugcauucucugauggaggcuagauggaaccacgagcucgccggaugcgaaaugacacuggacgccuucgcugcgauggccugcaccgagaugcuuacacggaauacccugaagccuagcccccaggcuuggcuccaacuggugaaaaaccuguccaugccccuugaacucaucuguagcgacgagcacaugcagggcucugggucccuggcccaggccgucauuagagaagugcgcgcucaguggagccggaucuuuuccaccgcccuguucguugagcaugugcuccugggaacagagucuagagucccugaacuucaaggccuggugacggagcacguuuuucuccuggauaagugccugcgcgaaaauagcgacgugaagacccaugggcccuucgaggcggucaugcggacacuuugugaaugcaaagagaccgcuuccaagacacucucuagauucggcauucagccuuguagcaucugccugggcgaugccaaagacccggugugucugcccugcgaucacguccauugucuccgcugccugcgggccugguuugcuuccgagcagaugauuuguccuuacugccuuaccgcccugcccgacgaguucucuccugcugugagccaagcccacagagaggcgaucgaaaagcacgcccgguuucgccagaugugcaacuccuucuuuguugaucucgugagcacgaucuguuucaaagacaacgcucccccggagaaggaagucauugagucucugcugucccuucucuuugugcagaagggcagacugcgggaugccgcucagcgccauugcgagcacacaaaaagccugucuccuuucaaugacguuguggauaagacccccgucaucagauccgugauucucaaacugcuucugaaguacagcuuucaugacgugaaagacuauauccaagaauaccucacccugcugaagaaaaaggccuucauuacagaggauaagaccgaacuuuauaugcucuuuaucaacugucuggaggacucuauucuggagaaaacaagcgcguacucccggaaugaugaacucaaccaccuggaggaagaggggagauuccuuaaggccuauagcccugcuucccgcggacgggaacccgccaaugaggcuucuguugaguaccugcaggaagucgccagaauccgccucugccuggaccgggccgcugauuuucugagcgagccggaaggcgggccugagauggcgaaagaaaagcaguguuaucuucagcaagugaaacaguucugcaucagaguggagaacgacuggcaccgcgucuaccucgugagaaagcuguccucucagcggggaauggaguucguucagggccugagcaagcccgggcgcccccaucaauggguguuuccuaaagaugucgugaagcagcagggacucagacaggaccaccccggccaaauggaucgguaccugguuuauggcgacgaauacaaagcccuucgcgaugcuguggccaaggccguccuggaguguaaaccucucgggauuaagacggcucugaaggccugcaaaaccccgcagucccagcaaucugcguauuuccugcuuacacucuuuagagaaguggcuauccuguaccggagccauaaugccucccugcaccccaccccugagcagugugaagccgugagcaaguucauuggagagugcaaaauccucucucccccugacauuucccgcuuugcuacaagccugguugauaacucugucccccuucugagagccggcccuuccgacagcaaucucgacgggaccgugacggagauggcuauccaugccgcggccgugcugcuguguggacagaacgaacuucucgagccgcugaagaaucuggcuuucucucccgccaccauggcucacgccuuucucccuacaaugcccgaagaucugcuugcgcaggcccggagauggaaaggccuggagcgcguccacugguauaccugcccuaacgggcaucccugcuccguuggagaguguggccggccgauggaacaaagcaucugcauugacugucacgcuccuaucggcgggauugaucauaagcccagagacggauuccaccucgugaaggauaaagccgaccgcacacagaccggccacgugcuggggaauccccagcggagagaugucgugacaugcgaccgcggacugccucccguuguguuucuucucauccggcugcugacccaucucgcucugcuucugggcgccucucaguccagccaagcccucauuaacaucaucaagccuccggucagagaucccaaaggguuccugcagcagcacauucugaaggaccuugagcagcucgcuaaaaugcugggacauuccgcggaugaaacgaucggcgugguucaccuggugcuccggcgccugcuucaagagcagcaucagcugagcucuagacggcuccugaauuuugacacagaacugagcaccaaggagaugcgcaacaacugggagaaagaaauugccgcugucaucuccccugagcuugaacaccucgauaagacccugcccacaaugaauaaccugauuucucaagacaagagaaucagcuccaauccuguggccaaaauuaucuacggcgaccccgugacguuccucccgcaucugccucggaagucugucguucauuguagcaaaaucugguccugccgcaagagaauuaccguggaguaucuucagcacaucguggaacagaaaaacgggaaggagcggguccccauucuguggcauuuucuccagaaggaggccgaacugagacugguuaaauuccuuccugagauccuggcucuccaacgcgaucuggugaagcaguuccagaaugugcagcaagucgaauacagcucuauucggggauuucucuccaaacacagcucugacggccugagacagcuucugcauaaccgcaucacaguguuccucuccaccuggaauaagcugcggagaagccuggagacaaacggggaaaucaaucuucccaaagauuacuguucuaccgaccuggaucucgacacagaguuugagauucugcucccucgccggagaggacugggccuuugcgccaccgcgcugguuuccuaucucauccgccugcacaacgaaauuguguacgcugucgagaagcugagcaaggaaaauaacuccuauucuguggaugccgccgagguuacggagcuucacgugaucagcuacgaagucgagcgggaccugacaccccugauucuguccaauugucaguaucagguggaagaggggagagaaacaguccaagaguucgaucucgagaaaauccagcgccagaucgugagcagauuucugcagggcaagccgcggcuuucucugaaaggcauucccacccugguuuaccgccaugacuggaacuaugaacaccucuucauggauaucaagaauaaaauggcucaagacucccugccuagcucugugauuagcgccaucuccggccagcuucagucuuacagcgacgcuugcgagguccuguccgugguggaaguuacacucggguuucugagcaccgccggaggcgaucccaacaugcaacucaacgucuacacgcaggacauucugcagaugggggaucagacaauccaugugcuuaaggcgcugaauagaugucaacugaagcacaccauugcccucuggcaguuccugucugcucacaaauccgagcagcuucugcggcuccauaaggaaccuuuuggagagaucagcucuagauauaaagccgaccuguccccggagaacgcuaagcuccugagcacauuccuuaaucagaccggccuggaugccuuucugcucgaacugcacgagaugaucauucuuaaacugaagaacccccaaacgcagaccgaggaacgcuuccggccucaguggucccucagagacacacuggugucuuacaugcagaccaaggaaagcgagauccugcccgagauggcgucccaauuuccugaagagauucuccuugccucuugcguuagcgucuggaaaacagcugccgugcugaaguggaaucgggaaaugcgcuga

SEQ ID NO: 74970 - RNA, 2112 nt, Artificial Sequence
  derived and/or modified sequence opt5 from RNF214__Homo_sapiens__NP_997226
auggccgcuagcgagguggccggcgucguugcgaacgcucccuccccuccggaaucuagcucccugugcgccucuaagagcgacgaggggcuccccgauggacuguccaccaaagacucugcccagaagcaaaagaauagcccucuucuguccgugagcucucagacaaucacgaaggaaaacaauagaaacgugcaccucgagcauuccgaacagaaucccggcagcucugcuggggauaccuccgccgcucaccaggucgugcugggagagaaccuuauugccacagcgcugugucucagcggcucugggucccaaagcgaccugaaagauguugccuccaccgcuggagaggaaggcgacacaucucugcgggagagccuccauccugugacccgcucccugaaggccggcugccacacaaagcagcuugcuagcagaaauuguucugaagagaaaagcccccagaccuccauccugaaggaggggaaccgggauacgucucucgacuuccgcccugucgugagcccggccaauggaguugaaggcgugagagucgaucaggacgaugaccaagauuccucuagccugaaacuuucccagaacauugcggugcagaccgacuuuaagacagccgacagcgaggugaauaccgaucaggacaucgagaaaaaccuggauaagaugaugacagaacggacccuccugaaggaacgcuaccaagagguccuggacaaacagagacagguugagaaucaacuccaggugcagcugaagcagcuucaacagcggcgcgaagaggaaaugaaaaaccaucaggagauucugaaggcuauccaggaugugacgaucaaaagagaagagacaaagaaaaagauugagaaggaaaagaaggaguuccuccaaaaagaacaggaccugaaggccgagaucgaaaaacuuugcgagaaggggcggcgcgaggucugggaaauggagcuggauagacucaagaaucaggacggagaaauuaaccggaacaucauggaggagaccgaacgcgcuuggaaagccgagauucugucucuggaauccagaaaggagcuccuggugcuuaaacuggaagaggccgagaaggaagcugagcuccaccugacauaucuuaaaagcacacccccuacccuggaaaccguucggucuaagcaggagugggaaacgagacucaauggcgugcgcaucaugaagaaaaacguccgggaucaauuuaauucccacauucagcuggugagaaacggggcgaagcugagcucccucccccagaucccuacccccacacugccgccucccccuucugagaccgacuucaugcuucagguuuuucaacccagccccucccuggccccucgcaugccguucucuaucggacaggugacaaugcccauggucaugccuagcgcugauccccggucccucagcuuuccuauucugaaucccgcccugucucagccgucccaaccuagcucuccccuuccuggcucccauggcagaaacagccccgggcucggaucucuggugagcccucacggcccccauaugccgccugccgcuuccauucccccucccccggggcugggaggcgucaaagccagcgcggagacgccccgcccucagcccguggacaagcucgagaaaauccuggaaaaacuucugacccgguucccucaguguaauaaggcucagaugacaaacauccuccaacagauuaaaaccgccagaaccacaauggccgggcugaccauggaggaacugauccagcuuguugcugcccgccucgcugaacacgagcggguggccgcgucuacacagccccugggaagaauccgcgcccuguuuccugcuccccucgcccaaauuuccacgccgauguuccugccuagcgcucaggucuccuaccccggccggucuagccacgccccugcgaccugcaaacuuugucugaugugccagaaacucgugcagcccuccgagcugcauccgauggccuguacacacguucugcauaaggaaugcaucaaauuuugggcucaaaccaauacaaacgacaccuguccuuucugccccacgcuuaaguga

SEQ ID NO: 74971 - RNA, 2601 nt, Artificial Sequence
  derived and/or modified sequence opt5 from RNF216__Homo_sapiens__NP_996999
auggaggaaggcaacaauaacgaggaagugauccaccugaauaacuuccauugccacagagggcaggaguggauuaaucuccgggacggacccaucaccauuagcgauuccucugacgaagaacgcaucccuaugcuggucacaccggcuccccaacagcaugaggaagaggaucuugacgaugacguuauucugacggaagaugacagcgaggaugacuacggcgaguuucucgaucuggggccucccggaaucuccgaguucaccaagccuucuggccagacagagagagaacccaaaccugggccgagccacaaccaggcugccaaugacaucgugaacccccgguccgagcaaaaggugauuauccuugaagagggaucucugcucuauaccgagagcgauccucuggaaacacagaaucaguccagcgaggacucugaaaccgagcugcucuccaaccugggcgaaagcgcggcucuugccgacgaucaggccauugaggaggacuguuggcuggaucaucccuacuuucaaucucucaaucagcagccucgcgaaaucacaaaccaggucgugccccaagagagacagccggaagcugagcugggccggcuucuguuccagcacgaauuuccugggcccgccuucccucgccccgagccccaacagggaggcauuuccgggccuagcucuccgcagcccgcucacccucucggagaguuugaagaccagcaacuggccuccgaugacgaggaacccggcccugcguuccccaugcaggagagccaggagccgaaucuggaaaacaucugggggcaggaggccgcugaaguugaucaagagcucguggaacugcuugucaaagagaccgaggccagauuuccugacguggcuaauggauucauugaagagaucauccauuuuaagaacuauuacgaucugaacguucucugcaauuuccugcuugaaaaccccgacuauccuaaacgggaggaucgcauuaucauuaaucccuccucuagccugcucgccucccaggacgaaacgaagcugccuaagaucgacuuuuucgauuacagcaaacugacaccccucgaccagagauguuucauucaggcggccgaucugcuuauggcugacuuuaaggugcugucuucccaagauaucaaaugggcccuccacgagcugaagggccauuaugcuaucacccggaaagcccuuagcgacgccauuaagaaguggcaggagcugucuccggaaaccagcggcaaacgcaagaaaagaaagcagaugaaccaguacuccuacaucgauuucaaauuugagcaaggggacauuaagaucgaaaaacggauguucuuucucgagaauaagcgcagacacugccggucuuaugauagacgcgcucugcugccugcgguccagcaggaacaagaguucuacgagcagaagauuaaagaaauggccgagcacgaagacuuucuccuggcccuucagaugaacgaggagcaguaucaaaaggauggacagcugaucgaaugucggugcuguuacggcgaguuccccuuugaagaacucacacagugcgccgacgcccaucuguucuguaaagaaugccugaucagauaugcucaggaggccguguuugggagcggaaaacuugagcucuccuguauggaaggcagcuguaccugcucuuuccccacguccgagcuggaaaaggugcugccucaaacaauucucuacaaguauuacgagcgcaaggcggaagaggaggucgcugccgccuacgcugaugaacugguucggugcccgagcugcucuuuucccgcccuucuggacuccgacgugaaaagauucagcuguccuaauccccacugccgcaaggagaccugucggaaaugccaggggcucuggaaggaacauaacggacugacaugugaggaacuggcugagaaagaugacaucaaguauagaaccuccauugaggaaaagaugaccgccgcgcgcauccggaaaugccacaaguguggcacaggccuuauuaaaucugaggggugcaauagaaugagcugucgcugcggagcccagaugugcuaccucugucggguguccaucaacggcuaugaucauuucugccagcacccuagaucucccggggcuccuugucaagaaugcagccgguguucccuguggacggaccccaccgaggaugacgagaagcugauugaagagauccagaaagaagccgaggaggagcagaagcgcaagaauggagagaacacauuuaaaagaaucggcccgccucucgaaaagcccgucgagaaagugcaacggguugaagcucugccuagacccgugccgcagaaucuuccucagccccagaugccucccuacgccuucgcgcaucccccuuuuccgcugcccccuguccgccccguguucaacaauuuuccucucaacauggggcccauuccugccccguauguucccccucugcccaacgugcgggucaauuacgauuucggcccuauccacaugccccuggagcacaaccuuccgaugcauuuuggaccucaacccagacaccgcuucuga

SEQ ID NO: 74972 - RNA, 447 nt, Artificial Sequence
  derived and/or modified sequence opt5 from RNF24__Homo_sapiens__NP_001127809
augagcuccgacuucccccacuacaacuuuagaaugccuaauaucggcuuccagaaccugccgcucaauauuuauaucguggucuuugggaccgccauuuucguuuuuauccugucucuucuguucugcuguuaccucauucggcugcgccaucaagcucacaaggaguuuuaugccuacaaacaggugauccuuaaggaaaaagugaaggagcugaaccuccaugaacugugcgcggucugucuggaggauuucaaacccagagacgaacucggaaucugcccuuguaagcacgcuuuucaucggaagugccugauuaaauggcuugaggugcgcaagguuuguccccugugcaauaugccugugcuccagcuggcccagcuucacagcaaacaagauagagggcccccucagggcccgcugcccggagccgagaacaucgucuga

SEQ ID NO: 74973 - RNA, 864 nt, Artificial Sequence
  derived and/or modified sequence opt5 from RNF2__Homo_sapiens__XP_005245470
augugccccaucugucuggacaugcucaagaacaccaugacaacgaaagagugccugcacagauucugugccgauugcauuaucaccgcccuucggagcggcaauaaggaauguccuacaugccgcaaaaagcugguguccaaaagaucucuccggccggaccccaacuuugaugcucugauuagcaagaucuacccuucccgcgacgaguaugaagcgcaucaggagagaguccuugcucggauuaauaagcacaacaaucaacaggcccugucucauagcaucgaagaggggcucaaaauccaggccaugaaccgccugcagagaggaaagaaacaacagauugagaauggcuccggggcugaagauaacggagacucuagccacuguuccaaugccagcacccauucuaaccaggaggcuggccccuccaauaagcggacaaaaaccagcgaugacucugggcuggaacucgauaacaauaacgccgcgauggccaucgacccuguuauggauggagcuuccgagauugagcugguguuccgcccccacccuacacuuauggaaaaggacgauagcgcccagaccagauacaucaagacgucuggcaaugcuaccguggaccaccuguccaaauaucucgccguccggcuggcgcuugaggaacugcgcagcaagggcgaguccaaccaaaugaaccucgacacagccucugaaaaacaguacaccauuuauaucgcuacagccagcgggcaguuuaccgugcugaauggauccuucagccuggagcucguuucugagaaguacuggaaagugaacaagccgauggaacuguauuacgcucccacgaaagagcauaaguga

SEQ ID NO: 74974 - RNA, 3219 nt, Artificial Sequence
  derived and/or modified sequence opt5 from RNF31__Homo_sapiens__NP_060469
augcccggcgaggaagaggaaagagccuuccugguggcucgggaggaacucgccagcgcgcugcgcagagacuccgggcaggcuuuuucucuugagcaacugcggccucuccuggccagcucccuuccgcuggccgcucgcuaccuccagcuggaugccgcuagacugguccggugcaacgcccacggagagccccgcaauuaucucaacacccugucuacagcgcuuaauauccuggaaaaguacggcagaaaccuccugagcccucagcggccccgcuauuggagagggguuaaauucaauaacccuguguuucgguccacgguggacgccguccagggaggccgcgaugugcuuagacuguacggguauaccgaggaacaacccgacggacucucuuucccugagggccaggaggaaccggaugagcaucagguugcuacagugacccuggaaguccugcuccugcggacagagcuuagccugcuccugcagaauacccacccccgccaacaggcccuugaacagcugcucgaggacaagguggaggaugacaugcugcagcuguccgaauuugauccucuccugagagagauugcucccggcccucuuacaacccccagcguuccggggucuacgccuggacccuguuuccugugcggcuccgccccugggacccuccauugucccagcugcaaacaagcgcugugucccgccugcgaccaccuuuuucauggacacccuucucgggcucaccaucugagacagacacucccgggcgugcugcaggggacccaccugucccccagccucccugccucugcucaaccccgcccucaguccacaagccugcuugcccugggagauuccucucucagcucccccaacccggccagcgcucaucugccuuggcacugugcggccugcgcuaugcugaaugaacccugggccguccuuuguguggccugcgaccggccuagaggcuguaagggccucgggcugggaaccgagggcccccaggggacgggaggccuggaaccugaucucgcucgcgggcggugggccugccagucuugcacauucgagaacgaggcggcugccgugcuguguuccaucugcgaaagaccccgccuugcccaaccgccuagccuggucguugacucucgggacgcuggaauuugucuccagccccugcagcagggcgaugcccugcuugcuagcgcccaaucccaggugugguacugcauccacuguaccuuuugcaauucuagccccggcugggugugugucaugugcaacagaacauccagcccuauuccggcgcagcaugcccccagaccuuaugcuucuucccucgagaaagggcccccuaagcccggaccuccccggagacugagcgccccgcugccuucuuccuguggcgaccccgaaaagcagcgccaagauaaaaugcgggaggaagggcuccagcuggugagcaugaucagagagggagaggcugccggcgcgugcccugaagagaucuucuccgcccuucaguacucugggaccgaaguuccccugcaguggcuccggagcgagcugccguacgugcuggagauggucgcugaacuugccggccaacaggacccuggacucggcgcuuuuuccugucaggaggcccgcagagccuggcuggaucggcacgggaaucuggacgaagcuguggaggaaugcguuagaacccgccggagaaaggugcaagagcuccagucucugggauucggccccgaggaagggagccuucaggcgcuguuucagcauggaggcgaugucucccgcgcccucacagagcugcaaagacagcggcuggaaccuuuccgccagagacuuugggacagcgggcccgagcccacgccuucuugggauggcccggacaaacagucccucgugcggcgccugcuggcugucuaugcccuccccagcuggggacgcgccgaacuggcucuuucucugcuccaagagaccccucggaacuacgagcugggcgaugugguugaagccgugcgccacucccaggacagagcguuccugcggcgccuucuggcucaggagugcgccgucugugggugggcccucccccauaauagaaugcaggcucugacaagcugcgaauguaccauuugcccugacuguuuucggcaacacuucacaaucgcccucaaggagaaacacauuaccgauauggugugccccgcguguggaagaccugaccugacggaugacacacagcuucugucuuauuuuagcacccucgauauccagcugcgcgaaucccuggagccggacgcuuacgcccuuuuccauaagaagcugaccgagggcguucucaugcgggaucccaaauuucuguggugcgcccaauguagcuucggguuuauuuaugaaagagagcagcucgaagcuacaugcccucagugucaccagaccuucugcgugcgcugcaagcggcaaugggaggagcagcauagaggacgcucuugugaagacuuucagaacuggaaacggaugaacgaucccgaguaccaggcccaaggccuggcuauguaucuucaggaaaaugggaucgacugcccuaaguguaaauucuccuacgcccuggcgagaggcggaugcaugcacuuucacuguacacagugccgccaucaguucuguagcggcugcuacaacgccuuuuaugcuaagaauaaaugucccgagccgaacugccgggucaagaagucccuccacgggcaucacccuagagauugucuguucuaccugcgggacuggacggcccuucgccugcaaaaacuccugcaggauaauaacgugauguucaauaccgaaccucccgcuggagccagagccgugccuggcgggggaugccggguuauugagcagaaggagguccccaacggccuccgcgacgaggcuugcgggaaagagacacccgcgggcuaugccggacugugucaggcucauuacaaggaauaucuugugucucugaucaaugcccacagccuggacccggccacccucuacgagguggaagaacuggagacagcuaccgaaagauaucuucacguccggccccaaccucuggccggcgaggaucccccugcguaccaggcuagacuccugcagaaacucacggaagaggugccccuggggcaauccaucccgcgccggagaaaguga

SEQ ID NO: 74975 - RNA, 1119 nt, Artificial Sequence
  derived and/or modified sequence opt5 from RNF34__Homo_sapiens__NP_079402
augaaggccggcgcuaccagcaugugggccuccugcugugggcugcucaacgaggugaugggaacaggcgcggucagagggcagcaaucugcuuucgccggagccacgggccccuuucgguucaccccuaauccggaauuuagcacauaucccccugcugccaccgaggggcccaacaucguuugcaaagccuguggacuguccuucucuguguuucgcaagaaacacgugugcugugacugcaagaaagauuucuguagcgucugcuccgugcuucaggaaaaucugagacgguguucuacaugccaucuccugcaggagaccgcuuuucagcgcccucaacuuaugagacugaagguuaaggaccuccggcaguaccugauucugcgcaacauccccauugauacauguagagaaaaagaggaccucguggaucugguccuuugccaccauggccugggcagcgaggacgauauggacaccuccagccucaauucuucccggagccagacgucuuccuucuuuacccgcagcuucuuuucuaacuacacagcgccuuccgccaccaugagcuccuuccagggggaacugauggauggagaccaaacaucuagaagcggcgugccggcucagguucaguccgagaucaccagcgccaauacggaagaugacgaugacgacgaugacgaggaugacgaugacgaggaagagaacgcugaagaucggaaucccgggcuuucuaaggagcgcgugagagccucccugagcgaccucucuagccuggaugacgucgaaggaauguccgugcggcagcugaaagagauucucgcgcgcaacuuugugaauuauucuggcugcugugagaagugggaacuggucgagaaaguuaacagacuuuacaaggaaaaugaggaaaaccaaaagagcuauggggagcggcugcagcuccaggaugaggaagacgacucccugugcagaaucuguauggaugccgugaucgacugcgugcuucuggaguguggacacauggucacaugcaccaaauguggcaagcgcaugagcgaaugcccuauuugucggcaauacgugguuagagcugugcaugucuucaaaucuuga

SEQ ID NO: 74976 - RNA, 1263 nt, Artificial Sequence
  derived and/or modified sequence opt5 from RNF39__Homo_sapiens__NP_079512
augugguggagagaccugacccggcuccgccuguggcuuaagagagaggccauccccggcgaagggcggaaagcugccaaggugaacgcgggagucggcgagaaagggauuuacacagcuagcucccgcggaggcccuccgucugccagaagcaaggccguuacggugguggcugaaggggccgcuucccggucuuggcugagcauggaugcccccgagcucggaccuggccuggucgaacgccuugagcagcuggcgaccugcccccucuguggcggguccuucgaggacccugugcugcuggccugcgaacacucuuuuuguagagcuugccucgcccggcgcuggggaacacccccugcuaccggcacagaggccagcccgaccgcgugucccugcugugggcugccuugccccagacggucccuucgcagcaauguuagacuggccguggaaguccggaucucucgcgagcucagagagaaacuggcugaaccuggagcccgggcuggcagacgcagagggggacggauucccacaaugggcugucuugaucugccgggcgaggacaugcgcaagaccuggcggagauucgaagugccuacguccaagagcucuaacuccgaggaugaccuccccgaagauuauccuguugugaaaaagaugcugcaucgccugaccgccgaccucacacuggaucccgggaccgcccaccggagacuucugaucagcgcugaccgccggucuguccaacucgcgcccccuggaacaccggcucccccugauggccccaaaagauuugaccagcugccugccgugcuuggggcccagggauucggcgccgggcgccauugcugggagguggagaccgcugaugccgcguccugucgggacagcuccggagaagacgcugaugacgaggaaucucacuacgccgucggcgccgcuggcgagagcguucagagaaaggggugcgugcggcugugccccgccggagcugugugggccgucgaaggccgcgggggaagacucugggcgcugacggccccggagccuacacugcucggcgggguggagcccccuccccggcgcauuagaguugaucuggacugggaacggggcagaguggcuuuuuaugauggacgcucccuugaccugcucuacgccuuccaagcuccuggcccccugggggagagaaucuuuccgcuuuucuguaccugcgauccucgggcgccccugcgcaucguccccgccgaaagcuga

SEQ ID NO: 74977 - RNA, 2706 nt, Artificial Sequence
  derived and/or modified sequence opt5 from RNF40__Homo_sapiens__NP_001193963
augagcggccccgggaacaagagagccgcuggagacggcggguccggaccuccggagaaaaagcugucucgggaagagaaaaccacaacgacccucaucgaacccauucgccugggcgggaucagcuccacagaggaaauggaucuuaaggugcugcaguucaaaaauaagaagcucgccgagagacuggagcaacggcaggcgugcgaagacgagcuucgcgaaagaauugagaaacuggagaagcggcaggcuaccgaugacgccacacuccugaucgucaaccgcuacugggcccagcuggaugaaaccguugaggcucuccugagaugucacgaaucucaaggagagcuuagcuccgccccugaagcucccggcacacaggagggcccuaccugcgacgggacgccccugccugagccgggaaccucugaacuccgggauccccugcuuaugcagcugcgcccuccccucagcgagccugcccuggcguuugugguggcccugggcgcuuccagcucugaagaggucgaacucgagcugcaggggagaauggaguucuccaaagccgcugugagccggguuguggaagccucugaccgccuucaaagacgggucgaggaacugugucagcgcguguauuccagaggagauagcgagccccucucugaagcggcccaggcucauacacgggagcugggcagagagaaucgccggcuucaggaccuggccacccaacuccaggaaaagcaccauagaauuucccuggaguacagcgaacugcaggauaaaguuacauccgcugagaccaaggugcucgagauggaaacgacagucgaggaccugcaaugggauaucgaaaagcugcgcaaacgggagcagaagcugaacaaacaccucgccgaagcccuggagcagcuuaauucuggguauuacgugagcggauccagcucuggcuuucagggcgggcaaaucacccuguccaugcaaaagagcgacgagcucggacugcagaaaaagcugagaacagaagugauucagcucgaggacacccuggcucagguccgcaaagaauaugagaugcuucggaucgaguucgagcagaaccuggcggccaaugagcaggcuggcccgauuaacagagaaaugcgccaucucaucucuagccugcagaaucacaaccaccaacugaagggggaugcccagcgguacaagagaaaacuucgcgagguucaggccgaaauuggaaagcuccgggcucaggccuccggcucugcgcauagcaccccuaaucuggggcaccccgaggacuccggagugagcgcuccugcccccggcaaagaagagggcgggcccggaccugugucuacaccggauaacagaaaggagauggcccccgucccuggcacgaccacaaccacaaccuccgugaaaaaggaagaacugguucccagcgaagaggacuuucaagggaucacgccuggagcucagggccccucuucccgggggcgcgagccggaagccagaccuaagcgggagcucagagaacgcgagggccccagccugggaccucccccuguggcuuccgcccuuucucgggcggauagagaaaaagccaaggucgaggagacaaaacgcaaggaaagcgagcugcucaaaggccugagagcugaacugaagaaggcccaggagucccaaaaagaaaugaaacuucuccuggacauguauaagucugcucccaaggagcagcgggauaaagugcagcugauggccgcggagcgcaaggccaaggcugaaguugacgagcucagaagccggauucgcgaacuggaggaaagagaucggcgcgaguccaaaaagaucgccgacgaggaugcucuuagacggauccgccaggccgaggaacaaauugaacaucugcagagaaaacucggggccaccaagcaggaggaggaagcucugcugagcgagauggacgugaccggacaggcguucgaagacaugcaagagcagaauggccggcuucuccagcagcugagagaaaaagaugacgccaacuuuaagcugaugucugagcgcaucaaagcuaaucaaauucacaagcuccugcgggaggaaaaggaugagcuuggggaacagguccugggacucaaaucccagguggacgcccaacugcugacaguccagaaacuugaggaaaaggagagagcccuccagggcagccuugggggcguggagaaggaacugacccuccgcucucaggcucuggagcuuaacaaacggaaggccguugaagcggcucaacuggccgaggaucucaaggugcagcuggaacacguccagacaagacugcgcgagauccagccgugccuugccgagucccgggcugccagagaaaaagagagcuucaaccugaagcgcgcgcaagaagacauuucucggcucagacggaaacuggagaagcagcgcaaaguggagguuuacgcugaugccgacgaaauccuccaggaggaaaucaaggaguacaaggccagacugacguguccuugcuguaauacccggaaaaaggaugcugugcuuacaaaaugcuuucaugucuucuguuuugaaugcgugcgcggaagauaugaggcccggcagagaaagugucccaaaugcaacgcugccuucggcgcgcacgacuuucaucgcauuuacaucagcuga

SEQ ID NO: 74978 - RNA, 954 nt, Artificial Sequence
  derived and/or modified sequence opt5 from RNF41__Homo_sapiens__NP_001229755
augggcuacgacgugaccagauuccagggggaugucgacgaggaucugaucugccccauuuguagcggaguucucgaggaaccugugcaagccccgcacugcgaacaugcuuuuuguaacgccugcaucacacagugguucucccagcagcaaacgugucccguggaccggucugucgugaccguugcgcaucugcgcccugugcccagaauuaugcggaauaugcuuagcaagcugcagaucgcuugcgauaacgccgucuuuggcuguuccgccgugguucgccucgacaaucugaugucucaccuuagcgauugcgagcacaacccuaaaagacccgugacaugugaacaggggugcggacuggagaugccuaaggacgagcucccgaaucauaacuguauuaaacaucugcgguccgucgugcagcaacagcagacccgcaucgcugaacuggagaagacaucugccgaacacaaacaccagcucgcugagcaaaagagagauauccagcugcuuaaggccuauaugcgggcgauucgcagcgugaaucccaaccugcagaaucucgaggaaaccaucgaguacaacgaaauucuggagugggucaauucccuucaaccugccagaguuacacgguggggcgggaugaucagcacccccgacgcugugcugcaggccgugauuaaacgcucucucgucgaauccggaugcccugcuagcaucgugaacgagcugauugagaaugcccacgaaagaucuuggccccagggccuggcgacgcucgagacccggcagaugaaccgcagauauuacgaaaauuauguugccaagcggaucccgggcaaacaagcuguggucgugauggccugcgagaaccagcauaugggggaugacaugguucaggaaccuggacuggugaugaucuucgcucacggcgucgaggagauuuga

SEQ ID NO: 74979 - RNA, 2352 nt, Artificial Sequence
  derived and/or modified sequence opt5 from RNF43__Homo_sapiens__NP_060233
augagcggcgggcaccagcugcaacucgccgcucuguggcccuggcuucugauggccacccuccaggcgggauucggcagaacagggcuggugcuugcugccgccgucgaguccgaacggucugcugagcagaaggccaucauucgcguuaucccucugaaaauggacccgacgggaaagcucaaccugacccuggaaggcguguuugcugggguggccgagauuacacccgcggaaggaaaacucaugcagagccauccucuguaccuuugcaaugccuccgaugacgauaaccuggagcccggcuucaucucuauugucaagcucgagagcccuagacgggcuccccgcccuugucugucccuugccucuaaagcuagaauggccggcgaacggggcgcgagcgccgugcuguuugacaucaccgaggaucgcgcugccgcugaacaacuccagcagccgcugggacugacauggcccguugugcucaucuggggcaaugacgccgagaagcugauggaguucgucuauaagaaccagaaagcccacgugagaauugaacuuaaggagccucccgcuuggccugauuacgacguuuggauccugaugaccguggucgggacaauuuuugugaucauucucgcguccgugcugcggauccgcugcagaccccggcauagccgcccggauccucuucaacagagaaccgccugggcuauuucucagcuggccacgcggcgcuaucaggccuccuguagacaagcucggggagaauggcccgacagcgggucuuccugcagcucugccccugucugugcgaucugccucgaggaguucuccgaggggcaggagcugagaguuaucagcugucugcacgaauuucaucgcaauugcguggaucccuggcuccaccagcaccggaccuguccccugugcauguucaacauuacagagggagacuccuuuucucaaagccuuggcccuuccagaagcuaccaggaaccgggccgccggcugcaucucaucagacagcaccccgggcaugcucacuaucaucugccugccgccuaccuucugggacccucucgcuccgcuguggcccggccucccagaccgggcccuuuccuccccagccaggagccugggaugggaccccgccaccaccgguuuccuagagcugcccauccccgcgcgccgggcgaacaacagcggcuggccggggcucagcacccuuaugcccagggauggggccugucucaucuccaaagcaccucccagcaccccgcugccugucccgucccucugagacgggcgcgcccgcccgauucuagcggcuccggggagagcuacugcacagagagaucuggauaccuugccgacggcccugcuuccgacagcagcuccgggcccugccacggaagcuccucugauagcgugguuaauuguaccgacauuucccugcagggcgugcaugggucuagcuccacguucugcagcucucucuccagcgauuuugacccucuggucuauuguucucccaaaggcgauccucagcggguggacaugcaacccuccguuacaagcagaccgcgcucucuggauagcguggucccuaccggagaaacacagguguccagccacguccauuaccaccggcacagacaucaccauuauaagaaacgcuuccaguggcacggcagaaagcccgggccugagaccggagugccccagucucggccgccuaucccccgcacccaaccucagcccgaacccccuuccccggaccagcaaguuacaagaagcaacuccgccgcucccucuggccggcuuagcaauccucagugcccccgcgcccucccugagcccgccccugggccgguggaugcuuccucuauuugucccagcacguccucucuguucaaccugcagaagucuucccucagcgcgagacauccucagcggaaacgcagaggaggccccucugaaccuacccccgggucccggccgcaagacgccacaguccacccugcuugccagaucuuuccccacuacacccccagcguggccuauccuuggucucccgaggcccauccucugaucuguggcccgcccggacuugauaagcgccugcucccugagacacccggcccuugcuacuccaauagccagcccguuuggcugugucugaccccgagacagccucuugaaccccacccucccggggagggaccuucugaaugguccagcgacacggcugagggccggcccugcccguauccucauugucaagugcucuccgcccagcccgggagcgaggaagaacuggaggaacugugcgaacaggcggucuga

SEQ ID NO: 74980 - RNA, 1056 nt, Artificial Sequence
  derived and/or modified sequence opt5 from RNF44__Homo_sapiens__XP_005265902
augcugcaccccgccacccagcaaagcccuuucaugguggaccuccaugagcagguccaccagggcccgguuccccuguccuacacagugacgaccgugacaacccagggguuuccucuucccacaggacaacauaucccuggcugcucugcucagcagcugcccgccuguagcgucauguucuccgggcagcacuauccucucugcugucugccgcccccucuuauucaagcgugcaccaugcagcagcugcccgugccuuaccaggcuuauccccaucucaucucuagcgaucacuacauucugcacccgccucccccugccccuccgccccaacccacacauauggcuccccugggacaguuuguuucccuccagacccaacacccuagaaugccccugcagcggcuugacaacgauguggaccugcgcggcgaucagccuucucucgggagcuucacguauuccaccagcgcccccggaccggcccugucuccuuccgucccccuucauuaccugccucacgacccccuccaccaggaacugagcuuuggcgugccuuauucucauaugaugcccagacggcuguccacacaacgcuacagacuccagcagccgcugccucccccucccccgcccccucccccucccccuuacuaucccagcuuccuuccguacuuucugucuaugcucccuaugucccccaccgcuaugggcccuacaaucagccuggaucuugacguugaugacguggagauggaaaauuaugaggcccugcucaaccuggcggaacggcugggggaugccaagccccgcggacucaccaaagcugacauugagcagcugccguccuacagauucaauccugauucucaccaaagcgagcagacgcuuugugucgugugcuuuuccgacuucgaagcccggcagcugcuccgcgugcugcccuguaaccaugaguuucacacaaagugcgucgacaaauggcuuaaggcuaauagaaccuguccuaucugccgggccgaugcgagcgaaguuccccgcgaggccgaguga

SEQ ID NO: 74981 - RNA, 342 nt, Artificial Sequence
  derived and/or modified sequence opt5 from RNF4__Homo_sapiens__NP_001171939
augagcaccagaaagcggcgcggcggggccaucaacuccagacaggcucaaaaacggacacgcgaggccacgucuacccccgaaauuagccuggaggcggaaccuaucgagcucguggaaacagcuggagacgagauugucgaucugaccugcgagucccuugaaccgguugugguggaccugacacacaaugauucugucgugaucguugacggcccccaggugcucagcgucgugccuuccgccuggaccgauacacagagaucuugucggauggacguuagcuccuucccccagaacgccgcuaugagcucuguggccuccgcuagcgucauuccuuga

SEQ ID NO: 74982 - RNA, 543 nt, Artificial Sequence
  derived and/or modified sequence opt5 from RNF5__Homo_sapiens__NP_008844
auggccgcugccgaggaagaggacggcgggcccgaaggaccuaacagagagcggggcggggcgggagcuaccuucgaaugcaauaucugucuggagacagcccgcgaggccguggucagcguuugcggccaccucuacuguuggccgugccugcaucaguggcuugaaacgagacccgagcggcaagaauguccugugugcaaggcugggauuucccgcgagaaaguggucccccuguauggaagaggcucucagaagccucaggauccccggcucaaaaccccuccgcgcccccagggccaaagaccugcccccgagagccgcgggggauuucagccuuucggcgacacagggggauuucacuucuccuuuggcgugggggcuuuccccuuuggauucuuuaccacaguuuucaacgcccaugaaccguuucggagaggcaccggcguggaucuggggcagggacacccugcgucuagcuggcaggacucccuuuuccuguuucucgccaucuucuucuuuuucuggcugcugucuauuuga

SEQ ID NO: 74983 - RNA, 2058 nt, Artificial Sequence
  derived and/or modified sequence opt5 from RNF6__Homo_sapiens__NP_005968
augaaccagagcagaucccggucugacggcgggagcgaggaaacccugccccaagaucacaaucaucacgagaacgaacgcagauggcagcaggagcggcuccaucgcgaagaggccuacuaucaguucaucaaugagcugaacgacgaagauuacagacuuaugcgggaccacaaucugcucggaacaccuggcgagauuacguccgaagaacugcaacagcgccuugauggggugaaggagcagcuggcuucucagccggaccucagagauggaaccaacuaucgggacagcgaagucccccgcgaguccucucaugaagauagccugcuggaguggcucaauacauuuagacggaccggcaacgccacacgcuccgggcaaaauggaaaccagaccuggagagcgguuagccggacaaauccuaacaauggcgaguuccgcuuuucucuggagauccacgugaaccacgagaauagaggcuucgaaauucauggggaggacuacaccgauaucccccuuuccgacagcaaccgggaucacacggcuaacagacagcagcgcucuaccuccccuguggcccggagaacacgcagccaaaccucugucaauuuuaacggauccagcuccaauauuccccggacaagacuggccucucgcggccagaacccugcugaagggagcuucuccacccucggacggcugagaaauggcaucgggggagccgcuggcaucccgcgcgccaacgcgagccggacgaauuuuucuucccauacaaaccagagcggcgggucugagcuuagacaacgcgaaggacagcgguucggcgccgcucacgugugggagaauggggccagaagcaacguuaccgugcggaauacaaaccagcgccuggagcccauuagacuccgguccaccucuaauagcagaucccgcagcccuauccagcggcaaucuggaaccgucuaucacaacucccagagagaaagccgccccgugcagcagacaacgagacggucuguucgcagacggggccgcaccagaguguuucuggagcaagaccgggaacgcgagagacgggggacagcuuacaccccuuucuccaauagccgccuggucuccagaauuacaguggaagagggagaggaaucuagccgguccucuaccgccgugagacgccaucccacgaucacacucgaccugcagguccggcgcauucgcccgggcgagaaccgggauagagacagcaucgcgaaccgcacccgguccagaguuggccuugccgaaaauaccgugacaauugagagcaacucugggggauuucgccggaccaucuccagacuggagcggagcggcauccgcacauaugugucuacgauuaccgucccucucagacggaucuccgaaaaugagcugguggaacccagcucuguugcucuuagaagcauucugagacagaucaugacaggguucggagagcucuccagccugauggaagccgauucugaguccgagcugcagcggaacggccaacaccucccugacaugcauagcgaacuguccaaucuugggaccgauaacaauagaucucagcaccgcgagggcagcucccaggaccggcaggcucaaggagauucuacagaaaugcauggcgagaacgaaaccacgcagccccacaccagaaauagcgacucccgcgggggacggcagcugagaaaccccaauaaccucguggagacaggcacccugccuauucuucgccuggcccacuuuuuccuccugaaugagucugaugacgaugaccggaucagagggcugacaaaagaacaaaucgacaaccucagcacccgccauuacgagcacaauuccauugauagcgaacugggaaagaucugcucugucuguauuuccgacuacgugacgggcaacaaacuuagacagcugccgugcaugcaugaguuccacauccacuguauugaucgguggcucagcgaaaacugcacaugucccaucugccgccagccuguucuggggucuaauaucgccaacaauggcuga

SEQ ID NO: 74984 - RNA, 294 nt, Artificial Sequence
  derived and/or modified sequence opt5 from RNF7__Homo_sapiens__NP_001188299
auggccgacguggaggauggcgaagagaccugcgcucuggccagccacuccgggucuagcggauccaagucuggcggggacaaaauguucagccucaagaaauggaacgcggucgcuaugugguccugggauguugaaugugacacaugcgccaucuguagaguccaggugauggugguguggggagagugcaaucauucuuuucacaacuguugcaugagccuguggguuaagcaaaauaaccgguguccccuuugccagcaggauugggugguccagcgcauuggcaaauga

SEQ ID NO: 74985 - RNA, 1458 nt, Artificial Sequence
  derived and/or modified sequence opt5 from RNF8__Homo_sapiens__NP_003949
augggcgagcccggguucuuugugaccggagacagagccggcgggcggagcuggugccugcgcagagucggaauguccgcuggcuggcuccugcuugaagaugggugugagguuacagugggacggggcuucggcgugacguaccagcuggucucuaagaucugcccucucaugauuagccgcaaccacugugugcugaaacaaaauccggaagggcaguggaccaucauggacaacaagucccuuaauggaguuuggcugaacagagcccggcucgagccccugcgcguguauucuauucaucagggcgauuacauccagcugggggucccucucgaaaauaaagagaacgcggaguaugaauacgaggugacagaagaggacugggagaccauuuaucccugccugagcccuaagaaugaucaaaugaucgagaaaaacaaggaacuuagaacaaagcggaaauuuucccuggacgaacucgcuggacccggcgccgaggggccuucuaaucugaaaagcaaaaucaacaagguuuccugugaaagcggacagccggugaaaucucagggcaagggcgaggucgccuccacccccagcgauaaucuugacccuaagcugacagcucucgagcccucuaaaaccacgggggccccuauuuaccccggauucccgaaggugaccgaagugcaccaugagcagaaggcuuccaacagcucugccucccaacgcagccugcagauguuuaaggucacaauguccagaauccugcggcucaaaauucagaugcaggaaaagcacgaggcgguuaugaaugugaaaaagcaaacccagaagggcaacucuaaaaaggugguccagauggaacaagagcugcaggaucuucagagccagcugugcgccgagcaagcucagcagcaggcccgcguggaacaacucgagaaaacauuccaggaagaggaacagcaucugcaggggcuugagaucgcucaaggagagaaggaccugaaacagcagcucgcccaggcgcugcaagaacacugggcccugauggaggaacucaauagauccaagaaggauuuugaggcuauuauccaggccaaaaacaaggagcuggaacagaccaaagaggaaaaggagaaaaugcaagcucagaaggaagagguucuuagccacaugaacgacgugcuggagaaugaacuccaguguauuaucugcucugaguauuucaucgaagccgucacgcugaacugugcccauuccuuuugcagcuacuguauuaaugaguggaugaagcggaaaaucgaaugcccuauuugccgcaaggauaucaaaucuaagacauacagccuugugcuggacaacuguauuaauaaaaugguuaacaaucucuccucugaggugaaggagagacggaucguccugaucagagaacgcaaggcuaaacggcuguucuga

SEQ ID NO: 74986 - RNA, 1725 nt, Artificial Sequence
  derived and/or modified sequence opt5 from RNGTT__Homo_sapiens__NP_001273355
auggcccacaacaagauucccccuagauggcugaauugcccgcggcgcggccagcccguggcugggagauuccucccucugaaaaccaugcuuggaccccgguacgacagccaagucgccgaggaaaaccgcuuucauccuuccaugcugucuaauuaucucaagagccugaaaguuaagaugggccuucugguggaucucacaaacacguccagauucuacgaccggaaugauaucgagaaagaagggaucaaguauauuaagcugcaguguaaaggacacggcgagugccccaccacagaaaacaccgagacauuuauccgccugugugagagauucaaugaacggaacccuccggagcucauuggggugcauugcacccacggauuuaaucgcacaggcuuccugaucugugcguuucuugucgaaaagauggacuggucuaucgaggcugccguggccaccuucgcucaggccagacccccuggcauuuacaaaggggauuaucugaaggagcucuuucggcgcuacggagacaucgaagaggcucccccucccccgcugcuuccugauuggugcuucgaagacgaugaggacgaagaugaggacgaggauggcaaaaaggaaagcgagcccggguccucugccagcuuuggaaagagacggaaagaacgccugaagcucggcgcgauuuuccuggaggggguuacggugaaaggagucacccaggugacaacccaaccuaagcugggcgaaguucagcagaaaugucaucaguuuugcggcugggagggguccggauuccccggcgcccaacccgugagcauggacaagcagaacaucaaacuccuggaccuuaagccuuauaaggucucuuggaaagcugaugggacaagauacaugaugcugauugacggaaccaaugagguguucaugaucgaucgggacaacuccguguuucacgucagcaaucucgaguucccguuuagaaaggaucugcgcaugcaccuuucuaacacgcugcucgacggcgaaaugauuaucgaucggguuaaugggcaggccgugcccagauaccugaucuaugacauuaucaaauucaacucccagccugugggagauugugacuuuaacguccgccugcaaugcauugaacgggagaucauuagccccagacaugaaaagaugaaaacaggccucaucgauaagacccaggagccuuucucugugcgcaauaagcccuuuuucgacaucuguacaucccggaaaaaguacaaaccgggcagaugcgacgauauucugaaguggaaaccucccagccuuaacuccguugacuuucgccugaagaucacccggaugggaggggagggccuccugccucagaauguggggcuucuguaugucggaggcuacgaaagacccuucgcucaaauuaaggugaccaaagagcucaagcaguaugauaacaaaaucauugaaugcaaguuugagaauaacucuuggguuuucaugcgccagcggacagacaagagcuuuccuaaugccuacaacacggcgauggccguguguaauuccaucagcaaccccgucaccaaagagaugcuguucgaguucaucgauagaugcacagcugccucucaggggcaaaagcggaaacaccaucuggacccggauaccgaacucaugccucccccucccccgaagcgccccagaccucugacauga

SEQ ID NO: 74987 - RNA, 1386 nt, Artificial Sequence
  derived and/or modified sequence opt5 from RNH1__Homo_sapiens__XP_011518565
augagccuggacauccagucccucgauauucaaugcgaggaacugucugacgccagaugggcugagcuucugccccuccugcagcagugucaggugguccggcuugaugacugcggccugaccgaagcccgcuguaaggauaucagcuccgcgcucagaguuaacccugcucuggccgagcugaaucuccggucuaacgaacugggggacgugggagugcacugcguccuucaaggccugcagacaccgagcuguaaaauucagaagcucucccugcagaauugcugucuuacgggggccggaugcggcgugcugucuagcacccuccgcacacugcccacccugcaagagcuccaucuguccgauaaccuucugggggacgcuggacuccagcugcuuugugagggccugcucgauccucagugcagacuggaaaaacugcagcucgaguacuguagccugucugccgcuuccugcgaaccccuugccagcguucugcgggcgaagccugacuucaaagagcucacagugucuaauaacgauaucaaugaggccggcguccgcgugcugugccaagggcuuaaggacucccccugucagcuggaagcucucaagcuggagagcugcggaguuaccucugauaacuguagagaccugugcggcauuguggccuccaaagcuagccuccgggaacuggcccuuggguccaauaagcugggagacgucggcauggcggagcucuguccugggcugcugcacccgucuagccgccuuagaacacucuggaucugggaaugcggaaucaccgccaaaggcuguggcgaucugugccgggugcugcgcgcuaaggagucccucaaagagcugagccuugccgggaacgaacugggagacgagggcgcuagacuccugugugaaacgcugcuugagcccgggugccagcucgaaucucugugggugaaguccuguagcuuuaccgccgccugcugcucucauuucagcuccguccuggcucaaaaucgguuucuccuggagcuucagauuucuaacaaucgccuggaggaugcgggaguuagagaacucugucagggccuggggcagccuggaagcgugcugcgggugcuuuggcucgccgacugcgaugucuccgacagcucuuguuccagccuggcugccacacugcucgccaaccacucucugagagagcuugaucuguccaauaacugccucggcgacgcuggcauccugcaacugguggaaagcguucgccagcccgggugucuucucgagcagcuggugcuguaugauauuuacugguccgaagagauggaggaccggcuccaggcccuggaaaaggauaaaccuucucuuagagucaucagcuga

SEQ ID NO: 74988 - RNA, 1029 nt, Artificial Sequence
  derived and/or modified sequence opt5 from RNLS__Homo_sapiens__NP_001026879
auggcccaggugcugaucgucggcgcugggaugaccggaagccucugcgccgcgcugcuuagacggcaaacauccggcccccuguaccucgcuguuugggacaaggccgaggauucugggggacgcaugacgaccgccuguagcccucacaacccgcagugcacagcugaccugggcgcccaguauauuaccuguacaccccauuacgcuaaaaagcaccagagauucuaugaugaacuucuggccuacggggugcuccggccucuguccucucccaucgagggaauggugaugaaagaaggcgacugcaauuuugucgcgccucaaggcauuagcuccaucauuaagcauuaucugaaagagucuggggccgaaguguacuuccgccacagaguuacccagaucaaccuccgggaugacaagugggaggugagcaagcagacaggaucccccgagcaguuugaucugaucguccuuaccaugccugugccggaaauucugcaacuccagggcgacaucacgacccugauuagcgagugucagcgccagcaacuugaagcuguuucuuauuccagcagauacgcccugggacucuucuacgaggcugggacaaaaaucgaugugcccugggccggccaguauauuaccucuaauccuugcauccgguuugucuccauugacaacaagaaacgcaauaucgagagcucugaaaucgggcccucccuggugauucauacaaccgugccuuucggagucacguaccuggagcacagcaucgaagauguucaggagcucguguuucaacagcuggaaaacauucuucccggccugccgcagccuaucgcgacaaagugucagaaauggagacacucccaagugaccaaugccgcugccaacugccccggccagaugacacuccaucacaagccuuuccuggcuugugggggagacggcuuuacccagucuaauuucgaugggugcauuaccagcgcccuuuguguccuggaggcccucaagaacuauaucuga

SEQ ID NO: 74989 - RNA, 1431 nt, Artificial Sequence
  derived and/or modified sequence opt5 from RNMT__Homo_sapiens__NP_003790
auggccaacagcgcuaaggccgaggaauacgagaaaaugucccuggaacaggcgaaggcuucugugaauagcgagaccgaauccucuuucaacaucaaugagaacacaacggccagcggcaccgggcucuccgagaaaacaucugucugcagacaaguugacauugcccggaagcgcaaagaauuugaggaugaccuggugaaggaaagcuccagcuguggaaaggauacccccucuaaaaagagaaaacuugacccugagaucgugccggaggaaaaggauugcggcgacgcugaggggaauagcaaaaagcggaagcgcgaaacagaggauguccccaaagacaagagcucuaccggagauggcacacagaacaaaagaaagauugcccuggaagacgugccugagaaacagaagaaucucgaggaagggcacuccagcaccguugcugcccauuauaacgagcugcaggaagugggacuugagaaacggucucaaucccgcaucuucuaccugagaaauuuuaacaauuggaugaaguccguccucauuggcgaguuccuggaaaaggugcggcagaaaaagaaacgcgauaucacgguucuggaccucggcugugggaagggaggcgaucugcuuaaauggaagaaggggagaaucaacaaacuggugugcaccgacauugcggacgucuccgugaagcagugucagcaacgguaugaggauaugaaaaaucgcagagacucugaauacaucuuuagcgccgaguucauuacagcugauuccagcaaggaacuccugaucgacaaauuucgggauccccagaugugcuucgacauuuguucuugccaguuugugugucacuauuccuucgagagcuacgaacaggccgauaugaugcuucgcaacgcuugcgagagacugucuccuggaggcuauuuuaucgggaccacacccaauagcuucgagcucauucggagacuggaagccuccgagaccgaaucuuuuggaaacgagaucuacacggucaaguuccaaaagaaaggcgacuacccucuguucggcuguaaguaugauuuuaaccucgaggggguuguggacgugccggaguuccuggucuacuuuccccuucugaaugaaauggcgaaaaaguauaacaugaaacucguguacaagaagacauuccuggaauuuuaugaggaaaagaucaagaauaacgagaauaaaaugcuucugaagcgcaugcaggcccucgagccuuaccccgcuaacgaaagcuccaaacugguuagcgagaagguggaugacuaugaacaugccgcuaaauacaugaaaaauucucagguccggcugccucucggaacccuguccaagagcgagugggaagccacaucuauuuaccuuguguucgccuuugagaaacaacaguga

SEQ ID NO: 74990 - RNA, 1953 nt, Artificial Sequence
  derived and/or modified sequence opt5 from RNPEP__Homo_sapiens__NP_064601
auggccagcggcgagcacucccccgggucuggagcugccagacggccucugcauagcgcgcaggcuguggacgucgccuccgccucuaacuuccgcgcuuuugaacuccugcaccuucaucuggaucucagagccgaguucggcccgcccgggccuggagcuggcagccgggggcuguccggaaccgccguucuugaccugcgcugccucgaacccgagggcgcggccgaacugagacuggauucucacccuugucucgaggugacagcugccgcucugcggcgcgagagacccggcagcgaagaaccuccggccgaacccguguccuuuuacacgcaaccuuucagccauuaugggcaggcgcuuugcgucucuuuuccccagccuugucgggccgcugagcgccuccaggugcugcugaccuacagaguuggagagggccccggggugugcuggcuugccccggaacaaacagcuggaaagaaaaagccuuucgucuauacccagggccaggccgugcugaaucgggccuuuuuccccuguuuugacaccccugcuguuaaauacaaguauuccgcgcucaucgaggugcccgauggguucaccgccgucaugagcgcuucuacaugggaaaaacgcggacccaacaaguuuuucuuucagaugugccaaccuauuccguccuaccugaucgcccuggccauuggcgaccucgugagcgcugaggugggccccagaucucgggucugggccgaaccuugucugaucgaugcggcuaaggaggaguauaaugggguuauugaagaguuccuugccaccggagaaaaacuguucggccccuacgugugggggcgcuacgaccuccuguuuaugccucccuccuucccguuuggaggcauggagaacccuugccuuacguucgugacccccugucugcucgccggggauagaagccuggcugacgucaucauccacgaaauuucccacucuugguuuggaaaucuggugacaaacgccaauuggggcgaguucuggcucaacgagggcuuuaccauguaugcucagcggagaaucagcacaauucuguucggggccgcguacacaugccuugaagccgcuacgggacgcgcccugcuccggcagcauauggauaucacaggcgaggaaaauccucugaacaaacuuagaguuaaaauugagcccgggguggacccugaugacaccuauaaugaaacacccuacgagaagggauuuuguuucgucuccuaucuggcucaccucgugggcgaccaggaucaauuugacagcuuccugaaagccuacguucaugaguuuaaguuccgcucuauccuggcggaugacuuccucgauuuuuaucuggaauacuucccggagcuuaagaaaaagcggguggacauuaucccuggguuugaguucgauagauggcugaacacccccggcuggcccccuuaccucccggaccugucccccggagauagccugaugaaaccugccgaggagcuugcucagcucugggccgcugaggaacuggacaugaaggccaucgaagccgucgcuauuucucccuggaaaaccuaucagcugguguacuuucucgauaagauccugcaaaagagcccucuucccccuggcaaugucaagaagcugggggacacauaucccuccauuucuaacgcgcgcaaugccgagcuccggcugagauggggacagaucgugcugaaaaacgaccaccaggaagauuucuggaagguuaaagaguuucuucacaaccagggcaagcaaaaauacacgcucccgcuguaucaugcuaugaugggagggagcgagguggcccagacccuggccaaggaaacauucgcuuccaccgccagccagcuccacucuaaugucgugaacuacguucagcaaauuguggcgccuaagggcuccuga

SEQ ID NO: 74991 - RNA, 2178 nt, Artificial Sequence
  derived and/or modified sequence opt5 from RNPEPL1__Homo_sapiens__NP_060696
auggccgcucagugcuguugcagacaagcccccggcgcggaggcugccccugugcggccgcccccugaacccccucccgcccuggacgucgcuagcgccuccucugcucagcuguuccgccugagacaccuucagcuggggcucgagcugcggccugaagcccgcgagcuugcgggaugucugguucucgaacugugcgcccugagaccggcuccccgggcccucgugcuggaugcucauccugcccuucgccugcacagcgcggccuuuagacgggcucccgccgcugccgccgagaccccuugugcuuucgcguuuuccgcccccggcccggggccugcucccccuccuccccuccccgccuucccggaggcccccggaucugaaccugcuugcuguccccuggccuuucgcguggacccuuucacagauuacggcagcucccuuacggucacccugcccccggagcuccaggcgcaucaaccuuuucaggugauccugagauauacaucuaccgacgcucccgccauuugguggcuggauccugaacucacauacgggugcgccaagcccuucguuuuuacccagggacacagcguguguaaccgguccuucuuuccuugcuucgacacacccgcugucaaauguaccuauagcgccgugguuaaggcuccgucuggcgugcagguccugauguccgccacgcgcagcgcguacauggaggaggaaggcguguuucauuuccacauggagcacccugugcccgccuaucuugucgcucugguugccggggaucucaaacccgcugacaucggaccuagaucucgggugugggccgaaccgugccugcuucccaccgcgacauccaagcugagcggcgccguggagcaauggcucucugcugccgaacgccuguacgggccuuauauguggggaagauacgauauugucuuccugcccccuuccuuucccaucguggcuauggagaauccuugccucaccuucauuaucagcuccauccuggagucugacgaauuucuuguuauugaugugauccaugaggucgcccacagcugguucggcaacgccgugacaaaugcuaccugggaagagauguggcuguccgaagggcucgcgacguacgcccagcggagaauuacaaccgagacauauggagcugccuuuaccugucuggagaccgccuuccgccuugacgcucugcaucggcagaugaaacuccugggcgaagauagccccguuucuaagcuccaggugaagcucgagccgggcgucaacccuucccaccugaugaaucuuuuuacauacgaaaaaggguauugcuucguguacuaucugagccaacucuguggagacccccagagauuugacgauuuccugcgcgccuacgucgagaaguauaaauuuacgucugugguugcgcaggaccugcuugauagcuuccucuccuuuuucccugaacugaaggagcaaucuguggacugccgggcuggccuggaguucgaaagauggcucaacgccaccgggcccccgcuggccgagccugaucuuagccagggauccagccugacacgccccgucgaagcucucuuucagcuguggaccgccgagccucuggaccaggcggcugccucugccuccgcuaucgauauuagcaaauggcggacauuccaaaccgcccuuuuucucgacagacugcuggauggcucuccccucccccaggaggugguuaugucccugagcaaguguuacuccucucuucuggacagcaugaaugcugaaauccgcauucgguggcuccagaucguggucagaaacgauuacuauccugaccugcaccgcgugcggagauuccuggagucccagaugucucggauguacacgaucccgcuuuaugaagaccucugcacaggggcccucaagagcuuugcgcuggagguguucuaccaaacccagggacgccugcaucccaaucugagacgggccauucagcagauccuuucccaaggccugggcagcucuaccgaaccugcuuccgagcccagcacagagcucgggaaagccgaagcugauaccgacucugaugcccaggcccugcugcuuggagacgaggcuccuuccagcgcgauuucucucagagauguuaacgucagcgccuga

SEQ ID NO: 74992 - RNA, 849 nt, Artificial Sequence
  derived and/or modified sequence opt5 from RNPS1__Homo_sapiens__NP_001273555
auggcccccagcccuaccaagagaaaagaccgguccgaugagaagucuaaagaccgcagcaaggauaaaggcgcuacaaaggaauccucugagaaggacagagggcgggauaaaacgcgcaagagacggagcgccuccucuggaagcuccagcacccgcucuagauccagcucuacauccagcucuggcuccagcaccuccacagggucuagcuccggaagcagcuccagcucugcgagcucccggucuggcagcuccagcaccucucgcuccucuucuuccagcuccucuagcggguccccgucucccagcagacggcgccacgacaacagacggcgcuccagaagcaaaucuaagccucccaaacgggaugaaaaggagagaaagcgccgguccccuagccccaaaccuacaaaggugcauaucggaagacugacccgcaaugucacgaaagaccacauuauggaaaucuucucuaccuacggcaagauuaaaaugaucgauaugccgguugagcggaugcauccccaccucuccaagggcuaugcuuacguggaguuugaaaacccugacgaggccgaaaaagcccugaagcauauggaugggggacagauugacggccaagagaucacagcuaccgccgugcuugcucccuggccuagacccccgccucgccgguucagcccucccagacgcaugcugcccccucccccgauguggcggagaucucccccucgcaugcggagacggagccgcucccccagacggagaagcccuguccgccggagaucucgcucccccgggagacggcgccacagaagccgguccucuagcaauuccucucgcuga

SEQ ID NO: 74993 - RNA, 4656 nt, Artificial Sequence
  derived and/or modified sequence opt5 from ROBO1__Homo_sapiens__NP_001139317
augaucgccgagcccgcucacuucuaccuguuuggccugauuugccuguguagcggguccagacuucggcaggaagacuucccuccgcgcaucguggagcaucccucugaucugauugucagcaagggagaaccugccacccucaacugcaaagcggagggcagacccacaccuacgaucgaaugguauaaagggggagagcggguugagaccgacaaagaugacccccgcucccacagaaugcugcuuccuucuggcagccuguuuuuccuccggauugugcaugggcgcaaguccagaccggaugaaggaguguacgucuguguggcucggaauuaucugggcgaggccguuucucacaacgccagccuggaaguggcuauccuccgcgacgauuuuagacaaaaucccuccgacgucaugguggccguuggcgagccugcugugauggagugccagcccccucgggggcaucccgaaccgacaaucagcuggaaaaaggauggaucuccucuggacgauaaggacgagcgcauuaccaucagaggcgggaaacuuaugauuacauacacccggaaguccgaugccggaaaauaugucugugugggcacaaacauggugggggaacgcgagagcgaagucgcggagcugaccguucucgagagacccucuuucgugaagcggccuuccaaucuggccgugacggucgacgacagcgcugaauuuaaaugcgaggccagaggagaucccgugcccaccguucgcuggcggaaggacgauggcgaacuuccuaagucuagauacgagauccgcgacgaucacacacugaaaauucggaaggugaccgcuggcgacaugggguccuauacaugugucgccgaaaacauggugggaaaagcggaggccagcgcuacccucacgguucaggugggcuccgagccgccccacuucgucgugaagccuagagaucaggucguggcccuggggcgcacaguuaccuuucaaugcgaagcuacaggaaauccccagccugccaucuucuggcggagagagggcucucagaaccugcucuuuagcuaccagcccccgcaauccagcucucgcuucuccgugagccagaccggggaccugaccauuacaaauguccagcggucugaugugggauacuauaucugucagacgcuuaacguugccggcagcaucauuaccaaggcuuaccuggaagugacagacgucaucgcggauagaccucccccugugauucgccaaggccccgugaaucagaccguugccgucgacgggacauuugugcucuccugcguggcuaccggaucuccuguccccacgauccuguggcggaaggacggcgugcuuguuagcacacaggauuccagaauuaaacaacuggagaacggggugcuccagauccgguaugccaagcugggagacaccggccgcuacaccuguaucgccagcacaccgucuggggaagcuaccugguccgccuauauugagguccaggaguucggcgugccuguucagccucccagaccuacagauccgaaucugauccccagcgcgccuucuaagcccgaagugacggacgucucccggaacaccgugacacucagcuggcaaccuaaucugaacuccggagcuacccccacaucuuacauuaucgaggccuucagccaugccuccggcucuagcuggcagaccguugcugaaaacgugaaaacggagaccuccgccauuaaggggcuuaaaccuaaugcuaucuaucuguuucucgucagagccgcgaacgccuacggaaucagcgaucccucucagauuuccgacccggugaagacacaggaugugcugccuaccagccaaggcgucgaccacaaacagguucagcgcgagcuugggaaugcugugcugcaucuccacaaccccacagugcugucuuccagcucuaucgaaguccacuggaccguggaucagcaaagccaguacauucagggauauaagauccuguaccggccuuccggcgccaaucauggggagagcgacuggcucguuuucgaagugagaacgcccgcuaagaacucugucgugauuccggaucugcgcaaaggcguuaauuaugagaucaaggccagacccuuuuucaacgaauuucagggagcggacuccgagauuaaauucgccaagacacuugaggaagcucccagcgccccuccccaaggcgugaccgucuccaaaaaugaugggaacggaacagcuauccuggugucuuggcagcccccuccggaggacacccagaauggcaugguucaagaauacaagguguggugccucgggaacgagacccgguaucacaucaauaagacagucgacggaagcacguuuuccguggugauucccuuccuggucccuggcauccgcuacucuguugaaguggccgccagcaccggggcuggcuccggagugaaaucugagccccaguuuauucagcuggaugcgcauggcaacccugucagccccgaggaccaggugucccuugcccaacagaucagcgauguugugaagcagccugcuuucauugccgggaucggagccgcuugcuggaucauucucauggucuuuucuaucuggcuguauagacaccggaaaaagcgcaauggccugacauccaccuacgccgggauuagaaaagugacauaccagcggggaggcgaagcgguuagcucugggggccgcccgggacuccugaacaucuccgagcccgcugcccaaccuuggcuugccgacaccuggcccaacacgggcaauaaccauaaugauuguagcauuucuugcuguacagcugggaacggaaauuccgacagcaaccugaccaccuauuccagaccuggccagcccacaccguacgccaccacacagcucauccagagcaaucugucuaacaauaugaacaaugggagcggagauuccggcgaaaagcacuggaagccucugggccaacagaaacaggagguggcgcccguccaauauaacaucguggaacagaauaaacuuaacaaggacuaccgggcuaaugauacggugcccccuaccauucccuauaaccagucuuacgaccagaacacagggggaagcuauaauuccucugaucgcggcagcuccaccucugggagccaaggacacaagaaaggcgccagaacaccuaaggucccgaaacaagggggaaugaacugggccgaccuccugcccccucccccugcucaucccccgccucacuccaauagcgaggaguacaacaucucuguugaugaauccuacgaccaggagaugcccugcccugugcccccugcccggauguaucugcagcaggacgaacucgaggaggaagaggaugaaagaggccccaccccgccuguccgcggcgcugccagcucucccgcggccguguccuacagccaucaguccacggcuacccugacacccucuccucaggaggaacuucagccgaugcugcaagacugucccgaggagaccgggcacaugcagcaccagccugaucggagacgccagcccguuagcccucccccuccgccccggccuauuagcccuccccauacauauggauacaucagcggcccccucgugucugacauggauaccgacgccccggaagaggaagaggaugaagcugacauggaggucgccaagaugcaaacaagacgccugcugcuucgggggcucgagcagaccccugccuccagcgugggagaucuggaaucuagcgugacgggcuccaugauuaauggguggggaucugcuagcgaggaagacaacaucuccucuggcagaagcuccguuuccucuuccgauggcagcuucuuuacagacgcggacuucgcccaggcugucgccgccgcugccgaguaugcggggcugaagguggcucgccggcaaaugcaggaugccgccggaagacggcacuuccaugcuucccagugcccccgccccaccucuccugugagcaccgacuccaauaugucugccgcggucaugcagaaaacaagacccgcuaagaaacucaagcaccaaccuggccaucugcggcgcgaaaccuacacggaugaccuuccgcccccucccgugccucccccggccaucaaaagcccuacagcccaguccaagacccagcuggagguuagacccguggucgugccuaagcuccccagcauggaugcucggacagacagaucuuccgaucgcaaagggagcucuuauaagggacgggagguucuggacggcagacagguggucgauaugcgcaccaacccuggggacccccgggaagcccaagagcagcagaaugauggaaaaggcagaggcaacaaggcugccaaacgcgaccugccgccugcgaagacacaccuuauucaggaagauauccuccccuacugucggcccaccuuuccuacguccaauaacccgagagaccccagcucuagcuccucuaugagcucccgcgggagcggauccagacaacgggagcaggccaaugugggccgcagaaacauugcugagaugcagguucucgggggauacgaacggggcgaggacaauaacgaggaacuggaagagaccgagucuuga

SEQ ID NO: 74994 - RNA, 4185 nt, Artificial Sequence
  derived and/or modified sequence opt5 from ROBO2__Homo_sapiens__NP_001122401
auggccagacggcacgagcgcgugaccagacggauguggacaugggcucccggccugcucaugaugacggucguuuucugggggcaucagggaaacggccaagggcagggaagccgccugagacaggaagacuuuccuccgcggaucguggagcaccccuccgaugugauugucucuaagggcgaaccuaccacacuuaauugcaaagccgaggggcgccccaccccuacaaucgaaugguacaaggacggagagagaguggagaccgauaaagacgauccccggagccaucgcaugcugcucccuuccggcucucuguucuuucuuagaauuguucacggccggcgcagcaagccggacgaaggguccuaugugugugucgcgagaaacuaccugggagaggcugugucucggaaugccagccucgaaguugcccugcugcgcgaugacuucagacagaaccccacagauguggucguggcugccggcgagccugcuauccucgagugccaacccccucgggggcaucccgaaccgaccauuuauuggaaaaaggacaaggugagaaucgaugacaaagaggaacgcaucuccauucggggaggcaagcugaugaucagcaauacgagaaaaucugaugccgggauguacaccugugucggaacaaacaugguuggcgagcgcgacuccgacccugcggaacuuaccguguuugagcggcccacauuccugagacgcccuauuaaucaggugguccucgaggaagaggccguggaauuucggugccagguucagggcgauccccaacccaccgugagauggaagaaagacgaugcugaccugccucgcgggcgguaugauaucaaggacgauuacacgcuuagaauuaagaaaacaaugagcaccgacgagggaacauauauguguaucgccgaaaaccgcgucggcaagauggaggcuucugccacccugaccgugcgggcgccgccccaguucguugugagaccucgggaucagauugucgcccaggggcgcacagugacguuucccugcgagaccaaaggaaauccucaacccgcugucuucuggcagaaggaaggcucccagaaccuccuguuuccgaaucaaccucagcagcccaacagcagauguucuguguccccuacaggggaccugaccaucacaaauauccagcggagcgaugccggauacuacauuugccaagcucucaccguugccggcuccauccuggccaaagcucagcuugaggugacggacguccugacagacagacccccucccauuauccuccagggcccggcgaaccagacccuggccguggaugggaccgcccuucugaaguguaaagcuacaggagacccucuccccguuauuucuuggcugaaggaaggcuucaccuuucccgggcgcgauccucgggccacaauccaagagcagggaacgcugcagaucaagaaucucagaauuagcgacaccggcacauauaccugcguggcuacauccagcucuggggaaaccuccuggagcgccguccuggaugugacggagucuggcgcgaccaucagcaaaaacuacgaccuuuccgaucugccgggacccccuucuaagccccaggugacagacguuaccaaaaacagcgucacacucuccuggcaaccuggcacccccgggacgcugccugcuagcgccuauauuaucgaggccuucucucaguccgugagcaauucuuggcagacaguggcuaaccacgucaagaccacacuuuacaccgugcgcggacugagacccaauaccauuuaucucuucaugguucgggccaucaacccgcagggccuguccgauccuagccccauguccgacccugugcgcacacaagauaucucucccccggcucagggggucgaccacagacaggugcaaaaagaacugggagauguucucgugcggcugcauaauccugucgugcuuacgcccaccacaguucaggugaccuggacagucgaccgccagccucaguuuauucaaggcuacagagugauguaucggcagaccagcgggcugcaggccacguccucuuggcagaaccucgacgcgaaggugcccacagagcgcagcgccguccugguuaaucugaagaaaggcgugaccuacgaaaucaaggugagacccuacuucaacgaguuucaaggaauggauuccgagagcaaaaccguccggacaaccgaagaggcuccuucugccccgccccaguccgugacaguucuuacggugggcagcuauaauucuaccuccauuagcgucucuugggacccucccccucccgaucaccagaacgggaucauucaggaauacaagaucuggugucucggaaaugagacacgcuuccauauuaacaaaaccguggacgcugccaucagaagcguuaucauuggcgggcuguuuccuggaauccaauaucggguggaagucgcggccuccacaagcgcuggcguggggguuaagucugagccgcagcccauuaucauuggcagacgcaaugagguggucaucaccgaaaacaauaacuccaucacggagcagauuaccgauguggugaagcaaccugccuucaucgcuggaauuggcggggccugcugggucauccugaugggauuuagcauuuggcucuacuggcggcggaaaaagcgcaaaggccuguccaacuaugccguuacauuccagagaggggacggaggccuuaugucuaaugggagcagacccggccugcucaacgcuggagauccuuccuaccccuggcuggcggacucuuggccggccaccagccugccugugaauaacuccaauucuggccccaacgaaaucgggaauuuuggacgcggcgaugugcuucccccuguccccgggcagggagacaagacagcuaccaugcucagcgauggcgccaucuauuccagcauugacuucacaaccaaaacgucuuacaacuccagcucucagaucacacaagccaccccuuacgcuaccacacagauucugcacuccaauagcauccacgagcuggccguggaucucccggacccccaguggaagucuuccauucagcaaaagaccgaccugaugggcuuuggguauagccuuccugaucagaacaaaggaaauaacggcgggaagggaggcaaaaagaaaaagaauaaaaacuccagcaagccccagaagaauaacgggucuacgugggcgaacguuccucugcccccgccucccgugcagccucuccccggaacagaacuggagcauuacgcugucgagcaacaggaaaauggcuaugacagcgauuccuggugcccuccccugccggugcagaccuaccuucaccagggccucgaggacgaacuggaggaagaugacgaucggguuccuacaccucccgugagaggggucgccucuagccccgccaucuccuucggacaacagucuaccgcuacacugaccccgagcccccgcgaggagaugcagccuaugcuccaagcccaucuggacgaacuuacgcgggcguaucaguuugauaucgcuaaacagaccuggcacauucaguccaacaaucaacccccucagcccccugugccgccccugggcuacgucucuggggcccucaucagcgaccuggagacagauguggccgacgacgaugcugacgaugaagaggaggcccuggaaauuccuagaccccuucgggcucucgaccagaccccuggauccagcauggauaaccuggacucuuccguuacaggcaaggccuucaccagcucucagcgccccagaccgacguccccuuucagcacagauuccaauaccucugcggcccugagccaaucccagcggccccgccccaccaaaaagcauaaagggggaagaauggaccagcagccugcucucccccaccggagagagggcaugacagaugaagaggcccuggugccuuauagcaagccgucuuuucccuccccuggcgggcacagcucuagcggaaccgcuuccucuaagggcagcacagggccccgcaaaacggaaguccuucgggccggacaucaaagaaacgccuccgaccugcucgauaucggcuacauggggucuaauagccagggacaguucaccggcgagcuguga

SEQ ID NO: 74995 - RNA, 4161 nt, Artificial Sequence
  derived and/or modified sequence opt5 from ROBO3__Homo_sapiens__NP_071765
augcugagauaccuccugaagacccuucugcagaugaaccucuucgccgacagccuggcuggcgauaucuccaauucuagcgagcuucugcucggguuuaacuccucucuggccgcgcugaaucacacacuccugcccccuggagacccgagccuuaacggcucccggguggggcccgaagaugcuaugccucgcauugucgagcaacccccugaccugcucguuucuagaggagaacccgccacgcugccuugccgggccgagggccgcccgagacccaauaucgaaugguauaaaaacggggcucggguggccaccgugcgcgaggauccuagagcucaucggcuucugcuccccagcggagcccuguucuuuccucgcauuguccacggcagacgggcgcgccccgacgagggcguguacacauguguugccagaaauuaucugggggcugccgcuucccggaacgccagccucgaaguggcgguccugcgcgaugacuucagacagucuccgggaaaugugguuguggccgucggcgagccugcugugcuugaaugcgugcccccucgggggcaucccgagcccuccgucagcuggagaaaggauggagcccgccugaaagaggaagagggccggaucaccauuagagggggaaagcucaugaugucucacacacugaaauccgacgcuggcauguacguuuguguggccagcaacauggccggcgaacgcgagucugcugcggccgaagugaugguccuugagcggccuuccuuucugagacgcccggugaaucagguugugcucgcugaugcccccgucaccuuccugugcgaggugaagggggacccucccccucggcugagauggcgcaaggaagauggagagcuccccacaggccgguaugaaaucagaagcgaccauucccuguggaucgggcacguuucugccgaggacgaaggaaccuacacguguguggcugagaacagcgucggccgcgccgaggcguccgggagccuuucugugcacgucccgccucagcuggugacccaaccccaggaucagauggcugccccuggagaauccguugccuuucagugcgagacaaaaggcaaucccccucccgcuauuuucuggcaaaaggaaggcagccaggugcuccuguuuccgucucagagccuucagccuaccgggcgguucuccgucucucccagaggacaacugaacaucacagccgugcagcggggcgacgcuggguauuacguuugucaggccgugagcgucgcgggauccauucucgccaaagcucugcuggagaucaagggcgccagccucgaugggcugcccccugugauucuucaaggcccggcuaaucagacccuggugcucggaucuuccguuuggcugcccugccgcgucacgggcaacccucagcccagcgugagauggaaaaaggacgggcaguggcugcaaggagaugaccuucaguuuaagacaauggccaacggcacccucuacaucgcgaaugugcaggaaauggauaugggguucuauucuugugucgccaaauccagcacaggagaggcuaccugguccggcuggcugaagaugcgggaggacuggggcgugucuccugaucccccuaccgaacccagcuccccgccuggcgcccccucucagccuguugugacagagauuacgaaaaacagcaucacccugacauggaagcccaauccgcaaaccggagcugccgucacauccuacgugaucgaagccuuuagcccugcugcgggcaacaccuggagaacgguugccgacggggugcagcucgagacacauaccgucucuggacugcagcccaauaccauuuaucuuuuccuggugcgcgcuguuggcgccugggggcucuccgagccuagccccgugucugaacccguccggacacaggauuccagcccuucuagaccgguggaggaccccuggcgcggacaacagggccuggccgaaguggcugucagacugcaggagccuaucguucuugggccccggacccuccaggugagcuggacaguggacggcccuguccaacuggugcagggauuccgcguuuccuggagaguggccggccccgaagggggaagcuggacgaugcuggaucuccagucuccuucccaacagagcaccguccugcggggccuuccgcccgggacacagauucagaucaaagugcaagcgcagggacaggagggccugggggcugagucccucucuguuacccgcagcauuccugaagaggcccccuccggcccuccccagggaguggccgucgcucugggcggggacggaaacucuagcaucacaguguccugggaaccgccucugcccucucaacagaauggcguuaucaccgaguaccagauuuggugccuugggaacgaaagcagauuucaccucaaucgguccgccgcgggaugggcucgcagcgccaugcugagaggccuggugcccggccuccuguaucggacgcuugucgccgcugccaccucugcuggggugggagugccuuccgcccccguccugguucagcucccuagcccgcccgaucuggagccuggccuggaggugggggcgggacuugccgugcgccucgcuagaguccugcgggaacccgccuuccuggcuggcucuggggccgccuguggagcucuccugcuuggccugugcgcggcccucuacuggagacgcaagcaacggaaagagcugucccauuauacagcuagcuuugccuacaccccugccgugucuuucccccacuccgaaggccugagcggggcuuccagcagaccgccuaugggacuuggccccgccccuuacucuuggcuggcggacagcuggccccacccuucccgcucucccagcgcucaggagccgcggggguccugcuguccuucuaaccccgaucccgacgauagauauuacaaugaagccggaaucagccucuaucuggcccagacagcucgcggcaccgccgcgccuggggagggaccgguuuacuccacgauugaccccgcuggcgaggaacuccaaacauuucauggcggguucccucagcaccccucuggagaucugggcccuuggagccaguaugcuccgcccgaguggucccagggggacagcggagccaagggcgggaaggugaaacuucugggaaagcccguccaaaugcccucucucaacuggccugaagcccugcccccucccccgccuuccugcgagcugagcugucuugagggccccgaagaggaacuggaggggucuuccgaacccgaggaguggugcccucccaugccugaacggagccaucucaccgagccguccucuagcgggggaugucuggugacacccuccagacgcgaaaccccuagccccaccccuucuuacggccagcaguccacagccacgcucacccccagcccgccugaucccccucagcccccuacagacaugccccaucugcaccaaaugccgcggagaguuccucuugggcccucuagcccccuguccgugucucagccuaugcucggaauccgggaggcucgcccggccggccugggggcgggacccgccgcuagcccucaccugucccccucuccugcccccagcaccgcuuccagcgccccuggcagaacauggcagggcaauggggaaaugacgcccccgcuucagggaccucgggcccgcuuucggaaaaagcccaaagcucugccuuauagaagagagaacucucccggcgaucucccgccuccuccccugccucccccugaggaagaggcguccugggcccucgaacugcgcgcugccgggagcauguccucucuugagcgggaaagaagcggagagcgcaaggccguccaagcugugccgcuggccgcgcagcggguccugcaccccgacgaggaggcuuggcucccuuacuccagacccucuuuccugagccgcggccaggggaccuccacaugcagcaccgccggaucuaauuccagccgggggucuuccagcucuagaggcagccgcggcccuggaagaucccggucucgcagccaguccagaagccaaucccagcggcccggccagaagcgcagagaagaaccucgguga

SEQ ID NO: 74996 - RNA, 2589 nt, Artificial Sequence
  derived and/or modified sequence opt5 from ROBO4__Homo_sapiens__NP_001288017
augguggccgucguuggcgagcaguucacccuggaaugcgggcccccuuggggacacccggagcccacagugagcugguggaaggacggcaaaccucucgcucugcaacccgggagacauacgguguccggaggcucucuucugauggcccgggcggaaaagagcgaugaggggaccuacaugugugucgcuacaaacuccgccggacaccgcgaaucuagagccgcucgggugagcauccaggagccucaggacuauaccgagcccguugaacuccuggccgugcgcauucagcuugagaaugucacacugcucaacccugauccggcugaaggccccaaaccuagacccgccguguggcuguccuggaagguuucuggcccugcggcccccgcucaaagcuacaccgcccuguuucggacacagaccgcucccgggggacagggcgccccuugggcggaggagcuccuggccggguggcaguccgcugaacuuggaggccugcauugggggcaagacuaugaguucaaagugcgccccagcucugggagagcccggggcccugauuccaauguccuccugcuucgccugcccgaaaaggugcccagcgcuccuccgcaggaggugacgcucaagcccggcaacgggaccgucuuuguuucuugggugccucccccugccgaaaaucacaacggaaucauuagaggcuaccagguguggucccuggggaauacaagccugcccccggccaacuggaccgucgugggagagcagacacaacucgagaucgcuacccauaugccuggcucuuauugcguucagguggcggccgucacgggggcuggagccggcgaacccucccggccugugugucugcuucuggagcaggccauggaacgcgcuacacaagagcccagcgaacacggcccuuggacccucgagcagcugagagccacacuuaaacggcccgagguuauugcgaccugcgggguggcucuguggcuccugcugcucggaaccgccgucuguauccaccgcagacggagagcccgcgugcaucugggcccggggcuuuaccgguauacauccgaagacgcuauccugaagcacagaauggaucauucugacagccaguggcucgccgauacguggcgcuccaccagcggaucucgggaccuguccagcucuagcucccuuucuagcagacugggcgcugaugcccgcgacccucucgauugccggagaucccugcugagcugggacucucgcucccccggggucccccuccugccugacacaagcaccuucuacggcucucuuauugcggagcugccguccagcacacccgcccggccuagcccccaggugccugcuguuagacgccucccgccucaacuggcccagcugucuagccccuguuccucuagcgauucccuuugcagccggagaggacucucuuccccgcggcugagccuggcuccugccgaagcguggaaagccaagaaaaagcaggagcuccagcacgcuaauucuagcccccugcuucgcggcagccacucucuggaacucagagccugugagcuggggaaccggggaagcaagaaucugucccaaagcccuggcgcugugccccaggcccuugucgccuggagagcucucgggccgaaacugcugucuuccagcaacgagcucgugacccgccaucugccucccgcgccucuuuuuccccacgaaacgcccccuacacagucccagcaaacccagccgcccguugccccucaggcucccucuagcauccugcucccugccgcccccauuccuauccuguccccgugcucucccccuagcccccaggcuuccucucugagcggaccuucccccgccagcucucggcuuuccuccucuucccucagcucucugggcgaggaccaagauuccgugcugaccccggaagaggucgcgcucugucuggagcuuagcgaaggggaggaaacaccuagaaauuccgugagccccaugccccgcgcuccuucucccccuaccacauacggcuauauuagcgugccgacggccuccgaguucaccgacaugggaagaacaggcgggggaguuggccccaagggaggaguccugcucugcccuccccggccuugccugacccccacaccgucugaaggcagccuggccaacggguggggcuccgcuucugaggauaaugccgcgagcgcucgcgccucccuugugucuagcuccgacggauccuuucucgccgaugcucauuucgccagagcucuggccguggcggucgacucuuuuggcuucgggcuggagccucgggaagccgauuguguguuuaucgacgcuuccucucccccuagcccccgcgaugagauuuuccucaccccuaaccugucccuuccccugugggaauggagaccggacuggcucgaggacauggaaguuagccacacgcagcggcugggacgcggcaugccucccuggcccccugauucccagaucucuagccaaagaucccagcugcauugccggaugccgaaagccggggcuagccccguggacuacucuuga

SEQ ID NO: 74997 - RNA, 4065 nt, Artificial Sequence
  derived and/or modified sequence opt5 from ROCK1__Homo_sapiens__NP_005397
augagcaccggcgacuccuucgagacaagauuugaaaagauggauaaccugcuccgggaccccaaaucugaggugaauagcgauugccugcuugacgggcuggaugcccucgucuacgaccuggauuucccugcccuucgcaagaacaaaaauaucgacaacuuucuguccagauauaaggauacgauuaauaaaauccgggaccuccgcaugaaggcugaagauuacgagguugugaaggugauuggaagaggcgcguucggggaaguccagcuggugcggcacaaaucuacccgcaagguuuaugcuaugaaacugcucagcaaguuugagaugaucaaaagauccgacucugccuucuuuugggaggaacgggauauuauggccuucgcuaacagcccgugggugguccaacuguuuuacgccuuccaggacgaccgcuaucuuuacauggugauggaguauaugcccggaggcgaucugguuaaucucauguccaacuacgacgugccugaaaagugggcuagauuuuacacagccgaggucgugcuggcgcuugaugccauccauagcaugggguucauccaccgggacgugaagcccgauaauaugcugcucgacaaaucuggacaucugaagcuggcugauuuuggcaccuguaugaaaaugaacaaggagggcaugguccgcugcgacacagccguugggaccccugauuauauuucccccgaagugcucaaaagccagggaggcgacggguacuauggaagagagugugauugguggucugugggcgucuuccuguacgaaaugcuugugggggacacaccuuucuaugcugacucccugguuggaaccuacagcaagaucaugaaucacaaaaacucucucacguuuccggaugacaaugauauuuccaaggaggccaagaaccugaucugcgcguuccuuaccgaccgggaagugcgccugggcagaaauggcgucgaggagauuaaacggcaucucuuuuucaagaacgaucagugggccugggaaacacugagagacaccguggcucccguugugccugaucugagcuccgacaucgauacaucuaacuuugacgaucucgaggaagacaaaggggaggaagagaccuuccccauuccuaaggccuuugucggaaaucaacugcccuucgugggcuuuacguauuacagcaaccgccgguaccuuuccagcgcuaauccgaacgauaauagaacaucuuccaacgccgacaaaagccugcaggagucucuccagaagaccaucuauaagcuggaggaacagcuucacaaugaaaugcaacugaaagacgagauggaacagaagugucgcacaagcaacaucaaacucgauaagauuaugaaagagcuggacgaggaagggaaucagcggagaaaccuggaguccaccgucucucagaucgaaaaggagaagaugcuccugcaacaccgcauuaaugaguaccagcggaaagccgaacaggagaacgaaaagagacgcaauguggagaacgaaguuagcacccuuaaagaucaacuggaggaccucaagaaagugucccagaauagccagcuggcuaacgagaagcugucucagcuucaaaagcagcucgaagaggcgaacgaucugcugcggacagaauccgacacggccgucagacuccgcaaaagccauaccgagaugucuaaguccaucagccagcuggaaucccuuaaucgggagcugcaggagagaaaccggauucucgaaaauucuaaaagccaaacagauaaggacuauuaccagcugcaggcuauccuggaggccgaacgcagagaucggggacacgacuccgagaugaucggcgaucuucaggccagaauuaccucucuccaagaagaggugaaacaucugaagcacaaccuggagaaaguugaaggggagcgcaaggaagcucaggacaugcucaaucacagcgagaaggagaaaaacaaucuggaaaucgaucuuaacuauaagcugaaaucccuccagcagcggcuggagcaagaagugaaugagcauaaggucacaaaagccagacugaccgacaagcaccagagcauugaagaggcgaagucuguggcuaugugcgagauggaaaagaaacuuaaagaggaacgcgaggccagagaaaaggccgagaaccgggugguucagaucgagaaacaauguuccaugcucgacgucgaucugaagcagagccagcagaagcuggaacaucucacgggaaauaaagagcgcauggaagacgaggugaagaaccugacacuucaacuggaacaggagucuaauaaaagacuccugcugcagaacgagcuuaagacccaggcuuucgaagccgauaaucucaaaggccuggagaagcaaaugaagcaggaaauuaacacccugcucgaggcuaaacggcugcuugaguuugaacuggcccagcucacaaagcaguaccgcggcaacgaggggcaaaugagagaacugcaggaccagcuggaggcggaacaauauuucuccacccuuuacaaaacacaggugaaggagcugaaagaggaaaucgaggaaaagaaucgggagaaccucaaaaagauccaggaacugcagaaugagaaggagacgcucgccacccaacuggaucuugcugaaacaaaagccgagagcgaacagcuggcucgcggacuccuggaggaacaguacuuugagcugacccaggagucuaagaaagccgcgagcagaaaccggcaagaaauuacagacaaggaucacaccgucucccgccuugaggaagccaauagcaugcugacgaaagacaucgagauucucagacgggagaacgaggaacugaccgaaaagaugaagaaagcugaggaagaguauaagcucgagaaagaagaggaaaucucuaaucugaaggccgcuuucgagaaaaacauuaauacagaaagaacccuuaagacacaggccgugaacaagcuggccgagaucaugaaucgcaaagauuucaagauugaccggaaaaaggcuaacacccaggaucucagaaagaaggagaaggaaaaucgcaaacugcagcuggagcuuaaccaagaacgggagaaguuuaaucagaugguugugaaacaucagaaggaacugaacgacaugcaggcgcaacucgucgaggagugcgcccacagaaacgaacugcagaugcagcucgcuuccaaagagagcgacaucgaacaacugcgcgccaaacuucuggaucuguccgacucuacgagcguggccuccuucccuucugcugaugagacagacggcaaucuccccgagagccggaucgaaggguggcuguccguuccuaacagaggaaauauuaagcgcuacggcuggaaaaagcaguauguggucgugucuagcaaaaagauccuuuucuacaacgaugagcaggacaaagaacaguccaaucccagcaugguucuggauauugacaagcucuuucacgugcggcccgucacccaaggggauguguauagagccgagacagaagagaucccuaaaauuuuucagauccuguacgcgaacgagggcgaaugucggaaggacguggagauggaaccgguccagcaggcugagaagaccaauuuccaaaaccauaaaggacacgaauuuauccccacccucuaucauuucccugccaauugcgaugccugugcuaagccccuguggcacguuuuuaaaccucccccggcccuugagugccgcagaugccacgugaagugucaucgggaccaccuggauaaaaaggaggaccugauuugcccuuguaaggugucuuacgacgucacauccgcgcgcgauaugcuccugcuugcuugcagccaggacgaacagaaaaagugggugacgcaucugguuaaaaagauccccaaaaacccucccucuggcuucgugagagccuccccucggacccucagcacaagaucuaccgccaaucaguccuuucgcaaggucgugaagaacacaagcgggaaaaccuccuga

SEQ ID NO: 74998 - RNA, 4167 nt, Artificial Sequence
  derived and/or modified sequence opt5 from ROCK2__Homo_sapiens__NP_004841
augagcagacccccuccgaccggcaagaugcccggggccccugagacagcucccggagacggcgccggggcgucccggcagcgcaaacuggaagcucucaucagagauccucggucucccauuaacguggagagccugcuugacggacuuaauucccucguccuggaucuugacuucccugcccugcgcaagaacaaaaauaucgauaacuuucucaauagauacgaaaagauuguuaaaaagauccggggccugcaaaugaaggccgaggacuaugauguggugaaagucauugggcgcggagcuuucggcgaagugcagcugguuagacacaaggccucucagaaaguguacgcuaugaagcuccugagcaaauuugagaugaucaagcgguccgacucugccuucuuuugggaggaacgcgauaucauggcguucgccaacagcccgugggucgugcagcuguuuuaugcuuuccaagacgauagauaccuguauaugguuauggaguacaugcccggcggggaccucgugaaucugauguccaacuaugaugucccugaaaagugggccaaauuuuacacggcugagguggugcuugcccuggacgcgauucauagcaugggacucauccaccgggacgucaagcccgauaauaugcugcuggacaaacauggccaccucaagcuggccgauuucgggaccugcaugaaaauggacgagacaggaaugguucauugugauaccgcugugggcacaccugacuacauuucucccgaagugcuuaagucccaagggggagauggcuuuuauggccgcgagugcgacugguggagcgucgggguguuccuguacgaaaugcucguuggagauaccccguuuuaugccgacucucuggugggcacauacuccaaaaucauggaucacaagaacagccuuuguuucccugaggacgcugaaauuucuaagcacgccaaaaaucugaucugcgccuuccucaccgacagagagguccggcuggggcgcaacggaguggaggaaauuagacagcaucccuuuuucaagaaugaucaguggcacugggacaacauccgggagacggcugcgccuguugugcccgaacuguccagcgauaucgacuccucuaauuuugaugacauugaggaugacaaaggcgaugucgaaaccuuccccaucccuaaggccuuuguggggaaccaacucccguucauuggauuuacauauuacagagagaaccugcuucugagcgacucccccagcugucgcgagaccgauucuauccagucccggaaaaaugaagagagccaggaaauucagaagaagcucuauacacuggaggaacaucuuucuaacgagaugcaagcuaaagaggaacuggagcagaagugcaaaagcgucaauaccagacucgaaaagacggccaaagagcuggaggaagagaucacacugcgcaaguccguggaaucugcccuccggcagcuggagagagaaaaggcccuucugcaacacaaaaacgcugaguaccagcgcaaggcggaccacgaggcugauaaaaagcggaaucucgaaaacgacguuaauagccugaaagaccagcuggaggaucuuaagaagagaaaccaaaauucccagaucagcaccgaaaaagugaaccagcuccagcgccagcuggacgagacaaaugcccugcuccggaccgaaucugauaccgccgcuagacugcgcaagacacaagccgaguccagcaaacagauucagcagcuugagucuaacaaucgggaccugcaagauaagaacugucuccuggaaacggcuaaacugaaacuugagaaagaguucaucaaucuccaguccgcccuggaaagcgaaagacgggaccgcacccauggcuccgagauuaucaacgaucugcagggcagaauuugcgggcucgaggaagaccugaagaacggaaagauccuucuggcgaaagucgagcucgaaaagcggcagcugcaagagagauuuacagaucuggagaaagaaaagucuaauauggagaucgacaugaccuaccagcuuaaagugauucagcaaagccucgaacaggaggaagccgagcacaaggcuacaaaggcccgccuggcugauaaaaacaagaucuaugaguccauugaagaggccaaaucugaagcgaugaaggagauggaaaagaagcugcucgaggagcggacccugaagcagaaaguugaaaaucuucugcucgaggccgaaaagagauguagccugcuggacugcgaucuuaaacagucccaacagaagaucaacgagcuccugaaacagaaggacgugcugaaugaagacguccgcaaccucacgcugaagauugagcaggagacacagaaaagaugucuuacccagaaugaucugaagaugcagacccagcaagugaacacacucaaaaugagcgaaaagcagcugaaacaggagaauaaccaucugauggaaaugaagaugaaucuugagaaacaaaacgcugagcugcggaaggaacgccaggacgccgauggccagaugaaggagcuccaggaccaacuggaagcugagcaguacuucucuacccucuauaaaacacaggugagagaacugaaggaggagugcgaagagaaaacgaaacuugggaaggaacugcagcaaaagaagcaggagcuccaggaugaacgggacucccuggccgcccagcuggagaucacccuuacaaaagcugauagcgagcaacuggcgcgcucuauugccgaggaacaguacuccgaccucgaaaaggagaaaaucaugaaggaacuggagaucaaagagaugauggcuagacacaagcaggaacucaccgagaaggaugccacaauugccagccuggaagagaccaaucggacgcuuaccucugacguugcuaaccuggccaaugagaaagaggaacucaacaacaagcugaaagauguccaggaacaacugagccgccuuaaggacgaggaaaucuccgcggcugccauuaaagcccaguuugagaagcagcugcucacagagagaacccugaagacacaagcugugaauaaacucgccgaaaucaugaaccggaaggagccugugaaacgcggaaaugacaccgaugucagacggaaggaaaaagagaacagaaagcugcauauggaacuuaagagcgagcgcgagaaacugacgcagcagaugauuaaguaucagaaagaacugaaugagaugcaagcgcagaucgcugaagagucucagauccggauugaacuccagaugacacuggacuccaaggauagcgacaucgagcaacuuagaucccagcugcaggcccuccacauuggccuggauucuagcuccaucgggucuggccccggagacgccgaggcugaugacggcuucccugaaagccgccucgagggguggcugucccuucccgugcggaacaauaccaaaaaguuuggauggguuaaaaaguacgugauugucucuagcaagaaaauccuguucuaugauuccgaacaggacaaggagcaaagcaacccguacauggugcuggauaucgacaaacucuuccacguuagaccugugacacagaccgaugucuaccgcgccgacgcuaaggagauuccccggaucuuucagauucuguaugccaaugaaggcgagucuaaaaaggaacaagaguucccuguggaacccguuggggagaaguccaacuacaucugccauaaaggacacgaguuuauuccuacccuuuaucauuuccccacaaauugugaagcgugcaugaagccgcuguggcacauguuuaaaccuccucccgcccucgaguguagacgcugccacaucaagugucauaaagaccacauggauaagaaggaagagaucauugcucccugcaaaguguacuaugacaucagcacggccaagaaccugcuccugcuugcuaauucuaccgaggaacagcagaaaugggucucccggcuggugaagaaaauuccgaagaagcccccugcccccgauccuuucgccagaagcucuccccggacauccaugaaaauccagcaaaaccagagcauucgcagaccuucccggcagcuggcucccaauaagccgagcuga

SEQ ID NO: 74999 - RNA, 864 nt, Artificial Sequence
  derived and/or modified sequence opt5 from ROGDI__Homo_sapiens__NP_078865
auggccaccgugauggcugccacagcggcugagagagccguccuggaagaggaguuccgguggcuccugcacgacgaaguucaugccgugcuuaagcagcugcaagauauccucaaagaagcuagccugcgcuuuacgcuucccggcuccgggaccgagggaccugccaagcaggagaacuucauucugggcucuugcgggacagaccaggugaaaggaguccucacccugcagggcgaugcucugagccaagccgacgugaaucucaagaugccgagaaacaaucagcugcuucacuuugcguuccgggaagauaaacaguggaagcugcagcaaauccaggacgcccgcaaccauguuucccaggcuauuuaccuccugacaucuagagaucagagcuaucaauuuaagaccggggccgaggugcuuaaacugauggacgcugucaugcuccagcugacacgggcccgcaauagacugaccacgcccgcgacccucacacugccugaaaucgccgcuuccggacuuacccggauguucgcccccgcucugccuucugaucuccuggugaacguuuacauuaaucuuaacaagcugugucucacaguguaucagcugcacgcccugcaacccaauagcaccaaaaacuuucgcccugccggcggcgcuguccuccauuccccgggggcgauguucgaguggggaagccagagacuggaggugucucacgugcacaaggucgaaugcguuauccccuggcuuaaugacgcccugguguacuuuacggugucccuccagcugugucagcaacuuaaagauaagaucagcgucuucucuuccuauuggagcuaccggccuuuuuga

SEQ ID NO: 75000 - RNA, 1056 nt, Artificial Sequence
  derived and/or modified sequence opt5 from ROM1__Homo_sapiens__NP_000318
auggcccccgugcugccucucguccugccgcuucagcccagaauccggcuggcucaaggccucuggcugcuuagcuggcugcucgcccuggccgggggaguuauucugcucugcuccggccaucugcuugugcagcugcgccaccucgggaccuuccuggcuccuucuugucaguuucccgugcuuccucaggccgcccuggcugccggagcugucgcccucggcacagggcuggugggaguuggcgcgagcagagccucccugaacgcugcccucuaucccccuuggcggggcgugcuggggccgcuucuggucgcuggaacggccggcgggggaggccuccuggugguugcgcuugggcuggcccucgcucugcccggaucucuggacgaggcccucgaagagggccuggugaccgcucuugcccacuacaaggauacagaagucccuggccauugccaagccaaacgccugguggacgagcuccagcugagauaccacuguugcgggcggcauggauauaaggauugguucggcgugcagugggucagcucccgcuaccuugaccccggggauagagacguugcugaucggauccagucuaauguggaaggacuguaucucaccgacggcgugccuuuuagcuguugcaacccccacuccccgcgcccuugucugcaaaauagacugagcgauucuuacgcgcacccccucuucgacccucggcagcccaaccagaaucugugggcccaggggugccaugagguccuucuggagcaccuccaagaucuggcuggaacacugggcuccaugcuugccgugaccuuucuccugcaggcccugguucuccugggccuucgcuaucugcagacagcucucgaagggcugggaggcgugauugacgccgggggagagacccaaggcuaccuguuccccagcgggcuuaaagauaugcucaagacggcguggcugcagggcggagucgcuuguagaccugccccggaagaggcgcccccuggcgaggcucccccuaaagaagaccugucugaggccuga

SEQ ID NO: 75001 - RNA, 363 nt, Artificial Sequence
  derived and/or modified sequence opt5 from ROPN1B__Homo_sapiens__XP_005247195
auguggaagguggucaaccugcccaccgaccucuucaauagcguuaugaacgugggcagauuuacagaggaaaucgaguggcugaaauuccuugcccuggcuugcuccgcccucggggugacgauuaccaagacacugaaaaucgucugugaagugcuuucuugcgaucacaauggaggccugccucggauuccguuuagcaccuuccaguuucucuacacauauaucgcggagguugacggggaaauuugugcuucccaugugucucgcaugcugaacuacaucgagcaagaggucaucggacccgauggccugauuaccgugaaugacuucacacagaacccuagaguuuggcucgaauga

SEQ ID NO: 75002 - RNA, 441 nt, Artificial Sequence
  derived and/or modified sequence opt5 from ROPN1__Homo_sapiens__XP_011511238
auggcccagaccgacaagcccacaugcaucccuccggagcugcccaaaaugcucaaggaguucgcuaaagccgcgauuagagugcaaccucaggaucugauccagugggcugccgacuacuuugaggcccuuagccggggcgaaacgcccccuguccgcgagagauccgaacggguugcucuguguaaccgcgccgagcucacccccgagcugcuuaagauucugcacucucagguggcugggagacucaucauucgggccgaagaacuggcgcaaauguggaaaguggucaaucugccuacagaucucuucaacagcgugaugaauguuggacgcuuuaccgaagagaucgaguggcugaaguuccuugcccuggcuugcuccgcccucggcgugagacagccgcgggcugacugucgcaagagacugcccgauacauga

SEQ ID NO: 75003 - RNA, 693 nt, Artificial Sequence
  derived and/or modified sequence opt5 from ROPN1L__Homo_sapiens__NP_114122
augccccugccugacaccauguucugcgcccagcaaauccacauuccgcccgagcucccugauauccugaagcaguuuacaaaagcugccauuagaacgcagcccgcggacgugcuucgguggagcgcuggcuacuucuccgcccugucucgcggggauccucuccccgucaaggacagaauggaaaugccuaccgccacacagaaaaccgauacaggacugacccaaggccuucugaagguucuccauaaacagugucaccauaagcgguauguggagcugacagaccuggaacagaaguggaaaaaccucugccugccgaaggagaaauuuaaggcccuucugcagcucgaucccugugaaaauaaaaucaaguggauuaacuuccuggcucuugggugcagcaugcugggaggcucccucaauaccgcucugaagcaccugugugagauccucacggacgauccugaagggggacccgcccgcaucccuuuuaaaaccuucucuuacguguauagauaccuggcgcggcuugacagcgaugucucuccccuggagacagaguccuaucucgccagccugaaggaaaacauugacgcucgcaaaaauggcaugaucggccuuuccgacuuuuucuuuccgaagagaaaacugcucgagagcauugagaacucugaagauguggggcauuga

SEQ ID NO: 75004 - RNA, 2625 nt, Artificial Sequence
  derived and/or modified sequence opt5 from ROR1__Homo_sapiens__XP_011539828
augaacaauaucaccacaagccugggccagacggccgagcuccacugcaagguguccgggaaucccccuccgaccauuagaugguucaaaaaugacgcucccgucguucaagaaccucggcgccugucuuuuagaagcacaaucuacggaucccggcuucgcauuagaaaccuggauaccacagacaccggcuauuuccaguguguggccacaaaugggaaggagguggucucuagcaccggagugcucuuuguuaaauucgggcccccucccacggcguccccuggcuacucugaugaauaugaggaagacggauuuugccagccguaccggggcaucgcuugugcccgcuucauuggcaacagaaccguguauauggagagccugcauaugcagggggagaucgaaaaucaaaucacagccgcuuuuaccaugauuggaacauccagccaccuuucugauaagugcucccaguucgccauccccagccugugucauuacgcuuuuccuuauugcgacgagaccucuuccguccccaaaccucgggaucucugucgcgacgaaugcgagauucuggagaacgugcugugucagacggaauacaucuucgccagaagcaaucccaugauucucaugcggcugaaacuuccgaacugcgaggaucugccucagcccgaaucuccugaggcggccaauuguauccgcauuggcauccccauggcugaccccaucaacaagaaucacaagugcuacaacuccacagggguugauuauagaggaaccgugagcgucacaaaguccggccggcaaugccagccuuggaacucucaguacccgcauacccacaccuuuacagcccuccgcuuccccgaacugaacgggggacacagcuauuguagaaacccuggcaaucagaaagaggcucccuggugcuuuacgcuugacgagaacuucaaguccgaucugugugacauuccugccugcgacagcaaagauucuaaggaaaagaauaaaauggagauccucuacauucuggugcccuccguggcgaucccgcuggccauugcucuccuguucuuuuucaucugugucugccggaacaaucaaaagagcucuagcgccccuguucagagacagcccaaacaugugcgcggccaaaacguggaaauguccaugcuuaaugcuuauaagccuaaaucuaaggccaaagagcugccccucagcgccguccgguuuauggaggaacugggggagugugcuuucggaaagaucuacaagggccaccuuuaucugccugggauggaccaugcgcagcucguggccauuaaaacccugaaggauuacaacaauccccagcaguggacagaauuucaacaggaggcuucccugauggccgaacuccaccacccgaacaucguuugccugcuuggagccgugacccaggagcagccugucuguaugcuguucgaauacauuaaucaaggcgaccuccaugaguuucugaucaugagaagcccccacucugauguggggugcuccagcgacgaggauggaacaguuaaaucuucccuugaccauggcgauuuccugcacauugcuauccagaucgccgcgggcauggaauaucucagcucccacuuuuucgugcauaaggaccuggcugcccgcaacauucugaucggggagcagcuccacgucaaaauuucugaucugggacuuagccgggaaaucuacuccgccgacuauuacagagugcagucuaagagccugcuccccauucgcuggaugccuccggaggcuaucauguauggcaaguuuuccagcgacucugauauuugguccuucggggucgugcugugggagaucuuuagcuucggacugcaacccuacuauggcuucucuaaucaggaaguuaucgagauggugcggaaaagacagcuucucccuuguuccgaagacugucccccucgcauguacagccugaugaccgagugcuggaacgaaauucccucucggagaccucgcuuuaaggauauccauguccggcugagaagcugggaggggcucuccagccacacgucuuccacaacccccagcggcggaaaugccaccacacagaccacaucccugucugcuagcccgguguccaaccuuucuaacccucgguaccccaauuauauguucccuagccaaggcauuacgccccaggggcagaucgccggauuuauuggcccgccuaucccccaaaaccagcgcuucaucccuauuaauggguaccccauucccccuggauaugcggccuuuccggcugcccauuaccagcccaccggcccucccagaguuauccagcacugcccucccccuaaaucccggucuccgagcuccgcuagcgggucuacauccaccggccacgugacaagccugcccucuuccggaagcaaccaagaggccaauaucccucuccugccccauaugucuauuccuaaccaccccggcgggaugggaaucaccgucuucggcaauaagucccagaaaccguauaagaucgacagcaagcaggcgucccugcuuggggaugccaacauucauggacacacggaaagcaugaucucugcugagcucuga

SEQ ID NO: 75005 - RNA, 2832 nt, Artificial Sequence
  derived and/or modified sequence opt5 from ROR2__Homo_sapiens__NP_004551
auggccagaggcagcgcucugccccggcgcccucuccugugcaucccggccgugugggcggcugccgcccuucugcucuccgucucuagaaccagcggggagguugaagugcuggaccccaacgauccucuuggaccccuggacggccaggaugggccuauucccacacucaagggauacuuccugaauuuucuggagccugugaacaauaucacgauuguccaaggccagaccgcuauccuccacuguaaaguggccgggaacccgcccccuaauguucgguggcugaagaacgacgcucccgugguccaggaaccucgcagaauuaucauccggaaaacagaguauggaucccgccuucggauucaggaucuggacaccacagauaccggcuacuaucaaugcguggccacaaauggcaugaagaccaucacggcgaccgggguucucuucgugagacugggacccacacauucuccgaaccacaauuuucaggacgauuaccaugaagacggcuucugucagccuuaucgcgggauugccugcgcuagauuuaucggaaaccggaccauuuacgucgauagccuucagaugcaaggcgagaucgagaaucgcauuacagccgcuuucaccaugaucgggacguccacacaccugucugaccaguguagccaguuugccauccccuccuucugccauuuuguguucccucucugugaugcgagaagccggacccccaaaccccgcgaacugugcagagacgagugugaagugcuggagucugaccucugccggcaggaguauacaauugccagauccaacccucugauccuuaugcgccugcaacucccgaagugugaagcucugcccaugccugagagccccgaugccgcuaauugcaugcggauuggaaucccugccgaaagacuuggccgcuaccaccagugcuacaacggcucugggauggacuaucggggaaccgccuccaccacaaagagcggccaccagugucaacccugggcucugcagcauccgcacucucaucaccucuccagcacggauuuuccugagcucgggggaggccacgcguacugcagaaaucccgggggacagauggaaggcccuugguguuucacccagaacaaaaacguccgcauggagcugugcgacguucccuccuguucuccucgggauagcuccaagaugggcauucuguauauccuggugcccagcaucgccauuccgcuugugaucgcuugccuguuuuuccucgucuguaugugcagaaauaaacaaaaggccucugccuccacaccucagcgccggcagcugauggcuagccccucucaggacauggagaugccccuuauuaaccaacauaaacaggccaagcugaaggaaaucagccucuccgcggugagauucauggaggaacugggggaggaucgcuuuggaaaaguuuacaagggccaccuguucgggccugcuccgggagaacagacccaggccguggccauuaaaacacucaaggacaaagcugagggcccccugcgggaggaauuuagacaugaggccaugcuucgggcucgccugcaacacccuaaugucgugugucuccuggggguugugaccaaggaucagccccugucuaugaucuucagcuauugcucccauggcgaccuucacgaauuucucgucaugagaagcccucacucugaugugggauccacggacgacgaucggacagucaaaagcgcccuggagcccccugacuucgugcaucugguugcgcagaucgccgcuggcauggaauaccucucuucccaccaugugguccacaaggaucuggccaccagaaacgugcuuguuuaugacaagcugaaugugaaaauuagcgaucucgggcuguuucgcgaggucuacgcugccgacuacuauaagcugcuuggaaacucccuccugcccauccgguggauggcgccggaggccauuauguacggcaaauucucuaucgauagcgacauuugguccuaugggguggugcugugggaagucuuuucuuacggacuccagccuuauuguggcuacagcaaucaagaugucguggagaugaucagaaaccgccaggugcugcccugcccugacgauugccccgcuugggucuaugcccuuaugauugaauguuggaaugaguucccguccagacggccucgcuuuaaggacauccacagcagacugcgggcuugggggaaccucucuaauuacaacuccagcgcccagaccucuggcgccuccaauacaacccaaacaagcucucugagcacgucccccgugagcaacguuucuaaugcucgcuacgugggaccuaaacagaaggcgccucccuucccccagccgcaguuuauccccaugaagggccaaauuagaccuaugguucccccuccccagcuguaugugccuguuaacggguaccagccggugcccgccuauggagcuuaccuuccuaacuucuaucccguccagaucccuaugcaaauggcuccccaacaggugccgccucagaugguucccaaacccuccagccaucacuccggcucugggagcaccuccacaggauacgugaccacagccccuucuaauaccagcauggccgaucgggccgcgcuccuguccgagggcgcugacgacacgcagaacgcccccgaagauggggcccagucuaccguccaggaggcugaagaggaagaggagggcagcgugccugaaacagagcugcucggagacugcgauacccugcaaguggacgaagcccagguccagcuugaggcguga

SEQ ID NO: 75006 - RNA, 1647 nt, Artificial Sequence
  derived and/or modified sequence opt5 from RORA__Homo_sapiens__NP_002934
augaacgagggcgcccccggggacagcgaucuggaaaccgaggcuagagugccuugguccaucaugggacacugccuccggacaggccaggcccgcaugucugcgacgccgacccccgcuggggaaggagccagaagcuccucuacauguagcucccugucucggcuuuucuggagccaacuggagcauauuaauugggacggcgccaccgcuaagaacuuuaucaaucuccgcgaguucuuuuccuuccugcuuccugcccugagaaaagcucagauugaaaucauucccugcaagaucuguggggauaaaagcucuggaauccacuacggcgucauuacaugcgagggcuguaagggguuuuuccggcgcucccagcagagcaacgccaccuauucuugcccuagacaaaagaauugucucaucgaccggacaucccgcaacagaugccagcauugucggcugcagaagugccuggcgguuggaaugagccgcgaugccgugaaguuuggcagaaugucuaaaaagcagcgggacucccucuacgcugaagugcaaaaacaccgcaugcagcagcagcaaagagaucaucagcagcaacccggggaggccgaaccucugaccccgacguauaauauuagcgcuaacggacuuaccgagcugcacgacgaucucuccaauuacaucgacggccacacacccgaggggucuaaggccgauagcgcggucuccagcuucuaucuggacauucagccuucucccgaucaguccggacuugacaucaacggcauuaaaccugaacccaucugugacuacaccccggccagcggcuuuuucccuuauugcucuuuuacaaauggggagaccagccccacgguguccauggcugaacuggagcaucucgcccagaacaucucuaagagccaccuggaaacaugccaauaccugcgggaggagcuccagcagauuaccuggcagacauuccugcaagaagagaucgaaaauuaccagaacaagcagagagagguuauguggcagcuuugugcuauuaaaaucaccgaagccauucaauauguggucgaguuugccaagcgcaucgauggauucauggagcugugccagaaugaccagaucgugcuccugaaagcuggcucccuugaaguuguguucauucggauguguagagcguuugauagccagaacaacaccgucuacuucgacgggaaguaugccucuccugauguguuuaaaucccugggaugcgaggacuucaucagcuuuguguucgaauuuggcaagucucucuguuccaugcaucugacagaggaugaaauugcucuguucagcgccuuuguccucauguccgccgaccgcucuuggcugcaagagaaaguuaagaucgagaaacuucagcagaaaauucaacuggcucuccagcacgugcugcagaagaaucaccgggaagaugggauccuuacgaaacugaucugcaaggugagcacccucagagcccuguguggacgccauacagagaaacugauggcguucaaggcuauuuaccccgacaucguccggcuccacuuucccccucuguauaaggaacuuuucaccuccgaguuugagccggccaugcagauugauggcuga

SEQ ID NO: 75007 - RNA, 1380 nt, Artificial Sequence
  derived and/or modified sequence opt5 from RORB__Homo_sapiens__NP_008845
augagagcccagaucgaggugauucccugcaagaucuguggcgacaaaagcuccgggauucacuacggagucauuaccugcgaaggcuguaagggguucuuucggcgcucucaacagaacaaugcuagcuauuccugcccuagacagcggaacugucugaucgaucgcacaaauagaaaccggugccagcauugucgccuccaaaaaugccuggcccuuggaaugucuagagacgcgguuaaguucggccggaugagcaaaaagcagcgcgauucccuguacgcugaggugcagaagcaccagcaaagacuccaggaacagcggcagcaacagucuggggaggccgaagcccuggcucgcguguauagcuccagcaucucuaauggacuuuccaaccugaauaacgagacgagcggcaccuacgccaauggccaugucaucgaccucccgaaaucugagggguauuacaacguggauuccggacagcccagcccugaccaaucuggccuggauaugacagggauuaagcagaucaaacaggaacccauuuaugaccugaccuccguuccuaaucucuuuacauacagcuccuucaacaauggacagcuggcucccggcaucaccaugacagagauugauagaaucgcccaaaacauuaucaagucucaccuugaaaccugucaguacacgauggaggagcugcaucagcucgcguggcagacccacacauaugaagagaucaaagccuaccaaagcaagucccgggaagcucuguggcagcagugcgccauucagaucacccacgcuauucaauauguggucgaguuugccaagcgcaucacaggguucauggaacuuugucagaaugaccagauucugcuccugaaaagcggaugccuggaggugguucucgugagaaugugccgggcguuuaacccucugaacaauaccguccuuuucgagggcaaguacggcgggaugcagauguuuaaagcccugggaucugaugaccucgugaacgaggcuuucgauuuugccaagaaucuguguucccuucaacugacggaagaagagaucgcucucuucagcucugccgugcugaucagcccggacagagccuggcugauugaaccccgcaaaguccagaagcuccaggagaaaaucuauuuugcucugcaacauguuauucagaagaaccaccuugacgaugagacacuggcgaagcucaucgccaaaauuccuaccaucacagcugugugcaaucugcauggcgaaaaacuucagguguucaagcagucccaccccgagaucgucaacacccuguucccuccccucuacaaggaacuguuuaauccggacugugccaccgggugcaaauga

SEQ ID NO: 75008 - RNA, 1494 nt, Artificial Sequence
  derived and/or modified sequence opt5 from RORC__Homo_sapiens__NP_001001523
augagaacccagaucgaggugauucccugcaagaucuguggcgacaaaagcuccgggauucacuacggagucaucacaugcgaaggcuguaagggguucuuucggcgcucucaaagaugcaacgccgcuuauagcuguacgcggcagcagaauugcccuauugaucgcaccuccagaaaccggugucagcauugccgccugcaaaaaugucucgcccugggaaugucuagagacgcgguuaaguucggccggaugagcaaaaagcagcgcgauucccuucacgcugaggugcagaagcagcugcaacagagacagcagcaacagcaggaaccgguggucaaaacacccccugccggggcccaaggagcugacacccucacauacacccugggccuucccgauggccagcugccucucgggucuagccccgaccugccugaggccuccgcuugcccgcccggacugcucaaggccagcggcucugggccuuccuauagcaauaaccuggcgaaagccggacuuaauggcgcuucuugucaucuggaauacucccccgagcgggggaaggccgagggacgcgagagcuuuuauucuacaggcucccagcucaccccugauagaugcggccugcgguucgaagaacaccgccaucccgggcuuggagagcugggccaggggccggacagcuacggauccccuucuuuuagaagcacgcccgaggcuccuuaugccucccucaccgaaaucgagcaccuggugcaaagcguuugcaaaucuuaccgggaaacaugucagcugagacucgaggaucugcuucgccagcgguccaacaucuucagcagagaagaggugaccggcuaccagcgcaagucuaugugggagaugugggaacggugcgcgcaccaucugacagaggccauucaauaugucguggaauuugcuaagagacucagcggguucauggagcugugucagaaugaccagaucguucuucugaaagccggagcuauggaagugguccucgugcgcaugugccgggccuacaacgccgauaauagaaccguguuuuucgagggcaaguauggcgggauggagcuguuucgcgcucugggauguuccgaacucauuucuagcaucuucgacuuuucccacagccugucugcgcuucauuucuccgaggaugaaauugcccuguacacggcucucguccugaucaacgcccaccggcccggccuucaggagaaaagaaagguugaacaacugcaguauaaucucgagcuggccuuccaccaucaccugugcaaaacacaucgccagagcauucucgcuaagcugcccccuaaagggaaacuucggucucuguguucccagcacguggagagacuccaaaucuuucagcaucugcacccgaucgugguccaggccgcguuucccccucuguacaaggaacuuuucagcaccgagacagaaucccccgugggacucucuaaguga

SEQ ID NO: 75009 - RNA, 7044 nt, Artificial Sequence
  derived and/or modified sequence opt5 from ROS1__Homo_sapiens__NP_002935
augaagaauauuuacugccugauucccaagcucgugaauuucgccacacugggcugucuuuggaucagcgucguucagugcacagugcugaacuccugucucaagucuugcgugacgaaucuggggcaacagcuugaccugggaaccccucacaaccucagcgaaccguguauucagggcugccauuuuuggaacuccgucgaucagaagaacugugcucugaagugcagagaaucuugugaaguggggugcagcuccgccgaaggagcguaugaagaagagguucuggagaaugcugaccuccccacagccccuuucgccucuagcaucggcucccacaacaugacccugcgguggaaaagcgcuaauuuuucuggggugaaguacauuauccaauggaaguaugcccagcuucugggauccuggacauacaccaaaacagucagccgccccucuuaugugguuaagccucuccaucccuucaccgaauacaucuuuagaguggucuggauuuucacggcucagcugcagcuuuauuccccuccgagccccucuuaccggacccacccucauggcgugcccgagacagccccucugauccgcaacauugaauccagcucccccgauaccguggaggucucuugggacccgccucaauuucccggcgggccuauccucggauacaaucugagacugauuagcaaaaaccagaagcucgaugcgggcacacagcggaccuccuuccaguuuuauagcacgcugcccaauacaaucuaccgcuucucuauugccgcuguuaacgaggugggggaaggacccgaggccgaauccagcaucaccacaucuagcuccgcugugcaacaggaggaacaguggcuuuuucugucuagaaaaaccagccuccggaagcgcucccugaagcaccuugucgacgaggcccacugucugagacucgaugcgaucuaucauaauauuaccggcaucagcguggacguucaccaacagauuguguacuucucugaggggacacugaucugggccaaaaaggcugccaacauguccgaugucagcgaccugcggaucuuuuaucgcggaucuggccucaucuccagcaucuccauugauuggcuguaccagagaauguauuucaucauggacgaacuugugugcguuugcgaucuggagaacuguucuaauauugaagagaucacgccuccgagcauuuccgcuccccagaaaaucguggccgacucuuacaacggcuacgucuucuaucuccugcgggacgggaucuaccgcgccgaucuuccugugcccagcggaagaugcgcugaagcgguccggauuguggaguccuguacccugaaggacuuugccaucaaaccucaagcuaagagaauuaucuauuucaaugauacagcccagguuuuuaugagcaccuuccucgacggcucugccucccaucugauucugccccgcaucccguuugcugaugucaagagcuucgccugcgagaacaaugacuuucucgugacagaugggaaggugauuuuccagcaggacgcgcugucuuuuaacgaguucaucguuggaugugaucuuucccacaucgaggaauuuggcuucgggaaucuggugauuuuuggaagcucuagccaacuccacccucugcccggccggccucaggagcuguccguccuuuucggcagccaucaggcucucgugcaguggaagcccccugcccuggccaucggggcuaacgugauucugaucucugacauuaucgaacucuucgagcugggacccuccgccuggcaaaauuggaccuacgagguuaaagucagcacgcaggauccgccugaagugacacacaucuuucuuaacauuuccggcaccaugcugaaugugcccgagcuccagucugcuaugaaguauaaagucagcgugagagccuccucucccaagcgcccugggccguggagcgaacccuccguuggaaccacacuggugccugcgucugagcccccuuucaucauggccgucaaagaggacggccuguggagcaagccccuuaacuccuuugggccuggcgaguuccucagcucugacauuggaaauguguccgauauggacugguacaacaauagccuguauuacucugauaccaagggcgacguuuuuguguggcugcucaacgggacagauaucuccgagaacuaccaucugcccagcauugcuggagccggcgcucuugccuucgaauggcuggggcacuuucucuauugggcgggaaaaacguacgucauccagcggcaaucugugcugaccggccauacagacaucguuacccacgugaagcugcuugucaaugauauggugguggacuccgucgggggcuaucucuacuggacaacccuguauagcguugaguccacgagacugaacggagaaagcucucucgugcugcagacccagccgugguucagcggcaaaaaggugauugcccuuacacuggaucucuccgacgggcugcuguacuggcuuguccaagauucucagugcauccaccucuauaccgcugugcugcgcggacagagcacaggcgacaccacgauuacagaguuugccgcuugguccaccucugagaucagccagaaugcccugauguacuacuccgggcggcuguucuggauuaacggauuuagaaucaucacaacccaagaaauuggccagaaaaccucuguuagcgugcuggagccugcccgcuucaaucaguuuacaaucauucagacgucccuuaagccccugccugggaacuucagcuucacccccaaggucaucccggauucugugcaagaauccagcuuucggauugagggcaaugcuucuuccuuccagauccucuggaacggaccucccgcgguugacuggggcguggucuuuuauagcguggaguucuccgcccauucuaaauuucuggcuagcgagcagcacucccugccuguuuucacaguggaggggcuugaacccuacgcccuguuuaaucucagcgucacccccuauacauacuggggaaagggcccuaaaaccucucugucccucagagccccggagacggugcccagcgcuccugaaaacccccgcauuuucauccugccuucugggaaguguugcaauaaaaacgagguggucguugaauuucgguggaauaagcccaagcaugagaacggagugcuuacaaaauucgagaucuuuuauaauauuagcaaccaguccaucaccaacaagaccugugaagacuggauugccgugaaugucacaccuucugugaugagcuuccaacuggagggcauguccccgagaugcuucaucgcguuucagguucgggcuuucaccucuaaagggcccggcccuuacgccgauguggucaagagcacaacguccgaaauuaaccccuuuccucaccucaucacccugcugggaaauaaaaucguguuccuugacauggaucagaaccaaguuguguggacauuuagcgccgagcgcgucauuucugcuguguguuauaccgccgacaaugagaugggcuacuacgcggaaggggauucccuguuccuccugcaccuccauaacagaagcuccucugagcuguuucaggacagccuugucuucgauaucacagugauuaccaucgacuggauuucccggcaccuguauuuugcucucaaggaaucucagaauggaaugcagguuuucgauguggaccuggagcauaaagucaaguaccccagagaagugaagauccacaaccgcaauagcacgaucauuuccuuuagcguuuauccgcugcuuucucggcuguacuggaccgagguguccaacuucggcuaucaaauguuuuacuauagcaucauuucucauacacuccacagaauccugcagccuaccgccacaaaucagcagaacaaacgcaaucaaugcuccugcaacgucaccgaguucgaacucagcggggccauggcuauugauacaucuaaucuggagaagccccuuaucuacuucgccaaagcucaggaaauuugggccauggaccuggagggaugucagugcuggagagugaucaccgugcccgcgaugcuggccggcaagacgcucguuagccugacagucgauggcgaccuuaucuacuggauuaucaccgcuaaagacuccacccagauuuaucaagccaagaaggggaacggagcuaucgugucucaggugaaagcccugcggagccgccacauucucgccuacuccagcgucaugcagccuuuucccgauaaggcuuuccugucccucgcgucugacacaguggaaccuaccauccugaacgccacgaauacaagccuuaccaucagacugccgcuggcuaaaacaaaccucaccugguauggcauuacaucccccaccccuacguaccugguuuauuacgccgaggugaaugaucggaagaacucuagcgaccuuaaauaucgcauccuggaguuucaggauuccauugcccucaucgaagaccugcaacccuucucuaccuacaugauucagaucgcugucaagaauuacuauagcgauccucucgagcaucugcccccggggaaggaaaucuggggaaaaacaaagaacggcgugccugaggccguucagcuuauuaauaccacagugagauccgacaccagccugaucauuucuuggcgggaaucccacaaacccaacgggccuaaggagagcguccgcuaccaacuggcgaucucucaucucgcucugauucccgagacgccucuuagacaguccgaauuucccaauggacggcugacacuccuggugacccgccucagcggcggcaacaucuauguucugaaagugcuugccugucacucugaggaaauguggugcacagagucccauccggucaccguggagauguucaauaccccugaaaagcccuacagccuggugcccgagaacacaucccugcaguuuaauuggaaggccccucucaacgucaaucugauuagauucuggguugaacuucagaaauggaaguauaacgaguuuuaccacgugaaaacgagcuguucucaagggccggcuuaugugugcaauaucaccaaccugcagcccuacacaagcuacaacguccgggugguuguggucuauaagaccggagaaaauuccacaucucucccugagagcuucaaaaccaaggccggcgugcccaacaaaccugggauccccaagcugcuggagggauccaaaaauucuauucagugggaaaaagcggaggauaacggcuguagaaucacguacuauauucucgaaauccgcaagagcacauccaauaaccuucagaaucaaaaccugcgguggaaaaugaccuuuaaugggucuugcagcuccguuuguaccuggaaaagcaaaaaccugaagggaauuuuccaguuuagaguggucgcugccaauaaccucggcuucggcgaguacucugggaucuccgaaaauaucauucuggugggagacgauuucuggaucccugagaccagcuuuauucuuaccaucauugucggcaucuuccuggugguuacaaucccgcucacguuuguguggcaccgccggcugaagaaccagaaaucugccaaggagggggugaccguccugauuaaugaagacaaagagcucgcugaacuuagaggacuggccgcuggcguugggcuggccaacgcgugcuaugccauccauacacuccccacccaggaggaaauugagaaccugccugcuuucccccgcgagaaacuuacacugcggcuccugcugggauccggcgccuuuggcgaaguguacgaggggaccgcuguggacauccucggagucggcagcggggaaauuaaaguggccguuaagacgcuuaagaaaggauccaccgaucaagagaagaucgaguuccugaaagaagcccaccugaugucuaaguuuaaucauccuaacauucucaaacagcugggcgugugucuucugaaugagccccaguauaucauccucgaacugauggaagggggagaccugcucacauaccuuagaaaggcucgcauggcgaccuucuacggcccgcugcugacacucgucgaucugguggaccuuugcgucgauauuagcaagggcugcguguaucuggaacggaugcacuuuauccacagagaccucgccgcucggaacugucugguuuccgugaaagauuacaccagcccucgcauugucaagaucggggacuucggacuggccagagauauuuauaaaaaugacuacuaucggaagcgcggcgaggggcuccuucccgugagauggauggcccccgagucucugauggauggaaucuuuacaacgcaauccgacguuuggagcuucggcauccugauuugggaaauccucacccuggggcaucagccuuaccccgcucacucuaaccuugaugugcugaauuauguccagacaggaggccggcucgagccuccgagaaacugccccgacgaccuguggaaucugaugacccaguguugggcccaagaaccugaucagcgccccaccuuucaucggauucaggaccagcuccaacuuuucagaaacuucuuucugaauagcaucuacaaaucccgcgaugaggcgaacaauucuggcgugauuaacgagagcuucgagggggaggacggagaugugaucugccucaauuccgacgauaucaugccuguugcucucauggaaacaaagaaccgggagggccugaacuacaugguccuugccacggaaugugggcagggagaggaaaagucugagggcccccuggggagccaggaguccgaaagcugcggacucagaaaagaggaaaaggagccgcacgccgacaaagauuuuugucaggagaagcaaguggcuuauugcccuucuggcaaacccgaaggccugaauuacgccugucugacccauuccggguauggagacggcagcgauuga

SEQ ID NO: 75010 - RNA, 6471 nt, Artificial Sequence
  derived and/or modified sequence opt5 from RP1__Homo_sapiens__NP_006260
augagcgacacccccuccacaggcuucucuaucauucacccuacgagcuccgaggggcaagugccucccccuagacaucugucucucacccaccccgucguugccaagcggaucagcuuuuacaaauccggagauccucaauucggcggggugcgcguggucgugaaccccagaucuuuuaagagcuucgacgcucugcuugauaaucugucccggaaaguuccucucccguuuggagugcgcaacauuagcacacccagaggccggcauucuaucacccgccuggaagaacuugaagacggggaguccuaucugugcagccacggaagaaagguccagccuguggaucucgacaaagcccggcgcagaccccggccuuggcugucuucccgcgccauuagcgcucauucucccccgcacccuguugccguggccgcucccggcaugccuagaccgccccggucccuggucguguuccgcaauggcgauccuaagacaagacgggccgugcuccugagcagacgcgucacccaguccuuugaggcuuuccuucagcaccugacagagguuaugcaacggccgguggugaagcucuacgccaccgacgggagacgcguccccucucugcaggcggugauccuuagcuccggagccguuguggcugccggccgggagccuuuuaaacccgggaacuaugauauccagaaguaccugcucccugcuagacugcccggaauuagccagcgcgucuauccgaaaggcaaugccaagucugaaucccggaaaaucagcacgcauaugucuagcuccucuagaagccaaauuuacuccgugagcucugagaagacccacaacaaugacuguuaucuggauuacuccuucguuccugaaaaguaccucgcgcuggagaaaaacgacagccagaaucuucccaucuauccuucugaggaugacauugaaaaguccaucauuuuuaaccaggacgggacaaugaccguggagaugaaaguccgcuuccggaucaaggaagaggaaacaaucaaauggaccacgacagugagcaagaccggacccuccaauaacgaugagaaaucugagaugagcuuuccuggcagaacagaaucccgcucuagcggccugaagcucgccgcuugcuccuucagcgccgacgucucucccauggagcgguccagcaaucaggaagggucucuggcugaggaaauuaacauccaaaugaccgaucagguggccgagaccuguuccagcgccucuugggagaaugcuacaguugacacggauauuauccagggaacccaagaccaggcgaagcauagauucuaccggccgccuacacccggccuucgcagagugcggcagaaaaagagcgucauuggguccgugacccugguuagcgaaacagaggugcaggagaagaugaucggacaauuuucuuauuccgaggaaagagagagcggcgagaacaaguccgaauaccacauguucacccacucuugcagcaaaauguccucugucagcaacaagcccgugcucgugcagaucaauaacaaugaucagauggaggaauccucucuggagcgcaagaaagagaacagccugcucaaguccagcgccauuucugcugggguuaucgaaauuacgucccagaaaaugcuggagaugagccauaauaacggacuuccuucuacaaucuccaauaacagcauugucgaagaggacgugguggauugugucgugcuggacaauaagaccggcaucaaaaacuuuaagaccuauggcaauacaaacgaucgguucucuccgaucuccgccgacgccacccacuuuagcuccaauaacagcgggacagacaagaauauuucugaagcucccgccagcgaggcguccucuacgguuaccgcuagaaucgaucgccucauuaacgaguucgcccaaugcggacugacaaaacuuccuaagaacgagaagaaaauccugagcuccguggccucuaaaaagaagaaaaagagcagacagcaggcuauuaauucccgguaccaggacggccaacucgccaccaaagggauccugaacaagaaugagcgcauuaacacaaaaggaagaaucaccaaggaaaugaucguccaggauucugacagcccccugaaaggcgggauucucugugaggaagaucugcagaaauccgacacggugaucgagagcaauaccuuuugcucuaaguccaaccuuaauagcacaauuucuaaaaacuuccaucggaauaagcugaacaccacacaaaauuccaaaguucaaggccuccugaccaagcgcaaaagcagaucccugaacaagaucucucuuggagcucccaagaaacgggagauuggccagcgcgauaagguguuuccccacaaugaaagcaaauauuguaaguccacguucgagaacaaaagccucuuucaugucuucaauauccuggaacagaagccuaaggacuuuuacgcgccccagucucaggcggagguggccuccggguaccugagaggaauggcuaaaaagagccucguuucuaaagugacagauagccacaucacccugaagucccagaaaaagcggaagggcgacaaagucaaggccucugcuauucuuagcaaacagcacgccacaacccgcgcgaacucccuggccucucucaagaaaccggauuucccugaagcuaucgcccaucacagcauucaaaacuauauccaguccuggcugcagaauauuaaccccuacccuacccugaagcccaucaaaagcgcuccggugugcagaaaugagacaucuguggucaacuguuccaauaacagcuucuccgggaaugacccucauacgaacucuggaaagaucagcaauuuuguuauggaguccaacaagcacauuaccaaaaucgccggccuuacaggggauaaucucugcaaggaaggcgacaaaucuuucauugccaacgacaccggagaggaagaucugcacgagacacaggugggcagccugaaugacgcuuaucucgugccccugcaugagcacugcacccuuucccaaagcgcgaucaacgaucauaauacgaagucucacauugccgcugaaaaauccgggccugagaagaagcuggucuaccaggaaaucaaccucgcccggaaaagacagagcguggaggccgcuauccagguugaccccauugaagaggagacacccaaggaucugcugccugugcuuaugcuccaucaacugcaggccucugucccgggaauccacaaaacccagaacggcgugguucaaaugcccgggucccuggcgggagugccuuuucacagcgcuauuuguaauucuagcaccaaccuccugcuugccuggcugcucguccugaaucugaagggcuccaugaacucuuucugccagguggacgcccauaaagcuacaaauaagagcuccgaaacccuugcccuccuggagauccugaagcacauugcgaucacagaagaggcugaugaccucaaagccgccguugcuaaccugguggaaagcacgaccucccauuuugggcuuucugagaaggagcaggauaugguccccauugaccugagcgccaauuguuccacagugaacauccagucugugccuaaaugcagcgaaaaugagcgcacccaaggcaucuccucucucgauggaggcuguagcgcuuccgaagccugcgcgcccgaggucuguguucuggaagugacaugcagcccuugugagaugugcaccgugaacaaggccuauucuccgaaagagacguguaaucccuccgacaccuucuuuccuagcgauggguacggagucgaccagacaucuaugaacaaggcuugcuuccugggcgaagugugcucccuuaccgacacaguuuuuagcgauaaggccugugcucagaaagagaaucacaccuaugaaggggccugccccauugacgagacauacgugccugucaacguguguaauaccaucgauuuccugaacucuaaggagaauacguacacagacaaccucgauuccaccgaagaacuggaacggggagacgauauucagaaagaccucaacauccugaccgaucccgaguauaagaauggcuuuaacacacuuguuagccaucaaaauguguccaaccugagcucuugcgggcucugucugagcgaaaaagaggccgagcuggacaagaagcacuccucucuugaugacuucgaaaauugcagccugagaaaauuucaggacgagaacgcuuacaccuccuucgauauggaagaaccccgcacgucugaagaaccuggcagcauuacaaauuccaugaccucuagcgagcggaacaucuccgaacucgagagcuucgaggaacuggaaaaucacgacacagauaucuuuaacaccgucgugaauggaggcgagcaggcgacagaggaacucauucaggaggaagucgaggccucuaagacccuggagcuuaucgacauuuccagcaaaaacaucauggaagagaagagaaugaaugggauuaucuaugaaaucauuucuaaacgccuggcuacgccgcccucccucgauuucuguuacgacagcaagcaaaacuccgagaaagaaaccaaugagggagagacaaagauggugaagaugaugguuaaaaccauggaaacaggcucuuauagcgaguccagcccugaucugaagaaaugcaucaagucucccgugaccuccgacuggagcgauuaccggccugacucugauagcgaacagccguauaaaacguccucugacgaucccaacgacagcggggagcugacacaggaaaaggaguacaacauuggauuugucaagagagccaucgagaaacuuuacggcaaggccgacauuaucaaaccuuccuucuuucccggcucuacccgcaagagccagguguguccuuauaauuccguugaguuccaaugcagccggaaggcuucucuguacgauuccgaggggcagagcuuuggauccucugaacaggugagcuccucuagcuccaugcuccaagaguuccaggaagagagacaggacaagugugaugucagcgccgugcgggacaacuauugccgcggcgauauuguggagcccgggacaaagcagaaugacgauucuagaauccugaccgacaucgaagagggaguucucauugauaaaggcaaguggcugcuuaaagaaaaccaucugcugcggauguccagcgagaauccggggaugugcggaaacgcggacaccacaucugucgauacgcuccuggacaauaacuccagcgaggugccuuacucucacuuuggcaaucuugcucccggcccuaccauggaugaacuguccagcucugagcucgaggaacugacacaaccccucgaacugaaguguaacuauuucaauaugccucaugggagcgacuccgagcccuuucacgaggaccuucuggaugugcgcaacgaaaccugcgccaaagagagaaucgccaaucaccauacagaagagaagggaagccaccaguccgaacgggucuguaccucugugacgcauagcuucauuuccgcuggcaacaagguuuacccggugucugacgaugccaucaaaaaucagccucugcccgggagcaacaugauucacggaacacuccaggaggcggacucccuggauaaacuuuaugcucugugcggccaacauugucccauccucaccgucaucauucagccuaugaacgaggaagacagaggguucgccuaccgcaaagagucugauaucgaaaauuuucugggauucuaccucuggaugaagauucacccguaucugcuucagaccgacaaaaacguguuucgggaggaaaauaacaaggccagcaugagacagaaucugaucgauaacgcuauuggcgacaucuucgaucaauuuuacuucuccaauacauuugaccugaugggcaaacgccggaagcagaagagaaucaacuuccucgggcuggaggaggaaggaaaucuuaaaaaguuucagcccgaccugaaagagcgcuucugcaugaacuuucuccacaccagccugcucguugugggcaaugucgauucuaacacacaagaccuguccgggcagacgaaugaaauuuucaaggccguggaugagaacaauaaccuucugaacaaucgguuucagggaagcagaaccaaccugaaucagguugugcgcgagaacaucaauugucauuauuucuucgaaaugcucggccaggcuugccugcuugacauuugucaggucgagacaucucugaacaucuccaauagaaacauucucgaacugugcauguuugagggggaaaaucuguucaucugggaggaggaagauauucucaaccuuaccgaccuggagagcucucgggaacaggaggaucuguga

SEQ ID NO: 75011 - RNA, 7203 nt, Artificial Sequence
  derived and/or modified sequence opt5 from RP1L1__Homo_sapiens__NP_849188
augaacagcacccccagaaaugcccaggcuccuucccaccgggagugcuuccugccgucuguggcccgcacacccagcgucacgaagguuaccccugcgaaaaagaucacauuucucaaaagaggcgacccccgguucgcuggggugcgccuggccgugcaucaaagagccuuuaagaccuucuccgcucuuauggaugaacugucucagcgggucccucucagcuuuggagugcgcuccguuacaacccccagaggccugcacucucuuagcgcccuggagcagcucgaagacgggggauguuaccugugcuccgauaaaaagccuccgaagacacccagcggcccugggcggccccaggagcgcaacccuaccgcucaacagcugagagacguggaaggacagcgggaggcccccggcacgucuuccagccgcaaaucucucaagaccccgagacggauucugcuuaucaaaaauauggauccucgccugcagcaaacagucgugcucucccauagaaacacccggaaucuggcggccuuccuuggcaaggcuagcgaccugcucagauuucccguuaaacagcuguauacaaccucugggaagaagguggauucccugcaggcccuccugcacagcccuuccguccuugugugugcuggacaugaggccuuccgcacgcccgcgaugaaaaacgcccggagaucugaagcugagacacugagcggccucaccucccgcaauaagaacgggagcuggggacccaaaacaaagccuucugugauucacucccggagcccgcccggcucuaccccuagacugcccgaacgcccugggcccagcaauccgccugucggacccgccccuggccggcacccccaggacaccccugcucaauccggcccccuuguugccggggaugacaugaaaaagaaagugagaaugaacgaggauggaucucugagcguggagaugaagguccgcuuucaucucgugggcgaagacacacugcuguggucccggagaauggggcgcgccagcgcucucacggcggccucuggagaggauccgguucugggcgaaguggacccucuuugcugugucugggagggguaccccuggggauucuccgaacccggcguguggggcccucggccgugcagaguugggugucgggagguguuuggacgcggcgggcagcccggaccuaaguaugagaucuggaccaauccccugcacgcuagccagggcgaaagagucgccgcccggaaaagaugggggcucgcucaacaugugcgcugcucuggccuguggggacacggcacagccgggcgggagagauguucccaggacagcgcguccccugcuucuagcaccggacuucccgaaggcuccgagccugaaucuagcugcuguccccgcacaccggaggauggggucgacuccgccagcccuucugcccagauuggagcugagagaaaggccggcgggucccugggcgaagaucccggacucugcaucgacggcgcugggcugggaggcccugagcaggggggacggcugaccccccgcgccagaagcgaagagggcgcgucuuccgauagcucugccagcacggggucccacgaaggcagcucugaguggggaggccggccgcaagggugcccuggaaaagcucgcgccgagacaucccagcaggaagcuagcgagggcggggaccccgccuccccugcgcucucucugagcucccuuagaucugaugaccugcaggccgaaacccaaggacagggcaccgagcaggcuacaggggccgcugugacccgggagccccucguucugggccugagcuguuccugggauucugaaggagccagcuccacacccagcacgugcaccucuucccagcaaggccagcgcagacaucggagccgcgccucugcuauguccagcccuucuuccccggggcuuggaagaguggcgccccggggccacccuagacauagccacuaccgcaaggacacacauuccccccucgauagcucugucaccaaacaggugccucggcccccugagagacgccgggccugucaggacgggagcguuccgagauauuccggaucuagcuccucuacacgcacccaagcuagcggcaaccugcggcccccuuccucuggcagccugcccucccaggaccuccuggggacgagcucugccaccgugacaccugccguccacuccgauuucgugagcggagugucuccccacaaugcuccguccgccggcugggcgggggacgcuggaagcagaaccugcuccccugcccccauccccccucauacaucugauagcuguuccaagagcggcgccgcuucucuuggggaagaggcccgcgacaccccccagccuuccagcccgcugguucuccaagucggacggcccgaacagggcgcggugggcccucacagaucucauugcuguagccagcccgggacgcagccugcucaagaggcccagcggggacccuccccggaggccucuuggcugugcggccgcuacuguccuacacccccuagagggcggcccugcccucagcgcagaagcuccucuuguggaagcaccggcuccagccaccagucuacagcucgggggcccggaggcuccccgcaagaaggcaccagacagccugggcccacccccagcccuggaccgaacuccggcgccucucgccggagcuccgcuucucagggggccggaagcagaggccuguccgaggaaaagacacuucgcagcgggggaggcccccagggccaagaggaagcgucugggguguccccuagcucucucccccgguccagcccugaggccgucgugagagaguggcuggauaauauucccgaagagccuauccugaugacguaugaacucgcugacgagaccacaggagccgcuggcgggggacugcgcggcccggaaguugaucccggggacgaucacucucuugagggacugggcgagccugcccaggccggccagcaaagccucgaaggggaccccggacaggauccugagcccgaaggcgcucugcugggguccucugacaccggaccgcagagcggcgagggggugccucagggagcggcccccgagggcgucuccgaagcucccgccgaggccggcgcugaucgggaagccccugcggggugcagagugagccuucgcgcucuccccggaagaguuuccgccucuacacaaauuaugcgggcccugaugggcagcaaacaggggcgcccuuccucugugccggaggucagcagacccauggcucggcgccuguccugcucugccggagcgcucaucaccugucuggcuagccuucagcuguuugaagaggaccucggcuccccugccagcaaggugagauucaaagacucuccccgguaccaggagcugcuguccauuagcaaggaucuuuggccugggugcgacguuggagaagaucaacucgacucuggccugugggagcugacguggucccaggcccuccccgaucugggcagccaugcuaugacagaaaacuucaccccgaccucuuccagcgggguggacaucuccagcggaucuggcgggagcggagaguccucugucccuugugccauggauggcacacuugugacccaggggacagaacugccccucaaaacgagcaaccagagaccugacucccgcaccuacgagucucccggcgaucuggagaaucaacagcagugcuguuuuccuacauuccugaacgcucgggccugcgcgugugccaccaaugaagacgaggcugaaagagauagcgaggaacagcgcgccuccucuaaccuugagcaacuggcugagaauacagugcaggaagagguccagcucgaagagaccaaggagggaacggaaggcgaggggcugcaagaagaggccguucagcucgaagagaccaagacagaggaaggacugcaggaggaaggcgugcagcuugaggaaaccaaagagacagagggggaaggacaacaggaggaagaggcccagcuggaagagauugaggaaaccggcggggagggccuccaggaagagggagugcaacuggaggaagucaaggagggccccgaagggggacugcagggcgaggcucuugaagaggggcugaaagaggaaggacucccggaggaaggcagcgugcacgggcaggagcuguccgaagcgagcucuccugacggcaagggaucccaggaggaugaccccguucaagaggaagaggccggccgggcuagcgccucugccgaacccugcccugcugaggggacagaagagccgaccgagcccccuucccaucucagcgaaacggaccccuccgccucugagagacagagcggaucccagcuggaaccuggccuugagaaacccccuggggcgacaaugaugggacaagagcacacccaggcucagcccacccagggcgccgccgaacggagcucuuccguggcuuguagcgccgcgcuggauugcgacccgaucugggucucugugcuccugaagaagacagagaaagccuuucuggcucaucuugccagcgcuguugccgaacugcgcgcuagauggggccuccaagauaacgaccugcucgaucagauggccgcggagcugcagcaggacguggcccaacggcuucaggauuccaccaagcgcgaacugcagaaacugcaggggagagcuggacggaugguccucgagccuccccgcgaggcccugacgggcgaacuucugcuccaaacacagcagagacggcaccgccugagagggcuccggaaucugucugcuuucagcgagagaacccuuggacugggcccucuguccuuuacacucgaagacgagcccgcccugucuaccgcccuugggagccagcugggagaagaggcugagggcgaagaguucuguccgugcgaagcgugcgugcgcaagaaaguuuccccuaugagccccaaggccacaaugggcgcuacccgggggcccaucaaagaggccuuugaucuccaacagauucugcagagaaagcgcggagaacacacggacggcgaggccgcugagguggccccugggaagacccauacagaucccaccucuacacggaccguccaaggagcggaaggcgggcucggaccuggccugucccagggcccggggguggacgagggagaagacggcgaggggagccagagacuuaaccgcgauaaagaccccaagcugggagaggccgaaggcgaugcuauggcccaggagcgggaagggaaaacgcacaauuccgagacaucugcuggaagcgaacugggcgaggccgagcaagaaggcgaggggaucuccgaaagaggagagaccggcgggcagggaucuggccaugaagacaaccuccagggggaggcggccgcuggaggcgaucaggacccuggccaaagcgauggggccgagggaauugaagcucccgaggccgaaggcgaggcucagccugaauccgaggggguggaggcccccgaagcggagggagacgcccaggaagcugagggcgaggcccagccugaaagcgaggaugucgaagcuccggaggccgaaggggaggcccaacccgagucugaagacguugagacaccugaagcggagugggaagugcagcccgaguccgagggagcugaagccccugaggcugaaaaggaggcccagcccgaaaccgagagcguggaggcccuggaaaccgagggcgaagaugagccggagucugaaggcgcugaggcccaagaagcggaggaagccgcucaggaggccgaggggcagacacagccugaauccgaggucaucgaaagccaagaggcugaagaggaggcccagcccgaaucugaggacguggaagcgcuugagguugaaguggagacgcaggaggccgaaggagaggcucagcccgaauccgaggaugucgaggccccugaagcugagggcgaaaugcaagaggccgaagaggaggcucagcccgaaagcgacgggguggaggcccagccuaaaucugaaggagaggaagcgcaggagguugagggcgaaacccaaaagacagagggggacgcccagccggaaagcgauggaguggaggcucccgaagccgaggaggaagcucaggaggccgaaggcgagguccaagaggccgaaggcgaggcgcacccugaauccgaggacguggaugcucaggaagccgagggggaggcccagcccgaaagcgagggagucgaagcuccugaggccgaaggcgaggcucagaaggccgaggggauugaagcgcccgagaccgaaggagaggcccaaccggaauccgagggcaucgaggcuccugaagccgagggggaagcucagcccgagucugagggcguggaagcccaggacgcggagggagaagcccagccugagagcgaaggcaucgaggcucaagaggccgaagaggaagcucagcccgagcuggaagggguugaggccccggaggcugaaggagaggcccagccugaauccgagggcauugaagcgcccgaggccgagggggaagcucagcccgagcucgaaggaguggaggccccugaggccgaagaggaagcucaacccgagccugaaggcgucgagacaccggaggccgaaggggaggcgcagcccgaaucugagggcgaaacccagggagagaaaaagggcagcccucaggugucccugggggauggacaaucugaggaagcuagcgaguccagcucucccguuccugaagaccgccccacgccuccgcccuccccuggcggggauacaccccaucagcggccuggaagccagaccggccccucuuccagcagagccucuuccugggggaauuguuggcaaaaagacagcgagaacgaucacgugcucggcgacacccgcucuccggaugccaaguccacaggaaccccucacgcugaacggaaagccacaagaauguaucccgagagcagcacguccgagcaggaagaggcuccccugggcucucgcaccccugaacagggggccagcgagggauacgaccuucaggaggaucaagcgcugggcucccuggcccccacagaagcugucgggagagccgacggauucggccaggacgaucucgacuuuuga

SEQ ID NO: 75012 - RNA, 1053 nt, Artificial Sequence
  derived and/or modified sequence opt5 from RP2__Homo_sapiens__NP_008846
augggcugcuucuuuagcaagagacggaaagccgacaaggagucccgccccgaaaacgaggaagagagaccuaaacaguacucuugggaucaacgggaaaagguggacccgaaagauuauauguucagcgggcugaaggacgagaccgucggacgccuccccggcacaguugcugggcagcaguuucugauccaggauugugagaauugcaacauuuacaucuucgaccacuccgccacggugaccauugaugacuguacaaauugcaucauuuuucuuggaccugugaagggcucugucuucuuuagaaacugucgggauugcaaauguacccuggcgugccaacaguuccgcgugagagacugucggaagcucgaaguuuuucugugcugugcuacacagcccaucaucgagagcuccucuaauauuaaauucgggugcuuucagugguauuacccugaacuugccuuccaauuuaaggaugccggacugagcaucuucaacaauaccugguccaacauucaugacuucacacccgugagcggcgagcucaauuggucucugcugccugaggaugcugucgugcaggacuauguuccgauccccaccacggaggaacucaaagccgugcgcgucuccaccgaagcuaacagaagcauugugccuaucucucggggccagcgccagaaguccagcgacgagucuugccuggugguccuuuuugccggggauuacacaauugcgaaugccagaaagcugaucgacgaaaugguuggaaaaggcuucuuucucgugcaaaccaaggagguguccaugaaagcugaggaugcccagcgggucuuccgcgaaaaggcucccgacuuucugccucuucugaacaaagggcccgugaucgcccucgaguucaauggagauggcgcgguugaagugugucagcugauugucaacgagaucuuuaaugggacaaagauguucgugagcgaauccaaagagaccgccucuggagacguugauagcuuuuauaacuucgcugacauucaaaugggcaucuga

SEQ ID NO: 75013 - RNA, 666 nt, Artificial Sequence
  derived and/or modified sequence opt5 from RP9__Homo_sapiens__NP_976033
augagcuccagacccggccgggaggacgugggggccgcuggagcccgcagaccucgggaaccgcccgagcaggaacugcaacgcagacgggagcagaagcgcagacggcacgaugcgcagcagcuccaacagcugaaacaucuugaaucuuucuacgagaagccucccccuggccugaucaaagaggacgaaaccaagcccgaggauugcauuccugacgucccggggaacgaacacgcucgcgaguuucucgcccaugcccccacaaaaggacuguggaugccucuuggcaaggagguuaaggugaugcaguguuggagaugcaaacgguaugggcaccgcacgggagauaaggaaugucccuucuuuaucaaaggcaaucagaagcuggagcaauucagaguggcucaugaagacccuauguacgauauuauccgggacaacaaacgccacgagaaggauguccggauucagcagcucaagcagcugcuggaagacagcaccuccgaugaggacagaucuagcuccucuagcuccgagggcaaagaaaagcacaaaaagaaaaagaaaaaggagaagcauaaaaagcgcaaaaaggagaaaaagaagaaaaagaaaagaaagcacaaaagcucuaaguccaaugaagggagcgauucugaauga

SEQ ID NO: 75014 - RNA, 1851 nt, Artificial Sequence
  derived and/or modified sequence opt5 from RPA1__Homo_sapiens__NP_002936
auggugggccagcugagcgagggggccaucgcugccauuaugcaaaagggagacaccaacaucaaacccauucuccaggucaucaauauuagaccuaucacaacgggcaacuccccgccccgguaccgccugcuuaugucugaugggcugaauacccucagcuccuucaugcuggcgacacagcuuaacccucugguugaagaggaacagcucucuagcaauugcgugugucaaauccacagauuuauugugaacacccugaaggacggacggcgcgucgugauccugauggagcucgaaguucugaaauccgcugaggccgugggcgucaagauugggaaucccgugccuuauaacgagggacuuggccagccccagguugccccuccggcucccgccgcuucuccugccgcgagcuccagaccccagccucaaaauggcagcucugggaugggauccacagugagcaaagccuacggcgcuucuaagaccuucgggaaggccgcuggacccucccugagccauacaucuggcgggacccaguccaaagucgugccgaucgccagccucacgccuuaucaguccaaguggaccauuugcgcgcgggugacaaacaaaucucagauccgcaccuggagcaauuccagaggagaaggcaagcuguuuagccuugagcuggucgaugaaucuggcgagauucgggccacagcuuucaacgagcaaguugacaaauuuuucccccucaucgaagugaauaagguguacuauuuuuccaaggggacccugaaaaucgccaacaagcaguucacggcugucaaaaaugauuacgagaugacauuuaacaacgaaaccagcgugaugccuugugaggacgaucaccaucugcccacaguucaguucgacuuuaccggaauugaugaccucgaaaauaagucuaaagauagccugguggacaucauuggcaucugcaaguccuaugaggaugccaccaaaauuacaguccgcucuaacaauagagagguggccaagcggaacaucuaccuuauggacacgagcgggaagguugugaccgcuacacuguggggagaagacgcggauaaauucgacggcucccgccaacccguccucgccaucaagggggcuagagugagcgauuuuggaggccggucucuguccguccuuucuagcuccaccauuaucgccaauccugacauuccggaggccuacaaacugcgcggcugguucgaugcugaagggcaggcccucgacggagugagcaucuccgaucugaagucuggcgggguuggaggcagcaacacaaauuggaaaacccuguaugaggugaaguccgaaaaccucgggcagggcgacaagcccgauuacuucucuagcgucgcgacggugguuuaucugagaaaagagaauuguauguaccaggcuugcccuacacaagacuguaacaagaaagugauugaucagcagaauggacuuuaucggugcgagaagugugacaccgaauuucccaacuucaaauacagaaugauccuguccgucaauaucgccgacuuucaggagaaccaaugggugaccugcuuccaggaaagcgccgaggcuauucucggccagaaugccgcuuaucugggggaacuuaaggauaagaacgagcaggccuuugaggaaguguuccaaaacgcgaauuuucgcucuuucaucuuucggguuagagucaaaguggagacauacaacgacgaaucccgcauuaaggccaccgugauggaugucaaaccuguggacuaccgggaguauggaagacgccugguuaugagcauccggagaucugcucucauguga

SEQ ID NO: 75015 - RNA, 837 nt, Artificial Sequence
  derived and/or modified sequence opt5 from RPA2__Homo_sapiens__NP_001284487
augggcagaggggaccggaacaagcgcagcaucagaggauucgaguccuacggcucuagcuccuaugggggagccggcggguacacccagucucccggaggcuuuggcagcccugcuccgucccaagccgagaaaaagucucgggcgcgcgcucagcacauugugcccugcacaaucagccagcugcucuccgccacgcuggucgaugaaguuuucagaauugggaauguggaaaucagccaggugaccauugucggaaucauccggcaugccgagaaagcuccuacaaacauuguguauaagaucgacgauaugaccgccgcucccauggacguucgccaauggguggauacagacgauaccucuuccgaaaauacagucgugccucccgagaccuacguuaaaguggccggccaccuucggagcuuucagaacaagaagucucuggucgcguucaaaauuaugccucucgaggacaugaaugaauuuacgacccauauccuggaggugauuaacgcccacauggugcuuuccaaggcuaauagccagccgucugccgggagagcucccaucuccaacccuggaaugagcgaagccggcaauuucgggggaaacuccuuuaugcccgcgaauggccugacagucgcccagaaccaaguucucaaucugauuaaggcuuguccucgccccgagggccugaacuuccaggaucucaaaaaucagcugaaacauaugucugugagcuccaucaagcaggccguggacuuucuuagcaacgaggggcacaucuauucuaccgucgaugacgaucacuucaaguccacagacgcugaauga

SEQ ID NO: 75016 - RNA, 366 nt, Artificial Sequence
  derived and/or modified sequence opt5 from RPA3__Homo_sapiens__NP_002938
augguggacaugauggaucugcccagaagccggaucaacgccggcaugcucgcucaguucauugacaagccugucugcuuuguugggcgccuggagaaaauccacccgaccggaaagauguucauucuuuccgauggcgaagggaaaaauggaacaaucgagcugauggaaccccucgacgaggaaauuucuggcaucguggagguggucgggagagugacggccaaggcgaccauccuguguacaagcuacguucaauuuaaagaggauucccauccuuucgaccuuggacuguauaacgaagcugugaagauuauccacgauuuuccccaguucuacccucucggcauuguccagcaugacuga

SEQ ID NO: 75017 - RNA, 786 nt, Artificial Sequence
  derived and/or modified sequence opt5 from RPA4__Homo_sapiens__NP_037479
augagcaaguccggcuucgggucuuacggaagcaucuccgccgcugacggcgccucugggggaagcgaucagcugugcgagagagacgcgacccccgcuauuaaaacacaacggccuaaggugcgcauccaggaugucguuccguguaacgugaaucagcuccuguccucuacgguguuugaccccgucuucaaagugagaggcauuaucguuagccagguguccauugucggggugauccggggagccgaaaaggccagcaaccacaucugcuauaaaauugaugacaugaccgcuaagccuaucgaggcccgccaaugguuuggcagagaaaagguuaaacaggugacaccccuuucugucggcguguacgugaaggucuucgggauucugaaauguccuaccggaacaaagucccucgagguucugaaaauccaugugcuugaagauaugaaugaguuuaccgugcacauucuggagacagucaacgcucauaugaugcucgacaaggcccggcgcgauaccacgguggaaagcguucccgugucuccuuccgaggucaaugacgcgggcgauaacgacgaaagccacagaaauuucauccaggaugaggugcugcggcugauucaugagugcccgcaccaggaagggaagucuauccacgagcuccgcgcccaacugugugaccuuuccguuaaagcuaucaaggaagccauugacuaucugaccguggagggacauaucuaccccacagucgauagagaacacuuuaaaagcgcugacuga

SEQ ID NO: 75018 - RNA, 660 nt, Artificial Sequence
  derived and/or modified sequence opt5 from RPAIN__Homo_sapiens__NP_001028174
auggccgagagccugagaucuccccggcgcucccucuacaagcuggugggcagcccuccguggaaagaggcuuucagacagcggugccuugaacgcaugagaaacucccgggaccgccugcucaauagauaucggcaagccgggucuagcggacccggcaacucccaaaauucuuuucugguccaggaaguuauggaggaagaguggaacgcgcuucagagcguggagaauuguccugaagaucuggcucagcucgaggaacugaucgacauggccgugcuggaggagauucagcaggaacucaucaaccaggagcaauccauuaucagcgaauacgagaagucucugcaguucgaugaaaaaugccuuuccauuaugcuggccgagugggaggcuaauccccucaucuguccugucugcaccaaguauaaccugcgcaucacaagcggggugguugugugucagugcggacuuucuauucccucccacagcucugaacugacggagcagaaacucagagccugucuggaaggcuccaucaaugagcauagcgcucacugcccucauaccccggaauuuuccgucacagggggaaccgaggagaagucuagccugcucauguccugucuggccugcgacacaugggcggugauucuuuga

SEQ ID NO: 75019 - RNA, 4182 nt, Artificial Sequence
  derived and/or modified sequence opt5 from RPAP1__Homo_sapiens__NP_056355
augcugagcagacccaagccuggcgaguccgaaguggaccuccugcacuuccagucucaauuucuugccgcuggggccgcgccggcuguccagcugguuaaaaagggaaaccggggcgggggagaugccaauagcgacagacccccucuccaggaucaucgcgacguggugaugcuggauaaccuucccgaccugccucccgcccucgucccuuccccgcccaaacgggcucgcccuucucccggccacugccugccugaggaugaagaccccgaggaaagacugcggcgccaugaucagcacaucaccgccgugcucacaaagauuaucgagagagacacgagcuccguugcugugaaucugccggucccuucugggguggccuuccccgcgguuuuucuucggagccgcgauacccaaggaaaauccgccacaagcggcaagagaucuauuuucgcucaggagaucgccgcucggcgcauugccgaagcgaagggcccuuccgugggggaggucgugcccaacgugggacccccugaaggcgccgucaccugugagacaccgacccccagaaaucaggggugccagcugccuggaagcucucauuccuuucaaggccccaaccucguuacagggaaaggacugcgggaccaggaggcugaacaggaggcccagaccauccacgaagagaauaucgcucgccuucaagccauggccccugaagagauucugcaggagcagcaaagacuccuggcucagcuggaucccagccucguggcguuccugcggucucacucccauacgcaggaacagaccggcgagacagccagcgaagaacaaagaccgggcgggccuuccgcuaacgugaccaaggaggagccccuuaugucugccuuugccagcgagccucgcaaacgggacaagcuggaacccgaggcuccugcccucgcgcugcccgucacaccgcagaaagaauggcuucacauggacaccguggagcuggaaaagcuccauuggacgcaggaucugccucccguuagacgccagcaaacacaggagcggaugcaggcuagauucucccugcagggagagcuccuggcccccgacguggaucuuccuacccaccugggccuccaccaucacggggaagaggccgaacgcgcuggauacagccugcaagagcuuuuucaucugacacggucucaggucucccagcagagagcccucgcucugcacgugcuggcccaaguuaucagccgcgcgcaggccggcgaguucggggaccggcucgcuggaucugugcugagccuucugcucgaugccggcuuucuguuccugcuuagauuuucccucgacgaucgcgucgacggcgugauugcuaccgccauccgggcgcugagagcccugcucgucgcuccgggggaugaggaacugcuugacucuaccuucagcugguaucauggagcccugacauucccccucaugccuucccaggaagauaaggaggacgaagacgaggaugaggaaugucccgcuggcaaagccaagcggaaaagcccugaggaagagucuagacccccucccgaccuggcccgccacgaugugauuaaggggcugcuugcuacgucccuccugccgcggcugagauacguucucgaagugaccuauccuggacccgcggucgugcuggacauccuugccguucugauucgccucgcucggcacagccuggagucugccacaagagugcuggagugcccucgccuuaucgaaaccaucgucagagaguuucuccccacauccuggagcccggugggcgccgggccuacccccucccuguacaaagugccuugugcuacggccaugaagcugcuccggguucuggcgucugcuggccgcaauauugccgccagacuucugagcuccuucgaucuccggucucgccugugcagaaucauugcugaagcgccccaagagcuggcccuucccccugaagaggcugagaugcucagcacagaagcccugcggcugugggccgucgcugccuccuauggacagggcggguaccucuaucgcgagcuguacccggugcuuaugagagcucuccagguggucccccgggaacugagcacccauccuccccagccucugucuaugcaacgcaucgccucccugcuuacccugcucacacagcugacccucgcggccggaagcacacccgcugagacgauuucugacuccgccgaggcuagccugucugccaccccuagccuugugacauggacccagguuuccggccugcagccgcucguggaacccugucugagacaaacacugaaacuucugagccggccugagauguggagagccgucgggcccgugccuguugcuugccuccuguuucucggagcguacuaucaggccuggucucagcagcccuccagcuguccggaagauuggcugcaagacaugcagcgccuuuccgaggaacugcuccugccucugcuuucucagcccacccugggcagccucugggauucccugcggcacugcucucuccuguguaacccccuuagcugcgugccugcucuggaggcucccccuucccuggucucucucgggugcagcggcggauguccgagacugucccuugccggcagcgccucucccuucccuuuucugacggcccuccugucccuccugaauacccuugcgcaaauccauaaggggcugugcggacagcuggcugccauccucgccgcucccggccugcagaacuacuuccuucaguguguggccccuggggcggcuccccaccugacaccguuuagcgccugggcccuccgccacgaguaucaucugcaauaccucgcucuggcccuugcucagaaggccgcggcccugcagccucugcccgcuacccacgccgcucucuaucauggaauggcccuggcccuucugucucggcuccugccuggcuccgaauaccucacacacgagcugcuucugagcugcguuuucagacuggaauuucuccccgagcgcaccucugggggcccugaagcugcggacuucuccgaucagcugagccuuggauccagccgggugcccagauguggccaagggacgcugcucgcccaggcuugccaggaccugccgucuauucgcaauuguuaucugacacauugcagcccugcccgggccucccuccuugcuucucaggcccugcacagaggagagcugcaacggguccccacccuccugcuucccaugccuacagagccgcugcuccccaccgauuggccuuuucugccccugauccgccucuaccacagagcgagcgacaccccuuccggccuuucucccacagacacgauggggaccgcuaugcgggugcugcagugggugcugguccucgaaagcuggcgcccucaggcccugugggccguuccgcccgcugccagacuugcgcggcugauguguguguuccucguggauuccgagcuguuuagagaaucuccuguccagcaucugguggccgcucuccuugcccaacugugccagccccagguucugccuaaccucaaucuggacugucgccuucccggacugaccagcuucccggaucucuacgcuaacuuccuggaccacuuugaggccguguccuucggcgaucaucuguuuggggcucucguccuucugccucugcaacggagauucagcgugacacuccgccuggcccuuuuuggcgaacacguuggagcgcugcgggcccucucucugccccugacacagcuccccgugucccuugagugcuauaccgucccucccgaggacaaccuggcucugcuccagcuguacuucagaacgcuugugacaggcgcccugcgcccucgguggugcccgguucucuaugcuguggccgucgcccaugugaauagcuuuauuuucucucaggauccccaauccagcgacgaagugaaagcugcgagacgcuccaugcugcagaagaccuggcugcucgccgaugaggggcuuagacagcaucugcugcacuacaaacucccuaacucuacccugcccgaaggauuugagcuuuauagccagcugccuccccuccggcaacacuaccugcagcgccugacauccaccguccuccagaauggcguuagcgagacauga

SEQ ID NO: 75020 - RNA, 600 nt, Artificial Sequence
  derived and/or modified sequence opt5 from RPE__Homo_sapiens__NP_001265214
auggccagcggcugcaagaucgggcccuccauucugaacucugaccucgcuaaucugggagccgagugucuuagaaugcuggauagcggcgcggacuaccuccaccuggaugugauggacgggcauuucgucccuaacaucaccuuuggacacccgguuguggaaucccuucggaaacagcugggccaagaucccuucuuugacaugcauaugauggugucuaagccugagcagugggucaaacccauggcuguggccggggccaaucaguauacauuccaccucgaagcuacggagaacccuggagcccugauuaaggauauccgcgaaaauggcaugaaaguuggccuggcuauuaagcccgggaccagcguggaguaccucgccccuugggcgaaccagaucgacauggcccuggucaugacaguggagccgggauuuggcgggcaaaaguucauggaagauaugaugcccaaagcuggagccaauaugaucguuuccggcucugcuauuaugagaagcgaggacccucgguccgugaucaaccuucugcgcaaugucugcagcgaagccgcgcagaagagaucucucgaucgguga

SEQ ID NO: 75021 - RNA, 2448 nt, Artificial Sequence
  derived and/or modified sequence opt5 from RPGR__Homo_sapiens__NP_000319
augagagagcccgaagaacugaugccugacagcggcgccguguucaccuuugggaaguccaaauucgcugaaaacaauccgggaaaguuuugguucaaaaacgauguccccguucaccucucuugcggcgacgagcauagcgccguggugacagggaauaacaagcuguacauguuuggauccaauaacuggggccagcuugggcugggaucuaaaagcgcgaucuccaagccuacgugugucaaggcucucaaacccgaaaaggugaaacuggccgccugcggccggaaucacacccuuguuucuacagagggcgggaacguguaugcuaccggaggcaauaacgaggggcaacugggacucggcgauacagaagaacgcaauaccuuccaugucauuagcuuuuucacauccgaacacaagaucaaacagcugagcgccgggucuaacaccuccgcugcccugacggaggacggaagacucuuuauguggggcgauaauagcgagggccagauugggcugaagaacgugucuaauguuugugugccucagcaagucaccaucggaaagcccguguccuggauuagcugcggcuacuaucauucugcguucgugacaaccgacggggaacuuuacgucuuuggagagccugaaaacggcaaacuggggcucccgaaccagcugcuuggaaaucaccggacaccccagcugguuuccgagaucccugaaaaggugauccagguggccuguggcggcgagcacaccgucgugcucacggagaacgcuguuuauacauucgggcugggacaauuuggccagcuggggcucggaaccuuccuguucgaaacaagcgagcccaaagugauugaaaauauccgcgaucagaccauuuccuacaucucuugcggcgagaaccauaccgcccuuauuacagacaucgggcugauguauacguuuggcgauggaagacacggcaagcucgggcugggacuugaaaauuucaccaaccauuuuauuccuacacuguguagcaauuuccuccgguuuaucgucaaacugguggcuugcggcgggugucacaugguuguguucgccgcgccccaccgcggagucgccaaggagaucgaguuugacgaaauuaacgauaccugccuguccguggcuacauuccucccguacagcucucugaccuccggcaauguccuucagagaacgcugagcgcccggaugcgcagacgggagcgcgaaagaucuccugacagcuuuuccaugcggcgcacacugcccccuaucgaggggacccucggccuuucugcuuguuuccugcccaacagcguguuucccagaugcuccgaacggaaucuccaagagagcguucugucugagcaggaucugaugcagccugaggagccggacuaccuccuggacgaaaugaccaaagaggccgagauugauaacuccagcacaguggaaucucuuggagagaccacagacauccugaauaugacgcauauuaugucccucaacagcaaugaaaagucccugaagcugucucccguccaaaaacagaagaaacagcagaccaucggcgagcuuacacaagauaccgcccucacagaaaacgacgauagcgacgaguaugaggaaauguccgagaugaaggaagggaaggcuugcaaacagcacgugucucagggaaucuucaugacccagccugcgacgaccauugaggccuuuagcgaugaagagguugagauccccgaagagaaggaaggcgcugaggacuccaaagggaacggaauugaggagcaagagguggaagccaaugaggaaaacgucaaggugcauggcgggagaaaagagaagacagagauccugagcgaugaccugaccgauaaagccgaagaccacgaguucucuaagacagaggaacucaagcuggaagacguggaugaggagauuaaugcugaaaacguugaguccaaaaagaaaaccgucggcgacgaugaaagcgugccuacgggauaccauucuaagacagagggcgccgaacgcaccaaugacgauuccagcgcggagacaaucgagaaaaaggaaaaggcuaaccuugaggaacgggccaucugugaguauaaugaaaaccccaaaggguacaugcuggacgaugccgacucuagcucccucgagauucuggagaauagcgaaaccaccccgucuaaggauaugaaaaagacgaaaaagaucuuccuguuuaaaagagugccuuccauuaaccagaagaucgucaagaauaacaaugagccccuuccugaaauuaaaagcaucggagaccagauuauccucaaguccgauaacaaagacgcugaucagaaucacaugucucaaaaccaccagaacauucccccuacaaauaccgagcgccggagcaaguccugcacaauccuguga

SEQ ID NO: 75022 - RNA, 3861 nt, Artificial Sequence
  derived and/or modified sequence opt5 from RPGRIP1__Homo_sapiens__NP_065099
augagccaccugguggaccccaccuccggcgaucucccugucagagacaucgaugccauuccgcugguucuucccgcuucuaaggggaaaaacaugaagacacagccuccccugagccggaugaaucgcgaggaacucgaggacuccuucuuuagacugcgggaagaucauaugcuugugaaagagcugucuuggaagcaacaggacgaaaucaaacgccucagaacgacccugcugcggcucacagccgcgggacgcgaucugagaguggcugaggaggccgccccucuuagcgaaaccgcucggcgcggccagaaggccggguggagacagcggcuguccaugcaccaacgcccccagaugcauagacuccagggacacuuccauugcgucggcccugcuucuccgcggcgcgcccagcccagagugcaaguugggcaccggcagcugcacacagcgggagccccugugcccgagaagccuaaaagaggcccccgcgaccggcuuagcuacaccgcuccgccuuccuuuaaggaacaugccacaaacgagaauagaggcgaggucgcuagcaaacccucugaacugguguccgggagcaacucuauuaucuccuucagcucuguuauuuccauggccaagccuaucggacucuguaugcccaauagcgcgcacaucauggccuccaacaccaugcaaguggaggaacccccuaaaucuccggagaagauguggcccaaggaugaaaauuuugagcagcgcagcucccuggagugcgcucaaaaagccgcugaacugcgggccagcauuaaggagaaagucgaacucaucagacugaagaaacuucugcaugagcgcaacgccucucucgugaugacgaaggcucagcugaccgaagugcaggaggcguaugagacacuucugcagaaaaaucagggcauucucuccgccgcucacgaagcccugcugaagcaggucaacgagcuccgggccgaacugaaggaggaaagcaaaaaggcuguuucucuuaaaagccagcuggaggacguguccauccuccaaaugacccugaaggaguuccaggaaagaguggaggaucuugaaaaagagcgcaagcugcucaaugacaacuacgauaagcugcuggagucuaugcucgacagcuccgacagcagcucccagccucacuggagcaaugaacugauugccgagcagcuucaacagcaggucucucagcugcaagaucagcucgacgcggaacuggaggauaaacggaaggugcugcuugaacucuccagagagaaagcucagaacgaggaccugaagcuggaaguuacaaauauccuccagaaacauaagcaagagguggaacugcuucagaacgccgccaccauuagccagcccccugaucgccaauccgagcccgcuacgcacccggccguccugcaggaaaacacacagaucgagccuucugagcccaagaaucaggaagagaaaaagcucagccaagugcugaacgaacugcagguuucccaugcugagaccacacuugaacucgagaaaacccgggacaugcugauccugcagagaaagauuaauguguguuaucaggaggaacucgaggccaugaugaccaaagcggauaacgacaaucgggaucacaaggaaaagcuggagcgccuuacaagacugcucgaccugaaaaacaaucggaucaagcaacuggaggggauucuuagaucucaugaucucccuacgagcgaacagcugaaagacgucgccuacggaacccgcccccugucccucugccuggagacacuuccugcucacggcgacgaagauaagguggacaucagccugcuccaccagggggagaaccuguuugaacugcauauucaccaggccuuccuuaccucugcugcccucgcgcaagccggagauacacagcccaccacguuuuguacauauuccuucuacgacuuugagacccauugcaccccgcugagcgucggcccucagccccuguaugauuucacaucucaauacgugauggagaccgacucccucuuucugcacuaccuucaggaagcuagcgcccggcuggauauccaccaggcuauggccucugagcauagcacacucgccgcuggcuggaucuguuucgacagaguucuggaaacgguggagaaaguccacgggcuggcgacccuuauuggagccggcggggaagaguucggagugcuggaguauuggaugcgccucagauuucccaucaagccuucccugcaggcuugcaauaaacggaagaaggcccaaguuuaccucagcacagaugugcugggcgggcgcaaagcccaggaagaggaguucagaucugaauccugggaaccgcagaacgagcuuuggauugagaucaccaaguguugcggacugcggagccgcuggcucggcacacagcccuccccuuaugcugucuacagauuuuucaccuuuucugaccaugauacggccauuauccccgcgagcaauaacccuuauuuccgggaccaagcucgcuuucccgugcuggugaccuccgaucuggaccacuaccuuagacgggaagcccugucuauccauguuuucgacgaugaggaccucgaaccuggcagcuaucuggggcgcgccagagucccccuccugccgcuugcuaaaaaugaguccauuaagggagauuuuaaccugacagacccugccgagaaacccaauggcucuauccaggugcagcucgauuggaaguucccuuacauucccccggaaucuuuucugaagccugaggcgcagaccaaagggaaggacacaaaagauuccagcaagaucucuuccgaagaggaaaaagcuagcuuccccucucaagaccagauggccuccccugaggugcccauugaggccggacaguaccggagcaagagaaagcccccucacggcggggaacgcaaagagaaggaacaccaggucgugucuuauucccggagaaaacauggcaagcgcaucggaguucaaggcaaaaaccggauggaguaccugagccuuaacauucugaaugggaacaccccggaacaggugaauuauacggaguggaaguuuuccgagacaaacagcuucaucggagauggcuucaagaaucagcacgaagaggaagagaugacccucucucauagcgcucugaaacaaaaggaaccccuccacccugucaacgacaaagaguccucugagcaggggagcgaaguguccgaggcccagacaaccgauucugacgauguuaucgugcccccuaugagccagaaguaccccaaagcugacuccgaaaagauguguauugagaucgucucucuggccuuuuauccugaggcggaagugaugagcgacgagaauauuaaacaaguuuacguggaauauaaguucuacgaucuuccgcuguccgagaccgaaacacccgucagccugagaaagccucgcgccggagaggagauccauuuucacuucucuaaagugauugaccucgauccccaggaacagcagggccggagacgcuuucuguucgacaugcuuaacgggcaagauccugaccagggccaccugaaguuuacgguggucuccgauccccucgacgaggagaaaaaggaaugcgaagagguuggauacgcuuaucugcagcucuggcagauccuggagagcggccgggauauccuugaacaagagcuggacauugugucuccggaagaucuggccaccccuaucgggagacucaaagugucccugcaggcugccgccguccuucaugcuauuuacaaggagaugacagaagaccuguucagcuga

SEQ ID NO: 75023 - RNA, 3708 nt, Artificial Sequence
  derived and/or modified sequence opt5 from RPGRIP1L__Homo_sapiens__NP_001121369
augagcggccccaccgacgagacagccggggaucugccugugaaggacacgggacucaaccuguucggcaugggagggcuucaggaaaccuccacaaccagaacaaugaaaucucggcaagcugucagccgcguuuccagagaggaacuggaggaucgguuucuccgccugcacgacgaaaauauccuucugaagcagcaugccagaaaacaggaggauaagauuaaacggauggcgaccaagcucauccgccuggugaacgacaagaaaagauacgagcgggugggcgggggaccgaagcgccugggcagagaugucgaaauggaggaaaugauugagcagcuccaagagaaagugcacgaacuggagaagcagaaugaaacacuuaaaaaccggcugaucucugcuaagcagcagcuccaaacccagggcuaucgccagacgcccuacaauaacguucagagcagaauuaauaccgggcggcgcaaggccaacgagaaugccggacugcaagaaugcccuagaaaaggcaucaaguuccaggacgcugauguggccgagacaccccauccuauguuuaccaaauaugggaacucccuucuggaggaagcucggggagagaucagaaaucucgaaaacgucauucagucucaacgcggccagaucgaggaacuggagcaccuggccgagauucucaagacacagcugcggagaaaagaaaaugagaucgaacuuagccugcuccagcugcgcgagcaacaggcgaccgaccagcgguccaacauuagagauaauguggaaaugaucaagcugcauaaacagcugguugaaaagagcaacgcccucucugcuauggaggggaaguucauucaacugcaggaaaaacagcgcacgcugcggaucucccacgacgcccucauggcuaacggagaugagcugaauaugcagcuuaaggaacaaagacugaaauguugcagccucgagaagcagcugcacucuaugaaauuuuccgagcgccggaucgaagaacuucaggacagaauuaacgaccuggaaaaggagcgcgaacuccugaaggagaauuacgauaaacuguaugacagcgccuucucugcggcccaugaggaacaguggaagcucaaagagcaacagcugaaggugcagaucgcucaacuugaaacagcccugaaauccgaucucaccgacaagacagagauucuggaucggcugaagaccgaaagagaccagaacgagaaacuuguccaggagaaucgggaacuccagcugcaauaccuggagcagaagcagcagcucgaugaacugaaaaagcgcaucaaacuuuauaaccaagagaaugacauuaacgcugaugaacugagcgaggcccuccugcugaucaaggcccagaaggagcagaaaaauggcgaccuuuccuuucucgugaagguggauucugaaaucaacaaagaccuggagagaagcaugcgggaacugcaggcuacccacgcggagacaguccaagagcucgaaaagacgagaaauaugcugauuaugcagcauaaaaucaacaaggacuaccagauggagguugaagccgugacccgcaaaauggagaaucuucaacaggauuacgaacugaagguggagcaguauguccaccuccuggacauucgggcugccagaauccacaagcuggaggcccagcuuaaagauauugcuuacggcacaaagcaauauaaauucaagcccgaaaucaugccugacgauuccguggacgaguuugaugaaaccauccaucucgagcgcggggaaaaccuguucgagauucacaucaauaaaguuacauuuagcucugaggugcugcaggccuccggagacaaggaaccggucaccuucuguacguacgcguuuuaugauuucgagcuccagacaacccccgugguuagaggccugcauccugaauacaacuucaccagccaguaucuugugcacgucaacgaccuguuucuccaauacauucagaagaauacaaucacccuggaggugcaucaggcuuacucuacagaauaugagacgauugccgccugccagcugaaauuccacgagauccuugaaaagagcgggcggaucuuuuguaccgcuucccucauuggaacaaaaggcgauauccccaacuucgggaccgucgaguacugguuucgccugagagugccuauggaccaagccauucggcuguaucgcgaaagagcuaaggcccucggauacaucacaucuaauuucaaaggccccgagcacaugcagagccugucccagcaggcgccgaagaccgcccaacuuagcucuacggauuccaccgacggcaaccugaaugagcuccauauuacaauccggugcuguaaccaccuucagagccgcgcuucucaucugcagccucaccccuauguuguguacaaguuuuucgacuuugccgaucacgacaccgcuauuaucccuuccagcaaugauccccaauucgacgaucauauguauuuucccgucccuaugaacauggaccuugauagauaccugaaauccgaaucucucagcuucuacguguuugacgauuccgacacacaggagaauaucuauauugggaagguuaacgugccgcugaucucucucgcccacgaucggugcauuagcggaaucuucgaacugaccgaccaucagaaacaccccgcgggcacgauucaugucauccuuaaguggaaauucgccuaccugccucccuccgggagcaucacaaccgaggaucucggaaauuuuauucgcucugaggagccugagguggugcagagacugcccccggcuuccagcguuucuacacugguccuugccccucggcccaagccuagacaacgccugacccccguggacaagaaaguguccuucgucgacaucaugccucaccagagcgaugugucucaggaaggcagcguugacgaggugaaggaaaacaccgagaaaaugcagcaagggaaggaugacgucucccuccugagcgaaggccagcucgcugagcagucucuggccuccagcgaggaugaaacagagauuacggaagaccuugagcccgaaguggaggaggauauguccgccucugacagcgaugacuguaucauuccgggaccuaucuccaaaaauaucaagcagcccucugagaaaauucggaucgagauuaucgcucugagccucaacgauucccaaguuaccauggacgacacaauucagagacuguuuguggaaugccgcuucuauucucugcccgcggaggagaccccugucagccuuccgaagcccaaguccggccaguggguguacuauaauuacagcaacguuaucuauguggauaaagaaaacaauaaggccaaacgggacauucugaaggcuauccuccaaaaacaggagaugccuaacagaucucugcgcuuuacagucguguccgaucccccugaagacgagcaggaucucgaaugugaggacaucgggguggcccacgucgaucuggccgacauguuccaggagggacgggaucuuauugaacaaaauaucgacguuuuugaugcuagagccgacggcgaggggauuggaaagcugcgcgugaccguggaagcgcugcaugcucuccagagcgucuacaagcaguaccgggaugaccuggaggccuga

SEQ ID NO: 75024 - RNA, 2085 nt, Artificial Sequence
  derived and/or modified sequence opt5 from RPH3A__Homo_sapiens__NP_001137326
augaccgacacaguguucagcaacuccucuaauagauggauguaccccagcgaucggccucugcaguccaacgacaaggagcaacuccaggccggcuggucuguccaccccgggggacagccggaucgccagagaaaacaagaagaacugacggacgaagagaaggaaaucauuaaucggguuaucgcucgcgccgagaaaauggaggaaauggagcaggaaagaauuggccggcuuguggaucgccuggagaacaugagaaagaauguggcgggggacggagucaaccggugcauccucuguggcgagcagcuggggaugcuuggaagcgcuugcgugguuugugaagauugcaaaaagaauguguguaccaagugcggcgucgagacaaacaaucgccugcauuccguguggcucuguaaaauuugcaucgaacagagagagguuuggaagcggucuggcgccugguuuuucaaaggguuuccuaagcaagugcugccccagccuaugcccaucaaaaagaccaagccucagcagccggucagcgaacccgccgcuccugagcaacccgccccugagcccaaacacccggcucgcgccccugcgagaggagacuccgaagaucggcgcggccccgggcagaagacaggaccugaccccgccagcgcucccggcagagggaacuauggaccuccggugcggagagccucugaggcucgcauguccucuucuucccgggauagcgaaucuugggaccauuccggcggcgccggggauagcuccagaucucccgcgggacugcgccgggccaauagcgugcaggcuuccagaccugcccccggcagcguccaaucuccugcucccccgcagccugggcagcccggaaccccuggcgggucccgccccggaccuggccccgccggccgguucccggaccagaaaccugagguugcccccagcgaccccgggacaaccgcuccuccgagagaggagcgcacgggaggcgucgggggauaccccgcggugggcgcccgggaggauagaaugucucacccuagcgggcccuauucccaagcuagcgccgccgcuccucagcccgccgcggcucgccagccucccccgccugaagaggaagaggaagaggccaacagcuacgacuccgaugaggccaccacacucggcgcucuggaauuuagccuucuguaugaccaggauaauucuucccuccaauguaccauuaucaaggccaaaggacugaagcccauggacagcaacggccuugcugauccuuacgugaaacugcaucuccugcccggggccucuaaguccaauaagcugcggacaaaaacccucagaaacacgcggaacccgauuuggaaugagacacugguguaucacggaaucaccgacgaagauaugcagcgcaagacacuuagaauuagcguuugcgacgaggauaaauucggccacaacgaguuuaucggggaaacccgguucucccugaagaaacucaagccuaaucagagaaagaacuuuaauauuugucuggagcgcgugauccccaugaaacgggcgggaaccacaggcucugccagagggauggcucuuuacgaagaggaacaggucgagcgcgugggcgacaucgaggaaagaggaaagauucugguuagccucauguacuccacgcaacagggcgggcugaucgugggaauuauccggugcguccaucuggccgcuauggacgccaacggcuauucugauccuuucgugaaacucuggcugaagcccgacauggggaaaaaggcgaagcacaaaacccagauuaagaaaaagacacuuaaucccgaguuuaacgaagaguucuuuuacgauaucaaacauagcgaccuggccaagaagucccucgauaucagcgucugggacuaugauauuggaaaaucuaaugacuacaucggcgggugccagcugggcauuuccgcuaagggagaacgccuuaaacacugguaugagugucugaagaacaaagauaagaaaaucgagagauggcaccaacuccagaaugaaaaccaugugagcucugacuga

SEQ ID NO: 75025 - RNA, 948 nt, Artificial Sequence
  derived and/or modified sequence opt5 from RPH3AL__Homo_sapiens__XP_011545302
auggccgacaccaucuucggcagcgggaacgaucagugggugugccccaaugacagacaacuggcucuccgggccaagcugcagacaggaugguccguccacacguaccagaccgagaaacagcgcagaaagcaacaucuuucuccugcggaaguugaggcuauucuccaggugauccagcgggccgaacgccuggaugugcuggagcagcaaagaauuggccggcuugucgaacgccuggagacaaugagacggaacgugauggggaauggacucagccagugucugcugugcggcgagguucucggguuucugggauccucuagcguguucuguaaagacugccgcaagaaagucuguaccaagugcggcaucgaagccuccccgggccagaagagaccccuuuggcuguguaaaauuugcucugagcagcgggaaguguggaagcgcagcggggcuugguuuuauaaaggacucccuaaguacauccugccccuuaaaacaccuggcagagccgaugacccccacuuccggccucugccgaccgagcccgcugagcgcgaaccuagauccagcgagacaucucggaucuauaccugggccagagggcgcguuguguccagcgauucugacuccgauagcgaccucucuuccagcucccuggaagaucggcugcccucuacgggagucagagaccgcaagggcgauaagccuuggaaagagagcgggggauccguggaagcgccccggaugggcuuuacccauccgccuggccaccucagcgggugucaaucuucccuggccagcggagagacaggcaccgggucugcugaucccccuggaggccccagacccgggcuuacacgccgggccccugugaaggacaccccgggcagagcucccgccgcggacgccgcuccugccggacccagcuccugccugggcuga

SEQ ID NO: 75026 - RNA, 936 nt, Artificial Sequence
  derived and/or modified sequence opt5 from RPIA__Homo_sapiens__NP_653164
augcagagacccggcccuuucagcacccuguacgggcgggugcucgccccgcugcccggacgcgcuggcggggccgcguccggaggcgggggaaacucuugggaccuuccuggcagccacgucagacugcccggccgggcucaauccgggacacgcggaggcgccgggaauacgucuaccagcugcggagauuccaacucuaucuguccugcccccagcacaauguccaaggcugaggaagccaaaaagcucgcuggcagagccgcgguugagaaucaugugcggaacaaucaggugcuggggauuggaagcggcucuaccaucguccacgccgugcagcgcauugcugaaagaguuaaacaggagaaccuuaaucuggugugcaucccuacauccuuucaagcccggcagcucauucugcaguauggccugacccucagcgaccuggaucgccauccggaaaucgaccuugcuaucgauggggccgacgaggucgaugcggaccugaaccucauuaagggaggcgggggaugucugacacaggagaaaaucguggccggcuacgcuucuagauucauuguuaucgccgauuuucggaaggacuccaagaaucuuggggaucaauggcacaaaggcauucccaucgaagugauuccuauggcuuauguccccgugagccgcgccgugucucagaaguucggaggcgucguugagcugagaauggccgugaacaaagcugggccuguggucaccgacaauggaaacuuuauccucgauuggaaguucgaccgggugcauaaaugguccgaaguuaauacggcgaucaagaugauucccggcguggucgacaccgggcuguuuaucaacauggccgagcgcguguacuucggaaugcaggauggcagcguuaauaugagagagaagccguuuugcuga

SEQ ID NO: 75027 - RNA, 654 nt, Artificial Sequence
  derived and/or modified sequence opt5 from RPL10A__Homo_sapiens__NP_009035
augagcuccaaggugucuagagacacccuguacgaggccguccgggaaguucuccacggcaaccagcgcaaaagacggaaguuccuggagacaguggaacuucaaaucagccugaaaaauuaugauccccagaaggacaaacgcuuuuccgggacggugagacucaagucuaccccucggccgaaguucagcgucugcgugcugggagaucagcagcauugugacgaggcuaaagccguugauauuccccacauggacaucgaagcgcuuaagaaacugaacaagaauaaaaagcucgugaagaaacuggcuaagaaauacgaugccuuucuggccuccgagucucucauuaagcaaaucccucgcauucugggccccgggcuuaacaaagcuggaaaguucccuagccugcucacacauaaugagaacauggucgccaaaguggacgaaguuaaguccaccaucaaguuucagaugaaaaaggugcugugccuugcugucgccgugggccacgugaaaaugacagaugacgagcuggucuauaauauccaucucgcgguuaacuuccuggugagccugcucaagaaaaauuggcagaacgugagagcccuguacauuaagucuaccauggggaagccccagcggcuuuauuga

SEQ ID NO: 75028 - RNA, 651 nt, Artificial Sequence
  derived and/or modified sequence opt5 from RPL10__Homo_sapiens__NP_001243506
augggcagacggcccgcccgcugcuacagauauuguaagaacaaaccuuacccgaagucucgguucugccgcggggugcccgacgcuaaaaucagaauuuuugaucugggacggaagaaagccaaggucgacgaguucccucucuguggccacaugguuuccgaugaauaugagcagcugucuagcgaagcgcuugaggcugcccgcaucugcgccaauaaguacauggugaaauccugugggaaggacggauuucauauuagagugcggcugcaccccuuccaugucauccgcauuaacaaaaugcucucuugcgcuggcgccgauagaagcaccucccaacggucuggggcuagcccuuccagcaugcugaugaaucuuaagacaugguggcugaaaucuggauccagccagauggccgugggcagcuccacgagccccguuguggcgcucuggaccucuggcgggccuuguacacacgaaggauuucagugcgccgcuccgcugcugauccucaccaacaaguucuauuuucuguccacauacgucuucgugagcaccuuucuuacaggcaaggagcugccccucgggaccuucggaucccugccuuuucauuuccgcaauagacuuacgacccagcccuguucuuga

SEQ ID NO: 75029 - RNA, 645 nt, Artificial Sequence
  derived and/or modified sequence opt5 from RPL10L__Homo_sapiens__NP_542784
augggcagacggcccgcccgcugcuacagauauuguaagaacaaaccuuaccccaagagccgguucugccgcggggugccggacgcuaaaaucagaauuuuugaucugggacggaagaaagccaaggucgacgaguucccucucggcgggcacaugguuuccgaugaauaugagcagcugucuagcgaagcgcuugaggcugcccgcaucugugccaauaaguacauggugaaauccugcggaagagacggcuuucauaugcgggugcgccugcaccccuuccaugucauuagaaucaacaagaugcucucuugugcuggggccgaucggcugcaaaccggaaugcgcggcgcuuuuggcaaaccucaggggacaguggccagaguucacauuggacaggugaucaugagcauccggacgaaacuucagaaugaagaacaugucauugaggcgcugcgcagagccaaguucaaguuucccggccggcaaaagauccacauuuccaaaaaguggggguucaccaaauuuaacgcugacgaguucgaggauaugguggccaagaaaugccucaucccugacggauguggcguuaaguaugugccgucucacgggccccuggauaaauggagaguccugcauagcuga

SEQ ID NO: 75030 - RNA, 498 nt, Artificial Sequence
  derived and/or modified sequence opt5 from RPL12__Homo_sapiens__NP_000967
augcccccuaaguucgacccgaacgagaucaaaguggucuaccugagaugcaccggcggggaaguuggagccacaagcgcucucgcccccaagauuggcccucuggggcuuucccccaaaaaggugggagaugacaucgcgaaagcuacgggcgauuggaaggggcugcggauuaccgugaagcucacaauccagaaucgccaagcccagauugaggucgugccuucugccagcgcucugaucaucaaagcccuuaaggaacccccuagagaccggaaaaagcagaaaaacauuaagcacuccggaaauaucaccuuugaugagauuguuaacaucgcucgccagaugagacaucggucucuggcccgcgaacucagcggcacaauuaaggagauccugggcaccgcgcaauccgugggguguaaugucgacggaagacacccgcaugauauuaucgacgauaucaacucuggcgccguggagugccccgcuagcuga

SEQ ID NO: 75031 - RNA, 495 nt, Artificial Sequence
  derived and/or modified sequence opt5 from RPL13__Homo_sapiens__NP_001230060
auggcccccagcagaaacggcauggugcugaagccucacuuccauaaagacuggcagcggcgcgucgcuaccugguuuaaucaaccggccagaaagauccggcgcagaaaagcgcggcaggcuaaggcccgcagaauugcuccccggccugccuccgggcccauccgcccuauuguuagaugccccacagugcgguaccacacgaaagugcgcgccggaagaggcuucucucucgaggaacugcgggucgcugggauccauaagaagggagauagcuccgccgaggaacuuaaacuggcgacccagcucacaggcccugugaugccgguucgcaacguguauaagaaagagaaggccagagucauuaccgaagaggagaaaaauuuuaaggcuuucgccucucugcggauggcuagagccaacgcgcgccuuuuugggauccgggccaagagagcuaaagaagccgcugagcaggacguggaaaagaaaaaguga

SEQ ID NO: 75032 - RNA, 648 nt, Artificial Sequence
  derived and/or modified sequence opt5 from RPL14__Homo_sapiens__NP_001030168
augguguucagacgguuugucgagguuggacgcguggccuacgugagcuucgggccccacgcuggaaagcuggucgccaucguggacguuauugaucagaacagagcgcucguggacggcccuugcacccaaguccggcgccaggcuaugccguuuaaauguaugcagcugacagauuucauccuuaaguuuccccauuccgcccaccagaaauaugugagacaagccuggcagaaggcugacauuaauacgaaaugggccgcuacccggugggccaagaagaucgaagcgcgcgagagaaaagccaagaugacagauuucgaccgguuuaaaguuaugaaggcuaaaaagaugcgcaacagaauuaucaagaaugaagugaaaaagcugcagaaagccgcucuccugaaggccucuccuaaaaaggcgcccgggaccaaaggaacagccgcugccgcugccgccgcugcggccgcuaaggucccugccaagaaaaucaccgccgcuagcaagaaagcccccgcgcagaaggugccugcucaaaaagccacaggccagaaggccgcuccggcccccaaggcucagaaagggcagaaggccccugcgcaaaaagcccccgcuccuaaggccuccggcaaaaaggcuuga

SEQ ID NO: 75033 - RNA, 438 nt, Artificial Sequence
  derived and/or modified sequence opt5 from RPL15__Homo_sapiens__NP_001240313
augggcgccuacaaguauauccaggagcuguggcgcaaaaagcaaagcgacgugaugcgguuccuccugcgcgucagaugcuggcaguaccggcagcuuuccgcucugcaccgcgcccccagaccuacccggccggauaaagcgcgcagacucggguauaaggcuaaacagggauacguuauuuaucggauccgcgugagacggggcgggcgcaagagacccgugccuaagggagccacauacggcaaacccguccaucacggggugaaccaacugaaguuugcccggucucuucagagcguugcugaagagagagccggaagacauuguggcgcucugcgggugcucaauuccuauuggauggaaucucacagccauuccggcgggucugccgucggacagagcagacugacggcgaccuccgugagccgcguuuga

SEQ ID NO: 75034 - RNA, 687 nt, Artificial Sequence
  derived and/or modified sequence opt5 from RPL17-C18orf32__Homo_sapiens__NP_001186284
auggugagauacagccuggaccccgagaacccuaccaaguccugcaaaucucggggcagcaaucuccgcguccacuucaagaacacaagagaaacggcccaggcuaucaaagggaugcauauucggaaggccaccaaauaucugaaggauguuacacuucaaaagcagugugugccguuucgcagauacaauggaggcguggggcggugcgcgcaggcuaaacaguggggauggacccaaggccgcuggcccaagaaauccgccgaguuccugcuccacaugcugaagaacgccgaaucuaaugcugagcuuaaagggcuggacgucgauagccucgugaucgaacauauucagguuaacaaggccccuaagaugagacggcgcacauauagagcucacggacggaucaaucccuacauguccucuccuugucauauugagaugauccugaccgagaaagaacagaucgugcccaagccugaggaagaggucgcccagaaaaagaaacugcgcagcuccagccucggcaaguggugcgcguuucuggugucuuccuuccaauuuuguagcggcucuaccaaaaacuccuggagccacauuuauacacuuugguucccgcccucucugguuguguacgggcucagaaagcaguauaagaauccuaugauccagacgaaagccaaguga

SEQ ID NO: 75035 - RNA, 555 nt, Artificial Sequence
  derived and/or modified sequence opt5 from RPL17__Homo_sapiens__NP_001030178
auggugagauacagccuggaccccgagaacccuaccaaguccugcaaaucucggggcagcaaucuccgcguccacuucaagaacacaagagaaacggcccaggcuaucaaagggaugcauauucggaaggccaccaaauaucugaaggauguuacacuucaaaagcagugugugccguuucgcagauacaauggaggcguggggcggugcgcgcaggcuaaacaguggggauggacccaaggccgcuggcccaagaaauccgccgaguuccugcuccacaugcugaagaacgccgaaucuaaugcugagcuuaaagggcuggacgucgauagccucgugaucgaacauauucagguuaacaaggccccuaagaugagacggcgcacauauagagcucacggacggaucaaucccuacauguccucuccuugucauauugagaugauccugaccgagaaagaacagaucgugcccaagccugaggaagaggucgcccagaaaaagaaaauuagccaaaagaaacugaagaagcagaaacucauggcgcgcgaguga

SEQ ID NO: 75036 - RNA, 567 nt, Artificial Sequence
  derived and/or modified sequence opt5 from RPL18__Homo_sapiens__NP_000970
augggcguggacaucagacacaacaaggaucggaaaguccgcagaaaggagcccaaaagccaggacauuuaccugcggcuccugguuaaacuuuaucgcuuccuggccagacggaccaauuccacauuuaaccaaguggugcucaagcgccuguucaugucuagaacgaaucggccuccgcuuagccugucccgcaugaucagaaagaugaagcuccccgggcgggaaaacaaaaccgcugucgugguuggaacaauuaccgaugacgugcgcguccaggaggugccuaagcugaaaguuugcgcccugagagugacaucucgggcgcgcagcagaauccuccgggcuggcgggaagauucugaccuuugaucagcuugcccuggacucccccaaaggauguggcacaguccuccugucugggccuagaaagggacgcgaaguguaccggcauuucggcaaggcccccggcaccccucacagccauacgaaaccguaugugagauccaaggggcgcaaauuugagcgggcuagaggacgccgggccagcagaggcuacaagaauuga

SEQ ID NO: 75037 - RNA, 591 nt, Artificial Sequence
  derived and/or modified sequence opt5 from RPL19__Homo_sapiens__NP_000972
augagcaugcugagacuccagaagcggcuggccuccucugugcuucgcugcggcaaaaagaaagucuggcuggaccccaacgagaccaaugaaaucgcuaacgccaauagcagacaacagauucggaagcucaucaaagaugggcugauuauccgcaagccuguuacagugcacuccagagcgcggugucgcaagaacacgcuugcuagacggaaaggacgccauaugggcauugggaagagaaaaggaaccgccaaugcccggaugccggagaaggugacauggaugcgcagaaugcggauccugcgcagacuccugcggagauaccgcgaaucuaaaaagaucgaccggcacauguaucauagccuguaccucaaggucaaaggcaacguguucaagaauaaaagaauccugauggagcacauucauaaacuuaaggcugauaaggcccgcaaaaagcugcucgcugaccaggccgaagcgcggagauccaagaccaaagaggcccgcaagcggagagaggaacgccugcaggcuaaaaaggaggaaauuaucaaaacacuuucuaaggaggaggaaaccaagaaauga

SEQ ID NO: 75038 - RNA, 483 nt, Artificial Sequence
  derived and/or modified sequence opt5 from RPL21__Homo_sapiens__NP_000973
augaccaacacaaagggcaaaagacgggggacgcgcuacauguucagcagacccuuucggaagcacggaguggucccucuggccaccuauaugcgcaucuacaaaaagggcgacauuguugauaucaaagggaugggaacagugcagaagggcaugccgcauaagugcuaucacgggaaaaccggaagaguguacaaugucacacaacaugcugugggcauuguugugaacaagcaggucaaaggcaagauccucgccaaacggauuaaugugcgcaucgaacacaucaagcauuccaagucuagagacagcuuccugaaacggguuaaggaaaacgaucagaaaaagaaagaggcgaaggaaaaagggaccugggugcagcuuaagcgccaacccgcuccucccagagaggcccacuuuguccggacaaauggaaaggaaccugagcugcucgagcccauuccuuaugaguucauggccuga

SEQ ID NO: 75039 - RNA, 471 nt, Artificial Sequence
  derived and/or modified sequence opt5 from RPL23A__Homo_sapiens__NP_000975
auggcccccaaggcuaaaaaggaggccccugcgccgcccaaagcugaagccaaggccaaagcucugaaggccaagaaagcugugcucaagggcguccacagccauaaaaagaaaaagaucagaaccuccccuacauuccggcgccccaagacgcugagacuucggcgccagccuaaauaccccagaaagucugccccucggcgcaacaaacuggaccacuaugcgauuaucaaguuuccgcucaccacagagagcgccaugaaaaagauugaagauaauaacacccugguuuucaucguggacgugaaagcuaauaagcaucaaauuaagcaggccgucaaaaagcuguacgauaucgacguggcuaaaguuaacacacuuaucagacccgauggggagaagaaagccuaugugcggcucgcgccugacuacgaugcccuggacgucgcuaauaagauuggaaucauuuga

SEQ ID NO: 75040 - RNA, 423 nt, Artificial Sequence
  derived and/or modified sequence opt5 from RPL23__Homo_sapiens__NP_000969
augagcaagagaggccgcgggggauccucuggcgccaaauuccggaucagccuggggcuccccgugggagcugucauuaacugcgccgacaauaccggcgcgaagaaccuguacaucauuuccguuaaagggaucaagggaagacuuaaucggcugccugcugccggcgugggcgauauggugauggccacagucaaaaaggggaagccggagcuccgcaaaaaggugcaccccgcuguugugauuagacagcggaaaucuuaucgcagaaaggacggagucuuucuguacuucgaagauaacgccggcgugaucguuaauaacaaaggggagaugaagggaagcgcuaucacgggcccuguggccaaggaaugugcggaccuuuggccccggauugccuccaaugcugggucuaucgccuga

SEQ ID NO: 75041 - RNA, 474 nt, Artificial Sequence
  derived and/or modified sequence opt5 from RPL24__Homo_sapiens__NP_000977
augaagguggagcugugcagcuucuccggcuacaaaaucuaucccgggcacggaagacgguacgcccgcaccgacggcaaggucuuucaguuccucaacgcuaaaugugaaucugccuuucugagcaagagaaauccucggcaaauuaacuggacaguucuuuaucgcagaaaacauaagaaggggcaguccgaggaaauccagaaaaagcggacgcgcagagcggugaaauuccagcgggcuauuaccggagccucucuggccgauaucauggcuaagcgcaaucaaaaaccggaggugagaaaggcccagcgggaacaggcuauucgcgccgcgaaggaggccaaaaaggcuaaacaggccagcaagaaaacagcuauggccgcggccaaggcucccaccaaagccgcuccuaagcaaaagaucgucaaacccgugaagguuuccgccccuagagugggcgggaaacgguga

SEQ ID NO: 75042 - RNA, 447 nt, Artificial Sequence
  derived and/or modified sequence opt5 from RPL27A__Homo_sapiens__NP_000981
augcccagcagacugcggaagacccgcaaacucagaggccacgugucccaugggcacggacggaucggcaagcaucgcaaacacccugggggaagaggcaacgccgggggacugcaucaccaccggauuaauuucgacaaguaccauccgggcuauuuuggcaaagucgggaugaagcacuaccaucuuaagcgcaaccagucuuucugccccacaguuaaucuggauaaacucuggacgcuggugagcgagcaaaccagagugaacgcugccaagaauaaaacaggagcggcuccuaucauugacgucgugcgguccggcuauuacaagguucuugggaaaggaaagcugcccaagcagccugugaucgucaaagccaaguuuuucucucgcagagccgaagagaaaauuaagagcgugggcggggcuuguguucucguggccuga

SEQ ID NO: 75043 - RNA, 480 nt, Artificial Sequence
  derived and/or modified sequence opt5 from RPL29__Homo_sapiens__NP_000983
auggccaagagcaaaaaccacaccacacauaaucaguccagaaaguggcaccggaacggcaucaaaaagccccgcucucaaagauacgagagccugaaagggguggacccuaaguuccuccggaauaugcgcuuugcuaagaaacauaacaagaaaggacugaagaaaaugcaggccaauaacgcgaaggcuauguccgccagagccgaagcuauuaaggcccuugucaaaccgaaggagguuaaacccaagaucccuaaaggcgugucucggaagcuggaucgccucgcuuauauugcccaccccaaacuggggaagagagcgcgggcccgcaucgcuaagggacuuagacugugccggccuaaagccaaggcuaaagccaaggcgaaagaccagacgaaggcccaggcugccgcucccgccagcgugccugcccaagcuccgaagcgcacccaggcgcccacaaaagccuccgaauga

SEQ ID NO: 75044 - RNA, 348 nt, Artificial Sequence
  derived and/or modified sequence opt5 from RPL30__Homo_sapiens__NP_000980
augguggccgcuaagaaaaccaagaaaagccuggaguccaucaacucuagacuccagcuggucaugaaaagcggcaaguacguucuuggguauaagcaaacacugaagaugauucggcagggaaaagccaagcucgugauccuggcgaauaacugccccgcccuucgcaaauccgaaauugaguacuaugcuaugcuggccaagacgggcgugcaccauuacucugggaauaacaucgaacucggaaccgcuuguggcaaauauuacagagucugcacacuggccauuaucgacccuggggauagcgacaucauucgguccaugccggagcagaccggagaaaaguga

SEQ ID NO: 75045 - RNA, 378 nt, Artificial Sequence
  derived and/or modified sequence opt5 from RPL31__Homo_sapiens__NP_000984
auggcccccgcuaagaaaggcggggagaagaaaaagggaagaagcgccaucaacgaaguggucacccgggaguacacaauuaauauccacaaacgcauucauggcguuggguucaagaagagagcgccucgggcucugaaagaaauccgcaaguuugccaugaaagagaugggaacgccggacgugagaauugauacccggcucaacaaggccgugugggcuaaaggcauccgcaauguccccuauagaauccgggugcgccuguccagaaagcggaacgaagacgaggauucuccuaauaaacuuuacacacugguuaccuaugugcccgucacaaccuucaagaaccuccagacagugaauguugacgagaacuga

SEQ ID NO: 75046 - RNA, 354 nt, Artificial Sequence
  derived and/or modified sequence opt5 from RPL34__Homo_sapiens__NP_001306164
auggugcagagacugaccuaccggcgcagacucagcuauaacacagccuccaauaagacgcggcugucucgcacccccggcaacagaaucgucuaccuuuauaccaaaaagguugggaaagcuccuaagagcgccugcggaguguguccgggccggcugcgcggggugagagcgguccggcccaaagugcucaugcgccuguccaagacaaagaaacacguuucuagagcuuacggaggcagcaugugcgccaagugugugcgggaccgcauuaaaagagccuuccuuaucgaggaacaaaagauugucgugaaaguucugaaggcucaggcccagucccagaaggcuaaauga

SEQ ID NO: 75047 - RNA, 372 nt, Artificial Sequence
  derived and/or modified sequence opt5 from RPL35__Homo_sapiens__NP_009140
auggccaagaucaaagcuagagaccugcggggcaagaaaaaggaggaacuccugaaacagcuugaugaccugaagguggagcucagccaacugcgcgucgccaagguuacagggggagcggcuuccaaacuuucuaagauuagaguggugcggaaaagcaucgcccgcguccugacagugauuaaccagacgcagaaggaaaaucucagaaaauucuacaagggcaagaaauauaagccccuggaucugcggccuaaaaagacccgcgccaugagacggcgccucaacaaacacgaggaaaaucugaagaccaaaaagcagcaaagaaaggagcggcuuuacccgcugcgcaaauaugcuguuaaggccuga

SEQ ID NO: 75048 - RNA, 429 nt, Artificial Sequence
  derived and/or modified sequence opt5 from RPL36A__Homo_sapiens__NP_066357
augaucgcccccaccgacagccacgaggaagugagauccggcacaucuuacauucugccuuucgcuagccgguuucuguccuuccgcgccgauucugcgcaugcuagcauggucaacguuccgaagacgagacggaccuuuugcaaaaagugugggaaacaccagccccauaaggugacacaauauaaaaagggaaaggacucccuguacgcccagggcaaacgcagauaugaucggaagcagucuggguacggaggccagaccaaaccuaucuuccgcaagaaagccaagacaaccaagaaaauugugcuuagacuggagugcgucgaacccaauugucggagcaagcgcaugcucgcuaucaaaagaugcaagcacuuugagcucgggggagacaaaaagcggaaaggccaagugauucaguucuga

SEQ ID NO: 75049 - RNA, 321 nt, Artificial Sequence
  derived and/or modified sequence opt5 from RPL36AL__Homo_sapiens__NP_000992
auggugaacguccccaagaccagacggacauucugcaaaaaguguggcaaacaccagccucauaagguuacgcaauacaaaaaggggaaggacagccuguaugcccagggacgcagacgguacgaucgcaaacaguccggcuaugggggacagaccaagccgaucuuucggaaaaaggcuaaaacaaccaagaagauugugcucagacuggagugcguggaacccaauugucgcucuaaaagaaugcuugccaucaagcggugcaaacacuucgagcugggcggggacaagaaacgcaagggacaagucauucaguuuuga

SEQ ID NO: 75050 - RNA, 279 nt, Artificial Sequence
  derived and/or modified sequence opt5 from RPL37A__Homo_sapiens__NP_000989
auggccaagagaaccaaaaaggugggcaucgucgggaaauacggaacacgguauggcgcuagccugcgcaagaugguuaaaaagauugagaucucccagcacgccaaguacacgugcucuuucugugggaaaaccaagaugaaaagacgggcggugggaauuuggcauugcggcagcuguaugaagacaguggcugggggagccuggaccuauaacacaaccuccgccgucacagugaaaucugcuauccgcagacucaaggaacugaaggaccaauga

SEQ ID NO: 75051 - RNA, 213 nt, Artificial Sequence
  derived and/or modified sequence opt5 from RPL38__Homo_sapiens__NP_000990
augcccagaaagaucgaggaaauuaaagacuuccugcucaccgcccggcgcaaggaugcuaaaagcgugaagaucaaaaagaacaaggacaaugucaaauuuaagguuagaugcucccgguaccuguauacacuugugauuacggauaaagagaaggccgaaaaacugaagcagucucucccuccgggccuggcggugaaggagcuuaaauga

SEQ ID NO: 75052 - RNA, 156 nt, Artificial Sequence
  derived and/or modified sequence opt5 from RPL39__Homo_sapiens__NP_000991
augagcucccacaagaccuucagaaucaaacgguuucuggccaagaaacagaagcaaaaccgccccauuccucaguggaucagaaugaaaacaggcaauaagauucgguacaacucuaagcgcagacauuggcggcgcacgaaacucgggcuguga

SEQ ID NO: 75053 - RNA, 156 nt, Artificial Sequence
  derived and/or modified sequence opt5 from RPL39L__Homo_sapiens__NP_443201
augagcucccacaagaccuucacaaucaaaagauuucuggccaagaaacagaagcaaaaccggcccauuccucaguggauccagaugaaaccgggcucuaagauucgcuacaauagcaagagacggcauuggcgcagaacgaaacucgggcuguga

SEQ ID NO: 75054 - RNA, 1212 nt, Artificial Sequence
  derived and/or modified sequence opt5 from RPL3__Homo_sapiens__NP_000958
augagccacagaaaguucuccgcuccccggcauggcucucugggguuucucccucgcaaaagaagcucccggcaccgcggaaaggugaaaucuuucccgaaggacgaucccagcaaaccuguccaucugaccgccuuucuuggcuacaaggccgggaugacacacaucguuagagagguggaccggcccggauccaaggugaacaaaaaggaagucguggaggcgguuacgauuguggaaaccccucccauggucgugguuggcaucgugggguaugucgagacaccucgcggacugagaaccuucaaaacaguguuugcugaacauauuucugaugagugcaagcggcgcuucuacaaaaauuggcacaagagcaagaaaaaggccuuuaccaaauauuguaagaaauggcaggacgaggauggcaagaaacaacucgaaaaggacuucuccagcaugaagaaauacugccaggugaucagagucauugcccacacacagaugcggcugcuuccgcugcgccagaagaaagcucaucucauggagauccaaguuaacggcgggaccguggccgaaaagcuggauugggcuagagagcggcuggagcaacaggugcccgucaaucagguguuuggacaggacgaaaugaucgauguuauuggcgugacgaaagggaagggauauaagggcgucaccucucgcuggcacacaaagaagcucccuagaaaaacccaucgggggcugagaaagguggccuguaucggagcguggcaccccgcccgcguugcuuucuccguggcccgggcuggccagaaaggcuaccaccauagaacagagauuaacaagaagaucuauaaaauugggcagggauaccuuaucaaggacggcaaacugauuaagaauaacgccagcaccgauuacgaccucucugauaaauccaucaauccucuugggggauuuguccacuauggcgaagugacgaacgacuucgucaugcugaaggggugcgugguuggaacaaagaaacgcgugcugacccuccggaaaagccugcugguccagacaaaaagacgcgcgcucgagaagaucgaccugaaauuuauugauaccaccucuaaguucggccauggccgguuccaaacaauggaagagaaaaaggccuuuauggggccccuuaagaaagacagaaucgcuaaggaggaaggagccuga

SEQ ID NO: 75055 - RNA, 78 nt, Artificial Sequence
  derived and/or modified sequence opt5 from RPL41__Homo_sapiens__NP_066927
augagagccaaguggcggaaaaagcgcaugagacggcugaaacgcaagagacggaaaaugcgccagagaagcaaguga

SEQ ID NO: 75056 - RNA, 1284 nt, Artificial Sequence
  derived and/or modified sequence opt5 from RPL4__Homo_sapiens__NP_000959
auggccugcgcuagaccccugaucagcguguacuccgagaagggagaaucuagcgggaaaaacgucacccucccugccguuuucaaggcgccgauucggcccgacaucgugaauuuugugcacacaaaccugcgcaaaaauaacagacaaccuuaugcugucuccgagcuugccggacaucaaacgucugccgaaagcuggggcaccgggcgggcuguggcccgcauucccagaguucggggaggcgggacacaccgcuccggacagggcgcuuucggcaauauguguagagggggacggauguuugccccuaccaagacauggcgcagauggcaucggcgcgugaacaccacacagaaaagauacgcgaucugcucugcccuggcugccagcgcucuccccgcccuggucauguccaagggccaccggauugaggaagugccugagcuuccgcugguuguggaggauaaggucgaaggguauaaaaagaccaaagaggcggugcuccugcugaagaaacucaaggccuggaaugacaucaagaaaguguacgcuagccagcgcaugagagccggaaagggcaaaaugcggaacagacgccggauccaaagacgcgggcccuguauuaucuauaaugaagauaacggaauuaucaaggcuuuccggaauauuccuggcaucacgcugcuuaacgucucuaaacugaauauucucaagcuggcccccggcgggcauguuggaagauuuugcaucuggaccgaguccgccuuccgcaaacuugacgagcuguacggcacauggcggaaggcugcgagccucaagucuaacuauaaucugccuaugcacaaaaugaucaacaccgaucugucccgcauucucaagagccccgaaauccagagagcccugcgggcuccgcgcaaaaagauucacagacgggugcuuaaaaagaacccucugaagaaucucagaaucaugcugaaacuuaaccccuacgccaagacaaugcggcgcaauaccauucugagacaggcccggaaccauaaacucagaguggacaaggcugccgcggcugccgccgcucugcaggccaaaucugaugagaaggcugccgucgcggggaagaaaccugugguuggaaagaaaggcaagaaagccgcugugggggucaagaagcagaaaaagccccuggugggcaaaaaggccgcugccacgaaaaagcccgcgccugagaaaaagccggccgaaaagaaacccacaaccgaagagaagaaaccugcugccuga

SEQ ID NO: 75057 - RNA, 867 nt, Artificial Sequence
  derived and/or modified sequence opt5 from RPL6__Homo_sapiens__NP_001307069
auggccggcgagaagguggaaaaacccgacaccaaggagaaaaagccugaagcuaaaaaggucgaugccgggggaaagguuaaaaagggcaaccugaaagcgaagaaaccgaagaaggggaaaccccacugcagcagaaauccugugcucgugcggggaaucggccgcuacuccagaucugcuauguauagccggaaggccauguacaaacgcaaguauuccgccgcuaaaucuaaggucgagaaaaagaagaaagaaaaggugcuggccacaguuacgaaacccgucgggggagacaagaacggcggcaccagaguggugaaacuucggaagaugccucgcuacuaucccacagaggauguuccuagaaagcugcucagccaugggaaaaagccguucucccagcacgugcggaaacugcgcgcuucuauuacccccggaacaauccuuauuauccugaccggcagacaucgggggaagcgcgucguguuucucaaacaacuggccagcggacugcuccuggugacaggcccucuuguccugaauagaguuccccuccggcgcacccaccagaaguucgugauugcgacguccaccaagaucgacaucagcaacgugaaaauuccuaagcaucugacagaugccuacuuuaaaaagaaaaagcugagaaagccccggcaccaggagggggaaaucuucgacaccgagaaagaaaaguaugagauuacagagcagagaaaaaucgaucaaaaggcugucgacucucagauucuuccgaaaaucaaggccauuccucagcuccagggauaccugcgcuccguguuugcucugaccaauggcaucuacccccacaaacucguuuucuga

SEQ ID NO: 75058 - RNA, 801 nt, Artificial Sequence
  derived and/or modified sequence opt5 from RPL7A__Homo_sapiens__NP_000963
augcccaagggcaaaaaggccaaagggaagaaaguggcuccugccccggcggucguuaagaagcaggaggcuaaaaagguggugaacccccuguucgagaaaagaccuaagaauuuuggaaucggccaagacauucagcccaaacgggaucucacccgcuucgucaaguggccuagauacauccggcugcagcgccagagagccauucuuuauaagcggcugaaagugcccccugccaucaaccaauuuacacaggcucucgaccgccagacggccacccagcugcuuaagcuggcucacaaauacagaccggaaacaaagcaagaaaagaaacagcggcuccuggcccgcgcggagaaaaaggccgcugggaagggagauguucccaccaaaagaccucccgugcugcgggccggcgucaauacagugaccacacucguugaaaacaagaaagcucagcugguggucauugcccaugacguggauccuaucgagcuuguggucuuccugcccgcgcucugccgcaagauggggguuccguauuguaucauuaaaggaaaggccagacugggccggcuugugcaccgcaagaccugcacgaccguggcuuuuacacaggucaauagcgaggacaaaggcgcccuggcuaagcucguggaagccaucagaaccaacuacaaugaucgguaugacgagauuagacgccauuggggagggaacguucugggcccuaaauccguggcccggaucgcuaagcuggaaaaagcgaaggccaaggagcucgcuacaaaacugggguga

SEQ ID NO: 75059 - RNA, 747 nt, Artificial Sequence
  derived and/or modified sequence opt5 from RPL7__Homo_sapiens__NP_000962
auggagggcguggaagagaagaaaaaggaaguccccgccguuccugagacccugaaaaagaaaagacggaacuucgcugaacucaagaucaagcgccugcggaaaaaguuugcccagaaaaugcuucggaaggcgcgcagaaaacugauuuacgagaaggcuaagcacuaucauaaagaguaccggcaaauguaucgcacagaaaucagaauggcccggauggcccgcaaggcugggaauuucuacgugccggccgagcccaaacucgcuuuugugauuagaauccggggaauuaacggcgucagcccuaaggugcgcaaaguucugcagcuucugagacuccggcagaucuucaaugggacguuugugaagcugaacaaagccuccaucaauaugcugcgcauugucgaacccuauaucgcguggggauacccuaaccucaagucugugaaugagcugauuuauaagagaggcuacgggaaaaucaacaagaaacggauugcccuuaccgacaaugcucugaucgccagaagccucggaaaguacggcauuaucugcauggaggaucugauccacgaaauuuauacaguuggcaaacgcuucaaggaggcuaacaauuuucuuuggcccuucaagcuguccucuccuagagggggaaugaaaaagaaaaccacacauuuuguggaaggcggggacgccggaaacagagaggaucagaucaaucgccucauucggagaaugaacuga

SEQ ID NO: 75060 - RNA, 954 nt, Artificial Sequence
  derived and/or modified sequence opt5 from RPLP0__Homo_sapiens__NP_000993
augcccagagaggaccgggccaccuggaaaagcaacuacuuccugaagaucauucagcuccuggaugacuauccuaagugcuuuaucgugggcgcugauaaugucggguccaaacaaaugcagcagauucgcaugucucuuagaggaaaggccguugugcugaugggcaaaaacacaaugaugcggaaggcgauccgcgggcaccucgaaaauaacccggcucuggagaaacuucugccccauauuagaggaaaugugggcuucgucuuuacgaaggaagaccucaccgagauccgggauaugcugcuggccaacaaggugccugccgcugcccgcgcuggggccaucgcgcccugugaaguuacagugccugcccagaauaccggacucggccccgagaaaaccagcuucuuucaagcucugggcauuacaacaaagaucuccagagggaccauugagauccuuucugacguccagcugauuaaaacgggagauaaggugggcgccagcgaagcuacccuccugaacaugcuuaauaucuccccuuucucuuuugggcugguuauucaacagguguucgacaacggaagcaucuacaauccggagguccucgauaucacagaagagacccugcacucccgguuucuggagggcgugcgcaacguggccagcgucugccuccagauuggguaucccacaguugcgucugugccucauuccaucauuaauggauacaagagagugcuggcccuuagcgucgaaaccgacuauacguucccccuggcugagaaagugaaggccuuucucgcugauccuucugccuucguugccgcugcgcccguggccgcugccacaaccgccgcuccggccgcggcugccgccccugcuaaagucgaagccaaggaggaauccgaggagagcgacgaagauaugggcuuuggccuguucgacuga

SEQ ID NO: 75061 - RNA, 345 nt, Artificial Sequence
  derived and/or modified sequence opt5 from RPLP1__Homo_sapiens__NP_000994
auggccagcguguccgagcuggcuugcaucuacucugcccucauucugcacgacgaugaagucaccguuacagaggacaagaucaacgcgcuuauuaaagcugccggcgugaauguggaacccuucuggccugggcuguuugccaaggcucucgccaacgucaauaucggaagccugauuuguaacgugggcgcugggggaccggcccccgcggccggcgcugccccugcugggggacccgccccuuccacggcggccgcucccgccgaggagaaaaagguugaagcuaaaaaggaggaaucugaggaaagcgaugacgauaugggcuucggccuuuuugacuga

SEQ ID NO: 75062 - RNA, 1824 nt, Artificial Sequence
  derived and/or modified sequence opt5 from RPN1__Homo_sapiens__NP_002941
auggaggcccccgcugccggccuguuccuccugcuucugcucgggaccugggcgccugcuccgggaagcgccuccucugaagcucccccucugaucaacgaggacgugaagagaacagucgaucuuagcucccaccuggccaaaguuacggccgaaguggugcucgcucaucugggcgggggaucuaccagccgggccacauccuuucugcucgcgcuggagcccgaacuugaggcccgccuggcucaccucggcguccaggugaagggggaggacgaagaggaaaauaaccuggagguuagagagaccaaaauuaagggaaaaucuggccgguucuuuacagugaagcugccugucgcccuggaucccggcgcuaagaucagcgugauuguugaaaccguguacacacauguccuccacccuuauccgacccaaaucacgcaguccgagaaacaguucgugguguuugaagggaaucauuacuucuauagccccuacccuaccaagacacagaccaugcgcgucaaacuggccucuagaaacguugaguccuauacaaagcugggaaaucccacccggagcgaagaccuccuggauuacggcccuuuucgcgacgugcccgcguauucucaagauacguucaaagugcacuacgagaacaauuccccguuucuuacaauuaccagcaugacaagagucaucgaggugucucacugggggaacaucgccguugaagagaauguggaccugaagcauaccggagcuguccucaagggcccuuucucccgguacgauuaucagcgccagcccgacagcgggauuuccucuauccggagcuuuaaaaccauucugccugccgcugcccaggauguguacuauagagacgaaaucggaaacguuuccacaagccaccuucugauucucgaugacucuguggagauggaaauccgccccagauucccccuguuuggcggcuggaagacgcauuacauugucggguauaaucugccuuccuacgaguaucucuacaaccugggagaccaauacgcccuuaaaaugcgguucguggaucacgucuucgacgaacaggugaucgauagccugaccguuaagaucauucucccggagggcgcuaaaaauaucgagauugacucucccuaugaaaucagccgcgcgccugaugagcugcacuacacauaucuugacaccuuugggagacccgugauugucgccuacaagaaaaaccugguggaacagcauauccaggauaucguugugcacuauacauucaauaagguccucaugcugcaagagccucugcucgugguggcugccuuuuacauucuguucuuuaccguuaucauuuauguccggcuugacuucuccaucacgaaggaucccgccgcugaggccagaaugaaaguggcgugcauuacagaacaggugcugacccucgucaacaagcgcaucggacuguaccggcauuuugacgagaccgugaacagauacaaacagucucgcgauaucagcacacuuaauuccggcaagaaaagccuugaaaccgagcacaaggcucucacaucugagauugcccugcugcaaucccggcucaagacggaagggagcgaccugugugacagaguuucugagaugcagaaacuugaugcccaggugaaggaacugguccucaaauccgcuguggaggccgaacgccugguugcuggaaagcugaaaaaggacaccuauaucgagaacgagaaacuuauuagcggcaagcggcaggaacucgugacaaagaucgaucauauucuggacgcccuguga

SEQ ID NO: 75063 - RNA, 1848 nt, Artificial Sequence
  derived and/or modified sequence opt5 from RPN2__Homo_sapiens__NP_001129243
auggcucccccuggcagcuccaccguguuccugcucgcccugacaaucauugccucuacgugggcgcuuaccccgacacacuaccugaccaagcaugacgucgagagacucaaagcuagccuggaucggcccuuuacaaaccuugaauccgccuucuauucuaucguugggcugagcucccucggagcccaggugccugacgcuaagauuucuaucagcaaugagaccaaagaucugcugcucgccgcuguguccgaagacagcucugucacacaaauuuaccacgccguggcggcccuguccggcuuugggcuuccccuggcuagccaggaggcccucucugcucugaccgcccgccuuuccaaggaagagacgguucuggcgaccgugcaggcccuccagacagcuagccaucugucucaacaggccgaucugagauccaucgucgaggaaaucgaggaccucguggcucggcuggaugaacuuggaggcguuuaucugcaguucgaggaggggcucgaaaccacagcccuguuuguggccgcuaccuacaaacuuauggaccacgucggaacggagccuagcauuaaggaagaucaggugauccaacugaugaacgcgauuuucuccaagaaaaauuuugagucucucagcgaagccuucuccguggcuagcgccgccgcuguccugucucauaaccgcuaucacguucccgugguggucgugccugagggcuccgccagcgacacacacgagcaggcgauccugagacuccagguuaccaaugugcugucucagccgcuuacacaagcuaccgucaagcuggaacaugccaaaagcguggccucccgggcuaccguucuccagaagacaucuuuuacgcccgugggcgaugucuucgagcugaacuuuaugaaugugaaauucagcuccggguacuaugacuuucuugucgaaguggagggagauaaccgcuacauugccaauaccguugaacugagagugaagaucagcacagaggucggcauuaccaacguggaccucucuacaguugacaaggaucaguccaucgcuccuaaaaccacgcgggugacauaccccgccaaggcgaaagggaccuucaucgccgacagccaccaaaauuucgcucuguuuuuccagcuggucgaugugaacaccggagccgagcucacaccucaucagaccuuugugcgccugcacaaucagaagacaggccaagaaguugucuucguggcugagcccgacaacaaaaauguguauaaguuugaacuugauacgucugagagaaaaauugaguucgacuccgccagcgggaccuacacacuguaucucaucauuggagaugcgacccugaagaacccgauccuguggaacgucgccgacgugguuauuaaguuuccugaagaggaagcucccuccacagugcuuucucagaaucucuucaccccuaaacaggagauccagcaccuguuucgggaacccgagaagagacccccuacggucgugagcaacaccuucacagcccugauccucuccccgcugcuucugcucuuugcucuguggauucgcaucggcgccaauguuucuaacuucaccuuugcccccagcacaauuaucuuccaucugggccacgcugcgaugcuugggcucauguacguguauuggacccaacugaauauguuccagacgcugaaauaccucgccauucugggauccgucacauuucuugcuggcaaccggaugcuggcccagcaggccgugaagcgcaucgcugccgagcaaagcucuagacucgcgaaauaucggacccugagaacagcucauuga

SEQ ID NO: 75064 - RNA, 375 nt, Artificial Sequence
  derived and/or modified sequence opt5 from RPP14__Homo_sapiens__NP_001092253
augcccgccccugcugccaccuacgagagaguggucuauaagaacccgagcgaauaccacuauaugaaaguuugccuggaguuccaggacuguggcguggggcucaaugcggcucaauuuaagcagcugcuuaucuccgccgugaaagaucuguucggagaagucgacgccgcucucccccuggauauucuuacauacgaggaaaagacgcugucugccauccuccggauuugcagcuccggccuggugaaacuguggucuagccucacccugcuuggguccuauaagggaaagaaaugugcuuuucgcguuauccaggugucuccuuuccugcucgcccugagcggcaacuccagagagcuuguccuggacuga

SEQ ID NO: 75065 - RNA, 489 nt, Artificial Sequence
  derived and/or modified sequence opt5 from RPP21__Homo_sapiens__NP_001186049
auggccggccccgugaaggacagagaggcuuuccagcggcugaacuuucucuaccaagccgcgcacugcguccuggcucaggauccugaaaaucaggcccuugcccgcuucuauuguuacaccgagagaacaaucgcuaaacggcugguucuccgcagaccgcugagcuccucugcuccccgggacccuagcgugaagcgcacgcuuugcagaggguguuccucucugcucgugcccggacugaccugcacacagcggcaacgcagaugucggggccagcgcuggaccguccagacaugccugaccugucagagaagccaacgguuucucaacgauccugggcaucugcuuuggggagaccgccccgaagcccagcugggcucccaggccgauucuaaaccucuccagccgcugcccaauacagcgcacagcauuuccgacagacuuccugaggaaaagaugcaaacccaggggagcucuaaccaguga

SEQ ID NO: 75066 - RNA, 600 nt, Artificial Sequence
  derived and/or modified sequence opt5 from RPP25__Homo_sapiens__NP_060263
auggagaacuucagaaaggugcggagcgaagaggcccccgcuggcugcggggccgaaggaggcgggccuggauccggcccguuugcggaccuggcucccggggccguccacaugcgcguuaaagagggaucuaagaucagaaaucucauggccuucgcuaccgccagcauggcucagccugccacacgggcgauuguguuuuccggcuguggccgcgccacgaccaaaacagugaccugcgcugaaauccugaagagacggcuugccgggcugcaucaagucacacgccucagauaccggucugugcgcgagguuuggcagagccugcccccuggacccacccagggccagacaccuggggagccggcugccucccuuucugugcugaaaaacguccccggacucgcgauucugcugagcaaggaugcccucgacccuagacaacccggcuaucagccucccaauccgcacccugggcccuccagcccucccgcugcccccgcuucuaagcggucccugggagaaccugccgccggcgagggcagcgcuaaacgcucucagccggaacccgggguggcggaugaggaccagaccgccuga

SEQ ID NO: 75067 - RNA, 852 nt, Artificial Sequence
  derived and/or modified sequence opt5 from RPP38__Homo_sapiens__NP_001252530
auggccgcugcgccccaggccccuggcagagggagccugcggaagacccgcccgcucguggucaaaacaucccugaacaaucccuacaucauuagauggucugcucuugagagcgaagacaugcacuucauccugcaaacgcucgaggaucggcugaaggccauuggacuucagaaaaucgaagacaagaaaaagaagaacaaaaccccuuuucugaagaaagagucccgcgaaaagugcucuauugccguugauaucagcgagaaucucaaagagaagaagacagacgcuaaacaacagguguccggcuggacccccgcccaugugagaaagcagcuggcuaucggggucaacgaagugacacgggcccuggagcgcagagaacuccugcuuguucugguguguaaaucugucaagccugcgaugauuaccagccaccucauccagcugucccuuagccggucugugcccgccugccagguuccucgccuguccgagagaauugcuccggugaucggacucaaauguguccuggcccuggcuuucaagaaaaauacaaccgauuuuguggacgaggugcgggccauuaucccccgcgucccuagccucucuguucccuggcugcaggauagaauugaagacuccggcgagaaccuugaaacggagccucuggaaagccaagaucgggagcuccuggacaccucuuucgaggaucuuuccaagcccaagcgcaaacuggcggacgggagacaggccagcgugacacuccagccgcugaagaucaaaaagcugaucccuaaucccaacaaaauucggaagccucccaaguccaaaaaggcuacccccaaauga

SEQ ID NO: 75068 - RNA, 1092 nt, Artificial Sequence
  derived and/or modified sequence opt5 from RPP40__Homo_sapiens__NP_006629
auggccacccugagacggcuccgcgaggcucccagacaucugcuugugugcgaaaagagcaacuucggcaaucacaaaucccggcaccgccaucugguccagacacacuacuauaacuacagaguuucuuuucucaucccugagugugggauucugagcgaggaacuuaagaaucuggugaugaacacgggaccguauuacuucgugaaaaaucucccccugcaugaacugaucaccccugaguuuauuuccacauucaucaagaaaggcucuugcuaugcccucaccuacaacacacacauugacgaggauaauaccgucgcgcugcuucccaacgggaagcugauccucagccuggacaaggauacauaugaagagaccggacuucaaggccacccuucccaguuuucugggcggaaaaucaugaaguucauugugagcaucgaccugauggaacucucccugaaucuggauagcaaaaaguacgagcgcauuucuugguccuuuaaagagaagaagccccucaaauucgacuuucugcuugcuuggcauaagacgggaagcgaagagucuaccaugauguccuacuucagcaaauaucagauccaggaacaccaaccuaagguugcccugucuacacucagagaucugcaguguccggugcuucaguccagcgagcuggaaggcacccccgaggucuccugccgggcccucgagcuguuugacuggcugggcgcuguguucucuaacguugaucucaauaacgaaccuaauaacuuuauuagcacauacuguugccccgagccuuccaccguggucgccaaggcuuaucuguguacgaucacaggguucauucuucccgaaaagaucugccugcuccuggagcaucuuugucacuacuucgacgaaccgaaacuggccccuugggugacccucagcgugcagggauuugcggauucucccgucuccugggagaagaaugagcacggcuuccgcaaagggggagaacaucuguauaacuuuguuaucuucaacaaucaagacuacuggcugcagauggccgugggcgcuaacgaucacugcccucccuga

SEQ ID NO: 75069 - RNA, 831 nt, Artificial Sequence
  derived and/or modified sequence opt5 from RPRD1A__Homo_sapiens__NP_001290340
augagaaacagcaauuggcgguucugccagaccggcaucuacuccaagcccaaccgcaaacugacauuucucuaucuggccaaugacgugauucaaaacucuaagagaaaagggccugaguucacgaaggauuuugcuccggucaucguugaagccuucaaacacgugagcuccgagaccgacgaaucuuguaagaagcaucuuggacgggugcugagcauuugggaggaacgcuccgucuacgagaaugaugugcucgagcagcugaaacaggcgcuuuauggcgacaagaaacccagaaagcggacauacgaacagaucaaaguugaugagaacgaaaauugcucuagccugggguccccuagcgagcccccucaaacccucgaccuggugcgcgcucugcaggaucucgagaacgccgccucuggagacgcugccguccaccagagaauugcuucccugcccguggaaguucaggaggugagccuucuggauaagaucacagacaaggaaucuggcgagcggcucuccaaaauggucgaagaugccuguaugcugcuugcggacuauaaugggcgccuggccgcugagaucgaugacagaaagcaacucacccggaugcuggccgacuuucugcgcugccagaaagaggcucucgccgaaaaggagcauaaacuggaagaguacaagagaaaacuugcgcgggugagccuggugcgcaaggaacucagaucucggauucagucccugccugaucuuagcagacugccgaacgucacaggaucccacaugcaucuccccuucgccggcgacaucuauucugaggauuga

SEQ ID NO: 75070 - RNA, 981 nt, Artificial Sequence
  derived and/or modified sequence opt5 from RPRD1B__Homo_sapiens__NP_067038
augagcuccuucucugagagcgcccuggaaaagaaacucuccgagcugucuaacagccagcaauccgugcagacccuuucucuguggcucauccaccauagaaagcacgcuggccccauugucagcguuuggcaucgggaacugcgcaaagccaaguccaauagaaaacuuacauuucuguaccucgcgaacgacgugauccagaauagcaagcggaaggggccugaguucacgcgcgaauuugagucugugcuggucgaugcuuucucccacguggccagagaggccgacgaaggaugcaaaaagccgcuggagcggcuccugaacauuuggcaggaacgcagcguuuauggcggggaguuuauccaacagcuuaaacugucuauggaggauuccaagucucccccucccaaagcuaccgaagagaaaaagagccucaagagaacauuccagcagauucaagaagaggaagacgaugacuacccuggauccuauagcccccaggauccuuccgccggcccgcugcuuaccgaggagcugaucaaggcucuccaggaccuggaaaaugccgcgucuggggaugccacagugcggcagaaaaucgcuagccugccccaagagguccaggacgugucccuccuggaaaagauuaccgauaaagaggccgcugaacgccuuagcaagacaguugacgaggccugucugcuccuggcggaguacaacggaagacuugccgcugaacuggaggaucggcgccagcucgccagaaugcugguggaauauacccaaaaucagaaagacguccugucugagaaggaaaagaaacucgaggaguacaagcagaaacuggcucgggugacccaggugcgcaaggaacuuaaaucccauauccaaagccugccugaccucucucugcuucccaacgucacgggcggccuggccccucuccccagcgccggggaucuguuuuccacagacuga

SEQ ID NO: 75071 - RNA, 2805 nt, Artificial Sequence
  derived and/or modified sequence opt5 from RPRD2__Homo_sapiens__NP_001284602
auggccgcuggcgggggaggcgggagcuccaaggccucuagcuccucugcgagcuccgcuggagcccuggagucuagccucgacagaaaauuccaguccgugaccaacacaauggaaagcauccaaggccugucuuccuggugcauugagaauaagaaacaccauagcacgaucgucuaccacuggaugaaguggcuucggcgcucugccuauccccauagacugaaccucuuuuaccuggcuaaugauguuauucagaacuguaaacggaagaaugccaucauuuuccgcgaauccuuugcugacgugcuuccugaggccgcggcccuggugaaggauccgagcgucucuaaauccguggaaagaaucuucaagaucugggaggaccggaacguuuaucccgaggaaaugauuguggcucuccgcgaggcccugaccagcacaaauccuaaagcugcccugaaguccaaaaucgucgcggaauuuagaucucaggcccucauugaggagcugcuucuguacaagcggagcgaagaucagaucgagcucaaggaaaaacaacuguccaccaugcgcguggacguuugcagcacagagacccuuaagugucugaaagauaagacagggggaaagaaguucucuaaagaauuugaggaggcuuccagcaagcucgaagaguucgugaacggccuggacaagcaggucaaaaauggccccucucugaccgaagcccucgagaacgcugggaucuuuuaugaagcccaguacaaggaggugaaaguggucgccaaugcuuauaagacguucgcgaacagaguuaauaaccugaaaaagaaacuugaucagcugaaaagcacccucccugaccccgaggaauccccugugccgucucccagcauggaugccccuucccccacaggaagcgagucuccuuuucaaggcaugggaggggaagagucccagagccccaccauggaaucugagaaguccgcuacaccggagccugugaccgacaaucgggaugucgaagacauggagcugagcgacguggaagaugacggcuccaaaauuauuguugaggaucgcaaggagaaacccgccgaaaagucugccgugagcacguccgucccuacaaagcccaccgagaacaucucuaaagcuagcuccugcacacccgugccuguuaccaugaccgccacaccgccccuuccuaagcccgugaacacgagccugucuccuucccccgcgcucgcucugccgaaucuggccaacgucgaccucgccaaaaucagcucuauucuguccagccuuaccucugugaugaagaauacaggggucagcccugcuuccagacccagcccuggaacccccacaucuccuuccaaccugaccagcggccucaaaacgcccgccccggcuacaaccaccucccacaauccucuggccaacauccuuucuaagguggaaauuacacccgagagcauccuguccgcgcucucuaagacccagacacagagcgcccccgcucugcaaggccuguccucucuccugcagagcguuacggggaauccugugccggccuccgaagcugccagccagucuaccuccgcgagccccgccaacacaaccgucucuacaauuaaaggacggaaucuuccuuccagcgcucaacccuucaucccuaagucuuuuaacuacucccccaauagcuccaccagcgaggugucuagcacguccgccucuaaagcuagcaucggccaguccccugggcugcccucuaccacauucaagcucccgagcaacucccugggauucaccgccacacauaauaccucuccugccgcucccccuacggagguuacaauuugucagagcuccgaagugagcaaacccaagcuggagucugaauccaccagcccgucucuugagaugaaaauccacaacuuucucaagggcaauccuggguucuccggacugaaccugaacauucccauccucagcucccugggcucuagcgcgccuuccgaaagccaccccucugauuuucagcgcggccccacauccaccagcauugacaauaucgaugggaccccugucagagacgagcggucuggaacaccgacgcaagaugagaugauggacaagcccaccagcuccucuguggauacaaugagccuucuguccaaaaucauuucuccuggcagcuccacccccagcucuacaagauccccucccccugggcgcgacgaaagcuacccgcgggagcucuccaacucugugagcaccuauagacccuucggacugggcuccgaaucuccuuacaagcagcccagcgacgggauggagcgcccuuccagccugauggauucuucccaggaaaaauuuuaucccgacacgagcuuccaggaggaugaggacuaccgggauuuugaauauucuggcccgccucccuccgccaugaugaaucuugagaagaaacccgcuaagagcauccucaagucuagcaaacuguccgacacaaccgaauaccaaccuauucugucuagcuauucccauagagcccaggaguucggaguuaagagcgccuuucccccuuccguccgcgcucuccuggauucuagcgagaacugcgaccggcuuuccucuagcccgggccuguucggggccuuuuccgugagaggaaaugaacccggcucugaucgcagcccuucccccaaacacccuugucggagccaugggucucccacccacgugagacgcggagaguccccgggccuccaccauuuccaccaugucgacgauuga

SEQ ID NO: 75072 - RNA, 330 nt, Artificial Sequence
  derived and/or modified sequence opt5 from RPRM__Homo_sapiens__NP_062819
augaaccccgcccugggcaaucagaccgacguggcuggacucuuccuggccaacagcuccgaggcgcuugaaagagcuguccggugcuguacacaagccucuguugugacggaugacggguuugccgagggcgggccugaugaacgcagccuguacaucaugagagugguccagauugcugugaugugcguucucucccugaccguggucuucggaaucuuuuuccuuggcuguaaucugcucauuaagucugaggggaugaucaacuuucuggugaaagaccggcgcccgagcaaggaaguugaggccguggucgugggacccuauuga

SEQ ID NO: 75073 - RNA, 498 nt, Artificial Sequence
  derived and/or modified sequence opt5 from RPS10__Homo_sapiens__NP_001191020
augcugaugcccaagaaaaacagaaucgccauuuacgagcuccuguucaaggaaggcgugauggucgcuaaaaaggacguucacaugccuaaacauccggagcuugccgauaagaaugugcccaaccugcacgugaugaaggcgaugcagagccucaaaucccggggguaugucaaggaacaauuugcuuggcgccauuucuacugguaucugaccaaugagggaauccaguaccuuagagacuaucugcaccucccucccgaaauugugccugccacacugcggcgcucuagacccgagacgggccggccucgcccgaaagggcuggagggagaaagacccgcccggcucacccgcggcgaggcugauagagacacauaccggcgcagcgccguuccucccggggcugauaagaaagccgaagcgggagccggcuccgcuaccgaguuucaguucagaggcggguuuggacggggccgcgggcagccuccccaauga

SEQ ID NO: 75074 - RNA, 456 nt, Artificial Sequence
  derived and/or modified sequence opt5 from RPS14__Homo_sapiens__NP_001020242
auggcccccagaaagggcaaggagaagaaagaagaacaggugaucagccuggggccucaagucgcugagggagagaacguuuucggcgugugccacauuuuugccuccuucaaugacaccuuugugcaugucacagaucucucugggaaggaaacgaucugucgggugaccggaggcaugaaaguuaaggcggaccgcgaugagagcuccccguacgcugccaugcuggccgcucaggacguggcccagagaugcaaggagcuugggauuacagcucugcacaucaaacuccgggccaccggaggcaaccgcacaaagacccccggcccuggggcgcagucugcccugagagcucuugcccggagcggaaugaaaauuggccgcaucgaagaugucacacccaucccuuccgacucuaccagacggaaagggggacgcagaggccggcgccuguga

SEQ ID NO: 75075 - RNA, 393 nt, Artificial Sequence
  derived and/or modified sequence opt5 from RPS15A__Homo_sapiens__NP_001025180
auggugagaaugaacguccuggccgacgcucucaagagcaucaauaacgccgagaaacggggcaagcgccagguucugauuagacccugcuccaaagugaucgugcgguuccuuaccgucaugaugaagcacggguacauuggagaauuugagaucauugaugaccaucgcgcgggcaaaaucgugguuaaucugacagggagacucaacaaguguggagugaucucuccucgguucgauguccaacugaaggaccuugaaaaauggcagaauaaccugcucccgagccgccaguuuggcuucauugugcugacgaccuccgcugggaucauggaucacgaggaagccagacggaagcauacaggaggcaaaauucugggcuuuuucuuuuga

SEQ ID NO: 75076 - RNA, 459 nt, Artificial Sequence
  derived and/or modified sequence opt5 from RPS16__Homo_sapiens__XP_005259194
augcccagcaagggcccucugcaguccgugcaagucuucgggagaaagaagaccgccacagcuguugcccacugcaaacggggaaacggccucaucaaggugaaugggcgcccgcuggagaugauugaacccagaacgcuucaguacaaacugcucgagccugugcugcuucugggaaaggaacgguuugcgggcgucgacauccgcgugagaguuaaagggggaggccauguggcucagauuuauggcgagucucaggaacucggggccuggcggcgcuggcugugggagggaggccugcacagcgcccccgucccuuucaacuguguguccuuuucucaacucagcguuucccccucuccuaaaccgugguggcccaucaccagaaauauguggaugcggcugccucgcagacggagcaagacauccucuagcuccaugaccgggcccugcugguga

SEQ ID NO: 75077 - RNA, 459 nt, Artificial Sequence
  derived and/or modified sequence opt5 from RPS18__Homo_sapiens__NP_072045
augagccuggugauccccgagaaguuccagcacauucucagaguccugaacaccaauaucgacggccggcgcaaaauugccuuugcuaucacagccauuaaggggguuggaagacgguacgcgcauguggugcuucgcaaagcugauaucgaccugacgaagagagccggcgaacucaccgaggaugaagucgagcgggugaucacaauuaugcaaaacccucgccaguauaaaaucccggacugguuccugaauagacagaaggauguuaaggacgggaaauacucccaggugcuugccaacggacuggauaauaagcuccgggaagaccuggagcgccugaaaaagauuagagcucaccggggccuccgccauuuuugggggcugagaguccggggacaacacaccaaaacaaccggccgcagaggccggacaguggggguuucuaagaagaaauga

SEQ ID NO: 75078 - RNA, 411 nt, Artificial Sequence
  derived and/or modified sequence opt5 from RPS19BP1__Homo_sapiens__NP_919307
augagcgccgcucugcucagacggggccuggagcuucuggccgcguccgaagcuccccgcgacccuccggggcaggccaagcccagaggagccccugugaaacggccccgcaagaccaaagcuauccaagcccagaagcucagaaacucugcuaaaggcaaggucccuaagagcgcccuggaugaguaccggaaacgcgaaugcagagaccaccuucggguuaaucugaaguuccucacacgcacgagauccaccguggcggagucugugagccagcagauucugcggcaaaaccgcgggagaaaagccugugaucggcccgucgcuaagaccaaaaagaagaaagccgaaggaacaguguuuacagaggaggacuuccagaaguuucagcaggaauauuucggcuccuga

SEQ ID NO: 75079 - RNA, 429 nt, Artificial Sequence
  derived and/or modified sequence opt5 from RPS20__Homo_sapiens__NP_001139699
auggccuucaaggacaccggcaaaacacccguggagccugaagucgcuauccaccggauuagaaucacgcugaccagccgcaacguuaagucccucgagaaagugugcgccgaucugauuagaggggcgaaggagaaaaaucuuaaggugaagggaccgguccggaugcccacaaaaacccugcgcaucacaaccagaaagacaccuuguggcgaagggucuaaaaccugggaccgguuucagaugcgcauucauaagagacucaucgaucugcacagccccuccgaaaucgugaaacaaauuacgucuaucagcauugagccuggaguugagcuuaucgaauccaccgacgcugagcccauggauacagaaggccagcaguacacccugcggucuguguucgagagcccugggacaugcccguuuuga

SEQ ID NO: 75080 - RNA, 396 nt, Artificial Sequence
  derived and/or modified sequence opt5 from RPS24__Homo_sapiens__NP_001135754
augaacgacaccgugacaaucagaacgcggaaguucaugaccaaucgccugcuccagagaaaacaaauggucauugauguucugcaccccggcaaggccacagugccuaaaaccgagauccgggaaaaacuugcuaagauguacaagacaaccccggacgugauuuuugucuucggguuucgcacacauuucggaggcgggaagaccacgggauuuggcaugaucuaugauagccuggacuacgccaaaaagaacgagcccaaacacagacucgcgcggcaugggcuguaugaaaagaaaaagaccucccgcaagcagagaaaagagcggaagaaucgcaugaaaaaggugagaggaacagcuaaagccaacguuggcgccggcaagaaaaaguga

SEQ ID NO: 75081 - RNA, 471 nt, Artificial Sequence
  derived and/or modified sequence opt5 from RPS27A__Homo_sapiens__NP_001170884
augcagaucuucgugaagacccugacaggcaaaacgauuacccucgaggucgaacccagcgacacaaucgagaacguuaaggccaaaauucaagauaaggaagggaucccuccggaccagcagagacugauuuuugcuggaaaacagcuugaggauggccggacccuguccgacuacaauauccaaaaggaaucuacacuccaccuggugcuucgccugagagggggagccaagaaacggaagaaaaagagcuauaccacacccaaaaagaacaagcauaaacgcaagaaagugaagcucgcgguccugaaauacuauaagguggaugagaauggcaaaaucuccagacugcggcgcgagugcccuucugacgaauguggggcuggaguuuucauggccagccacuuugauagacauuacugcggcaaguguugccucaccuauuguuucaacaagcccgaggacaaauga

SEQ ID NO: 75082 - RNA, 255 nt, Artificial Sequence
  derived and/or modified sequence opt5 from RPS27__Homo_sapiens__NP_001021
augccccuggccaaggaccuccugcacccuagcccggaggaagagaaaagaaagcauaaaaagaaacggcuugugcagucccccaacucuuacuucauggaugucaagugcccuggcuguuauaagaucaccacaguuuuuagccacgcucaaacgguggugcugugcgucggguguuccaccgugcucugccagcccacaggaggcaaagcccgccugaccgaaggguguucuuucagacggaagcagcauuga

SEQ ID NO: 75083 - RNA, 255 nt, Artificial Sequence
  derived and/or modified sequence opt5 from RPS27L__Homo_sapiens__NP_057004
augccccuggccagagaccuccugcacccuagccuugaggaagagaagaaaaagcauaaaaagaaacggcuggugcaguccccgaacucuuacuucauggaugucaagugccccggcuguuauaagaucaccacaguuuuuagccacgcucaaacgguggugcucugcgucggguguuccaccgugcugugccagccuacaggaggcaaagcccgccuuaccgaaggguguucuuucagacggaagcagcauuga

SEQ ID NO: 75084 - RNA, 171 nt, Artificial Sequence
  derived and/or modified sequence opt5 from RPS29__Homo_sapiens__NP_001023
augggccaccagcaacuguacuggagccaucccagaaaguucgggcagggaucccggucuugccgcguguguagcaacagacacggccucauccggaaauaugggcugaauaugugccgccaguguuuuagacaguacgccaaggacauuggauucaucaaacuugauuga

SEQ ID NO: 75085 - RNA, 882 nt, Artificial Sequence
  derived and/or modified sequence opt5 from RPS2__Homo_sapiens__NP_002943
auggccgacgaugcuggcgccgcugggggacccggcgggccuggaggcccggggaugggaaacagaggcggcuuccgcgggggauuuggcagcgggauccggggaagaggccgggggcgcggaagaggccggggccgcgggagaggagcgcggggcgggaaggccgaggacaaagaauggaugcccgugaccaagcugggacgccucgucaaagauaugaagauuaaaucccuggaggaaaucuaccuuuucucucugccuauuaaggagagcgaaaucauugacuuuuuccucggcgccucccugaaggaugagguucuuaaaaucaugcccgugcagaagcaaacaagagcugggcagcggacgcgcuuuaaagccuucguggcuaucggagacuauaauggccacgucggccugggggugaagugcucuaaagagguugccaccgcgauuagaggagccaucauucucgcuaagcugagcaucgugccuguccggcgcggcuacugggggaacaagauuggaaaaccccauacagugccuuguaagguuaccggcagaugcggguccgugcugguccggcucaucccggcccccagaggcacaggaauugugucugcuccugugcccaaaaagcugcuuaugauggccggcaucgaugacuguuauaccagcgcgcgcgggugcacagccacccugggaaauuuugcuaaagccacguucgaugcuaucuccaagaccuacagcuaucucacaccugaccuguggaaagaaaccgucuuuacaaagucucccuaccaggaguucaccgaucaccuuguuaagacgcauacacggguguccgugcagagaacccaagccccggccgucgcuacaaccuga

SEQ ID NO: 75086 - RNA, 795 nt, Artificial Sequence
  derived and/or modified sequence opt5 from RPS3A__Homo_sapiens__NP_000997
auggccgugggcaagaacaaaagacugaccaaagggggaaagaagggcgcuaaaaagaaggucguugaccccuucagcaaaaaggauugguacgacgugaaagccccugcgauguuuaauauccggaacauugggaagacacucgugacgcgcacccagggaacaaaaaucgcuuccgauggccugaaggggagagucuucgaggugucucuugccgaccugcaaaaugaugaaguugccuuucggaaguucaaacucauuaccgaggacgugcagggaaagaacugccugacaaauuuucacggcauggaucuuacccgcgacaaaauguguagcauggucaagaaauggcagacaaugaucgaagcucauguggauguuaagaccacggacggcuaucugcucagacuguucugcgugggguuuaccaaaaagcggaacaaucagauucgcaagacauccuacgcccaacaccagcaggucagacagauccggaaaaagaugauggagaucaugacccgcgaagugcaaacaaacgaucugaaagagguggucaauaagcucauuccggacucuaucggaaaagauauugagaaggcuugucagagcaucuauccccugcaugacguuuucgugagaaaggugaaaaugcuuaagaaaccuaaguuugaacugggcaaacucauggagcugcacggggaaggauccucuagcggcaaggccaccggggacgagacgggagcgaaggucgagcgggccgauggcuacgaacccccugugcaggaguccguuuga

SEQ ID NO: 75087 - RNA, 732 nt, Artificial Sequence
  derived and/or modified sequence opt5 from RPS3__Homo_sapiens__NP_000996
auggccgugcagaucagcaagaaaagaaaguucgucgcugacggcauuuuuaaagccgagcugaacgaguuccucacccgggaacuggcggaagauggguacuccggaguugaggugcgcgugacacccacgagaaccgaaaucauuauccuugcuacacggacccaaaauguccugggcgagaaggggcgccggauuagagagcucacagccgugguucagaaacgcuuuggauucccugaaggcucuguggagcuguaugccgaaaaggucgcuaccagagggcuuugcgccaucgcucaggccgagagccugcgguacaagcuccugggaggccuggcggugcgcagagccuguuauggcguucuccgguuuaucauggaguccggggcuaaaggaugcgaaguggucgugucuggcaagcugcgcgggcagagagccaaaagcaugaaguucguggacggacuuaugauucacuccggcgauccggucaacuacuauguugacacagcugugcggcaugugcugcuccgccaagggguccugggaaucaaagugaagauuaugcuucccugggauccuaccggcaagaucggccccaaaaagccucugcccgaccacguuucuauuguggagccuaaagaugaaauccucccgacgacccccauuagcgagcagaaagggggaaagccugaacccccugccaugccccagccggucccuacagcguga

SEQ ID NO: 75088 - RNA, 792 nt, Artificial Sequence
  derived and/or modified sequence opt5 from RPS4X__Homo_sapiens__NP_000998
auggccagaggccccaagaaacaccugaagcggguggcugccccuaaacauuggaugcucgacaagcugaccggggucuucgcgccgcgccccagcacaggaccucacaaacuuagagagugccugccccucaucauuuuucugcggaaccgccuuaaguacgcucugacgggcgaugaaguuaagaaaaucuguaugcagagauucauuaagaucgacgggaaagugcggaccgauauuacauauccugccggauuuauggacgugaucuccaucgauaagaccggcgagaauuuccgccucauuuacgacacaaaagggagauuugccguccaucggaucacccccgaagaggcuaaguauaagcugugcaaagugcgcaagauuuucguuggaacaaaaggcaucccucaccuggugacccaugaugccagaacgauucgguacccggacccccucaucaaggucaacgauaccauucaaaucgaccuggaaacaggcaaaaucaccgauuuuauuaaguucgacacagggaaucuuuguauggugaccggaggcgcuaaccuggggcgcaucggaguuauuacgaauagagagcggcacccuggcucuuuugaugugguccacgugaaagacgccaacgggaauagcuucgcgacacgccucuccaacaucuuugugauuggaaagggcaauaagcccuggaucucucugccuagaggcaaagggauccggcuuaccauugccgaggaaagagacaagcgccuggcugccaaacagagcuccggauga

SEQ ID NO: 75089 - RNA, 792 nt, Artificial Sequence
  derived and/or modified sequence opt5 from RPS4Y1__Homo_sapiens__NP_000999
auggccagaggccccaagaaacaccugaagcggguggcugccccuaaacauuggaugcucgacaagcugaccggggucuucgcgccgcgccccagcacaggaccucacaaacuuagagagugccugccccucaucguuuuucugcggaaccgccuuaaguacgcucugacgggcgaugaagugaagaaaauuuguaugcagagauucaucaagauugacgggaaagugcgggucgaugugaccuauccugccggauuuauggacguuaucuccauugagaagacaggcgaacauuuccgccucguguacgauaccaaagggagauuugccguccaccggaucacaguggaggaagcuaaguauaagcugugcaaaguucgcaagaucaccgugggagucaaaggcauuccccaucuggugacacacgacgccagaaccauccgguacccugauccggugauuaaggucaaugacacgguucaaaucgaucucggcaccgggaaaauuaucaacuucauuaaguuugacacaggaaaucuguguauggugaucggcggggcuaaccuuggacgcgugggcgucaucaccaauagagagcggcaccccgggucuuucgaugugguucaugugaaagacgccaacggaaauagcuuugcgacacgccuguccaacauuuucgucaucggcaauggcaacaagccuuggauuucucuccccagagggaagggaauccggcugaccguggccgaggaaagagauaaacgccuugcuacgaagcagagcuccggcuga

SEQ ID NO: 75090 - RNA, 2226 nt, Artificial Sequence
  derived and/or modified sequence opt5 from RPS6KA2__Homo_sapiens__NP_001006933
augcccaucgcccagcugcucgagcuguggaagaaaauugaaguggagccuauggaaaucgagaccacagaagaggaccuuaaccuggaugucgagccggcuacggaagacaccgccgaggaagaggagggcguugugaaggaaauugauaucagccaccaugugaaagagggguucgaaaaggcggaccccucccaauuugagcuccugaaaguccuuggacagggcucuuacgggaagguguuccugguuagaaaggugaaaggaagcgaugcuggccagcucuaugccaugaagguccugaaaaaggccacacugaaagugcgggaccgcguuagauccaagauggaacgggauauucucgcugaggugaaucacccuuuuaucgucaagcugcauuacgccuuccagaccgaggggaaacuuuaucugauccucgacuuucugcgcggaggcgaucuuuucacaagacugucuaaggaagugauguuuaccgaggaagacgugaaauucuaccucgcugagcuggcccuggcgcucgaucaucugcacagccuuggcauuaucuaucgggaccugaagcccgaaaacauucuccuggaugaggaggggcacaucaaaauuacagacuuuggacuuuccaaggaagccaucgaccacgauaaacgcgcuuacucuuucugcggcaccauugaguauauggccccugaagucguuaauagacgggggcauacgcaaagcgcugacuggugguccuuuggagugcugauguucgagaugcucaccggcagccugcccuuucaggggaaggaucgcaaggaaacaauggcccugauccucaaagcgaagcugggaaugccucaguuccuuucuggcgaggcccagucccugcucagagcucuguucaaacggaacccguguaaucgccuuggcgccgggaucgacggaguggaggaaauuaagagacaccccuuuuucgucaccaucgauuggaacacacuguaccggaaagagauuaagccucccuuuaagccugcugugggccgccccgaagacaccuuccauuuugauccggaguucacggccagaacaccuaccgacagccccgggguuccucccucugccaaugcucaccaccucuuucggggauucuccuuuguggcgagcucucugauccaagagcccucccagcaggaucugcauaaagucccugugcacccgauuguucagcaacuccauggcaacaauauccacuucacagacggguacgaaaucaaggaggauauuggagugggcagcuauuccgucugcaaaagaugugugcauaaggccaccgacaccgaauacgcugucaaaaucauugacaagucuaagcgcgaucccagcgaggaaaucgagauucugcuucgguauggccagcacccuaacaucaucacacugaaagacguguacgaugacgggaaguuuguuuaucucgugauggagcugaugagaggaggcgaacugcuugaucgcauucuccggcagagauacuucuccgagcgcgaagccagcgacguccugugcacgaucaccaaaacaauggauuaucugcacucucaaggggugguucaucgggaccucaagcccuccaauauucuguacagagaugagagcggaucuccugaaagcauccgcgugugugacuuuggcuucgccaaacagcuucgggcugggaacggccugcucaugacccccugcuacacagccaauuucgucgcgccggaggugcugaagagacagggauaugaugcugccugugacauuuggucccugggcauccuucucuacaccaugcuggccggguuuacgccuuucgcuaacggacccgaugacacaccugaggaaauucuggcccgcaucggcucugggaaguaugcucucagcggaggcaauugggacuccaucagcgaugccgcgaaagacgugguuucuaagaugcugcacgucgauccccaucagcggcuuaccgccaugcaagugcugaaacacccuuggguggucaacagagaguaccucucccccaaccagcugagccggcaggacgugcaccugguuaagggggcuauggccgcuaccuauuuugcccuuaaucgcacaccgcaggcgccuagacucgaacccgugcugucuuccaaccuggcccaacggagaggcaugaaacgccucaccagcacacggcuguga

SEQ ID NO: 75091 - RNA, 2223 nt, Artificial Sequence
  derived and/or modified sequence opt5 from RPS6KA3__Homo_sapiens__NP_004577
augccccuggcccagcucgcugacccuuggcaaaagauggccguggagagcccguccgauucugcggaaaacggccagcagaucauggacgagcccaugggggaagaggaaauuaauccucagaccgaggaggucagcaucaaagaaauugcuaucacacaccauguuaaggagggacacgaaaaagccgaucccucccaauucgagcugcuuaaggugcugggccaggggucuuuuggaaaaguguuccucgucaagaagauuagcggcuccgacgccagacagcuguacgcuaugaaagugcuuaagaaagccacgcugaagguucgggaucgcgugagaaccaaaauggagcgggacauccucgucgaagugaaccauccuuuuaucguuaagcugcacuaugcuuuccagacagaggggaagcuguaccucauucuggauuuucuucgcggaggcgaccuguucaccagacucucuaaagaagugauguuuacagaggaagaugucaaguucuaucuggccgagcuugcgcuggcccucgaccaucugcacagccugggcaucauuuaccgggaucucaaacccgagaauauccugcuugacgaagaggggcacauuaagcugaccgauuuuggacucuccaaagaaagcaucgaccaugagaagaaggcuuauucuuucugcggcacaguggaauacauggccccugagguggucaaccgcagagggcacacccaauccgcugacugguggagcuuuggaguucugauguucgagaugcuuacgggcacccugccguuucaggggaaagaucggaaggaaacaaugaccaugauucucaaagccaagcugggaaugccccaguuccugucuccugaggcgcagucccuccugcgcaugcuuuucaaaagaaaucccgccaaccggcugggcgcuggcccugacgggguggaagagaucaagcgccauagcuuuuucucuacaaucgauuggaauaaacucuauagacgggaaauucaucccccguuuaagccugccaccggacgccccgaggacacguucuacuuugauccugaguucacagcuaagacccccaaagacucccccggcaucccuccgagcgccaacgcccaccaacuguuuagaggguucuccuuuguggcuauuacaucugaugacgaaagccaggcgaugcagaccgucggagugcacuccaucguucaacagcuucaccggaauagcauucaguucaccgauggcuacgaggugaaggaagacaucggggucggaucuuauuccguguguaaaagaugcauccauaaggccacaaacauggaguuugcuguuaaaauuaucgauaagagcaagcgcgaccccacggaggaaauugagauccugcuccgguacggccagcacccuaauauuaucacccugaaagacguguaugaugacggcaaguacgucuauguggucacagaacugaugaaagggggagagcuccuggauaagauccuuagacaaaaauucuuuucugaacgcgaggccagcgccgugcuguucaccauuacaaagaccguugaguaccuccaugcucagggcgugguccaccgggaccugaagcccuccaacauccuguauguggaugaaucugggaauccugagagcauuagaaucugugacuucggauuugccaaacagcuucgcgcggaaaacggccuccugaugacgcccugcuacacagcuaauuucguugccccggaggugcugaagcggcagggguacgaugccgcuugugacauuuggucccucggcguccugcuuuauaccaugcugaccggauacacaccuuuugccaacggccccgaugacaccccugaagagauccucgcuagaauugggagcggaaaauucucucuguccggcggguauuggaacagcgugucugauacagccaaggaccugguguccaaaaugcuucacguugauccccaucaacgccucacggcggcccugguccugcggcacccuuggaucgugcauugggaccagcucccccaguaccagcugaauagacaagacgcuccgcaccuugugaagggagccauggcugccaccuauagcgcgcugaaccgcaaucaguccccuguccucgagcccgugggccggucuacacuggcccagagacgggggaucaaaaagauuaccagcacagcucuguga

SEQ ID NO: 75092 - RNA, 2301 nt, Artificial Sequence
  derived and/or modified sequence opt5 from RPS6KA4__Homo_sapiens__NP_001006945
augggcgacgaggaugacgaugaaagcugcgccguggagcugagaaucaccgaagcuaaccucacagggcacgaggaaaaggucuccguugagaauuucgagcugcuuaaagugcugggaacgggcgccuacgggaagguguuucucguccggaaagcgggaggccaugacgcugggaagcuguaugccaugaaagugcuucgcaaggccgcucugguucagagagccaagacccaagaacacacacggaccgagcgcucugugcucgaacuggucagacaggcucccuuccuggugacacuccauuacgccuuucagaccgaugcgaaacugcaccuuauucuggacuauguuagcggaggcgagauguucacacaucucuaccagcggcaauauuuuaaggaggccgaagugcgcgucuacggcggggagaucgugcuggcucuugaacaucugcacaaacucggaauuaucuauagagaucugaagcuggagaacgugcuccuggacuccgaaggccacauuguccuuaccgauuucgggcugucuaaagaguuucucacggaggaaaaggagcggaccuucagcuuuuguggaacaaucgaauacauggccccugagaucauucgcuccaagaccggccacgggaaagcuguugacugguggucucugggaauccuucuguucgaacuccugacaggcgccagcccguuuacccuggagggcgagagaaauacgcaggcggaagugucccggcgcauucucaagugcucucccccuuuucccccuagaaucgggcccguggcccaggaucugcuucagcggcugcucuguaaagacccuaagaaacgccugggagcuggcccgcaaggggcccaggaggucagaaaccaucccuucuuccagggacuugauuggguggcucuggccgcccggaagauuccugcucccuucagaccucagauccgcagcgaacucgacguuggcaauuuugcggaggaguucacacggcuggaacccguguacuccccgccugggucucccccucccggagaccccagaauuuuucaaggcuauagcuucgucgccccuuccauccuguuugaucacaacaaugcugugaugaccgacggccucgaggccccgggggccggagaucgccccggccgggcugccguugcgagaagcgcuaugaugcagcaguacgaacuggaccuucgcgagccugcccuggggcaaggaucuuucuccgugugccggagaugucgccagcggcagagcggccaggaauuugccgucaaaauccucuccagacgccuggaggcuaacacacaacgggagguggccgcucugagacuuugccagucucaccccaaugucgugaaccuccaugaaguucaccaugaucagcugcacaccuaucuggugcucgagcugcuucgcgggggcgaacugcucgagcauauucggaagaagagacacuucagcgaauccgaggccagccagauccugcggucucuggucuccgcggugagcuuuaugcacgaggaagccggaguugugcauagagaccuuaaaccugagaauauucucuacgcugaugacacccccggcgccccggucaagaucauugauuucggguuugcucgccugcggccucaaucucccggagugccuaugcagacacccuguuucacgcugcaguaugccgcgccugaacuccuggcccagcaaggcuacgacgagagcugcgaucuuuggucccugggggugauccucuauaugaugcugucuggacagguucccuuucagggcgcuagcgggcagggcggacaaucccaggccgcugaaaucauguguaaaauuagagagggccgcuucagccuggacggggaggccuggcagggagucucugaagaggccaaggaacuugugagaggccuccugaccguggacccggcuaaacggcugaagcucgaggggcugcgcggauccagcuggcuucaagauggcucugcgagauccagcccuccccugcggacacccgacguccucgaauccucugggccugccgugcgcagcggccugaacgcuaccuucauggccuuuaauagaggaaagcgggagggcuucuuucugaaauccguugagaacgccccgcuugcuaagcgcagaaaacagaagcuccggucugccacagcgagccgcagagggucccccgcuccugccaaucccggacgggccccuguggcuagcaaaggcgcccccagacgcgcgaacgggccucugcccccgucuuga

SEQ ID NO: 75093 - RNA, 2409 nt, Artificial Sequence
  derived and/or modified sequence opt5 from RPS6KA5__Homo_sapiens__NP_004746
auggaggaagagggcgggagcuccggaggcgccgcugggaccucugccgacggaggcgaugggggagaacagcugcucacagugaagcacgagcugagaacggcgaaccuuaccggccaugcugaaaaagucggcaucgagaauuucgagcugcucaagguucuggggacaggagccuacggcaaaguguuucuugugcggaagauuagcgggcacgacaccggaaaacuguaugccaugaagguccucaagaaagcuacaaucgugcaaaaggccaaaaccacagaacauacccgcacggagagacagguucuggaacacauucggcagucccccuuccuggugacccuccauuacgcuuuucagacagagaccaagcugcaccuuauccuggauuauauuaacggcggggaacucuucacacaccugucucaacgcgagagauuuaccgagcaugaaguccagaucuacgugggagagaucguucuugcccuggaacaccuccauaaacugggcauuaucuaucgggacauuaagcuggagaauauccuccuggauagcaacggccacgugguccuuacggacuucgggcuguccaaggaguuuguggcggaugaaacagagcgcgccuacucuuucugcggaaccauugaauauauggcuccugacaucgugagaggcggggauagcggacacgacaaagccgucgauugguggucccucggcguucugauguacgagcuucugacaggggcuagcccguuuaccguggacggagaaaagaauagccaggccgagauuucccggcgcauccucaaaagcgagcccccuuacccccaggaaaugucugcgcuggccaaggaucugauccaaagacuccugaugaaagacccuaagaaacggcuuggcuguggcccccgcgacgcugaugagauuaaggaacaucuguucuuucagaagaucaacugggacgaucucgccgcuaaaaaggugccugccccguucaaacccgucauuagagacgagcuggauguguccaauuuugccgaagaguucaccgagauggacccuacauauagccccgcugcgcuuccucagucuuccgaaaagcuguuccagggguacagcuuuguugcccccuccauccucuucaaacggaacgcugccgugauugauccgcugcaauuucacaugggagucgagcgcccuggcgugacgaauguugccagaucugcuaugaugaaggacagccccuucuaucagcauuacgaucuggaccucaaggauaaaccucugggggaaggauccuuuagcaucugccggaagugugugcacaaaaagucuaaccaggccuucgcggucaaaaucauuuccaagagaauggaggcuaauacccaaaaggagaucacagcccuuaaacugugcgaaggccaucccaacauugugaagcuccacgaggucuuucacgaccagcugcauaccuuccuggugauggaacuucucaaugggggcgagcuguuugaacgcaucaaaaagaaaaagcacuucagcgagacagaggccucuuauauuaugcggaagcugguuagcgcugugucccauaugcacgacgucggagugguucacagagaucucaaacccgaaaaccugcuuuuuaccgacgagaaugauaaccuggaaaucaagaucauugacuucggcuuugcccgccucaaaccuccggauaaccagccccugaagacgccuuguuucacacugcauuacgcugcccccgagcuucucaaucagaacggguaugacgaaucuugcgaucuguggagccugggagugauccucuacaccaugcuguccggccaagucccuuuccagagccacgaccggucucuuaccuguacauccgcgguggagauuaugaaaaagaucaaaaagggggauuuuagcuucgagggagaagccuggaagaaugugucucaggaggcuaaagaccugauucagggccuccugaccguugaucccaacaagagacugaaaauguccgggcuucgcuacaaugaauggcuccaagacggcagccagcuguccucuaacccgcugaugacaccugauauccucggaagcuccggcgccgcuguccauacgugcgugaaggccaccuuucacgcguucaauaaauauaagcgggagggguuuugucugcagaacguggacaaggcuccccuugccaaaagacgcaagaugaaaaagacaucuaccagcacagaaacccgguccucuucuuccgagagcucucauuccagcucuagccacucccacggaaaaacgaccccuacaaagacccugcagcccagcaauccugccgacucuaacaaucccgagacacucuuccaauuuuccgauagcgucgcuuga

SEQ ID NO: 75094 - RNA, 2238 nt, Artificial Sequence
  derived and/or modified sequence opt5 from RPS6KA6__Homo_sapiens__NP_055311
augcugcccuucgccccucaggacgagccgugggauagagaaauggagguguuuagcggcgggggagcuuccucuggcgaagucaacgggcucaagaugguugacgagcccauggaagagggagaggccgauagcugccacgacgaaggcguggugaaagagaucccuauuacccaucacgucaaggaaggguacgagaaagcggaucccgcucaauucgagcugcuuaaggugcugggacagggcuccuuuggcaaaguuuuccucgugcggaagaagacagggccugacgccggacagcuguaugccaugaaaguccuuaagaaggcuucucugaaagugcgcgauagaguucggacgaaaauggaacgcgacauccucguggaggucaaucaucccuuuauugugaagcugcacuacgccuuccagaccgaaggcaagcuguaucucauccuggauuuucuuagagggggagacguguucacacggcugagcaaagagguccucuuuaccgaagaggauguuaaguucuaccuggcugagcuugcccuggcgcucgaccaucugcaccaacugggcauuguguaucgcgaucucaaaccugaaaacauccugcuugacgagaucgggcacauuaagcugacagacuuuggacucuccaaagaaucuguggaucaggagaagaaagccuacagcuucuguggcaccgucgaauauauggcuccggaggugguuaauagacggggccauucccagagcgccgacugguggucuuacggggugcugauguuugagaugcuuacaggaacccugcccuuccagggcaaggaucgcaacgaaacgaugaauaugauccucaaggcuaaacuggggaugccucaauuccuguccgccgaggcgcagagccuccugagaaugcuuuuuaagcggaaccccgccaaucgccugggaucugaaggcgucgaggaaauuaaaagacaccucuucuuugcuaacaucgacugggauaagcuguacaaacgggaggugcagccucccuucaagccggccuccgggaagccugacgauaccuuuugcuucgaccccgaguuuacagcuaaaaccccuaaggauagccccggacuucccgccucugccaaugcucaucagcuguucaaaggcuuuuccuucguugcgacaagcauugccgaagaguauaagaucaccccuauuacguccgcuaacgugcucccgaucguccaaaucaauggcaacgccgcccaguuuggggaaguguacgagcugaaagaggacauuggagucggcucuuauagcguguguaagcgcugcauccacgcuacaaccaauauggaguucgccguuaagauuaucgauaaauccaagagagaccccagcgaagaaauugagauccugaugcgguacgggcagcacccuaacaucauuacacucaaagacguguuugaugacggaagauaugucuaccuggugaccgaucuuaugaagggcggggaacugcucgaccgcauccugaaacaaaaguguuucucugagcgggaggcguccgauauucuguauguuaucagcaagaccguggacuaccuucauugccagggcgucgugcacagagaucucaaacccucuaauauucuguacauggacgaaagcgcuuccgccgauucuauccgcaucugugacuucggauuugccaagcagcugcggggcgagaacgggcuccugcuuacaccuugcuauacggcuaacuucguggcccccgaaguucugaugcagcaaggauacgaugcugccugugacauuuggagccucggcguccuguuuuauaccaugcuggcgggguacacaccguucgccaauggaccuaacgauacccccgaggaaauccuucucagaauuggcaaugggaaauuuucccugagcggcggaaacugggacaauaucucugacggcgcuaaggaucugcucucccauaugcugcacauggacccucaucagcgcuauacagccgagcagauucuuaaacacagcuggaucacccaccgggaucagcugcccaacgaccaaccuaagagaaaugaugugucucauguggucaaaggggcuaugguggccacguacuccgcgcucacacacaagaccuuccagcccguucuggagccgguggccgcuagcucccuggcccagcgccggucuaugaagaaaagaaccagcacaggacuuuga

SEQ ID NO: 75095 - RNA, 1509 nt, Artificial Sequence
  derived and/or modified sequence opt5 from RPS6KB1__Homo_sapiens__NP_001258971
augagacggcgcagacggcgcgacggcuucuaccccgccccugauuuuagagaccgggaggcugaagauauggccgggguguucgacaucgaucuggaccagccggaggaugcgggaagcgaagacgagcucgaagagggcgggcaacugaacgaguccauggaucacggaggcgucgggcccuaugaacuuggaauggagcauugcgaaaaguuugagauuucugagaccagcguuaaucgcggcccugaaaagaucagacccgaguguuucgaacugcuccgggugcugggcaaagggggauacggcaaagcuaugauugugcgcaacgccaaggacacagcccacacgaaagcugagagaaauauccuugaagaggucaagcauccuuuuauuguggaucugaucuaugccuuccagaccgggggaaagcucuaccugauccuggaguaucucuccggcggggaacuguuuaugcagcuugagcgggaaggaauuuucauggaggacacagcuugcuuuuaccuggccgaaaucucuauggcgcucggccaucugcaccagaaaggcauuaucuaucgcgaucuuaagcccgagaacauuaugcugaaucaccaagggcacguuaaacucaccgacuucggacuguguaaggagagcauccaugacggcacagugacccacacauuuugcgggaccauugaauacauggccccugagauccugaugagauccggacauaaccgggcugucgauugguggucucucggcgcccugauguacgacaugcuuacgggggcuccgcccuucaccggagaaaaucgcaaaaagacaaucgauaagauucugaaauguaagcucaaccugccucccuaucuuacccaggaggccagagaccugcucaaaaagcugcugaaacggaaugcggccagcagacucggcgcuggcccuggggaugccggagaagugcaggcucaccccuuuuuccgccacaucaacugggaggagcugcuugcccggaagguugaaccgccuuucaaaccccugcuccaguccgaggaagacgugagccaauuugauucuaaguucacaagacagaccccugucgacucccccgaugacagcacgcugucugaguccgccaaucagguguuucuuggcuucacauacguggcucccagcguccuggagucuguuaaggaaaaauuuuccuucgagccuaagauucgcagcccgcggagauuuaucgggucuccccgcaccccugugucccccgugaaauucagcccuggagauuuuuggggcagaggggcguccgccagcacagcuaacccccagaccccggucgaauauccuauggagaccucuggcauugaacaaauggacgugacaauguccggagaggccagcgcuccccucccuauccggcagcccaauucuggcccuuacaagaaacaggccuuccccaugaucagcaagcgcccggagcaucugcggaugaaccuguga

SEQ ID NO: 75096 - RNA, 1449 nt, Artificial Sequence
  derived and/or modified sequence opt5 from RPS6KB2__Homo_sapiens__NP_003943
auggccgcuguguucgaccuggaucucgagaccgaagagggcagcgaaggggagggagaacccgagcuguccccugccgacgcgugcccgcuugcugagcugagagccgccggccucgaacccgucgggcacuacgaggaaguugagcugacagagacgucugugaacgugggaccugaacggaucggcccccauuguuuugagcuucugcgcguccucgggaagggaggcuauggcaaaguguuccagguuagaaaggugcaagggaccaaucugggaaaaauuuacgcuaugaagguccugcggaaagccaagaucgugcgcaacgcuaaggauacagcccacaccagagcggaacggaauauucucgagagcguuaaacauccuuuuaucguggaacuggccuaugcuuuccagacaggcgggaagcucuaccugauucucgagugccuguccggaggcgagcuuuuuacccaccuggaacgcgaggggaucuuccucgaagacacagccuguuuuuaucuggcugagaucacccuggcccucggacaucugcacucucagggcauuaucuacagagaucuuaaacccgaaaacauuaugcugagcucccagggccacaucaagcucacggacuucgggcugugcaaagagucuauucaugagggagcggucacccacacauuuuguggcaccaucgaauauauggccccugagauucuugugcggagcgggcauaaucgcgcuguggauugguggucccugggagcccucauguacgacaugcugacaggcagcccgcccuucaccgcugaaaacagaaagaagacgauggauaaaaucauccgggggaagcuggcccucccucccuaccugacaccugacgcccgcgaucuugucaaaaaguuucugaaaagaaaucccucucaacggauuggaggcggcccgggggacgcugcggauguucagcgccacccuuucuuuagacacaugaacugggacgaccuccuggccuggcggguggaucccccuuucagacccugccuucaguccgaggaagacgugagccaguucgauacccgcuuuacacggcaaacccccgucgacucuccugaugacaccgcucuguccgagagcgccaaucaggccuuccucggauuuacauauguggcuccgucuguucuggauuccaucaaggagggcuucagcuuucagcccaaacugagauccccucgccggcucaacucuagccccagagccccugugagcccccugaaguucuccccguuugaaggguuccgcccuucucccucccuuccugagcccacggaacugccucuucccccgcugcugccucccccucccccgagcaccacagcgccccuuccuauucggcccccuucuggaaccaagaaaagcaagagaggccgcgggcggcccggcagauga

SEQ ID NO: 75097 - RNA, 585 nt, Artificial Sequence
  derived and/or modified sequence opt5 from RPS9__Homo_sapiens__XP_006726028
augcccguggccagaagcugggucugccggaagaccuacguuacaccucgcagaccguucgagaaaucccggcuggaccaggaacucaagcugaucggcgaguaugggcuucgcaacaaaagagaaguguggcgggugaaguuuacgcuggcuaaaauucgcaaggccgcgagagagcuccugacccuugaugaaaaggacccccggcgccuguucgagggaaaugcucuccugagacggcugguccgcaucggcgugcucgaugaggggaaaaugaagcuggacuacauucuuggacugaaaaucgaagauuuucucgagagacggcugcaaacacagguuuucaaacuuggccuggccaagucuauucaccaugcccgcgugcucaucagacagcggcacaucagaguccgcaaacaggugguuaacauuccuagcuuuaucgugcggcuggacucccaaaagcauauugauuucucucugagaagccccuaugggggaggccgcccuggccgggucaagagaaagaaugcuaaaaaggggcagggaggcgccggggcuggagacgaugaagaggaggacuga

SEQ ID NO: 75098 - RNA, 888 nt, Artificial Sequence
  derived and/or modified sequence opt5 from RPSA__Homo_sapiens__NP_002286
augagcggcgcccuggacgugcuccagaugaaggaggaagauguccugaaauuccuugcugccgggacccaccugggaggcacaaaccucgacuuucaaauggagcaguacaucuauaagagaaaauccgaugggauuuacaucauuaaucugaagcggacgugggaaaaacuucugcucgcggcucgcgccaucguugccauugagaaccccgcugacgugucugugaucagcuccagaaauaccggacagcgggccguccugaaguucgcugccgcgacaggcgccaccccuaucgcugggcgcuuuacaccgggaaccuucacaaaccagauucaagccgcuuuuagagaaccccggcugcucgugguuaccgauccucgcgccgaccaucagccccugacggaggcgucuuaugugaaucuuccuaccaucgcccugugcaacacagauagcccccucagauacgucgacauugcuaucccuuguaauaacaagggcgcccacuccgugggccugaugugguggaugcuugcucgggagguucugcgcaugagagggaccauuucucgggaacauccgugggaggugaugcccgaucucuauuucuaccgcgacccugaagagaucgagaaagaggaacaggccgccgcugaaaaggcggucacaaaagaggaauuucagggagaguggaccgcccccgcuccugaguucacggccacacaacccgaaguggccgauuggagcgagggcgugcaggucccguccguuccuauucagcaguuucccaccgaagacuggagcgcucaaccugccacagaggauuggucugcggcucccaccgcccaggccaccgaaugggugggggcuacaacggacugguccuga

SEQ ID NO: 75099 - RNA, 3534 nt, Artificial Sequence
  derived and/or modified sequence opt5 from RPTOR__Homo_sapiens__NP_001156506
auggagagcgaaaugcugcagucuccccuccugggccuuggggaggaagacgaggccgaucugaccgacuggaaccucccucuggcuuucaugaagaaaagacacugcgaaaagaucgagggauccaaaagccuugcccaauccuggcggaugaaggaucgcaugaaaacagugucugucgcgcugguucucugucugaaugugggcguggacccgcccgaugucgugaagacgaccccuugcgcuagacuggaguguuggauugacccccucagcauggggccucagaaggcccuggaaacaaucggagccaaccuucagaaacaguacgagaauuggcaaccccgggcucgcuauaagcagucccuggauccuaccguugacgaagugaaaaagcucugcacaucucugagacggaacgccaaagaggagcgcguccuuuuucauuacaauggccacggggugccgagacccaccguuaacggagaagugugggucuucaauaagaacuauacacaguacauuccucugagcaucuaugaucuccagaccuggaugggcucccccagcauuuuuguguacgacuguucuaaugcuggccugaucgugaaguccuucaaacaauuugcccugcagcgggagcaggaacucgaggucgcggccaucaacccuaaucauccccuggcucagaugccgcuuccucccagcaugaagaacugcauucaacuggccgcuugugaagccacggagcuccugccuaugauccccgaucuucccgcggaccuguucaccucuugccucacaaccccuauuaaaaucgcccugcgcugguuuuguaugcagaagugcguuucccuggugccgggggugacacucgaucugauugagaaaauccccggaagacuuaaugaccggcgcaccccucugggcgaacucaacuggauuuucacggcuaucacagacaccaucgccuggaauguccugcccagagaucuuuuucagaagcuguuccggcaagaccuccugguggcuagccuguuucgcaacuuccuccuggccgagagaauuaugcggucuuauaacuguacaccuguuuccagccccagacuuccgccuaccuacaugcacgccauguggcaggcuugggaucuggcgguggacaucugccucucccagcugcccaccauuaucgaagaggggacagccuuucgccauucuccuuucuucgcugaacagcugacggccuuucaagucuggcuuaccaugggaguggagaaucggaaucccccugagcagcuccccauuguucuccaggugcugcugagccagguccacagacugcgcgcccuugaucugcucggccgguuccuggaccuggggccgugggcugugucccuugcccucagcgucggaaucuuuccuuacgugcugaaacugcuccaaucuuccgcgagagaacugcgcccccuucugguuuucaucugggcuaagauucucgccguggauagcgagcuggucguggcccugucucaccuuguugugcaguaugaaagcaacuuuugcacagucgcucuccaguucaucgaggaagagaagaacuacgcccugcccuccccugcuaccacagagggcggcucucugaccccggugcgggacagccccuguacgccuagacuccgcuccgugagcucuuaugggaauauucgggccguugcgacagccagaucccugaacaaaagccuucagaaucugucucucaccgaagaguccggaggcgcugucgccuuuagccccgggaaccuguccaccucuagcuccgcuucuagcacacugggauccccugaaaaugaggagcauauccuuagcuucgaaaccauugauaagaugcgccgggccucuuccuacagcucucucaacucccugaucggcgugagcuuuaauucuguguauacacaaaucuggagaguccugcuccaccuggcggccgaccccuacccugaggugagcgauguugcuaugaaagugcuuaacuccauugccuauaaggcuacggucaaugcccggccccagcgcgugcuggacaccagcucucucacacaguccgccccggcuagcccuaccaacaaagggguucauauccaccaggcgggaggcucucccccugccuccagcacauccucuagcucccugaccaaugacguggcuaagcaacccgucucuagagaucugccgagcggccggccugggacgaccggacccgccggcgcccaguacacaccucacucccaucaguuccccagaacccgcaagauguuugacaaagggcccgaacaaacagcugaugacgccgaugacgcggcuggacacaagagcuucauuucugccaccgugcagacgggcuuuugcgauugguccgcccgguacuucgcucagccuguuaugaaaaucccggaggaacaugaccuugagagccagauuagaaaggagcgcgaauggagauuccugcggaacucucgcgugagacggcaagcccagcaggucauccagaaagggauuacacgccucgaugaccaaaucuuucugaacagaaaucccggcgugccuuccguggucaaguuccaccccuuuaccccuuguaucgcgguugcugauaaggacagcauuugcuucugggauugggagaaaggagaaaagcucgacuauuuucauaacggcaauccccgguacacacgcgugaccgccauggaguaucugaacgggcaggacuguucucuucugcucaccgccacagaugacggagcuaucagaguguggaaaaauuucgccgaucuggaaaagaacccugagauggucacggcuuggcagggccuguccgacaugcuuccgaccacacgcggggccggaauggugguugauugggagcaggaaaccggccugcucaugagcuccggggacgugcggauugucagaaucugggauacagaccgggagaugaaagugcaagauauucccaccggcgcggacagcugcguuacgucucugagcugugauucccacagaucucucaucguggccggacugggcgacgggagcauccgcgucuacgaucggagaauggcucuuuccgaaugccgcgugaugacauaucgggagcacaccgccuggguugugaaggcuucucugcagaagagaccugacggacauauugucagcguguccgugaauggcgacguccgcaucuuugauccccggaugccugaaucuguuaacgugcuccagauugugaaagggcugaccgcccuggacauccacccccaagccgaucuuauugcuuguggaagcgucaaucaguucacagcgaucuacaacuccagcggcgagcugaucaauaacauuaaguauuacgacggguuuaugggccagagagugggagccaucucuugccucgcuuuccauccgcacuggccucaccuggccguuggcuccaaugauuacuauauuagcguguacucugucgagaaacgcgugcgguga

SEQ ID NO: 75100 - RNA, 996 nt, Artificial Sequence
  derived and/or modified sequence opt5 from RQCD1__Homo_sapiens__NP_001258563
augcacagccuggccaccgcugcccccgugccuacaacgcucgcgcaggucgacagagagaagaucuaccaauggauuaacgaacuguccucuccggagacccgggaaaaugcccuucuggagcucagcaaaaagcgcgaauccguucccgaucuggcuccuaugcuuuggcauucuuucggcacaaucgccgcucugcuccaggagauugugaacaucuaucccagcauuaauccucccacccugacagcccaccaguccaacagagugugcaaugcucuggcccuccugcagugugucgcgucucauccugagacccggagcgccuuucuugcugcccacaucccgcuguuccucuaccccuuucugcauacaguguccaaaacccgcccuuucgaauaucuuagacugacgagccucgggguuaucguggagaccggauuucaccacgucggccaagcugaccuggaacugcccacaucuuccgaucucccugccagcgcgucucaguccgccgggauuaccggagcucuggugaagacagacgagcaggagguuaucaacuuccuucugaccacggaaauuaucccccucugccugcggauuauggagagcggcucugaacuuuccaaaacaguggccaccuuuauccugcagaagauucuccuggaugacacagggcuggcuuacaucugucaaaccuaugagcgcuucagccaugucgccaugauccucggaaagauggugcugcagcuuuccaaagaaccgucugccagacugcucaagcacgugguccggugcuaccugcgccuuagcgauaauccuagagcucgggaggcgcugcgccagugucuccccgaccagcugaaagauaccacauuugcccaaguucugaaggacgauacgaccacaaaaagauggcucgcucagcuggugaagaaccuucaggagggccaagugaccgacccucggggcauuccccugcccccucaguga

SEQ ID NO: 75101 - RNA, 927 nt, Artificial Sequence
  derived and/or modified sequence opt5 from RRAD__Homo_sapiens__NP_001122322
augacccugaacggcgggggaagcggcgccgggggauccagaggcgggggacaggagcgggaacgcagacggggcucuacacccuggggcccugcuccgccccuccaccgcagaagcaugccuguggacgagcgggaucugcaagccgcgcuuacgcccggggcucugaccgccgccgcugccggaacaggcacccaggggccucgccucgacuggcccgaagauuccgaggacucucugagcuccggaggcucugauagcgacgaauccgucuacaagguucuucugcucggggcuccuggagugggcaaaagcgcccuggcgagaaucuucggcgggguggaggauggaccggaggccgaagcugccggccauacauaugaccggucuauugucguggauggggaggaggcuucccugaugguuuacgacaucugggaacaggauggaggccgcuggcuccccgggcacugcauggccaugggagacgcguaugugauugucuacagcgugaccgauaagggcucuuuugagaaagccuccgaacugagaguucagcuucggcgcgcuagacaaacagacgacgugccuaucauucuggucggcaauaagagcgaucucgugcggucucgcgagguguccgucgacgaagggagagccugugcuguuguguucgauugcaaauuuaucgagaccagcgccgcccugcaucacaacgugcaggcucuuuucgaaggagucgugcggcagaucagacugcgccgggacuccaaggaggcgaaugccagacgccaggcuggcacgcggagacgcgagucucucgggaagaaagccaagcgguuucugggaagaauuguugcccgcaacagccggaaaauggcuuucagagccaaguccaaaagcugucaugaucugucugugcucuga

SEQ ID NO: 75102 - RNA, 942 nt, Artificial Sequence
  derived and/or modified sequence opt5 from RRAGA__Homo_sapiens__NP_006561
augcccaacaccgccaugaagaaaaaggugcugcucaugggcaaaagcggguccggaaagacaucuaugagaagcaucauuuucgcuaauuacaucgcccgggacacgcgcagacugggcgcgaccauugaugucgagcacucccauguucgguuucuugggaaccuggugcucaaucugugggacugcggaggccaggauacauucauggaaaacuauuuuaccucucaacgcgacaauaucuucagaaacguggagguccuuauuuacguguuugauguugaaagccgggagcuggaaaaagacaugcacuauuaccaguccugucucgaggcuauccugcaaaauucuccugaugccaagaucuucugccuggugcauaagauggaccucguccaggaggaucagcgcgaccugauuuuuaaagaaagagaggaagaucuucggcgccugagcagaccgcucgagugugccugcuuccggacauccaucugggacgagacccuguauaaggcuuggagcucuauuguguaccagcuuauccccaacguucagcagcuggaaaugaaucuccgcaacuuugcccaaauuaucgaggcugaugaagugcugcuguucgagagagccacauuucucgucauuucccacuaucaguguaaagaacagcgggacgugcaucgcuucgagaagaucagcaauaucauuaaacaguuuaagcugucuugcuccaaacuugcggccagcuuccaaucuauggaggugagaaacuccaauuucgcugccuuuaucgacauuuucaccagcaacacguacgucaugguugugauguccgauccuucuauccccagcgcugccacccugauuaauauccggaacgcgagaaagcacuuugaaaagcucgagcgcguggacgggccuaaacacucccugcuuaugcgguga

SEQ ID NO: 75103 - RNA, 384 nt, Artificial Sequence
  derived and/or modified sequence opt5 from RRAS2__Homo_sapiens__NP_001096139
augagagagcaguacaugcggaccggcgaaggguuccugcucguguuuagcgucacagaccgcggauccuucgaggaaaucuauaaguuucaaagacagauucugcggguuaaagaucgcgacgaguuccccaugauccuuauuggcaacaaggccgaucuggaccaccagagacaggugacgcaagaagaggggcagcagcucgcucggcagcugaaagugaccuacauggaggccucugcgaagauccgcaugaaugucgaucaggcuuuucaugaacuugugagaguuauucggaaauuccaagagcaggaaugcccuccgagccccgagccuacacgcaaggagaaggacaaaaagggaugucacugcgugaucuuuuga

SEQ ID NO: 75104 - RNA, 657 nt, Artificial Sequence
  derived and/or modified sequence opt5 from RRAS__Homo_sapiens__NP_006261
augagcuccggcgccgcuucugggaccggaagaggccggccccgcgggggaggcccugggccgggagaucccccucccagcgagacacacaagcugguggucguuggcggcgggggagugggcaaauccgcccucacgauccaguucauucaaucuuacuuugugagcgacuaugacccuaccaucgaagauuccuacacaaagauuugcucugucgacgggauccccgcgagacuggauauucuugacaccgcuggacaggaggaguucggcgccaugcgggaacaguauaugcgcgccgggcauggauuucugcucguguucgcuaucaacgauagacagagcuuuaaugaaguuggcaaacuguucacacaaauccuucgggugaaggaccgcgaugacuuuccugucgugcugguuggcaacaaagccgaucucgagucccagagacaggugccgcggagcgaggcuucugccuucggggcgucccaccaugucgccuacuuugaagcuagcgccaagcugcgccugaauguggacgaggcuuucgaacagcucgugagagccguccggaaguaucaagagcaggagcugcccccuucucccccuuccgcgccccgcaaaaagggaggcggguguccgugcguucuucuguga

SEQ ID NO: 75105 - RNA, 2934 nt, Artificial Sequence
  derived and/or modified sequence opt5 from RRBP1__Homo_sapiens__NP_001036041
auggacaucuacgauacccagacacugggcguggucguuuucgggggauuuaugguggugagcgccauuggcaucuuccucgucuccacguuuucuaugaaggagaccagcuaugaagaggcucuggccaaccaaagaaaagaaauggcgaagacacaccaucagaaaguggagaagaaaaagaaggaaaagaccguugagaagaaagggaagacaaagaagaaggaggaaaaacccaauggaaagauuccugaccacgauccggcucccaacgugaccguccuucugcgggagccugugcgcgcccccgccguugcuguggccccuacacccguccagccuccgaucauuguggcucccguggccaccgucccugcgaugccccaggaaaaacucgccuccucuccuaaggacaaaaagaaaaaggagaagaaaguugcuaagguggagcccgccgugagcuccgucguuaauucuauccaagugcugacgagcaaagcugccauccuugaaaccgcgccgaaggagggcagaaacacagauguggcccaguccccugaagcucccaaacaggaggccccugcuaagaagaaaagcgggucuaagaaaaagggaccucccgacgccgauggcccccuguaccucccguauaaaacccuggucuccacagugggcagcaugguuuucaaugaaggggaggcccagcggcugauugagauccucucugaaaaggcuggaauuauccaagacaccuggcauaaggcgacgcagaaaggcgaucccguggccauucugaagcgccagcuugaggaaaaagagaagcugcucgcuacagaacaggaggacgccgccgucgcuaaauccaagcugagagagcuuaacaaggaaauggccgcggagaaagcuaaggccgccgcuggggaagccaaagugaagaaacaacuggucgcucgggagcaggaaaucaccgccgugcaggcgcgcaugcaagccagcuacagagagcacguuaaggaggugcagcagcuccagggaaaaauucggacacugcaagaacagcuggagaauggcccuaacacccagcucgcucgccugcagcaagaaaauucuauccuuagagaugcccugaaccaggcuaccucccaggucgagagcaagcagaaugccgagcucgcgaagcugcggcaagaacuuuccaaagugucuaaggagcugguugagaaaagcgaagccgugcgccaggacgaacagcagagaaaggcucucgaggccaaagcugccgccuuugagaagcaaguccugcagcugcaggcuucccaucgggaaagcgaggaagcgcuccaaaagcgccuggaugaggugucuagagaacuuugccacacacaguccagccacgccucucugcgggcugacgccgagaaagcccaggagcagcaacagcagauggcugaacuccauagcaagcugcaguccucugaggccgaagugagaagcaaaugugaggaacuuuccgggcugcacggacaacuccaggaggcgcgcgcugagaacagccagcugacggaacggaucagaucuauugaggcccugcucgaagccggccaggcucgcgacgcccaagauguucaggcgucccaggcugaggccgaccaacagcagacccggcugaaggagcuugaaagccaggucucuggccuggagaaagaagccaucgagcucagagaagcuguggagcaacagaaggugaagaauaacgaucugcgcgagaaaaauuggaaggccauggaagcucuggccacagcggagcaggccugcaaagaaaaacuucauucccucacccaggcuaaagaggaaagcgagaagcaacugugucugauugaggcccagacaauggaagcucuccuggcccuucugcccgagcucuccguccuggcccagcagaacuauaccgaauggcugcaagaccuuaaggagaaagggccuacgcuccugaagcaucccccggcuccugcggaacccucuagcgaucuggccuccaaacuccgggaggcugaggaaacacagucuacccugcaggccgagugcgaccaguacagaagcauccuugccgaaaccgagggaaugcugcgcgaucuccaaaaguccguggaggaagaggaacagguuuggcgggcuaaagugggcgccgcggaggaggaacugcaaaagagcagagucacagugaaacaccuggaggaaauuguugagaaacuuaagggggaacucgagucuuccgaccaggugcgcgaacacaccagccaccuggaggcugagcuggaaaaacauauggccgccgcuucugccgagugucagaacuaugcgaaggaagucgcuggacuccggcagcugcuucuggagucccagagccaacucgaugccgccaaaucugaagcucagaagcagagcgacgagcuggcccuggugagacagcaacuuuccgagaugaaaagccacguugaagauggcgacaucgcuggggccccugcgucuucccccgaggccccucccgcugaacaggacccggugcagcucaagacacagcuggaguggacggaggccauccuggaagaugagcaaacccagcggcagaagcucacagcugaguucgaagaagcccaaaccagcgccugccgccugcaggaggagcuugaaaaacugagaacagcuggaccucucgaguccucugaaaccgaggaagcgagccagcugaaggagcggcuggagaaagaaaagaaacuuacguccgaccugggcagagccgcuacccgccuccaggagcugcucaagacaacccaagaacagcuggcccgggagaaggauacagucaaaaagcugcaggaacagcuugagaaagccgaggacggcucuagcuccaaggaagggaccucuguguga

SEQ ID NO: 75106 - RNA, 4431 nt, Artificial Sequence
  derived and/or modified sequence opt5 from RREB1__Homo_sapiens__NP_001003700
augaccagcuccucucccgccggccuggaggggagcgaccucuccucuaucaacacaaugaugagcgcugugauguccgucggaaagguuacggaaaauggcgggucuccucagggaauuaaaagcccguccaagcccccuggccccaacagaaucgggcggcgcaaucaagagaccaaagaagaaaagagcucuuacaacugcccucugugugagaaaauuugcacaacccagcaccagcuuacaaugcauaucagacagcacaauaccgauacaggaggcgccgaccauuccuguagcauuugcggcaagucucuguccagcgcgucuucccucgaucggcacaugcuggugcauagcggggagcgccccuauaaguguaccgugugcggacaauccuucacgaccaacggcaauaugcacagacacaugaaaauccaugagaaggacccuaacucugcuacagccaccgccccgcccagcccucuuaaacggcgcagacuguccagcaagcggaaacucucucacgaugcugaauccgagcgcgaagaccccgccccugcuaagaagauggucgaggaugggcagagcggagaccuggagaaaaaggccgaugaaguguuucauugucccguuugcuucaaagaguuuguguguaaguacggccuggaaacacacauggagacccacucugacaauccgcucagaugcgauaucuguugcgucacguuccggacacaucgcgggcugcuuagacacaacgcgcuggugcauaaacagcucccucgggacgccaugggacgccccuuuauucagaauaacccuagcauccccgcuggcuuccacgaucugggcuuuaccgacuucuccugcagaaaguuuccccggauuucucaagccuggugugaaacaaaucuuagacgcugcaucagcgagcagcaucgguucguuugugauaccugcgacaaagccuuuccuaugcuguguucccucgcccugcacaagcagacccacguggcggccgaccaggggcaagagaagccgcaggcuacaccccugccuggagaugcccucgaccagaaaggcuuccuggcucuccuggggcuccaacauacgaaggaugucagacccgccccugccgaggaaccccugccggacgauaaccaggcuauucagcuucagacccugaaaugccaacucccucaggaccccggauguacaaaucugcugagccucucuccuuuugaagcggccucccugggcgggagccuuaccgugcugcccgcuacaaaggauucuaucaaacaccucucccugcagccuuuccagaagggauucauuauccaacccgacagcuccaucguggucaagccgauuucuggcgagagcgccaucgaacuugccgauauucagcagauccugaaaauggcugccuccgcgccuccccagauuucucuucccccuuuuagcaaggcuccggccgcuccccugcaagcuaucuucaaacauaugccuccccugaagccuaaaccccucguuaccccucgcacggugguggccacauccacacccccgccucugaucaacgcucagcaggccagccccggcugcauuucuccuucccuucccccgccuccccugaagcuccugaaggggagcgucgaggcggccucuaacgcucaucugcuucaguccaaaagcggaacccaaccucacgccgcuacccggcucucucugcagcagcccagagccgagcugcccggccaaccugaaaugaagacccagcucgagcaggacagcaucauugaagcgcugcuuccgcuguccauggaggccaaaaucaagcaggaaauuacagagggggagcucaaggcuuuuaugacggcccccggaggcaaaaagaccccugcuaugcgcaaagugcuguaucccugucgguucugcaaucaaguuuuugccuucagcggggugcugagagcccacguccgcucucaccuuggcaucuccccuuaccaguguaacaucugcgacuauauugcugcggauaaggccgcucucauccggcaucugagaacacacagcggagaacgccccuacauuugcaaaaucugucauuauccuuuuaccgugaaggccaauugcgagcggcaccugagaaagaaacaccucaaagccacacggaaggacauugaaaagaacaucgaguacguuuccucuagcgcugccgagcugguggaugcguucugugcuccggacaccgucugccgccuuuguggcgaagaucugaaacauuacagagcccuccggauucacaugagaacgcauugcgggcgcggacugggcgggggacacaagggccggaaacccuuugaguguaaggaaugcuccgccgcuuucgccgcgaaaagaaauuguauccaucacauccugaagcagcaccuucaugugccugagcaggacauugaaucuuauguccucgcugccgaugggcugggccccgccgaggcuccugccgcugaggccagcggacgcggcgaagacuccgggugcgcggcccugggagauuguaagccccucaccgcuuuucuggagccgcaaaacggcuuccuucacagagggccuacacagccucccccuccccaugugucuaucaaacuggaaccugccagcuccuuugcuguugacuucaaugagccgcucgauuucagccagaagggacuggcccuggugcaggucaaacaagaaaacauuucuuuucuuucccccagcucucucgugccuuacgacugcuccauggagcccaucgaucugagcauuccuaagaauuuccggaaaggcgacaaggaccuggccacccccucugaggcuaagaaaccggaagaggaagcgggguccagcgagcagccuucccccugcccugcccccggcccuagccuccccguuacacugggaccgucuggcauccuugaaagcccuauggcucccgcccccgccgcuaccccugagccgcccgcccagccucugcaagggcccgugcagcucgcggucccuaucuauuccucugcucuggugagcuccccgccccuggugggaucuagcgcccuucuguccggcacggcccuccugcgcccccucagacccaagccuccccugcuucugccuaaacccccgguuacagaggaacucccuccccuggcuucuauugcccagaucauuagcuccgucagcucugcgcccacccugcuuaagacaaaaguggcugauccugggcccgccuccaccggaagcaacaccacagccucugacucccugggcgggagcgugccuaaggcugccacgaccgcuacaccggccgcgaccacaucccccaaggagucuagcgaaccucccgccccugcuuccagccccgaggccgcuucuccgaccgagcagggcccugccggaacguccaaaaagcggggccgcaaaagagggaugcggagccgccccagagccaauucuggaggcgucgaucucgacagcuccggggaauuugcuucuaucgagaagaugcuggcgacaaccgauaccaacaaauucagcccuuuucuccaaacagccgaagacaauacccaggaugagguggcuggagcccccgccgaccaccacggcccuuccgaugaggaacagggcucucccccggaggacaagcugcuucgggcuaaacgcaacagcuacacaaauugucugcagaagauuacgugcccucauugucccagaguuuuccccugggccuccagccuccaacggcacaugcugacccauacagggcagaagccuuuuccgugccagaaaugugaugcguucuuuucuaccaaguccaacugcgaaagacaccagcugcgcaaacauggagugacaaccuguagccuucggagaaacggccugaucccccaauccaaggagucugacgucgggagccacgauuccacgggagaacgcccuuauaaaugccagaccugugagcggacauucacccucaagcacucucuggugagacaucagcgcauccaccagaaggcucggcaugccaaacaccacggcaaggacagcgacaaagaagagagaggggaggaagauuccgagaaugaaagcacacauucuggaaacaaugccguuuccgagaacgaagcugagcucgcccccaaugcgagcaaccacauggccgugacccgcucucggaaggagggccuggcuuccgccacaaaagacugcagccauagagaagagaaggucaccgcuggcuggccuucugaacccgggcaaggagaucuuaauccugagagccccgccgcucugggccaggaccugcucgagccgcgguccaagcgcccugcccaccccauucuggcgacggccgauggggcuucucagcuugugggaauggaauga

SEQ ID NO: 75107 - RNA, 1014 nt, Artificial Sequence
  derived and/or modified sequence opt5 from RRH__Homo_sapiens__NP_006574
augcugagaaacaaucucggcaacagcuccgacucuaagaaugaggaugggagcguguucucccagaccgaacacaacaucgucgccacauaccugauuauggcuggaaugaucucuauuaucagcaauauuaucguucuuggcaucuuuauuaaauauaaggagcugcggacgcccaccaacgccaucauuaucaaucucgcggugacagacauugggguguccucuaucggauacccuaugagcgcugccuccgaucuguauggcagcuggaaauucggguacgccggaugccaagucuaugcuggccuuaacaucuuuuucggcauggccucuauugggcugcucaccgugguugcuguggaccgcuaccugacaaucugucugccggaugucggaagacggaugaccacaaauaccuauauuggccucauccugggggccuggauuaacggacuguuuugggcgcuuaugcccaucauuggcugggccuccuacgcuccugaccccacgggggcuaccugcacaaucaauuggcgcaagaacgaucggagcuucgugucuuacaccaugacaguuaucgccauuaauuuuaucgugccucucaccgucauguucuauuguuacuaucaugugacgcuguccauuaaacaccauacaaccagcgacugcacagaaucucuuaacagagauugguccgaccagaucgaugugaccaagaugagcgucauuaugaucuguauguuucugguugccuggucccccuacucuaucgugugccucugggcgagcuucggagacccuaagaaaauuccgcccccuauggccaucauugcuccccuguuugccaaguccagcaccuucuauaauccuuguaucuacguggucgcuaacaaaaaguuucgcagagccaugcuggccauguucaaaugccagacacaccagacgaugcccgugaccucuauucucccgauggauguuucccaaaacccucuggcuagcggccggaucuga

SEQ ID NO: 75108 - RNA, 2379 nt, Artificial Sequence
  derived and/or modified sequence opt5 from RRM1__Homo_sapiens__NP_001024
augcacgugaucaagagagacggccggcaggagcgcgucauguucgauaaaauuaccagcagaauccaaaagcugugcuacgggcucaacauggacuuuguugaucccgcccagauuacaaugaaagugauccagggacuguauuccggcgugacgaccgucgaacuugacacacuggcugccgagaccgcggcuacacucaccacaaagcauccugauuacgccauucuggccgcucggaucgccgugucuaaucuucacaaagaaaccaagaagguuuucagcgacgugauggaggaucuguauaacuacaucaauccgcauaacgggaaacacucccccauggucgcuaagucuacgcucgacauugugcuggccaauaaagaucgccugaacagcgcgaucauuuaugacagagauuuuuccuacaauuauuucggauuuaagacccucgaacggucuuaccugcuuaaaaucaacggcaagguugccgagcgcccucagcauaugcugaugagagugagcgucgggauucacaaggaggacaucgaugcugccauugaaacauacaaucuccuguccgagcggugguucacccacgcuagccccacacuuuuuaacgccggaaccaaucgcccucaacugucuuccuguuuccuccugagcaugaaagacgacucuaucgaaggcaucuaugauacgcugaagcagugcgcgcucauuuccaaaagcgccggcgggaucggaguggcugugucuuguauuagagccacaggcuccuacaucgcugggaccaacggaaauagcaacggccugguccccaugcuucggguuuauaauaacacagcccgcuacguggaccaagggggaaacaagagaccuggcgccuuugcuauuuaucuggagccguggcaucucgauaucuucgaguuucuggaccuuaaaaagaauaccggcaaagaggaacagcgggcgcgcgaucuguucuuugcccucuggauccccgaccuguucaugaagagaguggaaaccaaccaggauuggucccugaugugcccuaaugagugucccgggcucgacgaagucuggggagaggaguucgaaaagcuguacgcuucuuaugagaaacagggccgggugagaaagguugugaaagcccagcagcuuugguacgccauuaucgaaagccaaacagagacggggaccccuuacaugcuguauaaggauuccugcaaccgcaaaagcaaucagcagaaccucggaacaauuaaguguucuaaucugugcaccgaaaucgucgaguacacauccaaggacgagguggcuguuuguaaccuugccagccuggcgcucaauauguaugugaccucugaacacacguacgauuuuaaaaagcuggcugaggucacaaaaguggucgugcggaaccugaauaagauuaucgacaucaacuauuaccccguuccggaagccugccucagcaauaaaagacaucgcccuauuggcaucggggugcaaggacuggccgacgcuuucauucuuaugcgguaucccuuugaguccgccgaagcucagcugcucaacaagcagaucuucgagaccauuuacuacggcgcccuggaggcgucuugugaucuggccaaggaacagggcccuuaugagaccuacgaagggagccccgucuccaaaggaauccuucaauaugacauguggaaugugacacccaccgaucucugggacuggaagguucugaaagagaagauugcuaaauacggcaucagaaacagccugcucaucgccccuaugccgacagcuucuacggcccagauucuggggaacaaugaguccaucgaacccuauaccagcaacauuuacacacgccgggugcuuucuggagaguuucagaucgucaauccucaucugcucaaggaucugaccgaaagaggccuguggcacgaggaaaugaagaaccagauuaucgcgugcaauggguccauccaaagcauucccgagaucccugacgaucuuaaacagcucuauaagacagugugggagauuucccagaaaaccgugcugaagauggccgcugaacgcggcgccuucaucgaccagucucaaagccugaacauucacaucgcugagcccaauuacggaaaacucacguccaugcacuuuuacggcuggaagcaggggcugaaaaccggaauguauuaccuucggacaagaccggccgccaacccuauccaguucacccugaauaaggaaaagcucaaagauaaggagaaaguuucuaaggaagaggaggaaaaagagcgcaacacagcugcgauggucugcagccuggaaaaucgggacgagugucugaugugcggcuccuga

SEQ ID NO: 75109 - RNA, 1272 nt, Artificial Sequence
  derived and/or modified sequence opt5 from RRM2B__Homo_sapiens__NP_001165948
augcugcuccugagacuucccccucaccggagccaugccuccccgcuggacugcaagcuccaggaucgcuguagaaaaugcuacucuccccggagcggccaggcuuguccucccgcccuggcggcugccuggcuucgcagaugcgagcggcgcgggggaagaccucggggcgggcgcagaaaggaacugacccucggacugcggcccgcccgcuguuccgcuccuggcccggccaaagacgaugcuuggagaccccaagccgggcggucuagcuccgacacaaacgagucugaaaucaagagcaaugaggaaccucugcuccgcaaauccagcagacgguucgugauuuuucccauccaguauccugauauuuggaagauguacaagcaggcgcaagccucuuucuggacggcugaggaggucgaccuguccaaagaucuuccccacuggaacaagcugaaagccgacgaaaaguauuuuaucagccauauucucgcuuucuuugccgcgucugauggaaucguuaaugagaaccugguggaaagauucucccaggaggugcaggucccggaggcccgcugcuuuuacggcuuccagauccuuauugaaaaugugcacagcgagauguauucucugcucaucgacaccuacauucgggauccuaaaaagagagaauuucuguucaacgcuaucgagacaaugcccuauguuaagaaaaaggccgacugggcucugcgcuggauugccgaucggaaauccaccuuuggcgaaagaguggucgccuucgcugcgguggaggggguuuucuucagcggauccuucgccgcuaucuuuuggcucaagaaacgcggccugaugccugggcuuacauucucuaaugagcugauuagccgggacgaaggacuccauugugacuuugccugccugauguuccaauaccuugugaacaagcccuccgaggaaagaguccgcgagaucaucguggaugccgugaaaauugaacaggaguuucugaccgaggcucuccccgucggccugaucgggaugaauuguauucugaugaagcaguacaucgaauuuguugccgaccggcuccugguggagcuuggauuuagcaagguguuccaggcggaaaacccuuuugauuucauggagaauauuucucuggaaggcaaaacaaacuuuuucgagaagagagucuccgaguaucaacgcuuugcugugauggccgaaaccacggacaauguuuucacccucgaugccgacuucuga

SEQ ID NO: 75110 - RNA, 1170 nt, Artificial Sequence
  derived and/or modified sequence opt5 from RRM2__Homo_sapiens__NP_001025
augcugagccucagagugccccuggccccuaucaccgacccgcagcaacuucagcugagcccccucaagggccugucucuugucgauaaagagaacacaccucccgcucugagcgggacgcggguucucgccuccaagaccgcgcgcagaauuuuccaggaaccuacagagcccaaaaccaaggcugccgccccuggaguggaagacgagccgcugcugcgggaaaauccccgcagauuugugaucuucccuauugaguaccacgauaucuggcagauguauaaaaaggcugaggccucuuuuuggacagcugaagaggucgaccucagcaaggauauucaacauugggaaucccugaaacccgaggagcgguacuucaucucucacgugcuugccuuuuucgcggccagcgacggcaucguuaacgaaaaucugguggagcgcuuuucccaggaaguccagauuaccgaggcuagaugcuucuauggguuucagaucgccauggaaaacauucauagcgagauguacucucuccugaucgauacauauauuaaggacccuaaagagcgggaauuucuuuuuaaugcuaucgagaccaugcccugugugaagaaaaaggccgauugggcgcugcgcuggauuggagacaaggaagccacguacggcgagagaguuguggcuuucgccgcugucgaagggaucuuuuucuccggauccuucgccucuaucuuuuggcucaaaaagcggggccugaugccgggccugaccuucuccaacgagcucauuagccgcgaugaggggcugcacugcgacuuugccugucuuauguucaaacaucuggugcacaagccuucugaagagagagugcgggaaaucauuaucaaugcuguccgcauugagcaagaauuucucacagaggcgcugcccguuaaacuuaucggaaugaacugcacccugaugaagcaguauaucgaguucguggccgauagacucaugcuggaacugggcuuuuccaaaguguuccgggucgagaauccuuuugacuucauggaaaacauuagccucgaggggaagacaaauuucuucgagaagagagugggagaauaccagcgcaugggcguuauguccucucccaccgagaacagcuuuacgcuggacgcugauuucuga

SEQ ID NO: 75111 - RNA, 1866 nt, Artificial Sequence
  derived and/or modified sequence opt5 from RRN3__Homo_sapiens__NP_001287993
auggccgcuccccugcuccacaccagacugccuggcgacgccgcggcuagcuccucugccgugaagaaacuuggggccagccggacaggaaucuccaacaugcgcgcucuggagaaugauuucuuuaacucuccgcccagaaagacgguccgguucggcgggaccguuacagaagugcuccugaaauacaagaaaggagagaccaaugacuuugaacuucugaagaaccagcuccuggauccugacauuaagcgccugcccuggcucaauagaagccaaacaguggucgaggaauaucuggccuuccuuggcaaccugguguccgcucagaccguuuuucuccggccuugccugucuaugaucgccagccauuucgugcccccucgcgucauuaucaaagagggggauguggacguuuccgauagcgacgaugaggacgauaaucuuccggcgaacuuugacacaugucacagagcccugcagauuaucgcucgguacgugcccucuaccccuugguuccucaugcccauccuggucgaaaaguuuccuuucgugcgcaaauccgagagaacgcuggaaugcuaugugcauaaucuccugcggauuagcgucuacuuucccacccuucgccacgagauccuggagcucauuaucgaaaagcugcuuaaacuggauguuaacgccucuagacagggaauugaggacgcugaagagacagccacccaaacauguggcggcaccgacuccacggaagggcucuuuaauauggaugaggacgaggaaacagagcaugaaaccaaggcgggaccggagcggcuggaucagauggugcacccuguggccgaacgccuggacauccucaugagccugguccuuucuuauaugaaggaugugugcuacguugacggcaaaguggauaacgggaagacaaaagaccuguauagagaucucauuaauaucuuugacaagcugcuucugcccacccacgcuuccugucauguccaguucuucauguuuuaccucugcagcuucaaacugggauuugccgaggcuuuccuggagcaccucuggaagaaacugcaggauccuuccaaccccgccaucauucggcaagccgcuggcaauuacaucgggucuuuucuugcgagagccaaguucauuccccugaucaccgugaaaagcugucucgaccugcugguuaacuggcuucauauuuaucucaacaaucaggacuccggaacaaaggcuuuuugcgauguggcccugcacggcccuuucuacagcgccugucaggcugucuuuuauacguucguguuucgccacaagcagcugcucucuggcaaccugaaagaagggcuucaauaccugcagucccucaauuucgagcggaucgucaugagccagcugaacccgcugaagaucugccuucccucugugguuaauuucuucgccgcgauuaccaacaaauaucaacucguguucuguuacacaaucauugaaagaaauaaccgccagaugcugccugucauccggagcaccgcuggaggcgacuccgugcagauuugcacaaauccccuggauaccuuuuucccuuuugaccccugcguucucaagagaucuaagaaauucaucgauccgaucuaucaggugugggaggacaugagcgccgaggaacugcaagaguuuaagaaaccuaugaagaaagauauugucgaagacgaggaugacgauuuccuuaagggggaagugccccagaacgacacggugaucggaauuacaccuuccagcuuugauacccauuuccgcucucccuccagcucuguuggcuccccucccguccuguacaugcagccgagcccucucuga

SEQ ID NO: 75112 - RNA, 834 nt, Artificial Sequence
  derived and/or modified sequence opt5 from RRNAD1__Homo_sapiens__NP_001136032
augcccggcaucagcgccagagggcugucccacgagggacggaagcagcucgcugugaaccugacccgcguccuugcccuguacagaucuauucucgacgcguauaucauugaguucuuuacagauaaucugugggacacgcuuccuugcagcuggcaagaagcucuggauggccucaaaccgccccagcuggccaccaugcugcucgggaugccuggagaaggcgagguugugcgguaccgcuccguguggccccugacacuucuggcccucaagucuaccgcuugugcccuggcuuucacaagaaugccuggguuucagacccccagcgaguuccuugaaaacccuucccagucuagccggcugacagccccguuucgcaaacaugucagacccaagaaacaacacgagauccggcgccucggagaacuggugaagaagcuguccgacuucaccggcugcacgcagguuguggaugucggcagcgggcagggacaucucucuagauuuauggcgcugggccuugggcugauggugaaauccauugagggagaccagcggcucguugaacgcgcccaaagacuggaucaggagcuucugcaggcucucgagaaggaagagaaacggaauccucagaucugugccgcuggcgccaccgcgagcggggcccgcucucccgcugccacagaauccggaugcccuagcggccccagaggcccgggggagccuuguggaggccugcugcaacccgggucuaccgcuugcccuacaggaggcgacgccuauuccaccgggcccgccgcugugcccagcggaacgggcuucccuuguuga

SEQ ID NO: 75113 - RNA, 2277 nt, Artificial Sequence
  derived and/or modified sequence opt5 from RRP1B__Homo_sapiens__NP_055871
auggcccccgcuaugcagccugccgagauccaauucgcgcagagacuggcuagcuccgaaaagggcauucgggaccgcgccgugaaaaagcucagacaguacaucucugucaaaacccagcgggagacagggggauuuagccaagaagaacugcuuaagauuuggaaaggccuguucuauugcauguggguucaggaugaaccgcuccugcaggaggagcuugccaacacgaucgcucagcuggugcacgccgugaauaacuccgcugcccaacaucucuuuauucagaccuucuggcagacaaugaaucgcgaauggaaggggaucgacagacugcggcuggauaaguacuauaugcucauccgccugguccuuagacagucuuuugaggugcugaaacggaacggaugggaagagagccgcauuaagguuuuccucgacgugcugaugaaagagguccuuugucccgaaucccaaucuccuaauggcgugagauuucacuucaucgauauuuaccuggacgagcucagcaagguugggggaaaagaacugcuggcggaucagaaccucaaguuuaucgaccccuucugcaagauugccgcuaaaaccaaggaucauacacuggugcagaccaucgcccggggcgucuuugaggcuauuguggaccaauccccuuucgugcccgaagagacaauggaggaacagaaaaccaaggucggcgauggggaccuuagcgccgaggaaaucccugagaaugaaguuucucugcgcagagcgguguccaaaaagaaaacggcccucggaaagaaccacagccggaaggauggccugucugacgagcgcgggagagacgauuguggaaccuuugaggacacaggcccgcuucugcaguucgauuauaaagcuguggccgaccggcuccuggaaaugaccuccagaaagaauacaccccauuucaaccgcaaacggcugagcaagcucaucaaaaaguuucaggaucugucugagggguccagcauuucccaacuuucuuucgcugaagacaucagcgccgaugaggacgaucagauucugucccagggaaagcacaaaaagaaaggcaauaagcuccuggagaaaaccaaccuugagaaggagaagggcagcagagucuuuugcguggaagaggaagacucugaguccagccugcagaaacgccggagaaagaaaaagaaaaagcaccaucuccaaccugagaaucccgggccuggaggcgccgcucccucucuggaacagaaccgcgggcgggagccggaagcgagcggacugaaggcccucaaagcuagaguugccgagccuggcgccgaagcuacguccucuacaggggaggagagcggauccgaacacccuccugccgugcccaugcauaauaagcgcaaacggcccagaaagaaaagcccucgcgcgcaccgggagaugcuggaaucugcuguccuuccgcccgaggauaugucccagagcggcccuucuggcucccacccccaggggccuagaggaagccccaccggcggggcccaacugcucaagcggaaacgcaagcugggagugguuccggugaacggcuccgggcugucuacacccgccuggcccccucuucagcaggaaggacccccuaccggccccgcugagggcgccaacagccauaccacacucccgcagagacggagacugcaaaagaaaaaggcugggccuggaucccuggagcucuguggccugcccucucagaaaacggccagccuuaagaaacgcaagaagaugcgggucauguccaaucugguggaacacaacgggguccucgagagcgaagcgggacagccccaagcccugggcuccuccgggaccugcagcucucugaaaaagcagaaacuuagagcugaguccgacuucgugaaguuugacacaccuuuccucccgaaaccccuguuuuuccgcagagccaagagcucuaccgcuacacauccucccggcccugccguucagcugaauaagacccccagcuccagcaaaaaggugacguuuggacucaaccggaauaugacagcggaguucaaaaagaccgauaaaucuauccuggucuccccuaccggccccagccgcguggccuuugacccggaacagaagccucuucacgggguucugaagacacccaccuccucuccugcuagcucuccccucguggccaaaaagccgcugacaacgaccccuagacggcgccccagagcuauggauuucuuuuga

SEQ ID NO: 75114 - RNA, 1386 nt, Artificial Sequence
  derived and/or modified sequence opt5 from RRP1__Homo_sapiens__NP_003674
auggugagcagaguccagcugcccccugagauccaacucgcccagcggcuggcuggcaacgaacagguuacccgcgacagagccgugcggaaacuucgcaaguacauuguggcgagaacacagcgggcugccgggggauucacgcacgaugagcugcucaaggucuggaaaggccuguuuuauugcauguggaugcaagacaagccgcuucugcaggaagaacucgggcgcaccaucucccagcuggugcaugccuuccagacaaccgaagcucaacaccuguuucuccaggccuucuggcagacaaugaauagagaguggaccggaauugaucggcugcgccuugacaaauuuuacaugcugaugagaaugguucucaacgagucucugaaggugcuuaagaugcagggcugggaagaacggcaaaucgaagaacugcucgagcugcugaugacagaaauucuccaucccagcucccaggcuccuaauggggucaaaucucacuucaucgagaucuuucuggaggagcuuaccaaggugggagccgaggagcugacggcggaucagaaccucaaauucauugaccccuuuugucgcaucgccgcuagaaccaaggauagccugguucuuaauaacauuacacggggcaucuucgagaccauuguggaacaagccccucuggcuaucgaggaccuccugaaugaacuggauacacaggacgaggaagucgccuccgauucugacgagagcuccgagggcggggaacgcggagaugcgcucagccagaaaagaucugagaagcccccugccggcuccauuugccgggcugaaccggaggccggggaggagcaggcuggagacgacagagauagcggcgggcccgugcugcaauuugacuaugaggccguggccaaccgccuuuucgaaauggcuucucggcaguccaccccuagccagaauagaaagcgccuguacaaagucauccggaagcuccaggaucuggcgggaggcaucuuucccgaggacgaaauuccugagaaagccuguagacgccuucuggagggccggagacaaaagaaaacgaagaaacagaagcgccuccugcggcugcagcaggaaagagggaagggagagaaagaacccccgucuccuggcauggagcgcaagcgguccagacggcgcgggguuggagcugaucccgaagccagagccgaggcuggcgagcaaccugggacagccgaacgggcgcuccugagagaccagccccgcggacggggccagagaggcgcucgccagagacggcgcacccccagaccucuuacaagcgcccgggccaaagcugccaacgugcaagagccggaaaagaaaaagaagcgcagagaguga

SEQ ID NO: 75115 - RNA, 1428 nt, Artificial Sequence
  derived and/or modified sequence opt5 from RRP9__Homo_sapiens__NP_004695
augagcgccaccgcugccgcgagaaagcggggcaaacccgcuuccggggccggagccggcgcuggggccggaaagcgcagacggaaagcugacucugccggcgaucgcgggaaaagcaaaggaggcggcaagaugaacgaggaaaucuccucugacagcgaguccgaaucucuggcgccuagaaagccggaggaagaggaggaagaggaacucgaggagacagcccaggaaaagaagcugcggcuugcuaaacuguaccucgagcaacugcgccagcaggaagaggaaaaggccgaggcuagagccuucgaggaagaucagguggcggggcggcuuaaagaggacguccuggaacaacgcggaagacuccagaagcugguugccaaggagauucaggcucccgccagcgcugauauccgggugcugcgcggccaccagcucuccauuacgugccugguggucaccccugacgauagcgccaucuuuucugccgcuaaagacuguuccauuaucaaguggagcguggaaucugggagaaaacuucauguuaucccccgggcgaagaaaggagccgagggcaagccucccgggcacuccagccaugugcugugcauggcuauuucuuccgauggaaaauaucucgccagcggcgaccgcuccaagcugauccuuauuugggaggcccaaucuugucagcaccuguacacauucaccggccauagagaugcugucagcgggcucgccuuucggagaggaacacaccagcuguauuccaccagccacgaccgcucugugaagguuuggaauguggcggaaaacuccuacgucgagacacuguucggccaucaggaugcuguggccgcccucgacgcucugagccgggaaugcugugugaccgccgggggaagagacggcacgguccgcguuuggaaaaucccugaggaaucucaacuuguguuuuaugggcaccagggaagcauugauugcauccaucugauuaaugaggagcacaugguguccggcgcugacgauggcucugucgcccucugggggcugagcaagaaacggccgcuugcgcugcagagagaagcccacggacuccgcggcgagcccgggcuggaacaaccuuucuggaucuccagcguggcugcccugcucaacaccgaccugguugcuacaggaucucauuccagcugugugcggcuuuggcagugcggcgagggguuuagacagcuggaucuccugugugacaucccccuugucggcuucauuaauucucugaaguuuuccagcuccggagauuuccucguggccggcguugggcaggagcaccgccugggacggugguggagaaucaaagaagcgcgcaacucugugugcauuaucccucugcggagaguccccgugccgccugccgcuggcagcuga

SEQ ID NO: 75116 - RNA, 1098 nt, Artificial Sequence
  derived and/or modified sequence opt5 from RRS1__Homo_sapiens__NP_055984
auggagggccagagcguggaggaacugcucgccaaggcugaacaagacgaggccgaaaaacugcagagaaucaccguccacaaggagcuugagcugcaguucgaucucgggaaccugcuugcguccgaccggaaucccccuacaggacugcgcugcgcuggcccgacgcccgaagccgagcuccaggcccuggcuagagauaacacccaacugcucauuaaucagcuguggcagcuuccuacagaacggguugaggaggccaucguggcucgccugcccgaaccuaccacaagacucccccgggagaaaccucugccgcgccccagaccucuuacccgguggcagcaauuugcccgccugaaggggauuagacccaaaaagaagacaaaccucgugugggacgaagucucuggacaguggcggcgcagauggggcuaccagcgggcgcgcgaugacaccaaagaguggcugaucgaagugccugggaaugccgauccccuggaggaccaguucgcuaagcggauucaagccaaaaaggagagaguugcuaaaaacgaacucaauagacugcgcaaccuugcccgggcgcauaagaugcagcugccgagcgccgcuggacuccacccuacgggccaucaguccaaggaggaacugggcagagccaugcaaguggcuaaagucucuaccgccagcguggggcgcuuucaggagcggcuucccaaggaaaaaguuccuagaggauccggcaagaaacgcaaguuccagccccuguuuggggauuucgccgcugagaaaaagaaucagcucgagcugcugcgggugaugaacucuaagaaaccccaacucgacgucacaagagcgaccaauaagcagaugcgcgaagaggaucaggaagaggccgcuaaacggagaaagaugagccagaaaggaaagcgcaagggcgggcggcaaggaccuggcggcaaaagaaaagggggaccgcccucccagggcgggaagcggaagggaggccugggagggaaaaugaacagcggcccucccggccuugggggaaagcgcaagggcgggcagagaccuggaggcaaacggagaaaguga

SEQ ID NO: 75117 - RNA, 675 nt, Artificial Sequence
  derived and/or modified sequence opt5 from RS1__Homo_sapiens__NP_000321
augagcagaaagaucgagggcuuccugcuccugcuucuguuuggguacgaagccacccucggacuguccucuacagaggacgaaggcgaggaucccugguaucagaaggcuugcaaaugugacugccaagggggaccuaacgcccuuuggagcgcgggcgcuacgucccuggauuguauuccggaaugccccuaccacaaaccucucggguucgagucuggagaggugacccccgaccagaucacauguagcaauccugaacaguaugucggcugguacuccucuuggaccgccaacaaggcccggcugaauagccagggcuuugggugcgcuuggcuguccaaauuccaagauagcucucaguggcuccagauugaccugaaggagaucaagguuauuuccggaauccuuacacagggccgcugugauaucgacgaauggaugaccaaauauagcgugcaauacagaacagaugagcggcugaacuggauuuauuacaaggaccagaccgggaauaaccgcguguuuuacggaaauucugauagaacguccaccguccagaaccuccugcggcccccuaucauuagccgcuucaucagacuuauuccgcugggcuggcaugugcggaucgccauucgcauggagcuccuggaaugcguuucuaaaugugcuuga

SEQ ID NO: 75118 - RNA, 1086 nt, Artificial Sequence
  derived and/or modified sequence opt5 from RSAD2__Homo_sapiens__XP_011508716
augugggugcugacccccgccgcuuucgccggcaagcuccugagcgucuuuagacagccucuuuccucucuguggcggagccucguuccgcuguucugcuggcuucgcgcgacauuuuggcugcucgcuacgaaaagacggaagcaacagcuggugcugcgcgggcccgacgaaaccaaagaagaggaagaggauccuccccucccuacaacccccacauccgugaacuaccacuucaccagacaguguaauuauaagugcggauuuuguuuccauacagccaaaaccucuuuuguccugccucuugaagaggccaagcggggccugcuccugcuuaaggaggcugggauggaaaagaucaacuucagcggaggcgagccguuucugcaggaccgcggggaauaccucggaaagcuggugagauucugcaaaguugagcugcggcuccccuccgugucuauugucagcaauggcucccugauccgcgagagaugguuucaaaacuauggcgaauaccuugauauucuggccaucagcugugacucuuucgaugaggaagugaauguucucauugggcggggacagggcaagaaaaaccacguggagaaucugcagaaacuucgcagauggugccgggacuaucgcgucgcuuuuaagaucaacuccgugaucaauagauucaacguggaagaggauaugacggagcagauuaaagcccugaauccuguccgguggaagguuuuccaaugucuccugaucgaaggggagaacugcggagaagacgcgcugagagaggccgaacgcuuugugauuggcgaugaggaguucgaacgguuucucgagagacauaaagaagugagcugucugguccccgagucuaaucagaagaugaaagacuccuaccuuauccuggaugaauauaugcgcuuccucaacugccggaaggggagaaaagacccuagcaagucuauucuggaugugggaguugaggaggcuaucaaguuuuccggcuucgacgagaaaauguuucuuaagcgcggcgggaaauacauuuggagcaaggccgaccugaaacucgauugguga

SEQ ID NO: 75119 - RNA, 4326 nt, Artificial Sequence
  derived and/or modified sequence opt5 from RSF1__Homo_sapiens__NP_057662
auggccaccgcugccgcggcugccgccgugauggcucccccuggcugcccggggagcugucccaacuucgccgucguuugcuccuuucuggagagauacggaccucuccuggaccuucccgaacugccuuuccccgagcucgaacgggugcugcaggcuccuccgcccgaugugggcaauggggaggucccuaaggaacuuguggagcugcaccucaaacugaugcgcaagaucggaaaaucuguuacagccgacagaugggagaaguaucugauuaaaaucugucaagaauuuaacagcacgugggcgugggagauggaaaagaagggcuaccucgagauguccguggagugcaaacuggcccuucugaaguaucucugugaaugccaguucgaugacaaucugaaauuuaagaacauuaucaaugaggaagaugcugacaccaugcggcuucagcccauugggcgcgauaaagacggacugauguacugguaucagcucgaucaagaccauaacgucagaauguacaucgaggaacaggaugaccaggauggcucuagcuggaaguguaucgugcggaaucgcaacgagcuggccgagacacuggcucuccugaaggcccagauugacccuguucuucugaaaaauuccucucaacaggacaacagcuccagagaaagccccucucucgaggaugaagagaccaagaaagaagaggagacaccgaagcaggaagaacagaaagaauccgagaagaugaaaagcgaggagcaaccuauggaccuggagaaucggucuaccgcgaacgugcuugaagagacaaccgucaagaaggaaaaagaggaugagaaggaacuggugaaacuccccgugaucgucaagcuggagaaaccucugcccgaaaaugaggaaaagaagauuaucaaagaggaguccgacagcuucaaggaaaacguuaaacccauuaagguggaggugaaagaaugccgcgccgauccuaaggacacgaagucuuccauggagaaaccggucgcucaggaacccgagagaaucgaguuuggcgggaauauuaagagcucccacgaaaucaccgagaaaucuacagaagagaccgaaaagcucaaaaacgaucagcaagccaagaucccucugaagaaacgggagauuaaacuuagcgacgauuucgacucccccgugaagggaccucuguguaagagcguuacacccaccaaagaguuucucaaggaugaaaucaaacaggaggaagagacgugcaagcgcauuucuacaaucaccgcucugggccaugaggggaagcagcuugugaacggagaagucuccgacgagagaguggccccgaauuucaaaacagaaccuauugagaccaaguuuuaugaaaccaaagaggagagcuacucucccagcaaggaccggaacaucaucacagaaggcaaugggacggagucccugaacucuguuauuaccagcaugaaaacaggagaacucgagaaggaaaccgccccucugcgcaaggaugcugacuccagcaucucugugcuggagauucacucccagaaagcgcaaaucgaggaacccgauccucccgagauggaaacaagccucgacucuuccgagauggccaaggaucugagcuccaaaaccgcucuuucuagcacggaauccuguacaaugaagggcgaggagaaaucuccgaagaccaagaaagacaagagaccucccauucuggaaugccucgagaaacuggaaaagagcaaaaagaccuuccuggauaaggacgcccagcggcuuucccccaucccugaggaggucccgaaaagcacacucgaaucugagaagcccggcuccccugaagccgcugagaccucucccccuagcaauaucauugaucauugcgaaaaacuggccuccgagaaggagguggucgaaugucagagcacaucuacgguugggggacagagcgugaaaaagguggaccuggagacccucaaagaagauuccgaguuuacaaaggucgaaauggacaaccuggauaaugcgcaaaccagcggcaucgaggagcccucugaaacaaagggguccaugcagaaaagcaaguucaaauacaaacuugugccugaggaagagaccacggcuuccgaaaacaccgagauuacaucugagagacagaaggaaggaaucaagcugaccauucgcaucagcucccggaagaaaaagcccgacucuccgccuaaaguucucgagcccgaaaauaagcaggagaaaacagagaaggaagaggaaaagaccaacgugggcagaacgcugcgccggagcccuagaauuucccgccccacagccaaagucgccgagauccgggaccaaaaggcugauaaaaagagaggggaaggagaggacgagguggaagaggaaucuaccgcccugcagaaaacagauaagaaggagauccuuaaaaagagcgaaaaagacaccaauuccaaggugagcaaaguuaagccgaagggcaaaguccgcuggaccggcucucggacaagagggcgcuggaaguauuccagcaacgaugagucugagggauccggcagcgaaaaaucuuccgcugccagcgaggaagaggaagagaaggaguccgaagaggcgauucucgccgacgaugacgaaccuugcaaaaagugugggcugcccaaucacccugagcugauccuccugugcgauagcugugacucuggauaccacacggcuugccuucggccuccccugaugauuauccccgauggcgagugguucuguccgcccugccagcauaaacuccugugugaaaagcuggaggaacagcuucaagaccucgauguggcccugaagaaaaaggagagagcugaacggcgcaaagagagacugguguaugucgggauuagcaucgagaacaucauuccuccccaggaaccugacuuuuccgaggaccaggaagagaagaaaaaggauucuaagaaaagcaaggccaaucuccuggaacggagauccacccgcacacggaaaugcaucucuuacagauucgacgaguuugaugaggcgauugacgaagccaucgaggaugacauuaaggaagcugauggcggaggcguggggcgcggaaaagacaucagcaccaucacaggccacagagggaaggauauuuccaccauccuugacgaggaacggaaggagaacaaacgcccccaaagagccgcugccgcccggcgcaagaaaagacggcgccugaacgaucucgacucugacagcaaucuggaugaggaagaguccgaagacgaguucaagauuagcgauggaucucaggacgaguuuguuguguccgaugaaaacccugacgagagcgaagaggauccgcccucuaaugacgauuccgacacggauuucuguagcagacggcugcgcagacauccuucccggcccaugagacagucucgccggcuuagacgcaaaacaccuaagaagaaauauagcgacgaugacgaagaggaggaauccgaggaaaacagccgggacucugaguccgauuuuagcgacgauuucucugacgauuuugucgaaaccagacgccggagaagccgccggaaucagaagagacaaaucaacuacaaagaggacuccgagucugauggcagccagaagucccuccggcgcgggaaagaaauuagacgggugcacaagcgcagacugucuagcuccgagagcgaagagucuuaucuguccaaaaauagcgaagacgaugagcucgcuaaggaguccaagcggucuguuagaaaacgcggccggagcaccgacgaauacuccgaggcggaugaagaggaggaagaggaagagggaaagcccucuagaaaacgccugcaccggaucgaaacagacgaggaggaaagcugcgauaacgcccauggcgacgcuaaucagccggccagagacucccagccucgcgugcuucccagcgagcaagaaucuaccaagaaacccuaccggaucgaguccgaugaagaggaggacuucgaaaacgucgggaaggugggaagcccucuggauuauucucucguugaccugcccuccacaaauggccagagcccugggaaggccauugagaaccugaucggaaaaccgacggaaaagucucagacccccaaagauaauagcacagcuuccgccucucuugcgagcaacggcaccuccgggggccaggaggcuggagccccugaagaggaggaagacgagcugcucagagugacagaucuggucgacuacgugugcaauagcgaacaacucuga

SEQ ID NO: 75120 - RNA, 1473 nt, Artificial Sequence
  derived and/or modified sequence opt5 from RSL1D1__Homo_sapiens__NP_056474
auggaggacagcgccuccgcuucucugagcuccgccgcggcuaccggcacaucuacgagcacccccgccgccccuacagcuagaaagcagcucgauaaagaacaagugcggaaggccgucgacgcucugcuuacccacugcaaaucccgcaagaacaauuacgggcugcuccugaacgagaaugaaucucuuuuccugaugguugugcucuggaaaaucccgagcaaggagcugagagugcggcugacacucccccauuccauucgcagcgauucugaagacaucugucuguuuaccaaggaugagccuaacuccacacccgagaaaaccgaacaguucuauagaaaacuucugaauaagcacggaauuaagacggucagccagaucauuucucuccagacccugaaaaaggaguacaaguccuaugaagccaaacuucggcugcucagcucuuuugacuucuuucugacagaugcgcgcaucagacggcugcucccuucccugaucggccgccauuucuaccaaagaaagaaagugcccguuagcgugaaccuucuguccaagaaucucucucgggagauuaacgacugcaucgggggaaccguccugaauauuagcaaauccggcagcuguucugccauccgcauugggcacgugggaaugcagaucgagcauauuaucgaaaacaucguugcugugacaaagggccuuuccgagaaacugccugaaaagugggagagcgucaagcuccuguuugugaaaaccgaaaagucugccgcucugccgauuuucagcuccuuugugucuaauugggaugaggccacgaaaagaagccuccugaacaagaaaaagaaggaggcgcggcgcaaaagacgggaaagaaauuucgagaagcagaaagaacgcaagaaaaagcggcagcaagccagaaagacagcuuccguccuuagcaaagacgauguugcccccgagucuggcgacaccacagugaagaaaccugaauccaagaaagagcagacccccgagcacgggaagaagaaacgcggacggggcaaggcucaggugaaagccaccaacgaaagcgaggaugaaaucccucagcugguccccauugggaagaaaacaccggccaaugagaagguggaaauccaaaaacacgcuacgggaaagaagucuccugcgaaaucccccaacccuagcacccccagaggcaagaaacgcaaggcccuccccgcuuccgagacaccuaaagccgccgagucugaaaccccgggaaagagccccgagaagaaaccuaagauuaaagaagaggcuguuaaggagaaaucccccucucuggggaagaaggacgcccggcagacaccuaaaaagcccgaagcgaaauuuuucaccacgccgagcaaguccgugagaaaagcuagccauacaccuaagaaguggcccaaaaagccuaaagucccccagucuaccuga

SEQ ID NO: 75121 - RNA, 492 nt, Artificial Sequence
  derived and/or modified sequence opt5 from RSL24D1__Homo_sapiens__NP_057388
augagaaucgagaagugcuacuucuguagcggccccauuuauccugggcacggaaugauguuugugcggaacgacugcaaagucuuccgcuuuuguaaguccaaaugccauaagaauuucaaaaagaagagaaacccgcggaaaguucgcuggaccaaggccuuuagaaaagcugccggcaaggaacugacaguggauaauucuuucgaguuugaaaaacggcgcaacgagcccaucaaguaccagagagaacucuggaauaagacgauugacgcgaugaaacggguggaggagaucaagcaaaaacgccaggcuaaguucauuaugaacagacugaaaaagaauaaagaacuucagaagguccaggauaucaaggaggugaaacaaaacauccaccugauucgggccccucucgccgggaagggaaaacagcuggaagagaagaugguucagcagcuucaagaggacguggauauggaagacgcucccuga

SEQ ID NO: 75122 - RNA, 930 nt, Artificial Sequence
  derived and/or modified sequence opt5 from RSPH1__Homo_sapiens__NP_543136
augagcgaccugggcuccgaggaacucgaggaagagggggaaaacgauaucggagaguacgagggcgggagaaaugaagccggagagcggcacggccgcgggagagcucggcugcccaacggagacaccuaugaaggcucuuacgaguucggcaagcgccaugggcagggaauuuauaaauuuaagaauggcgccagauacaucggggaguaugugcggaacaaaaagcacggacaaggcacauucauuuacccugaugggagccgcuaugaaggagagugggcgaaugaccuuagacauggccacggcgucuacuacuauaucaacaaugauacguacaccggggaaugguuugcucaucagcggcacggacagggcacauaucuguacgccgagaccggguccaaauauguuggaacaugggugaacggccagcaagaagggaccgccgagcucauucaccugaaucaucgcuaccagggaaaguuccuuaacaagaauccggugggccccggcaaauaugucuuugacguggggugcgagcagcacggagaauacagacugacagauauggagcggggcgaagaggaagaggaggaggaacucguuaccguggucccuaaguggaaagcuacgcagaucaccgaacuggcccuguggacacccacccucccuaagaaacccacaucuaccgacgggccuggacaagaugcuccgggcgccgagagcgcgggggaacccggcgaggaggcccaggcucugcuugaaggauucgagggcgaaauggacaugcgcccuggggaugaggacgccgaugugcugagagaggaaucccgggaguacgaccaggaagaguuucgcuaugacauggaugaaggaaacaucaauucugaggaggaagagacgagacagagcgaccuccaagauuga

SEQ ID NO: 75123 - RNA, 2151 nt, Artificial Sequence
  derived and/or modified sequence opt5 from RSPH4A__Homo_sapiens__NP_001010892
auggaggacagcaccucccccaagcaggaaaaagagaaccaagaggaacugggcgaaacaagacggccuugggaggggaagacggccgcuucuccgcaguacagcgagcccgaauccucugagccucucgaagccaaacagggacccgagaccggccgccagagcagauccucucggccuuggagcccccaaucccgcgcgaagacaccucugggaggaccggcuggccccgagaccagcucuccugcccccguguccccuagagaacccuccucuuccccgagcccucuugcccccgcucggcaggaucuggccgcuccuccccagucugaccgcacaaccuccgucauccccgaggccgggacaccuuauccggauccccucgaacagagcuccgacaaaagagagucuaccccucaccauacgagccaauccgaaggaaauaccuuccagcagagccagcaacccaagccucaccugugcggccggcgcgauguuucuuacaacaaugcgaagcagaaagagcuuagauuugacguguuccaggaggaagauuccaacagcgacuaugaucugcaacagcccgccccgggcgggucugagguggcuccuagcaugcucgaaauuacaauccagaaugccaaggcuuaccugcugaaaaccuccucuaacagcggauuuaaucucuaugaccaucuguccaacaugcuuacaaagauucugaaugagcggcccgaaaacgccgucgauaucuucgagaauauuagccaggacgugaaaauggcgcacuuuucuaagaaguucgaugcccuccaaaacgagaaugaacugcuuccuaccuacgagaucgcugaaaaacagaaggcccuguuucuccagggccaucuggaggggguugaccaggaacuggaggacgagaucgcugaaaacgcccuccccaaugugauggaguccgccuucuauuuugaacaagcuggagucggccuggggacggaugagacauaccgcauuuuccuugcgcugaaacagcucaccgacacacacccuauccagagaugucgguuuuggggaaagauucugggccuugagaugaacuacaucguggccgaaguugaguuccgcgaaggcgaggaugaagaggagguggaagaggaagacgucgcugaggaaagagauaacggggagagcgaggcccacgaagacgaggaagaugagcugcccaaaucuuuuuauaaggccccgcaggcuauuccuaaagaagagucccggaccggagccaauaaguacguguauuucgugugcaacgagcccggcagacccugggucaagcucccuccgguuauccccgcgcaaauugugaucgcucgcaaaaucaagaaauucuuuaccgggcggcuggacgccccuauuaucagcuaucccccuuuccccggaaaugaauccaacuaccugagagcccagauugcucgcaucucugccggcacacaugugagcccucucggguuuuaccaguucggagaggaagagggcgaggaagaggaagaggcugaaggcgggcggaauagcuuugaggagaaccccgauuucgaagggauucaggucaucgaccugguggagucucuuagcaauuggguucaccaugugcaacacauccugucccagggcagauguaacugguuuaauagcauucagaagaacgaagaggaagaggaggaagaggaugaagagaaagacgacucugauuauaucgaacaagaggucgggcucccgcugcuuacgccuauuuccgaggaccuggaaauccagaauauucccccuuggaccacacgccucagcucuaaccugaucccccaguacgccaucgcggugcugcaguccaaucucuggccgggagccuacgcuuucagcaacggcaagaaguuugagaauuucuauauuggguggggccacaaauacucuccugauaacuauacacccccuguucccccucccguguaccaagaauauccgagcggacccgagaucaccgagauggacgauccuuccgucgaagaggaacaggccuuucgggcugcccaggaggcggugcugcuugccgcugaaaacgaggagagcgaagaggacgaagaugaggaagacgauuacgacuga

SEQ ID NO: 75124 - RNA, 921 nt, Artificial Sequence
  derived and/or modified sequence opt5 from RSPH9__Homo_sapiens__NP_001180270
auggacgccgauagccugcuccugucccuugagcuggcuucuggcagcgggcagggacucucccccgacagacgggccucucugcuuaccagccugaugcucgugaagcgcgauuacagauaugaccggguccuguucuggggccgcauccuggggcucguugcggauuacuauauugcucaaggacuguccgaagaccagcuugccccuagaaaaacacuguacucucucaacugcacggaguggagccugcuuccgcccgccaccgaagagaugguggcucaguccagcguggucaagggccgguuuaugggggauccuucuuaugaauacgagcacacagagcugcagaaagugaaugaaggagagaagguuuucgaagaggagaucgugauugacaaagccgucgcuaucauuccccgcggcgcccucuuuaagaccccuuucggccccacacaugugaacagaaccuuugaagggcugucccugagcgaggcgaagaaacucucuuccuauuuccacuuucgggaaccuguugagcugaagaauaaaacacuucuggaaaaggccgaucucgacccgagccuggauuucauggacucucuugagcaugauauccccaaaggauccgaggcugugguccaaggcgacuuuaccuggcugcucagccgcuguggguucggauggccuugcuccugggacucuuguagcguguccaugagagugcuggaacaccccgauggcgaggggcagugcccuggaggcgccgcucagcccgcccuggcgggcccgcaucuccugccuuguagcccccaccaggaacuuuggcugcggcuccgcgggcacuggagagaggaacauggacuggcccuucacgcuaucgagugggagccugccuggauguuucugaaccgggucuga

SEQ ID NO: 75125 - RNA, 540 nt, Artificial Sequence
  derived and/or modified sequence opt5 from RSPO2__Homo_sapiens__NP_001269792
augcaguucagacuguuuagcuucgcccucaucauucugaacugcauggacuacucccacugucaaggcaaucgguggcgcagaucuaagcgggggugccgcaucgagaacugugauagcugcuuuuccaaagacuucuguaccaagugcaaagugggauuuuaucuucauagaggccgguguuucgaugaaugccccgacggguuugcuccucuggaggaaacaauggagugugucggaugcgaaguuggccacuggucugagugggggacguguagccgcaauaacagaaccugcggauucaaguggggccucgagacacggacccgccagauugugaaaaagccggugaaggauacaauccugugccccaccauugccgaauccagacgguguaaaaugacaaugcgccauugcccuggcgggaagagaacccccaaagcgaaggagaaacggaauaagaagaaaaagcgcaaacuuaucgaaagagcucaggagcagcacucugucuuucuggccacggaccgggccaaccaauga

SEQ ID NO: 75126 - RNA, 819 nt, Artificial Sequence
  derived and/or modified sequence opt5 from RSPO3__Homo_sapiens__NP_116173
augcaccugagacucaucagcuggcuguucauuauccuuaacuuuauggaguacauuggcucccagaaugccucucgggggcgcagacaacggcgcaugcaucccaacgugagccagggaugccagggcgggugugcuaccugcuccgacuauaauggaugucugucuugcaagccuagacucuucuuugcccuggaacggaucggcaugaaacagauuggggucugucuuagcuccugcccgucuggauacuauggcacacgcuaccccgauaucaacaaguguacgaaaugcaaggcggacugugauaccugcuucaauaaaaacuuuuguacaaagugcaagagcggcuucuaucugcaccucgggaaaugccuggacaauuguccugagggacuggaagcuaacaaucauaccauggagugcguuuccaucgugcacugugaagugagcgaguggaaccccuggucuccuugcacaaagaaaggcaagaccuguggguuuaaaagaggaacagagacccggguccgcgaaauuauccaacaucccuccgccaagggcaaucucugcccuccgacgaacgagaccagaaaguguacagugcagcggaaaaagugccagaaaggggaacgcggaaagaaaggcagagagcggaagcgcaaaaagcccaauaagggcgagagcaaagaagccauuccugauucuaagucccuggagagcucuaaagaaauccccgagcagagagaaaacaagcaacagcagaaaaagcggaagguucaggacaaacaaaaguccgugagcgucuccaccgugcacuga

SEQ ID NO: 75127 - RNA, 705 nt, Artificial Sequence
  derived and/or modified sequence opt5 from RSPO4__Homo_sapiens__NP_001025042
augagagcuccccugugccuccugcuucugguggcccacgccgucgacaugcucgcgcugaaccggcgcaagaaacagguuggcaccgggcuuggaggcaauuguacagggugcaucauuuguagcgaggaaaacggaugcuccacgugucaacagagacuguuccucuuuauccggcgcgagggcauuagacaguacgggaagugccugcaugauuguccuccgggauauuucggcauccggggccaggaagugaaucgcugcaaaaaguguggggcuaccugcgagucuuguuuuagccaagacuucugcauuagaugcaaacggcaguuuuaccuguauaagggaaagugucuccccacaugcccucccggcacccuggcccaccagaacacacgcgaaugucagggggagugcgagcuuggaccuuggggcggguggucccccuguacccauaauggaaaaacaugcggcucugccuggggccuggaaagcagagugcgggaggcugggcgcgccggacacgaagaggcugccaccugucaaguccucuccgagucuagaaagugcccuauccagcggccgugucccggcgaacgcagcccugggcagaaaaagggaagaaaagaucggagaccccgcaaggaccggaagcuggauagacgccuugacgugcggccuagacagcccggccugcaaccguga

SEQ ID NO: 75128 - RNA, 831 nt, Artificial Sequence
  derived and/or modified sequence opt5 from RSRC1__Homo_sapiens__NP_001258763
augggcagacggagcuccgacaccgaggaagagucucgcagcaagcggaaaaagaaacacagacgcagauccucuagcuccucuagcuccgauagccggacauacucucgcaagaaagggggaagaaagucccggagcaagucucgcuccuggagcagagaccugcagccccggucucauuccuaugaucgcagacggcgccacagaagcuccucuagcuccagcuacggcucucggagaaaacgcucccggagcagaucucgcgggcggggaaagagcuauagagugcaacgcucccggucuaaaagcagaacgcgccgggaauccggcaacaucaaggccgggcucgagcaucugccuccggcugaacaggccaaagcgagacuucagcugguccucgaggcugccgccaaggcugacgaggcccugaaggcuaaagaacgcaaugaggaagaggccaagcggagaaaagaggaagaucaggcgacccuuguugagcaagugaagcgggugaaagaaauugaggccaucgaaagcgacucuuucguccagcagacauuucgcuccagcaaggaggugaaaaagucuguugagcccuccgaagugaagcaggcuaccagcacauccggaccugccucugcugucgccgaucccccuagcaccgagaaagaaauugaccccacauccaucccuaccgcgauuaaguaccaagaugacaacucucuggcccacccgaaucucuucaucgagaaagcugaugccgaagagaagugguuuaaaagacugaucgcucugcggcaggagagacucaugggcagccccguggccuga

SEQ ID NO: 75129 - RNA, 1305 nt, Artificial Sequence
  derived and/or modified sequence opt5 from RSRC2__Homo_sapiens__NP_075388
auggccgcuagcgacaccgagagagauggccuggcccccgaaaagacauccccugaccgggauaaaaagaaagagcagucugaagugagcgucuccccgcgcgcgucuaagcaccauuacagcagaucccggucucgcagcagagagcggaaacgcaaguccgacaacgaagggagaaagcaccggagccgcucuagauccaaagagggacggcgccaugagagcaaggauaaaucuuccaagaaacacaagagcgaggaacauaaugacaaggaacacucuuccgauaaaggcagagagcggcucaacagcuccgagaauggggaagaccgccacaagagaaaagagcggaagucuagcagaggacgcucccauagccggucuagaucccgcgaacggagacaccgcagccggucuagagagcgcaaaaagagccgguccagaucucgcgaacggaaaaagagcagaucccggagccgcgagagaaagaaaucucgguccagaagccgcgagcggaagagacgcaucagaucucggucccgcagcagaucccggcaucgccacagaacgcggucucgcagcagaacccggucccgcucuagagaucggaaaaagagaauugaaaaaccccgccgguucagcagaucccugagccgcacaccuucucccccucccuuucggggcagaaacaccgcuauggacgcccaagaggcccuugcucgccggcuggaaagagccaagaagcuccaggagcagcgcgaaaaagagaugguugagaagcagaaacaacaggaaaucgcugccgcggccgcuacagggggauccgugcugaauguggccgcccuucuggcuagcggcacccaggucacaccucagauugcgauggccgcucaaauggccgcucuccaggccaaggcccuggcugagaccggcaucgcggugccgucuuauuacaaccccgccgcuguuaauccuaugaaauucgccgaacaggagaagaagcggaaaaugcuguggcaggggaagaaagaaggagauaagucccaaagcgccgagauuugggagaaacucaacuuuggcaauaaggaccagaacgugaaguucagaaaacugauggggaucaagucugaagaugaggcuggaugcagcuccgucgacgaagagagcuauaaaacgcuuaagcagcaagaggaaguguuucggaaucuggacgcccaguacgagauggcgcgcucucagacccacacacagagaggcauggggcucggauucaccuccagcaugcggggcauggaugcuguuuga

SEQ ID NO: 75130 - RNA, 681 nt, Artificial Sequence
  derived and/or modified sequence opt5 from RSRP1__Homo_sapiens__XP_011540100
augagcaacuacgugaaugacauguggcccggcuccccucaggagaaggauucuccgagcaccuccagaucugggggaagcucccggcugucuagccgcuccagaagccggucuuucucccgcagcucuagaucccacagccgggucucuucccgcuuuagcuccagaucucggcgcagcaaauccagaagccggucucgcagacggcaucaacgcaaguauagacgguacuccagaagcuauucucgcagccgguccagaucucgcagccggagauaccgcgaacggagauauggcuucacacgccgguacuauagaucccccagccgcuaccggucuagaucccggagccgcucuagaucccgggggagaagcuacugcggacgcgccuaugcuaucgcccggggccagagauacuauggguuuggacgcacgguuuacccugaggaacacuccagauggcgggaccgcucuagaacccggagccgcuccagaacacccuuccggcucucugagaaagaucgcauggaacugcuugagauugcgaagaccaacgcugccaaagcccugggcacaaccaauaucgaccucccugcuagccugagaacagugcccuccgccaaggagaccagccggggcauuggggugucuuccaacggagcuaagccugaaauguuuuga

SEQ ID NO: 75131 - RNA, 834 nt, Artificial Sequence
  derived and/or modified sequence opt5 from RSU1__Homo_sapiens__NP_036557
augagcaagucccugaaaaagcucguggaggaaucuagagagaaaaaccagcccgaagucgacaugagcgaucggggcaucuccaauaugcuggacguuaacgggcuuuucacccugucucacauuacacaacucgugcugagccauaauaaacuuacgauggugccuccgaacaucgccgagcugaagaaucucgaaguccugaacuuuuucaauaaccagauugaggagcugcccacccagaucuccucucuccagaagcugaagcaccuuaaucugggaaugaaccgccucaauacacugccuagaggcuuugggagccuucccgcucuggaagugcucgaucugaccuacaacaaucuguccgagaacagccucccuggaaauuucuuuuaucugacaacccuucgggcccuguaccucucugacaacgauuucgaaauucugcccccugacaucggcaaacuuacaaagcugcaaauccucucccugcgcgauaacgaccugauuagccucccgaaagagaucggggagcugacccagcuuaaggaacugcauauucagggaaauagacucacgguucugcccccugagcuuggcaaccuggaucucaccggccagaaacaaguguuuaaggcggaaaauaaccccugggucacaccuaucgcugaccaguuccagcugggggugucucacguuuuugaguauauucgguccgaaaccuacaaguaucuguacggacgccauaugcaggccaaucccgagccgccuaaaaagaacaaugauaaaagcaagaaaaucucuagaaagccccucgccgcuaaaaaccgguga

SEQ ID NO: 75132 - RNA, 1518 nt, Artificial Sequence
  derived and/or modified sequence opt5 from RTCB__Homo_sapiens__NP_055121
augagcagauccuacaacgacgagcugcaguuccucgaaaagaucaauaaaaacugcuggcggauuaagaaaggcuuugugcccaauaugcaagucgaggggguuuucuaugugaacgaugcccuggaaaaacuuauguuugaggaacugcgcaaugcuuguagaggaggcggggugggaggcuuccucccugccaugaagcagaucgggaacgucgcggcucugccgggaauugugcaccggucuaucggccuucccgacguucauagcggcuacggguuugccauuggaaauauggccgcuuucgauaugaacgacccugaggccguggucucccccggcggggugggauuugauaucaauugcggcguucgccugcucagaaccaaccuggacgagucugaugugcagccugucaaggaacagcuggcucaagccauguucgaccacauccccgugggggugggaagcaagggcgucauuccuaugaaugcgaaagaucucgaggaagcccuggagaugggcguugacuggucccuucgggagggguaugcuugggccgaagauaaggagcauugugaagaguacggacgcaugcugcaggcugacccgaacaaagugucugccagagcgaagaaacggggccucccccagcuggggacacuuggagccggcaaucacuaugcugaaauccagguggucgaugagauuuuuaacgaguacgccgcuaagaagauggggaucgaccauaaaggacaagugugcguuaugauucacagcggcucccgcggccuggggcaccagguggccacggacgcccucgucgcuauggaaaaggcgaugaaaagagauaagaucauugugaaugaccggcagcuggccugugcucgcaucgccagcccugagggacaggauuaucugaaaggcauggccgcugccgggaacuacgcguggguuaacagaucuuccaugaccuuccucacacggcaggcuuuugccaagguguucaauaccacacccgacgaucuggaccuucaugucaucuacgaugugagccacaacauugccaaagucgaacaacaugugguugacggaaaggagcgcacccugcucgugcacagaaagggcucuacacgggcuuuuccuccccaccauccgcugaucgccgucgauuaucagcuuaccgggcaaccugugcugauuggcggaacgaugggaaccugcuccuacguucucacagggaccgaacagggaaugacagagaccuucggcacgacaugucacggggcuggcagagcccugagccgcgcgaaaucucggagaaaucuggacuuccaggaugugcucgacaagcuggccgacaugggcaucgcuauucgcgucgccucccccaaacuugugauggaggaagcuccugagagcuauaagaacgugaccgauguugucaauacaugccaugacgccgggaucuccaaaaaggcgaucaagcugcggcccauugccgugaucaaaggcuga

SEQ ID NO: 75133 - RNA, 3903 nt, Artificial Sequence
  derived and/or modified sequence opt5 from RTEL1__Homo_sapiens__NP_001269938
augcccaagaucgugcugaacggcgucaccguugacuucccuuuucagccguacaaaugccaacaggaguauaugacaaaggugcucgaaugucugcagcagaaagugaaugggauucuugagagccccacgggaaccggcaagacacugugccuccuguguaccacacuugccuggagagaacaucugcgggaugggaucuccgcucgcaaaauugccgagagagcgcaaggagaacucuucccugaccgggcucugucuagcuggggcaacgccgccgcugccgcuggggaucccaucgccugcuacaccgacauuccuaagaucaucuaugcgucccgcacacacucucagcugacccaggucauuaaugagcucagaaacacgagcuaccggcccaagguguguguucugggaucccgcgagcagcuuugcauccacccugaagugaaaaagcaagagucuaaucaucugcagauucaccucuguagaaagaaggucgccagccgguccugccauuuuuauaacaauguggaagagaaaagccuggagcaggaacuugcuucuccgauccuggauauugaggaccucguuaaguccggcagcaagcaccgcgugugucccuacuaucugucuagaaaccugaaacagcaagccgauaucauuuucaugccuuacaauuaccuccuggacgcuaagucccggcgcgcccacaacaucgaucuuaaaggcaccgucgugaucuuugacgaagcgcauaauguggagaagaugugcgaagagagcgccucuuucgaucugacaccccacgaccucgcuuccgggcuggaugucauugaccagguucuugaggaacagaccaaagccgcucaacagggagagccucaucccgaauuuagcgccgacuccccgucuccuggccugaacauggagcucgaagauaucgccaagcugaaaaugauucugcucagacuggagggggcuaucgacgcgguggagcuucccggagaugacagcggcgugacaaagccuggguccuauauuuucgaacuguuugccgaggcucagaucaccuuccagacgaagggauguauccucgauagccuggaccaaauuauccagcaccuugccggccgggccggcgucuuuacaaauaccgcugggcugcagaaacucgccgauauuauccagauuguguucucuguugaccccuccgaaggaagccccggcucuccugcggggcugggagcucugcaaagcuacaaggugcacauccauccggaugccggccaccgcagaacagcccagcgguccgacgcuuggucuaccaccgccgcuagaaaacgcgggaagguccucagcuauuggugcuuuucccccggacauagcaugcacgagcuggugcggcagggcguuagaucucuuauccugacauccggcacgcucgccccugugagcucuuucgcgcuggaaaugcagauucccuucccugucugccuggagaacccccauaucauugauaaacaccaaaucugggugggggucgugccgcgcggaccugacggcgcccagcuuuccagcgcuuuugaccggagauucuccgaggaaugucucucuagccuggggaaggcccugggaaauauugcucgcguugugcccuacggccuccugaucuuuuucccuuccuaucccgucauggagaagucucuugaauuuuggcgggccagagaucuggcgcgcaaaauggaggcccucaagccucuguucguggagccccggagcaaaggguccuuuagcgaaaccauuucugcuuacuaugccagaguugcugccccgggcuccacaggagccaccuuccuggcugugugccgcggcaaggcgagcgaggggcuugacuuuucugauacaaacggacggggcgucaucgugaccgggcucccuuacccucccagaauggacccccgggugguucugaaaaugcaguuccuggaugaaaugaagggacagggcggggccggcggacaauuucucuccggccaggagugguaccgccagcaagcuagcagagccgucaaccaggccaucgggcgggugauuagacaccgccaggacuauggagcuguguuccugugugaucaucgguuugccuucgcggacgcuagagcccagcuuccgucuuggguccgcccccacgugagaguuuacgauaauuucggccaugugauccgggacgucgcccaauuuuuccgcguggcugaaagaacgaugccugcccccgcgccucgggcuacagcccccagcguucgcggggaggaugccguguccgaggcuaagagcccuggacccuuuuucucuaccagaaaagccaagucccuggaccuccacgucccgagccugaaacagcgguccucuggcagcccugcugccggggaucccgaauccucucugugcguggaguaugaacaggagccuguucccgcgcgccagagaccgcggggccuucucgccgcucuggaacacagcgagcaacgcgccggauccccuggcgaggaacaggcucauucuuguagcacccugucccuccugagcgagaagagacccgccgaggaaccuagagggggacggaaaaagauucgccuugugucucaccccgaggaacccgucgccggcgcucagacagaccgggcgaagcuguuuaugguggccgugaaacaggagcucucccaagcuaacuucgccaccuuuacacaggcccugcaggacuacaaggggagcgaugacuucgcugcccuggcggcuugccuuggaccucucuuugccgaagauccgaaaaagcauaaucugcugcaaggcuucuaucaguuugucagaccccaccauaaacagcaguucgaggaaguuuguauccaacucacggggcgcggcugcggauaccggccugagcacucuauucccagacgccagcgggcccagccugugcuggaccccaccggcagaacagcuccugauccgaaacuuaccguguccacagccgcggcucagcaacuggacccccaggagcaccucaaccaggggcgcccucaucugagcccccggccucccccgaccggagauccuggcucucagccccaauggggguccggaguccccagagccggcaaacagggccagcacgccgugagcgcuuaucuggccgacgcucggcgcgcccuuggguccgcgggauguagccagcugcucgccgcucugacggccuacaagcaagaugacgaucucgacaagguucuggcugugcuugccgcccugaccacagcuaaaccugaagauuuuccccuccugcauagauucucuauguucguccggccucaccauaagcagcgcuuuagccagaccugcacagaccugaccggcagaccguaccccgggauggagccucccggaccucaagaggaacggcuugcggugcccccgguucugacgcacagagccccucagcccggcccuucccgcucugagaaaacagggaagacccagagcaaaaucuccucuuuccuccggcagagacccgcuggaacagugggcgccggcggggaagacgccggaccuagccaauccucugggcccccgcacggcccugcugccagcgaguggggagaaccccauggccgcgauaucgcggggcagcaggcuaccggagcccccggcggcccucuguccgccgggugugucugccagggaugcggcgcugaggacgugguuccguuucaaugucccgccugcgauuuccagcggugucaggcgugcuggcagagacaccuccaagccagccgcauguguccugcuugccauaccgccucucggaagcaguccgugaugcaggucuuuuggcccgaaccucaauga

SEQ ID NO: 75134 - RNA, 492 nt, Artificial Sequence
  derived and/or modified sequence opt5 from RTKN2__Homo_sapiens__NP_001269870
auggagggccccagccugagagggccugcccuccggcuggcuggacuuccgacccagcaagacugcaacauccaggaaaagauugaucuggagauccgcaugagagaaggcauuuggaaacuccugucccuuucuacacagaaggaccaggugcugcacgccgucaaaaaucucaugguuuguaacgcgcggcugauggcuuacacgagcgagcugcaaaagcucgaggaacagaucgccaaucagaccgggcgcugcgaugugaaauucgaguccaaggaaagaacagccuguaagggaaaaauugcuaucucugacauccggauuccccugauguggaaggauagcgaccauuuuuccaacaaagagcgcucuagacgguaugccaucuucugccuuuuuaagaugggcgcuaauguguucgauaccgacgucgugaacguugauaaaacaauuaccgacaucuguuuugaaaaugugacaauucuguga

SEQ ID NO: 75135 - RNA, 1692 nt, Artificial Sequence
  derived and/or modified sequence opt5 from RTKN__Homo_sapiens__NP_001015055
auguucagcagaaaccaccggucccgcgugaccgucgccagaggcucugcucuggagauggaauuuaagcgggggcgcuucagacucagccuguuuuccgaccuucccgaggauacagaacugcagcggaaacucgaccaugagauccgcaugagagaaggagccugcaagcugcuugcggcuuguucucaacgggagcaggcccuggaggccacgaaaagccuccugguuugcaauucccgcauucugucuuacaugggcgaacuccagagacggaaggaggcucaggugcuggggaaaaccagccgcagaccuuccgauagcggaccgcccgccgaacggucuccuugucgcggcagagugugcaucuccgaccuucggauuccccugauguggaaggauacagaguauuucaagaacaaaggggaccuccacagaugggcugucuuucugcuucugcaacucggagagcauauccaggauaccgaaaugauucugguggaccgcacacugaccgauaucagcuuccagucuaauguucucuuugccgaggcgggcccugacuucgaacugcggcuugagcuguacggcgccuguguggaagaggagggggcucucacaggaggccccaagagacuggccaccaaacuuuccagcucucuggggcgcuccagcggacggagaguccgcgcuucccucgauucugccggcgggagcggauccagcccuauccugcugccgacgcccgugguuggcggcccucgguaucaccuccuggcgcauaccacacuuacccuggccgcugugcaggacggguuuagaacacacgaucucacccuggccucucacgaagagaaccccgcuuggcuuccucuguacggauccgucugcugucgccucgccgcccaaccccugugcaugacgcagccgacagcuagcggcacccugcgggugcagcaggcgggggaaaugcaaaauugggcccaggugcauggaguccucaagggcacaaaccuguucuguuauagacagccugaggacgcugacaccggggaggaaccccuucugaccauugccguuaauaaagagacacgcgugcgggccggagaacucgaucaagcucugggcagaccuuuuacgcugucuaucagcaaccaguacggcgacgaugaggugacccacacacuucagaccgaaucccgggaggcccuccagucuuggauggaagcgcuguggcaacuguucuuugacaugagccaguggaagcagugcugugaugagauuaugaagaucgagacacccgcuccccgcaaaccuccgcaggcccucgccaagcaagggucccuguaucaugaaauggcuauugagccccuugacgauaucgccgcugucaccgacauucugacgcagagagaaggagcccggcucgagacaccucccccuuggcuggcgauguucaccgaucagcccgcccugccgaauccuugcagccccgcuucuguggccccugcucccgacuggacccacccucuucccuggggcagaccgcgcacauucucccucgaugccguuccucccgaccacagcccccgggcgagaucuguggccccucugccgccccagcgcuccccuagaacccgggggcugugcagcaaaggacaaccccgcacauggcuccaguccccugucuga

SEQ ID NO: 75136 - RNA, 4077 nt, Artificial Sequence
  derived and/or modified sequence opt5 from RTL1__Homo_sapiens__NP_001128360
augaucgagcccagcgaagacuccuucgagaccaugauggaacacaagaacccuucuagcaaacagauggaguccucugaaggcagcuccaauacaacggaggccaccucugggagcggagugagaggcgaggcugggccggccuccggacccgcgcaagaaaagaaagagccucccagcggcccucugcaggaaauggaggagcuccccacagaucugcuucaggacauggaggagccuucuuccgggccgcggaaggaaauugaggaucccccuaacgaccugcuccaggaucuggaagagagcugcaauggaucucaccaagcucgcggcgacccccuuuccggcgccagcgauagaaugaaagaggccucugucaacccuuccggggcucgggaggaacaggaagcccacaccgaccugaaggagagcggacgcgaagagacaccccaggagcagaaucaaaccgaacauuccacagcugagcucauggccaugguuagaucuaucauuagccuguacuuucggaugcaggaucugaaggaacagcagcgcguggcggaggaaauccucauuaaaggcaucaacgccgggcaacugccggcuccuaagcacuucuccggagacagacgggaguuucaugaguucaucgugcuuugucagcugacccuccagagcuauccccgcauguuuuacaaugauagacugcgggucggcuaugugauuaaccaccuuucugggcuggcccucgaaugggcuaaagcccugcugcaagaaaauuccccucucaucggagacuuccccgcguuucuggaagccaugagcgagguuuucgaguaccgccaggcucuuagaguggccgaagaggcuauguuuacgauucggcagggcggccgcucugccaccgaauauaucgaugaguuccagagccugguccccauucucggguggccugacgaagugcugcaagcccaccuuugccagggacugaacgaggagaucagacauuaccucuuucggguuccgcagcccgacucccuggauucucugauugugcucauccugcagaucgaagagaaacuugcugaaagacgcgcgaugcugcggcucccucccgaggccagaccucgcaaucugacauggauugacagccccgcuccggaacgguggauggucuccagcuggcuuccuucugaggugcaccccgauaucaacagagcccaucuguuccuccugcugauggugcgcgucaauccuuaucacuccguugccgugcaagcucucguggacagcggcgccgaugggaacuuuauggacgagaaguucgcgcaggaacacuacgucgagcuguacgaaaagcccuauccucagcccgugcagucuguugauggaucccuuauuggcaaugagccgguguggcuguacaccgaaccucucgucuguauccaucaaaaccaccaggagagcauugaguucgacaucgugcccucccccaacuuuucuguugugcuggggauccgguggcugagaguccaugcuccugaaguggauuggauuaagggacgcugcacauuccacagcccguauugucuuaaaaauugcuuucggcccccucccccuuguaucgcccucgagagacauggcaugucccugcugcccggccucccucaccccuacucugaccuggccgaugucuucaacccgaaggaagcugacgacgagaccagcgaucagccuuccagcgacgggucugaugaccuuuccgagagcgaacccucugagcugcagcaagccggagauuccgaccacagcgaaacguuuuaugagugcccuucuacagcucccugggaaccggugggcgcccgcaugcaggagcgggcgagacuccaggaggaauacugggaucugcaagacaugcugaccaaucggcaggauuauauucagaugaucccugagcuuuucgaccagcuccauggggccgaaugguuuacaaaacuggagcugcgcggaaccauuguugaagagagcgugaacggccacagaaccgaggaugucuggaaggcugccuucgggcucgaacuggaggaaaugaaauccuaccaacccuuugcucuuagcccugaccccaucaucccccagaaugugauucauuucauccugaaggauaugcucggcuuuuucguucugucuuacggacaggaggugcugauuuauuccaugagccaggaggaacaccuucaccauguccggcaagugcucgugagauuucgccaccauaacguuuacuguucccuggacaaaucucaguuccaccggcagacagucgaguuccugggcuuuguggugacgccuaagggggucaagcucaauaaaaacgugaugaccaucauuacaggauauccgacccccggcagcaagcugucccuuagaaauuucaucgaauuuguuuucccuuaccgccauuuuguggagagauucucuauuaucgccgaaccccugguccggcagcuccugagcuccuaucaauuuuacuggggaguggaggagcaggaagcguucgagugccugaaacgcgccuuuagaaaggcuccucuucuccaccaccccaaaccucagaacccguucuaucuggaaacagggguuaccggcacggcccugcaugcuucucucauccaaauugacgaucagacagggaagcgggccuguugcgccuuuuacagccgcaauaucucccccauugagguggaauacagccaggcugagaugaagauccugccuauuagagcggccuucauggucuggugccgguaucuugagaacaccgaggaacccaucaugauccugcucaauaccgaagaccuggcuucucugaacaaugaucgccuuacagugcugcucccuggccacuggguuuucuucuucucccauuuuaacuucgacgugauggagcugcccgaacaggauggaggcagagcccucccgccuguccggaaccugcgcuggagacgggccuuucaaagaaauaccgcugcccgccagacacuucugcucgcgagccggggguuccccagagaccccucuacggaguccggagaggaagagaacgaggaacaggaugaacugaaugagcagauucugcgccaagagcuucuggcuaugaucccuauugaccagauccucaacagcuuucuggcccacuucucuauggcccagauucgggcugugauccuccacuuuuucagaggccugcuuuacuggaaaaauacccuggcccucgcggcuauccuggugcugcuucgcguccggcagugucugucccucagacccgccccugccaugcgcguugcucggccgcaaccccagagaagccugcggcucauucuggauuccagccuuaucgccgggucuagcauuacaaccgcuaucacacagcugcugacccagaugccugcccucgugggagcgaacacgauucccgcccaagaacuggcugagcuuuuucugggcccugggcgcuggcagagaaaugcccuccacucccaggcucaccggggccugcaauucacccccggauuuuggcucacacugugcgaauuuuucggcgugcgcgucaccccgcaggaggggcaucuuccugcccugagacagaaccgguaucuggagcuccacgugguuggagacgaagaugugguccugagagaggcccuucaggacgaucugcaacgcuaccggcaguguggccuccaugacgggcugcaggacacaucucaggauaagcaagacaaugaugugcaggaagcucccccuagccacaccgcggccacgcaucccccuagaccccgccaucucauggacccgcagguucuggaguuucuuggaucccggcugcugcacauccauucugcugauggccagcuccaucugcuuagcagagaacaagccgcccgcgcucugucccaguuccucacacugaucuaucggagagcccucccuauucccgcgugggagucucagccccgcgagcaagcuagacuggaggaacuuccugacgaagaugaggacgccaaccuggauuga

SEQ ID NO: 75137 - RNA, 2331 nt, Artificial Sequence
  derived and/or modified sequence opt5 from RTN1__Homo_sapiens__NP_066959
auggccgcucccggcgacccucaggaugagcugcucccgcuggccgggcccggaagccaauggcuuagacaccggggcgaaggggagaacgaagcggugaccccuaagggagcuacacccgccccucaggccggcgagcccuccccugggcugggagcucgcgccagagaagcugccucucgggaggcgggcagcggcccggcccgccagucccccgucgcuauggagacggccucuaccgggguugcuggagugagcuccgccauggaccauacauucucuaccacaagcaaagauggcgaaggguccugcuacaccagccucaucucugacauuuguuauccuccccaggaggauuccacauacuuuaccggaauccugcaaaaggaaaauggccacgugacgauuagcgagucuccugaggaacuugggacccccggaccgucccugccugacguccccggcaucgagagcagaggccucuucucuuccgauagcgggauugaaaugacacccgcggaguccaccgaagugaacaaaauccuggccgacccccuggaucagaugaaggcugaggccuauaaauacaucgacauuacacggcccgaggaaguuaagcaucaggagcagcaccauccugaacucgaggauaaggaccuggauuuuaaaaauaaggacaccgacaucucuauuaaaccggaaggagugcgcgagcccgauaagccugcucccgucgagggcaaaaucauuaaggaccaccuucuggaagagagcacguucgccccuuauaucgaugaccucuccgaagaacaaagacgggcuccccagauuacaaccccggugaagaucacacugaccgaaaucgagccuagcguugagaccacaacgcaggagaaaacccccgagaagcaggauauuugccuuaaaccuucucccgacacagugccuaccgucacaguguccgaacccgaggaugacagcccggggucuaucaccccucccagcuccggaacggagcccucugcugcggaaagccaaggcaagggguccauuagcgaggaugaacugaucacagccauuaaagaggcuaagggacucucuuacgaaaccgccgagaacccucgcccggugggccagcuggccgacagacccgaggucaaagcucgguccggcccucccaccaucccuagcccccuggaucacgaagccucuuccgcggagagcggggacuccgaaaucgagcucguuucugaagacccuauggcugccgaggaugcccugcccagcggauauguguccuuuggccaugucgggggaccgccucccucuccugcuagccccuccauucaguacagcauccuucgcgaggaaagagaggccgaacuggacucugagcucauuaucgaauccugugaugcuagcucugccuccgaggagagcccgaagcgggaacaagacucuccucccaugaagccuagcgcgcuggaugccauucgcgaggaaacaggcgugagagcugaggagcgggcccccuccagacgcgggcuugcugaacccggcagcuuccuggacuacccuucuaccgagccgcagcccggaccugaacucccuccuggcgauggggcccuggagcccgaaacaccuaugcugccgcggaaacccgaggaggacuccagcuccaaucagucuccugcggccacgaagggacccggcccucucgggcccggagcuccgccuccccugcuuuuucugaacaaacagaaggccaucgaucuccuguauuggagagacaucaaacaaaccggcauuguguucgggagcuuucuucugcuccuguucucccugacacaguuuucuguugugagcgucguggcuuaccucgcccuggccgcucuuuccgcgaccaucucuuuccgcauuuauaagagcguucugcaggccgugcagaagacagaugaaggccaccccuuuaaagccuaccucgagcuggaaaucacccugucccaagagcagauucagaaguauacggacugccuucaguucuacgucaauagcacccucaaagaacugcggagacuguuccucgugcaagaucuggucgacucucuuaaguuugccgugcugauguggcuccugacauauguuggagcccuguucaacggccuuacccuccugcugauggcuguggucuccauguuuacacucccugugguuuacgugaaacaucaggcccagaucgaccaguaccuggggcuuguccgcacccacauuaaugcggugguggcuaagauccaagccaagauccccggagccaaacggcacgcugaguga

SEQ ID NO: 75138 - RNA, 1638 nt, Artificial Sequence
  derived and/or modified sequence opt5 from RTN2__Homo_sapiens__NP_005610
augggccaggugcugcccgucuucgcccacugcaaggaggcuccuagcaccgccuccucuacaccggacagcacggaagggggaaacgaugacuccgauuuuagagagcuccauaccgcgcgggaauuuucugaggaagacgaggaggaaacaaccagccaagauuggggcacaccccgcgagcugaccuuuuccuacaucgcuuucgacgggguugugggaucuggcgggagacgggauagcacagcccgcagaccucggccccagggacgcuccgugagcgaaccuagagaccagcacccccagccuucucuuggcgauucccuggagagcauuccgucucucucccaaagccccgagccuggccggcgcggggaccccgauaccgccccucccucugaaagaccgcuggaggaccuucggcugcgccucgaucaucugggaugggucgcuagaggcacgggguccggagaagacagcuccaccucuagcuccacaccucuggaggacgaagaaccccaggagccuaaucggcucgaaaccggcgaggccggggaggagcuggaucuucgccugagacucgcucagcccagcucucccgaagugcugacaccucagcuuuccccgggaagcggcacgccccaagccggcaccccuucucccagccgguccagagacucuaacagcgggccugaggagccccugcucgaagaggaagagaaacaguggggaccgcuggaacgcgagccuguucggggccagugucuggauuccacagaccagcucgaguuuaccguggaacccagacugcuugggacagcgauggaguggcugaagaccagccuccugcuugccgucuauaaaaccgugccuauccuggaacucucucccccucuguggacagcuauuggauggguucaacgcggccccacgccgccuacccccgugcugcggguccuccugaagugggccaaaucccccagaagcucuggggugccuucccuuagccugggagcugauaugggcuccaagguggccgaccuccuguacuggaaggauacacgcaccucuggcgucguuuucacagggcuuauggugagccugcucugccugcugcacuuuuccaucgugucugucgcggcccaucucgcucugcuucugcucuguggaaccauuagccugcggguguauagaaaaguucugcaggccgugcaccgcggcgacggggcuaauccguuccaggccuaccuugaugucgaccucacgcugacacgggagcaaaccgagagacugucccaccagaucaccagccgcgugguuucugccgcuacacagcuccggcauuucuuccugguggaagaucuugucgacucccugaagcucgcgcugcuguuuuauauccuuaccuucgugggagccauuuuuaacggccucacacugcugauccucggggucauuggccuguucacgaucccccuucuguacagacagcaccaagcucagauugaccaguaugugggacucguuaccaaucagcugagccauaucaaagccaagauucgggccaaaaucccuggcacaggggcucuggccucugcggcugccgccguguccggaagcaaggcuaaggccgaguga

SEQ ID NO: 75139 - RNA, 3099 nt, Artificial Sequence
  derived and/or modified sequence opt5 from RTN3__Homo_sapiens__NP_001252518
auggccgagcccagcgcugccacccagucccacucuaucagcuccucuagcuucggcgcggaaccuuccgcucccgggggaggcgggucucccggagccugcccugcccugggcacaaagagcuguuccagcucuugcgcugacuccuuugugucuagcuccagcucucaacccgucucccucuucagcacgucccaggaggggcugucuagccuuuguuccgaugaaccuagcucugagauuaugaccuccagcuuucugucuagcuccgaaauccauaacacaggacucaccauucugcacggcgagaaaucucauguucuuggcagccagcccauccuggccaaggaggggaaagaccaccucgaucugcuggacaugaagaaaauggaaaagccucagggaacauccaauaacgugagcgauucuuccgugagccucgcugccggcguccauugcgacagaccgucuauucccgcguccuucccugagcaccccgccuuucugagcaagaaaaucgggcaaguggaagaacagaucgauaaggagaccaaaaauccuaacggaguuuccucucgggaagcuaagacagcccuugacgcugaugaccgcuucacccugcucacggcccagaaacccccgaccgaguacagcaagguggaaggcauuuauacauacucccugucuccuagcaaggucuccggggaugacgugaucgagaaagauagccccgaaucuccuuuugagguuauuaucgacaaggcggccuucgacaaagaguuuaaggauuccuauaaagaaagcaccgacgauuucggaucuugguccgugcacacagacaaggagagcucugaagauauuagcgagaccaaugacaaacuuuuuccccugagaaacaaggaagcuggccgguaccccauguccgcccuccugagccgccaguucucucauacgaaugcugcccuggaggaggucuccagaugugugaacgauaugcacaauuuuacaaacgaaauccucaccugggaccuggugccucaagucaagcagcagacagauaaaagcuccgacugcauuaccaagaccacaggccuugauaugucugaguauaauagcgaaaucccgguugugaaccugaaaacguccacccaucagaagacacccguguguucuaucgacgggagcaccccuauuacaaaauccaccggagacugggccgaggcuucucuccaacaggaaaaugcgaucacgggcaagcccgucccugauagccugaacuccacaaaggaguucagcauuaaaggggugcagggaaauaugcaaaagcaggacgauacccuugccgagcugcccggcucuccgccugaaaaaugcgacucccucgggagcggaguugcuaccgugaaggucgugcugcccgaugaccaccugaaagaugagauggacuggcagucuuccgcccucggcgaaaucacagaggccgauagcucuggcgaguccgacgauaccguuauugaagacaucacagcugauacgagcuucgagaacaacaagauccaggccgaaaagccuguguccauucccagcgcggucgugaaaaccggggagcgggaaaucaaggagauuccuucuugugagcgcgaagagaaaacaagcaagaauuuugaggagcuggucuccgacucugaacuucaccaagaccagcccgauauccugggaagaagcccggcuuccgaggccgccugcucuaaagugccugacaccaacguuagccucgaggauguguccgaagucgcucccgagaagcccauuacaaccgaaaauccuaagcugccgucuacggugagccccaacguuuucaaugagaccgaauuuucccuuaacgugacaaccagcgccuaccuggagucucuccauggcaaaaaugucaagcacaucgacgauuccagcccugaggaccugaucgcugccuucacagaaacccgggauaaagggauuguggacucugagcgcaacgcguuuaaggccaucuccgagaaaaugacggauuucaagacaaccccgccuguggaaguucugcaugagaaugaaagcggaggcuccgagauuaaagacaucgggucuaaguauagcgaacaguccaaggagacaaacggcagcgaaccccucggagucuuuccuacccagggcacccccguggcuucucuggaucuugagcaagagcagcugacaauuaaagcccucaaggaacugggggagagacagguggaaaaauccacgagcgcucagcgggacgccgagcugccgucugaagagguccuuaagcaaaccuucacauuugcgccugagagcuggccccagcgcuccuacgauauccucgaaagaaaugugaaaaacggaucugaccugggcauuagccagaagccuaucaccauccgggagacaacccgcguugacgccguguccucucugagcaagacggaacucgucaaaaagcacgugcuggcuagacuucugacagauuucuccguucaugaccucaucuuuuggcgggaugugaaaaagaccggguucgucuuuggaaccacacugauuaugcugcuuagccucgccgcuuucucugugauuuccguugugagcuaccugauccuggcccuccuguccgucaccauuucuuucagaaucuauaaaagcgugauccaggccgugcaaaaguccgaggaaggccaccccuuuaaggcuuaccuugacgucgauauuacacugucuagcgaggcguuccacaauuauaugaacgccgcuaugguucauaucaaucgcgcccucaaacugauuauccggcuguuucuuguggaggaccucguggauucccugaagcuggccgucuucauguggcucaugacguacgugggggcuguuuuuaacggcauuacccugcuuauccuggccgaacuccugaucuucagcgugccgauugucuaugagaaauacaagacacagaucgaccacuaugugggaauugcgagagaucagaccaaaucuaucguugaaaagauucaagcuaagcugccuggcaucgccaaaaagaaagccgaguga

SEQ ID NO: 75140 - RNA, 600 nt, Artificial Sequence
  derived and/or modified sequence opt5 from RTN4__Homo_sapiens__NP_008939
auggacggccagaagaaaaacuggaaggauaaaguggucgaccugcucuacuggagagauaucaagaaaaccgggguuguguucggagccagccuguuucuucugcucucccugacaguguucucuauugucagcgugacggcuuauaucgcccuugcgcugcucuccguuaccauuucuuuucggaucuacaagggcgugauucaagcuauccagaaguccgacgaggggcaccccuuccgcgccuaucuggaauccgaggucgccaucucugaggaacuggugcagaaauacagcaauuccgcucucggacauguuaacugcacaauuaaggaacugagacggcuuuuucugguggaugaccucgucgauagccugaaauucgccgugcuuauguggguguuuaccuaugucggcgcucuguucaaugggcucacacugcugauccucgcccugauuucucuuuuuagcguuccugugaucuacgagcgccaccaggcgcaaauugaccauuaucugggacucgccaacaagaaugugaaagaugcuauggccaagauccaggcuaagauuccgggccugaaaagaaaggccgaguga

SEQ ID NO: 75141 - RNA, 1191 nt, Artificial Sequence
  derived and/or modified sequence opt5 from RTN4IP1__Homo_sapiens__NP_116119
auggaguuccugaagaccugcgugcucagacggaacgccuguacagcugucugcuuuuggcgcagcaaaguugugcagaagcccuccgugagacggaucucuacgaccagcccucgcuccacagucaugccggccugggugauugacaaauacggcaagaaugaaguucugagauucacccaaaacaugaugaugcccaucauucacuauccuaaugaggugaucgucaaagugcaugcggcuucuguuaaccccauugaugugaauaugcggagcggguacggagccacagcccuuaacaugaagcgcgacccucugcacgucaagaucaaaggcgaagaguuuccccucacccuggggagagauguguccggaguggucauggaauguggccuugacguuaaguauuucaaaccuggggaugaggugugggcugccgugccgcccuggaagcagggaacacugucugaguuugucgugguuagcggcaaugaagugucccauaaaccuaagagccucacccacacgcaggcugccucucugcccuacgucgcgcugaccgccugguccgcuaucaacaaggugggcgggcucaaugacaaaaacugcacaggaaagcggguucugauucuuggcgccagcgggggagugggcaccuucgcuauccaggucaugaaagccugggaugcgcaugugacagccgucuguucucaagacgcuuccgagcuggugcgcaagcucggggccgaugacguuauugauuauaaaagcggaucuguggaggaacagcugaagucccuuaaaccuuuugacuucauccuggauaaugucggcggcagcaccgagacgugggcucccgacuuucucaagaagugguccggggccacauacgugacccugguuacaccguuccugcucaacauggacagacugggaauugccgauggcaugcuucagaccggggugaccgucggaucuaaagcucugaagcacuuuuggaaaggcgugcacuaucggugggcguucuuuauggccagcgggccuugccucgacgauaucgcugaacugguggacgccggaaagauucgccccguuaucgagcagacauucccuuucuccaaaguccccgaagccuuucuuaagguggagagaggccaugcucggggcaagacggugaucaaugucguguga

SEQ ID NO: 75142 - RNA, 1422 nt, Artificial Sequence
  derived and/or modified sequence opt5 from RTN4R__Homo_sapiens__NP_075380
augaagagagccagcgcuggcgggucccggcugcucgccugggugcuguggcuucaggcguggcaagucgcugcccccugcccuggagccuguguuugcuacaacgagccgaaagugaccacaucuuguccccagcagggccugcaggcugugccugucgggauccccgccgcuagccaacgcauuuuccuccacggaaauagaaucucccaugugccugccgcgucuuuucgggccugccgcaaccugacgauucuuuggcugcacagcaauguucucgcuagaaucgacgccgcugccuucaccggccuggcgcugcucgaacagcuggaucuuuccgacaacgcccagcugcggucuguggaucccgcuacauuucaugggcucggacgccugcacacccuucaucuggacagauguggccuccaggagcugggcccugggcuguuccggggacucgccgcucugcaauaucuuuaccugcaggauaaugcccuccaggcccugccggacgauacauuucgcgaccuuggcaaccugacccaccucuuccugcacgggaauagaauuagcuccguccccgaacgggcuuuucgcggacugcauagccucgauagacugcuucugcaccagaaccggguggcgcauguucacccucacgccuuccgcgaccucggcagacugaugacacuuuaucuguuugcuaauaaccucucugcccugcccaccgaggcccuggcuccucuccgggcccugcaauaccuuagacugaaugauaaccccugggugugcgacugucgcgcgcggccgcucugggcuuggcugcagaaguucagaggguccagcucugaagucccuugcucccugccccagcgccuugccggacgggaucucaaaagacuggccgcuaaugaccugcaaggcugugccguggcuacgggcccuuaucaucccaucuggaccgggcgcgccacagacgaggagccccucggacugccuaagugcugucagccggaugcggccgacaaagcuagcgugcuugaacccggccggccugccucugcugggaacgcccugaagggaagaguucccccuggcgauuccccgcccgggaauggaagcggcccucgccacaucaacgacucccccuuuggcacccucccugggucugcggagcccccucugacagccguccggcccgaaggaagcgagccgccuggcuuccccaccuccgggcccagacgccggccuggaugcagcagaaagaaccggacgcgcucucauugcagacugggccaggcuggguccggcggaggcgggacaggagauagcgagggcucuggggcccuuccgagccucaccuguucccugacaccccugggacucgcucuggugcuuuggaccgugcugggcccuugcuga

SEQ ID NO: 75143 - RNA, 699 nt, Artificial Sequence
  derived and/or modified sequence opt5 from RTP3__Homo_sapiens__NP_113628
auggccggcgacaccgagguguggaagcagauguuccaagaacugaugagagaggucaaacccuggcaccgguggacacuccgcccugauaaggggcugcuuccgaacguucugaaacccggauggaugcaguaccagcaguggacguuugcuagauuccaaugcagcuccuguucucggaauugggccagcgcucaggugcucgugcuguuucauaugaacugguccgaagagaagucucgcggccaggucaaaaugagaguguucacccagcggugcaagaaguguccucaaccccuuuuugaagacccugaguucacacaggagaauaucagccgcauucugaaaaaccucguuuuuagaauccugaagaaaugcuaucgggggcgcuuccagcugauugaagaggugcccaugaucaaggauauuucccucgaaggaccucacaauucugacaacugugaggcgugccugcagggcuuuugugccgggccgauccaagucaccagccuucccccuucccagacacccagagugcauagcaucuacaaaguugaggaaguggucaagccuugggccucuggagagaauguguauuccuacgcuugccagaaccacauuugucggaaucugagcaucuucugcuguugcgugauucucaucgucauuguugugaucguggucaagaccgccauuuga

SEQ ID NO: 75144 - RNA, 741 nt, Artificial Sequence
  derived and/or modified sequence opt5 from RTP4__Homo_sapiens__NP_071430
augguggucgacuucuggaccugggagcagacauuucaagaacugauccaggaggccaagcccagagcuacguggacccucaaacuggauggcaaccuucagcuggacugccucgcccagggguggaagcaauaccagcagcgggcguucggaugguuucgcuguagcuccugccagagaucuugggcuagcgcccaaguucagauucugugucacacauauugggaacauuggaccucccagggccaggugcggaugcgccuuuucgggcaaagaugccagaaauguucuuggagccaguacgagaugccugaauuuuccucugauagcacaaugcggauccuguccaaucucgugcaacacauucugaagaaauauuacggaaacggcacccgcaagagcccggagaugcccgucauccuggaggugucucucgaagggucccaugacacagccaauugcgaggcuuguacccugggaauuugcggccagggccuuaagagcuguaugacgaaaccuucuaagucccugcucccccaccugaaaaccgggaacagcucuccuggaaucggcgccguuuaucuugcuaaucaggccaagaaccaguccgcggaagccaaagaggcuaaggggagcggauacgagaagcugggccccuccagagauccugacccgcucaauaucugcguguucauucugcugcucgucuuuaucgugguuaaauguuucacaucugaauga

SEQ ID NO: 75145 - RNA, 6681 nt, Artificial Sequence
  derived and/or modified sequence opt5 from RTTN__Homo_sapiens__NP_775901
auggugcuggccggacugauccgcaagcuggggcaccagcuugcugaaauucgggaacgcgcccucaagagcauccugugcaagauugagcacaaccugaucuguuacgccgaccuuauucaggaaagacagcuguuccuccaucugcuggagugguuuaauuuccccuccgucccuaugaaggaagagguucucaaccugcuuucucggcuggugaaguauccgcccgcugugcagcaccucgucgaugugggagccguugaguuucugagcaaacuucgcuccaauguggaaccuaaccugcaggccgagaucgacggcauccucgaugggcuguuccugcuccccucugaagucccugcucugagcuccgccucuuaccaaaccaaucagacagagcuuagcaagaaccccgagauucugacgggauauuuuccucaggacaaguccaauuuccagcaaauggaagugccgcccagaccuguugugaaccagaccgucaaaugccucaaguuuagcacauuccccuggcugccucuuaccacaaccgaucggcacgugcugucuuccaaugagagcucucuccgcuccagcaaccacacacugaucuggaauaccugugaacugcucaaagacgugauuaugcaggauuuucccgcugagaucuuccugcagagaccgaagauuguccaaucucuucugucccuccugaaacuugccuuuggcgacgggaagcaccggcuggcgcuccagagcguuuccugccugcagcaacuguguauguaccuccgcaacagacugaauuuccaccgggauccuggauuuuucucuaacaagcaugacacggugagccaaaauuccagccuuucuuauugccacgaagcccgcggcacccaucacucccagaaccccagcccuggcucuagcucccccagacccucuguggucgggcggacaggacagcgcccuagaggcgaugggcaagacugggaugcugccagcuccagcggaucuuccagccacgcucaugugaacucucggaucuccguucacagcccgcuggacaugggccauauugaccuccccgagcuggagaccgaagauacacuggagcuucaguuccagcagcucucccugccucaauuuugugugucuauccuggaaagcgccgucccccuccugagaaccgggucccgccaggugaucauucggguucuugagcugcucacggaagacaugacacugaucggagaggcgauuucuaccgauaucugggacgauagcucccuguucggcauugacaugaaagagaaacuucuccuggugcugggcgcccucggggaaacaaugugcuaccacaaaagcucuaucucccuggagcagccugaagucaugcuugugcaucacagaauggcuuuuaucagcauuucucuguucgccguccgccuccugcagacccugcuucccguggagaaggcuuccgaauuucucagcgagccgaugucuaccgcccuguuccugcucagccuggauaugccuaucucccuugaguaucccaauauucacgaagccguuguggcuuaccuggagcaacucaacagcgaaaauuacucuaucuauaaacggacagcggaggccgucuacuccauugaguguacgugcaacuuucugagcgacaucggaaaggaaggcgagaaaaaucugcuugaacucguggagcuggcugaucaggcccugagauccuucucuuaucaucagcacuuuccucucaucaaggaaauuaucagcauuuguuccaagaucuggaaaucugcccaggcuagcccccugcuucaaggggagucccagaagguucugcuccauaugcugucucacccucugccccgcgugaaagccgagaccuaccacugcugccuugaaauuacaaaggagugucugggaguccauaacgugaccaaaccggugagcucccucugcaauggcauccacuuccugcuccauccuaagguucuguaugaaauuagcgucuuugggauccaggagcccgaaucugaggugaacacagcggcuaaggccauccuucuguaccuccugcaaggacggcugaugaugaccgcccuuacguggaauaaauucauugagucccugugucccgugaucccuauucuccagggcuaugcugacacagaagauccgcugggcaacugcauccuccugcuuagcaaggccucuuccgacaccgaggaaaugcugcccuguaccacaagacucaaaagcaugcugcgccugcuucuggucaagaaaccuucugugcggucccucgcucugaagcuccuggccuuucaccuuaccagcgaggaaggggcggacacaaagagaccccugauugaugcccgcguucugucccgggugacggaccucuucaucggcaagaagccuaucgagcugagacuugaugaccggcgcgagcuggucauuaaacucgaaaccguggagaagguuuacgaaaucuucacaagcgaugacguggaucugguccucagaaaaucugcugccgagcagcuggcugugauuaugcaggacaucaagaugcaugccguugugaagaaacuuugccugauugauaagaucaucgaguaccugaaugaaugugucagccaagacggcaaagugguggagugccucguccagcccugucugacccuucugcggaagguucucugcggggauccugugaugagagugucccugucucagcagagcucccuccugacaguccuuuuucgcgugucucugauuuuccacgaagacuguagcguugugaccgaggucggagcgcuguuuugccuccugcuuuucgaugaagugucccggauggacauguggucuguuaaccccagcaauaaaccgucccugccuagcguguuuucucuccccgucuccguguucagacgcuaucaucugccuguucaugugaucggccaccaugccgucagccccuacucuauugugcucccgcuguccgcugacugccuugcccugaagccugugagcgauaugcugagaaucgcuuggaaccucuccugguaucacgggucugacaaucugcuuaaacaaaugaacagcgagacgaagacccaggagauucuggaugcccucaagcuguccacagaagacauccugacccucaaaaucacacauauggccagcggccuucaggauugucugcacucuauuguccaggcugcgacccaccgggagguucgcgccgcugugacgagaauguccuuuuaccugcucaacgaccggcugagccuuaagggaugccccggcccuuguggggugacacugaaaucucucgccuggcauaccgcccugaaucgcuuccugcaaguccuccccgcuugcacagaagaugagaaacuucugaucgacauuauccacuuucugaacaaacucauuaaggaacagagaaagaauagcucccuggagcuucugaacuggauccucgagcugcugcuccggcauucugccaauccccuucuggaucugcucgugcugaccgaaagccaggcgcgcgaggaaaccgacgauauuagaacagcuguucggcaacagcuucagaaagagcugaucgcccucuucgacacgcugcugcucaacuuuauggaagugaccgaucgcaaguguuccgagcuucuguaugucuuccagacacaacuggcccucaaacugcuucagugccugaaggugaccgacgcuccucacuuuuacggacucccgucucuggagagaacacugcggggcauggccaaucucaccgcguuccccggguggagcucccacagcccucuuacgaaaccccuggacaucuguguuaaguaucugucuggacuccuggaagugauuacauccuucuacgucgagagaggcgggaacgcuaugagcuuuaugggcaagggagugaccaaauccaccauccuuugccugcuccaucugucucacgaaaugauggcccaggccggcagccuggaguggaugucccucugguuccuuccucuggggucucauagcgaggaacacauucccacacagcaaggacuggcuuggcucaucccucugugggucgaucgcgacccggaggugcgguuuaccucccuuggccuggggagcgcccucacaacgcuggaaaccggauguguugcucuggccaauucuugccagaacauuuccggcgggcucuggggcacaguggucaauauccuucuggaucagagcgaguguucuauggugagacgcgaagcggccuucauccugcagaaccuccugguuauucccaugccuaccgagaucauuaaggacuacacauggcaaggacccugcgugcaugaugaggacuccggccuuagccugaucgggaaaccugcucuccaggcccugcuguaucacugccacuuuuacgaacaucucaaucagauggucaagcacuguuaucuuggacggugcauguucgaucugaacuuuucugcuuucgacagaaauagcgaguccaacgaucugaacggccucgacgauucuuuuaaauucuggcgcgcccccagccggaccucccaggacagagacccgagcucccugucuacgagcgaaaccacaguggccccuucccuugggucuaccgaguuucaaccccuggugcagagcacaacccuccugcccgaggcuucccaugaucaguucguugcgcaaggacaccaggagucuacaagcccuagacccccucacgacuccagccugucugccccgcuccccaaacuuugugucuucgugaccccuucccugcugagcgcuaugugcucucuccuggauaaucuucugacgauugcgccccgggacacagccaaggcuuuuagacaggcccaucucaucgagcugcuguguuccaucgcggaugcuacccucauucagaccugcgugcaagaacugcgggcccuucugccuagcucucccccggccgagcacacacaggcucaggucuccuuccuccuggaauaccuuagcucccugagccgccuccugcagucuugucugcucguggagccugaccugguuauccaagaugaacuugugaaaccccugauuaccaacaucauuggcauccucacgauuugcacaaaggacguccuggauaaagagcuuaucagcgccuuuuaucauaccuggacacaccuguucaaucuccuggcgaugcugcucagaaaggcuggggccaucacccugccuuuugugacaguugcccuugcuaaacauuggaccgccgcuauugacauguucuguacgugcgccggccuguccgcgaccugucccgcccucuacacagcuucucugcaguuucuuagcgugcugcucaccgaggaagccaagggacaucugcaggcuaaauccaagacacaccugugcugcucuccuaccgucgccagccuccuggaugacucccaggagaaccaaaagucucuugaacagcugagcgaugugauccuccaguguuaugagggcaaauccagcaaggacauucugaaacggguugccgcuaaugcgcuuaugucucugcucgccgugucccgcagagcucaaaagcaugcccugaaagccaaccugaucgacaauugcauggagcagaugaagcacauuaacgcucagcucaaucuggauagccuucggcccgggaaggccgcgcugaaaaagaaagaagacggagucaucaaggagcucucuaucgcuaugcagcugcuuagaaacugucuguaccaaaaugaagagugcaaagaagccgcccucgaggcucaucuggugccggugcugcacucccucuggccuuggauucugauggaugacagccuuaugcagaucucccugcagcuccugugugucuacacggccaacuuccccaauggcugcucuagccuuuguugguccagcugcgggcagcaccccguucaagcgacacaucgcggagccgugucuaacucccugaugcucuguauucugaagcuggcuagccagaugccucucgagaauaccacagugcagcagauggucuuuaugcugcuuucuaaccuggcccucagccacgauugcaagggcgugauccaaaaauccaacuuccugcagaauuuucuuucucuggcucucccgaagggcgggaacaaacaucugagcaaucugaccauucuuuggcugaagcuccugcucaacaucuccucuggagaagacggccagcagaugauccugcggcuugaugggugucuggaccugcucaccgagaugagcaaauauaagcacaaguccagcccccugcuuccucugcucauuuuccauaauguuugcuuuucucccgccaacaaaccuaagauccuggcuaaugaaaaagugauuacaguccucgccgcgugccuggaguccgaaaaccaaaaugcccagagaaucggagcugccgcucugugggcccuuauuuacaacuaucagaaggccaaaacggcucucaagagccccuccgugaagcgccggguugaugaggcguacucucucgccaaaaagaccuucccuaauagcgaggcuaacccgcugaaugccuauuaccuuaaaugucuggaaaaccucgugcaacugcucaauuccucuuga

SEQ ID NO: 75146 - RNA, 1803 nt, Artificial Sequence
  derived and/or modified sequence opt5 from RUFY1__Homo_sapiens__NP_001035542
augauggaggaaagagccaaccugaugcacaugaugaagcucagcaucaaagugcugcuucaguccgcucugucucucggccggagccuggacgccgaucaugcgccccuucaacaguucuuugucguuauggagcacugccugaagcaugggcucaaagugaagaaauccuucauuggacagaacaagagcuuuuucggcccucuggaacugguggagaagcucugcccggaagcuagcgacaucgccaccuccguccgcaaccugcccgagcuuaaaacagccguggggagaggacgggcuuggcuguaccucgcccugaugcagaagaaacuugcugauuaucugaagguucucauugacaauaaacaucugcugucugaguuuuacgaaccugaggcccucaugauggaagaggagggcauggugaucgucgggcugcuugugggacugaacguucucgaugcgaaucugugccuuaagggcgaagaccuggauagccaagugggcgucauugacuucucccucuaucugaaggaugugcaggaccuggaugggggaaaagagcacgaacgcaucacggacgugcucgaucagaagaacuacgucgaggaacugaauagacaccuuagcuguaccguuggcgaccugcagacaaaaaucgacgggcucgagaagaccaacucuaaacugcaagaggaacuuuccgccgcuacagaucggauuugcagccugcaggaggaacagcagcaacuccgcgagcagaaugaacugaucagagagcggucugagaaguccguggaaauuaccaaacaggacacaaagguggagcuggaaaccuauaagcaaacgcgccagggacucgaugagauguacagcgacgucuggaaacagcugaaggaagagaaaaaggugagacuugagcuggaaaaagagcucgaacugcagaucggcaugaagaccgagauggagauugccaugaagcugcuugaaaaagauacacacgagaagcaagacacccucguugcucugcggcagcagcuggaagaggugaaagccaucaaccuccagauguuucauaaggcgcaaaaugccgaaucuucccugcagcagaaaaacgaggcuauuacaucuuucgaggggaagaccaaucaggucauguccucuaugaagcaaauggaagaacgccuucagcacagcgaaagagcccggcagggagcugaggaacgcucccauaaacugcagcaagagcucggcggcagaaucggggcccugcagcugcagcuuagccaacuccacgagcaguguucuucccuggaaaaggagcugaaaagcgaaaaggagcagcggcaggcccuccaaagagaacugcagcacgagaaagauacgucuagccuucugcgcauggagcuccaacagguggaaggacugaagaaggagcugcgggaacuucaggacgagaaagcugagcuccagaagaucugcgaggagcaggaacaggcgcugcaagagaugggccugcaucucucccagucuaaacugaagauggaagauauuaaagagguuaaccaggcccuuaaggggcacgcuuggcugaaagacgaugaggccacacauuguagacaaugcgaaaaggaguuuagcaucucccgccggaagcaccauuguagaaauugcggacacauuuucuguaauaccugcagcucuaacgaacucgcccugcccuccuauccuaaacccgugcgcgucugcgacagcugucacacacugcuucuccagcgguguucuuccaccgcuagcuga

SEQ ID NO: 75147 - RNA, 1863 nt, Artificial Sequence
  derived and/or modified sequence opt5 from RUFY3__Homo_sapiens__NP_001032519
augagcgcccugacacccccuaccgacaugccgacgcccaccacagauaagaucacccaggcugccauggagacaauuuaccucugcaaauucagaguguccauggacggcgaauggcugugucuucgggagcuggaugacaucucucucaccccugaucccgaaccuacacacgaggaccccaacuaucugauggcgaaugaacgcaugaaccuuaugaauauggcuaagcugagcauuaaagggcucaucgaguccgcccugaaccugggaagaacccucgauucugacuacgccccucugcaacaguuuuucgucguuauggagcauugccuuaagcacggccugaaagcuaagaagacguuucucgggcagaauaagagcuucuggggaccgcuggaacuuguggagaagcuggugcccgaagccgcugagauuaccgccuccgucaaagaucucccuggccugaagacacccguggggcggggacgcgcguggcugagacucgcccugaugcagaaaaagcugucugaguauaugaaggcucugaucaacaaaaaggaacuccugagcgaguuuuacgaaccuaaugcccuuaugauggaggaagagggcgcuaucauugccggccugcucguugggcugaacgugaucgacgcgaauuucuguaugaaaggagaggaucuggacucccaagucggcgugauugauuuuagcauguaucucaaggacgggaacucuuccaaaggaaccgaaggcgacgggcagaucacagccauucuggaucagaagaauuacguugaggaacuuaaccggcaucugaaugcuaccgugaacaaucuccaggccaaagucgacgcucuggaaaagagcaacacgaaacuuacagaggagcuggccguggccaacaaucgcaucauuacccuccaagaggaaauggagagagugaaagaagagucuuccuauauccuggaaagcaaccggaagggacccaaacaggaucgcacagcugagggccaggcgcugucugaggccagaaagcaccucaaagaagagacccagcugcggcuugacgucgaaaaggagcuggagaugcaaaucuccaugcgccaggaaauggagcucgcuaugaagaugcuggaaaaagauguuugcgagaagcaggacgcccuggugagccuuagacaacagcucgaugaccugcgggcccugaaacaugaacucgcuuucaagcugcaguccucugaucuuggcgugaaacaaaagagcgagcuuaauucccgccucgaggaaaagaccaaccagauggccgcgacaauuaaacagcuggagcagagacugcggcaggcugaaagaagccgccaaucugccgagcuugacaaucggcucuuuaagcaggauuucggggacaaaaucaacucccugcagcuggaagucgaggagcucacgagacagcgcaaucaacuggaacuugagcugaagcaggaaaaagagcggagacuccagaacgaccgcagcauuccgggacggggcucucaaaagagcgaauccaagauggaugggaaacacaagaugcaggaggagaaugugaaacugaagaaaccucuggaagagucucacagacuucagccccauccuauggacgaacaggaucaacuccugcugagcgagaagccccagcucugucagcugugccaggaggacggaucccuuaccaaaaacguuuguaagaauugcagcggcacauuuugugaugccugcucuaccaacgaacugccccucccuuccagcaucaagcuggagcgcguguguaauccgugccacaaacaucugaugaagcaauacucuacaucccccagcuga

SEQ ID NO: 75148 - RNA, 1371 nt, Artificial Sequence
  derived and/or modified sequence opt5 from RUNDC3B__Homo_sapiens__NP_001127877
auggccagcagaucccugggcgggcucucuggaauccggggcgggggaggcgggggaggcaagaaaagccuguccgcucgcaacgccgcgguggagagacggaaucuuauuaccgucugccgcuucucuguuaagacacugaucgacagaagcuguuuugaaacgauugaugacuccucucccgaguucaacaauuuugcugccauccucgaacagauucugagccaccggcuuaaaggccaagugaccugguucggguacgaguccccucgcagcuuuugggauuauaucagaguggccugccggaaggucucucagaacuguaucugcuccauugaaaauauggagaacgugagcagcucccgcgcuaaaggcagagccuggauccggguugcucugauggagaagcaucucagcgaauacauuucuacagcccugcgcgacuucaagaccacaagacgguuuuaugaggauggcgcgaucgugcugggggaagaggccaauaugcucgcuggaaugcugcuuggccugaacgccauugacuucuccuuuugucucaaaggggagggacuggauggcagcuucccggcugucaucgacuacacccccuaucuuaaguacauucaguccucugauagcaucuccagcgacgaagaggaacugcgcacacucggaucuuccgggagcgagucuagcaccccugaaaaugugggacccccuuuucugauggaugagaacuccugguucaauaaaugcaagagaguuaaacagaaguaucaacugacgcucgagcagaagggcuaccuggaggaacuucugcggcucagagaaaaccagcugucugagagcgugucccagaauaaaauccuucugcaacgcauugaagacagcgaucucgcccacaagcuggagaaagagcagcuggaauacaucauugucgagcuccaggaccagcugaccgugcuuaagaacaaugaccugcggucuagacaagaacucacagcgcaucugaccaaccaguggcccuccccuggggcccuugaugugaacgcugucgcccuggacacacuccuguaucgcaaacacaauaagcagugguacgagaaaagcuaucaaucucuggaucagcucuccgcugaaguuagccugucccagaccucucuugacccgggacagagccaagagggcgaugggaagcaggacacgcugaacgugauguccgagggaaaggaagauacacccucucuccugggccuguguggcagccuuaccuccguggccagcuacaaaucucucacaucccugaagucuaaugacuaucuggccucuccuaccaccgagaugacaucccccgggcucacgccuagcuga

SEQ ID NO: 75149 - RNA, 1362 nt, Artificial Sequence
  derived and/or modified sequence opt5 from RUNX1__Homo_sapiens__NP_001001890
augagaauccccguggacgccagcaccucccggcgcuucacaccuccgucuacggcucugagccccggcaagauguccgaggcccucccucugggggcgcccgaugcuggagccgcccuugcuggcaaacugagaucuggggaccggagcauggucgaaguucucgccgaucacccuggagagcuggugcgcaccgacucccccaacuuucuuugcucugugcugccuacacauuggagauguaauaagacccucccgauugcuuucaaagucguggcccugggcgauguucccgacgggacacuggugaccgucauggcgggaaacgaugaaaauuacagcgccgagcuccggaacgcuacagccgcuaugaagaaucagguggcccgcuuuaacgaccugagauucguuggccgguccggccgcgggaaaucuuuuacccuuacgaucaccguguucacaaauccuccccaagucgcgaccuaucacagagccauuaagaucacaguggauggaccucgggaaccccgcagacaucggcagaagcuggacgaucagaccaaaccgggcagccucuccuuuagcgagcgccugucugagcuugaacagcugagacggacggcuaugagaguguccccucaccaucccgccccuacacccaacccccgcgcuagccucaaucacucuaccgccuucaacccucaaccgcagucccagaugcaggacacacggcaaauucagcccagcccucccugguccuacgaucagucuuaucaguaccuggggagcaucgccuccccuagcguccaccccgcuaccccgaucucuccugggagagcguccggcaugaccacacugagcgccgagcucucuagccgccuguccacggcucccgaccuuaccgccuuuucugacccucggcaauuccccgcccugccuagcauuuccgaucccagaaugcauuauccgggggcuuuuacauacagcccuacccccguuacaucuggaaucggcauuggcauguccgccauggggagcgcgacccgcuaucacacguaccugcccccuccguaccccggaucuucccaggcucagggcgggccuuuccaagccagcucccccucuuaucaucucuacuauggagccagcgcuggcuccuaccaguuuucuauggugggaggagaacggagcccucccagaauccuuccucccugcacaaaugccuccaccggcagcgcucugcucaacccgucucugccuaaucaguccgacguggucgaggccgagggcagccacucuaacucccccaccaauauggcgccuagcgcccgccuggaagaggcuguguggcggcccuauuga

SEQ ID NO: 75150 - RNA, 1815 nt, Artificial Sequence
  derived and/or modified sequence opt5 from RUNX1T1__Homo_sapiens__NP_001185560
augaucagcgugaagagaaacaccuggcgggcccugucccucgucauuggcgacugccgcaaaaaggggaauuucgaguacugucaggauagaacagaaaaacacucuacgaugcccgacagcccuguugaugugaagacccaaucccggcugacaccgcccaccaugccucccccucccacaacccagggagcuccucgcacaucuagcuuuaccccgacgacccuuacaaacggcaccucccauucucccacagcccugaauggggcgccuagcccucccaacggauucuccaauggccccagcucuagcagcagcuccagccucgcuaaccagcagcugccgccugccugcggggccagacaacuuucuaaacugaagcgguuucucaccacgcugcagcaguucggaaaugacaucucccccgagauuggcgaacgcgugagaacacugguccucggccuggugaacagcacccuuacaaucgaggaauuucacuccaagcugcaggaggcuaccaauuucccucuccggcccuuuguuauucccuuccugaaagccaaccuuccucugcuccaacgcgagcugcugcauugugcuagacucgccaagcagaauccggcgcaguaucuggcccagcacgaacaacuucugcucgaugcuucuaccacaagccccguggacuccagcgagcugcuucuggaugucaacgaaaaugggaaacggcgcacgccugacagaaccaaggagaacggauuugaucgggagccccuccauucugaacacccuuccaaacgccccugcacaaucagcccgggccagagauacucuccuaauaacgggcugagcuaucagcccaacggacugccucaccccaccccucccccgccucaacauuaccggcucgacgauauggccaucgcucaccauuauagagacuccuaccgccaccccucucaccgggaucugagagaccgcaaucggcccaugggccuucaugggacaagacaggaggaaaugauugaccaccgccugaccgaucgggagugggccgaagaguggaagcaucucgaccaucugcuuaacuguaucauggauaugguggagaagacgagacgcagccugacaguucuccggagaugccaggaagcggaccgcgaggaacugaauuauuggauucggagauacuccgaugccgaggaccugaaaaagggaggcggcuccucuuccagccacucucggcagcaauccccugugaacccggaucccgucgcucucgacgcccaccgcgaguuccugcacagaccugcuagcggguacgugcccgaagagaucuggaaaaaggccgaagaggccgugaaugaagucaaacggcaggcuaugaccgagcuucagaaggcgguuuccgaagccgagagaaaagcucaugauaugauuaccacagagcgcgccaagauggaacggaccguggccgaggcuaagagacaggccgcggaagacgcucuggccgugaucaaccaacaggaggauucuagcgaguccuguuggaauugcggacgcaaagccucugaaacauguagcggcugcaacacggcuagauauuguggguccuuuugccagcacaaggacugggagaaacaucaccacauuugcggacagacccuccaagcccagcagcagggcgacaccccugcugucucuucuuccgugacccccaauagcggggccggaucuccuauggauacacccccggcggccaccccucgguccacgacccccggcacaccuagcaccaucgaaacaacaccccgcuga

SEQ ID NO: 75151 - RNA, 1500 nt, Artificial Sequence
  derived and/or modified sequence opt5 from RUNX2__Homo_sapiens__NP_001015051
auggccagcaacucccuguucucuaccgugacacccugccagcaaaacuuuuucugggacccuagcacguccagacgguuuucuccgcccagcuccucucugcagccuggcaagaugagcgaugucucccccguuguggcugcccagcagcaacagcagcagcaacagcagcagcaacagcagcaacagcagcagcaacagcagcagcaacaggaggcggcugccgccgcugccgcugccgcggccgcugccgcugccgcggccgcugugccucgccugagacccccucacgacaaccggaccauggucgaaaucauugccgaucauccggcugagcuugugcgcacagacagccccaauuuccuguguucuguucucccuucccacuggagaugcaacaaaacccugcccguggccuuuaaggucguggcccuuggggaaguuccugauggaacaguggucaccgugauggcuggcaaugacgagaacuacagcgcggaacugcggaaugccucugcugugaugaaaaaccaggucgcccgcuucaaugaucucagauuuguugggcgguccggacgcggcaagagcuucacacugaccaucacgguguuuaccaaucccccucagguggccacauaucauagagcuauuaaagucaccguggacgggccgcgggagccccgcagacaccggcaaaagcuggaugacucuaagccuucccucuucagcgaucgccuguccgaccuuggaagaaucccccaucccucuaugcggguuggcgugccuccgcagaaucccagaccuagccugaacuccgcccccagcccuuuuaauccccagggccagucucaaauuacagauccgcgccaggcgcaguccagcccucccuggucuuacgaccaaagcuauccuuccuaccucucucagaugaccagccccuccauccacagcacgacaccucugucuuccacccgggggacaggacuucccgcuaucaccgacgucccgagacgcauuagcggcgccucugagcuggggccuuucuccgauccccggcaguuucccagcaucuccucucucaccgaaagcagauucuccaacccucgcaugcacuauccggccacauucacguacacacccccugugaccucuggaaugagccugggcauguccgcuaccacacauuaucacaccuaccugcccccucccuacccugggagcucucagucccaaagcggacccuuucagacgucuuccacaccguaucucuacuauggcaccagcucuggcagcuaccaguucccuaugguucccgggggagaccgguccccuagcagaaugcugcccccguguaccacaaccucuaauggcuccacacuucugaacccuaaccuccccaaucagaacgaugggguggacgccgauggaagccauuccucuagcccuacgguccucaauuccucuggccgcauggacgagagcguguggcggcccuauuga

SEQ ID NO: 75152 - RNA, 1131 nt, Artificial Sequence
  derived and/or modified sequence opt5 from RUNX3__Homo_sapiens__XP_011540653
auggccagcaacuccaucuucgacucuuuucccaccuacagcccuacauucauuagagauccguccacgucucggcgcuuuacacccccuagccccgcuuucccuugcggcgggggaggcgggaagaugggagagaauagcggcgcccugucugcgcaggcugccguggggcccggaggcagagcccggccugaaguccgcagcaugguugacgugcucgcugaucacgccggcgagcuggugagaaccgacuccccgaacuuucuuuguagcguccugcccucucauuggcggugcaauaaaacccucccuguggcuuucaagguuguggcccugggggauguccccgacggaacagugguuaccgugauggcgggcaacgaugaaaauuauuccgccgagcuucgcaacgcuagcgccgucaugaaaaaucaaguggcuagauuuaacgaccugcgguucguggggcgcucuggaagaggcaaguccuuuacacucaccaucacggucuucaccaauccuacacagguugccaccuaccaccgggcgauuaaagugacaguggaugggccccgcgaaccgagacggaccagcgagcugaacccuuuuucugacccccgccaguucgauagauccuuuccuacgcugcccacacucaccgagagccgguuccccgacccuagaaugcauuauccgggagccauguccgcugccuuccccuacucugcuacaccuagcggcaccuccaucagcucucuguccgucgccggcaugcccgccaccagccgcuuucaccauacauaucuuccucccccguacccuggggcuccccagaaucaaucuggaccuuuccaggcgaaccccagcccuuaucaccuguacuacggcacguccucugggagcuaucaguuuuccaugguggccggauccucuuccggcggggaucggagccccaccagaaugcucgcuucuuguacauccagcgccgccuccguugcugccggaaaucugaugaacccgucucuuggcggccagagcgacgggguggaagcggacggaucccacucuaauagcccuaccgcucuguccacacccggccgcauggaugaggccgucuggcggcccuacuga

SEQ ID NO: 75153 - RNA, 1371 nt, Artificial Sequence
  derived and/or modified sequence opt5 from RUVBL1__Homo_sapiens__NP_003698
augaagaucgaggaagugaaaagcaccacaaagacgcagagaauugccucccacucucaugucaaaggccuggggcucgacgagagcggacuggcuaagcaagccgcguccggccuuguugggcaggaaaacgcucgggaggccugcggagugaucguggaacugauuaaaucuaagaagauggccggccgcgcuguccuccuggccgggcccccuggaaccggcaaaacagcucuugcccuggcgaucgcccaggagcucggcagcaaggugccguucugucccaugguuggguccgagguguacucuaccgaaauuaaaaagacagagguccugauggaaaauuuuagacgggcuaucggacugcgcaucaaagagaccaaggagguguaugaaggcgagguuacagaacucaccccuugcgagacggaaaaccccaugggaggguacggcaagaccauuagccacgugaucauugggcugaaaacagccaagggaaccaaacagcuuaagcuggauccuuccaucuucgagagccuccaaaaagagagagucgaagcuggcgacgugauuuauaucgaggccaauucuggcgcggugaagcggcaggggcgcugugauacauacgccaccgaauuugaccuggaggcugaagaguaugucccccuuccuaaaggagauguucauaagaagaaagagauuauccaggacgugacgcugcacgaucucgacguggccaacgcuagaccgcagggcgggcaagauauccuguccaugaugggacagcugaugaagcccaaaaagacagaaauuaccgacaaacuccggggcgagaucaauaaggucgugaacaaguacauugaucaggggaucgccgaacugguuccuggagugcuuuucgucgacgaggugcauaugcuggauauugaaugcuuuacauaucuccaccgcgcccuggagagcucuaucgcucccaucguuauuuucgcguccaauagaggcaacugugugauccggggcaccgaggacauuaccagcccucacgggaucccccuugaccugcucgaucgcgucaugauuaucagaacaaugcuguacacgccgcaggaaaugaaacaaaucauuaagauccgggcccagaccgagggaauuaauaucucugaagaggcucugaaccaucucggcgagauugggacaaaaaccacacugcgcuacuccgugcagcuucugaccccugccaaucuccuggccaagaucaacggaaaagacagcauugaaaaggagcacgucgaagagaucuccgaacuguuuuaugaugcuaagucuagcgccaaaauccuugcggaccaacaggauaaguacaugaaauga

SEQ ID NO: 75154 - RNA, 1392 nt, Artificial Sequence
  derived and/or modified sequence opt5 from RUVBL2__Homo_sapiens__NP_006657
auggccaccgugacagcuacgaccaagguccccgagaucagagacguuacacggauugaacgcaucggcgcccacagccauauuagagggcugggacucgaugacgcgcuggagccucggcaggcuucccaaggcaugguggggcagcuugccgcccgcagagcugccggagugguccuggaaaugauccgggagggcaaaauugcugggcgcgccgugcucaucgcgggacagccgggcaccggcaagacagccaucgcuauggggauggcccaggcucugggacccgauaccccuuucacagccauugcgggcucugaaaucuuuagccuugagauguccaaaaccgaggcccugacgcaggcuuucagacggucuauugggguucgcaucaaggaagagaccgaaauuaucgagggagagguggucgaaauucaaaucgacagacccgccacaggcaccgggagcaaagugggaaagcucacacugaagaccacggagauggaaacaaucuacgaucugggcaccaaaaugauugagucccucacaaaggacaaaguucaggcuggcgaugugaucaccauugacaaggccaccgggaaaaucucuaagcugggacggagcuuuacacgcgccagagauuaugacgcuaugggcucccagacgaaguucguccaaugcccugauggggaacuucagaaacggaaggagguggugcacaccgucagccugcaugagauugacguuaucaacucucgcacacagggauuucucgcgcuguucuccggcgauaccggggaaaucaaaagcgaggugagagaacagauuaaugccaagguggcugaguggcgggaagagggaaaagccgagaucauucccggcguccuuuuuaucgacgaagugcacaugcuggacauugagucuuucuccuuucucaacagagcccuggaaagcgauauggcuccuguucugaucauggccacaaaucgcggcaucacccggauuagagggacgucuuaccaauccccgcauggaauccccauugaccuccuggaucgccuucugaucgugagcacaaccccuuauuccgagaaggacaccaaacagauucuccggaucagaugugaagaggaggaugucgaaaugucugaggacgcguacacagugcugacccgcauuggccuugaaacaagccugcgguaugcuauccagcucaucacggccgccucccugguuugcagaaagcgcaaggggaccgaggugcaagucgaugacauuaaacggguguacagccuguuccucgaugagucuagauccacacaguauaugaaggaauaccaggacgcuuuucuguucaacgagcuuaaaggagaaaccauggauacaagcuga

SEQ ID NO: 75155 - RNA, 2130 nt, Artificial Sequence
  derived and/or modified sequence opt5 from RXFP1__Homo_sapiens__NP_001240658
augaccagcggcuccguguucuuuuacauccugauuuucgggaaguauuuuucucacggaggcgggcaggacgucaaaugcagccugggauacuuccccuguggcaacaucacaaagugccugccucaacuucugcauuguaaugggguugaugacugcggaaaccaggccgaugaggacaauuguggcgauaacaauggcuggucccuccaguuugacaaauauuucgcuucuuacuauaagaugacgagccaguacccguuugaagccgagacccccgaaugccuggugggguccgugccuguccaaugucuuugccagggacuggagcucgauugugacgaaacaaaccugagagcggugcccucuguuagcuccaaugugaccgcuaugagccugcaguggaaccucauucggaaacugccucccgauugcuucaagaauuaucacgaccuucagaagcuguaccuccaaaacaauaaaaucacaucuauuuccaucuacgccuuucgcggccugaacagccuuaccaagcuguaucucucucauaauagaaucacauuccugaaaccuggggucuuugaggaucugcaccggcucgaguggcugauuaucgaagacaaccaucuuucccgcauuagcccgcccaccuucuacggacugaauagccucauccugcuugugcugaugaacaacguucucacgagacugccugauaagccccugugucagcacaugccucggcuccacuggcuggaccuugagggcaaucauauucacaaccugcgcaaucucaccuuuaucuccugcagcaaccugacagugcuugucaugcggaaaaauaagauuaaccaucugaaugaaaacaccuucgcuccccuccagaagcuggacgaguucucccuggaggggaucgaaaucucuaauauucagcaacggauguuucgcccgcucaugaaccugagccacaucuauuucaaaaaguuucaguacugcggauaugccccucacgugagauccuguaaacccaauacagauggcauuagcucucuugagaaccugcucgccuccaucauucagcggguguucgucuggguugugagcgcugugaccugcuuuggcaauaucuucgucaucuguaugcgcccuuacauuagaucugaaaacaagcuguaugccaugagcaucauuucccugugcugugcggacugccuuauggggaucuaccucuuugugauuggaggcuucgaucugaaauuuagaggggaguacaauaagcaugcccaacuguggauggaaucuacgcacugucagcucguuggaagccuggcuauccuuuccacagaggugagcguccugcuccugaccuuccugacacuugagaaauauaucugcauuguguaccccuuucgcuguguuagacccggcaagugccggaccaucaccgugcucauucugaucuggauuacaggguucaucgucgccuuuauuccucugucuaacaaggaguucuucaaaaacuauuacggaacgaauggcguguguuuuccgcuccauuccgaagacaccgaaagcaucggcgcucagaucuauucugucgccauuuuccuggggaucaaccuugcggccuuuauuaucauuguguucuccuacggaagcauguuuuauuccguucaccagucugcuaucacagccaccgagaucagaaaucaagugaagaaagaaaugauucuggcuaagcgcuucuuuuucaucgucuuuacagaugcccucugcuggauucccaucuucgugguuaaauuucugagccugcuucagguggagauuccuggcaccaucacguccugggucgugaucuucauucuccccaucaacucugcccugaauccuauucuguacacacucaccacccggcccuuuaaggagaugauccauagauucugguacaacuaucgccagcggaagucuauggacuccaaagggcagaagacauacgcuccgagcuucauuuggguggaaauguggccucugcaagagaugcccccugaacuuaugaaacccgaucuguuuaccuauccuugcgagaugucucucaucucccagagcacaagacucaauucuuacuccuga

SEQ ID NO: 75156 - RNA, 2193 nt, Artificial Sequence
  derived and/or modified sequence opt5 from RXFP2__Homo_sapiens__NP_001159530
augaucguguuccuggucuuuaagcaccucuucagccugagacuuauuaccauguuuuuccugcuccauuuuaucguucugauuaacgugaaagacuucgcccuuacacagggcuccaugaucacgcccucuugccaaaagggguacuuuccuuguggaaaucugaccaaaugccucccgcgggcuuuccacugugauggcaaggacgauugcgggaacggagccgacgaggaaaauuguggcgauacaagcgggugggcgaccauuuuuggaacagugcauggcaacgcuaauuccgucgcccugacccaggagugcuuccugaaacaguauccccaguguugcgacuguaaggaaacagagcucgaaugcgugaacggcgaucugaagucuguuccuaugaucagcaauaacgugacccuucugucccucaaaaagaauaaaauccacucucugcccgacaaggucuuuauuaaauacacgaaacuuaagaagaucuuccugcaacauaacuguauucgccacaucagcagaaaggccuuuuucgggcucugcaaucugcagauucuguaucucaaccacaauugcaucaccacacugcggccuggaauuuucaaagaucuucaucagcugaccuggcucauccuggacgauaaccccaucacacgcauuucccagagacuuuuuaccggccugaauagccucuucuuucugucuauggugaacaacuaccuggaggcucucccuaagcaaaugugugcccagaugccgcagcugaauuggguugaccuugaggggaaccggaucaaauaucugacaaauuccacguuccucagcugcgauucucugaccgugcuugaccuguccagcaacacaauuaccgaacucucuccccaccuguuuaaggaccugaaacuccugcagaaacuuaaucuguccagcaacccucucauguaccugcauaagaaucaauucgagucccugaagcagcuucagucucucgaucuggaacgcaucgagauucccaacaucaauaccagaauguuucaaccuaugaagaaccugagccacaucuauuucaaaaauuuucgguacuguuccuacgcuccccacguccgcauuugcaugccgcucacagacggaaucagcucuuucgaggaucugcuugccaacaauauucugagaaucuuugugugggugauugcguucaucacguguuuuggcaaccucuucgucaucgggaugcgguccuucauuaaggccgaaaauaccacacaugcuaugagcaucaaaauucugugcugugccgacugccugaugggaguuuaucuuuucuuugugggcaucuuugauauuaaguaccgcggccaguaucagaaguacgcucuccuguggauggagucugugcaguguagacugaugggguuccucgccaugcugagcaccgaagucuccgugcuucugcucacauaucugacccuggagaaauuucuuguuaucguguucccuuuuucuaacauucggcccggaaagcgccaaacgagcgucauccucaucugcauuuggauggcgggcuuccugaucgccgugauuccuuuuuggaacaaagacuacuucgggaauuuuuauggaaagaacggcguuuguuucccccuguacuacgaucagacagaagacaucggguccaaaggauauagccucggcauuuuucugggcgugaaucuucuggcuuuccucaucaucgucuucucuuacauuaccauguuuugcuccauccagaagaccgcccugcagacaaccgaggugagaaacugcuucgggcgggaggucgcuguggccaauagauuuuucuuuauuguuuucagcgaugccaucuguuggauucccguguuugucgugaagauccugucucuuuuccgcguugaaaucccugacacaaugacguccuggauugugaucuuuuuccucccggucaacagcgcucugaaucccauucuguauacccucacaaccaacuuuuucaaagauaagcugaaacaacuucugcacaagcaucagcggaaauccaucuucaagauuaagaaaaagucucucagcacauccaucguguggaucgaggacucuagcucccugaaacugggagugcuuaauaagauuacccugggcgacagcaucaugaaaccuguuucuuga

SEQ ID NO: 75157 - RNA, 1410 nt, Artificial Sequence
  derived and/or modified sequence opt5 from RXFP3__Homo_sapiens__NP_057652
augcagauggccgacgcugccaccaucgcgacaaugaacaaggcugccggcggggauaaacuggccgaacucuucagccuggugcccgaccuucuggaagcugccaauacguccggaaacgcuucucuccaacugccugaucuuuggugggagcugggccucgaacugccggacggggcgcccccuggacaucccccuggcagcgggggagccgaguccgccgauaccgaagcuagaguccggauucugaucucuguuguguacuggguggucugcgcccucggccuggcuggcaaucuucuggugcucuaucugaugaaaagcaugcagggguggcgcaaguccucuauuaaccuuuuuguuacaaaucuggcccucaccgacuuccaguuugugcugacacugcccuucugggcggucgagaacgcccucgauuuuaaguggccuuucggaaaagcuauguguaagaucgugagcaugguuaccuccaugaauauguacgccagcguguuuuuccugacagcuaugucugucaccagauaucacuccguggccagcgcccuuaagucucaccggacgcgcggccaugggagaggagacugcuguggccggucccugggggauagcugcuguuuuucugcuaaagcgcucugcguguggauuugggcccuggcugcccuugccucccugccgagcgcuaucuucuccaccacagucaagguuaugggagaggaacucugucuggugcgcuuucccgacaaacugcucggcagagaucggcaguucuggcugggccuuuaccacucucaaaaggugcugcucggguuuguccugccucuuggaaucauuauccugugcuaucuccugcuggugcgcuucauugccgacagacgggcggcuggcaccaaagggggagccgccguugcuggcgggcgccccacaggagccagcgcuagacggcucuccaaggugaccaagagcgucacgaucgugguucugucuuucuuucuuuguuggcugccuaaccaggcccucacaaccugguccauucugaucaaauucaaugcggugcccuuuagccaggaguacuuccugugccaggucuaugccuuuccggugucugucugucuugcucauagcaacuccugccucaauccugugcuguacugccugguucgcagagaguuccggaaggcccucaaaucucugcuuuggagaauugcuagccccuccaucacaagcaugcgcccuuuuaccgccaccacaaagcccgagcacgaggaucaaggccugcaggcgcccgccccuccgcacgcugccgcugaacccgaccuccuguacuauccucccggcguggucguguacucugggggacgguaugaccugcuuccuuccagcucugccuacuga

SEQ ID NO: 75158 - RNA, 1308 nt, Artificial Sequence
  derived and/or modified sequence opt5 from RXRA__Homo_sapiens__NP_001278849
auggccgcccccagccugcacccuucccucggcccggggaucggaucucccggccagcugcauagcccuauuuccacccuuucuagccccaucaacgggaugggaccucccuucuccgugauuucuagcccuaugggcccgcacuccaugagcguccccacaacgccuacccugggguuuucuacaggaagcccccaacucuccucuccuaugaaucccguuuccagcucugaggacaucaagccgccucugggccuuaacggcgugcugaaagugcccgcccauccuuccgggaauauggcgagcuucaccaagcacauuugcgcuaucuguggagauagauccucuggcaaacauuacggggucuauagcugcgaaggauguaagggcuuuuucaaacggacagugcgcaaggaccucaccuacacaugcagagauaacaaggacugucugaucgauaaacggcagcgcaauagaugccaguauugucgguaccagaagugccuggccauggggaugaaacgcgaggccguucaagaagagagacagcggggaaaggaccgcaacgaaaaugagguggaguccaccagcucugcuaacgaagauaugcccgucgagagaauccucgaagccgagcuggcuguggagcccaaaacggaaaccuauguugaggccaauaugggccuuaacccuuccagcccgaaugaccccgugacaaacauuugucaggcggccgauaagcagcuguuuacccucgucgaaugggcuaagcggauuccucacuucucugagcugccccuugacgaucaagugauccugcuccgcgccggcuggaaugaacugcugauugcuagcuuuucccacagaucuaucgccgugaaagacgggauucuccuggcgacaggacuucauguccaccggaacagcgcccauuccgcuggcguuggggccaucuucgaucgcgugcugaccgagcucgugagcaagaugagagacaugcagauggacaaaacggagcugggaugccuucgggcuaucguccuguuuaauccugauucuaagggccucuccaaccccgccgaaguggaggcccugagagaaaaaguuuacgcuagccuggaggcguauuguaagcacaaauacccggaacagccugggcgcuucgccaagcuccugcuucggcugcccgcucucagaucuauuggacugaagugccuugagcaccuguuuuucuuuaaacucaucggcgacacaccuauugauaccuuccugauggagaugcuggaagcuccccaucagaugacauga

SEQ ID NO: 75159 - RNA, 1614 nt, Artificial Sequence
  derived and/or modified sequence opt5 from RXRB__Homo_sapiens__NP_001257330
augagcugggccgcuagacccccuuuccugccgcagcggcacgccgcgggccaaugcgggcccgugggaguccgcaaggagaugcauuguggcguugcuuccagauggcggcgcagacggccuuggcucgaccccgccgccgcugccgcugccgcgguggccgggggagaacagcagaccccugagcccgaaccuggcgaggcugggcgcgauggaaugggcgacucuggcagagauagccgguccccggacucuagcucccccaacccucugccccagggggugccucccccgucuccucccggaccuccccuucccccuagcacagccccgucccugggcgggagcggagcucccccucccccucccaugccgccucccccucucggcucucccuuuccugucaucuccagcucuauggggucccccggacugccgccucccgcgcccccuggcuucagcggcccggugucuagcccccaaauuaauuccacgguuucccuuccugggggaggcucugggcccccugaagaugugaaacccccuguccugggagugcgcggccuccacugucccccgccucccgggggaccuggcgccggcaagagacugugcgccaucugcggggaccggagcuccggaaaacauuacggcguuuauagcugugaggggugcaagggauuuuucaaacgcaccauuagaaaggaucugacauacucuugucgggacaacaaggauugcaccguggacaaacgccagagaaaucggugucaguauugcagauaccagaagugucucgcuacaggcaugaaacgcgaggccguccaagaggaacggcagagagggaaggauaaagacggcgauggagaaggcgcugggggagcccccgaggagaugccgguggaccgcauccuggaagccgagcuugcuguggaacagaaguccgaccagggcgucgaggggccuggaggcaccgggggcagcggaucuagccccaacgauccuguuacaaauauuugccaagcggccgacaagcagcuguuuacccucguggaaugggcuaaacggaucccccacuucuccucucugccccuugaugaccaggugauccugcucagagccggcuggaacgagcugcugauugccagcuuuucccaucgcagcaucgauguccgggacgggauucuccuggcuacgggacuucacgugcacagaaauucugcccauuccgcgggcguuggggcuaucuucgaucgcagccugucucgggugcucaccgagcuggucuccaagaugagagacaugcgcauggauaaaacagaacuuggaugccugcgggccauuauccucuuuaacccugacgccaagggccugagcaauccguccgagguggaaguucugagagagaaaguguaugcuucucucgaaaccuacuguaagcaaaaauaucccgagcagcaggggcgguucgccaagcugcuucugcgccucccugcucugagaagcauuggccuuaagugccuggagcaccucuuuuucuuuaaacugaucggagauacacccaucgacaccuuccugauggaaaugcucgaggccccucaucagcuggcguga

SEQ ID NO: 75160 - RNA, 1392 nt, Artificial Sequence
  derived and/or modified sequence opt5 from RXRG__Homo_sapiens__NP_008848
auguacggcaacuauagccacuucaugaaguuucccgccggguacggaggcuccccugggcauaccggaucuacaagcauguccccgucugcugcccugagcacgggcaaacccauggacucccacccuucuuauaccgauacacccgugagcgcgccuagaacccucuccgcugucgggacaccccugaaugcccuuggaagcccuuaccggguuaucaccucugccaugggcccgcccuccggcgcucuggccgcuccucccgggauuaaccucguggccccucccagcucucagcugaauguggucaacuccgugucuagcuccgaggacaucaagccgcuuccuggacugcccggcauugggaauaugaacuauccuagcacaucccccggaucucucguuaaacauaucugcgcgauuuguggcgaucgcagcuccgggaagcacuacggaguguauagcugcgaaggcuguaaaggcuucuuuaagagaaccauccggaaggaccugaucuacacgugccgcgauaauaaagacugucugauugauaagagacaacggaaccgcugccaguacuguagauaucagaaaugccucgucauggggaugaagcgggaggccgugcaggaggaacgccaaagaucucgggaacgcgcugaguccgaggccgaaugugcuaccagcggacaugaggacaugcccguugaaagaauccuggaggccgagcuugcgguggaaccuaaaacagagucuuacggcgauaugaauauggaaaacagcaccaaugacccggucacaaacauuugccacgccgcugauaagcagcuguucacccucguggagugggccaagcggaucccccacuuuuccgaccugacgcuugaagaucaggugauucugcuccgcgcuggguggaaugagcugcugaucgccucuuucagccauagauccgucagcguucaggacggcauucuccuggccacaggacuucacgugcaucggucuuccgcucacagcgcgggggugggaucuaucuuugacagaguccugaccgagcucguguccaaaaugaaggauaugcaaauggacaaaagcgaacugggcugucuucgcgccaucguucuguucaacccugaugcuaagggccucuccaaucccucugagguggaaacacugcgggagaaagucuaugccacccuggaagccuacaccaagcagaaauauccugagcagcccgggagauuugcuaagcuccugcuucgccugccggcccuccggagcauuggacugaagugccuugagcaccuguucuuuuucaaacucaucggcgacacaccuauugauacguuucugauggaaaugcuggagacaccccuccagaucaccuga

SEQ ID NO: 75161 - RNA, 687 nt, Artificial Sequence
  derived and/or modified sequence opt5 from RYBP__Homo_sapiens__NP_036366
augaccaugggcgacaagaaaagccccacaagaccuaagcggcaggccaaaccggcugccgaugagggguucugggacugcuccguguguacguuucgcaacucugcggaggcuuucaagugcagcaucugugaugucagaaaaggaaccuccacacggaagccccgcauuaauucucaacugguugcccaacagguggcccagcaguacgcuaccccucccccucccaagaaagaaaagaaagaaaagguggagaaacaggacaaggaaaagccugagaaagauaaggagaucagcccguccgucaccaaaaagaacacaaauaaaaagacaaaacccaagucugacauucucaaggauccucccagcgaagccaacuccauccagagcgcuaaugccaccacgaaaaccucugagacaaaccacaccuccagaccucggcugaagaauguggaccgcagcacagcgcagcaacuugccguuaccgugggcaacgucacggugauuaucacagauuuuaaagaaaagaccagaucuuccagcacaucuuccagcaccguuaccuccucugcugggagcgagcagcagaaucaguccagcucuggauccgagagcacagacaaaggcucuagccgguccucuacgcccaagggggauaugagcgccgugaacgacgaauccuucuga

SEQ ID NO: 75162 - RNA, 1833 nt, Artificial Sequence
  derived and/or modified sequence opt5 from RYK__Homo_sapiens__NP_001005861
augagaggcgccgcucggcuggggcgccccggaagaagcugccucccuggcgcccgggggcugcgcgcgccgcccccucccccucuucugcuccugcuugcucugcucccccugcugccugccccgggagccgcugccgcucccgccccuagacccccugagcuccaguccgcgucugccggccccagcgugucccuguaccuuucugaagacgagguccggcgccugaucgggcucgaugcugaacuguauuacguuagaaacgaccuuauuagccacuaugcccuguccuucucucuccuggugccgagcgagaccaauuuucugcauuucacauggcacgcuaaguccaaaguggaauacaagcucggauuucaagucgauaacgugcuggccauggacaugccucagguuaauaucagcgugcagggcgaggucccccggacgcuuucuguguuccgcguugagcuguccuguaccggcaaaguggauagcgaagucaugauucucaugcagcugaaccuuacagugaauagcuccaagaacuuuaccgugcugaauuucaaaagacggaagaugugcuauaagaaacucgaggaagucaagacaagcgcgcuggacaaaaacaccucucgcacaaucuacgauccuguucaugccgcucccaccacguccaccagaguguuuuauauuagcgugggggucuguugcgccgugaucuuccugguugcuaucauucucgccgugcugcaccuucauuccaugaagcggaucgagcuggacgauucuauuagcgccuccucuucuucccaaggacucagccagcccucuacacagaccacacaguaccugcgcgcugacaccccuaauaacgcgacgccgaucacaagcucccuuggcuaccccacccugagaauugagaaaaaugaucuccggucugucacacugcuggaagccaaggggaaggugaaagacaucgcuauuagcagagagcgcaucacccucaaggauguucugcaagaaggaaccuuuggccggaucuuccacgggauucuuaucgacgagaaagacccuaacaaggaaaaacaggccuuugugaagacagucaaagaucaggccuccgagauucaggugacgaugaugcugaccgagagcuguaagcucagaggacugcaccaucgcaaucugcuucccaucacacacgucugcauugaagagggcgaaaagccuauggugauccuccccuauaugaacuggggcaaucugaaacuguuccuccggcaauguaagcugguugaggcuaacaacccgcaggccaucucucagcaagaccuugugcauauggcgauucagaucgcuugcgggauguccuaccuggccagacgcgaagucauucacaaagaucucgccgcucggaauugugugaucgacgauacccugcagguuaagauuacagacaacgcccugagcagagaucuuuuuccuauggacuaucacugccucggagauaaugagaaccgccccgugcgguggauggcucuggagucucuggucaauaacgaguucuccagcgccuccgacgugugggcguucggcgugacccucugggagcugaugacgcuugggcagacaccuuacguugauaucgaccccuuugaaauggccgcuuaucugaaagacggauacagaaucgcccaaccuauuaauugucccgaugaacucuucgcugucauggccugcugcugggcgcuggacccggaggaacgcccuaaguuucagcagcuggugcagugucuuaccgaguuccaugccgcucucggcgccuauguguga

SEQ ID NO: 75163 - RNA, 15117 nt, Artificial Sequence
  derived and/or modified sequence opt5 from RYR1__Homo_sapiens__NP_000531
augggcgacgccgagggggaagaugaggugcaguuccugagaacagacgaugaagucguucuccaaugcagcgcuacagugcugaaggagcagcuuaaacugugucucgccgccgaaggauuuggcaaccggcugugcuuccuugagcccacguccaaugcucagaacgugccuccggaccuggccaucuguugcuuuguccucgagcagucucugagcgugcgcgcccugcaagaaaugcucgcuaauaccguugaggccgggguggaauccucucagggaggcgggcacagaacacugcuuuacggacacgcuauucugcuccggcacgcccauagccgcauguaucuguccugucuuaccacaucuagaagcaugaccgauaagcuggcguucgacgucggccuccaggaggaugccacaggcgaggcuugcugguggaccaugcaccccgccuccaaacagcggagcgaaggggagaaggugcgcguuggagacgauaucauucuggugucugucuccagcgaaagauaccugcaucucucuacggcuuccggcgagcugcaaguggacgccagcuuuaugcagacccuuuggaacaugaauccuaucuguucucggugcgaagagggguucgugacaggaggccacguccugcgccucuuucacgggcauauggaugagugucugaccauuucccccgccgacagcgaugaccagagacggcuuguuuauuacgaaggaggcgccgugugcacacacgcucgcucccuguggagacucgagccucugcggaucucuuggagcggcucccaucugcgcugggggcagccccucagagugcggcacgucaccacgggacaauaucuggcccuuacagaagaccagggccuggugguuguggaugcuagcaaagcccacaccaaggccacaucuuucuguuuuagaaucuccaaggagaaacucgacgucgcuccuaagcgcgauguggaagggaugggaccgcccgagauuaaauacggcgagagccugugcuucguucagcauguggcgucugggcuuuggcugaccuaugccgcuccugaccccaaggcccuccggcugggaguccugaaaaagaaggccaugcuccaccaagaaggccauauggaugacgcucugagccuuaccagaugccagcaggaggaaucccaggccgcgcgcaugauccacucuacaaacggccuguacaaucaauuuauuaaaagccucgauuccuucagcgggaagccucggggaucuggaccucccgcugggacggcccugcccaucgagggagugauucugucccuucaggaccucaucauuuacuuugaacccccuagcgaggaucugcagcaugaggaaaaacagucuaagcugagaucccuccgcaaccggcaaagccuguuccaggaggaaggcaugcuuuccaugguccugaauuguaucgacagacucaacguguauaccacagccgcucacuucgccgaguuugcuggggaggaagccgcggagucuuggaaagaaaucguuaaucugcuguacgagcuucucgccagccugauucgcggcaaccgguccaauugcgcucuguucucuaccaaccucgauuggcuggugagcaaacuugacagacuggaagccuccagcggaauccucgagguccuguauugugugcugauugagucucccgaaguucuuaauaucauucaggagaaccacaucaaauccaucauuagccuccuggacaagcauggccgcaaccacaaggugcuggauguccucugcucucugugugugugcaaugggguggcuguucgguccaaccaggaccuuaucacagaaaaucugcuccccggaagagagcugcugcuucaaaccaaccucauuaauuacgucacgagcauccggccuaacauuuuugugggccgcgccgaagggacaacccaguauucuaaaugguacuucgaggugauggucgaugaggugaccccguuucugacagcgcaggccacccaucugagaguuggaugggcucucacagaaggcuauacgcccuacccuggggccggcgagggauggggcgggaauggagugggcgacgaucuguacagcuauggguucgacggacuucaccuguggaccggccacgucgcucggcccgugacauccccugggcagcaucuccuggcccccgaagauguuaucagcuguugccuggaccuuucugugccguccaucagcuuuagaauuaacggcuguccuguccaaggaguguucgaguccuuuaaucuggauggccucuucuuucccguugugucuuucagcgccggggucaaggugcgcuuucugcucggaggccggcacggggaguucaaauuccugccucccccuggauacgcucccugccaugaggcggugcuuccgagagagcgccugcaccucgaaccuaucaaggaguauagacgggaaggcccccgcgggccccaucuggucggcccuuccagaugucugucucacaccgacuuuguuccgugccccguggauacagugcagauuguccuuccuccccaccuggagcggauccgcgagaaacucgccgaaaacauucaugagcugugggcucucaccagaaucgaacagggauggacguacggcccugugcgggacgauaauaagcgccugcaccccugccuuguugacuuccauagccugccugagcccgaaagaaacuauaaucuccaaauguccggggagacccugaagacacugcuugcccugggaugucacgugggcauggccgacgagaaagcugaagauaaccucaagaaaaccaagcugccgaaaacauacaugaugucuaauggguauaagccugcgccccucgaccugagccauguccggcuuaccccugcgcagacgacacugguggaucgccuggcugagaacggacacaacguuugggccagagaccgggugggccagggcugguccuacagcgccguccaggauauucccgcuagacgcaauccgcggcucgugccuuacagacugcuugacgaagccaccaagcgcucuaaccgggauucccugugccaagcgguuagaacacuccugggguauggauacaauaucgagcccccugaccaggaacccagccagguggagaaccagucucgcugugaucgggucagaaucuuucgcgcugagaaauccuauaccgugcaaagcggccggugguacuucgaauuugaggccgugaccacaggggaaaugagagucggaugggcccggcccgagcuccgcccugacguugaacugggcgcugaugagcuugccuauguguucaaugggcacagaggacagcgguggcaucugggcucugagccguuuggccgccccuggcagccuggggacguggucggaugcaugauugaucugacggaaaacaccaucauuuucacacucaauggcgaggugcugauguccgacagcggguccgaaaccgcuuuuagagagaucgagauuggagacggcuuccuucccguuuguagccuggggccuggacaggugggccaccucaaccugggccaagaugucucuagccuccgguuuuucgccaucugcgggcugcaggaaggauuugagcccuucgcgaucaauaugcagagaccugugacaaccugguucuccaagggccuuccgcaauuugaacccguuccucuggagcauccccacuacgaagugucucgcgucgacgggacgguggauacaccucccugucugcggcucacccacagaaccuggggaagccagaacucccuggucgagaugcuuuuccugcgccucucucugccggugcaguuucaucagcacuuccggugcacagccggcgcuaccccucucgcgccgcccgggcugcaaccucccgcugaggacgaagccagagccgcugagccugauccggacuaugaaaaucuucgccggagcgcgggaggcugguccgaggccgaaaacggcaaagaggggacagcuaaggagggagcccccggcgggacgccucaggccggaggcgaagcucagcccgccagagcggagaaugaaaaagaugcuaccacagagaagaacaagaaacgcggguuucuguucaaggccaaaaagguugccaugaugacccagccucccgcuacaccgacccugccuagacucccccaugacguggucccugccgauaaucgggacgaucccgaaauuauccugaacacgaccacauacuacuauucugugcgcguuuuugcgggacaagagccuagcugugugugggcuggcugggucacccccgacuaccaccagcaugacauguccuucgaucuuagcaaagugagagugguuacagucaccaugggcgacgagcaggggaacgugcacucuucccugaagugcagcaauuguuauaugguguggggaggcgauuuugucucuccggggcagcaaggacggauuucccacacagaccucgugaucggcugccugguugaucuggccaccgggcucaugacguucacagccaacggaaaagaaagcaauaccuuuuuccagguggagccuaacaccaaacuuuuccccgcugucuuugugcugcccacacaucagaauguuauucaguucgaacugggcaagcagaagaacaucaugccucucuccgccgcuauguuucagucugagcgcaagaauccggcuccccagugcccucccagacuggagaugcaaaugcuuaugccugugagcuggucccggaugcccaaccacuuccugcaggucgaaaccagacgcgcgggcgagcggcucgggugggccgugcagugucaggaaccucugacgaugauggcucugcauaucccggaggaaaauagaugcauggacauucucgagcuuagcgagcgccuggaucugcaacgguuucacucucacacacucagacuguaccgggccguuugugcucuuggaaacaaucgcguggcccaugcccugugcucccacgucgaccaggcucagcuccugcaugcgcuggaagaugcccaccuccccggcccucuuagagcuggguauuacgaccugcugaucagcauucaucucgagucugccugucggagccgcagauccaugcugucugaauauaucgugccccuuaccccugagacacgggccauuacccuguuucccccgggacgcagcacagaaaacggccacccuagacacgggcuccccggagugggcgucaccacgucccugcggcccccucaucacuuuucucccccuugcuucguugcugcccugccggcggcuggcgccgccgaggcucccgcccgccucagcccugcgaucccccuugaggcccugagagauaaagcucugcggaugcucggggaagccgugagagacggaggccagcaugcucgcgauccugucgggggcuccguggaguuucaauucgugcccguucugaaacuugugagcacccugcucgucaugggcaucuuuggggacgaagacgugaaacagauucugaagaugaucgagccggaaguuuucacagaggaggaagaggaagaggaugaggaagaggaaggcgaggaagaggacgaggaagagaaggaagaggaugaagaggagaccgcccaggaaaaagaggacgaagagaaggaagaggaggaagcugccgagggagaaaaagaggagggccuggaagaggggcuccuucagaugaagcugccugaaucugugaaacugcaaaugugucaccuccuggaguacuuuugcgaucaggaacuucagcaccgggucgagucccuggcggccuucgcugagagauacguggacaagcuccaagccaaucagcgcagccgguauggacugcugauuaaggcuuucuccaugacagccgccgaaaccgcuagacgcacgcgggaguuuagaucucccccucaggaacagaucaacaugcuccuucaauucaaagauggcacagacgaggaagauuguccccugccugaggagauucgccaggaccugcucgauuuucaucaggaccugcuugcgcacugcgggauccagcuggauggagaagaggaagaacccgaagaggagaccacacucggcagccggcugaugucccugcucgaaaaggucagacuugugaaaaagaaagaggaaaagccggaggaggaacgcucugccgaggaaagcaagccucggucccugcaagagcugguuagccauaugguggugagaugggcucaggaagacuucguccagucucccgagcucguucgcgccauguuuucccugcuucacagacaguacgacgggcugggcgagcuccugcgggcccugccccgcgcuuauaccauuagcccuucuuccguggaagauaccaugagccuccuugagugucugggacaaaucagaucucugcucaucgugcagaugggcccgcaggaagagaaucugaugauucagagcaucgggaacauuaugaacaauaaagucuucuaccaacaucccaaccuuaugcgggcccugggaaugcacgaaacagugauggagguuauggugaauguccucggcgggggagaguccaaggaaaucagauuuccuaaaauggugacgucuugcugccgguuccuguguuauuuuugccgcauuagcagacagaaccagcgguccauguucgaccaccugagcuaccuccuugaaaauagcggcaucgggcugggcaugcaaggaucuacaccccucgaugucgcggccgcuagcgugaucgacaacaaugaacucgcccuggcccuucaagagcaggaucuggaaaagguuguguccuaucucgccggcugugggcugcagucuugcccuaugcuggucgcgaaaggauaccccgacauuggcuggaacccuugugggggagagcgcuaccucgauuuucugagauucgccguguuuguuaauggcgagagcguggaagagaacgcuaaugucguggugcggcuucugauccgcaagcccgaaugcuucggcccggcccucagaggggagggaggcuccgggcugcuugcugccauugaggaagcuauccggauuucugaggacccugcccgcgauggacccggcaucagacgggaccgcagacgggaacauuucggggaggaaccucccgaggagaaccgcguucaccugggacaugcgaucaugagcuuuuaugccgcucucauugaucugcugggcagaugugccccggaaaugcaccucauccaagcuggcaaaggggaggcccugcggauuagagccauccuucgcucccuggucccucucgaagaccuggugggaauuaucagccuuccccugcagauucccacacucggcaaggacggggcgcuggugcagccuaagaugucugcuuccuucguccccgaucauaaagccagcaugguucuguuucucgaccggguguacggaaucgagaaucaggauuuccugcuucacgugcuggacgucggcuuucucccugauaugagagcugccgccucucuggacaccgcuacauucuccaccacggaaauggcccuugcgcugaaccgcuaucucugccuggccgugcugccgcucaucacaaagugugcuccccuguuugccgggaccgagcaccgggcuauuaugguugauagcaugcuucauaccguguacagacugucucgcggacggucccucacaaaagcccaaagagacgucaucgaggauugccugaugagccuuugucgcuauauucggccuuccaugcugcagcaccuccugagacgccugguguucgacguucccauccucaaugaauuugcgaagaugccucugaaacuucugaccaaccauuacgagcggugcuggaaguauuacugccuccccacaggcugggccaauuucggcgugacgagcgaagaggaacugcaccuuaccagaaagcuguuuugggggauuuucgauucucucgcucacaaaaaguacgacccugagcuguaucggauggccaugccgugucugugcgcuaucgccggagcucugcccccugauuacgucgacgccagcuauuccucuaaagcggagaagaaagccacaguggacgcugaaggcaacuuugaucccagaccuguggagacccugaacgucaucauucccgaaaaacuugacagcuucaucaauaaguucgccgaguacacacaugagaaaugggcuuuugauaagauucagaacaauugguccuauggggaaaacaucgacgaggaacugaaaacccacccgaugcuccgcccuuacaagacguucucugagaaagauaaggaaauuuaucgguggcccaucaaggagagccugaaagccaugaucgccugggaguggaccauugaaaaggcgagagagggagaagaggagaagaccgagaagaaaaagacccgcaagaucucccagucugcucaaacauacgaccccagagagggcuacaauccucagcccccugaucuuagcgccguuacccugucccgggaacuccaggccauggcugagcaacuggccgaaaacuaucauaauacaugggggcgcaaaaagaaacaggagcuggaagcuaagggaggcggcacgcacccgcuccuggugcccuacgacacccuuacagccaaagagaaggcgagagaucgggagaaagcccaggaacugcucaaguuucugcagaugaacggguaugcugugacccgcggacuuaaggacauggagcuggauuccucuuccauugagaagagauucgccuuuggcuuccuccaacagcugcugcgguggauggacaucagccaggaguuuauugcucaucuugaggccgucgugucuuccgggcgcguugaaaagagcccucacgagcaggaaaucaaauucuuugcgaagauucugcucccccugaucaaucaauacuucaccaaccacugucucuauuuucuguccacgccugccaaagugcuuggaucuggcgggcaugcuagcaauaaggagaaggaaaugaucacgucccuguucugcaaacuggccgcucucgucagacaccgggugagccuguuuggaaccgacgcccccgcuguugugaacugucuucauauucuggcccgcucucucgaugcgagaacagucaugaaguccggcccggagaucgugaaagccggccugcggagcuucuucgagucugcuagcgaagacauugagaagaugguugaaaaucuccgccuggggaaagugucccaggccagaacccaggucaagggagugggccagaaccugacauacaccacggucgcccuucugccugugcucacaacccuguuucaacacaucgcucagcaccaguucggggaugacguuauucuugaugacgugcaagucucuugcuaucggacccuguguagcaucuacucccucggaacaaccaagaauacauacguggagaaacugagacccgcccucggcgaaugccuggcgcgccuggcugccgccaugccuguggcuuuucuugagccccagcugaacgaguauaacgccuguucuguuuacaccacaaagagcccgcgggaaagagcuauccucgggcugccuaauuccguggaggaaaugugccccgauauucccguccuugagcgccugauggccgacaucggaggccucgcggaaagcggcgcccgguauacagagaugccucaugugauugagaucacccugcccaugcuguguucuuaccucccuagauggugggaacgcgggccggaggcucccccuuccgcccugcccgcuggagccccucccccuugcacagcgguuaccagcgaucaccuuaacucccugcucggcaauauucugcggaucaucgugaacaaucuugggauugacgaagccucuuggaugaaaagacuggcugucuucgcccagccgaucgugagccgcgcucggcccgagcuccugcagucccauuuuauuccuacgaucggaagacugcggaagcgcgccggcaaagucgugucugaggaagaacaacucagacuggaagccaaggcugaggcgcaggaaggggagcuucugguucgggaugaguucagcgugcucugccgcgaccuguaugcccuuuacccccugcucauuagauaugucgauaacaaucgggcucaguggcugaccgaaccuaaccccuccgccgaggaacuguuuagaauggugggagagaucuucauuuacuggagcaagucucacaauuuuaaacgcgaagaacagaacuucguugugcaaaaugagaucaacaauauguccuuucucacagccgacaacaagagcaaaauggcuaaggccggcgacauccagucuggcggguccgaucaggaacggaccaaaaagaaaagacgcggagaccgguacagcguccagacaucucugauuguggcgacccuuaagaagaugcugccgaucggccucaauaugugugcuccuacagaucaagaccugauuacccuugccaaaacgagauaugcccugaaggauacagacgaggaagugcgcgaguuccuccauaacaaccugcaucugcaggggaaaguugaaggaucccccagccucagauggcagauggcucuguaccggggcguccccgggcgcgaggaggaugccgacgauccugaaaagaucgugagacgggugcaggaggucucugcugugcuuuauuaccuggaccaaaccgaacaccccuauaaaagcaagaaggccguuuggcauaaacuccuguccaagcagcgcagacgggcgguggucgccugcuuucgcaugaccccucuuuacaaucugccgacacacagagcuuguaacauguuccucgagagcuauaaagccgcuuggauucugaccgaggaucauuccuucgaagaccggaugaucgaugaccugucuaaggccggcgagcaggaagaggaagaggaggaaguggaggagaagaagcccgacccucuccaccaacugguucuucauuuuagcagaacagcgcugacggagaaguccaaacucgaugaagacuaccuguacauggccuaugcugauaucauggccaagucuugccaccuugaggagggaggcgaaaauggggaggcugaagaggaaguggaggucagcuucgaggaaaaacagauggagaagcagcgccugcucuaccagcaagcccggcugcacaccagaggagccgcugaaauggugcugcagaugauuuccgcguguaaaggcgagacaggggccaugguuucuagcacccucaagcugggaaucuccauucuuaacggcgggaaugcugaggugcagcagaagaugcuggacuaucucaaagauaagaaagaagucggcuuuuuccaaagcauccaggcccugaugcagacaugcucugugcuggaccucaacgccuuugagcgccagaauaaggcugaaggacuuggcauggugaacgaggaugggaccgucauuaaucggcaaaacggagaaaaaguuauggccgacgaugaguucacgcaggaccuguuuagauuccugcagcuccugugugagggccauaauaacgauuuucaaaauuaccuucgcacccagacagggaacaccacaaccaucaauaucauuaucugcacgguggacuaucugcuccggcugcaggaauccauuagcgacuucuacugguauuacucuggaaaggaugugaucgaggaacagggcaaaagaaacuuuuccaaggcgaugagcgucgcuaagcaaguguucaacucucugacagaguacauucaggggcccuguaccggcaaucagcagucccuugcccacagccggcucugggacgccguugugggauuucugcaugucuucgcucacaugaugaugaaacuggcccaagauucuucccagaucgaacuccugaaggagcuucuggaccuccagaaagauauggugguuaugcugcugagccuucucgagggcaacguggucaaugggaugauugcucgccagaugguggacaugcuggucgaaagcuccucuaacguggagaugauccugaaguucuuugauauguuccucaaacugaaggacaucguuggaagcgaagccuuucaagauuaugugacagacccuagaggccuuauuuccaagaaagauuuccagaaggcgauggacucucagaaacaguuuagcgggcccgagauccaauuccugcucuccugcucugaagccgaugagaaugagaugauuaacugugaagaguuugcuaaucgguuccaggaaccggcccgcgacaucggauuuaacgucgcugugcugcugaccaaucuuagcgagcacguuccucaugaccccagacuccacaacuuccuggagcuggccgaauccauucucgaguacuuucggccuuaucugggccgcaucgaaaucaugggggcgagcagacggauugagagaaucuacuucgaaauuucugagaccaaucgcgcccagugggagaugccccaagugaaggaauccaaacggcaguucaucuuugaugucgugaacgagggcggagaagcugagaagauggaacuuuucgugagcuuuugcgaggacacaauuuucgagaugcagaucgccgcucagaucucugaaccugagggcgaacccgagacggaugaagacgagggggccggagccgcugaggcgggcgccgaaggggcugaggaaggagccgccggccuggagggcaccgcugccacagcggcugccggggccaccgcuagaguugucgccgcugccggacgcgcgcuccggggccuguccuauagaagccugcgccggagagugcgccggcuuagacgccucacagccagagaggcugccaccgcuguggccgcgcugcugugggccgcugucacgcgggccggggcugccggagcgggcgccgcugccggggcucucggacugcuuuggggcucccuguuuggcgggggacucguggaaggcgccaagaaaguuacagugaccgagcugcuggccgggaugccggaucccaccucugacgaaguccauggagagcaaccugcuggccccgggggagaugccgacggcgaaggcgcgagcgagggggcuggagaugccgccgagggcgcuggggacgaagaggaagccgugcacgaggcgggaccuggcggggcugauggagccguugccgugacagacggcggcccguuccgccccgaaggggcuggaggccuuggggauaugggagacaccaccccugccgagcccccuacgcccgagggcuccccuauucucaagagaaaacugggggucgacggaguggaagaggaacugcccccggagccugaacccgagccugagcccgaacucgagccggaaaaggcugaugccgagaauggcgagaaagaagaggugccugaacccacccccgagccucccaagaagcaggcgccuccgucucccccucccaaaaaggaagaggccggcggggaguuuuggggagaacuggagguucagcgggucaaauuccuuaacuaccugagcagaaauuuuuauacacuccgcuuccuggcucuguuucuugccuucgcuaucaacuuuauucuccuguucuacaagguguccgacagcccucccggcgaagaugacauggaggggucugccgcgggagauguguccggcgccgggagcggaggcucuagcggcugggggcugggagcuggcgaagaggccgagggggacgaagaugagaacauggucuacuauuuccucgaagaguccaccggauacauggaaccggcucugcggugucuuucucugcuccauacacugguugccuuucugugcaucauuggcuauaauugccuuaaagugccucucgugaucuucaagagagagaaggagcuggcccggaaacuggaauuugacgggcucuacaucaccgagcagcccgaagaugacgaugucaagggacaaugggaccgccuggugcuuaacacgccuagcuuccccuccaauuauugggacaaauuuguuaagagaaaagugcuggauaagcacggcgacauuuacggccgggagcgcaucgcugagcuccuggggauggaucuggccacccuugaaauuacagcgcacaacgagagaaaaccuaaucccccgcccggacuccugaccuggcugaugagcaucgacgucaaguaucagauuuggaaguucggcgugaucuuuacagauaacucuuuccucuaccuggggugguacaugguuaugucccuucugggacauuauaauaacuuuuucuuugcugcccaccuccuggacauugccaugggcgugaaaacccugcggacaauccuuagcuccgucacccauaaugggaagcagcucgugaugacggugggccugcuggcugucguuguguaccucuauacaguggucgccuucaacuuuuuccgcaaauucuacaauaagucugaagaugaggacgaaccugauaugaaaugugacgauaugaugaccugcuaucuguuucacauguacguuggagugagagcgggcgggggaaucggcgacgagauugaggaucccgcuggggacgaauacgagcuuuaucggguggucuucgacaucaccuuuuucuuuuucgugauuguuauccugcucgccauuauccagggacugaucauugaugccuuuggcgaacugcgcgaccaacaggaacaggugaaggaagauauggagacaaaguguuucaucugcgggauuggcagcgacuacuuugauacgaccccucacggauucgagacacauacccuugaggagcacaaccucgcuaauuauauguuuuuccugauguaccugaucaacaaagacgaaacagagcauaccggccaagaauccuaugucuggaagauguaccaggagagauguugggauuucuuccccgccggggacugcuuccggaaacaguaugaggaucagcucucuuga

SEQ ID NO: 75164 - RNA, 14958 nt, Artificial Sequence
  derived and/or modified sequence opt5 from RYR2__Homo_sapiens__XP_006711865
auggcugacggcggggagggagaagaugagauccaguuccugagaaccgacgaugaagugguccuccaaugcacagcuacgauucacaaggagcagcagaagcugugucuugccgcggaaggcuuugggaaucggcugugcuuccucgaguccaccuccaauucuaagaacguucccccugaccugagcaucuguacauuugugcuugagcagucccugucugugagagcucuccaagaaaugcuggccaauaccgucgaaaagagcgagggacagguggauguugagaaguggaaguucaugaugaagacagcccagggcgggggacacagaacccugcucuacggccacgcuauucugcuucggcacuccuauucuggcauguaccugugcugucucagcacauccagaagcucuaccgacaagcuggccuuugauguggggcuucaggaggacacgaccggagaggcuugcugguggacaauccaccccgccuccaagcaaagaagcgagggcgaaaagguccgggugggggaugaccugauucucguuucuguguccagcgagcgcuaucugcaucugucuuacggaaacggcucccuccacgucgaugcggccuuccagcagacccuguggagcguggcucccaucuccucugggagcgaagccgcucagggauaucuuaucggcggcgacgugcugagacuccugcacgggcauauggaugagugucuuacagucccuuccggagagcacggcgaggaacaacggcgcaccguucauuacgaagggggagccgugagcgugcacgcgagaucucuguggcggcucgagacgcugcgcgucgccugguccggcagccacauuagaugggggcagcccuuucggcugcgccaugugacaaccggaaaguaucucucucugauggaagacaagaaucuucugcucauggacaaggagaaggcugauguuaagagcacagccuucaccuuuagauccucuaaggagaagcuggacgugggcguccggaaggaaguggauggcauggggaccagcgagaucaaguacggagacuccguuugcuacauucagcacguggauacaggccuuuggcugacguaucaaagcgucgacgugaaaucugucagaaugggguccauccagcgcaaggcuauuaugcaucacgaaggacauauggaugacggcaucagccucucucggucccagcacgaggaaagcagaaccgcccgcgugauucgguccacaguuuuccuguuuaacagauucauccgcgggcuggaugcccucucuaaaaaggcuaaggcgagcaccguggaccugccuaucgaguccgucucucuuagccugcaggaucucauuggcuacuuucaucccccugacgagcaccuggaacacgaggacaaacaaaaucggcugagagcccuuaagaaccgccagaaucucuuccaggaagagggaaugaucaaccuggugcuggaguguauugaucggcuccauguuuauuccagcgcugcccacuucgccgacguggcuggcagagaagccggggagucuuggaaauccauccugaauagccuuuacgaacugcucgcggcucugauucgcggaaaccggaagaauugcgcccaguuuucuggcucccuggauuggcuuaucagcagacucgagcggcuggaagccucuagcgggauccuggagguccuccacugugugcugguggaguccccggaagcucuuaacauuaucaaagagggacauauuaagagcaucauuucucugcucgacaagcacggccgcaaucauaaaguucuggauguccugugcucccuuugcgugugucacgggguggccgucagaagcaaccaacaucucaucugcgacaaccugcugcccggccgggaucuccugcuucagacaagacuggugaaucacguuuccucuaugcgcccuaacaucuuccucggagugagcgaaggcuccgcucaguauaagaaaugguacuaugagcugauggucgaccacaccgaacccuuugugacggccgaggcgacacaucugcggguugggugggccucuaccgagggauacagcccuuaccccggcgggggagaagaguggggcgggaauggcgugggagaugaccuuuucuccuauggcuuugaugggcuccaccuguggucuggauguauugcuagaaccgucagcuccccgaaccagcaucugcuccgcacagacgaugugaucagcugcugucuggaccuuucugccccuuccauuagcuucagaaucaauggccaacccguucaggggauguuugaaaacuucaauauugacggacuguuuuucccuguggucucuuuuuccgcuggcaucaaggugcgguuccuccucgggggccgccacggagaguuuaaauuccugccgcccccuggcuacgccccgugcuaugaagcggugcuucccaaggagaagcugaaagucgagcauagcagagaauacaagcaggagcggaccuauacacgcgaucuccuggggccuacgguuucucucacccaggccgcuuucacacccauuccuguggacaccucccaaaucgugcugcccccgcaccuugaaagaauccgggagaaacuggccgagaacauucacgaacucugggucaugaauaagaucgagcugggauggcaguacggcccugugcgcgaugacaacaaaagacagcaucccugucugguugaauuuagcaaacuuccugagcaagaacggaauuauaaccugcagaugucccucgagacacugaagacccuccuggcucuugggugccacgugggaauuagcgaugagcaugccgaagacaaagucaagaaaaugaagcugcccaaaaauuaccagcucacgucuggcuacaagccugcccccauggaucugagcuucaucaaacugaccccgucccaggaggcuaugguggacaaacuugcggaaaacgcccacaauguuugggcucgcgaucgcauucggcaaggcuggacauaugggauccagcaggacgugaagaacagacgcaacccucggcugguccccuacacccuccuggaugacagaaccaagaagucuaauaaagauagccuccgcgaggccgugcggacccugcuuggauauggcuacaaccuggaagcccccgaccaggaccacgcugccagagcggagguuuguuccgggacgggagagcgcuuucggaucuucagagcugaaaagacauaugccgugaaagccggccgcugguacuuugaguucgaaaccgucacagcuggggauaugcgggugggauggucuagaccuggcugccaaccggaccaggagcugggcagcgaugaacgggccuuugcguucgacggguuuaaggcucagcgcuggcaucagggaaaugagcacuauggcagauccuggcaagccggggauguggucggauguaugguugacaugaacgagcauaccaugauguucacccucaauggcgaaauucugcuugaugacucugggagcgagcuggccuuuaaggauuucgacgugggagauggcuuuauccccgugugcucccucggcgucgcucagguggggcggaugaacuucggaaaagacguuagcacacugaaguacuucacgauuugcggccuccaggaaggguacgagccuuuugccgugaauaccaaccgcgacaucacaauguggcugucuaaaagacuuccccaauuccugcaggucccuuccaaucacgagcauauugaagugacccggaucgauggaacaaucgacagcucucccugucugaagguuacccagaaauccuuuggcagccagaacuccaauacggauauuauguucuauagacucucuaugccuaucgagugcgcugaaguguuuagcaagacagucgccgggggacugcccggcgcgggccuuuucgggccgaagaacgaccuggaggauuacgacgccgauuccgacuuugaagugcucaugaaaaccgcucacggacaccuggucccugaucgcguggacaaggauaaagaggccaccaagcccgaguucaauaaccauaaagacuaugcucaagaaaagccuagccggcucaagcagagauuucugcuucgccggacaaaacccgauuacucuaccucccacagcgccagacugacagaggacguucuggccgacgaucgcgacgauuaugacuuccucaugcagacgucuaccuacuauuacagcgugcggauuuuuccgggccaggaaccugcuaaugucugggugggguggaucacauccgauuuccaucaauacgacaccggauucgaucuggacagaguucgcacagugaccgucacgcuuggcgaugagaaggggaaagugcacgaaucuuuugcgauugacagccuguguggauucggcaucaagagauccaacugcuauauggugugugccggcgagucuaugagccccgggcagggacggaacaauaacggccucgagaucgggugcguugucgaugcugccuccggacugcucaccuuuauugccaauggcaaagaacugagcacauacuaucagguggagccuucuaccaaacuuuuccccgcuguguuugcccaggcgacaucccccaacgucuuccaauuugaacuggggcgcaucaaaaaugugaugccucugagcgcuggacucuucaaguccgagcacaagaacccgguuccccaguguccucccagacugcaugugcaguuucuuucucacguccuguggagccggaugccuaaucaguuccucaaaguggacguuucccgcauuucugaaagacaaggcuggcuggugcagugccuggauccccuccaguuuaugagccuucauaucccugaggagaaccgguccgucgacauucuggaacugaccgagcaagaagaacugcugaaguuccacuaccauacacuuagacuguauagcgccgugugugcccucggcaaucaccgcguugcucacgcccugugcucucauguggacgagccgcagcugcucuacgcgaucgaaaacaaauauaugcccgggcuucugcgggcuggauacuacgaucugcucauugacauccaccuguccagcuaugccaccgccagacuuaugaugaauaacgaguacaucgucccuaugacggaagagacaaagucuauuacccuguuucccgaugaaaauaaaaagcauggccucccugggaucggacuguccaccagccugcgcccccggaugcaguucucuagcccguccuucgugucuauuagcaacgaguguuaucaguacuccccugaguuuccccucgacauccuuaagagcaaaacaauucaaaugcugaccgaagcugugaaggagggcucccugcacgccagagaucccgucgggggaacgacagaguuccucuuuguuccucugaucaaacuuuucuauacccugcucaucaugggcauuuuucacaaugaggaccugaagcauauccugcagcucauugaacccucuguguucaaagaggcugccacaccugaggaagagagcgauacccuugaaaaggagcuguccguggacgaugcgaagcugcagggcgccggggaagaggaggcuaaaggaggcaagcggccgaaagaagggcuccugcagaugaaacuucccgagccugucaaacugcaaaugugccuccugcugcaguaccucugcgacugucaggugcgccacagaaucgaagccauuguugcuuuuucugaugacuucguggccaaacuucaggacaaccaacgguuucgcuauaacgaggucaugcaggcccugaauaugagcgcugcgcugacagccagaaagaccaaagaguuccggucucccccucaggaacaaaucaacaugcuccugaauuuuaaggaugacaaaagcgagugccccuguccggaagagauccgcgaucagcuucuggacuuccaugaagaucucaugacgcacugcggaauugagcuggacgaggauggcagccuggacgggaacuccgaucucaccaucagaggccggcuucugagccugguggaaaagguuacauaccucaaaaagaagcaggcugagaaaccuguggaaucugacuccaagaaaagcucuacccugcagcaacuuauuuccgagacaaugguccgcugggcccaggaaagcgugaucgaggaucccgagcuggucagagccauguuugugcuccugcaucggcaguacgacggaauuggcgggcugguuagagcucucccuaagaccuauacgaucaauggagugucuguggaagauacaauuaaccuucuggccucccugggccagauccgcagccuccuguccguccggauggggaaagaggaagagaaacuuaugaucagaggacugggcgacauuaugaauaacaaaguuuucuaccaacaccccaaucucaugcgcgcgcuggggaugcacgaaaccgugauggaggugauggucaacgugcugggcggaggcgagagcaaggaaaucacauucccuaagaugguugcuaauuguugccgguuucucuguuauuucugcagaauuucucgccagaaccagaaagccauguuugaccaucuuagcuaccugcuggaaaauuccucuguggggcucgccagccccgcuaugcggggauccaccccgcuggaugucgccgcggccucugugauggacaacaaugaacuugcucuggcccucagagagccugaucuggagaaggucgugcgcuaucuggcuggcugugggcuccagagcugccaaaugcuuguuuccaaaggauaccccgacaucggcuggaaccccguggaaggggagcgguaucuggauuuccugagauuugccgucuucuguaauggcgaaucuguggaggaaaacgcuaacguugugguccgccuccugauucggagaccugagugcuuuggaccggcccuucgcggcgaaggcgggaaugggcugcucgcggccauggaagaggcuaucaagaucgccgaagaccccagcagagaugggccuucccccaacagcggaucuuccaaaacccuggacacagaggaagaggaggaugacacgauucacaugggcaaugcuaucaugaccuucuacagcgcccugauugaucuccugggccggugcgccccugaaaugcaucuuauccacgcugggaagggagaggcgauucgcaucagaucuauccugcggucccucauuccccugggcgaccuugugggggugaucagcauugccuuucagaugccuacaaucgcuaaggacggaaacguugucgaaccggauauguccgccggcuucugucccgaccauaaagccgcuauggugcuguuucucgauagaguguacgggauugagguccaggacuuccugcugcaccuccuggaaguuggauuucuuccugaucugcgggccgcggccucucucgacaccgcugcccugagcgcuacagauauggcccuugcgcugaaucgcuaucucugcaccgccgugcugccccugcucacgagaugugcuccucuguucgccggcacagagcaccaugcuucccuuaucgacagccugcuccacaccguguaccggcugucuaagggcugcucccuuaccaaagcccagcgcgauagcauugaggucugucugcucucuaucugcgggcaacugagacccagcaugaugcagcaucugcuccggcgccugguguucgacguuccgcuucugaacgaacacgcuaagaugccucucaaacugcuuacaaaucacuaugagagauguuggaaguacuauugccugcccggaggcugggggaacuuuggagccgcguccgaagaggagcuccaucugucucggaagcuguucuggggcaucuuugaugcccucagccagaaaaaguacgaacaagagcuguucaaacuugcucugcccugucucuccgccguggcuggggcccugccucccgacuauauggaaucuaauuacgucagcaugauggagaagcaguccagcauggauucugaaggaaacuuuaauccucagccgguggacaccuccaacauuacaauccccgagaaacuugaguacuucauuaauaaguaugccgaacacagccaugacaagugguccauggauaaacuggcgaacggcuggaucuacggcgagauuuauucugacagcuccaagguucagccucucaugaaacccuacaagcugcugucugaaaaagagaaggaaaucuaucgcuggccuaucaaagagagccucaagacgaugcuggcuuggggguggagaauugagcggacccgcgaaggagauuccauggcccuuuacaauagaacacggcgcaucagccaaaccucucagguguccgucgacgcugcccacggcuauagccccagagccauugauaugucuaacgugacacugucccgggaccuccaugcuauggccgagaugauggcggaaaacuaccacaauaucugggccaagaaaaagaaaauggagcuggaaagcaaagggggaggcaaccacccgcuucuggugccuuacgauacccucacggcuaaagagaaggccaaggacagagagaaagcucaggauauucugaaguuucugcagaucaauggguaugccgucucucgcggauucaaagaccucgaacuggauacccccuccaucgagaagcgguuugcguacagcuuccuucaacagcugauuagauauguugacgaagcccaucaguacauccucgaguuugauggcggcucucgcgggaaaggagagcacuucccuuaugaacaggagauuaaguuuuucgcuaagguggugcugccccuuaucgaccaauacuucaaaaaccaucggcuguauuuucucagcgccgcuuccagaccucugugcagcggcgggcacgccuccaauaaggaaaaagagauggucacaucucuguucuguaaacuuggagugcugguucgccaccggauuagccucuuuggcaacgacgcuaccuccaucgugaauugccugcauauucucgggcagacacuggaugccagaaccgucaugaaaacaggacuugaaucuguuaagagcgcgcugcgcgccuuccuggacaacgcugccgaggaucucgagaagacgauggaaaaucugaaacagggccaauuuacccacacacggaaccagcccaagggcgugacccagaucaucaauuacaccacaguggcccuucugccgaugcucuccucucuguucgagcauauugggcagcaccaauuuggagaagaccucauccuggaggauguccaggugagcugcuaccgcauucugacgucccuuuaugcccugggcaccagcaaaucuaucuacguugaacgccagcgguccgcccucggggagugucuggcggcuuucgccggagccuuuccuguggcuuuccuugagacacaucuggacaagcacaacauuuauagcaucuacaauaccaaaucuuccagagaacgggccgcucucagccugcccacaaacgucgaggaugugugccccaauaucccuucucucgaaaagcugauggaggaaauugucgagcuggccgaguccggcaucagauauacccagaugccgcacgugauggaaguuauucuucccaugcuguguagcuacaugucucgcuggugggagcaugggccugaaaacaaccccgagcgggcggagaugugcuguacggcccucaauuccgaacacaugaacacacugcuuggaaauauccugaaaauuaucuauaacaaucucggcaucgacgagggcgcuuggaugaagagacuggccguguuuagccaaccuauuaucaacaaggucaaaccccagcugcucaagacccauuuccugccucuuauggaaaaacugaagaaaaaggcugccaccguggugagcgaggaagaucaccucaaggcggaggcccgcggggacauguccgaggcugaacugcuuauucuggaugaguuuacaacccucgccagagaccuguacgcuuucuacccccugcucauccgguucguugacuauaaucgcgccaaauggcugaaggaaccgaacccugaggcugaggaacuuuuuagaaugguggccgaggucuucauuuacuggucuaaaagccauaauuuuaagcgggaggaacagaacuucgugguucagaaugaaaucaacaauauguccuuucugauuacagauaccaaaucuaagaugagcaaggcggccguguccgaccaagagcgcaaaaagaugaaaagaaagggagaucgguauucuaugcagacgagccucaucgucgcugcccugaaacgccuucugcccaucggccucaacauuugcgccccuggggaccaggaacugaucgcucuggccaagaauagauucucccucaaggauacagaggacgaggugcgggauauuauccgcagcaacauucaucugcaaggaaaacuugaagaccccgcgaucagauggcagauggcucuguacaaggaucucccgaaccggaccgacgauacaucugacccugagaaaaccgucgaacgcgugcuggauaucgccaauguucuuuuucaccuggagcagaaguccaaaagagugggccggagacauuauugucucgucgagcacccccagcgcagcaagaaggccguguggcauaaacugcugucuaagcaacggaaaagagcuguuguggccugcuuccgcauggcuccccucuacaaccugccucggcacagagccgucaaucuuuuucugcagggguaugaaaaguccuggauugagacggaggaacacuacuucgaagacaaacucaucgaggaccuggcgaagcccggagccgagccuccggaagaggaugaaggcaccaaacgcguggacccccuucaucagcugauucuccuguuuagccggacagcucugaccgagaaguguaagcucgaagaggauuuccuguacauggccuaugcugacaucauggccaaauccugccacgaugaggaagacgaugacggcgaggaagaggugaagucuuuugaaguuacagggagccagagauccaaagagaaggagauggaaaaacaaaaacuucuguaccagcaggcgcgccuccaugaucggggagccgcugagaugguccugcagaccauuucugccagcaagggcgaaacagggccuaugguggcugccacccuuaaacugggaaucgccauccucaacggcggaaauuccacggugcaacagaagaugcuggacuaucugaaagagaagaaagaugucggcuucuuccagagccucgcuggacugaugcagucuuguuccgugcuugaccugaacgcguuugagagacaaaauaaggccgaaggccucgggaugguuacagaggaaggaagcggcgagaaggugcugcaggaugacgaguucacaugcgaccuguuucgguuccuccagcuucugugcgaggggcacaacucugauuuucaaaauuaccugcgcacccagacaggaaacaauaccacagucaacauuaucauuagcacgguggacuaucuccugagaguucaggaguccaucucugauuucuacugguauuacagcggcaaagacgugauugaugaacaggggcaacggaauuuuuccaaggcuauccaggucgccaaacagguguucaacacccuuacagaguacauccagggccccuguaccggaaaucaacagagccuggcccauucucgccucugggacgcuguugugggcuuucugcacgucuucgcccacaugcagaugaagcugucccaggauagcucccaaauugaacuucucaaagagcugauggaccugcagaaggauaugguggugaugcuccugucuaugcuugaagggaacgucguuaacggaacaaucggcaagcagaugguggacaugcugguggagagcuccaauaacgucgagaugauucucaaauuuuucgauauguuccugaagcugaaagaccuuaccucuagcgacacguuuaaggaauaugauccugacgggaaaggagugaucuccaagagagauuuccauaaagcgauggagucucacaagcauuacacccaaagcgaaacagaguuucuccuguccugcgcugaaaccgacgagaaugagacacuggauuaugaagaguucguuaagcgguuucacgaacccgccaaagacauuggcuucaacguggccguccuccugaccaaucuuagcgagcacaugccuaacgauacgagacugcagacauuucucgagcuggcugaaucugugcugaauuacuuccagccguuucuugggcgcaucgagauuaugggcuccgccaagcggaucgaaagaguuuauuucgagaucagcgaaucuucccgcacccagugggagaaaccccaagugaaggagagcaaacggcaguuuauuuucgacgucgugaacgaaggaggcgagaaggaaaagauggagcucuuugucaauuucugugaagauacaaucuucgagaugcagcuggcugcccagauuucugagagcgaccugaacgaaagauccgcgaauaaagaggaaagcgagaaggaacgcccugaggagcaagggcccagaauggccuuuuucuccauccucaccgugcggucugcucuguuugcccuucgcuacaacauucugacccucaugagaaugcugagccugaaaucccuuaagaaacagaugaagaagguuaaaaagaugacagugaaagauauggucacggcuuucuuuucuagcuacugguccaucuucaugacccuccugcauuuuguggccucuguuuuccggggauuuuuccgcaucauuugcagccugcuccugggcgggucccuuguggaaggagcgaagaaaaucaaggucgccgagcugcucgcuaauaugccugaccccacacaggaugaagugagaggcgacggggaggagggcgaacggaagccgcuggaggccgcucugccuagcgaagaccuuaccgaucucaaagagcugacagaagagucugaccugcucuccgauauuuuuggacuggaccuuaagcgcgagggcgggcaguauaaacugaucccccacaaccccaaugccggacucagcgaucugaugucuaacccugugcccaugccugaaguucaagagaaguuccaggaacagaaagccaaggaggaagagaaagaggaaaaggaggaaaccaaguccgagccggaaaaagcugagggcgaggacggggaaaaggaggaaaaagcgaaggaggauaaaggaaagcagaagcugagacaacuucauacgcaccgguacggcgagcccgaagucccugagagcgccuuuuggaaaaagauuaucgcuuaucagcagaaacuccugaacuacuucgccagaaauuucuauaacaugcgcaugcuggcccucuuuguggcuuucgccaucaauuuuauucugcuuuucuacaaggugucuacauccagcgucguggaaggcaaagagcugcccacccggucuuccagcgaaaacgcgaagguuaccucccucgacagcucuagccauagaaucauugcugugcacuauguccuggaggaguccucuggguacauggaaccuacacugcgcauccuugccauucuccacaccgugaucagcuuuuucuguauuaucggauacuauugccugaagguuccccuggugaucuuuaaacgggagaaggaagucgccagaaaacucgaguucgauggccuguacauuacagaacaaccguccgaggacgauaucaaggggcagugggaccgccuugugauuaauacgcagucuuuuccuaacaauuauugggauaaauucgugaagcggaagguuauggacaaauacggagaguuuuauggcagagaccggaucagcgaacugcucgggauggauaaggcugcccuggacuucuccgaugcucgcgagaaaaagaaacccaagaaggacagcucucuguccgccguccuuaacagcauugaugugaaauaccagauguggaagcucggaguggucuuuaccgacaauucuuuccuguaucuggcgugguacaugacaauguccguucucggccauuacaacaauuucuuuuucgccgcucaucugcuugauaucgccaugggcuuuaaaacccugagaacaauccucagcucugugacccauaacgggaagcaacuggugcugacggucggacuucucgcugugguuguguaucuguacaccgucguggccuucaacuuuuuccggaaauuuuauaacaaguccgaagacggcgauacaccugacaugaaaugugaugacaugcugaccugcuacauguuccacauguauguuggggugcgcgcgggaggcgggauuggagacgagaucgaagaucccgccggcgacgaguacgagauuuauagaaucauuuuugauaucacauucuuuuucuuugucaucgugauucuccuggcuaucauucagggccuuaucauugacgccuucggggaacugcgggaucagcaggagcaagugaaggaagacauggagaccaaguguuucaucugcggaauuggcaaugauuacuuugacacagucccgcacggguucgagacccauacgcuccaggaacacaaccuggcuaacuaccuguuuuuccuuauguaucucaucaauaaagaugagacagaacauaccggacaggagagcuacguuuggaagauguaucaggaacgcuguugggaguuuuucccugccggcgacugcuuuagaaaacaauacgaggaucagcugaacuga

SEQ ID NO: 75165 - RNA, 14613 nt, Artificial Sequence
  derived and/or modified sequence opt5 from RYR3__Homo_sapiens__NP_001027
auggccgagggcggggaaggaggcgaggacgaaauccaguuccugagaaccgaggaugaagugguccuccaaugcauugcuacaauccacaaggagcagcggaaauuuugucuggccgcggaggggcuuggaaaccgccugugcuuccucgaacccacgagcgaggcuaaguacauuccuccggaccuguguguuugcaauuuugugcuugaacagucccugucugugagagcccuccaggagaugcuggccaacaccggcgagaaugggggagaaggcgcugcccaaggcgggggacaucggacacugcucuauggccacgcuguccugcuucgccauagcuucuccgggauguaccugaccugucucacaaccucuagaagccagacagauaaacuggccuuugacgugggacuucgggagcacgcgaccggcgaagccugcugguggacgauccaucccgcuuccaagcagcgcucugagggggaaaaaguuagaauuggagaugaccugauccucgugagcgucuccagcgagcgguaucugcaccugucuguguccaacggcaauauccagguugaugccagcuucaugcaaacccucuggaacgugcacccuacauguucuggcuccagcauugaggaaggguaccugcuuggaggccaugucgugcgccuguuucacgggcaugacgagugccucaccauccccucuacagaucagaaugacucccagcacagacggauuuucuaugaagcuggaggcgccgggacccgcgcgagaagccuguggcggguggagccucuucgcaucuccuggucuggaagcaacauuagauggggccaggccuuucggcugagacaccucacgacaggccauuaccuggcucugaccgaagaucaagggcucauccugcaggaccgcgccaaguccgauacaaagagcaccgcuuucucuuuucgggccuccaaagagcuuaaggagaaacuggacagcucucacaagagagacauugaaggaaugggcguccccgagaucaaauauggggauagcguuuguuucgugcagcauaucgccuccggacucugggugaccuacaaggcucaagacgcgaagacaucucgccugggcccucuuaaacggaaggucauucugcaccaggaagggcauauggaugacggccucacgcugcagagaugccagcgcgaggaaagccaagccgcucggaucauuagaaauaccacagcccuguuuucccaguucgugagcggaaacaaucgcaccgccgcuccgaucacacuccccauugaggagguucugcagacccuucaggaucugaucgccuacuuccaaccucccgaagaggaaaugcggcacgaggacaaacagaacaagcucagaucucugaaaaaucgccagaaccuguuuaaggaggaaggcaugcuugcgcucgugcugaauuguaucgaucggcugaacgucuauaacuccguggcucacuucgccgggauugccagagaggaaagcggaauggcuuggaaagagauccucaaucugcuuuacaagcugcucgccgcucugauucggggcaaccgcaauaacugcgcccaguuuucuaauaaccuggacuggcuuaucuccaagcucgauagacuggaaagcuccucugggauucuggagguucuccauugcauccugacggagagcccugaagcgcuuaaucugaucgccgagggacacauuaaauccaucauuucucuccuggacaagcauggccggaaccacaaagugcuggauauccuuuguagccucugccuguguaauggggucgcugugagagccaaccaaaaucugauuugcgacaaccuccugccccgccggaaucuucugcuccagacaagacugaucaacgacgucaccuccauucgcccgaauaucuuccugggcguggcugaaggaagcgcccaguauaagaaaugguacuuugagcuuaucauugaucagguugacccuuuccucaccgcggaacccacacaccugagagugggcugggccucuuccagcggguaugcuccuuaccccggaggcggggagggauggggcgggaacggcgucggagaugaccuguauucuuacggcuuugaugggcuccaucugugguccggacggaucccccgcgccguggcuagcauuaaccaacaccuucugagaucugacgauguugugagcuguugccucgaccugggcgucccuuccaucagcuuccggauuaaugggcagccggugcagggaauguuugagaacuucaauaccgauggccuguuuuuccccgugaugucuuuuuccgccgggguuaagguccgcuuccuuaugggcggaagacauggcgaauucaaguuucugccucccagcggguacgccccuuguuaugaggcucuccugcccaaagaaaagaugcggcucgagccggugaaagaauacaagcgcgacgcggauggaaucagagaccugcuuggcacaacgcaauuccugucccaggccucuuuuaucccuugccccguggauaccagccaggucauucucccuccccaccuggagaaaauccgggaccgccuggcugagaacauucaugaacuuugggggaugaauaagaucgagcugggauggacauucggcaagauuagagacgauaacaaacggcagcacccuugucucguggaauuuuccaagcugcccgagaccgagaaaaauuauaaccuccaaaugucuacagaaacccugaagacgcuucuggcccucggcugccacaucgcccauguuaauccggcugccgaggaagaccugaaaaaggugaagcugccuaaaaacuacaugaugagcaauggguauaagcccgcgccccuugaucuguccgacgucaaacuccugccuccgcaggagauccucguggauaagcuggcugaaaacgcccacaauguuugggccaaagacagaauuaagcagggauggaccuacggcauccagcaagaucuuaaaaacaagcgcaauccccggcuggugccuuaugcucugcucgacgagagaacaaagaaaucuaaccgcgauagccugcgggaggccgucagaaccuucgugggguacggauacaacauugaacccuccgaccaggagcuugcggauagcgcuguugaaaaggugucuaucgacaaaauucgcuuuuuccgggucgagagauccuaugccgugcgcagcggcaagugguacuuugaauucgagguggucacagggggagauaugcggguuggcugggccagaccuggcugucggcccgacguggagcugggggcugacgaucaggccuuuguguucgaaggaaaucgcggccagagauggcaucaagggucuggauauuuuggccggaccuggcagccuggggacgucgugggaugcaugaucaaccucgaugacgcuuccaugaucuucacgcugaauggcgagcuccugauuacaaacaaaggcagcgaacuugccuucgcggauuacgagaucgaaaauggguuuguucccauuugcugucugggacugucucagaucggccgcaugaaccucgggaccgacgccuccacauucaaguuuuauaccaugugcggacugcaagagggcuucgagccguuugcugugaauaugaacagagaugucgccaugugguucagcaagcggcuuccuaccuuugugaauguucccaaagaccacccucauauugaagugaugagaaucgaugggacaauggacucccccccgugucugaaggucacgcacaaaaccuucggaacacagaacagcaaugcugauaugauuuacugccgccucucuaugccuguggagugucacagcuccuuuucucauagccccugccuggacuccgaagccuuccagaagcggaaacagaugcaagagauccucucucacaccacaacccaguguuauuacgccaucagaauuuuugcuggccaggacccuagcugcguuugggugggcugggucacgcccgauuaccaucuguauuccgagaaguucgaccuuaacaagaauuguacagugaccgugacccugggggaugaacgcggacggguccacgagucuguuaaaagaagcaacugcuacaugguguggggcggggacaucguggcguccagccagcgcucuaaucgguccaacgucgaucuggaaauuggaugucucguggaccuggccaugggcaugcuuagcuucucugcuaacgggaaggagcugggaacaugcuaucaaguugaacccaauaccaaaguguuuccugccgucuuccuccagccgacauccacgagccuguuucaguucgagcucggcaagcugaaaaacgccaugccccuuuccgcugccaucuuuagaucugaggaaaagaauccugugccccagugcccuccccgccuggauguucaaaccauucagccugugcuguggagcagaaugccgaacuccuuccucaaggucgagacagaacgggugagcgagcgccacggcugggucgugcagugucuggaaccccuucagaugauggcgcugcauaucccugaggagaauagaugcguugacauccucgaacugugugagcaagaagaucugaugcgguuucacuaccauacccuccgccuuuauucugcugugugcgcccuggggaacuccagagucgccuacgcucuguguagccacguggaccucucucagcuguucuaugccauugauaauaaauaccuucccggacugcuccggagcggcuuuuacgaccugcugaucuccauucaucucgcgucugcuaaggagagaaaacuuaugaugaagaacgaauauaucauuccuaucacaagcaccacgcgcaauauccggcuguuccccgaugaguccaaaagacacgggcugccgggaguuggccuccgcaccugccugaagccuggguuucgguucucuacacccuguuuuguggucaccggagaggaccaccagaaacaaagccccgaaauuccucuugagucccugagaacaaaggcccucagcaugcugaccgaagccgugcagugcucuggcgcucauauccgggaccccgugggcggguccguugaguuccaguucgucccugugcugaagcucauuggaacacuucuggugaugggcgucuuugaugacgaugacgugcgccagauccugcuccugauugauccgagcguuuucggggagcacuccgccggaaccgaagagggcgcugaaaaagaggaagugacgcaagucgaggagaaggccguggaagcgggggagaaagccggaaaggaagcucccguuaaaggccuucugcagacaagacucccugagucugugaagcugcagaugugugaacugcucagcuaccuuugcgacugugagcugcagcaucgggucgaggccaucguggcuuuuggcgauauuuauguuuccaagcugcaagccaaccagaaauuccgcuacaaugaacucaugcaggcccugaacaugucugcugcgcuuaccgccagaaagaccaaagaguuucggagccccccucaggaacaaaucaauaugcugcucaacuuccagcugggggagaauugccccugcccggaagagauccgcgaggaacuguaugacuuucacgaggaucuccuucugcacuguggagugccucuggaagaggaggaagaggaagaggaagacacauccuggaccggcaagcucugcgcucuggucuacaaaauuaaggggcccccuaagcccgagaaagagcagccuacggaagaggaagagagaugucccacaacccuuaaggaacugaucagccaaacaaugauuugcugggcccaggaggaucagauccaggacucugagcucgugcggaugauguucaaccugcugcgcagacaauaugauuccauuggagaacuccuucaggcccugcggaaaaccuacacaaucagccauaccucuguguccgacacgaucaaucugcucgcugcccugggccagauuagaagccuucugucuguccgcauggggaaggaggaagagcuccugaugaucaacggccugggagacauuaugaacaauaaaguuuuuuaccagcacccgaaccucaugcgggugcuuggcaugcaugaaaccgugauggaggucauggugaauguucuggggacagagaagagccaaaucgcguucccuaagaugguggcuuccuguugcagauuucuguguuauuucugccgcauuucucggcagaaccagaaagccauguuugaacaccucagcuaccugcuugagaauuccagcgucggacuggccucccccucuaugagaggcagcaccccccucgauguggcugccuccucuguuauggacaacaaugaacuggcgcugagccucgaggagccugaucuugaaaagguggucacauaucuggccggguguggacugcaguccugcccgaugcuccuggcuaaaggcuaccccgacgugggguggaacccuaucgagggcgaacgcuaucuuucuuuccugcgguucgccgucuuugugaauagcgaguccguugaagagaacgcuagcgugguggucaagcuccugaucagacgccccgaguguuucggaccugcccugcggggcgaagggggaaauggccuccuugcugccaugcaaggggcgauuaaaaucucugagaaccccgcccuggaucugccuucccagggauacaagagagaaguuagcaccggcgacgaugaggaagaggaggaaauugugcauauggggaaugcuaucaugucuuuuuauuccgcccucauugaccugcuuggccgcugcgcuccggagaugcaccugauccagacgggaaagggcgaagccauucggaucagaagcauccuccgcucucuggugcccacagaggaucuggucgggauuaucuccauuccucucaaacugcccagccuuaacaaggacggauccgugagcgaaccugauauggccgcuaauuucugccccgaccacaaagcgccgaugguucuguuucucgacagaguguacggcaucaaggaucagaccuuccugcuucaucugcucgaggucggguuucugccugaccugcgggccucugcuagccucgauacagugucccugucuaccaccgaggccgcccuugcucugaaccgcuacauuuguagcgccguccucccccugcuuacaagaugcgcgccccuguucgccggaacggaacacuguaccucccucaucgacucuacacugcaaaccaucuaucggcugagcaaaggcagaucccucacaaaggcucagcgggauaccauugaggaaugccugcuugccaucuguaaccaucugcgcccuucuaugcuccagcaacugcuuagacggcugguguuugacguuccccagcucaaugaguacugcaaaaugccucugaagcugcucacgaaccacuaugagcaguguuggaaguacuauugccugccgagcggcuggggguccuacggacuugcuguggaagaggaacugcaccucacagagaaacuguucuggggcauuuuugauagccuuucucauaagaaauaugaccccgaucuguuccgcauggcccucccuugucuguccgcgaucgccggggcucugcccccugacuaccucgauaccagaauuaccgccacacuggaaaagcagaucagcgucgacgcugauggaaauuuugaccccaaaccgaucaacaccaugaauuucucucuuccugagaagcuggaguacauugugacaaaguaugccgaacacucccaugacaaaugggcuugcgauaagagccaauccggcuggaaauacgggaucucucucgacgagaacguuaagacgcacccccugauucggccuuucaaaacccuuacagaaaaggagaaggaaaucuaucgcuggcccgccagagagagccugaaaaccaugcucgcggugggauggacagucgagcggaccaaggaaggcgaggcccuggugcagcagcgcgaaaaugagaaacugagauccgugagccaggcuaaccaaggcaauucuuacuccccugccccccucgaucugagcaacguuguccuuucucgggaacugcaggggaugguggagguggucgcugagaauuaucauaacauuugggccaagaaaaagaagcucgaacuggagagcaaaggaggcgggucccacccgcuucugguuccuuacgacacgcucaccgccaaggaaaaauuuaaggaucgcgagaaagcgcaggaccuguucaaguuucugcaggugaauggaaucauugugucuagaggcaugaaagauauggagcucgacgcuagcuccauggaaaagcgguucgccuauaaguuucugaaaaagauccuuaaauacgucgauucugcucaagaguucaucgcccaccuggaagccauugugagcuccgggaagacagagaaaagcccccgcgaccaggaaaucaaguuuuucgcuaagguucuccugccccuuguggaucaguacuuuaccucucauugucuguauuuccucuccagcccucugaaaccgcuguccucuagcggauacgccucccacaaggagaaagagauggucgcgggccuuuuuugcaagcuggccgcucucgugagacaucggauuucucuguucggcagcgacuccacaaccaugguuagcugccuccacauccuggcccaaacacuugacacgagaaccgugaugaaaucuggguccgaacuggucaaggcuggacugcgcgccuuuuucgagaacgcggccgaagaucucgagaagacaagcgaaaaucugaaacuuggcaaguucacccauucucggacccagauuaaaggggugucccagaacaucaacuauacaacgguggcucugcuccccauccugaccagcauuuuugagcacgucacacagcaccaauucggaauggaccuccugcugggcgauguucagaucucuuguuaccauauucuuugcucccuguauagccucgggaccggaaagaauaucuacguggagagacagcgcccugcccugggcgaaugucuugcuucucuggccgcugccauucccguggcguuucucgagccuacacugaaccgguauaauccccucagcgucuucaacaccaaaacgccuagagaacgcuccauccugggcaugcccgacacaguggaggauaugugcccggacaucccucagcuggaagggcuuaugaaggagauuaaugaucuggccgagagcggagcucgguacaccgaaaugccccacguuaucgaggugauucucccuaugcuguguaacuaccuuuccuauuggugggaaagaggccccgagaaucugccgccuucuaccgggcccugcuguacaaaggucaccagcgagcaucucucccugauccugggaaacauucucaaaaucauuaauaacaaucugggcaucgacgaagccucuuggaugaagcgcaucgcuguguacgcccaacccauuaucagcaaagcccggccugaucuucugagaucccacuuuauucccacacucgagaagcugaaaaagaaagcgguuaagaccgugcaggaagaggaacagcuuaaggcugacgggaaaggagauacgcaggaggccgagcugcucauccuggacgaauucgccguccugugccgcgaucucuaugcuuuuuacccuaugcugauucgguauguggacaacaauagaucuaacuggcuuaagagcccggacgccgauuccgaccaacuguuccggaugguugcugagguguuuauccucugguguaaaagccacaauuucaagagagaagagcagaacuuugucauccagaacgaaauuaauaaccuggccuuccuuacaggcgauucuaaauccaagaugagcaaggcgaugcaagugaaaucuggcgggcaggaccaggagcgcaagaaaaccaagcggagaggagaucuguacuccauccagacaagccucauugucgccgcucugaaaaagaugcugcccaucggccucaauaugugcaccccuggggaccaagagcugauuucucuugccaagucccgcuauagccauagagauacggacgaagaggugcgggaacaccugcgcaacaaucuccaucugcaggagaaaucugaugaccccgcuguuaaguggcagcuuaaccuguacaaagaugugcucaaguccgaagagccuuuuaaucccgagaaaaccgucgaaagagugcagcggaucagcgccgcgguguuccaccuggagcaaguugaacagccucugcgcagcaagaaggccguguggcauaaacuccuguccaagcagagaaaacgggcugucguggccuguuuccgcauggcuccgcuuuacaaccugcccagacaccggucuaucaaucucuuucugcacggauaucagcgcuucuggauugagacagaggaauacagcuuugaggaaaagcuuguucaagaccuggccaaauccccuaagguggaggaagaggaggaagaggaaaccgagaagcagcccgauccucuccaucagaucauucuguauuucucuagaaacgcucugacagaacggagcaaacucgaggacgacccccuguacaccuccuauucuagcaugauggccaaguccugccagagcggcgaggaugaagaggaagacgaggauaaagaaaagacauuugaggagaaagaaauggagaagcaaaaaacccuuuaccagcaggcgcgccugcacgaaagaggggccgcugagaugguccuccaaaugaucucugccuccaagggagagaugagcccgaugguggucgaaacgcugaagcuuggcauugccauccugaauggcgggaacgcuggagugcagcagaaaaugcucgacuaucugaaggagaaaaaggaugccggcuucuuucagucucuguccgggcucaugcaaagcuguuccguucuggaccuuaaugcguucgaacggcagaacaaagcugagggacugggcauggugacagaagaggggacccucaucgucagagagcgcggagaaaaggugcugcagaaugaugaguuuacccgggaccuguucagauuucuccagcuucugugcgaaggccauaacucugauuuccaaaacuuucugcgcacacagaugggcaauaccacaacgguuaacgugauuaucagcaccgucgacuaccuccugcggcuucaggaguccauuucugauuucuacugguauuacagcgggaaggacaucauugacgaauccggacagcacaauuucagcaaagcccuggccgugacaaagcaaaucuuuaacucucucaccgaguauauucagggcccuugcaucgggaaucagcaaucccuggcucacagcagacugugggaugccgugguuggauuccuucaugucuuugcuaacaugcagaugaaacucucucaggacagcucccagaucgagcugcugaaggaacuccuggaucuucugcaagacaugguggugaugcuccugucucugcuugagggcaaugucgugaacgggacaauuggcaaacagaugguugauacccucguggaaagcuccacgaaugucgagaugauccugaaguucuuugacauguuccugaagcucaaagaucugaccagcucugacacauuuaaggaauacgaucccgacggaaaaggcauuaucuccaagaaagaguuccagaaggccauggaggggcagaagcaauauacccagagcgaaauugauuuucuucuguccugugcggaggccgacgaaaacgauauguucaauuacguggacuuuguugaccgcuuccacgagcccgcuaaagauaucggauucaacguggccguccuccugacaaaucugucugagcauaugccuaacgacagccggcuuaagugccuccuggaucccgcugaauccgugcugaauuauuuugagccuuaccucggcagaaucgaaauuauggggggagccaaaaagaucgagcgcguuuacuucgaaauuucugagagcucccggacccagugggagaaaccgcaggugaaggaaucuaaaagacaauuuaucuucgacgucgugaacgagggcggggaacaggagaagauggaacuguuugugaacuucugugaggauacgauuuuugagaugcagcuugcgagccagaucuccgaaagcgacucugccgaucggcccgaggaagaggaagaggacgaggauuccagcuauguccuggaaaucgcuggcgaggaagaggaggacggaucucucgaaccugccuccgcuuucgccauggccugcgcuagcguuaagcgcaaugugacagauuuucugaaaagagcgacccugaagaaccuucggaaacaauaccgcaaugugaagaaaaugacagccaaggagcucgucaaggugcuguucucuuuuuucuggaugcuguuuguuggccucuuccagcugcuuuucaccauucuggggggaaucuuucagauucucuggagcaccguguucggcgggggacuggucgaaggcgcuaaaaacaucagagugacaaagauucugggggacaugcccgauccuacgcaauuuggcauccacgacgacaccauggaggccgaacgggccgagguuauggagcccggaauuacaaccgaacuugugcauuucaucaaaggcgagaagggggauacagacaucauguccgaucucuuuggacugcacccgaaaaaggaaggcagccugaagcacgggccugaggucggacucggcgaccuguccgaaauuaucgggaaagaugagcccccuacccuugagucuacggugcagaagaaaagaaaggcucaggccgcggaaaugaaagcugccaaugaggccgaaggcaaggucgagagcgaaaaggcugacauggaggauggagagaaagaagacaaggauaaagaggaagagcaggccgaguaucuguggacagaagugaccaagaaaaagaaacgccgguguggccaaaagguugagaagcccgaagcuuucaccgccaacuuuuucaaagggcucgagauuuaccagacaaagcugcugcauuaucuugcgagaaauuuuuacaaccuccgcuuccuggcccuguuuguggcuuucgccaucaauuuuauucuccuguucuauaaagucaccgaagagccgcuugaggaagagacagaagacguggcuaaccuguggaauuccuucaacgaugaggaagaggaggaagccaugguuuuuuucgugcuccaggagucuacgggauacauggcgccuacccugcgggcccuggcuaucauccacacaauuaucagccuugucugcguggugggcuacuauugucucaagguuccccuggucguguuuaaaagagaaaaggagauugcccgcaagcuggaauucgacgggcucuacaucaccgagcagcccuccgaggacgauauuaaaggacaaugggacagacuggugaucaauacaccuucuuuucccaacaauuauugggauaaguucgucaaacggaaggugaucaacaaauacggcgaccuuuauggcgcugaacgcauugccgagcugcucgggcuggauaagaacgcccuggacuuuagcccuguugaagagaccaaggcugaggcggccucccuugugagcuggcucucuuccaucgauaugaaauaccauauuuggaagcugggagucguguucacggacaauagcuuucuguaccucgcuugguauaccacaaugucuguucugggccacuacaacaauuucuuuuucgccgcccaucuucuggauaucgcuaugggguuuaaaacccucagaacaauucuguccagcgugacccacaacggaaagcagcugguccuuacagugggccuccuggccgugguugucuaucuguacaccgugguggcguucaauuucuuucggaaauucuauaacaagucugaagacgaugacgagccggauaugaagugcgacgacaugaugacguguuaccucuuucacauguaugucgggguucgcgcuggaggcggcaucggggaugaaauugaggaccccgccggagauccuuacgaaauguacagaaucguguucgacaucacauuuuucuuuuucgugauugucauccugcuugccauuauccagggccugauuaucgaugcuuuuggggagcuccgggaccagcaagagcaggugcgcgaagauauggagaccaaaugcuucaucuguggaauuggcaaugacuauuuugauaccacaccccauggguucgaaacgcacacccugcaggagcauaaccuggccaauuaccuuuuuuuccucauguaucugaucaacaaggacgaaacagagcacaccggacaagaguccuacguuuggaaaauguaucaggaaagaugcugggauuucuuuccugcuggcgacugcuuccggaagcaguacgaggaucagcugggcuga

SEQ ID NO: 75166 - RNA, 294 nt, Artificial Sequence
  derived and/or modified sequence opt5 from S100A10__Homo_sapiens__NP_002957
augcccagccagauggagcacgccauggaaaccaugauguucacauuucauaaguucgcuggcgacaaaggguaccugacgaaggaggaucucagagugcugauggaaaaagaguuuccuggauuccuugaaaaccaaaaggacccgcuggccgucgauaaaaucaugaaggaccucgaucagugccgggacggcaagguuggguuucaguccuucuuuucucugauugcgggacuuaccaucgcuuguaaugauuauuucguggugcacaugaaacagaagggcaaaaaguga

SEQ ID NO: 75167 - RNA, 318 nt, Artificial Sequence
  derived and/or modified sequence opt5 from S100A11__Homo_sapiens__NP_005611
auggccaagaucagcucccccaccgagacagaaagaugcauugagucucugaucgcuguguuccagaaauacgccggcaaggacggguauaacuacacgcucagcaaaaccgaauuucuguccuucaugaauacagagcuugcggcuuuuaccaagaaccaaaaagauccuggaguccuggaccggaugaugaagaagcucgauacaaauucugacggccagcuggauuucagcgaauuucuuaaccugauugggggacucgccauggccugucacgacuccuuccugaaagcuguuccgucucagaagcgcaccuga

SEQ ID NO: 75168 - RNA, 279 nt, Artificial Sequence
  derived and/or modified sequence opt5 from S100A12__Homo_sapiens__NP_005612
augaccaagcuggaggaacaccucgagggcaucgugaacauuuuccaucaguacagcgucagaaaagggcacuuugacacacuguccaagggagaacuuaaacaacugcucacgaaggagcuggccaauaccaucaaaaacauuaaggauaaggcuguuaucgacgaaauuuuccagggccuugaugccaaucaggacgaacagguggauuuucaagaguucaucucucugguggcgaucgcucucaaagccgcccauuaucacacacauaaggaguga

SEQ ID NO: 75169 - RNA, 297 nt, Artificial Sequence
  derived and/or modified sequence opt5 from S100A13__Homo_sapiens__XP_011508166
auggccgcugagccccugaccgaacucgaggaaagcaucgagacaguggucacgaccuucuuuacauucgccagacaggaaggccggaaggacucccugucuguuaacgaguuuaaagagcuugugacccaacagcugccucaccuccugaaggauguggggagccuugacgagaaaaugaagucccuggaugucaaucaggacucugaacucaaauucaacgaauacuggcgccugauuggagagcuggcgaaggagaucagaaagaaaaaggaucucaaaauucggaagaaauga

SEQ ID NO: 75170 - RNA, 315 nt, Artificial Sequence
  derived and/or modified sequence opt5 from S100A14__Homo_sapiens__XP_005245419
augggccagugcagaagcgccaacgcugaggacgcccaagaguucuccgauguggagcgggcgaucgaaacccugauuaagaauuuucaccaguacucugucgaagggggaaaagaaacacucacgcccagcgagcugcgcgaccuuguuacccagcagcugccucaucucaugccguccaacuguggccuggaggaaaagaucgcuaaucuugggucuugcaacgauagcaaacuggaguucagauccuuuugggaacucauuggagaggccgccaagucugugaaacuggagcggcccgugcgcggccacuga

SEQ ID NO: 75171 - RNA, 312 nt, Artificial Sequence
  derived and/or modified sequence opt5 from S100A16__Homo_sapiens__NP_525127
augagcgacugcuacaccgagcuggaaaaggccgugaucguccucguugagaacuucuauaaauacguguccaaguauucucuggugaaaaauaagauuagcaaauccucuuuuagagaaaugcuucagaaggagcugaaccacaugcucagcgauacaggcaaucggaaggcugccgacaaacugauccaaaaccuugaugcgaaucaugacgggcgcauuuccuucgaugaauacuggacgcugaucggaggcauuaccgggcccaucgcuaagcucauccacgagcaggagcagcagucuagcuccuga

SEQ ID NO: 75172 - RNA, 285 nt, Artificial Sequence
  derived and/or modified sequence opt5 from S100A1__Homo_sapiens__NP_006262
augggcagcgagcuggaaaccgccauggagacacucaucaacguguuccacgcucauuccgggaaggaaggagacaaauacaagcugucuaaaaaggagcuuaaagaacugcuccagacggagcugagcggcuuucuugaugcccaaaaggacgucgaugcgguugacaaggugaugaaagagcuggaugaaaauggggacggagagguggauuuccaggaauaugucgugcucguugcugcccugaccguggccugcaacaauuucuuuugggagaacuccuga

SEQ ID NO: 75173 - RNA, 294 nt, Artificial Sequence
  derived and/or modified sequence opt5 from S100A2__Homo_sapiens__NP_005969
augugcagcucccuggagcaggcccucgcugugcuggucaccacauuccacaaguacucuugucaagaaggcgacaaauuuaaacuuagcaagggggagaugaaggaacugcuccauaaagagcugcccuccuucguuggagaaaagguggaugaggagggccuuaagaaacugauggggucucucgacgaaaacagcgaucaacagguggacuuucaggaguaugccgucuuccuggcgcugaucacggugaugugcaaugacuuuuuccagggauguccugauagaccguga

SEQ ID NO: 75174 - RNA, 306 nt, Artificial Sequence
  derived and/or modified sequence opt5 from S100A3__Homo_sapiens__NP_002951
auggccagaccccuggagcaggcuguggccgcgaucgucugcaccuuccaagaauacgcuggccgguguggggacaaguauaaacucugccaggccgagcugaaggaacuucugcagaaagagcucgccacauggacgccuaccgaauuucgcgagugugauuacaacaaguucaugagcguucuggacacaaauaaagauugcgagguggacuuuguggaauaugucagaucccuugcuugucugugccucuacugucacgaguauuucaaggauugcccgucugaacccccuuguagccaguga

SEQ ID NO: 75175 - RNA, 306 nt, Artificial Sequence
  derived and/or modified sequence opt5 from S100A4__Homo_sapiens__NP_002952
auggccugcccccuggagaaggcucucgacgugauggucagcaccuuccacaaauacuccggcaaggaaggggauaaauuuaagcugaacaaaucugagcuuaaggaacugcucacaagagagcugccuagcuuccuuggaaagagaacggacgaagccgcguuucagaaacugauguccaaucucgauucuaaccgcgacaaugagguugauuuccaagaguauuguguguuucugagcugcaucgcuaugauguguaacgaguucuuugaaggcuucccggacaagcagccccggaaaaaguga

SEQ ID NO: 75176 - RNA, 279 nt, Artificial Sequence
  derived and/or modified sequence opt5 from S100A5__Homo_sapiens__NP_002953
auggagacaccccuggaaaaggcccucaccacgauggugaccacauuccacaaauacagcggcagagagggguccaagcugacccuuucucggaaagaacugaaggagcucaucaaaaaggaacugugccuuggagagaugaaggagagcuccauugacgaucugaugaaaucucucgacaagaacagcgaucaggaaaucgacuuuaaagaguauuccgucuuccugacaaugcuguguauggcuuacaaugacuuuuuccucgaagauaacaaguga

SEQ ID NO: 75177 - RNA, 273 nt, Artificial Sequence
  derived and/or modified sequence opt5 from S100A6__Homo_sapiens__NP_055439
auggccugcccccuggaccaggcuaucggccuccugguggccauuuuccacaaguacagcgggagagagggagauaaacauacccuuuccaagaaagaacugaaggagcucauccaaaaagaacugacaauuggcucuaaacuucaggacgcggagaucgcucggcugauggaagaucucgaccgcaacaaggaucaggaggucaauuuucaggaguauguuacguuccugggggcccuggcccucauuuacaacgaagcucugaagggauga

SEQ ID NO: 75178 - RNA, 306 nt, Artificial Sequence
  derived and/or modified sequence opt5 from S100A7A__Homo_sapiens__NP_789793
augagcaacacccaggccgagagauccaucauuggcaugaucgacauguuccacaaguacacagggcgggauggaaaaauugaaaagcccucucugcucacgaugaugaaagagaauuuuccuaacuuccugagcgcuugcgacaagaaaggcauccauuaucuugccaccguguuugaaaagaaggauaaaaaugaggacaagaaaauugauuucuccgaauuucugucucuccugggggacaucgcggcugauuaccacaagcaaagccauggagccgccccguguuccggcgggucucaguga

SEQ ID NO: 75179 - RNA, 306 nt, Artificial Sequence
  derived and/or modified sequence opt5 from S100A7__Homo_sapiens__NP_002954
augagcaacacccaggccgagagauccaucauuggcaugaucgacauguuccacaaguacacacggcgcgaugacaaaauugaaaagcccucucugcucacgaugaugaaagagaauuuuccuaacuuccugagcgcuugcgauaagaaagggaccaauuaucuugccgacguguuugaaaagaaggauaaaaacgaggacaagaaaaucgauuucuccgaauuucugucucuccugggagacauugcgacagauuaccauaagcaaagccacggcgcugccccguguuccgggggaucucaguga

SEQ ID NO: 75180 - RNA, 282 nt, Artificial Sequence
  derived and/or modified sequence opt5 from S100A8__Homo_sapiens__NP_002955
augcugaccgagcucgaaaaggcccugaacagcaucauugacguguaccacaaauauucccuuaucaagggcaauuuccaugcugucuacagagaugaccugaaaaagcuccuggagacagaaugcccccaguauauucggaaaaagggggccgauguuugguuuaaggagcuugacaucaacacggauggagcggugaauuuccaagaauuucugauucucgugaucaaaaugggcgucgcugcccacaagaaaucucaugaggagagccacaaggaauga

SEQ ID NO: 75181 - RNA, 345 nt, Artificial Sequence
  derived and/or modified sequence opt5 from S100A9__Homo_sapiens__NP_002956
augaccugcaagaugagccagcuggagagaaacaucgaaacaauuaucaauacguuccaccaauacuccgugaaacucggccaucccgacacccugaaccagggggaguuuaaggaacuuguccggaaagaucugcagaauuuccucaagaaagagaacaagaaugaaaagguuauugagcacaucauggaggaccuggauacaaacgccgacaaacagcuuucuuuugaagaguucauuaugcugauggcucgccucaccugggccagccaugaaaagaugcacgagggagaugagggcccugggcaucaccacaaaccgggacugggcgaagggacacccuga

SEQ ID NO: 75182 - RNA, 279 nt, Artificial Sequence
  derived and/or modified sequence opt5 from S100B__Homo_sapiens__NP_006263
augagcgagcuggaaaaggccaugguggcucucaucgacgucuuccaccaguacuccggcagagagggggauaaacauaagcugaaaaagucugaacuuaaagagcugauuaacaaugaacucagccacuuucuggaggagaucaaggaacaagagguuguggacaaggugauggaaacccuugauaacgacggagauggcgagugcgacuuccaggaguuuauggccuucgucgcgauggugacaacggcuugucaugaauuuuucgagcacgaauga

SEQ ID NO: 75183 - RNA, 288 nt, Artificial Sequence
  derived and/or modified sequence opt5 from S100P__Homo_sapiens__NP_005971
augaccgagcuggaaacagccaugggcaugaucauugacguguucagcagauacuccgggucugagggaagcacgcagacccucacaaagggcgaacugaaaguccuuauggagaaggaacugcccggguuucuccaauccggaaaagauaaggacgcuguugauaaacugcuuaaggaccuggaugccaacggcgacgcucagguggauuucucugaguuuaucguguucgucgcggccauuaccagcgccugccacaaguauuuugagaaagcugggcucaaguga

SEQ ID NO: 75184 - RNA, 300 nt, Artificial Sequence
  derived and/or modified sequence opt5 from S100Z__Homo_sapiens__NP_570128
augcccacccagcuggagauggccauggacacaaugaucagaauuuuccaccgguacagcggcaaggaacgcaaaagauuuaagcucuccaaaggggagcugaaacuucugcuccaacgggaacugacggaguuccuuucuugccagaaggaaacccagcugguggauaagaucguccaggaccucgaugcuaacaaggacaaugagguugauuuuaacgaguucguggugauggucgccgcgcugacaguggcuuguaaugacuauuuuguugaacaacugaaaaagaaaggaaaguga

SEQ ID NO: 75185 - RNA, 1062 nt, Artificial Sequence
  derived and/or modified sequence opt5 from S1PR2__Homo_sapiens__NP_004221
augggcagccuguacuccgaguaucucaaccccaauaaggugcaggaacacuacaacuauaccaaagagacacuggaaacgcaagagaccacaucuagacaggucgccagcgcuuucaucguuauucuuugcugugccaucgugguggaaaaucugcucguccugauugcgguggcucggaacuccaaguuucauucugccauguaccuuuuccuggggaaucucgccgcuagcgaccugcuggccggaguugcuuuuguggccaacacccuccuguccggcucugucacacuucgccugaccccugugcagugguucgcgagagaggggagcgccuuuaucacacucuccgcuagcguuuucucucugcuugccauugcuaucgagcggcacguggccaucgcgaaagucaagcuguauggauccgauaaaagcugccgcaugcuccugcugauuggcgccucuuggcucaucucccuggugcuugggggacugccgauucucggcuggaauugucugggccaucuugaggcuugcagcaccgugcugccccucuacgccaagcacuauguccuguguguugugacgaucuuuucuauuauccugcucgcuauuguggcccuguacgucagaaucuacugcgugguucgguccagccaugccgacauggcugcgccucagacccuugcccugcucaagacagugaccaucguccuggggguguucauuguuuguuggcuucccgcuuuuuccauccugcuccuggauuaugccugcccugugcacucuugucccauucuguacaaagcccacuauuucuuugcugucagcacacucaacucccugcuuaauccugugaucuacaccuggcgcagcagagaccugcggcgcgaaguccucagaccgcugcaaugcuggcggcccggagugggcguucaggggcgcagacggggaggcacgccugggcaucaucugcuuccccucagaucuuccagcucucuggaacgcggaaugcacaugccuacaagccccaccuuccuggagggcaacacaguggucuga

SEQ ID NO: 75186 - RNA, 1137 nt, Artificial Sequence
  derived and/or modified sequence opt5 from S1PR3__Homo_sapiens__NP_005217
auggccaccgcucugcccccuagacuccagccggugcggggcaacgagacacugcgcgaacacuaccaauaugucgggaaacuugccggaagacugaaggaggcgagcgaaggcuccacgcucaccacaguucuguuccuugugaucugcucuuuuauugugcuggagaaucucaugguccugaucgcuauuuggaagaacaauaaauuccauaaccggauguacuuuuucaucgggaaucuggcccucugugaccugcuugccggaauugcuuauaaggugaacauccugaugagcggcaaaaagaccuuuucccucucucccacaguuugguuccugcgcgaagggagcauguuuguggcccuuggagcuucuaccugcucucugcucgccaucgcgauugagagacaccugacaaugaucaagaugcggccuuacgaugccaauaaacgccauagagucuuccugcucauuggcauguguuggcugaucgcuuuuacccuuggcgcccugcccauucucggguggaacugccugcacaaucuuccugacuguagcacgauccugccccucuauuccaagaaauacauugcuuucugcaucagcaucuuuaccgccauucuggugacaaucguuauucuguaugcgcggaucuacuuccucgugaagucuuccagccgcaaagucgccaaccauaauaacucugagagauccauggcucugcuucggaccguggugauugucguuagcguguuuaucgccuguuggucuccucuguucauccucuuccugauugauguggcuugccgcguccaggccuguccgauccuuuuuaaggcccagugguucauugugcuggcuguucucaauuccgcgaugaaccccgugaucuacacacuggccagcaaggaaaugagacgggccuuuuuccgccuggucugcaauugucucgugagaggacggggcgcuagagccuccccuauucagcccgcucuggacccuucucgcagcaaauccagcuccuccaacaacagcucucacagccccaagguuaaagaggaucuuccgcacaccgccccuuccucuugcaucauggacaagaaugcggcucugcaaaacgggaucuuuugcaauuga

SEQ ID NO: 75187 - RNA, 1155 nt, Artificial Sequence
  derived and/or modified sequence opt5 from S1PR4__Homo_sapiens__NP_003766
augaacgccaccggcacacccguggcuccugagagcugccagcaacuggccgcugggggacacuccagacucaucguccugcauuacaaucacucuggccggcuugcugggcgcggaggcccggaagacgggggacugggcgcccucagaggccugagcguugccgcuuccugucuuguggugcuggagaaccuccugguccuggccgcuauuacgucucauaugcggagccgcagauggguguauuacugccucguuaauaucacccuguccgaucuucugacaggggccgcguaucucgccaacgugcugcuuucuggagcucggaccuuccgccuggcccccgcucagugguuucucagagaaggccugcuguucacagcccucgcggccagcaccuuuucccugcuuuucacagcuggggagcgguuugccaccaugguccgcccuguggcugaaagcggagccacgaagaccucuagaguuuacggcuucauugggcuguguuggcuccuggccgcgcuucugggaaugcucccccugcugggcuggaauugccucugugcguuugaccggugcuccagccugcuuccucuguauucuaaacgcuacauccucuucugucuggugauuuuugccggcguccuugcuacaaucauggggcuguauggagccaucuucagacucgugcaggccuccggccagaaggcuccccggccugccgcgcgcagaaaagcucggagacugcugaagaccgugcucaugauucugcuugccuuucuggucugcugggggccgcuguucggacugcugcuugccgauguuuuuggcagcaaccucugggcucaagaguaccugcgcgggauggacuggauccuggcccucgcugugcucaauucugccgugaaccccauuaucuacuccuuccggagcagagaggucugucgcgcggugcuuuccuuccugugcuguggaugccuccggcugggcaugagaggcccuggggauugccuggcccgcgcuguugaagcccacucuggagcuagcacaaccgacuccagccuucggcccagagauucuuuucgcggcucccggagccucucuuucagaaugcgcgagccucugagcuccauuucuagcgugcgguccaucuga

SEQ ID NO: 75188 - RNA, 1197 nt, Artificial Sequence
  derived and/or modified sequence opt5 from S1PR5__Homo_sapiens__NP_001159687
auggagagcggccugcucagacccgccccuguguccgaagucaucguucugcacuacaacuauaccgggaaacuucggggagcucgcuaccagccgggcgccgggcugagagcggacgcuguggugugccucgccgucugugccuucauugugcuggagaaucuugcuguucugcucgugcugggacggcauccccgcuuucacgccccuauguuccugcuccugggcucucuuacacugagcgaucuccuggcuggggccgcguaugccgcuaacauccuucuguccggaccccucacgcugaagcugucuccugcccucugguuugcuagagaaggcggcgucuucguggcccugaccgcgagcguucuuucccugcucgccauugcucuggagcggucucuuacaauggcccgcagagggcccgcuccugugagcucccggggacgcacccuggccauggccgcugcggccuggggcgucagccuccugcuggggcuccugccggcucuuggauggaauugccugggcagacucgacgccuguucuacagugcugccccuuuacgccaaggcuuaugugcuguuuugcguccucgccuucguugggauccuggcggcuauuugugcccuguacgcccggaucuauugccaagugcgcgcuaacgccagacggcucccugcucgccccggaaccgccggcacaaccuccacgagagcgcggagaaaaccucgcagccuggcccuucugcggacccucucugugguccugcuggcuuuuguggccuguuggggcccccuuuuccuccugcugcuccuggauguugcuugcccggccagaacauguccugugcuucugcaggcggaccccuuucucgggcuggccauggcuaauucccugcuuaacccuaucauuuacacccucacaaaucgcgaucugcggcaugcccugcucagacuggucugcuguggacgccacagcugcggccgggaccccucugggucccagcagagcgcuuccgccgccgaagcuagcggaggccuuagacgcugccugcccccugggcucgauggaucuuucuccggcagcgagcggucuuccccgcaaagagacggccuggauaccagcgggucuacgggaagccccggcgcgccuacagccgcucgcacccugguguccgagcccgccgccgacuga

SEQ ID NO: 75189 - RNA, 369 nt, Artificial Sequence
  derived and/or modified sequence opt5 from SAA1__Homo_sapiens__NP_001171477
augaagcugcucaccggccugguguucugcagccuuguccuggggguuuccucucggagcuuuuucuccuuucucggagaggccuucgacggcgcuagagauauguggcgcgccuacucugacaugagagaagcgaacuauaucgggagcgauaaauacuuucacgcucggggaaauuaugacgccgccaagcgcggccccgggggagcuugggccgcugaggugauuuccgaugccagagaaaacauccagcgguucuuuggccauggcgcggaggacucucuggccgaucaagcugccaaugaaugggggcgcagcggaaaagacccuaaccacuucagaccggcuggccuucccgagaaguacuga

SEQ ID NO: 75190 - RNA, 252 nt, Artificial Sequence
  derived and/or modified sequence opt5 from SAA2__Homo_sapiens__NP_001120852
augaagcugcucaccggccugguguucugcagccuuguccuguccguuucuagcagauccuuuuucucuuuucucggggaggccuucgacggagcucgggauauguggcgcgccuacagcgacaugagagaagcgaacuauaucggcuccgauaaauacuuucacgcucgggggaauuaugacgccgccaagcgcggacccggcggggcuugggccgcugaggugauuucucuguucagcgccgaacuuuga

SEQ ID NO: 75191 - RNA, 393 nt, Artificial Sequence
  derived and/or modified sequence opt5 from SAA4__Homo_sapiens__NP_006503
augagacuguucaccggcaucguguuuugcagccucgucauggggguuacauccgagucuuggcggagcuucuuuaaggaagcccugcagggagugggcgacauggggcgcgcuuacugggauauuaugaucuccaaccaccaaaauucuaacagauaucuuuacgcccggggaaauuaugacgcggcucagcgcggccccgggggagugugggccgccaaacugauuagcagaucccgggucuaccuccagggccugaucgauuguuaucuuuucggcaacucuagcacggugcuggaggacuccaagagcaaugaaaaagcugaggaaugggggcgcucuggaaaggauccugacagauuucggccggauggccuccccaaaaaguacuga

SEQ ID NO: 75192 - RNA, 1425 nt, Artificial Sequence
  derived and/or modified sequence opt5 from SAAL1__Homo_sapiens__NP_612430
auggacagaaaccccagcccuccgcccccuggccgggauaaggaggaagaggaagagguggccgggggagacugcaucggcuccaccgucuacucuaaacacuggcuguucgggguucucagcggacugauucagaucgugucccccgaaaauacaaagucuagcuccgaugacgaggagcaacuuacggaacuggaugaggaaauggagaacgagauuugucgcgugugggacaugucuauggaugaagacgucgcucucuuucugcaggaguucaaugccccugauaucuuuaugggcgugcuugcgaaaagcaagugccccagacugcgggaaauuuguguugggauccucggaaacauggcuugcuuccaggagaucuguguguccauuagcucugacaaaaaucugggccagguccugcuccauugccuguaugauuccgacccuccgacccuucuggaaacaagccgccuccugcuuaccugucugucucaagccgagguggccuccguuuggguggagagaauccaggaacaccccgcuauuuacgauagcaucugcuuuauuaugucuuccagcacaaacgucgaccuccuggugaaggugggcgaggucguugacaagcuguucgaucucgacgaaaaacugaugcuugagugggugcggaauggggccgcucagccucuggaucagccccaagaagaguccgaggaacagccuguguuucgccucguccccuguauccuggaggccgcgaaacaggugagaucugaaaacccggaguggcuugacguuuauaugcauauucugcagcuccugaccacaguggaugacggaauccaagccaucguccacugcccugauaccggcaaggacauuuggaaucuccuguucgaucuggugugucaugaauuuugccagagcgacgaucccccuaucauucuucaggagcaaaagacgguucuggcuuccguguucagcguccucucugccaucuacgcuucccagaccgagcaggaauaucugaaaauugagaagguggaccuuccccugaucgacagccucauccggguccugcagaacauggaacaaugccagaagaaacccgaaaauucugccgagagcaacacagaagagaccaagcgcacagaucugacccaggacgauuuucaccucaaaauucugaaggacauccuuugugaguuccuguccaauauuuuucaggcgcucacgaaagagacaguggcccaagggguuaaggaaggacagcugucuaaacagaagugcagcuccgcuuuccagaaccugcuuccuuucuacagcccgguggucgaggauuuuaucaagauucucagagagguggacaaagcccuggcugaugaccuggaaaagaauuuccccucucucaaaguucaaaccuga

SEQ ID NO: 75193 - RNA, 1077 nt, Artificial Sequence
  derived and/or modified sequence opt5 from SAC3D1__Homo_sapiens__NP_037431
augcccggcugcgagcugccuguggggaccuguccggacaugugccccgccgcugaaagagcccagcgggagcgcgaacacagacuccaucggcuggaggucguuccuggaugucgccaagaucccccuagagcggacccccagcgggcugugaaggaauacagccgcccugccgccggcaaaccgagacccccucccucccagcuucggccucccucugugcugcucgcuacaguccgcuaucuggccggggagguggcugagagcgccgauaucgcgagagccgaaguugcuuccuucguggccgaccggcuucgcgcuguccugcucgaucuggcccugcagggagcgggcgacgccgaggcugccgugguucucgaagcugcccuggccacgcuucugaccguggucgcuagacucgggccggaugcggcccggggaccugcugaccccgugcugcuucaagcccaggugcaggagggcuuuggcucucugcgcagaugcuacgccagaggggcuggaccucacccccggcagcccgccuuccaaggccucuuucugcuguauaaccucgggagcgucgaggcgcugcaugaaguucuucagcugccugcugcccuccgcgccuguccgccccugcggaaggcucuugccguggaugcugccuucagagagggaaaugcggcccgccuguuucggcuccugcagacacugccuuaccuccccuccugcgcugugcagugucacgucggccaugccagacgcgaagcucuggcccgguucgcgagagccuuuucuaccccuaaagggcaaacacuuccccugggauucauggugaaccuccuggcucuugacggccugcgcgaggcccgggaucucugccaggcucacggccugccgcuggacggggaagagagaguuguguuucuccgcggacgguaugucgaggaaggccugccucccgccagcaccuguaaggugcuuguugaguccaaacugagagggcggacacucgaagagguggucauggccgaagaggaggaugaaggaaccgaccgcccuggcagccccgcuuga

SEQ ID NO: 75194 - RNA, 1764 nt, Artificial Sequence
  derived and/or modified sequence opt5 from SACM1L__Homo_sapiens__NP_054735
auggccaccgcugccuacgagcagcugaagcuccacaucacacccgaaaaauucuauguggaggcgugcgacgauggcgcugacgauguccugacgauugacagaguuagcaccgaagugacacuugccgugaagaaagaugucccuccguccgccgugacccggcccaucuuugggauucugggaacaauccaucucguugcuggcaacuaccugauugugaucaccaagaaaaucaaggucggggaguucuuuucucacgugguuuggaaggccacagacuucgaugugcuuagcuauaaaaagaccaugcugcaucucacggacauucaacugcaggauaauaaaaccuuucuggcuaugcucaaccacguccugaauguggacggauucuacuuuuccacaaccuaugaucuuacacauacccugcagcgccucucuaacacgagcccugaguuccaggaaaugucccugcuugagagagccgaccaacgguuuguguggaauggccaucugcuccgcgaacugucugcgcagcccgagguccacagauucgcccugccuguucuccacggguuuaucacaaugcacagcuguuccauuaacggaaaguacuucgauuggauccugauuagccggcgcucuugcuuuagagcuggcgugcgguauuacgugcgcggcaucgacuccgaagggcaugccgcuaauuucgucgagaccgagcagauugugcacuacaacggaagcaaagccucuuucguucagacaagaggcuccauccccguguuuuggagccaacggccuaaucuuaaguauaagccgcugccccagaucucuaaagucgcgaaccacauggacggguuccagcgccauuuugauucccaggugauuaucuacggaaagcaaguuauuaucaaucucauuaaccagaaaggcagcgaaaagccucuggagcagaccuucgccaccaugguguccucucuugggagcggaaugaugagauauaucgcuuuugacuuccacaaagaauguaagaauaugcggugggaucgccuguccauccuccuggaccaagucgccgagaugcaggaugaacugagcuacuuucucguggacucugcuggccaggucguggccaaccaggagggcguuuucagauccaauugcauggauugucuggaccggacaaacgugauucaaagccuucuggccagacgcucucuccaggcucagcugcagcggcuugggguccugcaugugggacaaaaacucgaggaacaggaugaguuugaaaagaucuauaagaacgcgugggccgacaaugcuaacgccugcgccaaacaguacgcuggcacgggggcccugaagaccgauuucacaagaaccggaaaacgcacacaccugggccucauuauggacggguggaauagcaugauccgguauuacaagaacaauuuuuccgacggauucagacaggauucuauugaccuguuucuuggcaacuacagcguugaugagcuggaaucccauagcccccucucugugccucgcgacuggaaauuccuggcgcugcccaucaucauggucguggcuuucuccauguguauuaucugccuucucauggccggcgauaccuggacggagacacuggccuaugugcuguuuuggggaguugcuagcauugggaccuucuuuaucauucucuacaauggcaaggacuucgucgaugccccgcggcuggugcaaaaggagaaaaucgacuga

SEQ ID NO: 75195 - RNA, 13299 nt, Artificial Sequence
  derived and/or modified sequence opt5 from SACS__Homo_sapiens__NP_001264984
auggcccccuaccagggcccugcucuguauguguacaacaaugccgucuucaccccggaggacuggcacgggauccaagaaauugcgagaagccggaagaaagaugacccccucaagguuggacgcuuuggcaucggguucaacuccguguaucauauuacagaugugccuugcaucuuuucuggagaccagauuggcaugcuggauccccaccagacgcuuuucgggccucaugagagcggacaguguuggaaucugaaagacgauuccaaggaaaucucugagcucagcgaccaauuugcucccuucgucggcaucuuuggcuccaccaaagaaacauucauuaacgggaauuuuccuggaaccuucuuuagauucccgcugcggcuucagcccucucagcugagcuccaaccucuacaauaagcagaaggugcuggagcuguuugagagcuuccgcgccgaugccgacacaguucuccuguuccuuaaaucugugcaagaugucucccuguaugugagagaagcugacggcaccgagaagcucguuuuucgggugacaagcucugaauccaaagcccugaagcacgagcgcccuaacagcaucaaaauucuugggaccgcuaucucuaauuacugcaagaagacgcccuccaacaauauuaccugugucacauaucaugugaacaucgugcuggaggaagagagcaccaaagaugcccagaagacauccuggcucgucugcaauucuguuggaggcagagggauuagcuccaaacuggacagccuggcggacgaacucaaguucgugccuaucaucggaauugccaugccccugucuucccgggaugacgaggcuaaaggcgccaccagcgauuuuucuggcaaggcuuucuguuuucuuccgcugccucccggggaagagagcuccacgggacucccugugcacaucucuggcuucuuugggcugacagacaaccgcagaagcauuaaauggcgggagcuugaucaguggcgcgaccccgccgcgcuguggaaugaauuccucgucaugaacgugguucccaaggccuacgcuacccugauccuggauuccauuaagagacucgagauggaaaaaagcucugacuuuccucuguccguggaugucaucuacaagcuuuggccggaggccagcaaagugaagguucacuggcagcccgugcuggaaccucucuucucugagcugcuucaaaacgcugucaucuauuccauuagcugcgacugggugcggcuggagcaggucuacuuuuccgaacucgaugagaaucuggaauauacaaaaaccgugcugaacuaccuccagucuagcggaaagcaaaucgccaagguucccggcaauguggacgccgcuguccagcugaccgcggccuccgggacaacgccugugcgcaaaguuacccccgcuugggugagacagguccuucggaagugugcccaucugggaugcgccgaggaaaaacuccaccugcuggaguucgugcuuucugaccaggcuuauagcgagcuccugggccuggaacuccugccgcuucaaaacggcaauuuugugccuuucuccagcucuguuuccgaucaggacgucauuuacaucacaagcgccgaguaucccagaucucuguucccuucccucgaagggcgcuuuauucuggauaaccugaagccccaucuuguggcggcucucaaagaggccgcccagacccggggaagaccuuguacacagcugcaacugcucaaucccgagcgcuucgcucggcugaucaaggaagugaugaacaccuuuuggccgggcagagagcuuaucguccagugguacccuuucgacgaaaaucgcaaccaccccagcgugucuuggcugaagaugguuuggaaaaaucucuacauucacuuuagcgaggaucugacgcuguucgacgaaaugccccuuaucccucggacaauucucgaggaggggcagaccugcguggaacugaucagacugcgcauuccgucccucgucauccuggaugacgagagcgaagcccagcuucccgaguuucuggcugauauugugcaaaagcucggaggcuucguucugaaaaagcuggacgccucuauccagcauccucuuaucaaaaaguauauucacuccccccucccuagcgcggugcugcagaucauggaaaagaugccccugcagaaacucuguaaccaaauuaccucccugcuuccuacacauaaggaugcccugcggaaauuucucgcuucucugaccgacagcuccgagaaggagaaaagaaucauucaggaacuggccaucuucaagcgcaucaaucacucuagcgaucaggggauuuccucuuacacaaaacuuaagggcugcaagguccugcaucacacggcuaaacuccccgccgaccugcggcucagcaucuccgugauugacagcucugaugaggcgaccaucagacuggccaacaugcuuaagauugaacaacugaaaacaaccuccugccucaagcugguucugaaagacaucgagaaugcuuuuuauagccacgaagaggugacacagcuuaugcuguggguccucgagaaccugucuucccucaagaacgaaaauccgaacgugcuggaguggcuuaccccucugaaguucauccagauuagccaggaacaaauggugucugccggagagcucuuugaucccgacaucgagguccugaaagaucuguucuguaaugaagagggcacguacuucccucccuccguuuuuaccagcccggacauucuucauucccugcggcagaucgggcucaagaacgaagcuagccugaaagagaaggauguggugcaggucgccaaaaagauugaagcccuccaggugggagcuugcccugaccaagauguucugcuuaagaaagcgaagacacugcugcucgugcugaauaaaaaccacacccuucugcagucuagcgagggcaagaugacacucaaaaagaucaaguggguccccgccuguaaagagcgcccucccaauuaucccgggucccugguguggaagggagaccucugcaaccugugugcuccuccggauaugugcgacguuggccaugccauccuuauugggucuagccugccccugguggaauccauccacgucaaucucgagaaagcccugggcauuuucaccaagccuucucuuagcgcugugcugaaacacuuuaagaucguuguggauugguacuccucuaaaacguucagcgacgaagacuauuaccaguuucagcauauucuccuggagaucuacggauucaugcacgaucaucucaacgaaggcaaggacuccuuuagagcccugaaguuccccugggucuggacagggaaaaaguuuuguccucuugcgcaagcugugauuaaacccauccacgaucuggaccugcagccuuaucuccauaaugugccgaagaccauggccaaauuccaccagcuguuuaaggucugcggaagcaucgaggagcuuacaucugaucacauuuccaugguuauccaaaagauuuaccugaaaagcgaccaggaucucucugaacaggaguccaagcagaaccugcaucucaugcugaauaucauucgguggcuuuauagcaaccaaauccccgccuccccuaauacccccgugccuauccaccauucuaaaaaccccagcaagcugauuaugaaaccgauccacgaauguugcuacugugacauuaagguggaugaccugaacgaucuccuggaggacuccgucgaaccuaucauucuugugcaugaggacauccccaugaagaccgcugaguggcugaaaguucccugccucagcacaagacugaucaauccugaaaacaugggcuucgagcagucugggcagcgcgaaccccugacggugcggauuaagaauauccucgaggaguauccuuccgucagcgauauuuucaaagaacuucugcagaacgccgacgaugcgaaugcuaccgagugcucuuuucugaucgacaugagacgcaacauggauauuagagaaaaucuccuggacccgggaauggccgccugucacggccccgcucuuuggagcuucaacaauucccaauuuucugauagcgacuucgugaacaucacacggcugggggagucccucaagcgcggcgaaguugauaaagugggaaaguuuggccugggguucaauucugucuaccacauuaccgacaucccuaucauuaugagcagagaguuuaugaucauguucgaucccaacauuaaucauaucuccaagcacauuaaagacaagagcaacccuggaaucaaaaucaauuggucuaagcagcagaaacggcugcgcaaguuucccaaccaguucaagccguuuauugauguguucggcugccaacucccucuuacagucgaggcccccuauuccuacaacgggacccuguuuagacugagcuuccggacgcagcaggaagcuaaaguguccgagguuucuagcacauguuacaauaccgccgacaucuauucccucguggacgaauucucucugugcggacaucgccuuauuaucuuuacccagagcgucaaguccauguaccugaaauaucucaagauugaggaaacaaacccuagccuggcgcaagauaccgugaucaucaaaaagaaaucuuguuccagcaaggcccugaauacacccguucucucugugcuuaaggaggcugccaaacugaugaagacgugcuccagcucuaacaaaaagcugccuagcgacgagcccaaauccucuuguauucuccagaucaccgucgaagaguuccaccacguguuuagacggauugcugaucugcagagcccgcuuuuccgcggcccugacgaugaccccgccgcccuguuugaaauggcuaaguccgggcaaagcaagaaacccuccgaugagcucucucagaagacaguggaaugcaccacauggcugcuguguaccugcauggacacgggcgaggcgcucaaauucagccuuuccgagucuggaagacggcugggccugguuccuuguggggccgucggagugcagcucagcgaaauccaggaucaaaaguggaccgugaaaccgcauauuggcgaggucuuuugcuaccugccccuuagaaucaagacagggcugccugugcacauuaauggaugcuucgcuguuaccuccaaccgcaaggaaaucuggaaaacagacaccaagggccgguggaauacaaccuuuaugagacaugugaucgucaaagccuaucuccaggugcugucuguucugcgcgaucucgccacgagcggcgagcuuauggacuacacauauuacgcuguguggcccgauccugaccugguccacgacgauuucuccgugauuugucagggguuuuacgaggacaucgcccauggaaagggcaaagaacugaccaagguuuucagcgaugggucuaccuggguguccaugaagaacguccgguuucucgacgauagcauucugaaaagacgcgacgugggaucugcggcuuucaagaucuuccuuaaauaucugaagaaaacaggcuccaagaaucucugcgccguggagcugcccagcucugucaaacugggguuugaagaggccggauguaagcagauucuccuugaaaacaccuucuccgagaagcaauuuuucagcgagguuuuuuucccuaauauccaggaaaucgaggcugaacugcgggauccgcugaugauuuuugugcucaacgagaaaguggacgaauucuccggcguccugagagugacgcccugcaucccuuguagccuugagggccacccccugguucucccuucucgccugauucaccccgaggggcggguggccaagcuguuugauaucaaagacggaagauucccguacggcagcacacaggauuaucucaauccuauuauccuuaucaagcugguccagcuggggauggcgaaagacgacauucucugggaugacaugcuggaacgggcuguguccguugccgagaucaacaagucugaucauguggccgcuugccuucgcagcuccauucugcucucucugaucgacgaaaagcugaaaauuagagauccccgggccaaggacuuugcugccaaauaccaaaccauccgcuuccuccccuuucuuacaaagccugcgggauucagccuggauuggaaaggcaauuccuucaagcccgagaccauguuugccgcuacagaccuguauaccgccgaacaccaggauauugucugucuccugcagccuauccuuaacgagaauucucauagcuucagagggugcggauccgugagccuggcugucaaggaguuucucggccugcugaaaaagccgacgguggaccucguuaucaaccaacuuaaagaaguggccaagucuguggaugacggcauuacccuguaccaggagaacaucacaaaugccuguuauaaauaccugcacgaagcucucaugcagaacgagauuaccaagauguccaucauugauaagcugaaacccuucagcuuuauccuugucgagaaugcguacguugacucugaaaagguguccuuccaccugaacuuugaggccgcuccuuaucucuaccagcugcccaauaaauauaagaacaauuuccgggaacuguuugagacagugggggucagacaaagcugcaccguggaagacuucgcccucguucuggaguccaucgaucaggagcgcggaacgaaacagauuacagaagagaacuuucagcuuugucggagaaucauuucugaaggcaucuggagccugauucgcgagaagaaacaagaauucugcgagaagaauuacgggaagauccuccugccugacaccaaccuuaugcugcuccccgccaaaucccugugcuauaaugauuguccguggaucaaggugaaagacacaaccgucaaguacugccaugcugauauuccucgggagguggccgucaaacugggagcggugcccaagagacacaaggcucucgaacgcuaugccagcaacguuuguuuuaccacacugggcacggaguucgggcagaaagaaaagcuuaccucucggaucaaauccauucugaaugccuacccuagcgagaaggaaaugcucaaagagcugcuucagaacgcugacgaugccaaggcgacagagaucugcuucguguuugaccccagacagcauccugucgaucgcauuuucgacgauaagugggccccccugcaaggaccggcucucuguguguacaauaaccagccuuuuaccgaagacgacguuagaggcauccagaaccugggcaaagggacaaaggagggaaaucccuauaaaaccggccaguacgggauuggauucaacucuguguaucacaucacggauugccccagcuuuaucuccggcaaugacauucuguguaucuucgauccucaugcccgguacgcuccgggggccacaucuauuagccccggacgcauguuuagagaccucgaugcugacuuccggacccaauuuuccgauguccuggaccuuuaucugggcacccacuucaagcucgauaacugcacaauguuucgcuucccucugagaaaugccgaaauggcgaaagugucugagaucagcuccgugcccgccagcgaccggaugguucagaaccuucuggauaagcucagaucugacggcgcugagcugcugauguuucucaaucacauggaaaagauuuccaucugugagaucgauaaaagcaccggggcccugaacguccuuuacuccgugaagggaaaaauuacagacggcgaccgccugaagcggaaacaguuccaugcuucugugaucgauagcgucacgaagaagagacaacucaaagacauuccuguucagcagaucaccuauacaauggauaccgaagacuccgaggggaaucugacaaccuggcuuauuugcaaccgcucuggauucagcuccauggaaaaggugagcaaaucugugaucuccgcccacaagaaucaggauaucacgcuguuuccccggggcggggucgccgcuuguauuacccauaacuacaaaaagccucacagagcguucugcuuucucccccugagccuggagacaggacucccguuccacgugaauggccauuuugcccuggacucugcucggcgcaaccuuuggagagaugacaauggcguuggggugcgguccgauuggaacaacagccugaugaccgcccucaucgccccugcuuacgucgagcugcuuauucaacugaaaaagcgcuauuuccccggaucugacccuacacucuccgugcugcagaauacccccauccacguugugaaggauacacugaaaaaguuucucagcuucuuuccggucaacagacuggaccuucagccugaucuguacugccucgugaaagcccuguauaauuguauucaugaagacaugaagcggcuucugcccgugguccgcgcgcccaacaucgacggcucugaucuccacagcgccguuaucauuacguggaucaauauguccaccagcaacaaaacaagaccuuucuuugacaaucugcugcaggaugagcuccaacaucugaagaacgcugacuacaauauuaccacccggaagacaguggccgaaaacguguaucgccuuaaacaccugcuccuggagaucggguucaaucuugucuacaacugcgaugaaacggcuaaucuguaucacugucucauugacgccgauauccccguguccuacguuaccccugcggacauuagaucuuuucugaugacauucagcuccccggauaccaacugccauaucggaaagcugcccugucggcuucagcagacaaaucugaaacucuuccacucucugaagcuccugguggacuacugcuuuaaagaugccgaggagaacgaaaucgaggucgaaggccuuccucugcugauuacccucgacagcgugcugcagacguucgacgcuaagagacccaaguuucuuacaaccuaucaugagcugaucccuucccgcaaagaucucuucaugaacacccuguaccucaaguauucuaauauucugcugaacuguaaaguugccaagguguuugacaucagcuccuucgcugaucuucugagcucuguccucccccgggaauacaaaacaaaguccugcaccaaguggaaagacaauuuugccagcgagucuuggcugaagaacgcuuggcacuucauuuccgagagcgugucuguuaaagaagaucaagaggaaacaaagccuaccuuugacaucguggucgauacgcuuaaagacugggcccugcucccggggacaaaguucaccguguccgcgaaucagcuggucgugcccgagggagauguucuccugccucugagccuuaugcauaucgccguguuucccaacgcucagucugacaaagucuuccacgcccugaugaaggcuggcuguauucaacucgcccugaauaagaucugcuccaaagauagcgccuucgugccucuucugagcugucacacagcgaacauugagucccccaccucuauccucaaggcucugcauuauauggugcagacgagcaccuuuagagccgaaaaacugguugagaaugacuucgaagcucuccugauguacuuuaacugcaaucuuaaccaccugaugucccaggaugacauuaagauccucaaaucucugccgugcuauaagagcaucuccggccgcuacgugucuauugggaaguucggaacauguuacguccuuaccaaaagcaucccuuccgccgagguggaaaaguggacacagagcucuuccagcgccuuucuggaggagaaaauucaucucaaggaacuguaugagguuaucggcugcgugcccgucgacgaucuggaaguguaccucaaacaccugcuucccaagauugagaaucugucuuaugacgcuaagcucgaacaccugaucuaccuuaaaaaccggcuguccagcgccgaggagcucuccgaaauuaaggagcaacuguucgaaaaacuggagucucuccugaucauccaugaugcgaauagcagacuuaagcaggccaaacacuuuuaugaccgcaccguccggguguucgaaguuaugcugccugagaagcucuuuauucccaacgauuucuuuaagaaacuggagcagcuuaucaagccuaaaaaccaugugacauucaugaccuccugggucgaauuucugagaaauauugggcucaaguacauccugucucagcaacagcugcuccaguucgcuaaagagauuagcgugcgcgccaacacggaaaauugguccaaggagacacugcagaacaccguugacauccuucugcaccauaucuuccaagagcggauggaucuccugagcggaaauuuucuuaaagaacugucucucauuccguuccugugucccgagagagcuccugccgaauuuauccgcuuccacccccaguaucaggaggugaacggcacccugccucucauuaaguuuaauggggcgcaagucaaccccaaguucaaacagugcgacgugcugcagcuucuguggacauccuguccgauccucccugaaaaggccaccccccugagcauuaaagagcaggagggcucugaucuuggaccucaagaacagcuggagcaggugcucaauaugcugaacguuaaucuggaccccccgcucgauaaggucaucaacaauugccggaacaucuguaauauuacaacgcuggacgaagagauggugaaaaccagagcuaaggugcuucgcagcaucuacgaauuucuguccgccgagaagagagaguuccgguuucagcuccgcggcgucgcuuucgugaugguugaagauggguggaaacugcugaagccugaggaaguggucauuaaccucgaguacgaaucugacuuuaaacccuaucuuuacaagcugccccuggagcucggaacauuccaccaacuguuuaaacaucuuggcaccgaggacaucauuagcacaaagcaguauguggaaguucuguccagaaucuucaagaacagcgaggggaaacagcucgauccuaaugaaaugcggaccgugaagagagucgugucuggacuguuccggucccugcagaacgacagcguuaaagugcgcuccgaucuugagaaugucagagaccucgcccuguaccugcccucucaagauggccggcucgugaagagcuccauucugguguuugacgaugcuccucacuauaaaucucgcauccaggggaacaucggcguccagaugcuuguugaccugagccagugcuaccucggaaaggaucauggcuuccacacgaagcugauuaugcuguuuccgcaaaaacuuagaccccggcuccuguccucuauccuggaggaacagcucgacgaggaaaccccuaaggugugucaguucggggcccugugcagccuucaaggacgccugcagcuccugcuguccagcgagcaguuuauuacaggccuuaucagaauuaugaaacacgaaaaugauaacgcguuccucgccaaugaggagaaggcuauccggcuguguaaagcccugcgcgaagggcucaaggugucuugcuuugagaagcugcagaccacacuuagagucaaaggauucaaccccaucccucauucccggagcgaaaccuuugcuuuccugaagcgcuuuggcaaugccgugauucuccuguauauccaacacucugacuccaaagacauuaacuuccugcuugcccucgcgaugacgcugaagagcgcuacagauaaucugaucucugacaccagcuaccucauugccaugcugggguguaacgauaucuacagaaucggcgagaaacuugacucccugggaguuaaguaugauagcuccgaacccucuaaacucgagcugccuaugccgggcacacccauuccugccgagauccauuacacccugcuuauggaccccaugaauguguuuuauccuggggaauacgucggauaucucguggaugcugagggcggggacauuuacggaagcuaucagcccaccuacacauacgccaucauuguucaggaaguggagcgggaagaugcugacaacuccucuuuccugggcaagaucuaucagauugauaucggcuacagcgaguauaagaucgucuccucucuggaccucuacaaauucagccgcccggaggaauccagccaaucuagagauuccgccccuagcacgcccaccucucccacagaguuucugaccccugggcuucgguccauucccccucuguucagcggaagagaaucucacaagacauccagcaaacaucagucuccgaagaaacucaaggugaauucccugcccgagauccugaaggaggucaccagcgugguugaacaggcguggaaacuuccugaguccgaacgcaagaaaauuauccggagacucuaucugaaguggcaccccgacaaaaacccugagaaccacgacauugccaaugaaguguuuaagcaucugcagaacgagaucaaucgccucgagaagcaagcuuuccuggaucagaacgccgaccgggcuagcagacgcacguuuucuacaagcgccucccgguuccagucugauaaauacagcuuucaaagauucuauaccuccuggaaucaggaagcgaccucucacaagagcgagcgccagcagcaaaacaaagaaaagugccccccguccgccggccagacauacagccagcgguuuuucgucccucccaccuuuaaaucuguggggaauccuguugaggcuagacgcuggcuucggcaggccagagcuaacuucuccgccgcucggaaugaccugcauaagaacgccaaugaaugggugugcuuuaaguguuaccucagcacaaaacuggcgcugaucgccgcugauuaugccgucagaggaaagucugacaaagaugugaagcccacggcccuugcucaaaaaauugaggaguacucccagcagcucgaaggccugaccaacgacgugcacacacuggaggccuaugggguugauagccucaagacccgcuacccugaccugcuucccuucccgcagauccccaaugaucgguucacaucugaagucgcgaugagagugauggagugcaccgcuuguauuaucauuaaacuggaaaacuuuaugcaacagaagguguga

SEQ ID NO: 75196 - RNA, 900 nt, Artificial Sequence
  derived and/or modified sequence opt5 from SAE1__Homo_sapiens__NP_001139185
augguggagaaggaagaggccggcgggggaaucagcgaagaggaagcugcccaguacgacagacaaauucggcuguggggccucgaggcgcagaaacgccugagagcuucccggguccuucugguugggcucaagggacugggcgccgagaucgccaaaaaccuuauucuggcuggggugaagggacucaccaugcuggaucacgaacaggugacacccgaggacccuggcgcccaguuccugauccgcacgggcucugucgggagaaaucgggcugaagccagccucgagcgcgcgcaaaaccugaauccgaugguggauguuaaaguggacaccgaggauauugaaaagaagcccgaguccuuuuucacacaguuugacgccgucugccuuaccuguugcucuagagaugugaucguuaaaguggaccagaucugucauaagaacagcauuaaauucuuuacaggagaugucuucggcuaucacggguacaccuuugcuaaucugggagaacaugaguucguggaagagaagacaaaaguggccaaggucucccagggcguugaggacgggccugauaccaagcgggcuaaacucgacucuagcgaaacgaccauggugaagaaaaagguggucuuuugccccgugaaagaggcccuggaaguugauugguccagcgagaaggcgaaagccgcucuuaagcgcacaaccucugacuauuuccugcuccaaggaccuguguccgccggccccagcucucagcagcugcugcuccugagauggcacgaaggcgagugggacuguggggucccuuggccccaggugaacucccgguuuggaagcccgcgcgaugcuaauugcucuaugccuacauguauccccugcccucuucccuccuga

SEQ ID NO: 75197 - RNA, 2862 nt, Artificial Sequence
  derived and/or modified sequence opt5 from SAFB2__Homo_sapiens__NP_055464
auggccgagacccugcccggcagcggggacuccggaccuggcacagcuucucucgggccgggaguggccgaaacgggcaccagacggcugagcgagcuucgcgucaucgaucugagagcggaacucaagaaacggaaccuggacacagggggaaauaaguccguucuuauggagcgccugaaaaaggcugugaaagaagagggccaggaucccgacgagauuggcaucgaacucgaggccaccucuaaaaagagcgccaagagaugcgugaaggggcugaaaauggaagaggagggaacagaagauaacggccuggaggacgauucccgggacgggcaagaagauauggaggcuucucucgaaaaucugcagaacaugggaaugauggacaugagcguccuugaugagaccgagguggccaauuccagcgcuccugacuucggcgaagaugggacagacggacugcucgacucuuuuugugauuccaaggaguacguugccgcgcagcugcgccagcuucccgcccaaccucccgaacacgcuguggacggcgagggcuucaaaaacacccuggaaacgagcucucucaauuuuaaggucaccccugauauugaggagucccugcuggaaccggagaacgaaaagauccucgacauucugggggagacaugcaaaagcgaacccgugaaggaggagucuuccgaacuugagcagccuuucgcccaggauaccagcuccguuggacccgacagaaaacuggcugaagaggaggaucucuuugacucugcccauccugaagagggcgaucuggaccuugcgagcgaauccacagcccacgcucagagcucuaaggccgauucccugcucgcuguggucaaacgggagcccgccgaacaaccgggggacggagagcgcaccgacugugagccugugggccuggaacccgccguggagcagagcucugcugcgagcgaacuggccgaggcuuccucugaagaacucgccgaggccccuacggaagcucccagccccgaggccagagauuccaaggaagacgggcggaaauucgauuuugacgcgugcaaugaggucccuccggcucccaaggaaagcucuacauccgagggagccgaucagaagaugagcucuuucaaagaggaaaaggacaucaaaccuaucauuaaggaugagaaaggccgcguuggcuccgggagcggaagaaaccuguggguguccggccuuucuagcaccacacgggccaccgaccugaagaaucucuuuuccaaguaugggaaaguggucggagcuaaggugguuaccaacgcccgcucucccggcgcuagauguuacggguucgugacaaugagcacguccgaugaagccaccaaaugcaucagccaucugcaccggacagagcuucauggcagaaugauuucugucgagaaggcgaaaaaugaaccugccggaaagaagcuguccgaccgcaaagagugugaagugaagaaagagaagcucagcucuguugaucggcaccacuccguggaaaucaaaauugagaagaccgucaucaagaaagaggaaaagauugagaaaaaggaagagaaaaagcccgaagacaucaaaaaggaggagaaggaucaggacgaacugaaaccgggcccuacaaacagaagccgcgugaccaagucugggagccggggaauggagagaacggucgugauggacaaauccaagggcgaacccguuaucagcgugaaaacaaccucucgcuccaaggagcggagcuccaagucucaagauagaaaaagcgaauccaaggagaaacgcgacauucugucuuuugauaagaucaaagagcagcgggaaagagagcgccagcggcaaagagaacgggagauucgcgagaccgaaagacggagagagcgcgaacagcgggagagagaacagcgccucgaggcuuuccaugagagaaaggaaaaggcccggcugcagcgcgagagacuucaacuggaaugccagcggcagcgccucgagagagaacggauggagcgcgagagacuggaacgggagcgcaugagagucgaacgggagagacgcaaagaacaggagcggauccacagagagcgcgaggagcugcggagacaacaggaacagcuucgcuaugagcaggagcggagaccugggcgccggcccuacgaccucgauagacgggacgaugcuuauuggccugaaggaaagcgcguggccauggaggacagauaccgggcggauuuuccccgcccggaccauagauuccacgauuucgaccaccgggauagaggccaauaucaggaccaugccauugaccgccgggaagggagcagaccuaugaugggcgaucaccgcgacggacagcauuacggcgaugaccggcacgggcauggaggcccucccgagagacacgggcgcgauucccgggacggauggggcggguacggcucugauaaaagacugagcgaaggacgcggccugcccccgcccccuagagggggacgggacuggggcgagcacaaucagcgccucgaggaacaucaagcuagagccuggcagggggcuauggaugccggagccgcuucccgggagcacgcgcgcuggcagggcggggaaagaggccugagcggacccucuggcccugggcauauggccucccggggaggcguugcugggagaggaggcuuugcccaaggcgggcacagccagggacacgugguccccggcgggggacuugagggcgggggaguggccucucaggaccgcggcucccgggugccucauccccacccgcauccucccccuuauccccacuucacaagacgcuacuga

SEQ ID NO: 75198 - RNA, 2754 nt, Artificial Sequence
  derived and/or modified sequence opt5 from SAFB__Homo_sapiens__NP_001188267
auggccgagacccugagcggccucggggacuccggagcugccggcgcggcugcccugucuagcgccuccucugaaacagggacgagacggcuuagcgaucugcgcgugaucgaccucagagcugagcugcggaagcgcaacgucgauuccucuggaaauaaaagcguucuuauggaaagacugaagaaagccauugaggacgaaggcgggaaccccgaugagaucgagauuaccuccgaaggaaauaagaaaacaagcaagcggucuuccaagggccgcaaaccugaggaagagggcguggaggacaacgggcucgaagagaauagcggagauggccaggaagacguggagaccucucuggaaaaccugcaagauaucgacauuauggauaucuccguccucgacgaggcugagaucgauaaugggagcguggccgacugcguugaagacgaugacgcggauaaccugcaggagucucuuuccgacagcagagaacugguggagggagaaaugaaggagcucccggagcagcugcaggaacacgccauugaggauaaagaaacaaucaauaaccuugacaccuccucuagcgauuucacaauucugcaagagaucgaggaacccucccucgagccugaaaaugagaagauucuggacauccugggcgaaaccuguaaaagcgagcccgucaaggaggaaucuuccgagcucgaacagccuuuugcucaggauacgagcucuguggggcccgaccggaagcuggccgaggaagaggaucuuuucgacagcgcucauccugaggaaggagaccuggaucucgccuccgagucuaccgcgcacgcccagagcuccaaagcugacagccugcuugccguugugaagcgcgaaccggcugagcaacccggcgauggcgaaagaacagacugcgagccugucgggcuggagcccgccguggaacagucuuccgccgcuagcgagcucgcggaagccucuuccgaggaacuggcugaggccccuaccgaggcccccagcccggaagcucgggauuccaaagaggacggacgcaaguuugauuucgacgccuguaacgaagugccucccgcgccuaaagagucuagcacauccgagggcgcugaucagaagaugucuagccccgaagacgauuccgacaccaaaagacugagcaaggaggaaaaggggcggucuuccugcggacgcaauuuuugggucagcggccucucuuccacgacaagagccaccgaucugaaaaaccuuuucagcaaguacgggaaaguugugggagccaagguggucacaaaugcucggucucccggcgccagauguuauggcuuugugaccaugagcaccgcugaggaagccacaaaaugcauuaaccaucugcacaagacggagcuccaugggaagaugaucuccguugagaaagcgaagaacgaaccuguggggaaaaagaccagcgacaaacgcgacucugauggcaagaaggagaaauccagcaauuccgaccggucuacaaaccugaagagagaugacaaaugugaucgcaaggacgaugccaaaaagggggacgauggaagcggcgaaaaguccaaagaccaggaugaccaaaagccggggcccucugagcggagcagagcuaccaaauccggcucucgcggaacagaacggaccgucgugauggauaagagcaaaggcguuccugugaucuccgucaagacgagcgggucuaaagagagagccuccaagagccaggaccgcaagucugcuucccgggagaaaagaagcguggucucuuucgacaaggugaaagaaccccgcaagucccgggauagcgagucccacagcagaguucgggaacgcucugagagagaacagcggaugcaagcccagugggagagagaggaacgcgagcggcuugaaauugcgagagagcgccuggccuuucagagacagcggcucgagcgcgaaagaauggagcgggaacgccuggagagagaacggaugcacguggagcaugagcgcagacgggaacaagagcgcauccacagagaacgggaggaacugagacgccagcaggagcuccgguacgagcaggaaagacgcccugcuguccggagacccuaugaccuggaucgccgggacgaugccuacuggccggaggcuaaaagagccgcccuugacgaacgcuaucauagcgauuucaaucggcaagacagauuucacgauuucgaccaccgggaucgcggaagauacccugaccauuccguggaccggcgcgagggcucuagaagcaugaugggggaacgggagggacagcacuaucccgagagacauggcgggccugaacgccacggccgggauuccagagacggauggggcggguacggaucugauaagcgcaugagcgagggccgggggcugcccccucccccgagaggacgccgggacuggggcgaucaugggagacgcgaagacgauagauccuggcagggcacagcugacggaggcaugauggaucgggaccacaagcgcuggcagggaggagagagaucuaugagcggccacuccgggccuggacauaugaugaaccggggcgggaugagcggccgcggaucuuuugcgcccggcggggccuccagaggacaccccauuccucauggcgggaugcaaggaggcuucggcgggcagagccggggaucuagaccguccgaugcucgcuucacccggagauacuga

SEQ ID NO: 75199 - RNA, 2715 nt, Artificial Sequence
  derived and/or modified sequence opt5 from SAGE1__Homo_sapiens__NP_061136
augcaggccagcccccugcaaaccucccagccuacaccgcccgaggaacuccacgcugccgcguacguguucacgaacgacggccagcagaugagaucugaugaggucaaucugguugcuaccgggcaccaaagcaagaaaaagcacucccggaaaucuaagcgccauagcuccucuaaaagacggaaaagcauguccagcuggcuugacaagcaggaagaugccgccgugacacacucuaucugcgaggaacgcauuaacaauggacagccuguggcugacaacguccuguccaccgcucccccuuggcccgaugccacaaucgcccauaauauuagagaggagcggauggaaaacggccagagccgcaccgacaaagugcucucuacagcgccuccgcaacugguucacauggccgcugccgggauccccuccaugagcaccagagaucuucacucuacggugacccauaauauucgggaggaacgcauggagaacggacagccucagcccgacaauguccuguccacaggcccuaccgggcucaucaacauggcugccacacccaucccggcgaugagcgccagagaucuguaugcuaccgugacgcacaauguuugugagcagaagauggaaaacgugcaaccugcccccgacaauguccugcucacacugcggccucgcagaauuaacaugaccgauacaggaaucucccccaugucuacccgggaccccuacgcuaccauuacauauaaugugccugaggaaaagauggagaagggccagccgcagcccgauaacauccuuagcacggccuccaccggccugauuaacguggccggggcuggaaccccugcgaucagcaccaauggccucuacucuacagucccccauaacguuugcgaagagaaaauggagaaugaccaaccucagcccaacaaugugcuguccaccgugcagccggucauuaucuaucuuacggccacagggaucccuggaaugaacacccgcgaccaguacgcuaccauuacacacaaugugugugaagagagaguugugaacaaucaaccccugccuagcaacgcccucucuaccguccugcccggccuggccuaucucgcuacagccgauaugccugcgaugagcacgcgggaccagcacgcuaccaucauucauaaucugagagaagagaagaaggauaacucccagcccacaccggacaaugugcuuucugccguuaccccugaacugaucaaccucgccggggcuggcauuccucccaugagcacacgcgaucaguacgccaccgugaaucaccauguccacgaggcucggauggagaacggacaaagaaaacaggacaacgugcuguccaauguccuuagcggccugaucaacauggccggggcgucuauccccgccauguccagccgcgaucucuacgcuacgauuacccauucugugcgggaagagaagauggaauccggaaaaccgcagacagacaagguuaucagcaaugaugcuccccagcugggccacauggccgccgggggcauuccuuccaugucuaccaaagaccuguaugcgacagugacccaaaacguccacgaggaaagaauggagaauaaccagccccagccuagcuacgaucucuccacggugcugcccggacuuacauaucugaccguugccgggaucccugcuaugucuacacgcgaccaguacgccaccgugacccauaauguccacgaggaaaagauuaaaaacggacaagcugccagcgacaauguguuuuccacagugcccccggccuucaucaacauggcugcgacgggcguuagcucuauguccacccgggaucaguaugccgcugucacacauaauaucagagaggaaaagauuaacaauagccagccugcccccggcaacauccucucuaccgccccucccuggcugcgccacauggcugccgcggggauuuccagcacaaucacccgggaccuuuacgugacggcuacacacucugugcaugaggagaagaugaccaauggacaacaggccccggauaacagccuguccaccgucccucccggcugcauuaaccucagcggggccggaaucucuuguagauccacacgcgaccuguaugcuaccgugauucacgauauccaggaagaggaaauggagaaugaccagacaccucccgauggcuuucugagcaacuccgacucucccgaacucaucaauaugacggggcauugcaugccuccgaacgcccuggauagcuucucccacgacuuuaccucucuuagcaaagaugagcugcucuacaagcccgacuccaaugaguucgcgguuggcaccaaaaacuacucugugagcgcuggagauccucccgucacagugaugucccugguugaaacagugccuaauacaccccaaauuagcccugccauggccaagaaaaucaacgacgacauuaaguaucagcugaugaaggagguccggagauuuggccagaauuacgaacggaucuucauucuucucgaggaagugcaggggucuaugaaaguuaagcgccaauuuguggaguucacgaucaaagaggcugccagauuuaagaaagucgugcugauccagcagcuggaaaaggcucucaaggagauugauucccauugucaucugcggaaagugaagcacaugagaaaacgcuga

SEQ ID NO: 75200 - RNA, 1218 nt, Artificial Sequence
  derived and/or modified sequence opt5 from SAG__Homo_sapiens__NP_000532
auggccgcuagcggcaagaccuccaaaucugagcccaaccacgugaucuucaagaaaauuagcagagacaaguccgucacaaucuaccuggggaaucgggauuauauugaccauguuucucaggugcaaccuguggauggagucgugcucguugacccggaucuggugaaaggcaagaaggucuacgugacgcuuaccugcgccuuucgcuaugggcaggaagacaucgauguuauuggacugacauucagacgggaccucuacuuuagccgcgugcaggucuaucccccugugggcgcggcuuccacccccacaaaacugcaggagucucuucugaagaaacucgggagcaacaccuacccuuuccugcugacauuucccgauuaucucccuuguuccgugaugcugcaaccggcuccccaggacagcggaaagucuugcggcgucgauuucgaaguuaaagccuuugccaccgacuccacggaugccgaggaagacaagaucccuaagaaaagcucugugagacuucugauccggaaggugcagcacgcuccccucgagaugggcccucagccccgcgccgaggcggccuggcaauucuuuauguccgacaaaccgcugcaucuugcugucagccugaauaaggaaauuuacuuccacggggagccuauccccgugaccguuacagugaccaacaauacagagaaaaccgucaagaaaauuaaggccuuuguggaacagguugcuaacgugguccucuacucuuccgauuauuacgugaagccugucgccauggaggaagcgcaggagaaagugccucccaauagcacgcugacaaagacccugacacuccugccccuucuggccaacaauagagaacggcgcggaaucgcucucgacggcaaaauuaagcaugaggauaccaaccuggccuccucuaccaucauuaaagaagggaucgacagaacaguucuuggaauccuggugagcuaucagauuaaggucaagcucacgguguccggcuuccugggggagcugaccagcucugagguugcuacagaagugccguuucggcucaugcacccccaaccugaggaucccgccaaagaauccuaccaggacgccaaucuggucuucgaggaguucgcucgccacaaccuuaaggaugcgggagaagccgaggaaggcaaaagagacaagaaugauguggacgaguga

SEQ ID NO: 75201 - RNA, 3684 nt, Artificial Sequence
  derived and/or modified sequence opt5 from SALL1__Homo_sapiens__NP_001121364
augaacgacaccgugaauaagacagaucaggucgacugcagcgaucuguccgagcacaacggccucgacagagaagagucuauggaaguugaggcccccguggcuaauaaaagcggguccggaacgucuagcggcucccauucuagcaccgccccuuccuccucuuccuccucuuccucuagcuccgggggaggcgggagcuccucuacaggaaccagcgcgaucacaaccucccugccgcaacuuggcgaucugacaacccucggcaacuucagcgugauuaauucuaacgucaucauugaaaaucugcaguccacgaagguggcuguugcccaguuuagccaggaggcccggugugggggagcuucuggcgggaaacuugccgugcccgcucugauggagcaacuccuggcccugcagcagcagcaaauccaccagcuccagcugauugaacagauccgccaucaaauccuucugcucgcgagccagaacgccgaccugccuaccuccucuagccccucccagggaacacuuagaaccagcgcuaauccucugucuacacucuccagccaccugucucaacagcuggccgcugccgcgggccucgcccagucccuggcuagccaguccgccucuauuagcggggucaagcaacuucccccuauccagcugccgcaguccucuagcggaaacaccauuauccccuccaauagcgggucuuccccuaacaugaauauucucgcugccgccgugacgacacccagcucugagaaaguugcuuccagcgcgggcgccucucaugugagcaacccugcugucuccucuagcuccagccccgccuucgccaucuccucucugcuuagcccggcuuccaauccucugcucccccagcaagccucugcgaacagcguguuuccuagcccccugcccaacauuggcaccacagcugaagaucucaauucucucagcgcccuggcccagcagcggaaguccaagccuccgaacgugaccgcuuucgaggccaaaagcaccucugacgaggccuuuuucaagcacaaaugccgcuuuugugcuaaggucuucggauccgauagcgcgcuucagauccaccugagaucucauacaggcgaacggcccuuuaaaugcaauaucugugggaaccgcuucuccacgaagggaaaucucaagguucacuuucaaagacauaaagagaaguacccucacauucagaugaaccccuauccugugcccgaacaccuggacaauaucccgaccagcacaggcauuccuuacgggaugucuauucccccugagaaacccgugaccuccuggcuugauacaaagccuguccugcccacccucacgacaagcgugggacugccgcugccucccacccuccccucccugaucccuuucaucaaaaccgaggaaccggcccccaucccuauuagccauucugcuacaagcccucccggcuccguuaagucugacagcggcgggcccgaguccgccacccggaaccuuggaggccugccugaagaggcugaagggucuacacugcccccgagcggaggcaaauccgaggaaucugggauggugacgaauagcgucccuaccgccuccagcucugugcuguccagccccgcggccgauugcggcccugcuggaucugccacaaccuuuacaaacccccugcuuccgcucauguccgagcaguucaaggcuaaguucccuuuuggcgggcugcuggacagcgcccaggccuccgagaccucuaaacuccaacagcugguugaaaauaucgacaagaaagcuacggaucccaacgaguguauuaucugccaccgcgugcuuagcugucaguccgcgcugaagaugcauuauagaacccacacaggagaacggccuuucaaaugcaagauuuguggccgcgccuuuaccacaaaggggaaucucaaaacccauuacagcguccacagagcuaugccuccccugcgggugcaacacucuugccccaucugccagaagaaauucacgaacgccgucgugcugcagcagcauauccgcaugcacaugggaggccaaauuccgaauacacccguuccugacuccuauagcgagucuauggaaagcgauaccggguccuuugacgagaagaacuucgaugaccuugauaacuuuucugacgagaauauggaagauugucccgagggcagcaucccugacacacccaaauccgccgaugcuucucaggacagccucuccagcucuccucugccgcuggaaauguccagcauugccgcgcucgagaaccagaugaagaugaucaaugcuggacuggccgagcagcuucaagccucccugaagucuguggaaaacggcagcauugagggggacguccucaccaaugauuccucuagcgugggaggcgacauggaaucccagagcgcugggucucccgccaucuccgagagcaccucuuccaugcaggcgcugagcccuucuaacagcacacaggaguuccauaaaucccccucuauugaagagaagccucaaagagcuguucccagcgaauuugccaauggacuguccccgacgccugugaacggcggggcccuugaucucaccagcucccacgcugagaaaaucaucaaggaagacucucugggcauucuguuccccuuucgggauagaggaaaauucaagaauacagccugcgacaucuguggcaagaccuuugcuugccagagcgcccucgauauucacuaccgcucccauacaaaagagcggcccuucaucuguaccgucugcaacagaggguucucuacgaagggaaaucugaaacagcacaugcuuacacaucaaaugcgcgaccugccuagccagcucuuugaacccuccucuaaccugggcccuaaucagaacagcgcggugauuccggccaauucccugagcucucuuaucaagaccgaggugaacggguucguucacgucagcccccaggauagcaaagacaccccuacaucucaugugcccuccggaccucucucuagcuccgcuaccagccccgugcugcugccggcccucccucggagaacacccaagcaacacuauuguaacacgugcggcaaaaccuuuuccagcucuagcgcucugcagauccacgagcgcacacauaccggggaaaagccuuucgccuguacaauuugcggccgggccuuuaccacgaagggaaaucuuaaaguccacaugggcacccauauguggaacuccacacccgcuagacgcgggcggagacugucuguggauggaccuaugaccuuccucggcgggaaucccguuaaguuuccggagauguuccagaaagaccuggcggcccgcagcggauccggcgauccuucuagcuuuuggaaccaguacgcugccgcccuguccaauggccuugcuaugaaggccaacgaaaucucugugauucaaaaugggggaaucccucccauucccggcagccugggguccggaaacagcucuccggucuccggccucacagggaaucuggagcggcuccagaacagcgaacccaaugcgccucuggcuggacuugagaaaauggccucuuccgagaacggcaccaauuucagauuuacacgguucguggaagacagcaaggagaucguuaccuccuga

SEQ ID NO: 75202 - RNA, 3024 nt, Artificial Sequence
  derived and/or modified sequence opt5 from SALL2__Homo_sapiens__NP_005398
augagcagacggaagcagcgcaaaccccaacagcugaucuccgacugcgagggcccuucugccagcgaaaacggggaugcuuccgaggaagaccacccccaggugugugccaagugcugugcgcaguucaccgauccgacagaguuucucgcucaucaaaaugccugcucuacggacccucccgucaugguuauuaucggaggccaggaaaacccuaauaacagcuccgccucuagcgagcccagaccugaggggcacaauaacccccaggugauggauaccgaacauuccaauccgccugacagcggaucuuccgugcccacagauccuaccuggggccccgagcggcgcggggaagagagcucuggacacuuccuggucgcugccacaggcaccgcugccggcgggggaggcgggcuuauucuggcguccccgaaacucggagccacaccucugcccccugagagcacccccgcucccccuccgcccccucccccucccccgccucccggcguggggucuggacaucuuaacaucccucugauucucgaagaacugagaguucugcagcaacggcagauccaccagaugcagaugacggaacaaaucugucgccaggugcuccugcuuggcucccugggccagaccgucggggcccccgcuagcccuuccgagcuccccggaacaggcaccgccucuagcacaaagccgcugcuuccucuguuuucccccauuaaacccgugcaaaccagcaagacgcucgcgucuuccagcucuagcuccucuagcuccagcggggccgaaacaccuaagcaggcuuucuuucaccuguaccauccgcugggaucucagcaccccuucuccgccggcgggguuggaagaagccauaaaccuacccccgcuccuucucccgcccucccuggcuccacagaccagcugaucgccagcccccaccuugcuuuuccguccaccaccggccugcucgcggcccaaugccugggggcugcccggggacuugaggccacagcuucuccuggccugcucaagcccaaaaaugggagcggagagcuguccuauggcgaagugauggggccucuggagaagcccggcggacgccacaaauguagauucugcgccaaggucuuuggcucugauagcgcgcuccagauucaucugcggucccacacgggggaacgcccguacaaguguaacgugugcggaaauagauucaccacacggggcaaccuuaaagugcauuuucaccgccauagagagaaguauccucacguccagaugaauccccacccuguucccgaacaucuggacuacgugaucaccagcucugggcuccccuauggaauguccgugccuccggagaaagcugaggaagaggccgccacacccggcgggggcgucgaacggaagccucugguggcuagcaccacggcccuuucugcuacagagucccugacccuccugagcaccucugccggaacagcgaccgcccccggccugccugcuuucaacaaauuuguucucaugaaggccguggaacccaaaaauaaggcugaugagaacacaccuccggggagcgagggauccgccauuagcggcgucgcggaaucuuccacggccaccagaaugcagcugagcaaacuugugacaucccugcccucuugggcucuccugaccaaccacuucaagagcacaggguccuucccuuuucccuacguucuggagccucuuggagccucucccagcgaaaccuccaagcuccaacagcugguggagaaaaucgaccgccagggcgcugucgccgugacgucugccgcuagcggggcgccgaccacauccgccccugcucccuccucuuccgccagcucuggccccaaucagugugucauuugccugcgggugcucuccugcccuagagcccugcgccuucauuauggacaacacggcggggagcggcccuucaaguguaaaguuugcggcagagcuuuuagcacccgcggaaaccugcgggcccacuucguggggcauaaggcgucuccugcugccagagcccagaauagcuguccgaucugccagaagaaauuuacaaacgcugucacccuccagcaacacgugcgcaugcaucugggaggccagauccccaaugggggcacggcccugccugaaggaggcggggcggcucaggagaacggaagcgaacaauccacaguuagcggcgcccggucuuucccccagcagcagagccaacagccuucccccgaggaggagcuuucugaggaagaggaagaggaagaugaggaggaagaggaagacgugaccgacgaggauagccucgccgggagaggauccgaaucuggcggcgagaaggcuauuagcguccgcggggacuccgaggaagccucuggagcugaggaagaggugggcacaguggccgcggccgcuaccgccgggaaagagauggauagcaaugaaaagaccacacagcaguccagccugccgccucccccucccccugacucucuggaucaaccccagccgauggagcagggauccagcggcguucucgggggaaaagaagagggcggcaagccugaacggucuuccagccccgcuuccgcccugacgcccgagggggaggccaccucugucacacuuguggaggaacugagccuccaggaagcuaugagaaaggagccuggagaauccagcucucggaaagcgugugaggugugcggccaagccuuuccgucccaggcugcccuggaggaacaccagaagacccaucccaaagaggggccucuguucacaugugucuuuugccgccaaggauuccuugaaagagccacccucaagaaacacaugcugcuggcucaccaucaggugcagcccuuugccccucacggcccccagaacaucgcggcucucagccugguuccuggguguucuccgagcauuacguccacaggacuuucucccuucccucggaaggacgaucccaccaucccuuga

SEQ ID NO: 75203 - RNA, 3903 nt, Artificial Sequence
  derived and/or modified sequence opt5 from SALL3__Homo_sapiens__NP_741996
augagcagacggaagcaggccaaaccccaacaccugaaguccgacgaggaacuccugccuccggauggcgcucccgagcaugccgcgccuggggaaggagcugaggacgccgauucuggccccgaaagccgcuccgggggagaggagaccucugugugcgaaaaauguugcgccgaguucuuuaagugggcugacuuccuugaacaccagagaagcuguacaaaacugccucccguccucaucguucaugaggaugccccugcuccgcccccugaggacuuucccgaaccuucccccgccucuagcccguccgagcgggcggaaagcgaggccgcugaagaggccggcgcugagggggccgaaggagaggcgcgcccuguggaaaaggaggccgaacccauggaugcugagccugccggcgacacgagagcuccccggcccccuccggccgcccccgcuccucccaccccugcguacggcgcccccucuacaaacgugacccuggaggcccuucuguccacaaaggucgccguggcccaguucagccagggggcucgcgccgcgggaggcucuggggcuggaggcgggguugccgccgcugccgugccgcucauucuggaacaacugauggcucuccagcagcagcaaauccaccagcugcagcuuauugagcagaucagaucccaagucgcccugaugcagcggccucccccucgccccagccucucuccugcggccgcucccuccgccccgggaccugcucccagccagcugcccggccuugccgcgcugccucucuccgccggcgcuccggccgcugccauugccgggucuggacccgcugcgccugccgcuuuugaaggcgcccaaccccugagcagaccugaguccggggccagcacccccggaggcccugcugaacccucugccccggcggcuccuuccgccgcccccgcuccugccgcgcccgcuccggccccugcuccccagagcgcugccucuagccagccucaguccgcuucuacaccucccgcccuggcgcccgggagccuccugggagccgcuccgggccuucccuccccucugcucccccaaaccagcgccucuggcgugaucuucccuaauccccugguuuccaucgcugccacggccaacgcucuugauccucugagcgcgcucaugaaacaucggaaggggaaaccgcccaaugugucugucuuugagccuaaggccuccgcugaggaccccuucuuuaaacacaagugccgcuucugugccaagguguuuggaagcgauuccgcccugcagauucaccugagaucucauaccggcgaacggccuuucaaaugcaacaucugugggaaucgcuuuagcacaaagggaaaccucaaagugcacuuccagagacauaaggagaaauauccccacauucagaugaauccguacccuguccccgaauaucuggacaacguuccuaccugcuccggcauccccuacgggaugucucuucccccugagaagccggugacaaccuggcuggauagcaaacccgugcucccuacgguccccacauccgugggccugcaacuuccucccaccguuccgggagcucacggcuaugccgacagcccuucugcgacacccgcuucccggagcccucagagacccucuccugccuccagcgagugugccucucugagccccgggcucaaucauguggaauccggagucagcgcuaccgccgagucuccgcagucccugcugggcgggccuccccucaccaaggcggaacccgugagccugccuugcacaaacgcucgcgccggagacgccccgguuggcgcucaggccuccgcugcccccacgucuguggauggggcgccuaccagccuuggcucccccggacugccugccgucucugagcaauucaaggcucaguuucccuucggcgggcuccuggacagcaugcagacauccgaaaccucuaaacugcagcaacuuguggagaauauugauaagaaaaugacagacccuaaccagugugucaucugccaccgggugcucagcugccaguccgcccugaagaugcauuacagaacccacacgggagagcgcccguuuaaauguaagauuugcggccgggcuuucacaaccaaggggaaucugaaaacccauuuuggaguucacagagccaagcccccucuccgcgugcaacacagcugucccaucugccagaaaaaguucacaaacgccgucgugcugcagcagcauauccggaugcacaugggcgggcaaauuccuaauacaccccuuccggaaggcuuucaggaugcuauggacucugagcuggcguaugaugacaaaaacgccgaaacccucuccagcuacgaugacgauauggacgagaacucuauggaagacgaugcugagcugaaggacgccgccacggauccugcuaagccccugcuuuccuacgccggaagcugucccccuucucccccuuccguuaucagcuccauugcggcucucgagaaucagaugaaaaugaucgacagcgugaugucuugccagcaacugaccggccucaagagcgucgaaaacggguccggagagucugauagacugagcaaugacuccucuagcgccgugggcgaucuggaaucccgcucugccgggagcccggcucuuuccgagagcagcuccagccaggcccugucucccgcgccuuccaacggagaaucuuuccgguccaaaucucccggccucggggccccugaggagccccaggaaauuccgcugaagacagagagaccugacagccccgcugccgcuccuggcuccggaggcgcccccgggcgcgcuggaaucaaagaagaggccccuuuuagccugcuuuuccucucucgggagagaggcaagugucccuccaccgugugcgggguuuguggaaagccguuugcgugcaaaagcgcccuggaaauccauuaucggucucacacaaaggagcgcccuuucgucugugcucugugcagacggggcugcagcaccaugggcaaucucaaacagcaucugcuuacgcacagacugaaggaacuccccucccaacuguuugaucccaacuucgcccuggggccuucucagagcaccccgucccuuauuucuagcgcugcccccacaaugaucaaaauggaggugaauggacacggcaaggccauggcucucggggaaggaccuccccugccugcgggcgugcagguccccgccgggccucaaaccgugaugggacccggccuggcuccgaugcucgccccucccccucgccggacacccaaacagcauaacugucaguccugcggcaagaccuucagcucugccuccgcucugcagauucacgagagaacgcauacaggggagaagccguuuggauguaccaucugcggccgcgccuucacaaccaaagggaaucuuaagguucacaugggaacccacauguggaacaaugcgccugccagacggggccgcagacugagcguggaaaaccccauggcucuccuugggggagacgcccugaaauuuuccgagauguuccaaaaggaucuggcugcccgggcgaugaaugucgaccccucuuuuuggaaccaguacgccgcugccauuacaaauggccuggcuaugaaaaacaacgaaaucagcgugauccagaauggcgggauuccucagcuccccguuucccugggaggcucugcccucccuccgcuggggagcauggcuuccggaauggauaaggcccgcacgggcagcucucccccuaucgugucccuugacaaggcgagcucugagaccgccgcuuccagacccuucacacgguuuauugaagacaacaaagagaucgggauuaauuga

SEQ ID NO: 75204 - RNA, 3162 nt, Artificial Sequence
  derived and/or modified sequence opt5 from SALL4__Homo_sapiens__NP_065169
augagcagacggaagcaggccaaaccccaacacaucaacuccgaggaagaccagggcgagcagcagccucaacagcagaccccggaguucgcugaugccgcgcccgcugccccugccgcuggggagcugggagcccccgugaaucauccuggcaacgacgaagucgcuucugaggaugaggccacaguuaagcgccucagacgggaagagacgcacgugugcgaaaaauguugcgcggaguuuuucagcauuuccgaguuucuggaacauaagaaaaauuguaccaagaaucccccugugcuuaucaugaacgacucugaggggccgguccccagcgaagauuucuccggagccgugcugucucaccagccuacaagccccggcuccaaggacugccaucgcgagaacgggggaagcucugaagauaugaaagagaagccugacgcugaguccguuguguaccucaaaaccgaaacagcccugcccccgaccccucaagauauuagcuaucuugcuaagggcaaagucgccaauacaaacgugacccugcaggcgcucagaggcacgaagguugccgugaaucagcggucugcugacgcccugcccgcuccuguccccggggccaacuccauccccugggugcuggagcagauucucugucugcaacagcagcaacuucagcagauccagcugaccgaacaaauccgcauucaggugaauaugugggccagccacgcucuccacucuuccggagcgggcgccgauacacugaagacccuugggagccauaugucccagcaggucucugcugccguugcccugcucagccaaaaagcuggaucccagggccugagccuggacgcccucaagcaggcgaaacugccucacgcuaacaucccgucugccacauccagccuuucucccgggcuggccccuuuuacccucaagcccgauggaacgagagugcugccuaaugugaugagccggcuucccuccgcucugcucccgcaggccccuggcucuguccuguuccaaagccccuuuuccacaguggcucuggacaccagcaaaaagggcaaagggaagccucccaacauuucugccguugacgugaagccuaaagaugaggcggcccucuacaagcauaaaugcaaguauuguuccaaagucuucggaacagacagcucucugcagauccaccuucgcucccacaccggcgaaagacccuuugugugcagcguuugugggcaucgguucaccacaaagggaaaucugaaggugcacuuucaucgccacccgcaggucaaagcuaacccucagcuuuucgccgaguuucaagauaagguggcugccggcaacgggauucccuacgcgcuguccguccccgacccuaucgaugagccgucucuuagccuggacuccaaacccgugcucguuacgaccucugugggacugccucagaaucugagcuccggcacaaaccccaaggaucucaccggcgggagccugccuggagaccuucagcccggcccuucucccgaauccgaagggggaccgacacugccuggcgucgggcccaauuauaacagcccuagagccggcggauuccaaggcucugggacccccgaaccgggauccgagacgcucaaacugcagcagcugguggaaaauauugauaaggcuacaaccgacccuaacgagugccuuaucugucaucggguucucagcugccagucuagccugaagaugcacuaccgcacccacacaggcgagagacccuuccaaugcaaaaucugugggcgggccuuuuccaccaagggaaaucugaaaacacaucucggcgugcacagaacgaacaccagcauuaagacacagcauucuugcccuaucugucagaaaaaguucaccaaugcugucaugcugcagcaacacauucgcaugcacaugggcgggcagauccccaacacaccccuuccugaaaauccgugcgauuuuaccggauccgagcccaugacggugggcgaaaacgggagcaccggagccauuugucaugacgacgugaucgaguccaucgauguugaggaagucucuagccaggaggccccuuccucuagcuccaaggugcccacaccucugcccucuauucacagcgcuuccccuacccucggcuucgcgaugauggccagccuggacgcuccggggaaagugggacccgccccuuuuaaucugcagcggcaaggcucuagagaaaacggguccgucgagagcgauggccuuacaaaugacucuuccagccucaugggagaucaggaauaucagucucgcucccccgacauccuggagaccacgagcuuccaagcccuguccccugcuaacagccaggccgagucuauuaagagcaaaucccccgaugcgggcucuaaggcugaaagcuccgagaacucucggacagaaauggaggggagaagcucccucccgucuaccuuuauccgcgccccucccacauacgugaaaguugaagugcccggaaccuucgucggcccuagcacccugucccccgggaugacaccucuucuggccgcucagccgcggagacaggccaagcaacauggaugcacgcgcuguggcaaaaauuuuagcucugcguccgcucuccagauucacgagcggacccauacaggggagaagcccuucgugugcaacaucuguggcagagccuuuaccacaaagggaaaucugaaaguucacuacaugacccacggcgccaacaauaacagcgcucgccgggggagaaagcuggccaucgaaaauacgauggcucuccucggaacagacggcaaacgggugucugagauuuucccuaaggaaauccuggcccccuccgucaacguggauccuguuguguggaaucaguauaccagcaugcugaacgggggacucgcggucaaaaccaaugagauuuccgugauccagucuggcggcgugcccacacugccggucagccuuggggccaccuccguugugaacaaugcuacagugagcaagauggacggaucucaauccggcauuagcgccgaugucgaaaagccuucugcuacggacggggugcccaaacaucaguuuccucacuuccuggaggagaacaagaucgccguuagcuga

SEQ ID NO: 75205 - RNA, 1338 nt, Artificial Sequence
  derived and/or modified sequence opt5 from SAMD14__Homo_sapiens__NP_777580
auggccagcuccaagcugagagagcccguggacgaagucuucgaucucgaccuggcuguuccugagaccgcccggcuugauucuagccugcacaaagcgcgcgcucagcuccuggccaagggcagacggcaucgcccguccagaucucggcuucgcgacagcgccuccucugcugaagauggggagggaagcgacggccccgggggaaaagugacagauggcugcggguccccucugcacagacuccggagcccccugcauucuggaccuggcucccccgccggcgggagcuuuugucuggacccuccgggacuccgcagaucucuggaugaagacgagcccccucccuccccucuuacgcgguaccgcccccugcacaacgcugccagccaugagggccucgcggccgcuucuugcuccccgccuagaagcgcccccuccucugauagcuccccuagcuucgugcggcgccaccccagagcugaaccccacucugaggacgauucccgggacgccagcccuccggaacccgcgucuccuaccaucgggcuggacaagaaaacaagacgcaaguuucuugaucugggagucacccuccggagagccagcacaggcaagucccgcaaagagaaggggucuaaucggcugagcaugggauccagagagagcguggaaggcucuggccgcuccgggggaagccccuuccugccuuuuucuugguucaccgacuccggcaaagggagcgcuuccucuggaagcacaaccucccccacguguucuccgaagcaugagggcuuuagcccuaaaaaguccgccagccaagcucagcuccuggcccacgcccaggaagcucuuucuaacuccuggugccugguucaggauuucgggagcacccaaauuggaauggagucuacacucuccgacgauagcacacccccuucuagcucccccaagaucccuagcggccccuggcaggaagcgaaauguucuuauccguaccauacccugucccagagcuccgacgaguuucuugaugagccucugccucccgugcaccacuggaccucucagcaagucggccaguggcuccagagccugaaucuggaacaguaugccgcugaguucgccgcccggcaaguggacgggccccagcuccugcagcuugauggauccaagcugaaaucucucggccugagcaacucccaugacagagcucuuguuaagcgcaaacugaaggaaauggccgcggcugccgagaaagaacggaaggcccaagagaaggcugccagacagcgcgagaaacuccggagacgggaacaggaggcuaagaaaucuuga

SEQ ID NO: 75206 - RNA, 1617 nt, Artificial Sequence
  derived and/or modified sequence opt5 from SAMD1__Homo_sapiens__NP_612361
auggccgggcccccugcucugccgcccccugagaccgccgcggcugccacaacggccgcugccgcuagcuccucugccgcgagcccccacuaccaggaauggauccucgacaccauugauucccugagaucucggaaggcccgcccugaccuugagagaaucugccggauggugcgcagacggcauggccccgaaccugagcgcacaagagcugaacuggagaaacucauucaacagcgggccguccugcgcguuagcuauaagggauccaucucuuacagaaacgcugcccgggugcagccgccccgcagaggcgcgaccccucccgccccuccccgggcuccgcgcggggccccugcugccgccgcugcggccgcucccccucccacacccgccccuccgcccccucccgccccuguggcugccgcggcucccgccagagccccgcgggcugccgcugccgcggccaccgcuccucccagcccuggacccgcccagccuggccccagagcucaacgcgccgcgccgcuugccgcuccuccucccgcccccgcugccccgcccgccgucgcuccucccgcggggccucggagagcucccccucccgccguggccgcccgcgagccgccucugcccccucccccgcagccucccgcuccuccccagcagcaacagcccccuccgccccagccucagcccccucccgaaggaggcgccguucgggcgggcggggcugccagaccugugucccuccgcgaggucgugcgguaucugggaggcagcgggggagccggcgggagacugacacgcggacggguucaaggccuccuggaagaggaggcugccgcgagaggccgccuugaacggaccagacugggggcucucgcccugccgcggggagaucgccccggcagagccccucccgcugccucugcucggccuuccagaagcaaacgcgggggagaggaacgggugcuugagaaggaagaggaggaagacgaugacgaggaugaagacgaggaagaugacgucucugagggcuccgaggugcccgaaagcgauagaccggccggggcgcagcaccaucagcugaauggagagcgcggcccucaaucugccaaagaaagagugaaggaguggacgcccugcggcccccaccaggggcaggacgaaggacggggcccugcucccggguccggaacccgccaggucuucagcauggccgcuaugaacaaggagggcgggacagccuccguugccaccggcccugauucuccgagccccgugccucugcccccuggaaaacccgcucucccgggcgcggacgggacaccuuuuggaugucccccuggcagaaaggagaaacccuccgacccuguggaauggaccgucauggaugugguugaguacuucacggaagccggguuucccgagcaagcuacagccuuccaggagcaggaaauugacggaaagagccugcuccugaugcagcggaccgaugugcuuacaggccugucuauccgccucgggccggcccugaaaaucuaugagcaucacauuaagguccuucaacagggccacuuugaagacgaugacccugauggauuccugggcuga

SEQ ID NO: 75207 - RNA, 1893 nt, Artificial Sequence
  derived and/or modified sequence opt5 from SAMD4A__Homo_sapiens__NP_001155048
augauguucagagaccaggugggcguccuggccgggugguuuaagggauggaacgagugcgaacaaaccguugcucuccugagccuucugaaacgggugucccagacacaggcccgcuuccuccagcugugucuugagcacucucuggcggauugcgcugaacuccaugugcuggagagagaagccaauagccccggcaucauuaaccaauggcagcaggaguccaaggacaaagucaucucucugcuccugacgcaccuuccucugcucaagccggggaaucuggaugccaaaguggaguacaugaaacuucugcccaagauucucgcucauagcaucgaacacaaccagcauauugaggaaucccggcaacugcugucuuaugcccucauccacccugcuaccagccuggaggaccgcuccgcccuugcgauguggcugaaucaccucgaggauagaacaagcaccucuuuuggaggccagaaccgggggcgcuccgacagcguugauuacggacagacacauuauuaccaccagagacaaaauucugacgauaaacugaacggcuggcaaaauucccgggacagcggcaucuguauuaacgccucuaauuggcaggauaaguccauggggugcgaaaacggacaugugccccuuuauagcuccucuagcgucccuaccacaaucaauaccauuggcacguccaccagcacaaacgugcccgcuuggcugaaaucucuccgccugcacaaguacgccgcucuguucucccagaugaccuaugaggaaaugauggcccucacagagugucagcuggaagcgcagaauguuaccaaaggggccagacacaagaucgugauuagcauccagaaacuuaaggagcggcaaaaccugcucaagucucuggagcgcgacauuaucgaaggaggcagccuuagaaucccucugcaggagcuccaucagaugauucugacgccgaucaaggcuuacuccucucccagcacaaccccugaagcccggcgcagagagccccaggcuccucggcaacccucccugauggggccggaaagccagucuccugauugcaaggacggagccgccgcuacaggcgcgaccgccacccccuccgcuggcgccagcgggggacuccagccucaccagcugucuuccugugacggcgagcuugccgucgcuccccugcccgagggggaucucccuggacaauuuacaagagugaugggcaaagugugcacgcagcugcuggucagccgcccggacgaagagaacauuuccucuuaccuucagcucaucgauaagugucugauucaugaagccuucaccgagacacagaaaaagcggcugcucagcuggaagcaacagguucagaaacuguuuagauccuucccccgcaagacccuucuggacaucucuggguaucggcaacagagaaaucgcggauuuggccagagcaacucccucccuacagcgggcagcgucgggggaggcauggggcggagaaauccccgccaguaccaaaucccuucucggaacgugcccuccgcuagacugggacugcuuggcaccagcggguucgugucuuccaaucagcgcaacacgacagccaccccgaccauuaugaaacagggccggcagaaucucugguuugccaacccuggaggcagcaauucuaugcccagcagaacacacuccagcgugcaacggacccgcucucugccuguucauacaagcccccagaacaugcugauguuccagcagccugaauuucaacuccccgugacggagccggauaucaauaacagacuggagucccuuugccuguccaugaccgaacacgcucucggggacggagucgaucggacaucuaccauuuga

SEQ ID NO: 75208 - RNA, 522 nt, Artificial Sequence
  derived and/or modified sequence opt5 from SAMD5__Homo_sapiens__NP_001025231
augugcaccaacaucguguacgaguggcugaaggcccuccagcugccccaauaugcugagagcuucgucgacaauggcuacgaugaccuugaaguuuguaaacagauuggggauccugaccuggaugccaucggagugcucgcgccggcucacagacggcgcauucuggaagccgugagacggcuucgcgagcaggacgccaacgcugccggccuguauuuuacacucgaaccccagccugcucccccugggcccccugccgaugcggucccgacgggaagacggggcgagcccugcgggggaccugcccaaggcacccgcggcgacuccagagggcauacaaccgcuccccggucucgcgagcuggugagcuacccuaagcugaaacucaagaucaugauuagagauaaacugguucgggacggaauccaccuuuccaagcccccguauucucgcaaggugccuauggccggcauccuggaauaccucaugaauuggcccaaaagcucccagucuagauga

SEQ ID NO: 75209 - RNA, 4770 nt, Artificial Sequence
  derived and/or modified sequence opt5 from SAMD9__Homo_sapiens__NP_060124
auggccaagcagcugaaccuccccgagaauaccgacgauuggacaaaagaagacgugaaccaauggcuggagagccacaagaucgaucagaaacauagagaaauucuuacggagcaggacgucaauggcgcuguucugaaguggcucaaaaaggaacaccugguggauauggggaucacccauggaccugccauucagaucgaggagcuuuucaaggaacugcggaaaacagcgauugaggacuccauccaaaccucuaagaugggcaaaccgagcaagaacgcucccaaagaucagacagugucccagaaggaacgcagagagaccucuaagcagaaacaaaaggggaaagagaauccugacauggccaaccccagcgccauguccacaaccgcuaagggaucuaaaagccucaaggucgaacugaucgaggauaaaauugacuacacgaaggaacggcagccuuccaucgaucugaccugcgugagcuaucccuuugacgaguucucuaauccuuaccgcuauaagcucgauuuuucccugcagccggaaacaggccccgggaaccuuauugacccuauccacgaguucaaagccuuuaccaauacagcuaccgccacggaggaagacguuaagaugaaauucagcaacgagguguuuagauucgcgucugccuguaugaacucccggacaaauggaaccauucauuuuggcgucaaggauaaaccccacggcaagaucguggggauuaagguuacaaaugacaccaaagaagcucugaucaaccacuucaaucucaugaucaacaaguacuuugaggaucaucaggugcaacaggccaaaaagugcauucgcgaaccuagauucgucgaggugcugcuucccaacagcacccugucugaccgguuugugaucgaggucgauauuaucccgcaguucuccgaaugucaauaugacuacuuccagauuaaaaugcagaauuauaacaauaagaucugggagcagagcaagaaauuuucccucuucguucgcgauggaacaucuagcaaggacaucacgaaaaacaagguggauuuuagagcuuucaaagccgacuuuaagacccuggcggaaucccggaaggccgcugaggaaaaauuccgcgccaagacaaauaaaaaggagagagagggcccuaaacuggugaagcuccugaccgggaaccaagaucuucuggacaauagcuacuacgaacaguauauucucgucacaaacaaaugccaccccgaccagaccaagcaucuggauuuucuuaaggagaucaaaugguucgcugugcuggaauuugacccugagucuaauauuaacggaguugugaaggccuacaaagagucccgggucgccaaucuccacuuccccagcguguauguugaacagaagacgacacccaacgagaccaucucuacccugaaucuguaccaccaaccuagcuggaucuuuuguaacggccgccucgaucuggacuccgaaaaauauaagccguucgaucccucuagcuggcagagagagcgggcuuccgacgugagaaaacuuauuagcuuucugacacaugaagauaucaugccucgcgggaaauuccucgucguguuccugcuucugucuuccgucgacgauccccgggacccucucauugagaccuuuugcgcguucuaccaggaucugaagggaauggagaauauccuguguauuugcgugcacccccauaucuuucagggcuggaaagaccuccuggaagccagacuuauuaagcaccaagaugagaucagcucucaguguauuuccgcucugagccucgaagagaucaacggcacaauccugaaacugaaguccguuacgcagucuagcaagcgccuucucccguccauugggcugucuaccgugcugcucaaaaaggaagaggacaucaugacagcccuggagauuaucugcgaaaacgagugugaaggaacccuucuggagaaagacaagaauaaauuccucgaauuuaaggccagcaaggaggaggauuucuaucggggcgggaaagucuccugguggaacuuuuacuucagcucugaauccuacagcucuccuuuugugaagagagacaaauaugagcgccuggaagcuaugauucagaauugcgccgauuccagcaagcccacaucuaccaaaaucauccaucuguaccaccacccuggaugcggcgggacgacccuugcgaugcauauucucugggagcugcggaagaaauucagaugugcuguucugaagaacaagacaguggacuuuagcgagaucggagaacaagucaccucccucauuacauauggcgccaugaaucgccaggaguacgugcccgugcugcuucugguugaugacuucgaggaacaggauaacgucuaucuccugcaauacagcauccagaccgccauugcuaaaaaguauauccgguacgaaaaaccucuggugaucauucuuaauugcaugagaucucagaaccccgagaaguccgcccgcaucccggacagcauugcugugauccagcaacucuccccuaaagagcagcgggccuuugaacugaagcugaaggagauuaaagaacagcacaagaauuucgaggauuucuacucuuuuaugaucaugaaaacgaacuucaauaaggaauauaucgagaacgucgugagaaauauucucaaaggccagaacaucuuuacaaaggaggcgaagcuguucagcuuucuugcccugcucaauuccuacguucccgacaccacaauuucucugagccaaugugaaaaauuccuggggaucggaaacaagaaggcuuuuuggggcaccgagaaguucgaagauaaaauggggaccuauuccacaauucuuaucaagacggaggugauugaaugcggaaacuacuguggcguccggaucauccauucucucauugccgaguuuagccuggaggaacugaagaaauccuaucaccucaauaagagccagaucaugcuggacaugcuuaccgagaaccuguucuuugauacagggaugggcaaaucuaaguuccuccaggacaugcacacccugcugcuuacacgccauagagacgaacacgagggagagaccggcaauugguucucccccuuuauugaagcucugcauaaagaugaggggaacgaagccguggaggcgguucuccuggaaagcauccaccgguucaauccuaacgccuuuauuugccaggcucucgccagacauuucuacaucaagaagaaagacuuuggaaaugcucugaacugggccaagcaagccaaaaucauugagccggauaauucuuauaucuccgacacgcuuggccagguguacaagagcaaaauucgcugguggaucgaggaaaacgggggaaauggcaacauuucugucgaugaccugaucgcucuccuggaucuggcggagcacgccuccagcgcuuucaaggaaucccagcaacagagcgaggaccgggaauacgaggugaaagagagacuuuaucccaagucuaagcgcagauacgauacauauaauaucgccggguaccagggcgaaauugagguuggacuguauaccauccagauucuccaacugauccccuuuuucgacaacaaaaaugaacucagcaagcgguacauggugaacuuugucuccggcucuagcgauauuccuggggacccuaacaaugaguauaaacuggcccuuaagaacuacauccccuaccugaccaaacucaaguucucccugaagaaaucuuuugacuucuuugaugaauauuucgugcugcuuaagccucgcaauaacauuaaacagaaugaggaggcuaagacaagacggaaaguggccggauacuucaagaaguaugucgacaucuuuugucugcucgaagagagccagaacaauaccggccugggguccaaauucucugaaccccuccagguugagcgcugcagacggaaccugguggcgcuuaaggcugauaaauuuagcggacugcuggaguaccucaucaagucccaagaagacgccauuagcacaaugaaauguaucgugaaugaguauacguuccugcuugaacagugcaccgucaagauucagucuaaggagaaacugaacuuuauccucgccaauauuauccuguccuguauccagccgacaagccgccucgugaagccuguugaaaaacugaaggaucaacuuagagaggugcugcagcccauuggccugaccuaccaguucucugagccuuauuuucucgcuucccugcuuuucuggcccgaaaaccagcaacuggaccagcacagcgagcagaugaaagaauacgcccaagcgcucaaaaauuccuuuaaggggcaguacaagcauaugcaccggacaaagcagccgaucgcuuauuucuuucugggcaaaggaaagcgccucgagagacugguccauaaaggcaagauugaucagugcuucaaaaagaccccugacaucaacucucuuuggcaaagcggggauguguggaaggaagagaaaguucaggagcugcugcuccggcugcagggcagagccgaaaauaacugccuuuacauugaguauggaaucaaugaaaagaucacgauucccaucaccccugccuuucuggggcagcuccgcuccggacggagcauugagaaagugucuuucuaccugggcuucuccaucgggggcccccucgcuuaugacauugaaaucgucuga

SEQ ID NO: 75210 - RNA, 4755 nt, Artificial Sequence
  derived and/or modified sequence opt5 from SAMD9L__Homo_sapiens__NP_001290426
augagcaaacaggugucccugcccgagaugaucaaagacuggaccaaggaacacgucaaaaaguggguuaacgaggaucucaaaauuaaugaacaauacggccagauccugcuuucugaggaagugacagggcuggugcuccaggagcugacggagaaggaccuugucgaaaugggacugccuuggggcccggcccuccugauuaagagaagcuauaacaaacucaauuccaagucucccgagagcgauaaccaugacccugggcagcucgauaauuccaaacccucuaagaccgaacaccaaaagaacccuaagcauacaaagaaagaggaggaaaauagcauguccagcaacaucgacuacgauccccgggagauucgcgacaucaagcaggaagagucuauccugaugaaagaaaaugugcuugaugagguugcuaacgccaagcacaaaaagaaaggaaagcugaagccugagcagcugaccugcaugccguaucccuucgaccaguuucaugauucccacagauacauugaacacuauacacugcaaccugagaccggcgcgcuuaaucugaucgaccccauucaugaguucaaagcucucacaaacaccgaaacggccaccgaaguggauaucaagaugaaauuuagcaaugaggucuuccgguuugccucugcuuguaugaacucccgcacaaaugggaccauucacuucggagugaaggacaaaccucauggcgagaucguuggcgugaagauuacaagcaaggccgcuuuuaucgaccacuucaacgucaugaucaaaaaguacuuugaagagucugaaauuaacgaggccaaaaagugcaucagagaaccccgguucguggaggugcugcugcagaauaacaccccguccgaucgcuuugucauugagguugacacgaucccuaaacacagcauuuguaaugauaaguauuucuacauccagaugcagaucugcaaggacaaaauuuggaagcaaaaccagaaucucucccuguuugugagagaaggggcgucuagccgggauauccuugccaacuccaaacagcgcgacguggauuucaaggcuuuccugcaaaaucucaaaagccuggucgccucuagaaaggaggcugaagaggaguacggaaugaaggccaugaaaaaggaauccgagggccuuaaacuggugaagcuccugauugggaaccgggacagccuggauaauucuuauuacgacugguauauccucguuacaaacaaaugucaucccaaucagauuaagcaccuggauuuucuuaaagaaaucaagugguucgcggugcuggaguuugacccugaaagcaugaucaacggagucgugaaggccuacaaagagucccgcguugcuaaucuccauuuccccaaccaguaugaggacaagaccacaaauaugugggaaaagauuucuacccugaaccuuuaccagcaacccagcuggaucuuuugcaacggcagauccgaucucaagagcgagaccuauaaaccucuggaaccgcaccuguggcagcgggagcgcgccucugaagugagaaagcugauucucuuccugacagacgagaauaucaugacgcgggggaaguuucuugucguguuccugcuccuguccagcgucgagucucccggagauccucugauugaaaccuuuugggcuuucuaccaggcccuuaaaggcauggagaacaugcucuguaucuccgugaauagccauauuuaccagagauggaaggaccugcugcaaacacgcaugaaaauggaagaugagcucaccaaccacuccaucucuacacugaauaucgaacuuguuaacagcaccauucugaagcucaaauccgugacgcggucuagcagacgcuuucugcccgcccggggcuccagcucugucauccuggagaagaagaaagaggacgugcuuacagcucucgaaauucugugcgagaaugaauguaccgagaccgauaucgagaaggacaaauccaaguuccuggaauuuaaaaagagcaaggaggaacacuucuauagagggggaaaaguuucuugguggaacuucuacuuuuccagcgagaauuauucuagcgauuucgugaagcgcgacuccuacgaaaaacucaaggaucugauucauugcugggcggagagcccuaaacccaucuuugccaagaucauuaaccuuuaucaccauccgggcugugggggaacaacccuggcuaugcacguccucugggaccugaaaaagaauuuccggugcgccgugcugaagaacaaaacaacggauuuugccgagaucgcugaacaggugauuaaucuuguuaccuacagagccaagucucaccaggacuauaucccuguccuccugcugguggacgauuucgaggaacaggagaacguguacuuucuccaaaaugcgauucauuccguccuggcugaaaaagaccuucgcuacgagaagacacuggugaucauccucaacugcaugcggagcagaaaccccgaugaguccgccaaacuggccgacucuauugcucugaauuaucagcuuagcuccaaggaacagcgcgccuucggcgcuaagcucaaagagaucgaaaagcagcacaaaaacugugagaauuuuuacucuuucaugauuaugaaaagcaacuuugaugaaaccuauaucgagaauguugugcggaacauucugaaagggcaagacgucgauuccaaggaggcccagcugaucucuuuccucgcgcugcuuagcuccuacgugacagacagcaccaucucuguuucccagugcgaaauuuuucugggaaucauuuauacgagcaccccuugggagcccgaaucucucgaggauaagaugggcacauacuccacccugcugaucaaaacagagguggccgaauauggcagauacaccgggguccggauuauccauccucuuauugcucuguacugucucaaggagcuggaacgcagcuaucaccucgacaaaugccaaaucgcccugaauauccuugaggaaaaccuguucuacgauucuggaauuggcagagacaaguuccagcaugaugugcagacgcuccugcugacacggcagagaaaaguuuauggggacgagaccgacacacuuuuuagcccccugauggaggcucuccaaaauaaggauaucgaaaaggugcugagcgccggaucccgccgguucccgcagaacgcguuuauuugucaggcccucgcuagacacuucuacaucaaagagaaggacuuuaauaccgcccuggauugggcucgccaggccaaaaugaaggccccuaaaaacagcuauauuucugacacccuuggccaagucuacaagagcgaaaucaagugguggcuggaugggaauaaaaacugcagauccaucacagugaaugaccucacgcaucugcuggaggcugcggaaaaggccucucgggcuuucaaagagagccagcgccagaccgauuccaagaacuaugagacagaaaacuggucuccccagaaaagccaaagacgguacgacauguacaauaccgccuguuuucuuggcgagauugaagugggacuguauacaauccagauucuccagcugacccccuucuuucacaaggagaacgaacucuccaaaaagcacaugguccaauuccugucuggcaaguggacgaucccuccggauccccgcaaugagugcuaccuugcccugagcaaauuuacaucccaucugaagaaccuccagagcgaccugaaaagauguuucgauuucuuuauugacuauaugguucuucugaagaugcgguacacccagaaagagaucgcugaaaucaugcucucuaagaaggugucccgcugcuucagaaaauauaccgagcuguuuugucaccucgacccuugccugcuucagagcaaggaaucucaacugcugcaggaggagaauugccggaaaaagcucgaagcccugcgcgcggauagauucgcugggcuucuggaguaccucaaccccaauuauaaagacgccacaaccauggaauccauugugaacgaguacgccuuucugcuccagcagaauagcaagaagccuaugacaaacgaaaaacaaaauuccauccuggcuaacauuauccuuucuugucugaagcccaauagcaaacugauucagccucucacgacccugaagaaacagcuucgggagguccugcaguucgugggacucucccaucaauaccccggcccguauuuucuggccugccuccuguucuggccugagaaccaggaacuugaucaggacagcaagcugaucgagaaguacguuucuucccugaauagauccuuucgcgggcaguauaaacggauguguagaucuaagcaagcgagcacacucuucuaccugggaaaacgcaagggccuuaacuccauugugcacaaagcuaagaucgaacaguauuuugauaaagcccagaauaccaacucucuguggcacagcggggacgucuggaagaagaacgaggugaaagaucuccugcggagacugacaggccaagccgaaggaaagcucaucuccguugaguacggcaccgaggagaaaauuaagauccccgugauuucugucuauagcgggccucuucgcuccggacggaauaucgaaagagugagcuucuaccugggcuuuucuauugaagggccccuggcuuacgacaucgagguuaucuga

SEQ ID NO: 75211 - RNA, 1881 nt, Artificial Sequence
  derived and/or modified sequence opt5 from SAMHD1__Homo_sapiens__NP_056289
augcagagagccgacagcgagcaacccuccaagcggccucgcugcgaugacucuccgagaacccccagcaacacaccuuccgccgaagccgauuggucucccggccuggagcuccacccugacuacaaaacgugggggcccgaacagguguguagcuuccugcggcgcggaggcuuugaggaaccuguccuucugaagaauaucagagagaacgagauuaccggggcgcuccugccgugccuugaugaaucccgguucgagaaucugggaguuucuagccucggcgaacgcaaaaagcugcuguccuauauccagagacucgugcagauucauguggacacaaugaaagucaucaacgaucccauucacgggcauaucgagcugcacccucuucuggugcggaucauugacacaccccaauuucagcgccucagauacaucaagcagcugggaggcggcuauuacguuuucccuggggcuagccauaaucgguuugagcacucucuuggagugggcuaucuggccgggugucucguccacgcccugggagaaaagcagcccgagcugcaaauuuccgaacgcgaugugcucugcguucagaucgcuggccugugucaugaccuugggcacggaccguucagccauauguuugauggcagauucauuccucuggcccggcccgaggugaaauggacccacgaacagggcucugucaugauguuugagcaccucaucaacuccaaugggauuaagccugugauggagcaguacggacugauccccgaagaggacaucugcuucauuaaagaacaaaucgugggcccccuugagagcccugucgaagauucucuguggccguauaaggggcgccccgagaacaaauccuuucucuacgagauuguuagcaauaagagaaacggaaucgacguggacaagugggauuacuucgcucgggacugucaucaccugggcauucagaauaacuuugauuauaaaagauucaucaaguucgcccgcgugugcgaagucgacaaugagcugcggaucugugcgagagauaaagaaguggggaaccucuacgacauguuucauacccgcaauucccugcaccggagagccuaucagcauaagguuggaaacauuaucgauacaaugauuaccgacgcuuuccuuaaagccgaugacuacaucgagauuacgggcgcuggcgggaagaaauaucgcaucucuaccgccaucgaugacauggaagcguacacaaagcugaccgacaacauuuuucucgagauccuguauagcacagauccuaaacuuaaggacgcccgggagauucugaagcaaaucgaauacagaaaucucuucaaauacgugggagagacccagcccacgggccagauuaagaucaaacgcgaagauuaugagucccugccuaaggaggucgcuagcgccaagcccaaagugcugcucgacguuaagcugaaagcugaagauuuuauuguggacgucaucaacauggauuacgggaugcaggagaagaauccgaucgaccacgugucuuucuauugcaaaacagccccuaaccgggccauuagaaucaccaagaaucaagucucccagcuucugcccgaaaaguuugcugagcagcucauucgcguguacuguaaaaagguugaucggaaaagccuguaugcggccagacaguacuucgugcaauggugcgcugaccggaacuuuacaaagccucaggauggagacgucaucgcuccccugauuaccccucagaaaaaggaauggaaugauucuaccagcgugcagaaccccacacgccuuagagaggccuccaagucucggguucaacucuucaaagacgacccgauguga

SEQ ID NO: 75212 - RNA, 1410 nt, Artificial Sequence
  derived and/or modified sequence opt5 from SAMM50__Homo_sapiens__NP_056195
augggcaccgugcacgccagaagccuggagccccucccuuccucugggccggacuucggaggccugggggaagaggcugaauuugucgagguugaacccgaggccaagcaggagauccuugaaaacaaagauguggugguccagcaugugcacuucgacggacugggccggacaaaggaugacauuaucauuugcgagaucggggauguuuuuaaagcgaagaaucucauugaagugaugcgcaaaagccaugaggcuagagagaagcugcuucggcugggaaucuuccgccaggucgacgugcucaucgauacgugucagggcgacgaugcccugccuaacggccuggacguuaccuuugaagugacagagcucagacggcugaccggguccuacaauacaauggucggaaacaaugaaggcucuauggugcuugggcugaagcuccccaaccugcuuggacgcgccgagaaagugaccuuccaguuuagcuauggcacaaaggaaaccuccuacgggcugucuuucuuuaaaccuagacccggaaauuucgagcggaacuuuagcgucaaucucuauaagguuacgggccaauucccuugguccagccugcgcgagaccgauagaggcaugucugcugaauacuccuuuccgauuuggaaaacaagccacaccgugaagugggaggggguguggcgggaacugggaugccucucucgcacagccuccuucgcugucagaaaggagagcggccauucucugaaauccagccuuucccacgccauggugaucgacucucggaacagcuccauucugccccgcagaggggcgcuccugaagguuaaucaggaacuugccggauauaccggcggggaugugagcuucaucaaagaggacuuugagcugcagcucaacaagcagcugauuuucgacucugucuuuuccgcuagcuucuggggaggcaugcuggugccuaucggcgauaaacccucuagcauugccgaccgguuuuaccucgggggaccuacguccaucagaggcuucucuaugcacagcaucgggccccaauccgaaggagauuaucugggcggggaggcuuacugggccggcggacuucaucuguacacaccgcucccuuuucgccccggccaagggggauucggcgaacuguuucggacccacuucuuucuuaaugcggggaaccuguguaaucucaacuauggagagggcccuaaggcccauauuagaaaacuggcugaaugcauccgcuggagcuacggggccggcauuguucugcggcucggaaacaucgcuagacuggagcuuaauuauugugugcccaugggcguccagacaggggaccgcauuugcgauggagugcaguucggcgccgggauccgguuucuguga

SEQ ID NO: 75213 - RNA, 1326 nt, Artificial Sequence
  derived and/or modified sequence opt5 from SAMSN1__Homo_sapiens__NP_001243299
auggagaucagacuggacacccucagcgccucccugggccggucuagcacacuuaacaauugcaaccuggaagauaagcucgcuugguacgagggggaagccuauauguggcaccauuggaaacccuucccugagaauccgcuguggacgugucuugacuuucagauugcgcaagugggacccugggaucacugcuccucuuguauccgccauaccagacucaagagcuccugcucugacauggaucugcugcacagcuggcgguccagcucuuucggcaacuuugaccgcuucagaaauaacucccugagcaaaccugaugacucuacagaagcucaugagggggaucccaccaauggauccggcgagcagagcaagacaucuaacaaugggggaggccucggcaaaaagaugcgggccauuuccuggaccaugaagaaaaaggucgggaaaaaguacaucaaagcccugagcgaagagaaggacgaagaggauggagagaacgcucacccuuaucgcaauuccgaccccguuauuggcacacacaccgaaaaggugucucuuaaagccagcgauuccauggacagccuguacucugggcaguccagcucuagcggaaucacguccuguucugacggcaccagcaacagagauuccuuucggcucgacgaugacgggccuuauagcggaccguucugcggccgcgcuagagugcauacagauuuuacccccucuccuuacgacacagauucccugaagaucaaaaagggcgacauuaucgauauuaucuguaaaacccccauggggauguggacgggaaugcuuaauaacaaggucggcaauuucaaauuuauuuauguggacguuaucagcgaggaagaggccgcgccuaagaagauuaaagccaaccggcgcucuaacuccaagaaaagcaagacacugcaggaguuccucgaaagaauccaucugcaagaguacaccuccacacugcuccugaauggguacgaaacccuugaggaucugaaagacaucaaggaaucucaccucauugagcugaacaucgaaaaucccgacgaucggcgcagacuucugagcgcugccgagaacuuucucgaggaagagauuauccaggaacaggagaaugaaccggagccucugucccugucuagcgacauuucccucaacaagagccagcuggaugacugcccccgggauucuggauguuauaucuccagcggcaauucugacaacgggaaagaggaucuugaauccgagaaucugagcgacauggugcacaagaucauuaucaccgaaccuucugauuga

SEQ ID NO: 75214 - RNA, 879 nt, Artificial Sequence
  derived and/or modified sequence opt5 from SAP30BP__Homo_sapiens__NP_001288768
auggccggcaagaaaaacgugcugagcucccucgcugucuacgccgaggacucugaacccgagagcgauggggaagcgggaaucgaggcuguuggcuccgccgccgaagagaaagggggacuggugucugacgcuuauggcgaggaugacuucagcagacuugggggagaugaagacggcuacgaggaagaggaggaugaaaauucccggcagucugacaacaccgaggccgaaaagcgcgauccucaagagcugguggcuagcuuuuccgaaagaguccggaauaugagcccggacgagauuaagauucccccugagcccccuggccgcugcucuaaccaccuccaggauaaaauccagaagcuguaugaaagaaagaucaaagaggggauggacaugaauuacauuauccagcggaagaaagaguuccgcaaccccuccaucuaugaaaaacuuauucaauuuugugccaucgaugaacugggaacaaauuacccuaaggacauguucgacccgcauggcuggagcgaggauucuuauuacgaggcgcucgccaaggcucagaagauugaaauggacaaacuggagaaggccaaaaaggaaagaacgaaaaucgaguuugugaccgggacaaagaaaggaaccacaaccaacgcuacauccaccacgaccacaaccgccagcacagcgguugccgaugcucagaagcggaagucuaaaugggacuccgccauucccgugaccacgaucgcucagccuacaauucugaccacaaccgccacccuccccgccgucgugacaguuacgaccagcgcuuccggcucuaagacaaccgugaucagcgcggucgggacaaucgugaaaaaggccaaacaauga

SEQ ID NO: 75215 - RNA, 429 nt, Artificial Sequence
  derived and/or modified sequence opt5 from SAP30L__Homo_sapiens__NP_001124534
augaacggcuucagcaccgaggaagacuccagagaggggcccccugccgcuccggccgcggcugcccccggauacggccagucuugcugucugaucgaagauggggagcggugcgugcgcccugccggaaaugcuagcuuuuccaagagaguccaaaaaucuauuagccagaagaaacucaagcuggacaucgauaaauccguugaccuuuuccagcuccaggugaacacacugcggcgcuauaagagacacuacaagcugcaaacgcggcccggcuuuaauaaagcccagcuugcugaaaccgugucucgccauuucagaaacauuccugucaaugagaaggagacacuggccuauuuuaucuacauggugaaaagcaacaagucccggcucgaucagaaaagcgaagggggaaagcagcuggaguga

SEQ ID NO: 75216 - RNA, 537 nt, Artificial Sequence
  derived and/or modified sequence opt5 from SAPCD1__Homo_sapiens__NP_001034740
augggcagccagggguccggaggcgugccccugguccaagccccuuacaccguucuccugcuuccgcuggggacaucuagacaggaccccggagcucagagcuucuuucucuggcugcggcgcaugcaggcccuugagagagaacaagaugcgcuguggcagggccucgagcugcugcagcacgggcaggcuugguucgaagaccaucuccgggaggcccaacgccagcagcugcaccuuggagcccugggcgaaaacuuucucacggaucugcauuccgagccuggcagacccccucuugcucagauccaaaaggugaauauuugccugcagaaccucauccacgagaaauucucucccagcccucugaauaaggccuccucuuguaccacacaggacagcaaagaacggcgcagagagcaaaaccuguggcagcagcaggaacucucccggcaacagaagggggugacccagccgaaagaggagauggcucagcgcggaugcacaaagggccccagagggccuacccgggucuga

SEQ ID NO: 75217 - RNA, 1185 nt, Artificial Sequence
  derived and/or modified sequence opt5 from SAPCD2__Homo_sapiens__NP_848543
auggccggcgcugccauggcggagagagggcgggugcccccuccggcucccgccccuagcaccgaaggacugccccgcgccuuccuccagucccugagaacacuuuuugacauccuggaugaccggcgcagaggcugcguccaccuccgggagauugaaucucgcuggcaagggacggaugcuagagagcugccucggggaguucuugaaggccugcgccagguggcccccgcuagcggguaccucaccuucgagagauuuguggccggacugcggacaucccugcucucugcggacggcggcccucgcgauccgaccagagcccccgcucggccuggggaccagcccccucccccgccucagcgccuggucuucgcccccgcugaugagccuagaacagugcuugaacggaagccccugccccucggaguuagagccccucuggcgggcccgagcgccgcugcccgcucccccgagcaacuuugugcuccugccgaagccgcucccugcccugcggagcccgagcggucucagagcgccgcucuggaaccguccagcucugccgacgccggggcuguggccuguagagcgcucgaggcugauuccggagacgcccgccgggccccuagagcucgcggcgaacggagacgccauaccaucgccagcggggucgauugcggacugcugaaacagaugaaggagcucgaacaggagaaagaggugcugcuucaaggccuggaaaugauggcucggggcagagacugguaucagcagcagcuccaacgcguucaggagcggcagagacggcuggggcaaucucgcgccuccgcggauuuuggagccgcuggcagccccagaccucuugggcggcugcuccccaaggugcaggaagucgccagaugucugggagagcugcucgcugccgcgugcgccucucgcgcucugccucccuccagcuccggcccgccuugucccgcccuuacaucuaccagcccucccguguggcagcagcaaacgauucugaugcucaaagaacagaaccggcugcuuacccaggaggugacagagaaguccgaaagaaucacccagcuggagcaagaaaagagcgcucucauuaaacagcuguucgaggcccgcgcccugucucagcaggacgggggaccgcucgacuccacauuuaucuga

SEQ ID NO: 75218 - RNA, 597 nt, Artificial Sequence
  derived and/or modified sequence opt5 from SAR1A__Homo_sapiens__NP_001136120
augagcuucaucuuugaguggauuuacaacggcuucuccucugugcugcaguuucucgggcuguauaagaaaagcggaaaacuugucuuccugggccucgacaaugccgggaagaccacacugcuucacaugcugaaggaugacagacucggacaacauguucccacgcugcacccuaccuccgaggaacugacaaucgcuggcaugaccuuuacaaccuucgaucucgggggacaugaacaggcccggcgcguguggaaaaacuaccugccggcgauuaauggcaucguguuucuugucgacugcgcugaucacucuagacugguggagagcaagguugaacucaacgcccugaugacagacgagaccauuuccaaugugcccauccuuauccugggcaacaagauugaucggacggacgccaucucugaggaaaaacuccgcgagauuuucgggcuguauggacagaccacaggcaaggggaaugucacccugaaagaacucaacgcuagaccuauggagguguuuauguguagcguucugaagcggcagggauacggcgagggguuccgcuggcuuucccaauauaucgauuga

SEQ ID NO: 75219 - RNA, 597 nt, Artificial Sequence
  derived and/or modified sequence opt5 from SAR1B__Homo_sapiens__NP_001028675
augagcuucaucuuugacuggauuuacuccggcuucucuagcgugcugcaguuucucgggcuguauaagaaaaccggaaaacuugucuuccugggccucgauaacgccgggaagacaacgcugcuucacaugcugaaggacgauagacucggacaacauguucccacccugcacccuacauccgaggaacugaccaucgcuggcaugacauuuaccacauucgaccucgggggacaugugcaggcccggcgcguguggaaaaauuaccugccggcgauuaacggcaucgucuuucuuguggauugcgcugaccacgagagacugcucgaaucuaaggaggaacuggauagccuuaugaccgacgagacgauugccaauguucccauccugauccucggcaacaagauugaucggccugaggccaucuccgaggaacgccugagagaaauguucgggcuguauggacagaccacaggcaaagggucuauuagccucaaggagcugaaugcucggccccuugagguguuuauguguuccguccugaaacgccagggauacggcgaaggguucagauggauggcccaauauaucgacuga

SEQ ID NO: 75220 - RNA, 2757 nt, Artificial Sequence
  derived and/or modified sequence opt5 from SARDH__Homo_sapiens__NP_001128179
auggccagccuguccagagcucuccggguggccgcggcucacccccgccagucuccuaccagaggcauggggccgugcaaccugagcuccgccgccggacccacagcugagaagucugucccuuaccaacggacgcuuaaagaaggccaggggaccagcguuguggcccagggacccucccgcccucugcccucuacagcuaauguggucgugaucggcgggggaagccucggcugucagacccuguaucaucuugccaagcugggcauguccggggcgguucuccuggagagagaacggcugacaagcggaaccacauggcacaccgccggccuccuguggcaacuucgcccuucugacguggaggucgaacugcucgcucauacgagacgggugguuucccgcgagcuggaggaagagaccgggcuucacacaggauggauucagaacggcgggcuguucaucgccagcaauagacagcggcucgaugaauacaaacgccugaugucucugggaaaggcuuauggcguggagucccauguccucagcccggccgagaccaaaacacuguacccccuuaugaacguggacgaucuguauggcacccucuacgugccucacgacgggacgauggaucccgcgggaacaugcaccacacuggccagagcugccucugcucggggcgcccaggucauugaaaauuguccuguuaccgggauccgcguguggaccgacgauuuuggagugagacgggucgccggcguggagacacaacacggguccauucagacgcccugcguugugaacugugcuggagucugggcgagcgccgugggcagaauggcuggcguuaaggugccgcuugucgccaugcaucacgccuauguggucaccgaacgcaucgaggggauccagaauaugccuaacgugcgggaccaugaugcuuccguuuaccugagacuccagggagacgcccugucugugggcggguacgaagcgaaucccauuuucugggaggaggucagcgauaaguuugcuuucggacuguuugaccucgauugggaaguguucacacaacacaucgagggcgccauuaaccgcguuccugugcuggagaaaaccgggaucaaguccacagucugcggccccgagagcuuuacccccgaccacaaaccucuuaugggagaagccccggagcugcggggcuucuuucucggguguggauucaauucugcuggcaugaugcuugggggaggcugcgggcaggagcuggcccauuggauuauccacggcagacccgaaaaggacaugcauggauaugauauucgccgguuucaccauucccugacggaccacccuagauggauccgcgagcggagccacgaaucuuacgcuaaaaacuauagcgugguguucccccaugaugagccucucgccggcagaaauaugcgccgggacccccugcacgaagaacugcucgggcagggauguguuuuucaagagagacauggcugggaacggccggggugguuccacccucgcggacccgcgccuguccuggaguacgauuauuacggcgccuauggguccagagcucacgaagacuacgccuaccggagacuucuggcugaugaguauacauucgccuuucccccucaucacgacaccaucaagaaggagugccucgcgugucgcggcgccgcugccguguucgauaugucuuacuuuggaaaauucuaucuggugggccuggacgcucggaaggccgccgauuggcuuuuuagcgcugacgucuccagacccccggggagcaccguguacacaugcaugcucaaccaucgcggaggcaccgaaucugaccugacaguuuccagacuggcgccuagccaccaggccucuccccucgcucccgccuucgagggggauggauauuaccuggccaugggcggggcuguggcccagcauaauuggucccacauuacgaccguccuucaggaccaaaagagccagugccagcugaucgauuccucugaagaccucggcaugauuagcauccagggaccugcgucccgggcuauucugcaagaggugcuggaugccgaccuuucuaacgaagccuuuccguucagcacacacaagcuccugcgcgcugccggccaucugguuagagcgaugcggcucuccuuugugggggagcugggaugggagcuucacauccccaaagcuagcugugucccuguguaucgcgccguuauggccgcuggcgccaagcaugggcugaucaacgcuggauacagagccauugauucucucuccaucgaaaaaggcuaccggcacuggcaugcggaccugcgccccgaugacagcccucuggaggccggccuugcuuuuaccugcaagcucaagucucccgugccuuuccuggggagagaagcccuggagcagcagcgggcugccggacuccgcagacggcuggucuguuucacaauggaagauaaagugcccauguuuggccuugaggccauuuggagaaauggacagguggucgggcacguucgccgggcugacuucggcuucgcgaucgauaagaccauugccuauggguacauccacgacccguccggaggcccugugagccuggacuuugugaaaucuggcgauuaugcucucgagagaaugggggucacguacggagcccaagcccaucugaaaagccccuucgacccuaacaauaaacgcgugaagggcaucuauuga

SEQ ID NO: 75221 - RNA, 2175 nt, Artificial Sequence
  derived and/or modified sequence opt5 from SARM1__Homo_sapiens__NP_055892
auggugcugacccuccugcuuagcgccuacaagcugugcagauucuuugcuauguccggcccccggccuggggccgagcgccucgcggucccgggacccgacggcgggggaggcacagggccuuggugggcugccggaggcagaggcccccgggaaguuucuccuggggccggaacggaggugcaggaugcucuggaacgcgcccuucccgagcugcaacaggcucucagcgcccugaaacaggcgggcggggccagagcugugggagccggccuggcugaagucuuccagcucguggaggaggccuggcugcuuccugcgguugggcgggaaguggcccaaggacugugugacgcuauccgccucgauggcggccuggaccuucugcucagacugcugcaggccccggagcucgaaacccggguccaggcugcccgccugcuugagcagauucugguggccgagaacagagaucggguugcucgcaucgggcucggagugauucugaaucuugcgaaggaaagagagcccgucgaacuggcccgguccguggcuggcauccucgagcacauguuuaaacauucugaagagacaugccaacgccugguggccgccgggggacuggacgcuguccucuauugguguagacggaccgauccugcccugcuuagacacugcgcgcuggcucucggcaacugugcccugcaugggggacaggccguucagcgccggaugguggagaagagagcugccgaauggcuuuucccccuggcuuuuagcaaagaggacgaacuccugcgccugcacgccugccucgcgguggccguccuggcuacaaauaaggagguggaacgggagguugagagauccggcacccuugcccugguggaaccucucgucgcuucucuggaucccggccgcuucgcccggugucugguggacgcgagcgauacaucccaggggagaggaccggacgaucuucaacgccucguuccucugcuggacagcaaccggcucgaggcccagugcauuggcgcuuuuuaccugugugccgaagcugccaucaagucucuucaggggaaaaccaagguguucuccgacaucggagccauucaaagccugaaaagacucgucucuuauuccacgaauggcaccaagagcgcucuggcgaaacgcgcccugcggcuucucggggaggaagugcccagaccuauccugcccucuguccccuccuggaaggaggcugaggugcagacauggcugcagcagauuggcuuuagcaaguacugcgaauccuuccgggagcaacagguugauggagaccuccugcuucgccugaccgaagaggagcuccagacagaucugggcaugaaaucugggaucaccagaaagcgguuuuucagagaacugacggagcuuaaaacauuugccaacuauagcaccugugaccgcuccaaucucgccgauuggcugggaagccuggacccucgguucagacaguacacauauggccucgugucuugcgggcuggaucgcucccuucugcauagagucagcgaacaacagcuccuggaggacugcggcauucaccugggagugcaccgggcucgcauccuuaccgccgcgagagaaaugcuccauucuccgcugcccuguaccgggggcaagccuagcggagauacacccgacguuuucauuuccuaccggcgcaacucuggcagccagcuggcuucccuccugaaagugcaccuucagcugcauggguuuagcgucuucaucgauguggagaagcucgaggccggaaaauuugaagacaagcugauccaaucugugaugggcgccagaaauuucguucugguccuuuccccuggggcucuggacaagugcaugcaggaucacgacuguaaagauugggugcacaaggagauugugacggcccucagcugcggcaaaaacaucguccccauuaucgacggauuugaauggccggagccucaggugcugcccgaagauaugcaggcgguucucaccuucaaugggauuaaguggucucaugaguaccaagaggcuacaaucgagaaaaucauucgguuucugcagggccgcuccagcagagacuccucugccggaagcgauaccucccuugaaggcgccgcuccuauggggcccacauga

SEQ ID NO: 75222 - RNA, 633 nt, Artificial Sequence
  derived and/or modified sequence opt5 from SARNP__Homo_sapiens__NP_149073
auggccaccgagacaguggaacugcacaagcucaaacuggcugagcuuaagcaggaaugccuggccagaggccucgagacgaaagggaucaagcaagaccugauucaucggcuucaggcguaccuggaggaacacgcugaggaagaggccaacgaagaggauguccucggagacgagaccgaagaggaagagacaaaacccaucgaacugccuguuaaggaggaggaaccgcccgagaagaccguggauguggccgcugaaaagaaggucgugaaaauuacaagcgagaucccucagaccgaacgcaugcagaagagagccgagcgguucaauguucccgugucccuggagucuaaaaaggcugcccgcgcggccagauuuggcauuagcuccgucccuacaaaggggcucucuagcgacaacaaacccauggugaaucuggauaaacuuaaagaacgggcucaacgcuucggacugaacguuuccucuaucagcagaaaguccgaggacgaugaaaaacucaagaaacggaaggagcgcuuuggcaucgugaccagcucugccgggacgggaaccacagaagacaccgaggcuaagaaaagaaagcgggccgagcgcuucggcauugcguga

SEQ ID NO: 75223 - RNA, 1563 nt, Artificial Sequence
  derived and/or modified sequence opt5 from SARS2__Homo_sapiens__NP_001139373
auggccgcuagcauggccagacggcuguggccccuccugacccgcagaggcuuccggccucgcgggggaugcaucuccaacgacucuccgagacggagcuuuacaacggagaagcgcaauagaaaccuucuguacgaauaugcgcgggagggcuacuccgcucucccccagcuggauauugaacgcuucugugccugcccugaggaagccgcucacgcccuugagcugagaaaaggggagcuccggucugcugaccugcccgccaucauuagcaccuggcaagaacugcgccagcuccaggagcagaucagaucccuggaagaggagaaggcggccgugacagaagcuguccgggcccuucuggcuaaucaagauucuggagagguucaacaggugcgccucgacccuggcgccgggagcauuuuuggacccaccuuccugccuuuuccgggccagcuuucccugcucguggaagcgcagcuggaggaacaguucuaucugcaggcccucaaacugcccaaccagacacauccugauguccccgugggcgacgagagccaagcuagaguucuucacauggugggggauaagccugucuuuucuuuccagccccggggacaucuggagaucggcgaaaaacucgacaucauuagacagaagcgccugucccacgugagcgggcaucggucuuacuaucuuagaggagccggcgcucugcuccaacacgggcugguuaauuuuaccuucaacaagcugcuccgccggggauuuacaccgaugaccgugccugaucugcuuagaggcgccgucuucgagggcugugggaugacgcccaaugccaacccuucccagaucuacaauauugaccccgcucgcuuuaaagaucugaaccucgcgggaaccgccgaagugggccuggcuggguauuucauggaccacacaguggccuuccgggaucuucccgucagaaugguuugcagcucuaccuguuaccgcgccgagacaaauaccggacaggaaccucggggccuguacagagugcaucacuuuacgaagguggagauguucggggucacaggaccgggccucgagcaguccagccaacugcuggaagaguuucucucccugcagauggaaauccuuaccgagcugggccuccauuuccgcgugcuggacaugcccacacaggaacuggggcuuccugcuuaucggaaauuugacauugaggccuggaugcccggaagaggccgguucggggagguuaccucugcgagcaacugcaccgauuuucagucccgcagacuccacaucauguuccaaacagaagcuggagagcugcaguuugcccacacggugaaugccaccgcuugugccgucccucggcugcucauugcucugcuugaaagcaaccagcagaaggacggcucugugcugguucccccggcccuccaauccuaccuggggacagauagaaucaccgcgccuacacaugugccccugcaguauaucggcccuaaucagccccgcaaaccuggacuucccggccagccggccgucagcuga

SEQ ID NO: 75224 - RNA, 2403 nt, Artificial Sequence
  derived and/or modified sequence opt5 from SART1__Homo_sapiens__NP_005137
augggcagcuccaagaaacacagaggggagaaggaagccgcuggaaccacagccgcggcuggcaccgggggagccacggagcagcccccucggcaucgcgaacacaaaaagcauaaacacagaucuggcgggagcggaggcuccggcggggagcggcgcaagagaucucgggaacgcggaggcgagagagggagcggacggcgcggcgccgaggcugaagccagauccucuacacaugggcgggagcgcagccaagcugaaccguccgagagacgggugaagcgcgagaaaagagacgauggauacgaagccgcggccagcucuaagaccuccagcggcgacgcuucuucccugagcaucgaggaaacaaacaaacuccgggccaagcugggccuuaaaccccuggaggucaaugcuauuaagaaggaagccgggaccaaagaggagccuguuacagcggaugugaucaaccccauggcccucagacagcgcgaagaacugcgggaaaaacuugcugccgcuaaagagaagagacugcucaaucagaaacugggaaagauuaaaacccugggcgaagacgauccuuggcucgacgauacggccgccuggaucgagcgcucucggcagcugcaaaaggagaaggaccuugcugaaaagagagcgaagcugcucgaggaaauggaucaggaguucgggguguccacccuggucgaagaggaguuuggacagcgccggcaggaccuuuauagcgccagagaucugcaaggccucacaguggaacacgcuauugacuccuuccgcgagggggaaaccaugauccugacacugaaagauaagggaguucuccaggaggaggaagacgugcuggucaacgugaaucuuguugacaaagagcgggccgaaaagaacguggagcugagaaagaaaaagcccgauuaccucccuuaugccgaagacgagucugucgaugaccuggcucagcagaaaccgcgcagcauccuuuccaaguacgaugaggaacuggagggcgaacggccccacagcuuuagacucgagcaaggcgggaccgccgacggacugcgggaacgcgagcuggaggaaauuagagcgaaacuccggcugcaggcucagucucuuuccacggugggcccuagacuggccagcgaguaucucacacccgaagagauggugaccuucaagaagacaaaacgccgggucaagaaaaucagaaagaaagaaaaggagguuguggugcgcgccgaugaccugcuuccucugggggaucaaacccaggacggagauuuuggcucuagacuccgggggcgcggcagacggcgcgucagcgagguggaagaggaaaaggagcccguuccgcagccucugcccuccgacgacaccagaguggagaauauggauauuucugacgaagaggaaggaggcgcuccuccucccgggagcccccagguccuggaggaagaugaggccgagcucgaacugcaaaaacagcuugagaagggacggcgccugagacagcuccagcaacugcagcagcugcgggacuccggcgaaaaagugguugagaucgugaagaaacuugaaagccgccagagagggugggaggaggaugaagacccggagcggaagggagcuauugucuucaacgccacaucugaauuuugcagaacgcucggcgagauccccaccuacgggcuggcgggcaaucgcgaggagcaagaggaacugauggauuucgagcgggacgaagagagauccgccaacggaggcagcgagucugauggggaagagaauauuggaugguccacagugaaccucgacgaagagaaacagcagcaggauuuuagcgcuuccucuaccacaauccuggacgaggaaccuaucgucaaucgcggccuugccgcugcccugcuccugugucaaaacaaggggcugcuugagaccacggugcagaagguugcgcgggugaaagcccccaauaagagccucccuuccgcugucuauugcauugaagauaaaauggccaucgacgacaaguacucuagacgcgaggaauaccggggauucacacaggauuuuaaagagaaggacggcuauaagcccgaugugaaaauugaauacguugacgagaccgggagaaagcugaccccgaaagaggcuuuccgccaacugagccaucgguuucacggcaagggauccggcaaaaugaagacagaaagacggaugaagaaacucgaugaggaagcccugcuuaagaaaaugucuagcuccgacaccccucuggggacaguggcccuccugcaggagaagcagaaagcucagaagacgcccuauaucguccugagcggaucuggcaaguccaugaacgcgaacaccauuacaaaauga

SEQ ID NO: 75225 - RNA, 2892 nt, Artificial Sequence
  derived and/or modified sequence opt5 from SART3__Homo_sapiens__NP_055521
auggccaccgcugccgagacaagcgcguccgaacccgaggcugaaucuaaggccggcccuaaagccgacggggaggaagaugaggugaaggcugccagaacgcggcgcaaaguccugagcagagcuguugccgcggccaccuacaagacaaugggaccggcuugggaccagcaagaggaaggcguguccgagucugauggggacgaauaugccauggcuagcuccgccgagucuagccccggagaguacgaaugggaguaugaugaagaggaagagaaaaaccagcucgagaucgaacggcuggaggaacagcuuuccauuaauguguacgacuauaacugccacgucgaucugauccgccuccugagacuugagggcgaacugaccaaggugcggauggcgcgccagaagaugagcgagauuuucccucucacagaggaacuguggcuggaguggcuccaugacgaaaucucuauggcccaagaugggcuggacagagagcacguuuacgaucuuuuugaaaaagcugugaaggacuauauuugucccaauaucuggcuggaguacggacaguacuccgucggcggcaucgggcagaaaggaggccucgagaaggugcggagcguuuucgaacgcgcccugucuuccguggggcuucauaugaccaaaggacuggcucucugggaggccuauagagaauuugagagcgccauugucgaggcugcgcggcuggaaaaggugcacucucuguuccgcagacagcucgccaucccucuguacgauauggaggcuacauuugccgaauaugaggaaugguccgaggaccccauuccugagagcgugauccaaaacuacaauaaggcccuucagcagcuggaaaaauauaagccguacgaggaagcucuccugcaggccgaggcgccccggcuugcugaauaucaagccuacauugacuucgagaugaaaaucggcgauccugcccgcauucagcugaucuuugagagagcucucgucgaaaacugccugguucccgaccuguggauccgguacucccaguaucucgauagacaacugaaggugaaagaccuugugcugucuguccauaaucgcgccauucggaacuguccuuggaccguggcucucuggagcagauaccugcuugccauggagcgccacgggguugaucaccaggugaucuccgucacguucgaaaaggcgcugaaugccggauuuauucaggcuaccgacuauguggagaucuggcaggccuaccucgauuaucugcggagacgcguugacuucaaacaagauagcucuaaggaacuggaggagcuccgggcugccuuuacaagagcgcuggaauaccuuaagcaggagguggaagaacgcuucaacgaguccggcgaccccagcugcgucauuaugcagaauugggcccggaucgaagcuagacuguguaacaauaugcagaaagcccgcgagcucugggauucuaucaugacccggggcaacgcuaaguaugccaauauguggcuggaauacuacaaccuggagagagcccauggggacacacaacacugccggaaagcccuucaucgcgcggugcaguguaccagcgacuauccggaacacgucugcgaggugcuccugacgauggagagaacagaaggaucccuggaggauugggacauugccguucagaagaccgaaacacggcucgcuagagugaacgagcagcgcaugaaagccgccgaaaaggaggcugcccugguccaacaggaggaagagaaggcggaacagcggaaaagagcucgcgccgagaagaaagcccuuaagaaaaagaagaaaaucagaggcccugaaaagcgcggggcugaugaggacgaugagaaagaauggggagacgaugaggaggagcagcccucuaagcggagacggguggagaauagcauuccugccgcgggcgaaacccaaaacguugagguggcugccgggcccgccggaaaaugugcugccgucgacguggaacccccuuccaagcagaaggagaaagcugccagccugaagcgcgauaugccgaaagugcuccacgacucuuccaaggauagcaucaccguuuuugucucuaaucugcccuacuccaugcaggaaccugacacaaaacugagaccccuuuucgaggcgugcggcgagguggugcaaauucggccuaucuucagcaaccgcggcgauuuuagaggguauuguuacgucgaguucaaggaagaaaaauccgcccuccaggcucuggagauggaccggaagucuguggaaggacgccccauguuuguuagcccgugcguggacaaguccaaaaauccugauuucaaggucuuuagauauucuacgagccuggagaaacauaaacucuucaucuccggccugcccuuuagcugcaccaaggaggaacuugaggaaauuuguaaggcccacgggacagugaaggaccugcggcucguuaccaacagagcuggaaaaccuaagggccuggccuacguggaguaugaaaaugagucucaggccucccaggcugucaugaaaauggaugggaugacaaucaaggagaacauuaucaaaguggcgauuagcaaucccccucaacgcaagguucccgaaaagccggagacccggaaagccccuggcggacccaugcugcuuccccagacguacggcgcuagagggaagggacgcacacagcucucucugcugccucgggcccuccagagaccguccgccgcugcuccccaagcggaaaacggcccugcugccgcccccgcuguggccgcgccugcugccaccgaggcccccaaaaugagcaaugcugacuucgccaagcuguuucuucgcaaauga

SEQ ID NO: 75226 - RNA, 3744 nt, Artificial Sequence
  derived and/or modified sequence opt5 from SASH1__Homo_sapiens__NP_056093
auggaggacgccggcgcugccgggcccggaccugaaccggagcccgaaccugagcccgaaccugagcccgcgccugagccggaacccgagccuaagcccggcgcugggaccagcgaagccuucuccagacuguggacagaugugaugggaauccucgacggcucucuggggaacauugaugaccuugcccagcaauacgcugauuauuacaauacgugcuuuagcgacgucugugagcggauggaggaacugcgcaaaagacggguuucccaggaucucgagguggaaaagccugacgccucucccaccagccugcagcuucgcucccagaucgaggaaucucugggauucugcagcgcuguguccacaccggaggucgagagaaagaacccucuccacaagagcaauucugaagauuccagcgugggcaaaggcgacuggaagaagaaaaacaaguauuuuuggcaaaauuuccggaaaaaccagaaggggauuaugcgccagaccucuaaaggagaggauguuggcuacguggccuccgaaaucacaaugagcgacgaggaacggauucagcugaugaugauggucaaggagaagaugaucaccaucgaggaagcgcuggccagacucaaagaguaugaagcucaacaucgccagucugccgcucuggaucccgccgacuggccugacggguccuaccccacauuugauggaagcuccaauuguaacucuagagagcagagcgacgaugaaaccgaggaguccgugaaguucaaacggcuucacaagcugguuaauagcacgcgcagagugcggaaaaagcucauucgcgucgaagagaugaaaaagcccucuaccgaaggcggggaggagcauguguuugaaaacuccccugugcuggacgagagaagcgcgcuuuauucuggaguccacaagaaaccgcuguucuuugauggcagccccgaaaagccucccgaggacgauuccgacucucucacaaccagcccuuccucuagcucccuggauacauggggcgccgggcggaaacugguuaagaccuucagcaaaggagaaucuagaggccucaucaagcccccgaagaaaauggggacguuuuucuccuacccugaggaggaaaaggcucagaaagugagccgcucccugacagagggagaaaugaagaaaggccuugggucucugagccauggacggaccugcuccuuuggcggcuucgaccucacaaauagaucucugcacguggggagcaacaauuccgaucccaugggaaaggagggcgacuucgucuacaaggaagugauuaaaagcccuaccgccucucgcaucucccuugggaagaaaguuaagagcgugaaagagaccaugcggaagagaaugucuaagaaauauuccagcucugucagcgagcaagacuccggacuggauggcaugcccgggagcccucccccgucucagccugaccccgaacaccucgauaagcccaaacugaaggcuggcggauccguggagagccugcgcuccucucucagcggccaguccucuaugagcgggcaaacaguuuccacgaccgacucuagcacauccaaccgggaaagcgugaaaucugaggauggagacgaugaggaaccuccguacagaggccccuuuugugggcgcgcccggguccauaccgacuucacaccuucccccuaugauaccgacagccugaagcugaaaaagggagauauuaucgacauuaucucuaagccucccaugggcacguggauggggcugcucaauaacaaagugggcacauuuaaguucaucuacgucgaugugcuguccgaggacgaagagaaaccuaagagacccacccgccggagacggaaaggacgcccgccucagcccaagagcguugaagaccuucuggauagaauuaaccucaaggagcacaugccuaccuuucuguucaauggcuaugaggaccuggauacauuuaaacuccuggaagaggaagaccuugaugagcugaacauccgggaccccgaacauagagccgugcuccugaccgcugucgagcugcuucaggaguacgauucuaauuccgaccagagcgggucccaagaaaagcuccugguggauagccagggacugucuggcugcagcccgcgcgacuccggguguuaugagucuagcgaaaaccucgagaauggaaaaacacggaaggcgucccugcuuucugccaaaagcuccacggaaccuucucuuaagagcuucuccagaaaccagcucggcaauuaccccacccugccucugaugaaaagcggggaugcucuuaaacagggccaagaggagggacgccucggcgggggacuggcccccgacacaucuaaguccugcgaucccccuggcguuaccgggcugaacaaaaauagacggagccucccggugucuauuugucgcuccugcgaaacacuggagggaccccagaccgucgacacguggccuagaagccacucccuugacgaucuccagguggaacccggcgccgagcaggacgugccuaccgaaguuacagagcccccuccgcaaaucguccccgaggugccucagaagaccacagcuucuagcaccaaagcccagccccuggaacaggauuccgcgguggacaacgcucugcugcuuacgcaaagcaagcgguuuucugagccucagaagcucacaaccaaaaagcuggaaggguccauugccgccagcggccgcggacugucucccccgcagugucucccuagaaauuacgaugcucaaccucccggcgccaaacacgggcuggcucggacaccccuugagggacaucgcaagggccacgaguucgaagggacccaucacccccugggaaccaaagagggcgucgacgccgaacagagaaugcagccuaagaucccgagccagcccccucccgugccugcgaaaaagucccgggagcgccucgccaacggccugcaucccguuccgauggggccuucuggagcucugcccagcccugaugcccccugccuuccugugaagagaggcucccccgcuucuccgacaagcccuuccgacugcccucccgcccucgcgccccggccgcugagcgggcaagcccccggaucuccucccuccacgagaccucccccuuggcugagcgaacucccggagaauaccucccugcaggagcacggcgucaaacuugggcccgcucugacacgcaaggugucuugugcccggggaguugaucucgaaacccugacagagaacaaacugcacgcugaaggcaucgaccuuaccgaggaaccuuauagcgauaagcauggcagaugcgggauucccgaggcccuggugcagcgcuacgccgaggaccucgaccagccugaacgggaugucgcugcgaauauggaccaaaucagagugaaacagcugcgcaagcagcaccggauggccauucccuccggaggccucacggagaucuguagaaagccgguuucuccugggugcauuagcuccgugagcgauuggcugaucucuaucggacuucccauguaugcuggcacacuguccaccgccggguuuagcacccucucucagguccccucccugagccauacaugucugcaagaagccggaauuaccgaggaacgccacauccggaaacuucugucugcugccagacucuucaagcugccucccggcccugaggcgauguga

SEQ ID NO: 75227 - RNA, 1143 nt, Artificial Sequence
  derived and/or modified sequence opt5 from SASH3__Homo_sapiens__NP_061863
augcugagacggaagcccagcaacgccuccgagaaagaaccuacccagaagaaaaagcucucucugcaacgcagcuccucuuucaaagacuuugcuaagagcaagccguccucucccguggucagcgagaaagaguucaaucuugaugacaacaucccugaagaugacuccggcguucccacaccugaagaugccggaaagagcgggaaaaagcugggcaaaaaguggagagcggugauuucucggacgaugaaucgcaagauggggaaaaugauggugaaggcucucuccgaggagauggccgacacccuggaagagggaagcgccucucccacauccccugauuacagccuugacucuccgggccccgagaaaauggcucuggccuuuuccgaacaggaggaacacgagcucccuguccugagcagacaggcuuccaccgggucugaacugugcagccccuccccuggaagcggcucuuucggcgaggaacccccggccccucaguauacagggcccuuuuguggacgggcgcgcgugcauaccgauuucacaccuucccccuacgaccacgauagccucaagcugcaaaaaggcgacguuauccagauuaucgagaagcccccuguggggaccuggcuuggacugcucaacggcaaagucgggucuuuuaaguucauuuauguggauguucugccggaggaagccgugggacaugcuagacccagccggcgccaguccaagggcaaaagaccuaagcccaaaacgcuucacgagcugcucgaacggaucggccuggaggaacauaccucuacacugcuccugaauggguaccagacccuugaggacuuuaaggagcugcgcgaaacacaccucaacgagcugaauaucauggacccucaacacagagccaaacuucugaccgcugccgaacuccugcuggauuaugacacgggaagcgaggaagcggaggagggcgccgaauccagccaggagcccgucgcucauacagugucugaaccgaagguggauauuccucgggacuccgggugcuucgagggaagcgagucuggccgcgaugacgccgaacucgcugggaccgaggaacagcugcagggacuuucccuggccggcgcccccuga

SEQ ID NO: 75228 - RNA, 516 nt, Artificial Sequence
  derived and/or modified sequence opt5 from SAT1__Homo_sapiens__NP_002961
auggccaaguucgugaucagacccgcuaccgccgcggacugcagcgauauucugcggcucaucaaagagcuggcuaaguacgaauauauggaggaacaggucauucuuacagagaaagaccugcucgaagauggcuuuggggagcacccuuucuaccauugucugguugccgaggugccgaaggaacacuggacgcccgagggacauuccaucgugggcuuugccauguauuacuucaccuaugacccuuggauugggaaacuucuguaccucgaagacuuuuucgucaugucugauuaucgcggauuuggcaucgggagcgagauccugaagaaccugucccaaguggcuaugagaugccgguguucuagcaugcacuuccucguugccgaguggaaugaacccuccauuaacuuuuacaagcgcagaggagcuucugaucugagcuccgaggaaggcuggcggcuuuucaaaaucgacaaggaguaccugcucaaaauggccacagaagaguga

SEQ ID NO: 75229 - RNA, 513 nt, Artificial Sequence
  derived and/or modified sequence opt5 from SAT2__Homo_sapiens__NP_597998
auggccagcgugagaauccgggaggcuaaggaaggcgacugcggggauauucugcgccucaucagagagcuggccgaauuugagaaacuuuccgaccaggucaagauuucugaagaggcgcugcgggcugauggauuuggcgacaaccccuucuaccacugucucguugccgagauccugccugccccggggaaacuucugggacccugcguggugggcuaugggauuuacuauuuuaucuacagcaccuggaagggacgcacaaucuaucucgaagauauuuacgucaugccugaguauagaggccaaggcaucggguccaaaauuaucaagaagguggcugaaguugcccuggacaaaggauguucucaguuccggcuggcugugcucgauuggaaucagcgcgccauggaccuguacaaggcgcuuggcgcccaggaucugacggaggcugagggguggcauuucuucugcuuucaaggagaagccaccagaaaacucgcuggcaaguga

SEQ ID NO: 75230 - RNA, 2388 nt, Artificial Sequence
  derived and/or modified sequence opt5 from SATB1__Homo_sapiens__NP_001182399
auggaccaccugaacgaggccacccagggcaaggaacauagcgagauguccaauaacgugucugaucccaaagggccuccggcuaagaucgccagacucgaacaaaauggaagcccccugggccgggggcgccuuggauccacaggcgcgaaaaugcagggggucccucugaagcacucuggacaucucaugaaaacgaaccugagaaagggcaccaugcuucccguuuucugcgugguggagcacuacgaaaaugcuauugaguaugacuguaaggaggaacaugccgaguuuguccuggugcggaaagauaugcuguucaaccagcucaucgaaauggcccugcucagccugggcuacucccacucuagcgcugcccaggcuaaggggcuuauucaaguuggaaaauggaauccugugccccuguccuaugucacagacgccccugaugcgaccguggccgacaugcuccaggauguuuaccacguggucacacugaagauccagcuucauagcugcccgaaacuggaggaccugcccccugagcaguggucucacaccacagugcgcaacgcucucaaggaucugcucaaggacaugaaucaauccagccuggccaaagaauguccccuuucucaguccaugauuagcucuaucgugaacuccaccuauuacgcuaaugucagcgccgcgaagugccaggaguuuggcagaugguauaaacauuucaagaaaacgaaggauaugaugguugaaauggacucccugucugagcucagccagcaaggggccaaccacgugaauuuuggacagcagccugugcccggcaacaccgcugaacaaccgccuucccccgcccagcugagccacgggucucagccuuccguccggacaccccuucccaaucugcauccuggacucgugagcaccccgaucucuccccagcugguuaaccaacagcuggugauggcucagcuccugaaccagcaauacgccgucaaucgccuucuggcccagcagagccucaaccagcaauaccugaaucacccucccccuguguccagaucuaugaacaaaccccuugagcagcagguuagcacaaauaccgagguguccagcgaaauuuaucaguggguccgggaugagcugaagcgcgcuggcaucucucaagcgguguucgccagagucgcuuuuaaccggacgcagggccuccuguccgaaauucugcgcaaggaggaagacccgaaaacagccagccagucucuccuggugaaucuuagagccaugcaaaacuuccugcagcucccugaggcugagcgggaccgcaucuaccaggaugaaagagagcggucccugaaugccgcgagcgcuauggggcccgccccucugauuuccacacccccuucuagacccccgcagguuaagaccgccaccaucgcuaccgaacgcaacggaaaaccugagaauaacacaaugaauauuaacgccagcaucuaugacgaaauccaacaggagaugaagcgggcuaaagugucccaggcccuuuuugcgaaggucgccgcuacgaagucucagggcuggcucugugagcugcugagauggaaagaagaucccagccccgagaaucgcacccucugggaaaaccuguccaugauucggagauuccuuagccugccucaaccggagcgcgacgccaucuacgagcaggaaucuaacgcugugcaucaccauggggaucggcccccucacauuauccacguucccgccgagcagauucaguccccuagccccacaacccucggaaagggcgaaucuagagggguguuucugccuggacugcccacaccggcgccuuggcuuggcgccgcuccccaacagcagcaacagcagcagcaacagcagcagcaacagcagcaggccccucccccgccucaaccccagcagcagccucaaaccggcccccgccugcccccucggcagccgacggucgcuucccccgccgagagcgacgaagagaauagacagaaaacacgcccucggaccaagaucucuguggaggcccucgggauccugcagagcuucauucaagaugugggacucuaucccgacgaagaggcuauccagacccuguccgcgcagcuugaucugccuaaauacacaauuaucaaguuuuuccaaaaccagagauauuaccucaagcaucacggcaaacugaaggacaauagcgggcuggaaguugaugucgccgaguacaaagaagaggagcuucucaaggaccuggaagagucugugcaggacaaaaacaccaauacacuguucuccgugaagcucgaagaggaacugagcgucgagggaaacacggauauuaauaccgaccuuaaggauuga

SEQ ID NO: 75231 - RNA, 2028 nt, Artificial Sequence
  derived and/or modified sequence opt5 from SATB2__Homo_sapiens__XP_005246453
augauccccguguucugcgucguugagcagcuggacggcagccucgaauacgauaacagagaggaacacgccgaguuugugcuggugcggaaggacguccuuuucucccaacugguggaaaccgcucuccuggcccuuggguauucucauagcuccgcggcucaggcccagggaauuaucaaacugggccgcuggaauccucucccgcugucuuacguuacagaugcccccgacgcuacgguggccgauaugcugcaggacgucuaucacgugguuacccucaagauucaacugcagagcuguuccaaacuugaggaucugccugcugagcaguggaaccaugccacagugagaaaugcgcucaaggaacugcuuaaagagaugaaccagucuacccuggccaaggaaugcccccucagccaauccaugaucagcucuauugucaauuccacauacuaugcuaacgugagcgccaccaagugucaggaguuugggcggugguacaaaaaguauaaaaagaucaaaguggagcgcgucgaaagagagaaucugucugacuacugcguucugggacagcggccuaugcaccuccccaacaugaaucagcuggcuucccuuggcaagacaaacgaacaaagcccucauucucagauccaccacuccaccccgauucgcaaucaggugcccgcccugcaaccuaucaugagccccgggcuccuguccccucagcuuucuccccagcuggugagacagcaaauugcgauggcccaucucaucaaccagcagauugcugucagccggcugcuggcccaccagcauccgcaagcuaucaaucagcaguuccucaaccacccucccauuccucgcgccgugaagcccgagcccaccaauuccagcguugaagugucuccugauaucuaccagcaagucagagacgagcugaaacgggccuccgugagccaggcuguuuuugcgcgcguggccuucaacagaacgcagggacuucugucugagauccuccggaaggaagaggauccgcgcacagcuagccagucccugcuugucaaccugagagccaugcaaaauuuucucaaccugcccgaaguggagcgggacagaauuuaucaggaugaacgcgagcggucuaugaauccuaacgucagcaugguguccagcgccucuuccagccccucuuccagcagaaccccucaggcuaaaacauccacccccacgacagaccugccgaucaagguugacggcgccaauauuaacaucaccgcggcuauuuacgaugagauccaacaggaaaugaaacgcgccaaggugucucaggcccucuucgcuaaagucgccgcuaauaagagccagggcuggcugugugagcuucugcgguggaaggaaaacccuucccccgagaauagaacacucugggaaaaccugugcaccauccgccgguuucugaaucuuccucaacacgagagagacgugauuuaugaggaagagucucgccaucaccauagcgaacggaugcagcacguugugcagcugcccccugagcccguccaggugcuccauagacaacagucccagccggccaaagagagcucuccuccccgcgaagaggcgcccccuccgcccccucccaccgaagauuccugugccaagaaaccucggagcagaacaaagaucucucuggaggcucucgggauucugcaguccuucauccacgacgugggacuuuaccccgaucaagaagccauucacacgcugagcgcucagcucgaccugccuaaacauaccaucaucaaguuuuuccagaaccaacgguaucacguuaagcaucacggcaaacugaaggagcaccuugggucugccgucgauguggcggaguacaaagacgaggaacuccugacagaaagcgaggaaaaugauuccgaggagggaagcgaagagauguauaagguggaagccgaggaagagaacgcugacaaaucuaaggccgcucccgccgagauugaucagcgcuga
